United States Patent 7,041,814 (NUCLEIC ACID AND AMINO ACID SEQUENCES RELATING TO ENTEROBACTER CLOACAE FOR DIAGNOSTICS AND THERAPEUTICS) - sequence listing, part 2

SEQ ID NO: 2148 - DNA, 1443 bp, Enterobacter cloacae
ctactcattccaattcgtaatttcattcgatctaagccgccccctatagtccctttattcgtggttgttagtgagttgttgcctgtggactatctccccctttttgctgccttaaaagaccgaccggtattggttgtcgggacgggtgaaattgccgatcgcaaaatcgccttcctgcaacgcgccggggcgcaggtgcagatcgttgcagaggcggattttgcagagtcacagatcgacagcgtggtactggtgattgcggcaaccgaagatcgggcgctcaacagccgaatctccgacgcagcccaggcccgtcaccgcctggtgaacgtggtagacgaccagccgttatgttcatttatcttcccgtcgattgtcgaccgctcgccgctgctggtggcgatctcctccggcggcaccgccccggtgctggcgcgcgtgctgagagaaaaaatcgaagcgctgctgccgaccagcctcggacgcatggcggagaaggccagctactggcgcaaccatctgaaaacgcgtctgaccagcgtgacggaacgccgtcgcttctgggagcgtgtgtttcgcggccgctttgccagcctgatgcaggccggtaacgagacggcggcgcaacaaatcctcgaagacgaactggataaccccggcagtacgggcggggagatcattctggtgggcgccgggccgggcgatgccgggctgctcacgctgcgtggcctccaggttcttcaggatgcggatgtcgtgttctacgaccacctggtcaccgacggtattcgcgagctgatccgccgtgacgcggagcaaatctgcgtcggcaaacgtgccggcgagcactccgtgccacagcacgacaccaatcaaatgctgattgccgctgcgaaagcgggcaaaaccgtggtgcgcctgaaagggggcgatccgtttatcttcggtcgtggtggcgaggagttgcaggcggcagccgaagcgggcgtcccgttccaggtggttcccggcattacggcggcgtctgccgtcacggcctacgccggtattccgctgacccatcgcgattacgcccagagcgtgacctttgtgaccgggcactataaagccgacagtacgccgtttgactggtcgcatctcgcccagagccggcaaacgctggcgatttatatgggcacgatgaaagcggcagacatcagcgaacagcttattcagcacggtcgcgatgcggcgacgccggtagcggtgatctcccgcgggacacgcgtcgatcagcatgtcgccatcggcactttacaagaccttgcaaccctggcgaaagacgccccaatgcccgccctgattgtggtgggagaagtggtgcagctgcacagcacgctcgcctggttccaacacacaaccgacacagaaggctttggcgcttctgttataaatttggcttaa

SEQ ID NO: 2149 - DNA, 918 bp, Enterobacter cloacae
ggaacggttatggaccaaaaacgacttactcacctgcggcagctcgaagcggaaagtatccacattatccgcgaagtggccgccgagttttctaacccggtgatgatgtactccatcggtaaagattccagcgtcatgctgcacctggcgcgtaaagcgttttatccgggtacgctgccgttcccgctgctgcacgtggataccggctggaaattccgcgagatgtacgagtttcgtgaccgtaccgccaaagcctacggctgcgagctgctggtgcacaaaaacccggaaggggtggcgatgggtatcaacccgttcgtgcacggcagcgccaagcataccgacatcatgaaaaccgaagggctgaagcaggcgctgaataaatacggttttgatgcggccttcggcggcgcgcgccgtgacgaagagaaatcccgcgccaaagagcgtatctactctttccgcgaccgcttccaccgctgggacccgaaaaaccagcgtccggagctgtggcacaactacaacggccagatcaacaagggcgaaagcattcgcgtcttcccgctctccaactggaccgagctggatatctggcagtatatctatctggaaaatattgagatcgttccgctgtatctggcggccgagcgcccggtgctggagcgcgacggcatgctgatgatgatcgacgacgatcgcattgatttacagccgggcgaagtgatcaaaaaacagatggtccgtttccgtactctcggctgctggccgttgaccggcgcggtggaatccagtgcgcagacgctgccggagatcatcgaggagatgctggtgtcgactaccagtgagcgacaggggcgcgtgattgaccgcgaccaggcaggctccatggagctgaagaaacgtcagggttatttctaa

SEQ ID NO: 2150 - DNA, 1434 bp, Enterobacter cloacae
ggagccgccatgaatacgactattgcccaacaaattgccgatgaaggcggcgtagaagcttatctgcacgcccaacagtacaaaagtctgctgcgtttcctgacctgcggcagcgtggatgacgggaaaagtaccctgataggacgtctgctgcacgacacgcgccagatctacgaagatcagctctcttccctgcacaatgacagtaaacgccacggcacccagggcgaaaaactcgacctggcgctgctggtagacggcttgcaggcggagcgcgagcagggcattaccattgatgtcgcctatcgctacttctctaccgaaaagcgcaaatttattatcgccgacaccccggggcacgagcagtacactcgtaacatggcgaccggcgcgtccacctgtgatctggcgatcctgctgatcgacgcccgtaaaggtgtgctggatcagactcgtcgtcacagctttatctctacgctgctggggatcaaacacctggtggtggcggtgaacaaaatggatctggtggactacagcgaagcgcgattcgacgagatccgtcagagctacctgacctttgctgaacagctgccgggcaacctcgatattcgctttgtgccgctgtcggcgctggaaggggataacgtcgcctctcagagcgggaacatgccgtggtacagcggcccgacgctgctggaagtgctggaaaccgttgaaattcagcgcgtggttgatacccagccgatgcgcttcccggtgcagtacgtgaaccgtccgaacctcgatttccgcggcttctcgggcaccattgcgtccggctcggtcaaagtgggccagcgcgtgaaggtgctgccgtccggtgtggaatcggccattgcccgaatcgtcacctttgatggcgatctggacgaagccggagcaggtgaagcggtaaccctggtactgaaagacgaaattgatatcagccgcggcgacctgctggtcgacgcgcaggaaacgctggcggcggtgcagggcgcatccgtagacgtggtgtggatggcggaacagccgctgaccgcaggccagagctatgacattaaaatcgccggcaagaaaacccgcgcccgcgtggacggcattcagttccaggtggacatcaacaacctgacccaccgtgacgtgagcgagctgccgctcaacggcatcggtcttgtggatatgaccttcgacgagccgctggtgctggatccgtatcagcagaacccggtgacgggcgggctgatctttatcgaccgcctgacgaacgtcactgtcggtgccgggatggtgcgtgagccaaacgcgcaggctgccgtggcctctgagttcagcgcgtttgagctggagcttaacgcgctggtgcgtaagcacttcccgcactggggcgcacgcgatctgctgggaggcaagtga

SEQ ID NO: 2151 - DNA, 348 bp, Enterobacter cloacae
gtcacggtcacaggattagctatgcgcaacagtgaaaactacatgattaccaccgggtcggaaccgttaacgaccgacgacgagacgacctggtccttccctggggcgatagtcggcttcgtatcgtggctactggcgctgggtatcccgtttttgatctacggtggtaacaccctctttttcttcctctatacctggcctttctttttggcgctgatgcccgttgcggtggttgtgggcgtggcgctgcactcccttttcaacggcaagctcctgtatagtacgctcatcactatcgccaccgttgtggtcatctttggcctgctgtttttatggctgatgggctaa

SEQ ID NO: 2152 - DNA, 1080 bp, Enterobacter cloacae
agccgtggcgctgctggtgaaggcggccaaatgacggatttcgacaacctgacgtatctgcacggtgaaccgcagggcaaggggctgctgaaagccaaccctgaagatttcgtggtagtggaagatctcggttttgagccggacggcgaaggcgagcacatcctggtgcgcattctgaaaaacggctgcaacacccgcttcgtggcggacgcgctggcaaaattcctcaatattcacgcccgcgaagtgagctttgccggtcaaaaagataaacatgccgtgaccgaacagtggctttgcgcccgcgtgcccggcaatgccatgcccgatttaagcaaatttgagcttgagggctgtaaggtactggagtacgcccgccataaacgcaaattgcgtctgggagcgttaaaaggcaatgcctttactctggtgttgcgcgaagtgaccgaacgcgaagacgttgaaaaacgcctgaaggccattaacgaacgcggcgtgccaaactatttcggcgcacagcgctttggcattggtggcagcaacctgcttggcgcgctgcgctgggcgcaaagcggtgcaccggtgcgcgatcgtaataaacgcagtttttggttgtcggcggcccgcagtgcgttgtttaatcagattgtgagcgaacggctgaaaaaaccggacgcgaatcaagttgttgtcggcgatgcgctacaattagcgggacgcggaagctggtttgtggcaacggccgatgagatggccgatgtccagtcgcgcgtggacgctaaaacgctgatgattaccgccgccttgccgggttcaggcgactggggaacccagggtgaggcgctggccgctgagcagtcagcggtggcggatgcgccagaattacaatcgttgctggtgcgggaaaaggtcgaggcggcgcgccgtgcgatgctcctctacccgcaacagctgagctggaactggtgggatgacgtaaccgtcgagttacgcttctggctgccggcaggtagctttgccaccagtgttgtcagggaacttatcaacacgtcgggtgattatgcgaatattgctgagtaa

SEQ ID NO: 2153 - DNA, 363 bp, Enterobacter cloacae
  unsure (348)
tgtggtgtcggactggttagatcgggtcggagtgaacgcgcaatggtaagtaaacgtgtacaaactcttctggaacaattacgcgcacaggggattgccaacgagcaggtgctggatgcgcttgcccaggttccccgtgagaagtttgtagatgaggcgtttgaacacaaagcgtgggaaaacgtggcgttgcccatcgggcaaggccagacgatttcgcagccctacatggtggcgcgtatgacggagcttctggagctaacgccagattcccgggtgctggaaattggcaccggttcagggtatcagaccgcgatcctggcccaccttgtgcaccatgtctgttcncgtggaacggattaa

SEQ ID NO: 2154 - DNA, 1053 bp, Enterobacter cloacae
ggactcactatgttttccgcaatgcgccaccgattcgttgccctggcgctcggcgtttgctttatccttccggctcaggcaaaaaatccatcttacggtgaaatagccagtatgcaggcgcggcatattgcgacggtctttccgggccgtatgaccggaaccccagccgagatgctctcggcagactatattcgtcagcagtttgcggatatgggctatgaaagcgacattcgcgctttccacagccgctacatctataccactcgcaataaaacgcaaaactggcataacgtaactggcagcacggttattgcggcgcacgaaggaaagacggctgagcagattattattatggcgcaccttgatacctacacgccgttgagcgatgccgatgtcgataataatctcggcgggctgacgcttcagggactggatgataatgcggcgggtctgggcgtgatgcttgagctggccgaacgcctgaagaatattccgacgaaatacagcattcgctttgttgcgaccagcggcgaagaagaaggaaaactcggcgctgagaatctccttaagcgcatgagcgctgaggagaagaaaaatacgttgctggtgattaacctcgataatctgatcgtgggggataagctctattttaatagcggacagagcacgccgagcagcgtacgtaaactcacccgcgaccgcgcgctggcgcttgcccgcacgcatggcgtctatgccgcgacaaatccgggcggtaacccggagtatcctaaaggcacaggctgctgtaatgacggtgaagtgtttgataaggcgggcattccggtgctgtacgtcgaggcgacgaactgggcgctgggcaaaaaagatggctatcagcagcgcagcaaatcgaaagcgttcccggacgggaccagctggcatgatgtgcggctggataatcagcagcacattgataaagcgctgccgcagcggattgagcaccgcagccgggatgtcgtgaaagtgatgctgccgctggtgaaggagctggcgaaagcggggaaagcctga

SEQ ID NO: 2155 - DNA, 1293 bp, Enterobacter cloacae
ctgaattgtatgaaaaacaatcaaaacaaagccgtcgctttacaacaaaaaattgcattttcaggcagtacgatcgtcatagactcgaaattatcatcgtttggcagaaaaaggataacaaaaatgacacatccaattatcgaagctctgcgtggcaacgaagctcggttcactgaattacggcgctattttcatcagcatcctgaaattggttttgaggagcacaatacgagcgatcgcgttgcagcgctgcttcaggaatggggatatgaggttcatcgcgggctggcgaaaaccggtgtggtcggcacactgaaggtgggtaacgggcataaacgcctgggcctgcgcgccgatatggatgcgctgccaatgcaggaaaacaacggcaaggcgtggagtagtaccgttgagggtaaatttcacggctgcggtcatgacggccacaccacaacgctcctgtatgcagcggagtacttggcacgcacccgcaattttaacggcacgctgcaccttatttttcagcccgcggaagaacttctgtatggcggacgcgttatggtagaggacggtttgtttgacctgttcccctgcgaccacatctttggtctgcacaatatgccgtcacagcccctcggaaaaattggtctgcgcgatggcgccatgatggcctcttccgacactcttcatattgaggttaacggcgtgggtggtcacggcgcggtgccagaacataccgttgacgccaccctggttgcctgtcatatcactatcgcgttgcagtcgattgtttcgcgcaacattacccccttccagccagccgtcgttaccgtaggcagcattcaggccgggcacgcccccaacattatcaacgacaaagtattgatgaaacttaccgtgcgcacgctggatgaacgcgtgcggcaaaccgtgctacagcgtatccatgatatcgccgttgcacaggcggaaagtttcaatgcgacggccaccattcgacacattaacggcagcccggtactgaaaaacaatccgcaagccaatgagatggtgcgcagcgtcgccaccgatctgttcggtcaggatgccgtcgcggaggtgaatgcgtttatgggcagcgaagactttgctttcatgctcgagaaaaatcccaatggatgctatttcacccttggcgccggcgatgagccggaccgctgcatggtacataacccgggttacgactttaacgacaacattctcctcaccggcgcggcgctgtgggccgcactgaccgaacacaatctgcgctga

SEQ ID NO: 2156 - DNA, 1425 bp, Enterobacter cloacae
ttcgcaccttcccgggagggctgcactatgagtaccgtttccctgacaggcgcatccgcctacgccggtaacgatcggctgctggcgggtatcgtcatgagcgttctgacattctggctgtttgcccagtcggttatcaacgtggttccggccatgcagaatagcctcgatattgccctcgaaacccttacgctggccgtcagccttagcgcgttgttcagcggctgttttgtcgtcgcctgcggtgggtttgccgataagtatgggcgcatgcgcctgaccatgattggcctgatactgagcatgatcgggagtggtctgctgttcatttcatgggagcccgtcctgtttctgttgggaagagcgatacaggggctatcagcggcctgcatcatgcccgccacgctggcgctgattaagacctggtatgacggtaaagcacgccagcgcgccatcagcttttgggttatcggctcctggggcggcagtggcctgagctcgtttgtgggaggcgccatcgccaccacgctgggctggcgctggatatttattttctccatggtggtggctctcgccgcgctattgattatccgcgccaccccggaaagccgcagccatgatgcgtgtcgacacaaactggatatcagcggcttggtgagttttgtccttatgctggtgctgttcaatctgtttattagcaaaggacacagctggggctggagcagcagtttatcgcttcttgtactgtgtggagccgtgattgcactgatgtgctttgtcgttaccgggcggcgaaaaggcgatgcggcgctgatcgatttcgccctgtttaaaaaccgggcccatagcgcctcggtattctcaaatttcctgctcaacggctgcattggcaccatgatgatcgccagcatctggttgcagcaaggccatcatctgtcaccactacagacaggcatgatgacgctggggtatctggttaccgtactggcgatgatccgggtgggtgaaaaactgcttcagcgctatggcgccaggctgccgatgatgaccggcccgctgctgaccgcaacaggtatttcgctgatttcatgcaccttcttaagcaaagaggtctacattgttaccgtttttctgagcaatattttatttgggctggggctcggatgttacgccacgccctcaacggacacggcggtaatgaatgcccctgaaaacaaagtgggggtggcttcagggatctataagatgggcagttccctgggcggcgcaatgggtatcgcggtcaccgcatcgctgtacgcgctatggctgccgatgggaacggccagtgccgcgcagtatgccttgcttttcaacagtgcgatttgccttgggtcggcagtcgtgacctgggctttactgccaacaacaaaagccccgcgttaa

SEQ ID NO: 2157 - DNA, 534 bp, Enterobacter cloacae
ttatcgttcttaacgataaaagcgattaaacaactatctgaaataaaacaacaaaagtcgataaacaccatgaatacgaggcggcgacagttcagagccgttttagttaatgataaaaattgtgctttccggtactatgcggcggttttttccgcattcctgagagctatgatgtccaccacactgtttaaagatttcaccttcgaagccgcacaccaccttccacacgttcctgccgggcacaaatgtggccgcctgcatggacactcgtttatggtgcgtcttgaaatcaccggtgaagtcgatccccatacgggctggatcatggactttgccgaactgaaggccgcgtttaagccgacctacgatcgtctcgatcactactatctgaatgatattccgggccttgaaaacccgaccagcgaggtgctggcgaaatggatttgggatcagatgaaaccgctggtgccgctgctgagtgcggtgatgatcaaagagacctgcacggcaggctgcgtctaccgcggggagtga

SEQ ID NO: 2158 - DNA, 324 bp, Enterobacter cloacae
catttccgggcgattagctggttgcatatcaatggacgtgagtggaagcatatccgcgaagtgctgatttacgcctttatttatgaaggtgttcccagctgggacaagactgatggtgtggtcaccattcatgtgccggatcaaccgcccattgagacccgcctgaccgaaggtgaaaaccgtcgcacattgtgcgccattgccagactcgtaaacgaaaacggcgcaattaaagtcgagcgaattaaccagtacttcaaaggccaggacgaaatggaccgggcatttggctggggatttcgctggagcgccggttctaaataa

SEQ ID NO: 2159 - DNA, 306 bp, Enterobacter cloacae
ggccagcttatgatcaataatgattacccgttaaacacgctcaaccagttgcgtcccttgctcattggttttcgcaaggcgaatggcctaacgcaaaaagacctgtccgaaaggttaggtgtcactcaacagacatactctcgtctggaagccaaccctgccagtgcgagcattgaacggctatttaaggtgtttaccgtcctgggtgtaaaaatcagtttctcctcggcaaccacttcttcagagaggaagcagacggaagacatatataaattaaattcacctgcaccacaggaggattggtaa

SEQ ID NO: 2160 - DNA, 828 bp, Enterobacter cloacae
gaagagatcaagatgagagagccaagaccacgccataccttgcaggtcattcgtgtaccttctctggaggttcaggacctggggctgaccagctttgatagctggcttgacgagcacgggtatgacaaaacgaatgccagaaataaccgtaccatctgggcgagagaaggcggatggcatctgaaacgttgcagaaatcttgaaactggcacggacgatttctggtttatcgctttcgatggtaaaggcgggaagatttacccgctgaaaacccaaagagactaccgggctgcatatcgtaagctggaagcagaaggttatgcacctgcggtcatcgagcaaatgaccacaggcgcagcatataacctggcctatccacgttccaccctaaaacaagttgagacggccaccagcgaaccaatgcggaaacctgacgtagatatccagggtgagcactgcgagcgcgtagtgacgcaacgtagtggcgtggcacagggtaaatttaaagctctgctcatcgagaatttcgctggccgttgtgcggtaaccggttgggttaatggtggtgtcctggatgcggcacacattgaacatggaacccggtacaatccgtctaatggcatcctgatgactccaacaatgcatgcgctgtttgatgccgatcttatgggtatagatccggccaccctgaccgttcattttaagccaggcattgaggtgggcgagctgtttgaaggccgtaaaatcacaccgctggtgtacgatctggacttagagcggttggccgtacgctgggcagaataccagggccttgctcaggaccaatga

SEQ ID NO: 2161 - DNA, 525 bp, Enterobacter cloacae
tatggccatgaatggcgttggatgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 2162 - DNA, 588 bp, Enterobacter cloacae
acgaaaacggcgcaattaaagtcgagcgaattaaccagtacttcaaaggccaggacgaaatggaccgggcatttggctggggatttcgctggagcgccggttctaaataacacagcaacaaaggaaacaggtatgagctttttcgacaaagttaaaggtgccattaactcaggccgtgacgaactgacccgccaggttggccgtttcaaaaacaaaaaattcatgcagggcaccgttgctgtatgtgcccgtattgccgtatcgagtgacggcgtaagttcggaagaaaagcagaaaatgatgggctttctgcgctcttcagaagagctgaaggtcttcgataccaatgaggtgattgagttcttcaataaactggtttcaagcttcgatttcgatgttgaaatcggcaagggcgaaaccatgaaatacatcctggcgctgaaagatcagcctgaggccgctcagctggccttacgtgttggtattgccgttgcgaaaagtgacggtaacttcgatcaggacgagaaactggcctcccgcgagatcgctatcgcgttgggcttcgacccggctgaatttggcctctga

SEQ ID NO: 2163 - DNA, 633 bp, Enterobacter cloacae
cttttctacccggggctgttaatgcagccctcattcaactgtttgcaggagctaaaaatggcagtttctctcgtaaaaggcggcaatgtatctctgaccaaagaagcaccaaccatgaatgttgctatggttggcctaggctgggatgcccgtgtaaccgatggtcagggttttgacctggacgcttccgtgttcgcagtaggcgaagacggtaaagtgttgtcagatgcgcatttcattttcttcaataacaaaaccagccctgatggcgcggtagagcaccagggcgacaaccgtaccggtgaaggcgacggcgacgatgagcaggtcaaaatcgatctgaccaaagtctcagcagatatcaaaaaactggtgtttgccgttaccatctatgatgcagaagcgcgtaaacaaaacttcggcatggtgagcaacagcttcatgcgcgtttacaacaacgacaacggcacggaaattgcccgtttcgatctgtctgaagatgcctcaaccgaaaccgctatggtcttcggtgaactgtatcgtcatggcgctgagtggaagtttaaagctgtcggtcagggctttgccggtggcctggcggctcttgcctcccagcacggcgttaacatctaa

SEQ ID NO: 2164 - DNA, 1263 bp, Enterobacter cloacae
tcaaaaatcaggagagttaatgtgaatctacaatccggacaaaacataccacttcagcaatctgcgatcaggctgaatcttcagtaccctaccaaatccggctttaaaggcgaacccgatacctgcctgttcctgcttaatgctcagggaaaggtcagcggcgattctgactttatcttttacaataatctgtcttctcctgaaggggcagtaaagctcgttaccggttctcagcagtccagcattgagatagcactggatcgtgttcctgcgaacatcagtaaaattgcaatcacagttgtcattgatggtgaagataccatcagtgggctcagttcgttgagcatgcaggctcaaggaatcgctgagttccaggctgagactcagggccgcagtgagaaagcaattatcctgggtgaagtatatcggcacaatggcgcctggaagcttcgtgcgctcgggcagggtttcaacggtggtcttgagcctctggccattagctatggcgttgatgtcgcacagccagctccgcagccagcaaagcctgctcgtatcagtctggaaaagaaactggaaaccagatctccgcgccttgtaagcctcgctaaaaaagcctcggtcagtcttactaaaaataaactggacacccttgaggcagcggttgcatttgtacttgacgcatccggctcaatgagtggccagttcagtaagggtaacgttcagtctgtgctggaccgcatcgccgttcttgccgcccagttcgacgacgacggtgaaatggatgtctggggatttggagagaagcataagaagtatccaaacgtcacactggacaacctggacacatatattcagtccattcgcggggctggaaagcgttcagcctgggagaacctgccgggcctcggagggacaaacaacgagcctcctgtgatggaagaaatagtcgactactttaaggactcgaaaatcccggtgtatgttgtatttattaccgatggcgggatcagcaagacccgggcgattaaagatgcaatccggcgttctgccaactaccccatcttctggaagtttgtcggcctgggtggttcaagctacggtatcctcaaaaatctggatgactttactgaccgccgggttgataacacccacttctttgccatggatgatttcggttcgattagcgatgaaaagttatatgataatctactggaagaattcagaccgtggatcgatgaaacaaaaaggttaggcatcctttaa

SEQ ID NO: 2165 - DNA, 1359 bp, Enterobacter cloacae
attcacctgcaccacaggaggattggtaactatatgagccggaaacagcaacgtctggtaatttggatgaacggcatcaaaatcgggtactgggaaaaaagcaaaggggtagacagcttagaataccttcctgaatgggttgctgacgaacagggaaggccgctgtcattgtcccttccttttactcccgggaaccaggtctggcgtggaaatgtggtacgtgactattttgataatttactcccggacagcgaaggcatacgcagacgtctggcaatgcgttacaaggccgatagcctggagccttttgatctgctgacggagctgggaaaagactgcgtgggcgcgatacagctgcttcatgacggagatgaacccactgatttatattccgtgaagtatcacccgcttactgaatcagaaattgcggcaactttgcgtaataccacggagacattgctaccgggcaggccagaagataacgacgacttacgtttatctattgccggtgctcaggagaaaacagccctactgtggcatgaagatcggtggtgtatgccggagggtaatacaccaacgacgcatatattcaagctaccgctcggacttgtggggaacatgaaagccgacatgagctcgtcggttgaaaatgaatggctctgctcggtacttctcgaccagtacgggctccccgtggcaagaacgcagattgctcactttgaagatcagaaagcgctggtggtagaacgttttgaccgaaaatggtcaggagacggacaatggatcattcgtttaccccaggaggatatgtgtcaggccctgggcgtttcgccattacgaaaatatcaggcggacggcgggccaggtatatcggaaattatggaggttctgagtaattcagaccgtgctgagcgtgacaaagcgcagttttttatgacgcagataattttctggatgatggccgcaacagatggccacgctaaaaatttcagtatttctattgggccacagggacgttatcaccttacaccactctatgatgtgttgtcggcatggccggtgatcggtcatgggaacaatcagatatcttggcagaagtgcaaactggcgatggccgtacgtggcagtagcaactattaccagatatatcgaatacaacgacgccactggatcaggcatggtgagataaccggcctgagtaaacagcagacagaggcgatgatagaggaaatcatcgccagaaccccgggtgtcattgaacgtgttagcgggcttcttccggaccagttcccccagcagcttgcggaaagtatttttgatggaatgaggcagcaatgcaggcgcctggctgagaaatga

SEQ ID NO: 2166 - DNA, 285 bp, Enterobacter cloacae
ggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaaccgcccgcattatgggcgttggcctcaacacgattttccgccatttaaaaaactcaggccgcagtcggtaa

SEQ ID NO: 2167 - DNA, 1044 bp, Enterobacter cloacae
aatatggtttccacacacatcggcttcccgactgaaacggtcattgtttttattgcgctttcagtcggtgccatctttattgacctgtttatgcaccgtgatgacaagcctatttcgctgaagagtgcggcgctctggtccgtattctgggttgtggttgcgatggcatttgccggtttcctctatatccaccacggtgctgaggttgccagtctgtttgtcacgggttatgcgctggagaaagtgctgtcggtcgataacctgttcgtcatgatggccatcttctcctggttcgccgttccggatcgttatcgccaccgtgttctctactgggggatcattggtgccattgtcttcaggggcatctttgtcgccatcggtacgagcctgctgagtctggggccgtatgttgaagttgtcttcgctattatcgttgcctggacagcggtcatgatgcttaaaagcggtgatgacgatgatgaaattgaggattactcccagcatctggcttaccgcatggttaaacgcttcttccctatctggccgaagctcagagggcatgccttcctgcttaaccagaaggaagtggatgctgaactggcgaaaccagaaaacagcgatgtcaccattggccgtggtaaaaaagcggcgctgtatgcgaccccgctgttcctgtgtgtggctgtggttgaactctcggacgtaatgttcgcgtttgactcggtaccggcaatcattgccgtcagtcgtgaaccgcttatcgtctatagtgccatgatgtttgctatcctgggcctgcgtactctgtactttgtccttgaggcactgaaacagtacctggttcatctggagaaggccgttatcgtgctgctgttcttcatcgcggcaaaactcggcctgaatgcgaccgatcacatctggcatcatggttacagcatcgcggcaacaaccagcctgtatgttgtactgggtgtactggcgctgggcattctcgcaagcgtcatgttcccgggcaaacctgaatctgaggaaaaggggagttaa

SEQ ID NO: 2168 - DNA, 606 bp, Enterobacter cloacae
acaattactaatcgaagaggttattttatgagtgtttctctttccaaaggcgggaacgtctccctaagtaaagcagctccgtcaatgaaaaacgtcctggtgggccttggctgggatgcgcgttcaacagacggtcaggactttgacctggatgcttcagcattcctgctggcctcaaacggcaaagtgcgcggcgattcagatttcatcttctataacaacctgacgtcatccgacggttccgtaacgcacaccggcgataaccgcaccggtgagggcgatggtgatgatgaatcgctgaaaattaaactggacgccgtcccgtctgaagttgacaagatcatcttcgttgtgaccatccacgatgctcaggctcgtcgccagagctttggtcaggtatccggtgcgtttattcgtctggttaatgacgataaccagactgaagttgctcgctacgatctgaccgaagatgcgtccactgagactgccatgctgttcggcgagctgtatcgccacaatggtgagtggaaattccgcgcagtaggtcagggttatgctggtggtctggcatctgtatgtgctcagtacggcattaacgcgtcctga

SEQ ID NO: 2169 - DNA, 234 bp, Enterobacter cloacae
tgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatga

SEQ ID NO: 2170 - DNA, 2043 bp, Enterobacter cloacae
ggcatgaccaaaagactgacttgggagcagaaaagtattgtcagccatgacaccggacatgcgttggtaaaagccgtacctggtagcgggaaaacaaccacacttgtaaagcgcgttgagcggctggtcaagacgggaactgatcctcgctccattctgatcctgatgtacaacaagtcggcgcaggtgagcttcacggagaagttgaagacggcactgatgtcgagcgtgattccagaaatccgcacgttccacagcttggccttaaagattgttggttacggagaacgccaacagataatcaagaagaaagacctcattactccaagcgactaccgctatgagcaactggtaaagcaagcctaccgctatggctttgaccatgaggcgaattatattgaccccaatgaaattgaaaacttcgagctgtttattgctcgctgccgggcggcggccgtaactcctgttgatgctgccaatgatccaacgttcagcaacatcaaacgggagtttattcacgcctatggccgctattgtgagctgctggaggaaaacagtctgcgaacctttgatgactgtttgattgaggctgtcgcactgttgcgtaatgacagcagccttggtgcccacttcaagcacatcattgttgatgaatatcaggacgttaacctgatacagcatgacatgacccgcttgctatctaagtcggatacgtcggttatggctgttggtgatgttaaccagtgtatttatgagtggcgtggtgctcgaccagactttatcggcggactgtttgaaaggcactacccgaatacgaaggtgtttcaactgtcatgcacgttcagatttggccatgagctttccttgatggctaactcggtaattcggcgcaactctacaaagctgaccaagctttgtgtcagtcatcctagcacccccaaaacagaggtcagattgcactttgataactgcctatccaaggtgctatcaaacctctcggtgagcagtggaacacaagccatattgtcccgcactaaggcgaaccttgctgaggcggaaattgctttacgcctgtgtgggctaccttatcgctacctcaatggttcaagcgcattacacacccgcaccgaaatcgggatactggtagttggcgtcttgctgtctgtgtacggcgatctgcggctactggaaaaccatcccaacaaacaagcgattgtttacggctttctgaaggaggctggttttagctggcagaaagggcaattcaaagcggcgctcagtggattgatggctccgcacgccgacctatggtctgctctaggtcagttattcgagggcgcacaataccaaaaagatcggctgggcaggctcgccactatctgccagaaagacggagaggaaacgcctgctatcgatgtgttacgacgcctgagtatggagggtttcattgatagtgttggctctgagggtgtaactcgcactggatcgaacgaccagcaacgaggggtcgtgaggatcggggagctacttgactccagtaagatcgattcccgcacgtttttaaaccttatcttgaatccaggcgaggctgctactgactgcgatcccttcatcctttccacactgcatggttccaaggggctggagtgggataacgtaatactgatcgggctgaatgagcaggaatttcctggcggcaaacccgatgatgtttacagcgttcgcacatcgatgaacacccctccggccgaagaggaaatcgaggaggaacgtcggctgttttatgtcggtatcactcgcacaaaacagcagctaaatctggtggtccctcttgatgaagggcttgcgcggtggctcaaaaaccgctgggatagcaccccgaagaagtcaccgatagctactcgcttcgtctatgaggctggctggactgcttgtgcggttaccagtgatgcgatctataacagcacggtagagaaacagaaggctgacttcagcaagtttcaccaatggtatctaagagatcttcagcggctaaaagtctag

SEQ ID NO: 2171 - DNA, 2448 bp, Enterobacter cloacae
acacttaccgcgcaagtggaaaagcagcataaatcagcacttgacagcttgctcatatcagagggtgaacaagcctcccgtctggcattgctgctacagcctccgggtaaaataaacggtaaaaatgtgctgcaacatatcgaccggcttaattccatcgctgcgctggggttgcctgatggtattgcactttccgttcaccagaacaggttgcttaaactggcgcgtgagggccggaaaatgagcagcagggacctggcaaaattcaccgatgtcagacgttacgctacgctggtttgtataataacagaggccagggccaccctgactgacgaagtgattgatctgcacgagcgtatcctgggtagtctgttcagcagggcaaaacgcacgcaggccgaacggctccagcaaacgggaaagcttattcagagcaagctgaagcagtacgttaccgtcgggcaggcgttacttaacgccagagaatccggggaagatccctggactgcaatagaagatgtccttccctggcaggaattcatcaacagcgtggaagaaacgcggtttctttcccgtaagggcaatttcgacgcgcttcatctgatcaccgaaaaatacagtacgttgcgtaaatatgccccgcgtatgctgtcagcattgcagttcatggcgacacctgcggcgcaggcgctcagcgatgcgctggacaccataacggaaatgtaccgtaaacaacttcgtaaagtgccgccatcagcgccaacagggtttatccctgaaagctggcgaaaactggtgctcacgccttcaggcatcgaccgcaagtactacgagttttgcgtactgaatgaactcaagggtgcattacgttccggtgatatctgggtaaaaggatcgcgccgctacaaaaattttgatgattatctcatcccgactgctgagtttgagaaatcccgacataatgaccagttacagttggccgttcagaccgatagccaggcataccttcaggcccgtatgactcttcttgcatctcggctggaagaagttaacgcgatggcgcttgccggtgatttgcccgatgtagatatctcagataaaggcgtaaaaatcactccactggagaacagcgttccttcaggtgtttcgccctttgcaggtttggtctatggcatgcttccccatccgaaaattacggagatactggaagaagttgatagctggacgggatttacgcgtcacttcgcgcacctcaaaaataataacgtcagaccaaaagacggaagactgttgctgaccaccattctggctgacggcatcaaccttgggctgacaaaaatggcggaatcctgccctggggccacaagatcgtcactcgaaggtattcaggcatggtacatcagggatgaaacttattcagcggcactggccgagctggtcaacgcacagaaagagcggcctctggccgcattctggggcgacgggacaacatcgtcgtcagacgggcagaactttcgggtaggcagtcacggacgttatgccggtcaggtcaatcttaaatatggtcaggagccgggcgtgcagatttatacgcatatctcagaccaatacagcccgttctacgccaaagtgatcagccgggtgcgcgactcaacccacgtgcttgatggcctgctgtaccatgaaagcgatctggaaattaccgagcattacaccgataccgcaggcttcactgaacatgttttcgccctgatgcacctgctgggattcgcttttgcgccaaggatccgtgatcttcatgacaagcggctgtttattcatggaaaggccgagcgctatccggggcttcagtctgtcatatcaacaacctgcctgaatatcaaagacattgagtcgcactgggatgaggtattgcgcctggcaacctcgattaagcaggggacagtcaccgcatcactgatgatgaaaaagttagccagttacccaaaacagaatggacttgccaaagcgctgagagagattggccgcatcgaacggacactatttatgctggactggttccgtgatcccggtctgcgccgacgcgtgcaggcggggctgaataagggtgaggcccgtaatgcccttgcgcgagcggtctttttgcaccgtctgggtgaaataagggatcgtgggctggagaatcagagttatcgcgccagcgggctgacattactgacagcagcgatcacgttgtggaacacggtatatatagaaagagctattgagtcactaaaacgaaagggtatcccgataaatgagcaactggtctctcatctttctcccctgggctgggaacatatcaatctgagtggagattacgtctggcgtaataatcttaagctgggatccggaaaataccgctcattacgtacagtcgataccgctttgtacaaaaaacagtcttag

SEQ ID NO: 2172 - DNA, 1026 bp, Enterobacter cloacae
gctttcattcggagaactatcatggaaaacattgcgctcattggtatcgatctgggtaaaaactctttccatattcattgccaagatcgtcgcggcaaggctgtttaccgtaaaaaatttacacggccaaagttaatcgaatttttggcgacatgccccgctacaaccatcgcaatggaagcctgtggtggctctcactttatggcacgcaagttggaagagttggggcattttcctaagctgatatcaccacaatttgtccgtccattcgttaaaagtaacaaaaacgactttgtcgacgccgaagctatttgtgaagctgcatcgcgtccgtctatgcgttttgtacagcccagaactgaatctcagcaggcaatgcgtgcgctgcatcgtgtccgtgaatccctggttcaggataaggtaaaaacaaccaatcagatgcatgcttttctgctggaatttggcatcagcgttccacgaggagctgccgttattagccgactgagtacccttcttgaggacaatagtttgcctctatacctcagccagttattgctgaaattacaacagcattatcactatcttgttgagcagattaaagatttggaatcccagttgaaacgaaagttggacgaagatgagattggacagcgcttgctgagcattccctgcgtcggaacactgacagcgagtactatttcaactgagattggcgacgggaagcagtacgccagcagtcgtgactttgcggcggcaacagggctagtgcctcgacagtacagcacgggaggtcggacgacattgctgggaattagtaagcgaggtaacaaaaagatccgaactttgttggttcaatgtgccagggtattcatacaaaaactggaacaccagtctggcaaattggccgattgggtcagggatctactgtgtaggaaaagcaactttgtcgtcacttgtgctctggcaaacaagctggccagaatagcctgggccctaacggcacgacagcaaacttatgtagcataa

SEQ ID NO: 2173 - DNA, 297 bp, Enterobacter cloacae; identical to SEQ ID NO: 1488

SEQ ID NO: 2174 - DNA, 1083 bp, Enterobacter cloacae
gccgctgtacactcgactgcttcaagaagcactacttaccatttgcctgccgtaaggtctgttcttagctggatttttttgggaggatacgcagtcatgacaactcaatccagctcaatacaatacgcttacgcgctagacggcgagggcaccctcacgcacattggcgctgccctgcgctcacatacttacacctgcccaggttgtaagagccccctgaccccggtaatgggcgagttcaacgctaagcactttcgccattcggaagaatgctgtgcccttgaaacctatcttcacaagtgcggcaaagaagcattcttctatcgctaccaacaagctctcagccgtgaaatgcctattagccttgagctggagcgccgggttgcctgtaatggttctcatttagccttggttagagacgaagcacgtcagtgcgtaaaatccgtgcctgcacgctacaacttgactcaatttttcgatcaggcagagctggaaaaacacgataaggtcacagggctgcgaccagacgtgatgttgtatgatacgactggcgaaaggcgttgctacgtagagatttgtgtcacacacccctgctctcaagacaagatcgaagccggtatcccgattcttgagtttaaggtccaatctgcctctgatattcagatgttgcttaccggggcctactcgatcaaggagaagatcctgagagtattcaactggcttcccccgtttcaatctgtggacacctgtagcggcgtctgctcagtaggtaacgtggatatgtctgtctggagtttaagtggttccggccgactcaacgaacaaacgatgccgctcgctgaagtggatttaacaatcaattctgacgtgaacacatggcctagatcgttaggggccgctgagctggctgataacttacgagcttttatccgtcacgccgatcctcattcactatttcccaactgcattatgtgcgagcaagcaggccgatgggaggatggctatctgcaatgtcacagtaaggcaaagatcgttccctacaccgaggcccgtcagtgcgccaattacaaggttaaggcatga

SEQ ID NO: 2175 - DNA, 2628 bp, Enterobacter cloacae
cggttattttttgaaatactgcgggtccgctgctttttctgttctgactggcatgcgacacccggaaacatcaggcgatacgtcttgtacctctatattgagactctgaaacagagactggatgccatcaatcaattgcgcgtggatcgcgcgcttgctgccatgggccctgctttccagcaggtatacagtcttctgccgacattgttgcactatcaccatccgctaatgccgggttacctcgatggtaacgttccccagggcatttgcctcttcacgcctgatgaaacccaacagcattacctgactgaacttgaactctaccgtggtatgccgccgcaggattcgccgaaaggcgagctgccgattaccggggtttactccatgggcagcacatcatcggttgggcaaagctgctcttctgacctggatatctgggtctgccatcagtcctggctcgacaatgaagagcgccagctgttgcagcgtaaatgcagcctgctggagagctgggcggcgtcgctcggcgtggaagtgagcttcttcctgattgatgaaaaccgtttccgccataacgaaagcggcagtctgggtggtgaagactgcggctcgactcagcacatcctgttgctggatgagttttaccgtactgccgttcgcctggccgggaaacgtattctgtggaatatggtgccgtgcgatgaagaagagaattatgacgactacgtcatgtcgctttactcgcagggcgttctgacgccaaacgagtggctggatctgggcggcctgagctccctgtccgccgaagagtactttggcgcaagcctctggcagctttataagagcattgattcaccatacaaagcggtgctgaaaaccctgctgctggaagcttactcctgggaataccccacgccgcgcctgctggcgaaagatattaaacagcgtctgcacgacggggagatcgtctcctacgggcttgatgcctactgcatgatgctggaacgcgtcaccgaatacctgacagccattgaggacgccacgcgtcttgacctggtgcgtcgatgtttctatctcaaagtttgtgaaaaactgagccgcgaacgcgcctgcgtgggctggcgtcgtgaagtcgtcagccagttagtcaaagagtggggatgggacgaagcgcgtctcgccatgctggacaaccgcgccaactggaagatcgatcaggtgcgcgaggcgcacaacgaactgcttgatgcgatgatgcagagctaccgcaacctgatccgctttgcccgccgtaacaaccttagcgtttctgccagcccacaggatatcggggtgctgacccgtaaactgtacgccgcgtttgaagcgttgccgggcaaggttacgctggttaacccacagatttcgcctgacctgtctgagccgaatctgacctttatctacgtgccgccgggccgcgcaaaccgcaccgggtggtatctgtacaaccgtgcgccaagcatggattcgatcatcagccatcagccgctggaatataaccgctatctgaacaagctggtggcctgggcctggtttaacggccttctcacctcacgcacccggttgtttatcaagggtaacgaggtggtcgatttagccaagttgcaggagatggtggcggatgtctcgcaccacttcccgctgcgtctgcctgcgccgacgccaaaagcgctctacagcccgtgtgagattcgccatctggcgatcatcgtcaacctggaatacgacccgacggcggccttccgcaatcaggtggttcactttgacttccgcaagctggacgtctttagcttcggcgagcagcaaaactgcctggtgggtagcgtggatctgctgtaccgcaactcgtggaacgaagtgcgtaccttacactttaacggcgagcaggcgatgatcgaggcgctgaaaacgatcctcggcaagatgcaccaggatgccgcacccccggacagcgtggaggtgttctgctacagccagcacctgcgcggcctgattcgtacccgcgtgcagcagctggtgtctgagtgcatcgaactgcgtctctccagcacccgtcaggaaaccgggcgctttaaagcgctgcgcgtctccggccagacctggggcctgttctttgagcgcctgaacgtgtcggtgcagaagctggagaacgccattgaattctacggcgcgatttcacacaacaaactgcatggcctgtcggttcaggtggaaaccaaccacgttaagctgccgcaggtggtggatggctttgcgagtgaagggattattcagttcttcttcgaagagtcgggcgataatgccgggtttaacatctacattctggatgaaaccaaccgtgccgaggtgtatcaccactgtgaaggcagcaaagaggagctggtgcgcgacgtcagccgcttctattcgtcttcgcacgatcgctttacctacggctcaagttttatcaacttcaacctgccgcagttctaccagattgtgaatgtggatgggcgagcgcaggtgatcccgttccgtacgcaggcgattacccctgcggcgcccgctaaccaggaaactgcgccgctgttgcagcagtatttttcctga

SEQ ID NO: 2176 - DNA, 888 bp, Enterobacter cloacae
cggcggcccgactcaggtcaatctctgacaattacgttctgtacccgcgcaatggagcaaatgatgcagttctctaaaatgcatggccttggcaacgactttatggtcgtcgacgcggtaacgcagaatgtctttttctccccggaactgatccgtcgtctggcggatcgacacgtgggcgtggggtttgaccagctgctggtggtggagccgccttacgatcctgacctggactttcactatcgcatttttaacgccgacggcagcgaagtttcccagtgcggcaacggcgcgcgctgttttgcccgctttgttcggctgaaagggctgaccaacaagcgcgatatccgcgtcagcaccgccaatggccggatggtgctcagcgtcaccgacgacgaactggtgcgcgtgaacatgggagagccgaacttcgaaccctctgccgtgccgtttcgcgccaacaaagcggaaaagacctatatcatgcgtgccgccgagcagacagtattgtgcggcgtcgtctcaatgggtaacccgcactgcgtgattcaggtggatgatgtgcaaaccgcggcggttgaaacgctcggcccggtgctggaaagccacgagcgcttcccggagcgggcgaacatcggtttcatgcaagtggtgaagcgtgaacatattcgcctgcgggtttacgagcgcggcgcgggcgaaacccaggcctgcggaagcggtgcctgtgcggcggtggccgtcggtatctcacaggggttactggcagaagaggttcgcgtggaattaccaggcggtcggcttgatatcgcctggaaaggagcgggtcatccactgtacatgactggcccggcgacacatgtttatgacgggtttatccatctatga

SEQ ID NO: 2177 - DNA, 750 bp, Enterobacter cloacae
cgcggcgcatccacgcgccaaacgggggaaataatgcgtttttaccgcccactcggtcagatctcagccctgacgtttgatcttgatgacaccctttacgacaatcgtccggtgatcctgcgtaccgagcaggagtcgctggcgtttgtgcagaactaccatcctgcgctgaaaacgatgcagaacaaagacttccagaagctgcgtcagtccctgcgggaaaccgagccggaaatttaccatgacgtgaccgaatggcgccgccgtgcggttgagcaggcgatgctcaatgccggcctgagcgcgcaggacgcggccacgggtgccgaagcggccatggaaaactttgccaaatggcgcagtcggatcgacgtgccgcaggagacccacgacacgctggcgaagctcgccgaaaagtggccgctggtggccatcaccaacggcaacgctcagcctgaactgtttggtctggggaactattttcagttcgttctgcgcgcgggcccgcacggacgctcgaagccgttcaacgatatgtatcatctggcagcggaaaaactggatttgccgctcggtgagatcctgcacgtgggcgacgacctgaccacggacgtcgccggggcgatccgctgcggcatgcaggcctgctggatcaagccggaaaatgccgatctgatgactacgccggatagccgtcttctgccgcacgtggaaatttcacggttggcatccctcacgacgctgatataa

SEQ ID NO: 2178 - DNA, 1023 bp, Enterobacter cloacae
tggtctgaaacccaatttgtttctgtgtgcccaccgaactgtccgatattttttgcattgggagtcccggtcatgttgagcgcatttcaactcgaaaataaccgactgactcggcttgaagccgaagagtcacagcccctcattgatgccgtatgggtggatctggtcgagccggacgacgatgagcgccttcgcgtacaatctgaactggggcaaagcctggcgacacgcccggaactggaagacatcgaagcatccgcccgtttttttgaagacgaagacggcctgcacattcactccttcttctttttcgaggatgccgaagaccacgcggggaactccaccgtggcgtttaccatccgcgatggccgcctgttcaccctgcgcgagcgcgaactgcctgcgtttcgtctctaccgtatgcgtgcccgcagccaggcgatgatggacggcaacgcttatgagctgctgctggatctgttcgaaaccaaaatcgaacagctggcggatgaaatcgaaaacatctacagcgacctggaaaagctgagccgcgtgatcatggaaggccatcagggtgatgagtacgacgaagcgttgtccacgctggcagagctggaagatatcggctggaaggtgcgtttgtgtctgatggatacccagcgcgcgctgaacttcctggtgcgcaaggcgcgtctgccgggcggtcagctggagcaggcgcgtgagatcttacgcgatatcgaatccctgctgccgcacaacgaatccctgttccagaaggtcaacttcctgatgcaggcggcgatgggctttatcaacatcgagcagaaccgcatcatcaagatcttctcggtggtgtccgtggtgttcctgccgccgacgctggtggcgtccagctacgggatgaacttcgagtttatgccggagctgaagtggagctttggctacccgggggcgattatctttatgatcctcgccgggctggcgccgtatctgtactttaagcggaagaactggctgtaa

SEQ ID NO: 2179 - DNA, 924 bp, Enterobacter cloacae
aatgcccggacaaaactattcattaaatgtcaccatttcaggagaacaccaccgatgcggacgtatctgggttggttactggcggcggttgcgctgcccctcacagcatatgcgcaggaagcgacgatcaaagaggtgcatgataaacctgccgttaagggcagcatcatcgccaatatgcttcaggagcatgacaatccgttcacgctgtacccgtatgacacaaactacgtgatctacacccagaccagcgatctcaacaaagaggcgataagctcctataactggtctgataatgcgcgtaaagatgaggtgaagttccagctcagcctcgccttcccgttctggcgcggcatcctggggccgaactcggtacttggcgcgtcctacacgcagaagtcatggtggcaactctccaacagcggggagtcatcaccgttccgcgaaaccaactatgaaccgcagctgttcctcggtttcgccaccgattatgagtttgcaggctggacgctgcgagacgtggaggtgggctataaccacgattccaacggtcgttccgacccaacctcacgcagctggaaccgcatctatacgcgtctgatggcgcagaacggcaatttcatggtggaagtgaagccgtggtacgtagtaggcagcaccgatgacaacccggatatcaccaaatacatgggatactatcagcttaaggtgggctatcagctgggtgacgcggtgctgagcgccaaaggccagtacaactggaataccggctacggcggtgcagagctgggcctgagctacccggtaacgaaacacgtgcgtctctatacccaggtgtatagcggctacggcgaatcgctgatcgactacaacttcaaccagacccgcgtcggtgtgggcgtcatgctgaacgatattttctaa

SEQ ID NO: 2180 - DNA, 1896 bp, Enterobacter cloacae
acgttgaagtttctctctcaggcgctgaaaatagcgcctgtttcatttctggcatatggggttaacgtggcgcaggcggaagtattgaatcaggaatcgctggctaaacaggttttgcatgaaacctttggctaccagcagttccgtcctggccaggaaaccatcattgaaaccgtgctggaaggccgcgattgcctggtggtcatgccgaccggcggcggtaaatcgctctgctatcaggtgcccgcgctggtgcttaatggcctgacggttgtggtatcaccccttatttccctgatgaaagaccaggtcgaccagctgctcgccaacggcgtggcggcggcctgtcttaactcaacgcaaactcgcgagcagcagcaagaggtgatggccgggtgccgcaccggacaggttcgcctgctgtatatcgcgccagagcgcctgatgctggacaacttcctcgaccacctggcgcactggaacccggtgctgctggcggtggatgaagcgcactgtatctcccagtgggggcacgatttccgcccggaatacgccgccctcggccagcttcgtcagcgcttccccgagctgccgtttatggcgcttaccgccacggcggacgacaccacgcgtcaggacatcgttcgcctgctgggactgaacgacccgtatattcaggtcagcagcttcgaccgcccgaacatccgctatatgctgatggaaaagttcaagccgctggatcagctcctgcgctacgtgcaggagcagcgcggcaagtccggcatcatctactgcaacagccgcgcaaaggtggaagacaccgctgcgcgtctgcaaaatcgcggctttagcgcggcggcataccatgccgggttagagaaccacatccgcgccgatgtgcaggaaaaattccagcgcgacgacctgcaaatcgtggtcgcaacggtggcgttcgggatggggatcaacaagcccaacgtgcgctttgtggtgcatttcgacattccgcgcaatatcgaatcctactatcaggaaaccggccgcgccgggcgtgatggtctgcctgcggaagcgatgctgttttacgacccggcggatatggcgtggctgcgccgctgtctggaagagaaaccgcaggggcagttgcaggatatcgaacgccacaagcttaacgcgatgggggccttcgccgaagcgcaaacctgccgccgtctggtgttactcaactactttggtgaagggcgtcaggcgccgtgcggcaactgcgatatctgcctcgacccgccgaagcagtacgatggcctgatggacgcgcgcaaagcgctctcgactatcggacgcgtgaaccagcgctttgggatgggctacgtcgttgaagtgctgcgcggggctaacaaccagcgtatccgcgatatgggtcacgacaagctaccggtttacggcatcgggaaagaccagagccatgagcactgggtgagtattatccgccagttgatccacctcggctttgccacgcaaaatattgcccagcattctgcgcttcagctgaccgaagcggcgcgacctgtcctgcgtggcgaggttgaactgaagctcgccgttccgcgcgtcgtcgccctgaagccgcgcgtgatgcaaaaatcctacggcggtaactacgaccgcaagctgttcgccaagctgcgtaagctgcgtaaagctattgccgatgaagagaacatcccgccatacgtggtgttcaacgacgcgacgctgatcgagatggccgagcaaatgccgctcagcgccagcgagatgctcagcgtcaacggcgtcggcacgcgcaagctggagcgcttcggtaaagagtttatggcgctcatccgttcccacgctgatggtgatgatgaggagtag

SEQ ID NO: 2181 - DNA, 471 bp, Enterobacter cloacae
attacggggggtggaaacccaatgtttcagcagaaaaaggactgggaaacacgagaaaacgcatttgctgctttctccatggggccgctgaccgatttctggcgccagcgtgaggaagatgagtttatgggcgtcggggaaatcccggtacgcttcgttcgtttccgtgatgaaaaaaatgaccgggtgattgtggtctgccccgggcgcatcgaaagctatatcaaatatgccgagctggcgtatgacctgttccatctgggctttgatgtgttaattatcgaccatcgcgggcaggggctttccggccggatgttaccggatacccatcgcggccacgtggataacttcagcgattacgtcgacgatctggccgcgttctggcagcaggaagtgcagcccggaccgtggcgcaagcgttatattcttgcccactccatggggggcgcgatctcgacgttgtttttgtag

SEQ ID NO: 2182 - DNA, 459 bp, Enterobacter cloacae
ggtcaggatcccgccgttgatttcacaatcgatatcgctgtcgccgtcccagtcgtcgatacgctcttcgatggtcatccacagggtatcggcaaggcgatgaaattcactgtcgttcatggttttattcctgtttttcgtgatggcggcagtataacgctaaataattcccgttgcaggaaagcggcaaactcttgcttttgtgtcttctcctgcgatgatagaaacagatttgaacttacgggcaacctctacatgaaaaacgtcttccgaacgcttgtcgttcttgtcactctgtttagcctgaccggctgtggactgaagggaccactgtacttcccgccagaggataaaaacgcaccaccgccgacaaaaccggtgcaaagtggtatcgagtcatctacgccggataccaacgatcgcggcaataacggcggcccgactcaggtcaatctctga

SEQ ID NO: 2183 - DNA, 909 bp, Enterobacter cloacae
gcgcgtatgacggacggattgctcgccactgacgtcaaccgctttctgcgctatctgggcgtagaacgccagctcagccctattacgctgctcaactatcagcgtcagcttgatgccatcatgcagattgccgatgaaatcggcctgaaaagctggcaacaatgtgacgccgccacggtacgcgggttcgtcgtgcgtagccgtaaaaaaaatctcagcccggcgagcctggcgctccggctctctgccctgcgcagtttcttcgactggctggtcagtcagggcggtctgaaagccaacccggcaaaagggatcgccacgccgaaagccccgcgtcatctgccgaaaaatatcgacgtcgacgacgtaaaccgcctgctggatatcgatcttaacgatccgctggccgtgcgcgaccgcgcgatgctggaggtgatgtacggcgcgggcctgcgtctctctgagctggtgaacctcgacttaaagcacctcgatctggaatccggcgaggtgtgggtaatgggcaagggcagcaaagagcgccgcctgccgatcggccgcaatgcggtctcctggattgagcactggctggatctgcgcgggctgtttggcgccgacgaagatgcgctgttcctgtcgaaactcggcaagcggatctcggcgcgtaacgtgcagaagcgctttgcggagtggggcattaagcaggggctgaacagccacgttcacccccacaagctgcgccactcttttgcgacgcacatgctggaatcaagcggcgacctgcgcggcgtacaggagctgcttggtcacgcgaatctgtcgaccacccaaatctatacccacttagacttccaacaccttgcctcggtgtatgacgcggcgcatccacgcgccaaacgggggaaataa

SEQ ID NO: 2184 - DNA, 2217 bp, Enterobacter cloacae
cagggttttggcgaatggaaacatttgcctgcccgccatgacgtgacggtgccaatggacgtttcttacctgctcgacagccttaatgataaacagcgtgacgcggttgccgcctcgcgtacaaacctgctggtactggctggagcgggcagtggtaagacgcgcgtgctggttcaccgtatcgcctggctacagagcgtggagaactgttcgccgtactcgattatggccgtgacgttcaccaacaaggcagcggcggagatgcgccaccgtatcgcacagctgatgggcaccagccagggcggcatgtgggttggcaccttccacggcctggcgcaccgtctgctgcgcgcgcaccatatggacgctaacctgccgcaggatttccagatcctcgacagcgaagatcagctgcgcctgctgaaacgcctgatcaaggcgatgaatctcgacgagaagcagtggccgccgcgtcaggcgatgtggtacatcaacggtcaaaaagacgaagggctgcgtccgcatcatattcagagcttcggtaacccggtcgagcagacctggcagaacgtctacaaggcctatcaggaagcgtgcgatcgcgccggtctggtggatttcgccgagctgctgctgcgcgcccacgagctgtggctgaacaaaccgcatatcctgcaacactaccgtgaacgctttaccaacatcctggtggacgaattccaggataccaacaacatccagtacgcctggatccgcctgctggccggggataccggcaaggtgatgatcgtaggcgatgacgaccagtctatctacggctggcgcggcgcgcaggtggagaacatccagcgcttcctcaacgatttccccggcgcgcaaaccatccgtctggagcagaactaccgttctaccagcaacattctgagcgcggccaacgccctgattgagaacaacaacgggcgcctgggtaaaaagctgtggaccgatggcgtagacggcgaaccgatttcgatttactgcgccttcaacgagctcgacgaagcccgcttcgtggtgaaccgcattaaaacctggcaggagaacggcggcgcgctggagcagtgtgccattctctatcgcagcaacgcccagtcgcgcgtgctggaagaggcgctgttgcaggtgagcatgccgtaccgcatttatggcggtatgcgcttcttcgaacgtcaggagatcaaagatgcgctctcgtatttgcgtctgattgccaaccgtaacgacgatgcggcgtttgagcgcgtggtgaacacgccgacgcgcggcatcggcgatcgtacgctggacgtggtgcgtcaggcctcgcgcgatcgtcagctcacgttgtggcaggcgtgccgcgagctgttacaggaaaaagcccttgccgggcgcgccgccagcgcattgcagcgcttcctggagttaatcgacgcgctggcgcaggaaacggccgacatgccgctgcacgtccagaccgaccgggtgattaaagattccggcttgcgcaccatgtacgagcaggaaaaaggcgagaagggccagacccgtattgagaacttagaggaactggtgacggcaacgcgccagttcagctacaacgaagaagacgaagacctgatgccgttgcaggcattcctctctcacgccgcgctggaggcgggtgaagggcaggccgatacctggcaggatgcggttcagctgatgaccctgcactccgcgaaaggtctggagttcccgcaggtgttcatcgtcgggatggaagaggggatgttcccgagccagatgtcgctggatgaaggcgggcgtctggaagaggagcgtcgtctggcctacgtgggcgtgacccgtgcgatgcagaaactgactctgacctacgcggaaacccgccgcctgtacgggaaagaggtgtatcaccgtccgtcgcgctttatcggcgaactgccggaagagtgtgtggaagaggtgcgcctgcgcgccagcatcagccgtccggtcagccatcagcgtatgggctcgccgatctctgaaaccgacaccggttacaagctgggccagcgcgtgcgccactcgaagtttggcgaaggcaccatcgtcaacctggaaggcagcggcgagcacagccgtttgcaggtagcgttccaggggcaggggatcaaatggctggtggcagcctatgccaagctggaaagtgtgtaa

SEQ ID NO: 2185 - DNA, 651 bp, Enterobacter cloacae
ctcactgtattatttccccgcgagctaattatgttaatgctatttctcaccgtggcgttagtgcacatcgttgcgctgatgagcccaggccctgattttttcttcgtgtcgcaaacggccgtcagccgctcccgcaaagaggcgatgatgggtgtgctcggtattaccatgggcgtcatggtctgggcggcggttgcgctgctcggtctgaacctgatcctggcgaaaatggcgtggctgcataacatcattatggttggcggcggtctgtacctgtgctggatgggctaccagatgctgcgcggagcgctgaagaaagaagagagcaagccggaagagccaaaggttgagctggcaacgggcggccgtagctttgtgaaagggctgctgaccaacctggcgaacccgaaagcaattatttacttcggctcggtattctcgctgtttgtgggggataacgtcggcgcgggcgcgcgctgggggatcttcctgctgatcgttgtggaaacgttcgcctggtttaccgttgtggcaagcctgtttgccttaccggcgatgcgtcgcggctaccagcgcatcgcgaagtggatcgacggcttcgccggcgcgttgttcgccggcttcggcattcatctcatcatttctcgctaa

SEQ ID NO: 2186 - DNA, 723 bp, Enterobacter cloacae
cgggtttatccatctatgaagcaaccaggggaagaactgcgggaacctgtaacagagctggacgacagcactgttgtggattatttgctgcacaatcctgagttttttatccgcaatgcacgcgtcgtcgaacggatgcgcgtgccgcatccggttcgcgagaccgtgtcgctggttgaatggcacatggcgcgctcgcgcaaccacatcaatcagctcgaagagaacatgacgctgctgatggagcaggccagcaataacgaaagcctgttctaccgtcttctgcaccttcaggcgcgtctggcttccgcacacagtctcgaagagttcctcaaccgcttccaccgctgggcgcgcgagctggggctggcaggcgcgacgatccgcctcttccctgaccgctggcgcattggcgcgccgtccgggtttacccatctggcgctgagccgtcaggcgtttgagccgctgcgcattcagcgtctgggccatgagcaccactatctggggccgcttaacgggccagaactgctggtggtgctgccggaagccaaagctatcggctcggtggcgatgtcgctgatggggcgcgatggtgacctgggcgtgatgttatttaccagccgcgacgcgcatcactatgaacaggggcagggtacgcaactgttgcaggagatcgccctgatgctgcctgagctgctggagcgctggattgagcgcgtatga

SEQ ID NO: 2187 - DNA, 645 bp, Enterobacter cloacae
aaacagacgatccgggagtttcaaatgaccttcgagtggtggttcgcctacctgctgacatccatcatcctcagcctttcacctggctcgggcgcaatcaacaccatgaccacctccattaatcacggctatcgcggcgcggtggcgtcaatcgccggtttacagaccgggcttggcattcatattgtgctggtggggattggtctgggcacgctgttctcccgttcggtgctggccttcgaggtgctgaaatgggctggcgcagcgtatcttatctggctgggtattcagcagtggcgcgccgcaggctcgattgatctgcatacgctctcccggacgcaaacacgcggccacctgtttaaacgcgcggtgttcgttaacctgaccaacccgaaaagcatcgtgttcctcgccgccctgttcccgcagtttatcgtgccgcatcagccacaggtgatgcagtacgtggtgctgggcgcaaccaccattattgtcgatatcattgtgatgattggttacgcgacgctggcgcagcgaattgcggcgtggatcaaagggcctaagcagatgaaggccctgaacaaagtttttggttcgctgtttatgctggttggcgcgctgcttgcgtcagcgcgtcatgcttag

SEQ ID NO: 2188 - DNA, 1254 bp, Enterobacter cloacae
aaacgccgacaacgatgcgctgctgcgcgcattacaataactctcaaatgggaagccataatgacggaacacgaaaaatcctccgccgtggttgaagagaccagggagactgtggacaccacgtcacagccagagacgacagacacaaccgttgagaagaaaaacggcagcaataaaaccagcctcacgctgagcgtgattgccatcgcgattgcgctggccgcaggcgtgggtctctacggactggtgaagaaacaaggcaccaaccagacggccaccagcgacgcgctggttaaccaaatcactgccctacagaaagcgcaggagacgcaaaaagctgagctggaaggtgtgatcaaacagcaggctgccgccctcgccgacgcgaacagcaaacgtgaagagttgaccaaacagctgagcgaagtgcaggaaaaagtcgccacaatttcgggaaccgatgccaaaacctggctactttcacaggccgattttctggtgaaactagccgggcgcaagctctggagcgatcaggatgtcaccaccgccgccgcgctgctgaaaagcgccgacgcaagcctggctgatatgaacgatccgagcctcatcaacgcacgccgcgctattacggaagatatcgccagcctgtccgcggtttctcaggtcgactacgacggtatcatccttaaggtgaatcagctctcgaaccagattgataaccttcagctggccgataacaacgacgatgactctccgatggattccgacggtaccgagctgtccagttccctgagcgaatggcgtatcaacctgcaaaagagctggcagaactttatggacagctttataaccattcgccgccgcgatgaaactgccgtgccgctgctggcaccgaaccaggacgtctatctacgcgaaaacattcgttcccgcctgttggtcgcggcgcaggccgtgccgcgtcaccaggaagagacctacaaacaggcgctggataacgtttcaacctgggtacgtgcttactacgataccaatgatgcaaccacgaccgcgttcctcgaggatatcgacaagctgagccagcaaaacatcaccatgaacgtaccggacaagctggaaagtcagccgattctggagaagatcatgcagacgcgcgtgcgtaacttgctggcccagccgggcgttccggcagagcgtccggctgaagcacctgccgccgcgccagcgcctgaaagcgcgccgcaaggagagtaa

SEQ ID NO: 2189 - DNA, 555 bp, Enterobacter cloacae
cttccgcttcctcgtttcttaaagtggcattcctttatcctgaagcataaaatcaacattttgttaacaacaaggatgccacttcagatgtcagccacactcaccgccgaagaaaccttaaagctcgtgggcgagatttttgtgtaccacatgccgttcaaccgtgcactgggtcttgagctggagcgatacgaaaaagacttcgctcagctgagtttcaataatcagccaatgatggtcggtaactgggcgcaaagcattttgcacggcggggtaattgcctccgcgctggacgtggcggccggtctggtgtgcgtgggcagcacgctgacgcgccacgacaccatcaacgaagatgagttacgccagcgcctgtcgcgcatgggcaccatcgatttacgcgtcgactacctgcgcccaggacgcggaaaccgcttcacctgtaccagcagcatgctgcgcgccgggaataaagttgccgtcgcccgcgttgagctgcataacgaggagcaggtttatatcgccagcgcaaccgccacttatatggtgggttga

SEQ ID NO: 2190 - DNA, 909 bp, Enterobacter cloacae
cggattttcccgatggatgctaaacagacgcggcagggcgttttactcgcccttgccgcttattttatttggggtatagcaccggcgtacttcaaacttatcgcctatgtcccggcggacgagatcctcactcaccgcgtcatctggtcgtttttcttcatgattgcgctgatgagtatcagccgtcagtggtcaggcgtcaaaacgctgctgaaaaccccgaagaaggtcttcctgctcgccctctctgcggtgctgattggcggaaactggctgctgtttatctgggcggtgaataaccatcacatgctcgaagccagcctgggctactttattaacccgctggtcaatattttgctggggatgattttcctcggcgagcgctttcgccggatgcagtgggtggcagtgattctggccttctgcggcgtgctggtacagctgtggaccttcggctcactgccggttatcgccctggggctggcgttcagctttgccttctacggcctggtgcgtaaaaaaatcgccgtggaagcgcagacgggaatgctgtttgaaaccctgtggctgctgcctgtcgccgcgatctacctgttcggtattgccgacagcgccaccagccacatgggcagcaacccatggtcgctgaacctgatgctgatagccgcgggcgtggtcacgacgattcccctgctgtgcttcaccggcgcggcaacgcgtctgcgcctctccacgttgggcttcttccagtacattggcccgacgctgatgttcctgctggcggtggtgttttacggcgaggtgccgggtgcggataagatggtgacgttcgcctttatctgggtggcgctggccatctttgttgcggatgcgatttatacccagcgcagggtgcgcaaagggctgtga

SEQ ID NO: 2191 - DNA, 756 bp, Enterobacter cloacae
cggagagccccctgcatgagcatacttgtcacccgcccttctcccgcaggagagcagttagtgagccgtctgcgcgcactggggcaggtggcctggagttttccgctgattgaattctcccccggtcgcgagctgcctgagctcgctgaccagatgcgtctcttgcaggaaggcgatctgctctttgcgctgtcgcagcatgccgtggagtttgcccatgcgcagctgcaacaacagggcgttcgctggcctcacgccccccgctatttcgccatcgggcgcactacggcgctggccttacataccgcgagcggaatcgatgttcgttacccgttagatcgggaaatcagcgaagtcttgctacaattacctgaattacaaaacattgcgggaaagcgcacacttattttgcgcggcaacggtggccgcgaactgctgggcgagacgctgcgcgaacgcggcgcagacgtgacgtttgtggagtgctatcagcgttgtgcaaaacactatgatggcgcggaagaagcaatgcgctggcacgcccgcggtattaatacgctggtggtcaccagcggtgaaatgttacaacagctttggtcgctgattccgctttggtatcgcgaaaactggttactccgctgtcggcttctggtcgtcagtgagcgtctggcgaaccacgcccgggaactgggctggcaggatattcggatcgctgaaaacgccgacaacgatgcgctgctgcgcgcattacaataa

SEQ ID NO: 2192 - DNA, 360 bp, Enterobacter cloacae
cgttatactgccgccatcacgaaaaacaggaataaaaccatgaacgacagtgaatttcatcgccttgccgataccctgtggatgaccatcgaagagcgtatcgacgactgggacggcgacagcgatatcgattgtgaaatcaacggcgggatcctgaccttaagcttcgaaaacggcagcaagattattattaaccgtcaggagccgcttcaccaggtgtggctggcggcgaaacagggcggctatcactttgatctgaaaggtgacgagtgggtctgcgaccgcagcggcgaaacgttctgggatctgctggagcaggcggcgaccgcgcaggcgggtgaggacgtgagtttcaggtag

SEQ ID NO: 2193 - DNA, 966 bp, Enterobacter cloacae
cgattgataatgacggtaacaagcatgttagacaatgttttgagaattgccacacgccaaagtcctcttgcactctggcaggcacattatgttaagcagcgcctggaagcctgccacaccggattacgcgttgagctggtgccaatggttacgcgtggcgatgtcatactggatacgccgctggccaaagtgggcggaaaaggtctgtttgtcaaagagctggagctggcattgcttgagaaccgcgccgatatcgccgtgcattcgatgaaggatgtgcccgttgagttcccggaagggctggggctggtgaccatctgcgagcgcgaggatccgcgcgatgcgtttgtctctaatcgatatgactcgctcgatgcgttgccggcaggcagcgtggtcggcacgtcaagtttacgccgccagtgtcagctggctgaacgtcgcccggatctggtgatccgttcgctgcgcgggaacgtcggcacacgccttggcaagctggataacggcgactacgatgccattattcttgcggttgcgggcctgaaacgcctggggctggaagaacgtattcgcgtggcgttgccgccggagctgtcgctccccgccgtcggccagggcgccgtcggcattgagtgtcgtctggatgatgtgcgcactcaggcactgctggcgccgctgaatcatgacgataccgccgttcgcgtaaaagccgagcgcgcgatgaatacacgcctcgaaggaggctgtcaggtgccaattggcagctatgctgaattaactgacggtgaactgtggctgcgtgcgctggttggcgcgccggacggctcgcatatggttcgcggtgaacgtcgcggcaaaccgcaagatgccgaggcgcttggcgtatcgctggcggaagagctgctaaataacggcgcacgtgaaattctggccgaggtctataacggagagccccctgcatga

SEQ ID NO: 2194 - DNA, 1224 bp, Enterobacter cloacae
aagcgcgccgcaaggagagtaatgatgctaaaagtcttcttactcttcatcctgctgatcgccgggattgtactggggccgatgcttgcgggtcaccagggttacgtattgatccagaccgataactacaacatcgaaaccagcgtaacagggctggtgattatcctgatcctgggtgtggtcgttctgctggcagtggagtggctcctgcgtcgtattttccgtaccggcgtacatacgcgcggctggttcgttggccgtaagcgccgtcgcgcccgtaagcagaccgagcaggcattgctgaagctggccgaaggtgactatcagcaggttgaaaagctaatgtcgaaaaatgccgaccatgcagaacagccggttgttaactatctgctggccgctgaggcggcgcaacagcgaggcgatgaggcccgcgccaatcagcatcttgaacgcgcgtctgagctctctactaaggatccgattccggttgagatcacccgcgttcgtctgcaactggcgcgcaatgaaaaccatgccgcacgtcacggcgttgaccgtctgctggaaattacccctcgtcatccggaagtgctgcgtcttgctgagcaggcatatattcggaccggtgcatggggctcgctgctggacattatcccttccatggcgaaagccgacgtgggcgatgatgaacatcgtgatgaacttcagcgtctggcctggattggcctgatggatcaggcgcgcgccgatctcggcagcgacggcctgaaaacctggtggaaaaaccagagccgcaaaacgcgccagcaggttcctcttcaggttgcgatggcagaacatctgattgagtgtgacgaccatgacaccgcgcaggagatcctcctcgacggtctcaagcgacagtatgatgaccgcctggtgatggtcatcccgcgtctgaaaaccaacaatccggaacaaattgaaaaagcactgcgccagcagatcaaaaccgtgggcgatcgtccgctgctgtggagtacgctgggccagtctctgatgaaacacggcgagtggcaggaggcgagtctcgccttccgcgccgcgctgaagcaacgcccggacgcatttgattacgcctggcttgctgattcgctggacaagcagcacaagccggaagaggccgcagctatgcgccgtgatgggctgttattgacgttgcaaaataacggaacgcagcagtaa

SEQ ID NO: 2195 - DNA, 1224 bp, Enterobacter cloacae
aaggatatcgtcatgaactcgcttttatatgcgcttttcgaagcgctgcggtgctatcgctggctccgcctgctggcctgcgcctttatctttagctccctgggtaatggcttaactcaggttgttgttttcggattattgttacagtggtcagccccgtcagcgctgttaaccctcgccttcctttttgctacggtgcccggttttatcggcagcctgattggtgaaaagctgtgccagcggttttcacctctctacctgttgatgctgaccgaatggctgggcttgctcgccctgctctttcccctttcaggcgcacattaccacagcataccggcgctgcttgcggtgcaatccacagaagcgttgctgagcgggatgagctggcctgcgttaacgcttctgtttaaacgcggactgcatgaggcagaactgcctgcggcaacgtgtctggaaaatgtgatttttgcctcccaggttttgttaggaaccgggctgggtgtggtgttgttccagcgcatcccggtcttcgccttactggtcatcgacgccgccagttttatgggatcgctggtcatgctgtttctcgcagaacgccagtatgtagcgcgtccagcaccgttgcctgtcggggaccctcaacctgtggcattgcgctggcaaactctgacccttcgacaaaaacgcagtttgctgattttgcctgcccttgctgccgtaggctcgcctgcaatggcgttgctgccagcactggcgcagcagatcaaccccgagaatgccgctgggcttgcgctgcccttgctttttgccagaagcctgggacagctttgtggccccttgctgctcagaaaagagagtctgacgcgctttgcagcaagaacgcctttgctacttagctgtcttgctctttttctggcagcctatgggttgcttccgtttttatccgcatgggtcgtgcttgcgctggggatgatctttatcgcgcatctggcgtcgaatatcgtttttgcggcgggtacgtttggggtactgagtaattttcaggctatacagatatccgctgccagcggtaaggcctggcgctggcaaacgttgagcgcttccctttttacgggcctcgccgcaatgacggcgacgatattgggagcggctcagacgctatatgctgtctctgctatcgcactgctgttggtggcgctggtcctggcccattatcgtgaataa

SEQ ID NO: 2196 - DNA, 3081 bp, Enterobacter cloacae
cccgtgaataactctacatcgcattctttagcggttaagacaccgctttccagactttacctcgctctattttccgcgccgctgttactgtttttacctgccgatatcgcgcgtgcagccgatgccttttttgatggcgactcgcgtattaccgaaacgctgggttacaccggtgatgtgtatgttggacgtaatcaacgcggaaatctgttgatcgataatggcaaaatcaccgcctataacatcaatatcggtcggctgttcgacggcaaaatttatgaaagcgtggtcacggtccgtgggccagacgctgagcttaacgcggtgaacgatcggtacgtcctgcgcggcgacctgaatcttggcctcggcaccctgcgagtcgaagagggcgcgctggcgagtgcaaaggagattgttgtcggcaccacccgcggctacgacagccaccttatcgccacgggtgctggctctcgtgtgaccagtaattttctcagcgtaggcaccgatctgggcgcacgctccacgcttgcgattgaagacggcgctgcgctcaataccgcttacgatgcacgcatcggcaacggtaccggaccgggtgaaaccgacacgctgagcccgaaagccaccgtcactgggagcggctcacagtggaacgttggccgtacgttgacgctttatggcgacctggacgtgctgaacggcggaacggttaacgttggcggcgtgcaggtggcaggcgtctccggggcagggaaaaccgccgagctggttattgcgggcgaggactcacgctttaccagcggcagcagcgtgagcgtgggcgattacggcaatggcgtgctgtctgtgattgacggcggttcattttccgctggcagcaatgcgctgatcgtggggacatcgggttccggctcgaaccggggtgcgctcatcatcggcagccgcggcaatatggacaccggcacgggtttaactgaaccaacgcttggcacggcgggcggcgcaggtaccctcgatgcgaagacggcaataagcctgcgtggcggactgttcggaagctatgtctacttcaaccataccgacggaaattacatcttcagcaacacgatgagcggtgaaggtgatgtgatcaacacctccgggcagacgacgctgaacggcgatctttccgcactcaaggcgaacgtcaccgcgcggggcggtaaagtcattattgccagcaatattaatacccaaccagaagacgatatttttgacgtccagacgcttagcgcggagaacggcggcacgctgatcctcaatgcgacggcgggttcagacgtcagcaacggggtgggttacagcagcgccgcgtcaatcaagtccggcggcacgctgggcggcaacgggacgctgggccagaccgagatcctgtccggcggacatatctcgcccggcgacggcactatcggtacgttgacgctgaaacgctatctgaactttatcggcgaatccttctatgacgtcgatatcgcaggagatggccgcagcgaccagctactggtatcgggcaaaaccaccatcagcaatcaggctaaggtacaggtcaccgcgctggatccgcaaaccagctataaaacgggccaaagctaccgcattttgacctccgacgggggaattgacggtgagttcgccggcgcgatctccaaatccgccttcctcgacgtggcgcttaagcaaagcaccaatgccgtcgatctgaccatcgcgcagaaagagaccggtggcgagaatcctggaggagaaaatcccggaggcgaaaaccctggcggtgagaatcctggtggtgaaaaccccggaggcgaaaaccctggcggtgagaatcctggcggtgaaaaccccggaggtgaaaatcctggcggtgagaatcctggtggtgaaaaccccggaggtgaaaacccgggcagcggcaagccgggcattttccagaccgtggcccaaagcagcaaccagtggaataccgctggcgcgctctccacgctgacgcaaagcggccagtctctggcgctgtataactcgctgcttctgctaagcgcgccggaagcgcgcgaggcgttcaaccagctttctggtgaagtttatccgtcaatgcagtccaacctgatcgctggcagcacgcaggtgtttaacgtgttaaaccagcgcatgcagcgcgcgtttgataacgacagcctgccgataccaccgttagccatgtcgctggtgcagcagccggagccgcaaaacaatggcgtctggggccagaccttcagctcctggagccgaaacagcggcgacggtaacgtgggcaagctggacggcaacaccaccggcttcctgctgggggcagatcgcaagctggcggaccataacgtgcgtgtcggcggctacttcggctacagccggggtgattacgacgtcgacagccgtcgctcctcaacggataccgacaactatcaccttggcctgtatgcggcgggtcaacaggatgcgttctcccttcgcggcgcgctgggttatacctggcacaagatcgaaggcgagcgcaatgttgatttcagcggtttctcggatcggctgaagtcagattacgacgccaactccctgctggcgttcaccgaagcgggctaccgtttcggccagccagacaggaatattgagccgttcgtcaatttatcgtacatccggctgcataccgacagcttcagggaagacggcggtgccgctgcgctgagcgtccgtaacgaaacgatgaacaccttctacacgacactcgggttgcgcggtgtgaccgagctgccgaagcacgttaacctctacggttcattgggctggcagcacgcctatggcgataagaatacctcttcgcgcatggcgtttgcgggcagcgacgcgttcattactcagggacaggccgtggatgaggatgtgatggtcggtgatatcggcgtgagcgtacagctgtcgcgtgctgcgacgctggatgtgggttaccagggacaatatggtgcggatacccgcgtcaactcggttaacgccaatctgcgctggtcgttctga

SEQ ID NO: 2197 - DNA, 819 bp, Enterobacter cloacae
ccgggcggttcgccgcccttcttccgcgatgagaaaaatgcgtcagcacgcgtgcgcaaggagcctcgtatgtcagaccagacgctaaaagcgacccgacagcagagccttatcaccctgctgagtcaaagcgactggctgactaccgaggtgctggctgaaaagctctccgtcagcaaagagacgatccgccgggatctgaagtcgttgcagcagcaggggaagcttctgcgccagcacgggcgcgcgcgtctgattcacccggacagccgcgacagcggtgaaccctttggcgcacgcctgaaaagccattatgccgacaaagccgatattgcccgccacgcgctgggctggatcagcgaagggatgaccatcgccctcgacgccagctcaacctgctttcatctggcgcgccagttgccggacatcgacctcaccgtatttaccaacagcctgcctgtctgccacgagatggcaaagcgcgagcggatcacgcttatctgctccggcggaacgcttgagcgtaagtatcgctgctatgttaatccggcgctggtgacgcagctaaaagggctggagatcgatctgtttatcttctcgtgtgaaggggtcgatgagcatggcgtcctctgggatccgtccgagcacaacgcgggctttaaggcgctgctgttaaaccgcgccagccagtcgctgctgctgatcgacaaaagtaaatttatgcgggcaagcgaagtgaaaattggtcagctgtcgcaggtaacacagattattcagagcgataaacgtcaggccgccagagacggcctgacacgatga

SEQ ID NO: 2198 - DNA, 348 bp, Enterobacter cloacae
  unsure (152)
  unsure (157)
  unsure (160)
  unsure (171)
ttgttgcggaatgcaggccgggtaaggcgacgccgccacccggcaggcaaggctgcaagagccttcgttttacttcgcggccgctttctcttcgccgaccagaccaatcttcaggtagcccgcctgatgcagcgtgtccattaccttcattnccccnaantgggtttttcnataatcgacggttttatccgcgcggaagaagacggtggtgtctttcttgccgccggtgagctggtccagcgccggaataaccgaggcatccgttaccggatcgttgcccaggaacatggacttatggcccttcacctcttcatcacgaggcgccaagaagccgagaaagtcgtctaa

SEQ ID NO: 2199 - DNA, 2013 bp, Enterobacter cloacae
gcgcccttacgacggcaaacgcgagagcaatctctccgtcacgttagatgcgactttacgcttttaaggatgaatatgctgaacacacgtttttctgtaagcctgatcgtcatcggctggctctgcctcagcgcgagcctctgcgcgcagccgctctcctttatggcccctgaagagaggccgcagctggaggccagcaaaccctggccggagaatcagtttttggtcctggcctaccacgacgtcgaagatgatgccgccgatcagcgctacctctccgttcgcaccagcgcgttaaacgagcagataagctggcttttgcacaacggctatcacgccattagcgtgcaggacattctggatgcgcatgaaggaaaaaaagcgctgccgccgaaagccgttttgctcagcttcgacgacggttatagcagtttttacacccgggtctggcccctgcttcaggcctggaacgttcctgcgctgtgggcaccggtgggcagctgggtggatacgccggcaaatcaaaaagttaacttcggcggtctgatgacgccccgcgatcgctttgccacctgggatatggttcgcgagctcagccagtccccgctgattgagattggctcgcatacctgggcctcgcattacggcattccggccaacccgcagggaagccgtgaacccgccatcgctaaccgtttttttgataacgcgacggggcattacgaaaccgatgaacacttcaatcagcggatcgccgcagacgtacggaaagtcaccgataaaatcacccaggtgacgggaaaagcgccgcgtgcctgggtgtggccctatggggctgccaacggtacatcgctcgctatcgcccagaaacagggctatcagctggcctttaccctggaggacgggctggcaaacgtgcgcgacctcggcaacatcccgcgcctgctgattgccggaaatccgtcgataaaaacctttgccaacacggttagccgcgttcaggagtttgaaccggtgcgcgtcatgcatgttgatcttgattacgtctacgatcccgatccggcccagcagacgaaaaacatcaacaaactcgtccagcgggtctacgacatgaaaatcagccatgtgtttctccaggcgttttcggatccgcggggcgacggcaggatcagcgcgctctatttccccaaccgtcgtcttccggtccgggccgatctctttaattttgtcgcctggcagctacaaacccgcgcgggagtgaaagtcttcgcgtggatgccggttctctctttcgatctcagtccagccttgccgcgcgtgcagcgccgtgagcgtcaaacgggagagttgaccgtggccgccgagccctatatccggctctccccctggagtccgcaggttcgccagcaggtgacggagatctatgaagatctggcccgctatgccagcttcaacgggatcttgttccatgacgacgcagtgctgacggacgttgacgatgccggacaggatacgacccggcagaagagccagcggcttatcggctttacccgcaccctgagccaggcggtgaaaaacatccgtggcccgcagatcaaaaccgcgcggaacatgttcgcgttacccattctcgagccggaaagcgaggcatggtttgcgcaaaatctggatgattttctggcggcctacgactggacggtgccgatggcaatgccactgatggagtccgtcccggcagaagagagcaatgcctggctgacgcgtttagtcaaagccgtcgccgaacgccccggcgcgctgaataaaacgatttttgagctacaggccagggactgggcgcagaaaccgcagcgtgccgtagccgatggacgtctggtggagtggatgcgggtgctccagctgaacggcatcaaaaattacggttattaccccgacgacttcctcaacaaccaacctgatatttcgcgtatcaggcctgaattttcttcgtactggtatcctgacaatgactga

SEQ ID NO: 2200 - DNA, 447 bp, Enterobacter cloacae
agggagcattcaatgaacgagagtacgttaattttgactgaacatcggctggcaccgcgtcttttcgatgctgcattaacgctgatagcctggggaggattcctgtttttcctgtacgccaggctgtggatgcagttaaccgaggagggcgatcaccgctggaacgcaattatcgcctcttttaatacagtgctggtttatctgctgattgccgcgttcaacggctggctgctgatcctgtggtatcagtacaatcgccgccgcgcgcatgtgaggcggcgtcatccggaaatgttgcgccatgacgagcttgcccaaagttttaacgtcacgccgcaaattatgtccgagatgagccagtacaacctgctgacggtttaccatgaccagattggccggatcattgatttgaagatcagcgagcagcaggacgagaaagaagagtaa

SEQ ID NO: 2201 - DNA, 1212 bp, Enterobacter cloacae
aattacgaagcatcttcattgagtattccttgccgtgagggtgaattcgcccagaggcgagtactcccctcgttatcggcagatactgtagaaaatatacttttttcgttatcgagtcggcatagaatgaaaacgttgtttcgaaaattcaccgacaagaaaggagacatcatgtcctggcacccttacaccggccgatacgaaaacatgcagtaccgatactgcggcaaaagcggcctgcgcttaccggcactgtcgctgggcctgtggcacagcttcggtcacgttcagccgctcgattcccagcgcgcgctgctgcgtaaggccttcgatctcggcattacccactttgatcttgccaacaactacggcccccctccgggcagcgctgaagagaattttggccgtctgctgcgggaggattttgccgggtatcgtgacgagctgatcatctccaccaaagcgggctacgacatgtggccaggaccgtatggttcgggcggttcacgtaagtacctgctcgccagcctcgaccagagcctgaaccgcatgggtgtggagtatgtggatattttctattctcaccgcgtagacgaaaacacgccgatggaagagaccgccgctgcgctggcacacgcggtgcagagcggaaaagcgctgtatgtcggcatttcgtcttactccacggaacgcacggcggcgatgaccaaattgctgcgcgagtggaagatcccgcttttgatccaccagccgtcttacaacctgcttaaccgctgggtcgacaagaccggcctgctggacgcgctggagaaaaacggaacgggctgtatcgcctttaccccgctggcacagggcctgctcaccggaaaatacctgaacggcattccggacggttcacgtatgcagcgcgaagggaaaaaagtgcgcggcctgacggagaaaatgctgacggaagccaacctgagcagccttcgtctgctgaacgagatggcgcacgcgcgcgggcagacgatggcgcagatggcgctaagctggttgttgaaagatgagcgtgtaacgtcggtactgattggcgcgagccgcccggagcagctggaagagaacgttcaggcgctgaataacctgcgctttagcgaagatgaactgatgcggattgaccagcacgttgcggatggtgagctgaatttgtggcaggcgtcgtcggataaatag

SEQ ID NO: 2202 - DNA, 2424 bp, Enterobacter cloacae
cttcactacgttattcttttatcgcaccacaatattattgttcctgcttttactgctcctcctgttctggttcaggctgatgaatccgtttatgagcatcagatacaacaggcacgtaacggtaattacgctctgtttcttgattacctacagcgctatgagcaacaacatgctttaacacccggacaggttgcggactggttacaggtagcctcctgggcaggacgcgatgacgaagttatccgggtctggcagcgttatggtatttatatgccgctgcccgctcgcgccatcgctgccgtcgcccagtccagaagaaaccaaaaagcctggccatccgccttatcgctgtggaaagaggcgctcagccttgcgccggataacgacgattaccgcatcggctatgtgaagactctggccgatgccagcaaagatcgcctcgcgctttcggaagcccggcagctggttaaagacaatccttctcccgcgcaccttgagacgctctcctatgtctggatgcgccagggaaaaaacagggatcggctgctggctgacatgcgcgcgctgagcgccgcgccagggaatgaggcccttcttcgcgagacgatcgatgcgctaacggataaccgggtaagcacgcccgcactctggctgtcacaaaacgcggcgctctctcctgcggagcgccgtcgccttgagcgtaacgccgcggctgaacgggtacgcctggcggatgtgcctggcagaacggagaaagagcgcctgcggctggcacaaaacgcgttagatcgctatcacgccctgctttcccgctggcaaaacgacccgcaggcggctgaagacgtcatccttgcccgtatcgatcggcttggcgccctgtatgcgcagggtaattaccggcaggtcattagcgaatatgagtcgctgacggccgcacagcatccggtgccggactgggccatcggctgggtgatctctgcatatttgcaggagaaaaacaccgttgccgccttctcgcttgtgcaacgctatccacactacgcctccgatccgcaggatgaggagcatgcgcttttctacgcctggctggatacggggcagtatcaggccgcccgccgctacgttgagcgcgagacccgcagcgttccctggacccgctacgatttcgggtcccccgccgcccagccaaacgatcggtggcttaccgggcagtcactcaaatttaactatttgctggcaaccaacgccctgccggaggccgaaaagctgtcgtatcgtctggcgtcaacggcgccgggaaatcagggattacagattgattatgccgccctgcttcaggccagaggcctgccgcgcgcggccgagcaaaagcttaaacgagcagaggcgctcgaacccacgaatctggagcttgaaaaacagcaggcttacgtcgcaatggaccttcaggagtggcgccagatggatttactggctgataacgtaattgctcgcgcccccgccgatcgcagcgcccgtcgcctggacagactcagaatggtccaccatatgtctgagctgcgtctgaacgcggctaaaggattgcactcagataaccccgtcagcggtagccacgacatgaactgggacgccacgctctatggcccgcccgtggcggataactggcggctgtttgccggcacccgctatgcccaggggaatttcgacgaaggtaaaggcatcagccgccacctgttgggcggcgttgagtggcgcccccgtgacctcacgctcgaagccgagctctccggcaaccgctatcacggcaaaaacaggccgggcgcacggctctcaacaacttacagcctgagtgataactggcaggtcagtggtaacctcgagcgcttgtcacgcgccacacccttacgggcattacgcaatgggattagcgccaaccggggtgaaggtggggtgcgctggtatcaaaacgaacgacgtgaataccagttcaacgccgcaatcagccgcttctcagaccacaaccgccgtcaggaatacaccctctctgggaaagagcgtctctggcagaccccgaccctgacgctggatctcgaaccggggatcgccgccagtaaaaacagcctgcggaatacgctctattacaacccggcacgggatctgtccgtgacggctgccctgtccgttgaccatgagatgtaccgccactacgacaccctctggagccagcagttcgtggcaggcgggggcagctactggcagaaaaatcagtcacctggcgccgttaccctgctgggttacgggcaacgcatccagtggaacaacgttgtcgatactggcgtgatgctgaactgggataagcgcccttacgacggcaaacgcgagagcaatctctccgtcacgttagatgcgactttacgcttttaa

SEQ ID NO: 2203 - DNA, 1434 bp, Enterobacter cloacae
acggcatcaaaaattacggttattaccccgacgacttcctcaacaaccaacctgatatttcgcgtatcaggcctgaattttcttcgtactggtatcctgacaatgactgatcgcattatcgccttctctattttgtgtctggtattcgggttgccgttaggcgtagccgcgctgtttactggcgaactgattctggactttgtctttttctggccgctgtttatgtccgtgctctgggtaaccggcggcctctatttctggtttcagcttgaacggcactggtcgtgggataacgcaacacccgcccccgccttagccggtgagccgttaatctcgattcttattccctgcttcaatgaggaacgcaacgcacgggagaccattagcgccgcgctggatcagcggtactggaatgtagaagttatcgccatcaacgacggttcttctgataacacggcggaggtactgcaacagctggcgcgggagcagccgcgcctgcgggtgattaatctcgcggagaaccaggggaaagccgtggcgctcaaggccggcgctgcggcggcccggggcgatctgttggtctgcattgacggcgacgccctgctcgaccgcgacaccgcggcgtatctggtggcaccgctgattcagtatccccacgttggggccgtcaccggaaatccgcgtattcgcacgcgctcaacgctgattggtcgtattcaggtgggcgagttttcttccattattggcctcatcaagcgaacgcagcggatctatggccgggtctttaccgtctccggcgtcatcgccgcctttcgccgacaggcgctggcggatgtcgggtactggagcccggatatgatcacagaggatatcgacataagctggaagcttcagcttcgccactgggatatctttttcgagccgcgggcactgtgctggatcctgatgccggagacgctaaagggactgtggaaacagcgtctgcgctgggcgcaggggggtgcagaggtgtttctggttaacctgcgcaagatggcccgctgggagcatcatcgcatgtggcccctgtttctcgagtacgccctatcaacgctgtgggcatttgcctatggggcgaccgtggtgttgttcattctcagccatattatccctcttcccgcgaacctggccgttgcgagcctgtttcccccggcgtttaccgggctgctgctgggcgtaatgtgcctgctgcaattcctcgtcagtttgtatatcgagcggcgctacgagcggaaagtggcaggctcgctgttctgggtaatctggttcccgatggtgtactggatgattggcctgtttaccaccctcgtggcatttccgaaagtcatgcttaaacgtaaacgcgcccgcgcgcgctggatcagtccggaccggggtaaagggagcattcaatga

SEQ ID NO: 2204 - DNA, 537 bp, Enterobacter cloacae
gctgtcgtctttcagcaccttgtcggtggcatgaaggtacatcaggtgcagttcgttggtggctttgatcagctcctgctcggcgctttcggtaatggtgaagtactggcagggatcgttgttgataacgtggccgttggcgcgaacgtacgcctgttgcagggcgtcgttttcattgagccattttccgtcgaactggcggttgttcttcaaccgcgcgccgctgattttcagcagttcaccgtcgatctccggctgaggaatactgtgttccgtctcctccgtctggatcatccagccgaggatctcggtatcgttgaacgtgtcatgaagcgtatagcaaccgtcctccacgctcagacgcagctcgcgcgtccactgctgccccatcggcagcggggagtgaataacgttctgctcggcaatgcgcactctgtcatccagcagctgggtaatgacggcgacgtggccggtctcatgaaactcaccgcccttttgccagatgagcagcgcaccggcctgcggcgcgcgttttga

SEQ ID NO: 2205 - DNA, 981 bp, Enterobacter cloacae
ctgacagaggtggcgttatcatacacccgccctgcccattacgctcgcatcgttaaacggttcctgcatctcctgctacactgcctcaacacaacaccaaagaggcaggccaacatgtcagataacacctatcagccaccgaaagtgtgggaatggaaacagaataacggcggcgcgttcgccaatatcaaccgtcccgtctcgggcgcgacgcacgagaaagagctacctgtgggcgcgcacccgctccagctgtactcactcggtacgccgaatggacagaaagttaccatcatgctggaagagctgctggcgctgggcgtgacgggcgcggaatacgacgcatggttgatccgcattggcgagggcgatcagttctccagcggttttgtcgacgtgaacccgaactcgaagatcccggccctgcgtgaccactccaccaccccgccgacgcgcgtctttgaatccggcaatatcctgctctatctggccgagaaatttggtcacttcctgccaaaagatccggcaggacgaacggaaaccctgaactggctgttctggttacagggcgcggccccgttcctcggcggcggttttggccacttctataactacgcgccagtgaagattgagtacgctatcgatcgcttcaccatggaagctaaacgcctgttcgacgtgctggacaaacagctggcgcgcggtcgttacgtagcgggtgaggaatataccattgcggatatggcagtctggccatggtttggctgcgtggcgctgggcagcgtctataacgccgccgagttcctggatgccgggaagtacaccaacgtgcagcgctgggcaaaagatgtggcgaatcgtccggccgtgaaacgcgggcgcattgttaaccgtaccaacggcgagctgaacgagcagttgcatgagcgtcattcagcaagcgacttcgatacccagacggaagataaacgtcagggttga

SEQ ID NO: 2206 - DNA, 281 bp, Enterobacter cloacae
  unsure (180)
  unsure (191)
  unsure (194)
  unsure (199)
cattagacgactttctcggcttcttggcgcctcgtgatgaagaggtgaagggccataagtccatgttcctgggcaacgatccggtaacggatgcctcggttattccggcgctggaccagctcaccggcggcaagaaagacaccaccgtcttcttccgcgcggataaaaccgtcgattatngaaaaacccanttnggggnaatgaaggtaatggacacgctgcatcaggcgggctacctgaagattggtctggtcggcgaagagaaagcggccgcgaagtaa

SEQ ID NO: 2207 - DNA, 531 bp, Enterobacter cloacae
cagaagcagcgagttatacagcgccagagactggccgctttgcgtcagcgtggagagcgcgccagcggtattccactggttgctgctttgggccacggtctggaaaatgcccggcttgccgctgcccgggttttcacctccggggttttcaccaccaggattctcaccgccaggattttcacctccggggttttcaccgccaggattctcaccgccagggttttcgcctccggggttttcaccaccaggattctcaccgccagggttttcgcctccgggattttctcctccaggattctcgccaccggtctctttctgcgcgatggtcagatcgacggcattggtgctttgcttaagcgccacgtcgaggaaggcggatttggagatcgcgccggcgaactcaccgtcaattcccccgtcggaggtcaaaatgcggtagctttggcccgttttatagctggtttgcggatccagcgcggtgacctgtaccttagcctgattgctgatggtggttttgcccgataccagtag

SEQ ID NO: 2208 - DNA, 645 bp, Enterobacter cloacae
aaggaggctcctttgggacagaattatgcgttagtcgttgatgaccatccattggtagcaagcggcatcgccaattttctgattacacattgccagtttaaacaggcgtgtgtggtgacgaatgaggatgattgctaccgacaaattagagatcatggcccgccacgtttgctggtaatcgatttttggctctcttccggaacggccctgaaattactcaaagaagtaaaacaactttacccacaggtacgactcctggtggtcagcggggatgacaataatgatatctggcgcaaagttaatgccgccgggggacacggttttgtattgaaaagcgagccacctgagatgttctcgcgggccgttttcgcgctcactgataatcagacctggtttcctgagggaaacgaaatttccgttaaggccaataatgagaagttaagtaaatttaacttaacgccgcgacaaatagacgtgttaaatatgattaggcgcggcctgccaaataaacgaatcgccgcacagctttcaatttctgagcccacggtcaaagaacacatcagcaatatattgaaaaagataggcgttaacagccgggttgaagccatcacgcttctgcatggcaagcaggaaccgtcggaatga

SEQ ID NO: 2209 - DNA, 528 bp, Enterobacter cloacae
gatatactcagcgctggtttcgtttgcagacaggattttatggaacgcttctttgaaaacgcaatgtatgcctctcgctggctgctcgcacccgtctattttggtctctccctggcgctggtcgccctgacgattaagttctttcaggagatattccacgtcctgccaaacattttctccgtggcagaagccgatttgattctggttctactgtcgctggtagatatgacgttggtgggaggattactggtgatggtgatgttctccggttatgagaatttcgtctctcagcttgatatcgccgagcacaaagaaaagctcagctggctggggaaaatggacgcctcatcgctgaagaataaagtcgcggcgtcgattgttgcaatttcgtctattcacctgttacgcgtctttatggacgcgaaaaacgtcccggataataagctgatgtggtatgtgattatccacctgacgtttgtgctgtcggcgtttgtgatggggtatctggataagatcagtaagaaataa

SEQ ID NO: 2210 - DNA, 1677 bp, Enterobacter cloacae
attttcgaaacaacgttttcattctatgccgactcgataacgaaaaaagtatattttctacagtatctgccgataacgaggggagtactcgcctctgggcgaattcaccctcacggcaaggaatactcaatgaagatgcttcgtaatttcaccatccgtttcgtcatgctgacgatactggggatcttttgtgtcatgtgggcaggcgtggggctttacagcacctggtctctgtctcgtgtttctgatggtaatgacgttgaccgcctgctggtccggcaaatgacggtgctgagccagggcaacgatcagtatttccgtttcgtcacccgcctgagccgggcaatggaagttaaagcggcgggcggcacgccggacctggctcctgctcagcaggcgctggataacatgagtaaaaagctggcagagatgaaagctatctccccgggcccgatggatgaaaaggtgtctgcgcaggtgatttccacctggcaggcgctgctcgatcagggcgttacaccgcagatggcgcaggcgaagcaggcgacgctcgaaggctatcgtcagcatgccaacaacgtcacgccgccgctaagccgtgcattcgggtcagcggctgagaactttaacaataccgcggcgaaggcgctcgacagcacgcgcgtggtggtcgacggcctcaccagcatgacccggacggtaattatcaccgccacgatcgtgggtctgctgatcctgcttttcaccgaccgctacctggtggcgatactggtaaaaccgctggatcgtatccgtcagcagttccgccagattgcgcagggcgacctcagccagccgattgaatctttgggccgcaactgcgtggggcaactggtaccgctgctgagtgcaatgcaggacagcctgcgggaggcggtcagcacgattcgttccggcagcgagaatatctggcgcggggcaacggagatctccagcgggaataacgatctttcttcgcgtaccgaagagcaggccgccgcgctggaagagaccgcggccagcatggagcagcttaccgcaacggtgaagctgaacgccgaaagcgcgcgccaggccagccagcttgcggatgtcgcctccagcacggccagccgcggcgggtcgctggtggaagatgtggttacgaccatgagcggcatttcggacagctcgaaaaaaatcgctgaaatcaccaccgttatcaacagcatcgctttccagactaatattctggcgctgaacgccgcggtggaagccgcccgggccggggagcaggggcgaggctttgcggtcgtggcgggtgaggtacgtaatctggccagccgcagcgcgaatgcggccaaagagatcgaagggctgattgcggattccgttgcccgcgtggagcagggggcgcagctggtgaacgataccggcaccacgatggaagcaatcctgcgcgacgtgacggaagtgaccgtcattatgaagcagatcgccaccgcgtcagaggagcagagcaaaggaatttctcaggtcggcgttgccatcacgcagatggacggcgtgacccagcagaacgcctcgctggtggagcaggtttccgccgccgccgccgcactggaacggcagaccgaagaactccagcgctcagtgcagaaattccgtctcaccgcgtaa

SEQ ID NO: 2211 - DNA, 1872 bp, Enterobacter cloacae
gttggacacatgcgtaaaggaacgttaagcagtgacgcccccttcgggacgttattaggttatgcgccgggtggcgtggcgatttactcttcaaattacggcagtctcgatccgcgtcgctatccggaagacgcggaattccgcagctatatcggcaacgagtacatgggccataaatggcagtgcgttgagtttgcgcgccgtttcctgtttctcaatcacgggtttgtctttaccgacgtcgggatggcgtgggagatcttctccctgcgttttttgcgccaggtggtaaacgacaatattctgccgctacaggcctttgccaatggctcaaaacgcgcgccgcaggccggtgcgctgctcatctggcaaaagggcggtgagtttcatgagaccggccacgtcgccgtcattacccagctgctggatgacagagtgcgcattgccgagcagaacgttattcactccccgctgccgatggggcagcagtggacgcgcgagctgcgtctgagcgtggaggacggttgctatacgcttcatgacacgttcaacgataccgagatcctcggctggatgatccagacggaggagacggaacacagtattcctcagccggagatcgacggtgaactgctgaaaatcagcggcgcgcggttgaagaacaaccgccagttcgacggaaaatggctcaatgaaaacgacgccctgcaacaggcgtacgttcgcgccaacggccacgttatcaacaacgatccctgccagtacttcaccattaccgaaagcgccgagcaggagctgatcaaagccaccaacgaactgcacctgatgtaccttcatgccaccgacaaggtgctgaaagacgacagcttactcgcgcttttcgacatcccaaaaatcctctggccgcgtctgcgcctctcctggcagtggcgtcgccaccatatgatcaccggtcgtatggatttctgcatggatgagcgcggcattaaggtttacgagtacaacgcggattccgcctcctgccataccgagggcgggctgattcttgaagagtgggtgaaaaacggctatcgcggcaccggccacaatccggcggaaggcttgctggaggagctgaccggcgcatggaagcacagccacgcgcggccgttcgtccatatcatgcaggacaacgatattgaagaggattaccacgtgctctttattcagcgctcgctgatccaggccgggtttgaaaccaaaatcctgcatggactgggcgcgctgagctgggatgccgccgggcaactgattgatgatgaaggccgtcacgttaactgcgtatggaaaacctgggcatgggaaacggcgattgagcagatccgcgaggtgagcgaaaccgagtacgccgccgtgcctatccgcaccggtcacccgcaaggtgaagtgcgcctgattgatgtcctgctgcgcccggaagtgctggtctttgaaccgctgtggacggtgataccaggtaacaaggcgatcctgccggtgctgtggcagctcttcccgaaccaccgttacctgctggataccgattttgaggtcaacgatctgctcaaacggaccggttatgccgttaaaccgatcgccggacgctgcgggagcaatatcgatctgatcggcgcccaggacgaactgctggaccagtccagcggcaagtttgttgaccgcaagaatatctaccagcagctatggtgcctgccgaaggttgacggcagatacattcaggtctgcacctttaccgtgggcgggaactatggcggaacctgtctgcgtggggataactcgctggtggtgaagaaagagagcgatattgaaccgctgattgtggtgaaggataactaa

SEQ ID NO: 2212 - DNA, 390 bp, Enterobacter cloacae
accgtccggaatgccgttcaggtattttccggtgagcaggccctgtgccagcggggtaaaggcgatacagcccgttccgtttttctccagcgcgtccagcaggccggtcttgtcgacccagcggttaagcaggttgtaagacggctggtggatcaaaagcgggatcttccactcgcgcagcaatttggtcatcgccgccgtgcgttccgtggagtaagacgaaatgccgacatacagcgcttttccgctctgcaccgcgtgtgccagcgcagcggcggtctcttccatcggcgtgttttcgtctacgcggtgagaatagaaaatatccacatactccacacccatgcggttcaggctctggtcgaggctggcgagcaggtacttacgtga

SEQ ID NO: 2213 - DNA, 1062 bp, Enterobacter cloacae
atgctctacactcacagttcacaccaaaacaggggaaacgcgatgtcgaagataaaaagctacgccgcaccgcaggcgggtgcagaacttgagctgtacgagtacgatgcgggcgaactaaaagcggaagacgtcgaagtacaggttgattactgcgggatctgccactcggatctctcgatgatcgacaatgaatggggcttttccagctatccgctggttgccgggcacgaagtcattggccgcgtcgtggcgctcggcagcgccgcgcaggacaaagggctgaaagtgggccagcgcgtgggtatcggctggacggcacgcagctgcggtcactgcgatgcctgtatcagcggcaaccagatcaactgccttgagggcgcaacgccgaccatccttaacaagggcggtttcgccgataagctgcgcgccgactggcaatgggttatcccactgccggacagcattgatattgaatccgcaggtccgctgctgtgtggcggtatcacagtatttaaaccgctgctgatgcatcacatcaccgccaccagccgcgtcggcgtgatcggtattggcggtctggggcatattgccatcaaactgctgcatgcgatgggctgtgaagtgacggcgttcagctctaacccggcgaaagagcaggaagtgctggcgatgggtgcggataaagtggtgaacagccgcgatcctcaggcactcaccgccctggcaggccagtttgacctgatcatcaacacggtaaacgtcgatctcgactggcagccgtactttgaagccctggcctacggcggtaacttccacaccgtgggtgcggtgatgaagccgctgccggttccggcgtttaccctgatcggcggggatcgcagcgtgtcaggctccgcgaccggtacaccgtacgagctgcgcaagctgatgaagtttgccggacgcacaaaagtggcacccaccaccgagctgtacccgatgtcaaaaatcaacgaagcgatccagcacgtgcgcgacggcaaagcccgctaccgcgtggtgttgaaagcggatttttga

SEQ ID NO: 2214 - DNA, 2880 bp, Enterobacter cloacae
cctgaatacggcaacctggaaataatggaaaagacatataacccacgcgatatcgaacagccgctttacgagcactgggaacagcagggctatttcaagcctaacggcgacgaaagcaaagagtccttctgcatcatgatcccgccgccgaacgtcaccggcagtttgcatatggggcatgctttccagcagaccatcatggataccatgatccgctaccagcgcatgcagggtaaaaacaccctgtggcaggcggggactgaccacgcgggtatcgcgacccagatggtggttgagcgtaaaattgccgctgaagagggtaaaacccgccacgactacggtcgcgacgcgttcatcgacaaaatctggcagtggaaggcagaatccggcggcaccattacccgtcagatgcgccgcctcggcaactccgtggactgggagcgcgagcgcttcaccatggacgaaggcctgtccaacgccgtgaaagaagtcttcgtccgtctgtacaaagaagacctgatttaccgcggcaaacgcctggtcaactgggacccgaaattgcgtaccgccatctctgacctggaagtggaaaaccgcgagtctaaaggctccatgtggcacatccgctatccgctggcagacggtgcaaaaaccgcagacggcaaagattatctggtggtggcgaccacccgtccggaaaccctgctgggcgataccggcgtggccgttaacccggaagatccgcgttataaagatttgatcggcaaattcgtggtgctgccgctggtgaaccgccgtattccgattgtgggcgacgaacacgccgacatggaaaaaggcaccggctgcgtgaaaatcaccccggcgcatgacttcaacgactatgaagtcggtcgtcgtcatcaacttccgatgatcaacattctgaccttcgacggcgatatccgcgaaagcgcagaagtgtatgacaccaaaggcaacgagtccgacgtttattccagcgacatcccggctgagttccagaagctggagcgctttgccgcgcgtaaagccatcgtagccgccgttgacgcgctcggcctgctggaagagattaagcctcacgatctgaccgtgccgtacggcgaccgtggcggcgtagttatcgagccaatgctgaccgaccagtggtacgtgcgtgccgacgtgctggcgaaaccggctgtggaagcggttgagaacggcagcattcagttcgtgccgaagcagtacgaaaacatgtacttctcctggatgcgcgatattcaggactggtgtatttcccgtcagctgtggtggggtcaccgtatcccggcgtggtacgacaacgaaggcaatgtctacgttggccgcaccgaagaggaagtgcgccaggaaaacaacctgggcgctgacgttgccctgcgccaggatgaagacgtgctggatacctggttctcctccgcgctgtggaccttctctaccctcggctggccggaaaacaccgacgcgctgcgtcagttccacccaaccagcgtgatggtctccggcttcgacatcatcttcttctggatcgcccgcatgatcatgatgaccatgcacttcatcaaagacgaagacggcaagccgcaggttccgttccataccgtttacatgaccggcctgatccgcgacgacgaaggccagaagatgtccaaatccaagggtaacgttatcgacccgctggatatggtggacggtatctctctggaagagctgctggaaaaacgtaccggcaatatgatgcagccgcagctggcggagaaaatccgcaagcgtaccgagaagcagttcccgaacgggatcgaatctcacggtaccgacgccctgcgcttcaccctggcggcgctggcctccaccggccgtgacatcaactgggatatgaagcgtctggaaggttaccgtaacttctgtaacaagctgtggaacgccagccgcttcgtgctgatgaacaccgaagatcaggattgcggcttcaatggcggcgagatgaccctctccctggcagaccgctggatcctggcggaatttaaccagacggtgaaagcgttccgcgacgcgctggacagctaccgcttcgacatcgcggcaggcatcctgtacgaattcacctggaaccagttctgcgactggtacctggagctggcgaagccggtcatgaacggtggttctgaagcggaactgcgcggcacgcgtaatacgttgattaccgttctggaaggtctgctgcgccttgcgcacccgatcattccattcatcaccgaaaccatctggcaacgcgtgaaggtgattgccggtattaatcccgataccatcatgctccagccgttcccggcattcgacgccgcgaaagtggatgaagccgcgtctgcggataccgagtggctgaaacaggcgatcgttgcgatacgtaacatccgcgcggaaatgaatatcgctccgggtaaaccactggaactgctgctgcgcggttgcagcgaagctgccgttcgtcgcgtcaccgagaacaacacattcctgaaaaccatggcgcgtctggaaagcatcaccgtgctgcctgccgatgacaaaggtccggtttccgtgaccaaaatcatcgacggcgcggagctgctgatcccgatggcgggcctgatcgacaaagacgcggagctggcgcgtctggcgaaagaagtggcgaaagtcgacgtggaaattggcaaaatcgaaagcaaactggcgaacgagggctttgtggcccgcgcgccggaagcggtcatcgccaaagagcgtgagcgtctggttgccttcgccgatgcgaagaccaaactgatcgagcagcaggcggttatcgcagccctgtaa

SEQ ID NO: 2215 - DNA, 597 bp, Enterobacter cloacae
ggggtatccttcctgaaaactcctcgcttgcactcccctttctgcggtgctattaacagcagttgtgtgtcaatttttgtcatgagtaaagctatgagcgtgattacccccgtcgcgacgacaatgcgtcggatcactaagcaggacaacccggctatcgccgcagttatccgcacggtttctgccgaatatggcctgaccgccgacaaaggctacaccgtggccgaccccaatctggacgaactttttcagctgtacagccagccgggtcatgcctactgggtcattgaacaggacggccaggtcgtgggcggcggcggcattgccccactgctttgcagcgagccggatatctgtgaacttcagaaaatgtatttcctgccaacgatacgcggacaaggcctggcgaaaaagctggcgctggtcgccctggaacatgcacactcacagggctttaaacgttgctacctcgaaaccaccgctttccttaaagaggccattggcctgtatgagcatctgggctttgagcatatcgatgcgccactgggctgcacgggccacgtggactgcgaagtcaggatgctgaaaagtctgtaa

SEQ ID NO: 2216 - DNA, 603 bp, Enterobacter cloacae
ggtaaaacccaaaggcgggaccgggacgtccggtggcgttgcggtcgcagttcatgttcaatcgggcgggttttaccggggaggagtaatgataaacgccggggtggcgtaccgcttacccgggctttgcatttaaatccacgacaagaaaccccatatatgaagaatgcaacgttctaccttctggacaatgacacccatcaggatggcctcagcgccgttgaacagctggtgtgtgaaattgccgcagaacgttggcgcgcaggtaaacgcgtcctgattgcctgtgaagatgagcagcaagcaattcgcctggatgaagcgctatgggcgcgcccgccggagagttttgttccgcataacctgtcgggcgaaggtccacgcggcggggcaccggtggagattgcctggccgcaaaaacgcaacagtagcgcgcgcgatattctcattagcctgcggacagactttgcagattttgccaccgctttcacagaagtggtagactttgtcccttacgaagaatctttgaaacaactggcgcgcgaacgctacaaagcgtaccgcctggccggttttaacctgaatacggcaacctggaaataa

SEQ ID NO: 2217 - DNA, 1572 bp, Enterobacter cloacae
ggaatttacgcagacattttgccgtcaggttgcctatactccacccaggactacgagaggacgtgcatcatgagtacaccattgctaatcgccaggacgctggaaaaagagctgtttttactgcccgcgatggcgaaccgtcatggcctgatcaccggcgcgaccgggacgggaaaaaccgttaccctgcaaaagctggctgagtcgttgtcagagactggcgtgccggtttttatggctgacgtgaagggcgatttaactggggtggctcaggaaggtgcagcgtcagaaaaactgcttgagcgcctgaaaaatatcggtatcacggactggacgccgcacggtaatccggtggtggtctgggatatcttcggcgaaaaagggcatccggtgcgtgccaccgtctccgacctcggcccgctgctgctggctcgtctgcttaacctcaacgacgtgcagtccggggtactgaacattatcttccgtatcgccgacgatcaggggctactgctgctcgacttcaaagatctgcgcgccatcacccagtacattggcgataacgccaaatccttccagaaccagtacggcaatattagcagcgcctcagtgggcgccattcagcgcgggctcctgacgctggagcaacagggcgccgaacacttcttcggcgagccaatgctggatatcaaagactggatgcgtaccgacagcagcggcaaaggcatcatcaacattctgagcgcagagaagctctaccagatgccgaagctttacgccgccagcctgctgtggatgctctctgaactgtacgaacaactgccggaagcaggcgatctggaaaaacccaaactggtgttcttctttgacgaagcgcacctgttgtttaacgacgcgccgcaggtgctgctggataaaattgaacaggttatccgcctgatccgctccaaaggcgtcggggtctggtttgtgtcgcaaaacccgtcggatattccggacaacgtactggggcagttgggtaaccgcgtgcagcacgccctgcgcgcctttacgccgaaagatcagaaagcggtgaaagccgcggcgcaaaccatgcgtgtcaatccggcctttgataccgaaaccgccattcaggcgctgggcaccggtgaagcgctgatttcgttcctcgatgcaaaaggcagcccgacagttgtcgagcgcgcgatggtgattgcgccctgctcgcgcatgggtccggtaacggacgatgaacgcaacggcctgattaaccactccccggtgtacggaaagtatgaagacgaggtggatcgcgaatcggcgttcgagatgctgcaaaaaggggtgcaggcgactgccgaatcgcaggatgcgcctgccgcaaaagggcaatctgttgccgtggacgacggcattctcggcgggctgaaagatattctgttcggcagcaccgggccacgcggcggcaaacgcgatggcgtggttcagaccatggcaaaaagcgcgacgcgtcagattaccaaccagatagtacgcggcatgctgggaagtctgctaggcggccgtcgccggtag

SEQ ID NO: 2218 - DNA, 4503 bp, Enterobacter cloacae
agttcagtgggaagcccgacgagcctggggaggttcactgatatgttgtacgataaatcccttgagaaggataactgtggtttcggcctgatcgcccacatagaaggcgaacctagccacaaggtagtgcgtactgctattcacgcactggcccgtatgcagcaccgtggcgccatccttgccgatggtaaaaccggcgacggttgcggtctgctgctgcaaaaaccggatcgtttcttccgcatcgtggcggaagagcgcggctggcgtttagccaaaaactacgctgtcggtatgctgttcctgaatcaggatccagaaaaagctgccgcgtcacgccgcatcgttgaagaagaacttcagcgtgaaaccctgtcgattgtcggctggcgcgatgtgccaaccaacgaaggggtgctcggtgaaatcgccctctcctcgctgcctcgtattgaacagattttcgtcaacgcgcctgcgggctggcgtccgcgtgatatggaacgccgtctgtttatcgcacgccgccgcattgaaaaacgtcttcaggacgataaagagttctacgtctgtagcctctctaacctggtgaacatctataaaggtctgtgtatgccggctgacctgccgcgcttctatctggacctggcggatctgcgtctggaatcggccatttgcctgttccatcagcgcttctccaccaacaccgttccacgctggccgctggctcagccgttccgctacctggcgcacaacggtgagatcaacaccattaccggcaaccgccagtgggcccgcgcccgtacctataagttccagaccccgctgatcccggacctgcacgatgccgcaccgttcgtcaacgaaaccggctcggactccagctccatggataacatgctggagctgctgctggcgggcgggatggatatcgtgcgcgccatgcgtctgctcgtgccaccggcctggcagaacaacccggatatggaccctgagctgcgcgcgttcttcgactttaactccatgcacatggagccgtgggacggcccggcgggcatcgtgatgtccgacggtcgttttgccgcctgtaacctggaccgtaacggtctgcgtccggcgcgctacgttattactaaagacaagctcatcacctgcgcctctgaagtcgggatctgggattaccagcctgacgaagtggtcgaaaaaggccgcgtcggtccgggcgagctgatggtgatcgacacccgcggtgggcgtattctgcattccgccgaaaccgacaacgatctgaagagccgccatccgtacaaagagtggatggagaaaaacgtgcgtcgtctggtgccgtttgaagatctgtcggacgaagaagtgggcagccgcgagctggacgatgacaccctcgcgagcttccagaagcagtttaactacagcgcggaagaactggactcggttattcgcgttctcggcgaaaacggccaggaagcggtcggctcaatgggtgacgataccccgtttgccgtgctttccagccagccacgcattatttacgactatttccgtcagcagtttgcgcaggtcactaacccgccaatagacccgctgcgcgaagcccacgtcatgtcgctggccaccagcatcggccgtgagatgaacgtattctgtgaagccgaaggccaggcgcaccgtctgacctttaaatcaccgatcctgttgtactccgatttcaaacagctcaccaccatgaccgaggagcactatcgcgccgacacgctcgatatcaccttcgacgtgaccgaaacgagcctcgaagagacggtgaacgcgctgtgcgacaaagccgagcagatggtacgtaacggcaccgttctgctggtgctgtctgaccgcaacatcgcgaaaaaccgtctgccggtgcctgcccccatggcggtgggggctatccagacgcgtctggtggacaagagcctgcgctgtgatgccaacatcatcgttgaaaccgcgagcgcgcgcgacccgcaccactttgcggtgctgttaggctttggcgccacggcgatttatccgtacctggcctacgaaacgctggcacgcctggtagatacccgcgcgatcgataaagactaccgtgctgtgatgctgaactaccgtaacggcatcaacaaaggtctgtacaagatcatgtccaaaatgggcatctcgaccatcgcctcttaccgctgctcgaagctatttgaagcggtcggcctgcataacgaggtcgccaacctctgcttccagggcgtggtcagccgtatcggtggcgccggttttgctgacttccagcaggatctggtgaacctgtcgaaacgcgcctggctggcacgtaagccgctggaacagggcggcctgctgaaatatgtccacgggggtgagtatcacgcttataacccggacgtagtgcgcacgctgcaacaggcggtgcagagcggcgagtacagcgattatcagcagtatgctgagctggtgaacaaccgtcccgcggcgacgctgcgcgatctcattgccctcaatccgggtgaggaagcggtcagcattgacgaggttgaacccgcgtctgagctgttcaaacgcttcgatactgcggcgatgtccatcggcgcgctgagcccggaagcccacgaagcgctggcggaagccatgaacagcatcggcggcaactccaactccggcgaaggcggtgaagatccggcccgctacggcaccaacaaagtgtcccgtatcaagcaggtggcgtccggtcgctttggcgtaacgcctgcgtacctggttaacgccgacgtgatccagattaaggtcgctcagggggcaaaaccgggtgaaggcggtcaactgccgggtgataaagtcaccccgtacatcgctaagcttcgctactcggtaccaggcgtgacgctgatctccccgccgccacaccacgatatttactctatcgaggatctggcgcagctgattttcgacctgaaacaggtcaacccgaaagcgatgatctccgtgaagctggtttccgaaccgggcgttggcaccattgccaccggcgtggcgaaagcctatgcggatctgatcaccatcgccggttacgacggcggcaccggcgcaagcccgctctcctccgtgaaatatgcgggctgtccgtgggagctcggcctggtggaaacccagcaggcgctggtcgctaacggcctgcgtcacaagatccgtttgcaggtggacggtgggctgaaaaccggcctcgacatcatcaaagcggcgattctgggagcggaaagcttcggctttggtaccggcccaatggttgcgctcggctgtaaatacctgcgtatttgccacctgaacaactgtgcaacgggtgttgctacccaggacgaaaagctgcgtaagaaccactatcacggcctgccgttcaaagtgactaactactttgacttcatcgcccgtgaaacccgcgagctgatggcgcagctgggcgtgaagcgtctggtggatctgattggccgtaccaacctgctgaaagagcttgagggcttcacggccaagcagcagaagctggagctgtccaagctgctggaaaccgctcagccgcatcctggcaaagcggtttactgtaccgagaacaacccgccgttcgacaacggcgtgctgaacgcacagctgctgcaacaggcgaagccgtatgtggatgagaagcagagcaaaacgttctggtttgatatccgcaacaccgaccgttccgtgggtgcgtctctctccggttacatcgcgcaaacgcacggtgatcagggtctggcgtcggatcccattaccgcgcatttcagcggtaccgcgggtcagagcttcggcgtgtggaacgcgggtggcgttgagttatacctgaccggtgatgccaacgactacgtcggaaaaggcatggcgggcggtctgctggcggtgcgtcctccggttggttcagccttccgcagccatgaagcaagcatcatcggcaatacctgtctgtacggtgcaaccggcggtcgtctgtttgccgcgggccgtgcgggcgagcgttttgcggtgcgtaactccggcgccatcaccgtggtggaaggcatcggcgataacggctgtgaatacatgacgggcggaattgtgtgcgtcctgggtaaaaccggcgtgaactttggcgcgggcatgacgggcggttttgcctacgtcctggatgaagacggtgagttccgcaaacgcgtgaaccctgagctggtggaagtgctggacgttgatactctggccatccacgaagaacacctgcgcggcttaattaccgaacacgtgcagcataccggttcttcgcgcggcgaagagatcctggccaactggccggcgttctctgcgaaattcgcgctggttaagccgaagtccagcgatgttaaagccctgttgggtcaccgtagtcgtagcgcagcagagctgcgcgtgcaggcgcagtaa

SEQ ID NO: 2219 - DNA, 1428 bp, Enterobacter cloacae
ggaattcagatgagccagaacgtttaccagtttatcgaccttcagcgtgttgatccgccaaagaaaccgctgaagatccgtaaaattgaatttgttgaaatctatgagccgttttcagaaggccaggccaaagcacaggcagaccgctgcctgtcctgcggtaacccttactgcgaatggaagtgtccggtccataactacatcccgaactggctgaagctggccaacgaagggcgtatttttgaagccgccgagctgtctcatcagaccaacaccctgccggaagtgtgcggccgcgtgtgccctcaggatcgtctgtgtgaaggatcctgtacgctgaacgacgagtttggcgcggtgaccatcggcaacatcgaacgctatatcaacgataaagcgttcgagatgggctggcgtccggatatgaccggtgtgcgtcaaaccgacaagcgcgtggcgattatcggcgcgggcccggcaggcctggcctgtgcggacgtgctgacccgtaacggcgtgaaggcggtggtcttcgatcgccacccagagattggcggcctgctgaccttcggtatcccggccttcaagctggagaaagaggtcatgacccgccgccgcgaaatcttcaccggcatgggcattgagttcaaactcaacaccgaagtgggccgcgacgtacagctcgacgacctgctgaaagattacgacgccgtgttcctgggcgtgggaacctatcagtccatgcgcggtggtctggagaacgaagatgcgccaggcgtgtacgacgcgctgccgttcctgattgcgaataccaaacagctaatgggctacggcgagaccgccgatgagccgttcgtcagtatggaaggcaaacgcgtggtggtgctgggcggcggtgataccgcgatggactgcgtgcgtacctccattcgtcagaatgcggcgcatgtcatctgtgcctaccgtcgtgacgaagagaacatgccgggttctaaacgcgaagtgaaaaacgcgcgtgaagagggcgtcgagttccagttcaacatccagcctctgggtattgaagtgaatgccaacggtaaagtgagcggcgtgaagatggcgcgcacggagatgggtgcgccagatgcgaaaggccgtcgtcgcgcggagatcgtggccggttctgaacacgtgatcccggctgatgccgtggtgatggcgtttggtttccgtcctcacagcatggagtggctggcgaagcacagcgtagagctggactctcagggccgcatcattgcgccagaaggcagcgacaacgcgttccagaccagcaacccgaaaatcttcgccggtggcgacatcgttcgtggctctgacctggtggtcacggcgattgccgaaggccgtaaagcggctgaggggatcatgaacttcctcgaagtgtaa

SEQ ID NO: 2220 - DNA, 1665 bp, Enterobacter cloacae
acaaaattttgggaaactatgtccagattcttttttaacgaccgcaaacagcttgtcaacgatgccattgaaggcatacttctctccgcgccgcacggtaatctcgtcaaactggatatcgatccggccatccgcgtggtggctcgcggcgactgggataaaagccgcgtggcggtgatctccggtggcggctccggccatgaaccggcacatgccgggttcgtcggcaaaggcatgcttaccgcagcggtgtgtggcgatctgttcgcctccccaagcgtggatgcggtcctcaatgccattgtggcggtgacgggcgaccgtggctgcctgctgattgtgaaaaactacaccggcgaccggcttaactttggcctggcggcggaaaaagccaaacgctacggcctgaaggtcgagatggttatcgtggcggatgatatcgccctgccggataacaagcagccgcgtggtatcgcgggaacggcgctggtgcataaaattgcgggatatgcggcagagcaggggaaatcgctaaacgacgtgcgggatattgcgcaacaggcctgcgataacctctggagcctgggcgtggcgatgcaaacgtgcaacctgccgggcagcgatgatgaaggggggcgcattaaacaaggccatgtcgagctgggcctgggcattcacggcgagcctggggcttccgtggtggatacgcaaaacagcaaagccattatcgacacgctggtgacgccgttacgcgcgcaggcgggggaagggcgttttgcggtgctgattaacaatcttggtggcgtatcggcgttggagatggcgctgctgaccaaagagctggcgcactcggcgctgaaagagaacattgcgtatctgattggcccggcgccgctggtgagtgcgctggatatgaaaggcttttcgttaacgctgctaaagctcaacgatttcttcgagaaggcgattcacgccgaggtcgagacgctgggctggcagaagccagtggcgttcgcgcccctgcgtaccgtcccacatagcgcccttcatgatcgcgtggaatatgccccgtcggacaatacggaggtgagcgaggccgtcgcctcggtaacgaaaacattgattcagctggaaaaccgccttaacgcgctggatgccaaagtaggcgatggcgacacgggctccacttttgcgcaaggggcgcgggatattacgcagcgacttgaggagaacaacctgccccttaacgacgtgccgacattactcctgctggtaggcgagcggctggcaacggtgatgggcggatcgagtggggtgttgatgtcgatcttcttcacggcggcaggacaaaagcttcacgatggacagccgctacctgaagccttgctgagcggacttgcgcagatgaagcagtatggcggcgcggatctcggcgatcgtacgctgatcgatgcgctgcaaccggcgctggaggcgttacagaaaggcaatattcaggcggcagcgcaggccgcgcagcagggcgccgaagcaacggcaaaaatggcgaaagccggcgcgggacgctcgtcgtatgtgaataaagagaatctggacggggtgatggatccgggggcagtcgcggtggcggaagtgtttaagaccatggtagatgcaaaacggtaa

SEQ ID NO: 2221 - DNA, 1032 bp, Enterobacter cloacae
aagccgtccagggcgattgatccaggtcatcgccgacagaggctaaaaatggcaggcttgtcccctttcttcgggacggtctatcagattatgcagttacagaaattagtcaatatgtttggtggggatcttttgcagcgctacggacaaaaggttcacaaactgacgctgcacggcggctttagctgcccgaaccgcgatggcaccatcgggcgtggtggctgcaccttctgtaacgtggcctcgtttgctgacgaggcccagcagcataaatctatcgctgaacagctcgcccatcaggcgagtctggtgaaccgcgcgaagcagtatctggcctatttccaggcctataccagcacgtgggcggaggtgcaggtgctgcgctcgatgtatcagcaggcggttgctcaagcgaacattgtcgggctgtgcgtggggacgcgtccggactgcgtgccggacgccgtgctggatttacttagcgagtacaaagagaagggctacgagatctggctggagctgggcttgcagaccgcgcatgacaaaaccctgcaccgtatcaatcgcgggcatgatttcgcctgctatcagcgcaccacgcgtctcgcccgccagcgtggattaaaagtctgctcgcatctgattgtcggcttgccgggagaagggcggcagcacgggctggaaacgctggaaaaagtcgttgagaccggcgtggatggcattaagctgcatccgctgcatatcgtgaagggcagcataatggcgaaagcctgggaagcggggcggttatgtggtatcgaactcgacgactatacggtgactgcgggggaaatgattcgccatacgccgccggagattgtttaccaccgcatctcggcaagcgcccgccgtccaacgcttctggcaccgctatggtgtgagaaccgctggacggggatgctggaaatcaaccgctatctacaggagaacggcgtacaggggtcggcgcttggccgcccgtgggttcccccgctaccggcgacggccgcctag

SEQ ID NO: 2222 - DNA, 948 bp, Enterobacter cloacae
cagacttcccagcatgccgcgtactatctggttggtaatctgacgcgtcgcgctttttgccatggtctgaaccacgccatcgcgtttgccgccgcgtggcccggtgctgccgaacagaatatctttcagcccgccgagaatgccgtcgtccacggcaacagattgcccttttgcggcaggcgcatcctgcgattcggcagtcgcctgcacccctttttgcagcatctcgaacgccgattcgcgatccacctcgtcttcatactttccgtacaccggggagtggttaatcaggccgttgcgttcatcgtccgttaccggacccatgcgcgagcagggcgcaatcaccatcgcgcgctcgacaactgtcgggctgccttttgcatcgaggaacgaaatcagcgcttcaccggtgcccagcgcctgaatggcggtttcggtatcaaaggccggattgacacgcatggtttgcgccgcggctttcaccgctttctgatctttcggcgtaaaggcgcgcagggcgtgctgcacgcggttacccaactgccccagtacgttgtccggaatatccgacgggttttgcgacacaaaccagaccccgacgcctttggagcggatcaggcggataacctgttcaattttatccagcagcacctgcggcgcgtcgttaaacaacaggtgcgcttcgtcaaagaagaacaccagtttgggtttttccagatcgcctgcttccggcagttgttcgtacagttcagagagcatccacagcaggctggcggcgtaaagcttcggcatctggtagagcttctctgcgctcagaatgttgatgatgcctttgccgctgctgtcggtacgcatccagtctttgatatccagcattggctcgccgaagaagtgttcggcgccctgttgctccagcgtcaggagcccgcgctgaatggcgcccactga

SEQ ID NO: 2223 - DNA, 675 bp, Enterobacter cloacae
caaatgaaaaaagttgtattggcttctatgcttgtcatgtttgtatcttctgcctttgccgcagacaccgccgtactgaaagtcacaggcgttctgacaaatagcagttgcatccctgaaatcagcggcggtggcgtggtagattacggtacgatccacctgtcagccctgaacaccactgctattaaccagctgggccagaaagatttctctctttctattacctgccctgcgctgaccaaagcgggctttagcgtttctgacgaccgtactggtactgcgccaaacattatggttaaagatggtgcgggtaacggtaacgatattattcagccgctcaatatgtttggtctgaataagaccgcaggaaacgttaacatcggtaactacaccattttcgtgaaaaacgacacgattactgctgatggtgccactgttggggcgatctacagcgcagacaacggcaccagctggtctgataacggcacactgatggttaatgacggtagccagattgtatccgttgctacagttggcagcaccgcgccagttgcgtttaaaaacctggtcattccgatggcggtttctgctgcgattcaggataccaatacgctggctattactgatgataccaacatggatggtcaggcaacgtttaccatcaagtatctgtaa

SEQ ID NO: 2224 - DNA, 540 bp, Enterobacter cloacae
ttacctgggacacaaacatcaagaggatatgagattatgagtaccgctaaactggtgaaaacgaaagcgtctaatctgctttatacccgtaacgatgtatcggatagcgataaaaaagcgaccattgagctgctgaatcgccaggtggtccagttcatcgatctttcgctgatcaccaaacaggctcactggaatatgcgcggtgcaaactttattgccgttcatgaaatgctggatggcttccgcacagcactggtgactcacctggataccatggccgaacgtgccgtacagctgggtggcgtggcactgggtaccacacaggtgatcaacagcaaaacgccattgaaaagctatccgctggatatccataccgttcaggatcacctgaaagagctggcggaccgctacgcgattgtggcgaatgatgttcgtaaagcgattggcgaagccaaagatgaagatactgctgatatcttcactgccgcatcacgcgacctggatcagttcctgtggttcattgagtccaacatcgaataa

SEQ ID NO: 2225 - DNA, 741 bp, Enterobacter cloacae
aagaaggatgaaaatcctgtgattgaatttaaaaacgtttccaagcactttggcccaacccaggtgttgcacaatatcgatttgaacatcaggcagggcgaagtggtggtgatcatcgggccgtccggttccggtaaatccaccctgctgcgctgcattaacaagcttgaggagatcaccagcggcgatttgatcgtcgatggtctgaaggttaacgatccgaaagtggacgagcgcctgatccgccaggaagcgggcatggtgttccagcagttctacctgttcccgcacctcacggcgctggaaaacgtgatgtttggtcctctgcgcgtgcgcggggccagcaaagcggcagcggaagcgctggcaaaagatctgctggcgaaggttggtctggcggagcgtgcccaccactatccttccgagctgtccggcggccagcagcagcgcgtggccattgcccgtgcgctggcggtgaagccaaagatgatgctgttcgatgagccaacgtcggctctcgacccggagctgcgtcacgaagtgctgaaagttatgcaggatctggcggaagaaggcatgacgatggtcatcgttacccacgaaatcggctttgccgaaaaagtggcgtcccgtctgatcttcattgataagggccgcatcgcggaagacggtaatccgcagacgctgattgcgaacccaccaagccagcgccttcaggagttcctgcaacacgtctcctga

SEQ ID NO: 2226 - DNA, 2328 bp, Enterobacter cloacae
  unsure (1615)
ccacacacagagccgggcatgcccggcttttttatgccggattgttcccaaaaactcccctccgctccgcgcgctctatacttatcattttgcacgatatttttgtcggaggacgccgtgccgtggatcctgttgctactgtttagcctgtttagcgcgccatcacttgctgtaacccttcccggcgtcaccaccggagccaccgccagccagcaaaatgcgccgccagagccagacgctgaaaagaaaaaagccgcttacggcgcgcttgccgacgtgcttgagaacgacacgtcacggcaggagctgatcgatcagctgaggaaggtggccgccacgccgcctcaggatccggttccagctgttgcgccgccggaagccgaagaagaaaaaacggtgctggaaaacgtcaccgacatcagtcgccgctacggggaagccctgtcgtcgcgttttgcccagctctatcgcaacctggttggcacctcacataagccttttaatcctcacaccttttccgccgccgccactcagtttgctattctggctggcgccgtcttcattttttactggctgttgcgcctgtctgtctggccgctttaccggaaaatgggacagtggggacgcaaaaagaatcagcataaaagcagctggctgcatcttccggcaatgattaccggggcgtttgtcatcgatttgctgctgctggccctgacgctgtttgtcggtcagctgctggctgaccgccttaatactggaaacaaaaccatcgcgtttcagcagggactgttcctcaatgcgtttgccctgattgagttctttaaagccctcctgcggttgatcttctgcccgcgcgtgccggaccttcgccccttcgccatttcggatcagagcgccaaatactgggcggtgcggcttagcgtgctgagcgggttgatcggttatggcttgttggttgccgtgccgattatttccaaccaggttaacgtgcagttcggggcgctggcgaacgtgctgatcatgctgtgcattaccgtctgggcgctgtacctcatcttccacaataaaaaagcgatcaccgacagcctgctgcacctggccgatcgctccctctcctttttcagcctctttattcgcgcctttgcgctggtgtggcactggctggccagcgcctattttattgtgctctgtttcttctccctgttcgacccgggcaatagcctgaaatttatgatgggggcgacgttcaaaagcctggcgattatcggcattgcggcctttgtctctggcctgctttcccgctggctgtcgaaaacgatcaccctgtcgccgcaggttcagcgtaactacccggaactgcaaaagcgggtgaatggctggatgaccgtatccctgaaggtggcgcgtattctgacggtctgcgtggcaattatgctgctgctgaacgcgtgggggctgtttgatttctggaactggctgcataacggcgcgggggaaaagaccgttgatattcttattcgtatcgcgctgatcctgtttttctccgccgtcggctggacgctgctggcaagccttatcgaaaaccgtctggtgtcggatgtccacggcaggccgntaccgagcgcccgcgcccgcacgctgctaaccctgtgccgcaacgcgctggcggtgatcatcagtaccatcaccatcatgattgtgctgtcggaaatcggcgtgaatattgccccgctgctggcgggtgccggtgcgctggggctggcgatctccttcggttcgcagacgctggtgaaggatattatcaccggcatttttatccagtttgagaacgggatgaataccggggatctggtgaccatcggtccgctcaccggcacggtcgagaggatgtccattcgctccgtcggcgtgcgtcaggataccggcgcgtaccacattattccgtggtcatcgatcaccacctttgccaactttgtgcgcggcattggttcggtggtggcgaattatgatgtcgatcgtcacgaagatgcagataaggcgaagcaggcgctgcgggatgcggtgaacgaactgatggagatggaggatattcgcgggctggtgattggtgaaccatcgttcgcgggcatcgtcgggctgacgaacactgcctttaccctgcgcgtgtcgttcaccacccagccgctgaagcagtggacggtgcgcttcgccctcgacagcatggtgaaaaaacacttcgatctggcgaacgtgagagcgccggtgcagacgtatcaggtattgtcgccgcccgcttcgccgctccctccgcaggagccgacgctgtaa

SEQ ID NO: 2227 - DNA, 300 bp, Enterobacter cloacae
gaggaatcacctgttgtttcccctgaggatgtgattatgaaaaaatatctgacctttattattgcgggtgcgctggcaggcgcatcgttctcagcctggtccgttcaacctctgacagacagcaacgataccagccagctacgtgcggcggggacggtctctgtcagccgggcaagcaaccttgatgaccttcagaacaagctggccgaaaaagcgcgtcaggaaggggctaaaggcttcgtggtgaacgctgccggtggcgataaccatatgtacggcaccgcgaccatctataaataa

SEQ ID NO: 2228 - DNA, 2583 bp, Enterobacter cloacae
acccgttcattaatcgtattacccggtaataaaatcatcatgtacagccataaaaagccgttcacctgccgattttcgtcattgctgatggctatttgttgcctggcaatggcgatctttgcgcagcaggttttggctgatgattattttaaccctgccctgctggacattgataacccgcagcagggaaagaccgatctgtctgtctatgaaaaaggtcccggccaggcaccaggtaaatatcaggtcgcgatctttatcaataacaataaaattgatacccgcgacgtgaccttcaacttagttaaagatccacagggcaccagcacgctccagccttgttttacactggacgaattaaagagcctcgggatcaaaacgcaaaaatatccgcagctgagagcaaaaggtcagtgcgccgatctacacgccatcccttcggcatccgcgacctttcgcgtgcgcaatcagcagctgctgctgagcattccgcaaaaggcgctcggtcaggtacctcgcggttacatcgacccgaaagagtttgacgaagggatcaacgcgggcctgcttaattacagcgtcaacgccagccagagccatgcgcgccagcagggtgaagagaatagcagcagccagtacgttaacctgcgtcccggcttcaacatcggggcatggcgcgttcgtaactactccacctggaatcgcagcaccacgggtcatgaggaggaacagaaattcacctccgtttatacctatgcgcaacgcgatattgtggcgatgaaaagtgacgtgacggtgggccaaagcacctcaccttccgacgtttttgacagcgtcccctataccggcgtggagctaaaatccgacagcgacatgctgccggacagcgagaaaggctatgcccctattattcgcggcagcgcccacagtaacgcgcaggtggtggtacgccagaacggttacatcatttatcagaacacggtcgcccccggcgcgttcgaaattaacgatctctaccccaccggcagcagcggcgatctccaggtcacggtgaaagaaacagacggcagcgaaagccacttcgtggtgccgtttgcctccgtgccggtattgcagcgtgaaaaaaacctgcgctacagcgtaaccgccgggcgttatcgctcttatgacaaagacgttgaaaagaccccgtttgcccagggaagcgccatctacggtttacccttcggcttcacggtctacggcggcgtgcagcagagtaaccattatcagtcacaggcgattggcgccgggaaaaacatgggcgatctgggggcgttctccattgacgtaacccgcgccagagctctgttgaaaaaacagcagtccagcaagggccagtcatggcgcatccgttacagcaaagatttcgccggttcgggcaccaactttacccttgcgggctatcgctataacagcaaagggttttacaccctggacgacaccatggagtcatatacccgctccgacaactggtctgcaccgcagcagcgccgcgcccgaaccgaagccaccatcgaccagacgctgccggaaggctggggatccgtcaccctgagcatggtgaaagagacgtactggagtcagagccagaacatgacctcgatgagcgtcagctacaacaatagctggcacggggtgagctacagcctcagctacagcatgaacaaaaacacccaggacagcgatgaagacggtaacgaggtgacaaacgacaaccagttctcgctgagcgtctcggtgccgctggaccgctggatgcataacacctgggccacctacaacctgaacaacaccaaagacggcacgacgcagaacatcggcctgaacggcacggcgctgaaagaggacaacctgaactggaacatccaggaagggctgagcagcaccggcagcggtaactccaccagcatcaacgccgattacaaagcgacctatggcgaagtgagcgcaggcgtcagtcaggataagtatcagcagaccctgaacgtcggtttgcagggcggcgtggttgcccatgcgaacggaataaccctgagccagccgctcggtgacaccatcgcgctggtgaaagcgccgggcacgcacggaacccatatcacgaaccagacgggcgtcgagaccgacttccgcggctacaccgtcgtgccgtttgttaccgcgtatcgccgcaacaccatcgcgctggataccgaaacgctaccggacaacgccgacgtcacccacgcggcgcagatcgtgacgccaacccgcggggccgtggtgcgcgccagctttaacacccgcgtgggtaaccgcgtcctgatgacgcttacgcaaaagggtaaaccgctgcccttcggcgcaacggtcaccaccgaagataaggacagcgaatttattgtcgggaatgacggccagacctacctctctggtctgccgcagcaagggcatctctacgtttcctggggacagggggcgaacgagcactgcgtcgctgactatgcgctaacggatgagaaagagcaaaccagcatcattaacgctgccgcgcagtgtcactga

SEQ ID NO: 2229 - DNA, 513 bp, Enterobacter cloacae
gtgaccaacatgaaaaagacaatcgcgtttctgacgatgggcttactggcccaggcccacgcagacgatattcagatccagatgacgggaaatatttacgccaatacctgcatcattgacagcgccagccgcaacctgacggtggacttaggccagacggtgtcgggcagttttaaagacgtgggggataccggcgagtggaaagacttttccctgtcagtatcgcactgtcctgccacgctggcgcttgccacggcctttttctatggccaggcagacagcgtgcatccgaccaaatttgccaatatcggcagcgcaaaggggctggcgcttgagctggcagaccggcaggacaaaatactgattgccccgcaggccgcctttaacgccgccatcaatccgagcgaccacacggcaacctttctcctgtccgcgcgctactacgccacctcaatgcccgtcactgccgggacgttcagcagcgtgattcaggtgacattcacttaccagtag

SEQ ID NO: 2230 - DNA, 1224 bp, Enterobacter cloacae
aagcgcaggccgccgacgactcgcagccagacccgaccatggagcaggcgtttatcaccctcatccacgactgggataaggagaatactcatgcgcagtaacgccctctcctggcgccgggtgcgcgccctgtgcgttaaagagacgcggcagatcgtgcgcgatcccagcagctggctgattgcggtggtgatccccctgctgctgctgtttattttcggctacgggattaacctcgactccagcaagctgcgggtcgggattttgctggagcagcagagcgaagaggcgctggacttcacccacgccatgaccggctcgccctacatcgatgccaccatcagcgacaatcggcaggaactgatccagaaaatgcaggccgggaagattcgcggtctgatcgtcattccggtggattttgccgccaacatggcgcgggcgaataccgatgcgccgatccaggtcatcaccgacggcagcgagccaaacaccgcgaactttgtgcagggctacgcggaggggatctggcagctgtggcagatgcagcgcgccgaagaccggggggaggagtttgaaccgctgattgacgtgcagacgcgctactggtttaaccccgccgccatcagccagcactttattattccgggcgcggtaacgattattatgacggtgatcggcgcgattctgacctcgctggtcatcgcccgcgaatgggagcgcggcaccatggaggcgctgctttcaactgaagtgacgcgcgtcgagctgctgctgtgcaagcttattccctactacttcctcggcatgctggcgatgctgctctgcatgctggtgtccgtctttatcctcggcgtgccgtaccgcggctcgctggtggtgctgttctttatcacaagcctgtttttactcagcacgctggggatggggctgctcatctccaccatcacccgcaaccagtttaacgccgcgcaggtggcgctgaacgccgctttcctgccgtcaataatgctctcagggtttatcttccagatagacagtatgcctgccgtcatccgcgccgtgacctacattatcccggcgcgctacttcgtgagcacgctgcaaagcctgttcctggcggggaatattccggtagtgctgattatcaacacgctgtttttaatggcgtcggcggtgatgtttatcgggttgacgtggatgaaaaccaaacggcggttagattaa

SEQ ID NO: 2231 - DNA, 816 bp, Enterobacter cloacae
aattggcacgattttttcattgtgcctgaggttctcgcaggggatcgccccgtggatataaaaggaaatgctatgaagtctgtattaaaagtttcactggctgcacttaccctggcgtttgcggtgtcttcgcaggctgccgacaaactggttgtggcgacggacacggcgttcgtaccgtttgaatttaaacagggtgataaatacgttggttttgacgtggatctgtgggccgctgtcgcaaaagaactcaaactggattacaccctgaagccaatggacttcagcggcattatcccggcactgcaaaccaaaaacgttgacctggcgctggcaggcatcaccattaccgaagagcgtaaaaaggccatcgatttctctgacggctactacaaaagcggcctgctggtgatggtgaaagcggataacaacgatgtgaaaagcgtgaaagatctcgacggtaaagtggtcgccgtgaagagcggcactggctcagttgattacgcgaaagccaacatcaaaaccaaagacctgcgtcagttcccgaacatcgacaacgcttacatggaactgggcaccaatcgcgcggatgcggtgctgcacgatacgcctaacatcctttacttcatcaaaactgccggtaacggcaagttcaaagcggtaggtgattctctggaagctcagcagtacggtattgcattcccgaaaggcagcgacgacctgcgtaacaaagttaacggcgcactgaaaaccctgaaagagaacggcacctataacgaaatctacaaaaaatggttcggtaccgagcctaaataa

SEQ ID NO: 2232 - DNA, 729 bp, Enterobacter cloacae
cgcccggtggcgcttacgcttaccgggcctacgtttttcgtttttcaccacggtatacaggaatacatcatgcagtttgactggagcgccatctggcctgccattccactcttgcttgaaggcgctaaaatgaccctgtggatttcggtcctcggtctggttggcgggttgattatcggtcttgtcgccggtttcgcccgcacctacggtggctggattgcaaatcacatcgcactggttttcatcgaagtgatccgcggcacacccattgtggtgcaggtcatgttcatctacttcgccctgccgatggccttcaccgacctgcgcattgacccgttcagcgccgccgttgtcaccatcatgatcaactccggcgcctacattgcggaaattacccgcggtgcggtgctgtcgattcataaagggttcagtgaagctggcctggcgttaggtctttcccgtcgcgaaaccatccgtcacgtgatcctgccgctggcgctgcgccgcatgctgccgccgctgggtaaccagtggatcatcagcatcaaagacacctcgctgtttattgttatcggcgtggccgagctgacccgtcagggccaggagatcatcgcgggtaacttccgcgccctggaaatctggagtgcggtcgccgttgtctacctgattatcacgcttgtcctgagctttgttctgcgtcgtcttgaaagaaggatgaaaatcctgtga

SEQ ID NO: 2233 - DNA, 582 bp, Enterobacter cloacae
aaacgtccaggcaacgtttttgccagaaacatatcgggatttactatgaacaaggttgcattagggttgtttatcgccgcaacggtgggatgttctgcatctgcatttgcggcaaccaacggtgaagggcagattaatttcaccggagaaattatcgattctgcttgccaggtcgtgaatggattaagtaatccattagatgttcagttgggaaaagtatctaaaacggtatttaccggtgcaggctctaccagcacattaacgaagtttgatattaagttaaccaattgtccggaaaccgtaacctcggcagcgattaacttcggtggtaccccggatgcggataataatgccgcgctggcgttaacgcccgataccgatgcggctaccggtgtggctattcagctggttgacacgtccgggcagcctgtcagcctgtataccccttcgaagcaatatcctttagcctccggcacggcggttaacgatctggagttcggtgcgcgttatattcaaacccaggcggcagtcaccgcgggccctgctaactctgtatcaaccttcaccgttatttataactga

SEQ ID NO: 2234 - DNA, 684 bp, Enterobacter cloacae
gaaatctttatgcgccacggttatttactgagcattcttttactggtagcagcctcggcacaggcgggggtcgtgattaatggcacccggctggtctatcagggagataaaaaggaatcatctctcggtctttcaaacccggataccacggattatctggtgcagtcctgggtcgattctggcggtaaaaaccaagccaaagccccgttcctgatcaccccgccgctttttcgactggatgcgaaagaggataacgtcctgcgcgtagtccgtacgggaggaaatttaccggaagacagggaatctctgtactggctgaatattaaagcgatcccgtcctcgaagcatgtcgaaggggtaaatacgctgcaaattgccattaatacccgcattaaattgctctatcgcccgtcagcggtaaaaggcagaccagaagatgtggccgataaacttgaatggcatcgcgaagggaatgatttagtggtgaataatcccacacctttctttatgaattttcagaccgtcaccctgaatggacagaaagtcaaaaaagccacctgggctgtgccgaaaactgaaacgcattttgctttacctggcaacgtcggaggttctaccgtcgcgtattccattattaccgattacggcagcatcagtcagacatggtctaaacccgttcattaa

SEQ ID NO: 2235 - DNA, 1065 bp, Enterobacter cloacae
cggatgagaaagagcaaaccagcatcattaacgctgccgcgcagtgtcactgatccaccgttcaggctaacgattatgcaaatgattaaacagtgctttttcttactggttctgggaaccgccgcgttatttatgccgcatgcgaaggcgacctgcaccacgccggatctgcccaaaatgattaacatggcctccatttctgtcccgacgacgctggcggttggtgcaaccattccgggtacagagcagagcgttcatgttgccgggcactgcgatcagagtatcgacagcggactggaaattgtctcgtgttactacggtaccggagcggaaattccggggctgaagggagtatacgaatccggcgtaccgggtgtcggggtcgcattgatgaacgatcagggtcagcgaatcagcggagcaggcggagtacagtgcgattcacgcggaacgcctgttggctatgtttctggcgatggcacacagtcgtttaactttgacgtcacgcttgaactggtcaaaacaagcgacgccgtgacctccggcacgctggtgcagtctcagaccgaattcggcattggcgttttcggtcacgaagggatcggcagccctaaccatattgcgtatgcaggtaacgtcattttgcatcaggtcacctgctctgtttcgccaaaaaatctcaccgttaatttgggtgattttcccgtcagtgattttatgagcgtgggttttttatccagccccgctcaaacgtttaatatcaccgttaactgtgacacaaccgttcagcctgagctaaaaatcaccagtgctaacagctacgagacggcattcgagggggtgatcaaactgacgaagcagacaggcatggcaacgggcgtcggggtgagaatgctgtttgatgaccgcattgcgacctttgatacctacgtcaacactcaaagccaggccgttgccaatgaaacgctggagatcccctttcaggttcgctacgagcagatcagcgatgtggtgacgcccggccccgccaacaccgtagcaaccatcactctcgcctataagtga

SEQ ID NO: 2236 - DNA, 1035 bp, Enterobacter cloacae
tctgatcctgcaaggcttaacgcaaaggagccagaagtcatgaaaaaacctgtcgccatcattctggtggttgttgtcttgcttgccgcgggaacaggcggctggctgtggtatcagagccagcaggatcgtggcctgacgctgtatggcaacgtggatatccgcaccgtgaacatgagcttccgcgttggcggacggctggcctcgctgaacgttgacgaaggcgatgccatcaaagccgggcagacgctggggatgctggacaaagccccgtttgagaacgcgctgatgcaggcaaaagcaggcgtctccgtcgcacaggcgcaatacgacctgatgctggcgggctatcgtgacgaagagatctcccaggcggccgctgccgttaagcaggcaaaagccgcctatgactatgcgcagaatttttataaccgtcagcaaggcttatggaaaagccgtactatttccgccaacgacctggaaaatgcgcgctcatcccgcgaccaggcacaggcgacgctgaaatctgcccaggataagctaagccagtaccgcaccggtaaccgtgcgcaggacattgcccaggcgaaggccagccttgagcaggcgcaggcgcagttagcccaggcggagctggatctgcacgacaccacgttaatcgccccgtctgacggcacgctgatgacccgcgccgtggagccgggcagcatgctcagcgcgggcagcaccgtgttaacgctctccttaactcgtccggtgtgggtgcgcgcttacattgatgagccgaatcttggccagatgcagccgggccgcgaactgctgctctataccgacggtcgcccggacaagccttatcacggcaaagtgggcttcgtctcccctaccgccgagttcacgccaaaaaccgttgaaaccccggacctgcgtaccgacctggtgtatcgcctgcgcatcatcgtcaccgatgcggacgacgcgctgcgtcagggcatgcctgttaccgtgaccttaaacgacggggaacgacatgaatga

SEQ ID NO: 2237 - DNA, 285 bp, Enterobacter cloacae
acagatcaggagaacatgatggcttccggctgggcgaatgacgacgccgttaacgaacagatcaacagtactattgaagatgcggtcgcgcgtgctcgcggtgaaattccacgcggcgaaagtttgacggaatgcgaagagtgcggagatccgattcctgaggcacggcgtaaagccattcctggcgtacggctatgtattgcctgtcagcaggagaaagattcgaaaaatgcgacacattcaggatataatcgcagaggatcgaaagacagccagttacgttga

SEQ ID NO: 2238 - DNA, 264 bp, Enterobacter cloacae
cctatgaaaaccatcaaatatgctgttgccgctgttgccctgtccgctctctctttcggcgctttcgccgtagagccagtctcctctactcaggcacaggatctgaacaaaatcggggtggtgagtgctgaaggcgcgaccacgctggacggtctggaagccaaactggcggaaaaagcagccgctgccggcgcaagtggatacaccatcacgtccactaacggtaataacaaactgagcggtactgcggttatctacaagtaa

SEQ ID NO: 2239 - DNA, 696 bp, Enterobacter cloacae
ttaatttttaatgctgctatgaatacaaccccagcgacaaccaaaggcgaacaggcgaaaagtcagcttatcgccgccgcgctggcgcagtttggcgagtatggtctgcatgccaccacgcgggatatcgccgctcaggccgggcagaatattgcggccatcacctactattttggctcaaaagaggattcatacctcgcctgcgcccagtggatcgcggattttatcggcaccagctttcgcccgcacgtggaagaagccaccgcgctgttcagccagccagagcctgaccgggctgccatccgccagctgatccttaacgcctgtcacaacatgatccgcctgctgacgcacgacgatacgctgaacctgagcaaatttatctcccgcgagcagctctcccccactgccgcgtaccagctggtgcacgatcaggtgatcgccccgatgcacagccatctgacccggctgatcgccgcctataccggacgggacgccagcgataccgacaccattttgcatacccacgccctgctgggcgaagtgctcgccttccgtctggggcgtgagaccatcctgttacgtacgggctggacacaattcgatgaggataaagccgcgcaaattagccaggtcattacctgtcacgttgatctgatcctgcaaggcttaacgcaaaggagccagaagtcatga

SEQ ID NO: 2240 - DNA, 1755 bp, Enterobacter cloacae
acgacggggaacgacatgaatgacgcggttatccagctcaacaatctggtcaaacgcttcccgggaatggctaaaccggcggtcgcaccgctgaattgtacgattcagaaaggctatgtgaccgggctggtggggccggacggcgcgggtaaaaccacgctgatgcggatgctggcgggattgctgaagccggatgaaggcagtgccagcgtgcttggactcaatccgatcaaagacgacgcggcgctccacggcatactcggctatatgccgcagaagtttggtctgtacgaagacctgacggtgatggaaaacctcaacctgtacgccgacctgcgcagcgtcaccggcgaaacccgggagaaaaccttcgcccgcctcctggaatttacctcgctcggcccgttcaccgaccggctggcgggcaagctctccggcgggatgaagcagaaactggggctggcctgcacgctggtgggcgaaccgaaggtgctgttgctggatgaacccggcgtcggcgtggacccgatttcccgccgtgaactgtggcagatggtgcacgagctggcgggtgacggcatgctgatcctctggagtacctcataccttgatgaagcagaacagtgccgcgacgtgctgctgatgaatgaaggcgaactgctctatcagggcgaacccaccgagctgacgcaaaccatggccgggcgaagttttctgctgcacagcgcgcaggaatccaaccgcacgctgctgcaacgggtgctgaagctgccccaggtgagcgacgggatgattcagggccgttcggtgcgcgtgatcctcaaaaaagaggccaccgccgacgatatccggcgtgcgcaggggatgcctgagatcgacatgacagagacctcgccgcgctttgaagatgcgtttattgatctgctgggcggggcgggaacctcagaatcaccgcttggcgccattctgcacacggtggaaggtacgccgggcgaaacggtcattgaagcgaaatcgctcaccaaaaaattcggcgatttcgccgccaccgataacgtcaattttgccgtgaagcgcggcgagatatttggcctgctcgggccgaacggcgcaggaaaatccaccacctttaaaatgatgtgcggtctgctggtaccgacgtccggcaaagcgctggtgctgaacatggatctcaaagtcagctccggcaaggcgcgccagcacctgggctatatggcgcagaagttttcgctctacggcaacctgacggtggagcaaaatctgcgatttttctccggcgtctatggcctgcggggacgggcgcagaaccagaagatcggccgcatgtgcgacgccttcggcctgaccgatatcgcctcgcaggcgaccgacgcgctgccgcttggcttcaaacagcggctggcgctggcctgctcgttgatgcacgagccggatatcctgtttcttgatgaacctacgtcaggcgtggatcccctcacccgccgtgaattctggttgcatatcaatagcatggtggaaaaaggcgtgaccgtgatggtcaccacccactttatggacgaggcggagtattgcgaccgtatcgggctggtctatcgcggcaagctgattgcccacggcacgccggatgacctgaaagcgcaggccgccgacgactcgcagccagacccgaccatggagcaggcgtttatcaccctcatccacgactgggataaggagaatactcatgcgcagtaa

SEQ ID NO: 2241 - DNA, 1407 bp, Enterobacter cloacae
tggtcggggcggttcggagtttttatgtcttttgattcccttggtctgaacccggaaattctgcgcgccatcgcagagcaggggtacgttgagccaacccctatccagcagcaggccataccggccgttttgcagggccgtgacctgatggcaagcgcgcagaccggtaccggtaagaccgcgggctttaccctgccgctgctggagctgttggtaaaaaaccagccgcacgccaaaggccgtcgtccggtgcgtgcgctgatcctcaccccaacccgcgagctggcggcccagattggcgagaacgtgcgtgaatacagccgctacctcaacattcgttcgctggtagttttcggcggggtaagcattaacccgcagatgatgaagctgcgcggcggcgtggacgtgctggtggcaacaccggggcgtctgctggatctggaacaccagaacgcggtgaagctcgataacatcgaaatcctggtgctggacgaagccgaccgtatgctggacatgggcttcatccacgacattcgccgcgtgctggcgaagctgccgacgcgtcgtcagaacctgctcttctccgcgaccttctccgacgagatcaaggcgctggcggaaaagctgctgcataacccgctggaagtggaagtcgcgcgccgcaacaccgcctccgagcaggtgacgcagcacgttcactttgtggataagaagcgcaagcgggaactgctctcccagatgatcggtcagggcaactggcagcaggtgctggtctttacccgcaccaagcacggcgccaaccacctggcggaacagctgaataaagacggcatccgcagcgcggcgatccacggcaacaagagccagggcgcgcgtacccgtgcgctggcggactttaaatctggcgacattcgcgtgctggtggcaaccgacatcgccgcacgcggtctggatatcgaagagctgccgcacgtggtgaactacgagctgccaaacgtgccggaagattacgttcaccgtatcggccgtaccggccgtgcggcggcaaccggggaagcgctctctctggtttgcgtggatgaacacaagcttctacgcgacattgaacgcctgctgaagaaagagatcccgcgcattgaaaccccgggctatgaagtggacccgtcgatcaaagccgagccaattcagaacggtcgtcagggtggcggacgcggtcagggcggcggtggtcgcggtcagcagccgcgtcgttcagaaggtggcgcgccgaaatcttcgggcaaaccgccgcgtcgtaataacgacagcaaaccagccggtggaaacccgtggcgtagcggcgaagggaaaccggcaggcgaggggcagcgccgacgccgcccgcgtaaacctgctaacccgcagtaa

SEQ ID NO: 2242 - DNA, 309 bp, Enterobacter cloacae
accagcccgatacggtcgcaatactccgcctcgtccataaagtgggtggtgaccatcacggtcacgcctttttccaccatgctattgatatgcaaccagaattcacggcgggtgaggggatccacgcctgacgtaggttcatcaagaaacaggatatccggctcgtgcatcaacgagcaggccagcgccagccgctgtttgaagccaagcggcagcgcgtcggtcgcctgcgaggcgatatcggtcaggccgaaggcgtcgcacatgcggccgatcttctggttctgcgcccgtccccgcaggccatag

SEQ ID NO: 2243 - DNA, 435 bp, Enterobacter cloacae
cccaggtgctggcgcgccttgccggagctgactttgagatccatgttcagcaccagcgctttgccggacgtcggtaccagcagaccgcacatcattttaaaggtggtggattttcctgcgccgttcggcccgagcaggccaaatatctcgccgcgcttcacggcaaaattgacgttatcggtggcggcgaaatcgccgaattttttggtgagcgatttcgcttcaatgaccgtttcgcccggcgtaccttccaccgtgtgcagaatggcgccaagcggtgattctgaggttcccgccccgcccagcagatcaataaacgcatcttcaaagcgcggcgaggtctctgtcatgtcgatctcaggcatcccctgcgcacgccggatatcgtcggcggtggcctcttttttgaggatcacgcgcaccgaacggccctga

SEQ ID NO: 2244 - DNA, 2256 bp, Enterobacter cloacae
agccgggcttttctttttgcggcagcggagagaaagtgccacaatagtggctgtttatacagtatttcaggttttccgatggctttaaccgctgcgctgaaagcgcaaataggcgcctggtataaggcgctacagcagcagatccccgattttatcccccgagcgccgcagcggcagatgattgccgacgtggcaaaaacgctcgccggggacgacgggcgacatctggcgattgaagccccgaccggcgtcgggaaaaccctgtcgtatctcattcccggcatcgccatcgcgcgggaggaggacaaaacgctggtggtcagcaccgccaacgtggccttgcaggatcagctcttcagcaaagatttgccgctgctgcgcaaaattatccccgatttacgcttcaccgccgcctttggtcgcgggcgctacgtctgcccgcgcaatctggcggcgctggccagcagtgaacccgcccagcaggatctgctcgcgtttcttgatgacgagctgacgccaaataacaaggcggagcaggagcagtgcgcaaagctgaaggccgatctcgacagctacaggtgggacggcctgcgggatcacaccagccaggcgatcggcgacgacctgtggcgcaggctcagcaccgataaagcgagctgcctgaaccgcaactgtcactactaccgcgaatgccctttctttgttgcccggcgtgagattcaggaagcggaggtggttgtcgccaaccatgcgctggtgatggccgcactggagagtgaagcggtcctgccggagcccaaaaacctgctgctggtgctcgatgaaggtcatcatctgcccgacgtggcgcgggatgcgctggagatgagcgcggaaattaccgccccgtggtttcgcctgcaactggatctgttctgtaagctggtggcaacttgcatggagcagttccgcccgaaaaccacgccgccgctggcagttccggagcggttgagcgagcactgtgaagaggtgtacggcctcatcgcctcgctgaataacattcttaacctgtatctccccgccacccaggaggcggaacaccgctttgcgatgggggagttgccgcaggaagtgatggaaatttgtcagcagctggcgaagcaccttgaaaagctgcgcgggctggcggagatgttcttaaacgatctcagcgagaaaaccggtacccatgacgtggtgcgtttgcaccgcattctgctgcaaatgaaccgtgcgttgggcatgtttgaggcgcagagcaaactctggcggctggcctcaatggcgcaggcgtccggcgcgccggtgacaaagtgggccacccgcgaagtgcgagacgggcaggtacatcttttcttccactgcgtgggcatccgcgtggccgatcagctggaaaagctgatctggcgcagcgtgccgcacgtggtagtgacatcggcgaccctgcgttcactgaacagcttctcaaggttgcaggaaatgagcggcctgaaagagaaagcgggggaccgttttgtggccctggactcgccgttcaaccactgtgagcagggcaagctggtgatcccgcgcatgaactatgagccgcttatcgataacgaagagcagcatattgcggaaatggcggcctacttccgcgagcaggttgagagtaaaaaataccccggtatgctggtgctgtttgccagcggccgcgcgatgcaacgcttcctggagcacgtcaccgatctgcgcttgctcctgctggtgcagggcgatcagccgcgttatcggctggtggaaacccaccgtaaacgcattgataacggcgagcgcagcgtgctggtggggttacagtcctttgcggaagggcttgatttgaaaggtgactacctgacgcaggtgcatatccataaaattgccttcccgcccatcgacagcccggtggtgatcaccgaaggcgaatggctgaaaagcctgaaccgttatccgtttgaagtgcaaagcctgcctgcggcgtcgtttaaccttattcagcaggtcgggcgcttgatccgtagccacggctgctggggcgaggtggtgatttatgacaaacgactgctcaccaaaaactacggccaacggctgctgaatgcgctgccgatcttcccgattgagcagccagaagtgccggaggtaaaaaaacgcccggcaaaaccctctgccgggcgtacaaaaagcatccgtgcaaagaggcgcggtcctactggtaagtga

SEQ ID NO: 2245 - DNA, 996 bp, Enterobacter cloacae
caagatgatgctgtcaggagaaatgtcgtggattaccgcaaaattatcaaagaggtagggcgtgggaaaaaccatgctcgcgatctggaccaggaaacggcccgtgcgttgtacacgcatatgctgaatggcgacgtgccggagctggaaatgggcggcattctgattgcgctgcgcatcaaaggggaaggtgaggcggagatgcggggtttttatgaggccatgcagtcgcagacgatgcgtttaaccccgcccgtcacgaagccgatgccgatgccgatagtgatcccgacctacaatggcgcgcgtaagcaggcaaacctcacgccgctgctggctattctgttgcagaaactcggtttcccggtggtggtgcatggcgtgagcgaagatccaacgcgcgtgctgacagaaaccattctggaattattaggcatcgaacctactctccatgctggccaggcgcaggccaaactggaggggaaccagccggtctatattcccgtgcgcgcgctctgcccgccgctggaaaagcagctggacatgcgatggcgaatgggagtacgtaacagcgcccacaccctggcgaagctggcgacgccgtttgccgaagacgccgcgctacgtctttccagcgtctcccatccggagtacgtgacgcgggtcggacaattttttgccgaaatcggcgggcgggcgctgctgatgcacgggacggaaggggaggtttatgccaacccgcagcgttgtccacagctgatgctgattgagcctgccgggacgcgggtcgtactggaacgtggggaggagaactgcgatgtgatcttgcccgagtcaaaagatccgcaggtcaccgcgcactggatcgtacagtgtctggccggaaaggtgccggttccgcagtcgatcaagctgcaaatggcctgctgcctgctggcggcaggggaagtggcatccgtggaagccggattgcagcgcgtggcacagtcgttttaa

SEQ ID NO: 2246 - DNA, 1026 bp, Enterobacter cloacae
cagatcatagacatacaggtcgctgatttttgtcgtttttttgtgcgtctcagacagttatttacccccgcgccgtcacagggtatcttacgcggctgtttaaaggagaatgccatgacttcccaaaagccgggattgcacccgcgtaaccgccaccgtagccgctacgacatgaaagccctgtgcctgagctgccccgaattgcaggattttattgttcagacaccagccggtgaaccgtcggtaaactttgccgatccgctggcggttaagacgctgaacaaagcgctgctggcccatttttatggcgttacgcactgggacatcccggatggctttctctgcccaccggtgccaggacgtgcggattacgtccatcatcttgccgatctgctggcggatgacaatggcggcgtggtgccaaaacaggccaccgtgcttgatatcggtacgggcgcgaacctgatctaccccctgataggcgcacatgaatatcagtggcggtttaccggtagcgagatcggtgccgaggccttcgccagcgcgcaggccattatcaacgctaacccggggttaagccgggccgttcgtctgcgtcgtcagaaggatgccgctgctattttcaacggcattattcataagaacgaacaatatgatgccaccctgtgcaacccgccattccacgactccgccgcctccgctcgtgcgggaagtgaacgcaagcggcgtaacctgggccaggctgaagatggcgcgctgaactttggcggccagcagcaggagctgtggtgcgagggcggggaagtggcatttattctgcgcatgattaccgagagtaagggcttcggtcgtcaggtgaaatggtttaccacgctggtctcccgtggcgataacctgccgccgctttaccgcgcgctgaccgacgtcggcgcggtgaaagtggttaaaaaagagatggcgcagggccagaagcagagccgctttattgcctggtcctttatggacgataacaaacgccgcaaataa

SEQ ID NO: 2247 - DNA, 444 bp, Enterobacter cloacae
ggtacgtaccttatcatacgaagacctcaaattgaaacgccctcgccaggtactcgcaataccggacgagagctaaccacaccaactatcaaggagttgattatggctgattcgcattctaccccagacaccgaccaatccggaaccgagcgttcgttaattgtgggataccgcccgaatgttttcgacaaatctacgccgaaaatcatcctttccggcaagtggctgcgcgcggcggggtttgataccggacagcaggtcacggtaaaggtcatgaaaggatgcatcgttctggtggcgtataacgagcaggagcagaggttgcaggatgattataaacggacgaaagcaaagcttattgagatagagaaagcgcttgcagcgatccaaattccacatgctggaaagcgcctcgcaaaatcaaatacaaaccatctggcttaa

SEQ ID NO: 2248 - DNA, 735 bp, Enterobacter cloacae
attaattcagattacctctttattggccgacgtatagtaggcctacactatgcaatacgtcattgcttcgagaatactggcgataaccttataaataattcgcctgattactattataaatcgaggaataacatgacgaacaatagccaaataacacagcatataactgttgcactgatgggcggcgatcattatgcaagaaacggcattaaaacattattaagcagcatccgcgacgaccttcacatcattatcatcgaaggaggttatcagcaactggataaggcgctgtcgtcgattcgtatcgatatcttatttatatctggcgcagagaaataccatacagggtatgactcactgaaatatttaaaaaaaatcaaagccacgcagcctgaagtgatgatctgcctgtactcaacctctgcccattccctgttatgggtccgggaagatattgatgcctatatctcgctacagaacacggtttatcagtggcggataaagctagcaaaaatggtcgatagccattatcggccccaaaagcagccagcggcgttatcgctgacgcctggagaaaggagggtattaaaggaactcaggaacggactggatatacgttacatcgcagaactggagaaactttcttatcgccgcgtgagcgccttaaaaagctcagcgataaggaaactcgggctcaggaataagacagatttgctggtctttttaaccagttag

SEQ ID NO: 2249 - DNA, 771 bp, Enterobacter cloacae
tgccagcgcggtcgccacctacaccgtgacctattcgtaatcttcaggcccggtctgctggccgggtctgactcagctttcaggagacgcacaatgcgcgtaaacacatggatttgtctggctggcacgttatgttcatccgccgtgtacgcaggcggcgtggggttaggcgcaacgcggctggtctacgcaggcgcggctacgcagacgatgatgcaggtaagaaatacccaccctgatgccacgttcctgatccagtcatggatggaagacgagaaagggagccgtaccaacgacttcgtcatcacgccgccgctgtacgtcatgaagcccgccagcgaaagcgcggtgaaaatcatgttcagcggcaacgccctgccatccgatcgcgagacgctgtactggatgacggtcaaagctatcccacagcaggttaaaaacggttccggcaattcgctgcaattcgcctctgccaaccgcatcaaggtcttttatcgcccggagcggctcagggaaggtgcaggggaggcatggaaaaaccttgccggcgcctaccgcgcgggcaaggtcacgctgaccaacccaacgccgtattacctcaccaccattaacgtgaaaattgatggcaggccggtatcgcccgtcatggtaccgccgaaagccagcgtgacgctggcagacaccttcagccatgcgagcagcatgagctaccagacgattaacgattatggggcctggacgcccgtcacccgcacgtcattgtcccaataa

SEQ ID NO: 2250 - DNA, 1110 bp, Enterobacter cloacae
cagcgtaaaaatgaccttctatgcgcgactggccgccacgggtgcgccggtcaatgccggagacgtttcggcagtggcgacctggacgacggagtatcaataatgcgtttactgtttttagccctgtttttcatgtcctctcaggcgcttgccctctcctggacatcggatatcaccctttcgccaacgcccatgtcgtggtccggcccggcagactccatcgtgcctggaaagacgatcggctctgaatggagcgcctctgcgagcgtctcggaagtgttctggtgcggcctggtatttacctgctccaaagggacgctggagccgagcagcagtataaccgccaccggcatcacggttattcttgatggcgcaaattacatggtatttgaaacgggcgtgcccggcatcggcttcattcttgggctcaaagattataacggcaccacctatgtgccgatgcagacgggcattacgcagagctatccggccgatgggactaacggttacgccaccgcactgggctggtcggcaaaagtgacgtttatcaagaccggcgttccgctgaaatccggcgtataccagaccccgaccattaactcggcgatcctgacggcctataacaacgaagtgaaaaccgcgcaggtgatcatcaaccccaccaccatcacggtgacggcaagcggctgcacggtaggcacaaaaagcgccaacgtcgacctgggcaccattgatgttcacacactgcccagcgtaggcagcacctcgccgtcgggggagtttaacgtcagcctgacctgcgatgagaacgtggcggttaatgcagtgatgaccgatcagaccacaccgtcaaatacctcgtcggtcgtgacgctgaccggggactccacggcctccggcattggcgtgcagtttttctataacggtaccgggccgctgatgatggggccagacagctcggccgcaggcacgacgggacagtttttcatccagaccaccagcgcagcacaaacgctgtcgctgccgttccaggcgcagtacatccgaaccggagacctggtccccggctcggccaatgccctggcaagcatcaccttttcgtatcagtag

SEQ ID NO: 2251 - DNA, 1209 bp, Enterobacter cloacae
cccacagaggcccaaagctgtaccccgtttagacgacaccctcactgtcgtcttttttttgcacccagcgtaaaatactgtaattctgtacaggttaagcgtgcacagcggagtaacccgatgatcaaaaatctgcatattcaaaactaccgctcaattcgcgatatgtcgcttgagctggaacagctcaatatcgtgttcggccccaacggcaccggaaaatccaatatttataaagcgatttacctgatgcacagcgcggcgcaggggcaattctcccaggcgctggcaaacgagggcggcattttgaaagtgttctgggcgggcaaaacccgcagcgatcaactgcggcgcatgaacctggcggtggaaacggaaacctatgaatatgagcttcaggtcgggttcgtggaaaagctgccctacccctcacagtttcagctcgatccggtgatcaaagaggaatctatctggctgagcggccagcaccgtcgtccgtcgtcacagctgatgaagcgtaagaaccaggccgtattcctgaacaacgtacatcacgaaaaagtgacccacagcggtacgctgtatgagaacgagtcggtgttcgggcagctcggcgaaccgcacctctaccccgaagtgtcgcagatgcgcgagtccctgcgtaactggcgcttttatcatgagttttccgtttcatccggctcggcgatccgcgcgccgcaggtgggtttccgctccccggtgctggccagcgacggcgcgaacctggccgccgcgtttcagaccattgtcgaaattggcgacgagctgctgctgatgcgcattctcgaccaggccttccccggctgcgtgttttacagcgacaacaccggcgggcgcttccgcatgatgatgcagcgcgaggggctgagcagaccgctggaaccggcagagttctccgacggcacgctgcgttttttatgcctggcggtggcgctgttaagcccgcgccctcccgcatttatcgccctcaacgaaccggaaaacagcctgcatccgcagatgctgcccgccctggcaagcctcattgccgaggccagccgctattcgcagatctggctcaccagccactcgccggagctggcgcatttgattgagaagcaccgatcgttttcgctgtatcagctgttgatggcggagggggagacacggatggagcggctggggtaa

SEQ ID NO: 2252 - DNA, 498 bp, Enterobacter cloacae
aaggagattgagatggctatacctgtttacttatggcttgaggacgatgcaggccggaagattaatggatctgtcgatataaaggatcgcgaaggctcaatagaagtgattgaatttatgcattcaatagaacaatctatagagaaattctccggaaaaatcacttcaaaacgtatttgtagcacctatgcattcatgaaagagattgattcctcatcctcatatctatacaaggccttgagcactggacaaacactaacaagagcagaatttatattttacaggatcaactataacgggctcgaagaggcttactttaagacaactttagaaaatgcaagagtagttcaaattgaaccactcatgtttgacattaaactaccgcaaaacgaacgctatacacattgtgaatatgtagatctaacatatgaaaaaataacatggcattacatagatggaaacatcattcattctgatacctggaaggaacgcgcttaa

SEQ ID NO: 2253 - DNA, 645 bp, Enterobacter cloacae
ccagttagacctgccgctttcagagcaaatctcgtaataaaaaaaccaaggaactatgaaatgaaagcacgccttacttgccattctctgctggcattaagcattgccgccctgctgccagcgggctcagcactggccgccaccaccagcggcggcacggttaacttcagcggtaaagtggtgacctccgcctgtgccatcagcgccggtagcgccaatatcgacgtcgacatgggggaagtgcgtaccgccacgctggctgccgcaggcagtgaagccagtaccgcaaaagccttctccatcacgctggaggattgcgaaatcgccgatacctccgcgtccacggaaaataaccccatcgccgcaacgaccgtggctatcaccttcaccggtacgccggacagtaccgatgtcaatagcctggccgcgggagtaaacggcggcgcgggctcggcgcagcatgtcgctatccgtctttatgacgaacagggcaacgtcgtcaggctgggtgagccggcagcagcgatccccctgcgtgcgggggcgaacaccctgaacttcagcgcgaaatattactccccactgggcaacgccacggcgggtgatgccagcgcggtcgccacctacaccgtgacctattcgtaa

SEQ ID NO: 2254 - DNA, 693 bp, Enterobacter cloacae
caaagccagcggtatcgtcggcgacggcggcagcgtgtatctgaccggcctgtcagcgcagggaaccttgcatgccgtatggggacgcgacagcgcccagcgctgcacgatccgctatgcgttgaacccgcagaattatcacgcccgcaccgggctttattcccaggaggccatatgtcagtaaccgtccgtttcctccccctgatcctgctgatggtcatcaccgtccccgcgcgcggctatgacgtgctggtttccgtgaccggcaacgtgatcggcaatacctgcattgtctcggaagattcgaaggagcaaaacgtgccgctgggcaccctcggcgtgaagcaatttagcgaggcgggggcggtcagcaatatcaaaacgcccttcacgctcacccttgaagcgtgcggccccacctttgctggcgtgaaaatccgcttcagcggtacgccggatgacgaaaacccgcagcttctgaaagtcgctgacggtggcgcgaccggcgtggcagtgcagattctggataaagacagcgtacttatcccgctggacacccaaaccgctgcttacggcgcggcgggggatgacagcgtaaaaatgaccttctatgcgcgactggccgccacgggtgcgccggtcaatgccggagacgtttcggcagtggcgacctggacgacggagtatcaataa

SEQ ID NO: 2255 - DNA, 753 bp, Enterobacter cloacae
gacaactccttctcttcggatgcagacatggcttactccatcggcgaattcgccagactcagcggcatcaccgccaccacgctgcgggcgtggcagcgacgctatggcttgctcaaacccgagcgtacggacggcggtcaccgcctgtacagcgatgaggacgttcagcaggcgctgaaaatcctcgactgggtaaaaaaaggcgtacctatcggtcaggttaaatcactgctggaacgccctgcgccgcgccgcgccaataactggcaaaccctgcaacaggccatgatgcaaaagttgcaggaggggaaaattgaatccctgcgtcagatgatttacgacgccggacgcgaatacccaaggccagagctggtcactaacgtgctgcgtccgttgcgcagccagatatcggccaacgtcgccgccgccatgacgctgcgtgagatcctcgacggcatcctcatcgcctatacctcgttttgccttgagggcgataaaaaagcgccgggcgataacgttctcatcagcggctggtacctcaacgacccgtgtgaaatctggctcgaagcgttaacgcgcaccggccagggccaccgcatcgacatcctgccggttccccctgccgcgctggccccggaaattttcccggatcgcaaatggctgctggtcaccagcggcaaactcaccgccgcgcggaaaaagcaggttgcgcagtggcagcagcaggtttcccttgaggtaattatcctctga

SEQ ID NO: 2256 - DNA, 474 bp, Enterobacter cloacae
atattttttcgcgcagcgagtgctaacgttttcctgtcaccgacaactcaacaggaaaacacgatgaaaaagacactccctctgatgatgctggctgcaatggctttcgcgcctgccgcattcagcgccccggcaggcaccctgagcgtccacgttctggaccagcaaaccggtatgccgccagcggatgtgaccgttacgctggagaagcaggagcaggacaagtggaccccgattgccagcggtaaaaccgaccacgacgggcgcattaaatcgctttatccgcaggatcaggatatggcacctggcgtgtataaagtgaccttcaaaaccgccgattacttccacggcaaaaagctggactccttcttcccggaagtgccggtgctgttcaccgtcacccgcaccaatgaaaaactgcacatcccgcttctgctcagccagtacggttactcaacctacaagggcagctga

SEQ ID NO: 2257 - DNA, 978 bp, Enterobacter cloacae
gatcgggaggtgcacaccatgacaacaaaacctgtgctgggtattagcggatgtttgaccggttccgccgttcgctttgacggcgggcataagcgtatgggctttgtgatggatgagctggcgcagtgggtcgctttccgcccggtatgccctgaaatgtctatcggcctgcccacgcctcgtccggcgctgcgcctggtgatgaccaccggcggcgagacagaaatgcggttcagcaaagcgccccacgatgacgtcacgcagaagatggccgcatttacggcagattatctgccgaaaatcggcgatctgtcggggtttatcgtctgtgcaaaatcccccagctgcggcatggagcgcgtgcggctgtacgacgaaaacggcaaccggggccgcaaggagggtgtcgggctgttcaccgccgccctccttgaaactttcccctggctgcccgtcgaagaagacggtcgcctgcacgatccggtactgcgggaaaactttgttgagcgcgtttttgccctccacgaactgaacgtaatgcgtaaaaatggcctgacgcgccgtgctctgctggactttcacagccgctataagcttcagcttctggcgcaccatcaggcaggctaccgtgaaattggcccgttcgtggcatcactgcacgagtgggacgatctggacgcgtttttcgtggcctatcgcgacaaactgatgaccatcctgaaaaaacccgcttcgcggaagaatcacactaacgtgcttatgcacattcagggctatttccgtaaccagctgaacagccgccagcgcggagaactgcgtgatgtgatcctgcattaccgggacggactgctgccgatcctcgcgccgctgacgctgcttaagcattatctggctgaataccctgaccggtatctgatgacgcaaaactactttgatccctatcctgatgatttgggtctgcgtctggccgttacctga

SEQ ID NO: 2258 - DNA, 252 bp, Enterobacter cloacae
cctccgcctgtgccatcagcgccggtagcgccaatatcgacgtcgacatgggggaagtgcgtaccgccacgctggctgccgcaggcagtgaagccagtaccgcaaaagccttctccatcacgctggaggattgcgaaatcgccgatacctccgcgtccacggaaaataaccccatcgccgcaacgaccgtggctatcaccttcaccggtacgccggacagtaccgatgtcaatagcctggccgcgggagtaa

SEQ ID NO: 2259 - DNA, 2598 bp, Enterobacter cloacae
cgattatggggcctggacgcccgtcacccgcacgtcattgtcccaataataaaaacagtaaggcgtgaccacatgaaaattaaaatcctgtgcgccacggcgatcgccctggtgattcggcaagccgtggctgccgaaagcgagctgcaatttaatcctgcgtttctcaacggcgagcgcgccaacagcgccgatctcgcctgggtcaacgccgggagcgcgttgccgccgggcgagtacaatcttaacgtgtatatcaatacccagttcgcgttcacaggtaacgtcacgtttcgcgtcgctgaaagcaccgctggtgaagccctgccgtgccttacgcctgcacaattcgccgcacttggcatcgacagccgtcaggctaaagggggtgagctgccgcctgcgcagcgctgcatttttttaacccagtcattcgccgatacccggtttgattttgaccagaggacgcttaccctcaacttcaccgtaccgcaaagcgcgatgcgcgctctgccgcgcggatacgtcagcccggagagctgggagtccggcatccctgccgcgtggctgaactatgtggtcaatggcgcgaataatgactaccggggcgagacgcgcacgcgggaacaacagctgtttgtgagcctgaacagcggcgccaacctgggcgcatggcggctgcgtgatttcaccacgtggaccaaagagagtaacgagctcacccacgtccagacctggctacagcgggatatccgcgccctgcgtgcccaggtttatgccggtgaaacgttcacctcctcgcaggtgtttgacgccgttggcctgcgtgggattgccctgaagaccgatgacaatatgttgcccgccagcctgagcggttacgcgcctgaagtgcgcggcatcgcgcgcagcaatgccacggtgacggttcgccagaacggtaacgtcatctatcaaacctccgttccgccgggggcgtttgtgctgaaagatctctatccgacctcttccggcggcgatctcgcggtcaccattcaggagagcgacggtagccagacgcaatacaccctgccctttgccagcgtgccgaatctggtgcgtaacggtcaggtcaaatatgctctgggtgcggggaaataccgccctgcgggcaatcagatctcgccctccttcgcgcagggcgagctgttcctgggctggcgatacggcctcacgttttatggcggggcgcagttttccgatcgctacaccggcctggccttcgggatcgggcagaatctcggccgctttggcgcctactctctcgacctcacccatgcccgcagccagctggctgataaccagcactacaccggtgattcggtgcgcctgcggtacagcaagctgctgaacgatatcggtacgcgagtcaatttcttctcgctgcgttactcaacggcagggttttatactctcagcgataccacttacaaaggcatggcgggcggagcgccagaacagaccgtggaagacgatggcaccgtcaccactcactacgacacggtttacaacctgcatatgtcgcgtaaggcaaaaaatcagctgctgttgtcgcagccgatgggcgaatacggcgcgctgtcgctgtcctgggatcaacaaacctactggaatacgtcaaaaaccacgcaaagtttgcagttcgcgtggaacgcgacgtttcgtaacctgtcgcttggcatcagcgcccagcgtagctctggcctgtacgacaacaagaaagacaatatcctcgcgttgtccctgtcggtgccgctgggtaatccggcgctgtcgacccgtctccgttttaccgctacccatgcggatcccgctggcaccaccgccagtaccggtgtcagtggttatctgccggggcaggagaatcttttctatagcgtcaaccagcgctacagcgcgcagcagcactacggcggcgatgccgcgctgcaatacgagggcgcgtggggagactataacctgggctacagctacgccggtgactcccgcaacctcagctacgggatgagcggcggagcggtgctgcatgaggatggtctgacgctgagccagccgctcgggaacaccaatattctggtgaaagccccgggcgccagccatgtcgccgtgctcaaccacaagggcatcaaaaccgacagccggggctatgcggtgatcccgtacgccacgccgtatcgcgttaatcaggttgcgctggatgtcaccaccgtgggcaatgacgtggaacttgagaacgccatcgccaataaaattcccaccgacggggcactggttcgcgccaccctcaccacgcgtcagggagcaaaagcgatgtttatcgtacgtcacgctaaagacgtgctccccttcggcacgctggtctcgtcagaggatgacaaagccagcggtatcgtcggcgacggcggcagcgtgtatctgaccggcctgtcagcgcagggaaccttgcatgccgtatggggacgcgacagcgcccagcgctgcacgatccgctatgcgttgaacccgcagaattatcacgcccgcaccgggctttattcccaggaggccatatgtcagtaa

SEQ ID NO: 2260 - DNA, 783 bp, Enterobacter cloacae
cccatgaacattacgcaaattcgcaatgccacccaactgatcacttacgcgggaaaacgctttttaatcgacccaatgctggcgccaaaaggcacttatccgggttttcccggcacggcgcgggctgatattcgcaacccgatggtcgagcttcccgttgacgttcaaacgcttctggatgctgacgcggtgatcgtcacccatacccatgccgatcactgggatcagtacgccgttgagctgatcgccaaaggcaagccgatctacgtgcaaaatgatagcgatgccgcgctgctgcgcagccagggatttaccaacctgacgatcatgaccggggaaacaacatacggcgatatccggatagtgaaaacccacggcggccagcacggtactgaccgcgcttacgccgtgccggagctggcagagtttctgggggaagcctgcggcgtggtgttccgtcatcccgatgagaagacgctttatatcgcaggggataccatctggcgcgatgcggtggcggccgatctgcaaaagcaccagccggatatcgtcgtgctcaacgccggttacgctcatgtcattgggtttgggccgattatcatgggggaagaagatctgcttaacgtgcatttcctgctgccgcaggcgaaaatcgtggcgacccatatggaagctatcaaccactgcctgctgacccgccgcgcgctgcgcgagtatgttgacgccaacgagataagtgacgcggtgagcattcctcaggacggcgaaaccgttatattctga

SEQ ID NO: 2261 - DNA, 504 bp, Enterobacter cloacae
aagagaagatttggctacggcatgggagacgccgccagccatatcatttttgataacgttatgctttatatgatgtttttctacaccgatatttttggtattcccgccgggtttgtcggcaccatgttcctgctggcccgcgcgctggatgcgatctccgacccgtgcatggggctgattgccgaccgcacccgcagccgctgggggcaagttccgtccatggattttgtttggcgctatcccgttcggcatcgtctgcgtgctggcgtataccacgccggacctgagcctcaacggcaaaatggtttacgccgccgttacctacaccctgctgaccctgctctataccgtggtcaacatcccgtactgcgcgctgggcggcgtgatcaccaacgacccgacgcagcgtatctccctccagtcctggcgctttgtgctggcgacggcgggcggtatgctctctacggtgctgatgatgccgctggtgaacctgattggcggtga

SEQ ID NO: 2262 - DNA, 1257 bp, Enterobacter cloacae
catatcgtgaaattaaaaaaccgaagcggacagcggcgggcgctgatcccgcatcacttctcaaaaagctatcacatcaacgcgccacggctgaaagccgtgctgacgctgttcatcgccttttttctctgcctgctggtctttgcgattgtctttaatttttcggaaaccacgctggcacgcggggtgttgatcccggcgcagggcgatgtggaagtccgcgccagggagtccggtacccttgtcgattttgccgtccggcccggccagtacgtgaaggaaaacgatccgctgttcaccgtgtcgcaggactatggcggcaagcagggctcggtggtgcagtttgaccgccagcagatggaagcggagaagaagcgcagcgagcagcgcattcaggccattgaggactcgattgcgtcgtatcgcaaaaatctggcgcagcagctggctctcaccgacaagcagatcgccgtttcccgcgataaggtgaagaagctgcgcgcgctgttaaaaaacagcaccgacacctacgaggcgtggaaatccgtctccgggaagggctatgtctccagagtggatctcgataaaagccacaatgatgtgctcaatgcgcagctcaacctgacgctggaggagagcactattcttgagcttgaggcacgcaaaaccagcctgaccgacagcacccagtcgcaaattgactctctgagcgaagagcagctgtatgtgaaaaaccgcatcagcgaaatcgatcgcaacctgtccagccggggaagttccaccatggcgatgctggccccttccgatggttacgtggtggcgattaacttcccgcctggccgggccattacgcaaaatagcgaggtggtggtggtgatccgtaaaaataccgcggcgacgatggaggggtacctgtatgttccggcaacgggggtggggcgcgtggcgaaaggcgataaggttaagctgcgcttcgactcctggcccgtggacaaatacggttcggtggaggcgacgctgtccgatttctatgaggtaaacattgatgcccattcggcgctgatcccgctccaggaagggcagaactactacctggctaaagtgcgcgtcccctcctggtttaccgacccggacaagaaaaagcgcatgctgatgggcgggatgacggtgaacgccgatatcgttatcgatcgtaagccgcttatcaatctgctgattgccccgctggaaagggtgcgcaagcggtttatcgattga

SEQ ID NO: 2263 - DNA, 1005 bp, Enterobacter cloacae
aggggaaaggagagacagatgccgcttgttaacgttgctattgtcgcggtggacgggtttagcccgttccactactccgtcccctgcattctgtttggcgatacggtatccggggaaaagcgctttaacgttacgatctgcgctgaaaaaccgggattcctgacctcgaaagacggttttgccctgcatgcgacgcaggatttttctgcaatcgcatcggctgaaattgtggttgtaccctactggcagcacgtgctggagcgcccgcctcagacgctgctcgacagcctggttcaggccagagacaacggggcggaaattgttgggctgtgtctgggatcgtttgtactgggctatgcgggcatactcagcggcaaacgggccgccacccactgggagtttgaacaccagtttcagacgctgtttccggacgttcgactggacatcaacgccctctacgtggatgacggcaatgtgatcacctcggcgggtaccgccgccgcgctcgactgctgtttgtacatcatccgccagcgctttggcagcgtcgtcgccaatcagattgcccgccggatgatcgtcccgccgcaccgcgagggcgggcaggcgcagtttattgcgcaacctgtgccgaaagatacccgcgacgggcggattaactgtctcattgactaccttcagcagcacatttccgaaccgcataacctggattcgctggcggacgtggtgtcgatgagccgacgcacgctgacccgccattttatcaaggcgacgggcatgagcgttgccgactggcttaccgccgagcgcctgcggcgcagccagatcctgctggagtccggcagtctgccaatcgaaagcgtcgctgagcaggtggggtttttatcagcggtgacgtatcggcagcagtttaaggcgcgctttggtgtcagtccggcggagtggcgtaagacgtttcgcgttaagccgtatgcagcgaaaaataatgctggcgcgatggaataa

SEQ ID NO: 2264 - DNA, 855 bp, Enterobacter cloacae
atgtcatcccatacatgcggtgacccaggttcaacatctgttaaccggagaattcatactgcccctatgcataagcattacattataaataatatcgtcgaatttcatcctgcggccagcacgttacgtgatatcaacaatcctgaccgtgtggttgtgttaaattcgccagcaggccgatgcctgttgttattaatcgacagagcggggtcgattgtcactcagcaagagttccttgatattgtctggcaaagccacggcatgcttgtctcctccaatacctattaccagaacatctccatcctgcgcaaagggctcaaaaagattggctttgaaactgaccctatcgttaccattccgcggattgggttgacgctggcaagcgacacgcaaataaccgtcagagagtcttcacctgtcgcgcctcaacccgcagaggaacaatgtgtggaggcgccagcgatcgaggaggtctctgcatcctccgcgccagcaacgcccgttgccaggaagcccacgcgctggctggctgttgtcatggggctattgatcgtcctggccggggcaggcgtgacgggatatatgaacgccacagaaaaccgttttgttgaggattaccgttttgcggcatccgtcggagcctgtcgcgtttatcttgcgaacgacattcagactcacgctgaacgcgcttccgcgctgacctatgtggaacaattcaaggctgaatgcgcgcaatatccctgggtttacatcagctggtacgctctgcttcctcgtgcatcggttattcgctgcgaccggccaatgaaagaaccgaaccgctgtatatctgattatttcctgaaggatagctag

SEQ ID NO: 2265 - DNA, 990 bp, Enterobacter cloacae
atgaaaagtgtatttgactcctccgatgggggaaaatcagtaccggaaaagtgtctgcatattgggttgatattatggccccgttattcactcctggccgtctccggattgctggaggcgctgcgttatgcagcgaaagctcaggataaattagcatttaaaatcagcctgataagtgaatttcctgatatcccgattatcagcaatgcggggattatcatgagaccggattccacccatgcgccgccggacagttttaactaccttgctgttatcggcggtgaattgcagtatctggacttagggtatcagggggataaagcgtatctggcacatgcccaccatgccggggttccgctcattggcattggcaccggcagttttgtcctcgcacaggaaggattgctgaatgaacgacgagcgtccatccatcctttccaccttgatgcatttcggcaggctttcccgctggtttatgctgagcaagggtatgatttcatcgacgatggcgatgtgctgacctgcccgggcggtatttccaccctgacgctggcaactgagcttatccgcgcccatgccggggatgatatcgccagcaccacctgtcagcgtttgtcgctcgttccgcatgaaattgccaccccacgtccggcgaatcttgcgcttatccctgactcgcggttgcgccgcgccgtcatgctgattgaacagttcctgacccggccgctcaccaccgccgggcttgcgcgagaagtggcattgagtgaacgccagctcaaccgcctgttccacgcagaattcggcaaaacggcccgcgaatttatccgcagcgccaggctgcgctatgcttgctggctgctgaagaactcgcagcaaagcgtgacggatattgcgcagcggatgggattcagcgactgcgcgcactttattcgtcatttccagacggagtatggttgtacgcctggggtgtggcgcacgtcgcagagctga

SEQ ID NO: 2266 - DNA, 492 bp, Enterobacter cloacae
atatcattacattgctgccctgaaactttactcaaccggaatatcaccatgaaaatagaagccgcacacccctcgcaatttgaacgcctcgtcgcagtctgggagtcgtccgtacgcgccacgcaccgctttttgcaggaaagcgatatcgcggcgctgcgtccgttattgctcaacgcatatttgcctaatctcagggttgtgattgcccgggatgacgtgggtattattcacggctttttgggcgtggataaaaatcgcattgaaatgctgtttgtggatgatgcgagccgggggaagggtatcgggaaaatgctgctgcaatatgccattgcagaattcggcgtaaatgaagtggatgtgaacgagcagaatccgcagggggtggcgttttatcgccatatggggtttgagcaggtcgggcgttcggaactggacgggcaggggaatccgtttccgctgttgcatatgcggttgagtggacaggcttaa

SEQ ID NO: 2267 - DNA, 1161 bp, Enterobacter cloacae
ttgccgaccgcacccgcagccgctgggggcaagttccgtccatggattttgtttggcgctatcccgttcggcatcgtctgcgtgctggcgtataccacgccggacctgagcctcaacggcaaaatggtttacgccgccgttacctacaccctgctgaccctgctctataccgtggtcaacatcccgtactgcgcgctgggcggcgtgatcaccaacgacccgacgcagcgtatctccctccagtcctggcgctttgtgctggcgacggcgggcggtatgctctctacggtgctgatgatgccgctggtgaacctgattggcggtgatgacaaagcattcggctttcagggcgggatcgccgtgctgtcggtggtcgcgttcctgatgctggcgttctgcttcttcaccaccaaagagcgcatccaggtgccgccgagcaccacctccatgcgtgaagacatgcgtgatatctggcaaaacgaccagtggcgcatcgtcggcgtgctgaccatcctcaacatccttgccgtctgcgtgcgcggcggggcgatgatgtactactgcacctggatcatgggctcgccggaggtgttcgtcgccttcctcaccacctactgcgtcggtaacctgatcggctccgcgctggcgaaaccgctcaccgactggaagtgcaaggtgagcatcttctggtggaccaacgccgcgctggcggtggtcagcgtggcgatgttcttcgtgccgatgcatgccaccgtgctgatgttcggcttcatctttcgttatcggcgtgctgcaccagctggtgacgccgattcagtgggtaatgatgtccgataccgtcgaatacggcgaatggaccaacggcaaacgcctgaccggcatcagctttgcgggcacgctgttcgtgctgaagctcggcctggcgctgggcggggcgatgatcggctggatgctggcaggcggcggctacgacgcggcggccaaaacccagaacagcgcgaccatcagtatcattatcggtctgtttacgctggcgccagcgatctgctacgtgctgagcgccatcatcgccaaacgctactacacgctgaaaacccctttcctgaccaaaatcctgcgcgagctggcgcagggtgcgcgccgcaatcagcaggagtttga

SEQ ID NO: 2268 - DNA, 1200 bp, Enterobacter cloacae
tacgtataccttcgtccgctggttaagacgctgctgacaatgctgctgatgggcgtgtttttcctgatccgcttttcgctgatcggcccctatcaacgcgcggtggatgactccatcgagcgcaccgcccagtatgagtctctgctggtggagacgcagaaagggatcataacgctcaaagcgaacaacatggagcaggcccgggatgcggtgatggacaaatcccagcgcgaacacatcgccgggctgatgcgtaaagagcggctactggcccgctttgacgtggcttcgctgctggtgatcaatgccgagcagctgctggtggtctgctttggcgcgtggctgatcctggaagggcagatgagcatcgggatgctttacgcctatatcagctataagcgctatttttccgatgccatggtgcaggtggcgcagaagctgctggacaaaaatgccctcaaggggccgctggatcgcgtgggcgacctgctgtttgctccctctgaaaccagccagtttgggaagcggattgtcacctcgccggtctgtctgcaatttgaggatgtctcatttgcctatcctggccgggaggccacgctacagcatatcaacatgaccctgaagcagggcgaagaggcggtgattgtgggccagagcgggtcgggaaaaaccacgctgctgcgtctgatctccggcatgctgctggcatcgtctggcacgctgcggatcaataagatccccattgaggagtgcgatctttcctcgctgcgtcagcacatccgcatcgtccatgcggacgatattctcttcaccggctcgattctggacaacatcgcctgctttgacagcgcaccggataaagagcaggtcattgccgcgtgtcggctggcggaggtggatcacgtcgtcgcccggctgccgcacggctacgaaacggagatgctgccggggaacacctttttctctgccggggagatgcagcgtctggttctggcgcgcgccctgtacagccagcctaagcttctgctctgtgacgaagtgacggcgaacctggataaaacgaccgcgcagaaagtgctggcgaacctgcgtagcctggggattggcctggtgtttgtcacccactcgccggacgtggtgggctgtcaggggcgtctctataccatggaaaacggcaccctgcgggagagtgagcaatga

SEQ ID NO: 2269 - DNA, 540 bp, Enterobacter cloacae
atgaaaggagttctcatgaggctatggcctgtagttaccggtgtcgccattgcgctgactctggttgcctgtaaatctcccacgccgccgaaaggcgtgcagcccattaccggctttgatgccagccgctatctcggcaaatggtatgaagtcgcccgactggaaaaccgctttgagcgcggtctggaacaggtcaccgcgacgtacggcaagcgcagcgatggcggtatcagcgtactgaaccgcggctatgatccggtgaagaacaaatggaatgagagcgaaggaaaggcgtactttaccggcgaaccgactacggctgcgctgaaggtatcgttcttcggcccgttctacggcggatataacgtgatcaagctggacgataagtaccagtacgcgctggtcagcggcccgaaccgtgactacctgtggattttatcgcgcaccccgaccattccggatgcggtaaaacaggactacctgaacaccgcacgcggtctgggcttccgggtcgatcagctggtgtgggtgaagcactaa

SEQ ID NO: 2270 - DNA, 492 bp, Enterobacter cloacae
aggatagctagcatgactcgttttcggcagatgctgtatatcatcgtgacgggcctcgtcatggcaggcgtgctgacgggctattacctgtggcaccgaacttacgttcagcctttttcatgccaggctaatctggtccagcaccatccggatgagacgctgacggtctggctgaattacaccttcgatgggaaattcggcaccctgagcatgaatggccgggcaaagagcgatccgggtaaaaccatcgacaggaaaatttcctttcgggtggagagacaagatcatctctatttgctgacgtcagaaaaaaatatgacgttcccggacgataatgttgacgacagctggctggaaaaatatgaaccgcaattttttgtctatccgggcaagagtatttatatgcggatcaatgaacaacataatggtaactatatctttaccttaggaacattaccgacatatgtgtgtcgtggttcaaaaaaagaatga

SEQ ID NO: 2271 - DNA, 435 bp, Enterobacter cloacae
tgttcggcttcatctttcgttatcggcgtgctgcaccagctggtgacgccgattcagtgggtaatgatgtccgataccgtcgaatacggcgaatggaccaacggcaaacgcctgaccggcatcagctttgcgggcacgctgttcgtgctgaagctcggcctggcgctgggcggggcgatgatcggctggatgctggcaggcggcggctacgacgcggcggccaaaacccagaacagcgcgaccatcagtatcattatcggtctgtttacgctggcgccagcgatctgctacgtgctgagcgccatcatcgccaaacgctactacacgctgaaaacccctttcctgaccaaaatcctgcgcgagctggcgcagggtgcgcgccgcaatcagcaggagtttgaaaacctgccggtcagcaaagaattacagaactaa

SEQ ID NO: 2272 - DNA, 2379 bp, Enterobacter cloacae
gaggacgagagcatgaaaatcagtgatggaaactggcttattcaaccgggcctgaacgtgacgtatccggttcaggtgttcgacgtggagcagcagggcaatgacctggtggtgtatgtggcgccgcgtgacgtgcgcgaacgcacctggcagctcgacacgttgatgttcacggtgcgcctgtttgccccgcaggaagggattgtcggggtgcgcattgagcacttccagggcgcgctgaataaaggcccgcactatccgctgaacgttctgaaagacgtgaaggtagagattgaaaacaacgccgagtttgccgagctgaaaagcggcagcgtcagcgtgcgcgtcaccaaaggcgagttctgggcgctggatttcctgcgcaacggccagcgcattaccggcagccagctgaaaaacaacggctacgtacaggacaacaataccgatcgcaactatgtgtttgaacgtctggatctgggcgtgggggaaacggtctacggcctgggcgagcgcttcaccgccctggtgcgcaacggtcagacggtcgaaacctggaaccgcgacgggggcaccagcaccgagcagtcctacaaaaatatcccgttctacctgaccaaccgcggctacggcgtgctggtgaatcatccggaaaacgtctcgtttgaagtcggctccgagaaagtgtccaaagtgcagttcagcgtggaaggggaatatctcgagtactttgtgatcgacggcccgacgccgaaagaagtgctgaaccgctatacccgcttcactggccgcccggcgctgccgcctgcgtggtcgttcggcctgtggctgaccacctccttcaccaccaactacgatgaagcgacggtgaacagctttatcgacggcatggccgagcgcgacctgccgctgcacgtcttccacttcgactgcttctggatgaaggccttccagtggtgcgacttcgagtgggacccggtgaccttccccgatccggaagggatgatccgccgcctgaaagagaaagggctgaaggtctgcgtgtggattaacccgtacatcggccagaaatccccgattttccgcgagctgaaagagaagggctacctgctgaagcgcccggacggctccctgtggcagtgggacaaatggcagccggggctggcgatctacgacttcaccaacccggacgcgtgccggtggtacgccgacaagttgaaaggcctggtggagatcggcgtcgactgcttcaagaccgatttcggcgagcgtatcccgacggacgtccagtggtttgacgggtccgatccgcagaagatgcacaaccattacgcctacatctacaacgaactggtgtggaacgtgctgaaagagacggtgggagaagaagaggcggtgctgtttgcccgctccgcgtccgtgggggcgcaacagttcccggtacactggggcggcgactgctacgccaactatgaatcgatggccgaaagcctgcgcggcgggctgtcgattggcctgtccggcttcgggttctggagccacgatatcggcgggttcgaaaacaccgctccggcgcacgtctacaaacgctggtgcgcgttcgggctgttctccagccacagccgcctgcacggcagcaaatcctaccgcgtgccgtgggcgtacgatgacgagtcctgcgatgtggtgcgccacttcacgcagctgaaatgccagctgatgccgtacctgtatcgtcaggcggctctggcgcgtgagttcggcacgccgatgctgcgggcgatgatgctggagttcccggacgatccggcgtgtgactatcttgaccgtcagtacatgctgggggattcaatgatggtggcgccggtgttctccgaggcgggcgatgtgcagttttacctgccggaagggcgctggacgcacctgtggcacaacgacgaaatcgagggtagccgctggcataagcagcagcacgatttcatgagcctgccggtctatgtgcgcgacaacacgctgctggcgctcggcaataataaccagaagccggactatgcgtggcacgaggggacggccttccagcttttcaacctgagcgatggcgcaacggcggtgagtgaagtgcctgcggcggacggttccgtgttgtttacgctgaaggcgtcacgtcagggcgacgtcgtgacctttaccggcacgggagatgcgcaaaactggtcggtgtgcttgcgcaacgtgcagaaggtcggcggcgtaaaaggcggttcacatgcgggcagcgagtggggtgtggtggtgaaagccgagggggatgaggtgatggttcacctgtgcgctgtcttcacctcggagcggccgatccgcgattatttaccccaatga

SEQ ID NO: 2273 - DNA, 1017 bp, Enterobacter cloacae
ggatttttgacgatgcagcccatttcaggtacgcctccgcgccctccgggtgaaggccccgtaacgcccaacacgccaggcgaacaaccgctctccacgcagcaacgcaccgtactggagcgtctgatcacgcgtcttattgcgttgacctcacagcaaaacgcagaggtgtgggccggcgtgaagcacgatttgggcgtcagaaacgatgcgcagctacagtcgcgccatttccctgccgccgaacaaaacctgaaccagcgtcttaccagcgcacagcagcaacataccacccgccagattatctcgcagctgaccgagctgttgggccaggggaataatcgtcaggcggtgagtgattttatccgtcaacagtacggtcataccgccctgagccagctttcgccggaacagctgaaaaccgtgttgaccctgctgcaaagcaatcagctttctatcccgcagccgcaacagcgcccgtctacagaacggccattgcagcctgcggagcataatacgctcaagcagatggtcactaagctggctgccgcaaccggcgaacccacaaagcttatctggcaatccatgctggaactttccggtgtgaaagcgggcgagatgatcccggcaaaacagtttacccatctggtcacctggctccaggcgcgtcagacgctcagcacccagagcgccccgaccctgcacagcgtacaggcggcgctgaaacaaccgctggaaccgcacgagttcgatacgatccgggattacgctcagcagagctggcaggctacgccgcaaacggtgctgaccaccgcccaggtgcaggatgtgctcaatcagatcttcgttcgccgcgccgagcgggaaggcggcgtgccggaggtaagaaacattcagccgatctacaacccgctgtttgcccccgtagttgatacgttcaaaacgctttctgcccgtccgggattgatgttgatcgcgttggtgattgcgctggcgattttctggctggttgcgtga

SEQ ID NO: 2274 - DNA, 1017 bp, Enterobacter cloacae
  unsure (942)
ctcaatgaggttatggtcatgagccagaaaaccctgttcaaacaaactgctttagcagttgcagtggcaatcgtctcaacgtccgcctggtcagcgggcttccagttaaacgaattttcttcctctggccttggccgtgcgtattccggggaaggtgcgattgccgatgacgcaggcaacgcgagccgtaacccggcgctgatcatgatgtttgatcgccctaccttctctgccggtgcggtttacatcgatcctgatgtcaatatttctggcaaatctcaattcaccggcgcagatctgaaggcggataacattgcgccgaccgcgtgggtgcctaacctgcactttgttgcgccaatcaatgaacagtttggttggggtgcctctgtcacctctaactatggcctggcaacggagttcaataacaactatccggccggggaatacggcggtaaaaccgacctgacgaccctgaacctcaacctgagcggcgcatatcgtctgaacgataactggagctttggtctgggctttgatgctgtttacgccgatgcaaaaatcgagcgttactccggggagcaaactgctgcgctgccgaaaaacagcaataaaattgccagcctgaaaggcgatgaatggggctacggctggaacgccggtatcctgtatgaactggataaaaacaaccgctggggtctgacctaccgctcagaagtgaagattgacttcgatggcgattacaaaagcggcatcctgagcccagtcaacggtatggtaccgggcgcaggcaccaccattccatggggtacctcgaatcaaaccgtaccgggttcactgtcactgcatctgccaaaaatgtgggaagtgtcaggttataaccgcgttgcgccgcagtgggctattcactatagcctcgcgtataccagctggaaccagttccangagctgaaaagcaccggcagcaacgggcagacgctgttctataaagaagaaaagctcacaatgctttacctatcg

SEQ ID NO: 2275 - DNA, 183 bp, Enterobacter cloacae
ttgttcgtcgccaggcgcgagggatcgagcgacggcgcggctgcatcacctgcgcgcacctcttccgctgcgccttctggcggctgggcaggcagcgcctgcgttgccgctggcagcatatcgggctcgtcgcgatcgcccggtttgggtaccagcggaatggccgcaaattcatcctggtaa

SEQ ID NO: 2276 - DNA, 303 bp, Enterobacter cloacae
ccgcccagcgccgtgccgcgcacctgcggagccacgcgcttcaccacttcaacgcccagcgccgggaagatcagcgagcagccgcagccggttaacgccgcacccagcagcgcaacggatgcagagggcgcctgccagagcagtaccagacccacggtctcaatgacaagtgacgacacggccaccttcacgccgccaaagcgatccagcatccagccaaacagcacgcgcatcaatacaaacgcgccgccaaaggccgtcagcgtaaagcccgccatcgcccagccgcggctcatgaaatag

SEQ ID NO: 2277 - DNA, 2172 bp, Enterobacter cloacae
tcactgcacgtttcattcaatacctctgtaagtcgcactataaaaagtttcgagtcgcacaatagcgtacacttgtacgccgaacaagtccgatcagccattttctgtggaaatttgcaccgatgggctcacatcgctaagatcgtgccactgcctgtcggacgagtaacttacgtgaaacaaaacgccatacaacctgccaacctcgaattcaatgctgagggtacacctgtttcccgagattttgatgacgtctacttttctaatgataacggactggaagagacgcgctatgtcttcctcgaaggaaatcatctcagcacccgcttccctgagcatccgcgcaggctgtttgtcgtagcggagagcggtttcggcaccgggctgaattttctgaccctctggcaggcgttcgattgttttcgcgctgcataccccgaggctaccttacaaagattacatttcatcagtttcgaaaaatttccgcttaccgcgcacgatctgcggcttgcccatcagcgctggccggagcttgcccactgggcggaacagcttcagacccagtggccaccggctatcggcggctgtcatcgtctgattctggatgacggacgcgtcaccctcgacctgtggctgggcgatattaacgacctgaccgataagcttgatgactcaatgaatcagaaagtggacgcctggttcctggacggttttgcgcccgctaaaaacccggacatgtggagcccgcacctgttcagcgccatggcacgtctggcgcgcccgggcgcgacgcttgctaccttcacctccgcgggctttgtccgtcgtgggttgcaggaggcggggtttaccatgcggaaaaccaaaggctttggccgcaaacgcgacatgctggtcggggtgatggaacaggatctggcgatcccggcgcaggccccctggtttgcccgccgcgccagcacctcgcgtgaggtcgctattgtgggcgggggtattgccagcgccctgctctcgctggcgctgctgcaccgtggctggcaggtgacgctctactgcgctgacgaggcgccggcgacgggcgcatcaggcaaccgtcagggcgcgctttatcccttattaagttcacacgatccggcactgttccagttcttcccggcggcgtttacgtttgctcgccgcctttacgatagcctgccggttgcgttcgaccacgactggtgcggcgtgacgcagctcggctgggacgagaagagccagcagaaaatcacacaaatgctgtcgctggggctgccggaggacatcgcccatgcagtgacggcacagcaggttacagagaccactggcgtcgacaccggctgcgggggtattcagtatccactcggcggctggctgtgtccggctgaactgacttctgcggcgatagccctcgggcagtcgcgtgggttgacagtgcattatgcccataaggttcaatcgctaagccgcactgcgcactggaaactgcgtttcgctgacggtaaagaggcgcagcatgccagcgttgtgctggccaacggacatcacatcactcagtttacccagacagcgtcattggcggtttatccagtcggcggccaggtgagccatatcccgaccgcgccccaactgagcaaactgcgtcaggtgctgtgttacgacggctacctgacgccgcaaaatccctccaacggccatcactgcatcggcgccagctaccatcgcggtgaaacagatatgcagtacagcgaagcggatcagcagcaaaaccgacagcgcctggtcgactgttttccggatgcgtcgtgggcgaaagaggttgatgtcagtgagggtcaggcgcgctgcggcgtacgctgcgcgacccgcgatcacctgccgatggcgggaaacgtgccggactatgacgccacgcttgaagtctatcaggatcttgcagacagcaaagaaacggcggtaagtgcgcccgttcaccccgagctgtttatgctgggtggcttaggctcgcggggattgtgctccgcgccgctgctggctgaagcgttagccgcgcaaatgagcgacgagccggttccgctggacagggttacgctcgcggggctgaatccaaaccgactgtgggtgcggaaattgctgaaggggaaaatggtcaagtag

SEQ ID NO: 2278 - DNA, 555 bp, Enterobacter cloacae
cgaatgaaaaagaaaacatcgctcagcgaggaggatcaggctctcttccgccagctgatgaccgggacgcgtcaaatcacgcacgacaccattgtccatcgcccgcagcgtaaaaaaatcagcgaggttccggtcaaacgtctgctccaggagcaggccgataacagccactatttttcagatgagtttcagccgctgctcagtactcagggtgcggtgaaatacgtgcgcgaagacgtcagccattttgaactgaaaaaattacgccggggagattactcgccggagctgttcctcgatctgcatgggttgacccagatgcaggcgaaacaggagctgggggcgttgatcgcggcatgtcgtcgcgagcatgttttttgcgcctgcgtgatgcacggtcacggcaaacatattcttaagcaacagacaccgctgtggctggctcagcacccgcacgtgatggcgtttcatcaggcacccaaagagtacggcggagatgccgcattgctggtattgattgaagtggaggagtggcagccgccagagttgccctga

SEQ ID NO: 2279 - DNA, 501 bp, Enterobacter cloacae
caaaagcggtgcaatatgcaagtttttatcatgcgtcacggcgacgcggcactcgatgccgccagtgactcagtacgtcctttaaccgtctgtggctgcgacgaatcccgtcagatggcgacatggcttaaaggtcaaaaagtggacattgaacgcgttctggtgagtccgttcctgcgggcagaacagacgctggatgtggtaggggagtgtatgaacctgccatccagtgtggatgtgctccctgaacttacgccgtgtggcgatgttggccttgtcagtgcttatcttcaggcgctgtgcaatgaaggtgtcgcttccgcactggtcatttcccacctgccgctggtcggctatctggtatctgagctgtgcccgggcgaaacgccaccgatgttcactacgtccgccattgccaacgtcaccctcgacgaaaccggcaaaggggtctttaactggcaaatgagtccgtgcaacctgaagatggcaaaagccatctga

SEQ ID NO: 2280 - DNA, 822 bp, Enterobacter cloacae
gcatgtactttaatggataatttcgtcgacctgttcatggtgtcaccgctgctgctggcggtgctcttttttgttgcaatgttagccggatttatcgatgccctggcgggcggcggcgggttgctcaccgttccggcgttgctggcggcaggcatgagccctgcccaggcgcttgccaccaacaaactccaggcatgcggcggttcgctctcctcgtcgctctatttcattcggcgtaaagttgtgaatctcgccgatcagaagctcaatatcctgatgacgtttattggctcaacggcgggcgcgctgctggtccagcacgtacagtccgacattctgcgccagatcctgccgctgctggttatctgtatcggcctctatttcttactcatgccaaagctcggggaagaagatcgacagcgtcgccttcacggcctgccgtttgcgctgatcgccggtggctgcgtcggtttttacgatggcttctttggcccgggggcaggctcgttttacgcgctggcattcgtgacgctggccgggttcaacctcgccaaatccaccgcccacgccaaagtcctcaacgcgacctccaacgttggcggtctgctgctgtttatcattggcggcaaggttatctgggcaaccgggtttgtgatgatggcagggcagtttttgggcgcgcgcgcaggctcgcgtctggtattaagcaaagggcaaaagctgatccgcccgatgattgttgtcgtctcggcggtgatgagcgccaaacttctttatgacagccatggacaggagatcctcacctggttggggatgaactaa

SEQ ID NO: 2281 - DNA, 366 bp, Enterobacter cloacae
tcgaggctttacagaattattaccacacgccggagatcacggcggaacgcttcccgtggccggaagatctttaacagaggaaagaagatgatcgcagaatttgaatcacgcattctggcgttaattgatgacatggtggaacacgccagtgatgatgagctgttcgccagcggttatctgcgtggtcacctgacgctggcggtagccgcgctggaagccggggacgatcactctgccgacgccgttcacgcggaagtcactcgcagcctggaaaacgctattcaggccggggaactctctccgcgcgaccagtctttagtgctgggcatgtgggataatttgttccagcaggcgaaagcgaagtaa

SEQ ID NO: 2282 - DNA, 1218 bp, Enterobacter cloacae
atgaaacgtgcagtgattactggcctgggcatcgtttccagcatcggtaataaccagcaggaagtcctggcatctctgcgtgaaggacgctccgggatcactttctctgaagagtttaaagattctggaatgcgtagccacgtatggggtaacgttaaactggacaccaccggtttaattgaccgtaaagtggttcgtttcatgaacgatgcctctatctacgcctatctttccatgcaggaagcgatcaaggattctggtctgagcgaagacgtttaccagaacaacccacgcgtgggcctgattgcaggttccggcggttcttctaaagctcaggtgttcggtgctgacgccatgcgcagcccgcgcggcctgaaagcggtcggtccatatgttgtgaccaaagccatgggttcagcggtttccgcgtgcctggcaacgccgttcaaaatccacggtgtgaactactccatcagctccgcatgtgcgacctccgcacactgtatcggtaatgcggttgagcagatccaactgggcaaacaggacatcgtatttgctggcggcggcgaagagctgggctgggaaatggcctgtgagttcgacgcgatgggcgcactgtccaccaaatacaacgaaacgccagacaaagcgtcccgtacttatgatgcacaccgcgacggttttgttatcgctggcggcggcggtatggttgtggttgaagagctggaacacgcgctggcgcgtggcgcgcacatctatgctgagatcgtgggctacggcgcaacgtctgacggcgctgacatggttgctccatccggtgaaggcgcggtgcgctgcatgaagatggcgatgcacggtgttgatactccaatcgactacctgaactcccacggcacctcaacgccggtaggcgacgtgaaagagctgggtgcgatccgtgaagtgttcggcgacaacagcccggctatctctgcaaccaaagccatgaccggtcactctctgggcgcggcgggcgtgcaggaagcgatctactctctgctgatgctggaaaacggctttatcgcgccaagcatcaacatcgaagagatggacgagcaggcggctggcctgaacatcgtgactgaaaccaccgaacgtgagctgacgaccgttatgtccaacagcttcggtttcggcggcaccaacgccacgctggtgatgcgtaagctgaaagcgtaa

SEQ ID NO: 2283 - DNA, 1002 bp, Enterobacter cloacae
tgtgcaacattcatggtctgttggaggcaaaaatggcattattcgcctcttacagcaaaactggcatacgaccaggttcaggcagaaaggttatcaatgagctggattgaacgaattaaaagcaacattaccccaacgcgtaaagcgagcattcctgaaggggtatggacgaagtgtgatagctgcggccaggttctgtatcgcgcagagctggaacgcaatcttgaggtgtgtccgaagtgtgaccaccatatgcgtatgtcggcgcgcaaccgcctgcatagcctgctggacgaaggttctctggtagaactgggcagcgaactggagccaaaagatgtgctcaagttccgcgactccaaaaaatacaaagatcgtctggcctctgcgcagaaagagaccggcgagaaagacgcgctaatcgtcatgaaaggcaccctgcatgaaatgccggtggttgccgccgcgtttgagttctcctttatgggcggctcaatgggctccgtggtcggcgcgcgtttcgtgcgtgccgttgagcaggcgctggaagacaactgcccgctgatctgcttctccgcctccggtggcgcacgtatgcaggaagcgctgatgtccctgatgcagatggcgaaaacctctgcggcgctggcgaaaatgcaggagcgcggtctgccgtacatttcggtactgaccgacccaaccatgggcggcgtttctgcaagcttcgccatgctgggcgacctgaacatcgcggagccaaaagcgctgatcggctttgccggtcctcgcgttatcgagcagaccgtacgtgagaaactgccgccgggcttccagcgcagtgagttcctcattgagaaaggcgctatcgatatgatcgtccgccgtccggaaatgcgcctgaaactggccagcattctggcgaagctgatgaatctgccagcgcctaacccggacgagccgcgcgaaggcgtggtggtaccggatcaggaacccgaggcctga

SEQ ID NO: 2284 - DNA, 372 bp, Enterobacter cloacae
aatcaaatccaccttcacggaagtagaaggcggcgtgcagctggatatcgactttgtgttcgcctgcgaagcagaaacgctgatcttccagttaggcctgcgttaatactttttgcacgggcctatgatcgtgtaggccgggtaaggcaacgccgcaacccggcaacaaatctcacaaatgcctctgccatgcaggggcattttctttttcttctctgtgccttagctcgcaatttttcgcttccccgattggctcaatgtaaaaaaatagttaagactattatcaggtcagaccacttaatgtgcgcgcaaaatttttttacaggggagtgttatgagtcaggcattaccgcttatcacccgacacggtga

SEQ ID NO: 2285 - DNA, 2151 bp, Enterobacter cloacae
ataatggaaacgacatctgcatttaacctggctgttcgccttgataacgtggctgttatcaccattgatgtacccgacgaaaagatgaacaccctgaaggccgagttcggcgttcaggtgcgtgcgatgctcagacagatccgcgaaaacaaagcgatacgtggcctggtatttatctcggcaaagccggataactttattgccggggccgatatcaacatgattgcccgggcgaaaagcgctcaggaagcagaagacctggcgcgtcaggggcagcaggtaatggcggagatccatgcgctgtcgatacccgttgtcgctgcgatccacggggcctgcctgggcggtgggcttgagctggcgctggcctgtcacagccgcatttgtaccgacgatgcgaaaacggtactcggactgccggaggtacagcttggattgctgcccggttcaggtggcacgcagcgcctgccgcgtctggtgggcgtcagtacggcgctggagatgattttaaccggtaaacagctgcgcgcccgtcaggcgttaaaggcgggtctggttgatgaggtcgttccgcacgccatcttgcttgaggccgccgttgagcgggcgctgaaaggtcgtcaggcgaaacgccctctgccggtgcgcgagcgtatcctcgccgggccgctggggcgcacgctgctgttcaatatggtgggtaaaaaaaccgagcaaaaaaccaaagggaactatccggcagcgacgcgcattctgaaggtgattgaaaccggtttatcgcagggcagcagcagcggttatgctgcggaagcgaaagcctttggcgagctggcgatgacgccgcagtcgcaggcgctgcgcggcattttctttgccagcacggaggttaaaaaagatccgggcagtgaagctgaaccggctccgctgcgcgccattggcgttctgggtggtgggctgatgggcggcggcatcgcatttgtcaccgccagcaaaggcaaattgcccgtacgtatcaaagatatcaaccctaagggtatcaaccacgcgttgcagtacagctggcagaaccttgatcgcaaagtgaaacgccgccatatcaaggccagtgagcgcgataaaaccctcgcgatgatcactggcgccaccgactacagtgggtttgcacaccgcgatctggtgattgaagccgtgttcgaagatctggcccttaagcagcagatggtggcggacgttgaacagcactgcgcgccgcacaccattttcgcgtcaaacacctcgtctttgccgatcggcgacatcgcggcgaaagccgtgcgcccggagaaggtaatagggctgcactatttcagccctgtcgaaaaaatgccgctggtggaggttatcccgcatgccacaaccagcccgcaaactattgccaccgtggtgaagctggcgaaaaaacagggcaaaaccccgattgtggtcgcggacaaagccggcttctacgtcaaccgcattctggcgccgtacattaacgaagcgatgcggttgctgacggaaggggagaaaattgagcacgtcgatgacgctctggtgaagtttggtttccccgtcggcccaatccaacttttggatgaggtaggaattgatacggggactaaaattatccctgtgctggaagcggcttatggcgatcgttttgcgccgcctgcaaactttgtttctgcaattttgaaggacgatcgcaaaggcagaaaaaatgaacgcggtttctatctttacgccgcgaaagggcgtaaaagcaagaaacaggtcgacccttcggtttatgcgcttattcctgtcacgggtcaggcaaaattgtcggcggttcagtgtgctgagcgctgcgtaatgatgatgctcaatgaagcggcgcgctgctttggtgagcaggtgatcaagagcgcacgcgacggcgacatcggcgccgtgtttggtatcggttttccgccattccttggcggtccgttccggtatatggataccctcggggcgggtgaagtggttgcgattctgcaacgtctggcctcgcaatatggtccacggtttacaccttgtgacgaattattgcagatggcggaacggggtcagacattctggcccgtaagggaaactgattgcgtaaactga

SEQ ID NO: 2286 - DNA, 216 bp, Enterobacter cloacae
aaaatagtggctgttatcggcctgctcctggagcagacgtttgaccggaacctcgctgatttttttacgctgcgggcgatggacaatggtgtcgtgcgtgatttgacgcgtcccggtcatcagctggcggaagagagcctgatcctcctcgctgagcgatgttttctttttcattcgtcattctcatctcgtatttccgatagtgtacccgactaa

SEQ ID NO: 2287 - DNA, 975 bp, Enterobacter cloacae
gatgatcaccaaagggcgtcacgatccgtgcgtggggatccgcgcggtaccgatcgcagaagcgatgctggcgatcgtgctgatggatcacttcctgcgccagcgcgcgcagaatgcggatgtgacgaccaccattccacgctggtaactatgaaaaaaaccgcaatcgctctgctggcgctgctggtcagtggagcaagcctggccgctacgccgtggcagaaaatcacccatccggtagcggggagcgcgcagtccattggcgctttctccaacgggtgtatcgtcggcgcgcaggaacttccgctgcaatcggatacctatcaggtgatgcgcaccgaccagcgccgttatttcggccatcctgacctggtgctttttattcagcgtcttggcaaccaggtgcataatctggggctgggcacgatgctgattggcgatatggggatgcctgccggtggccgctttaacggcggtcacgccagccaccagaccggactggatgtggatatcttcctgcaattgccgaaaacgcgctggagctcagcgcagctgctgaaaccgcaggcgctggatctggtctcggccgacggtaaacgtgtcgtcgcctcacgatggtcgccggaaatttccagcatgattaagctggcggcagaggataacgacgtcacgcggatctttgttaatccggccatcaagcagcagctttgcctggatgcgggaacggatcgcgactggttgcgtaaagtgcgcccgtggttccagcatcgtgcccatatgcatgttcgcctgcgctgcccggcgaacagcctggaatgtgaagatcagccgctgccaccgcctggcgatggttgtggttacgaactgcaaagctggtttgaaccagccaagcctggaacctctaagcctgagaagaagacaccgcctccgttgccgccttcctgccaggcgctactggatgagcatgtactttaa

SEQ ID NO: 2288 - DNA, 912 bp, Enterobacter cloacae
gcaggtgcagttctggtctgttgccgacaacgtgcgtttcggcggcgcgctgatggcggtcaaaatcgcggaaaaactggtgcaggagtatctgtactgatgtcagatgtggaacaaaagccggtccacagaattgccctcggcattgaatacgatggcagtaaatactatggctggcagcggcagaatgaggtgcgcagcgtccaggagaagctggagaaagcgctctctcaggtagcgaatgaaccgataagcgtcttctgcgcgggccgcaccgatgccggcgttcacggcacggggcaggtggtgcattttgacaccaccgccgtgcgcaaagacgcggcctggacgctgggtgtaaatgcgaatttgcctggtgacattgccgtgcgttgggtgaaagctgtgccggatgattttcacgcgcgtttcagcgcgacggcgcggcgctaccgttatgtcatctataaccagcgcctgcgcccggcggtgttaagccagggcgtgacgcatttttatgaaccgctggatgcagaacgtatgcagcgtgcggcgcagtgtctgattggagagaatgattttacgtcgtttcgtgcggtgcagtgtcagtcccgtacgccgtggcgtaacgtcatgcacattaacgtcagtcggtatggcgcgtatgtggtggtggatatcaaagccaatgcctttgtacatcatatggtgcggaatattgtgggcagcctgatggaagtgggcgccggacaccagccggagagctggattgcagaactgcttgcagcgaaggacagaacgcttgcggcagcaacggcgaaagcggaagggctgtatctggtttcggtggattatccggaccggttcgacctgccaaaaccgccaatgggcccgctgtttttagcggactaa

SEQ ID NO: 2289 - DNA, 1281 bp, Enterobacter cloacae
caaccgggcatcatggaaaataaaagcattcctcaagccacgtcgcccctggccgcgtggctttcttatctggaaaacctgcacagtaaaactatcgacatgggccttgagcgcgtaagccaggttgccgcgcgtcttgacgtgctgaaacccgcgcctttcgtgtttaccgtcgccggcactaacggtaaaggcaccacctgccgcacgctggaatctgtcctgatggcggcggggtacaaagttggcgtttacagctcgccgcatctggtgcgctataccgagcgcgtgcgggtgcaaaacaccgagctggcggaatcggcccatacggcgtcgtttgccgctatcgaagcggcgcgcggcgaaacctcattaacctatttcgaatatggcaccctgtcggcgctgtggctgtttaagcaggcgcagctggacgtggtgatcctggaagtggggctgggcgggcgtctggatgccaccaatatggtggatgcggatgtcgccgtcgtcaccagcatcgcgctggatcacaccgactggctgggcccggaccgcgagagcattggccgtgagaaggccggtattttccgggccaataagcctgccgtggtaggcgaaccggacatgccacataccatcgctgaggtagcgaaagagaagggcgctcgtctgctgcgtcgcggcgtggactggcagtatgaggtgcaggacaacggctggcgcttcagcgatgcgcagggcgtgctggagagtctgcccctgtcgcaggtgccacagcctaacgcggcgactgcgctggcagccctgcgcgccagcggattagcggtaagcgagcaggcaatccgcgatggcattcagaacgcactgttaccaggacgttttcagattgtgagtgagtcaccgcgtctgattctggatgttgcacataacccgcatgcggcggcgtacctcgcaggacgtctcaaatcgttaccaaaaaccgggcgcgtgctggcggttatcggtatgcttcatgataaagatatcggcggcacgctggcctgcatggagagtgtggtcgatagctggtattgtgctcctctggaagggccgcgcggcgcgactgctgagcagttgatggaacatctcggcaaaggcgaaatctacagcagtgtggtttcggcctggcgtgccgcgatggcggaggctaaaccagaagataccgtgctggtgtgtgggtcattccacacggtggcacatgtcatggaagtgatggacgcggggagaaccggtggcgagtaa

SEQ ID NO: 2290 - DNA, 288 bp, Enterobacter cloacae
gctatgagtaaatgcagtgctgatgaaaccccggtttgctgctgtatggatgttggcaccattatggacaacaccgattgcaccgcctcttacagccgcgtattccctaaccgtgctgaagcggaagagacgctggccgcgctgagccagcgcgcgcgtgaagtcgaatccgatccgtgtgaaatcaaatccaccttcacggaagtagaaggcggcgtgcagctggatatcgactttgtgttcgcctgcgaagcagaaacgctgatcttccagttaggcctgcgttaa

SEQ ID NO: 2291 - DNA, 1344 bp, Enterobacter cloacae
tgtgcgcgcaaaatttttttacaggggagtgttatgagtcaggcattaccgcttatcacccgacacggtgaccgcattgccattatcagcgggttacgtacgccgtttgcgcgtcaggcaaccgcgtttcacggtataccggctgtcgatctgggaaaaatggtggtgggggagatgctggctcgcagcgagatcccgccagaggttattgagcaactggttttcggccaggtggtgcagatgccggaagcacccaatatcgcgcgtgaaatcgtgctgggtaccggcatgaatgttcataccgacgcctacagcgtcagccgcgcctgcgccaccagtttccaggcggtggcgaacgtggcggaaagcctgatggcggggaccattcgcgcggggatcgccggcggcgcggattcctcctccgtgctgcccatcggcgtcagcaaacagctggcccgcatcctcgtggatgccaacaaagctcgcactaccggtgcaaagcttaaactcttctcgcgtttacgcctgcgcgacctcatgcccgtgccacctgccgttgctgaatactccaccggcctgcgcatgggcgatacagccgagcagatggcaaaaacctacggtattacccgcgaacagcaggatgcactggcgcatcgctcgcatcagctcgctgcgaaggcctggtcggaaggcaaacttgccgacgaggttatgacggcttatatcccgcctttccgcgaaccgctggtggaagataacaatatccgtggcacctcgacgctggaggattacgcaaaactgcgcccggcgtttgatcgtaaacatggcaccgttacggcggccaacagtacgccactgacggacggtgccgccgccgtgatcctgatgacggaatcccgggcgaaagagcttggcatcacaccgctgggctatttgcgtagctacgcctttaccgccattgatgtctggcaggacatgttgctcggtccggcctggtccacgcccctggcgctggagcgtgcggggttgacgctggctgacttaaccctgatcgatatgcacgaagcctttgccgcacaaaccctggcaaacattcagctgctggcaagcgagcgcttcgcgcgcgatgtactgggccgcgcccacgcgaccggcgaagtggatcagagtaagtttaacgtgcttggcggatccatcgcctacggccatccatttgcggcgaccggcgcgagaatgataacccagactttgcacgagctgcgtcgccgcggcggcggttttggtctcgttaccgcctgtgcggcgggcggcctgggtgcagcaatggttctggaggctgaataa

SEQ ID NO: 2292 - DNA, 1023 bp, Enterobacter cloacae
cctcaagcgacacgcgtcattgctgatttatcgccgtcttcatggcaaactagccgccgaaaattatgcgagcatgccctggaggaaagagtggataaaatttttgtcgatgaagcagtaaacgagctgcataccatacaggacatgttgcgctggtcggttagccgcttcagcgccgccaatatctggtacggccacggtacggataacccgtgggatgaggccgttcagctggtgctgccgtctctctatctgccgctggatattccggaagacatgcgcaccgcgcgcctgacctccagcgaaaaacaccgcatcgttgagcgcgtgatccgtcgcgtgaacgagcgcattccggtggcttacctgaccaacaaagcctggttctgcggccatgagttctatgttgatgaacgcgtgctggtgccgcgctcgccgattggcgagctgatcaacaaccactttgacggcctgattaaccatcagccgcagcacattcttgatatgtgcaccggcagcggctgcatcgccattgcctgcgcgtacgccttcccggaagcggaagtggacgccgtcgatatctccaccgacgcgctggccgtcaccgaacacaacattgaagagcacgggctgattcatcacgtcacgcctatccgctctgacctgttccgcgacctgccgacgctgcaatacgacctgatcgtcaccaatccgccgtacgtggatgcagaagacatgtccgacctgccgaacgagtaccgtcacgagccggagctgggtctggcgtccggctctgacgggctgaagctgacccgccgcatcctggcctgcgcgccggattatctgaccgacgacggcgttctgatttgtgaagtgggcaacagcatggtacatctgatagagcagtacccggatgtgccgttcacctggcttgagttcgacaacggcggtgacggcgtcttcatgctgaccaaggcgcagctgcttgatgcacgcgaatacttcagcatttacaaagattaa

SEQ ID NO: 2293 - DNA, 1146 bp, Enterobacter cloacae
tccagcgggcttcggcccgtttcacaacgctcaaacacaaacaacaacatcggagccgtgatggcaggaaacagtattggacaggtattccgtgtgaccacctttggcgagtcgcacggtctggcactgggttgtatcgttgatggcgtcccgccaggcatcgaactgaccgaagccgatttacagcatgaccttgaccgtcggcgtccgggtacctctcgctacaccacgcagcgtcgcgagccggaccaggtcaaaattctctccggcgtatttgaaggccgtaccaccgggaccagcattggtctgctgattgaaaacaccgatcagcgttctcaggactacggcgcgattaaagacgtcttccgtccgggccacgctgattacacctacgaacaaaaatatggctttcgcgactatcgcggcggcggacgttcttccgcacgtgaaaccgcgatgcgcgtggcggcaggggcgattgccaaaaaatatctccagcagaaattcggcatcgttatccgcggctgtctgacccagatgggcgacattccgctggctatcaaagactgggagcaggtagaacttaacccgttcttctgcgccgatgccgacaagctggacgcgctggatgagctgatgcgtggcctgaaaaaagagggcgattccattggtgcgaaagtcaccgtggtggccgatggcgtgccggctggctggggcgagccggtatttgaccgccttgacgccgacatcgcccacgcgctgatgagcatcaacgcggtgaaaggcgttgaaatcggcgacggttttgacgtggttaagcttcgcggcagccagaaccgcgacgaaatcacgaaggcgggtttccagagcaaccatgcgggcggcattctgggcggcatcagcagcgggcagcaaattattgccaatatcgcgctgaagcccacgtccagcattaccgtgccgggccacacgattaaccgcgctggcgatgaagttgagatgatcaccaaagggcgtcacgatccgtgcgtggggatccgcgcggtaccgatcgcagaagcgatgctggcgatcgtgctgatggatcacttcctgcgccagcgcgcgcagaatgcggatgtgacgaccaccattccacgctggtaa

SEQ ID NO: 2294 - DNA, 540 bp, Enterobacter cloacae
agttgtgaatctcgccgatcagaagctcaatatcctgatgacgtttattggctcaacggcgggcgcgctgctggtccagcacgtacagtccgacattctgcgccagatcctgccgctgctggttatctgtatcggcctctatttcttactcatgccaaagctcggggaagaagatcgacagcgtcgccttcacggcctgccgtttgcgctgatcgccggtggctgcgtcggtttttacgatggcttctttggcccgggggcaggctcgttttacgcgctggcattcgtgacgctggccgggttcaacctcgccaaatccaccgcccacgccaaagtcctcaacgcgacctccaacgttggcggtctgctgctgtttatcattggcggcaaggttatctgggcaaccgggtttgtgatgatggcagggcagtttttgggcgcgcgcgcaggctcgcgtctggtattaagcaaagggcaaaagctgatccgcccgatgattgttgtcgtctcggcggtgatgagcgccaaacttctttatga

SEQ ID NO: 2295 - DNA, 588 bp, Enterobacter cloacae
cagccatggacaggagatcctcacctggttggggatgaactaatgaacagtacgcataactacgaacagctgattgagatcttcgatagctgttttgctgatgattttaatacccgtctgattaaaggcgacgacgaaccgatctatcttccagctgatgacgaggttccgtataaccgcatcatctttgcccacggcttttacgccagcggtttgcacgaaatttcgcactggtgtatcgccgggaaagcgcgtcgcgagctggtggactttggttactggtactgcccggacgggcgcgacgccgccacccaggggcagtttgaagatgtggaggtgaaaccccaggcgctggaatggctgttctgcgtggcggcgggtttcccgttcaacgtgagctgtgacaacctcgaaggcgacttcgagccagaccgtatcgtcttccagcgccgcgttcatgcgcaggtgatggaatatcttgagaaaggcatcccggcacgtccggcacgcctgatcgaggctttacagaattattaccacacgccggagatcacggcggaacgcttcccgtggccggaagatctttaa

SEQ ID NO: 2296 - DNA, 1239 bp, Enterobacter cloacae
aggtatagtagaagggagccgcgcggctccctttttttatgcctgaacacggagttatgcatgaaggctgttacccctgagaagagcgctccttccgggaacctttcccttttccgcatcgcctttgcggtgtttctgacctatatgaccgttggcctgccgctgccggtgatccccttgttcgttcaccaggagctgggctatggcaacaccatggtcggcattgcggtgggcattcagtttttagcgacggtattaacccggggctacgccggtcgcctggcggatcagcacggcgcaaaacgctcggcgttgcagggcatgtttgcctgcgggctggcggggggagcctggctgctggcggcgctgttgccaatagatgcagcgtataaattcgcgctgctggtggtagggcgcctgatcctcggctttggcgaaagccagctgctgaccggcaccctgacctggggaatggggctggtgggacctgcgcgttccggaaaagtgatgtcctggaacgggatggcgatttacggcgcactggcggcaggcgcgccgctggggctgctgatccacagccagtttggttttgcggcgttggcaggcaccaccatggtattgccgctgctggcgtgggcgtttaacggttcggtgcgtaaggtgcccgcccataaaggcgagcgtccttcgctgtggagcgtggtggggcaaatctggcagccggggcttgggctggcgcttcagggggtgggcttcgcggttattggtacctttgtctccctctatttcatgagccgcggctgggcgatggcgggctttacgctgacggcctttggcggcgcgtttgtattgatgcgcgtgctgtttggctggatgctggatcgctttggcggcgtgaaggtggccgtgtcgtcacttgtcattgagaccgtgggtctggtactgctctggcaggcgccctctgcatccgttgcgctgctgggtgcggcgttaaccggctgcggctgctcgctgatcttcccggcgctgggcgttgaagtggtgaagcgcgtggctccgcaggtgcgcggcacggcgctgggcggctatgcggcgtttcaggatatctcatacggcatcaccgggccgctggcggggctgcttgcaacgtcgtttggctatccttccgtatttctcgccggtgcggtgtcagcggtggtggggattgtggtgacgatggtggcgtttcgcaagcggtag

SEQ ID NO: 2297 - DNA, 1167 bp, Enterobacter cloacae
gtttacttcctctcaaacaggtactcagacgtgaaaatcctcgttgatgaaaatatgccttacgcccgtgagctgttcagccgcctgggtgaggttaaggctgtccctggtcgcccgattccggtcagcgaactggacgatgcagacgccctgatggtgcgctcggtgactaaagtaaatgaggcgctgctcaccggcaaaggggttaaatttgtcgggacggcaacggccgggaccgatcatgtggatgaccagtggcttaagcaagcggggattggtttttccgcggcgccaggctgtaacgccattgccgtcgtggaatatgttttctcctcgctattgatgctggccgagcgcgatggttttacgctgaaagaccgcaccgtcgggattgtgggggtgggcaacgtgggcggacgtctgcaaaagcgtctggaagcctggggaatcagcaccctgctgtgcgatccgccgcgtaaggataacggtgatgaaggcgacttccgcacactggatgagctggtcgacgagtgcgacgtcatcaccttccatacgccgctctttaaagaggggccgtataagaccctgcacctggccgacgaaaagctgatccgccgtctgaaggctggcactattctgataaatgcctgccggggaccggtggtggataacgcggcgctgctggcatgtctcgacgaaggacaagagcttagcgtcgtgctggacgtctgggagccagagcctgatctcaacgtcgcattgctggataaggtagacgtgggtaccgcacatatcgcgggttatacccttgaaggcaaagcgcgtggcacaacccaggtgtttgaggcttacagcgcctttatcggccatccgcagcaggtggcgctggatacgctgctgcccgccccggaatttggccgcattacccttcatggcctgctggatgaggcaacgctgaaaagactggtgcatttggtgtatgatgtgcgccgcgatgacgcgctgctgcgtaaagtggcgggtattccgggtgagtttgacaagctacgcaaaaattaccttgagcgccgcgagtggtcttccctgtatgtcatgtgcgatgacgcgtcagcggcggggctgctgcataaactgggatttaacgccgttcaccacccggcacgttaa

SEQ ID NO: 2298 - DNA, 1020 bp, Enterobacter cloacae
accaccatgtctgaaggctggaacattgccattttgggtgccactggcgccgtgggcgaagccctgcttgaaacccttgctgagcgtcagttcccggtgggtgagatttacgcactggcgcgtaccgacagcgcaggagaacagctgcgtttcggcgggaaatccttgatggtgcaggacgccgccgcgtttgactggacgcaggctcagctggcgttttttgccgcaggtgcgcaagccacggcgtcttacattgaagaagcgacaaattcaggctgtctggtgatcgacctgagcggcctgttctccctggagccggatgtgtcgctggtggtgccggacgtcaacccgtttgtgctggctgactaccgcaaccgcaacatcattgcagtaccgaacagcctcaccagccagctgctgaccgcgctgaagccgctgatcgacgacggtggcctgtcgcgtatttccgtgaccagcctgctgtcagcctccgctaacggcaaaaaagccgtagacgcactggcagggcagagcgcgaagctgctgaacggtatcccgatcgacgaagatgatttctttggccgccagctggcgttcaacatgctgccgctactgccggatcgtgaaggttcggtgcgggaagagcgtcgtatcgtcgatgaagcacgcaaaattttgcaggatgacgggctaatgatctccgcgaatgtcgtgcagtctccggtcttttacggccacgcgcagatggtcgggtttgaagccctgcgtccgctggcggctgaagaagcccgcgacgcgtttggccgcggagaggacattgtcctgtccgaagagagcgaattcccgacgcaggtgggcgacgccaccggcagcgcgcatctctctgtgggctgtgtgcgtaacgattacggtatgcctgagcaggtgcagttctggtctgttgccgacaacgtgcgtttcggcggcgcgctgatggcggtcaaaatcgcggaaaaactggtgcaggagtatctgtactga

SEQ ID NO: 2299 - DNA, 672 bp, Enterobacter cloacae
ggcttagacaatatggacgtaatacgttttctgattgatttcatcctgcatattgatgttcacctggcggagctggtcgcgcagtacggcgtctgggtttacgccattctgttcctcattctgttctgtgaaaccggccttgtggttacgccgttcctgccgggagattcactgctgttcgtggcgggcgcgttatccgcactgccaacgaatgacctgaatgtccatctgatggttgtcctgatgatcatcgccgcgattgttggtgatgcggtcaactacaccatcgggcgggtgtttggcgagcggttgttcagtaatccggactcgaagattttccgccgcagttatttagataagacccatgcgttctatgagcgccatggcggtaagaccattatccttgcccgttttgtgcctattgtgcgtacatttgcaccgtttgtggcgggaatgggtcacatgtcctatcgtcattttgctatgtacaacgtggtgggcgcgctgctgtgggtgctgctgttcacctatgcaggctacctgtttggcgatctgccggtggttcaggaaaaccttaagttactgattgtagcgattattgtgctttccgtactgcctggcgtcatcgaaattatccgtcacaaacgcgcggcggcaaagcaagcgaagtaa

SEQ ID NO: 2300 - DNA, 339 bp, Enterobacter cloacae
tggacgcggggagaaccggtggcgagtaagtttcagaaccgtttaacaggaaccattgtgctggtcgcgctcggggtgattattctcccgggattgctcgacgggcagaaaaagcattaccaggatgaatttgcggccattccgctggtacccaaaccgggcgatcgcgacgagcccgatatgctgccagcggcaacgcaggcgctgcctgcccagccgccagaaggcgcagcggaagaggtgcgcgcaggtgatgcagccgcgccgtcgctcgatccctcgcgcctggcgacgaacaatcacattcttcaccaagggagctgccgctccgcatcacac

SEQ ID NO: 2301 - DNA, 771 bp, Enterobacter cloacae
  unsure (755)
gtgaaagactacatggttgcgcgcaccagccgtaaagagcgtttctctatgtttcgcgatcgtccactgaagcgcatgaagtctcctcgtgacgaagatgacgttgaagacgacatcgacggtcttgacgacgacggcgtgggtgaagttcgtgttcatcgggtcaatactgcgcccggcgcagcgcatggagagcatgaagccccccgcgctccgcagcaccagtatcaaccaccgtatgcctctgcccagccgcgccagccagcgccgccgccagtggaagaacctgttcgtcatccgccgcaccagcctgtgcaacagcagcccgttgcgccacagcctgtacagccgcaacctgtccaacagcctgcacagccagtgcatcagccacagcctgttcagcagccgcagccggtacaacaaccgcagccgcagcctgaaccgcctgcgccacagcccgccccgcgcgctgagccagagccggttgcagagccagaaccggttgttgaaaagccgcagcgtaaagaagcggtgatcattatgaacgtggctgctcatcatggcacccatctgaacggtgatgtgctgcttaacagcatccaacaggcaggcttcaagttcggcgacatgaatattttccatcgccacctgagtcctgacggcagcggtccggcgctgttcagcctggccaatatggtcaatccaggcacgttggtcttctacctcgggaactcgacagatgcccgcaaaaattntatatccccccccgcc

SEQ ID NO: 2302 - DNA, 813 bp, Enterobacter cloacae
attccaccggccgtcactatctcttcagggcgtttcatgcatgcagatcggtctacgcaacgtgctaccacgcggctatgtattcagtgcggactttttctcttacaacacggggcagaaagcgccctcgtcgaagaactttccacacgccttggtctggcgctggggatggacagcgttgagagctccatctcgtcaaatgccattgtactgaccaccattaaagacggacagtgcctcacctccactcgtaaaaatcatgaccgcggcattaacatgcacgtcgtgacggaagtgcagcacattgtgatccttgctgaacacaggctgctcgatctgcgggaaatagagaaacgcttcaaccagatcaaacctctccggtatccacgctggctggttgtgctgatggtgggactctcctgcgcctgcttctgcaagctcaacgcgggcggctgggacggcgctgtcgtgaccttctttgccagcagcatcgcgatgtatgtccgccagttgttgacgcacaggcaactgcatccgcaaattaacttctgcatcacggcatttgtggcgacaaccgtatccggcctgcttttgcgccagccttacttcgccagcacgcctactgttgcgatggccgccagcgtattgctgctggtgccgggttttcccttaatcaatgccgtcgctgatatgttcaaaggccacatcaacaccggtctggcgcgctgggcgatagccagcctgctgacgctggcgacctgtatcggggtggtaatggccatgacactctgggggttacgcggatgggcgtga

SEQ ID NO: 2303 - DNA, 1479 bp, Enterobacter cloacae
ggagactgcaaaatgaaaaagattaaccactggatcaacgggaaaaacgtcgccggaagtgagtacttccaaaccactaacccggcctccggcgaggtgctggctgaagtagcctccgggggcgaagccgaaatccatcaggccgttgccgccgccaaagaggcgttcccgaaatgggccaacctgccgatgaaggagcgtgcgcgcctgatgcgtcgcctgggggatctgattgaccagaacgtgccggacattgccgcgatggagaccgccgacaccggcctgccgatccaccagaccaaaaacgtgctcattccgcgcgcctcgcacaacttcgagttcttcgccgaggtgtgccagcagatgaacggcaaaacctacccggtcgacgacaagatgctcaactacaccctggtgcagccggtgggtgtctgcgcgctggtgtcgccgtggaacgtgccgtttatgaccgccacctggaaggtcgcgccctgtctcgcgctgggtaacaccgcggtgctgaagatgtctgaactctccccgctgaccgccgaccgtctgggcgagctggccctcgaagcgggcattccggcgggcgtgctcaacgtggtgcagggctatggcgccacggcgggcgacgcgctggtgcgtcatcatgacgtgcgcgccgtctccttcaccggcggcaccgccaccgggcgtaacatcatgaaaaacgccgggctgaagaagtattctatggagctgggcggcaaatctccggtgctgatttttgaagacgcggacatcgagcgcgcgctggacgccgccctgttcaccattttctccatcaacggcgaacgctgcaccgccggctcgcgcatcttcatccagcagagcatctacccggagttcgtcaaacgctttgccgagcgcgccaaccgcctgcgcgtgggcgacccgaccgatccaaacacccagattggcgcgctcatcagccagcagcactgggaaaaagtctccggctatatccgcctcggcattgaagagggggcaaccctgctggcgggcggcccggacaaaccgaccgatctgcctgcgcacctgaaaggcggcaacttcctgcgcccgaccgtgctggcggatgtcgataaccgcatgcgcgtggcgcaggaagagatcttcgggccggtggcctgcctgctgccgtttaaggacgaagcggaaggcctgcgcctggcgaacgacgtggagtatggcctggcgtcgtacatctggacccaggacgtcagcaaagtgctgcgtctggcgcgcaacatcgaagcgggcatggtgttcgtcaacacccagaacgtgcgcgacctgcgccagccgtttggcggcgtgaaggcctccggcaccgggcgcgaaggcggcgagtacagcttcgaggtattcgcggagatgaagaacgtgtgcatctccatgggcgaccatccgattccaaagtgggggatctga

SEQ ID NO: 2304 - DNA, 330 bp, Enterobacter cloacae
agacgcctacgccgtccagcgcgaatgggtgagcctgaaaattgccgaaggccgcgtgctgaaaggccacaagatcggccttacctccaaagcgatgcaggccagctcgcagatcagcgagccggactacggtgcgctgctggacgatatgttcttccacgacggcagcgacatccccgtggatcgctttatcgtcccgcgcatcgaagtggagctggccttcgtgctggcaaaaccgctgcgcggcccgaactgcacgatcttcgacgtctacaacgccacggattacgtcatccccgccctggagctgatcgacgcccgctgccataa

SEQ ID NO: 2305 - DNA, 342 bp, Enterobacter cloacae
gggccgtacggacaaagaaaccccgtacgtgccggtgccggaaggcggcgtgaagacctcctcacaccattaattaagcatgttactgtaggcccggatcgctgcgcgcctccgggcttcttctatctggaaccctcaatgtttggtaacttaggcgaagcaaaaaaatacctcggtcaggcggcgaaaatgctgattggcattccggactatgacaactacgttgagcatatgaagaccaaccatccggataagccgtacatgacttacactgaattcttccgcgagcgtcaggaagcgcgctacggcggaagtggagaaggcggcgtccgctgctgctaa

SEQ ID NO: 2306 - DNA, 489 bp, Enterobacter cloacae
cttgcaattgtatcgcgcactatctatattcatttcatggatgcaaaaatgaacgacaccactaacgcgcttctgctggataaccagctctgttttgccctctattcggcaaatctggcgcttaacaagctctaccggcaactgctggcgccgcttaacctgacctacccgcaatacctggtgatgctggtgctgtgggagcaggatgatattacggtatcagacattggcgagcggctgttcctggattccgccacgctgacgcccctgctgaaacgcctggaaagtgcaggattaatcttccgccagcgttcccgtcaggatgagcgtcaggtcgccgtcaccctgagcgacgcgggtcgggcgctgcaacagcaggccgtgacgataccccacgccgtgggctgtgcagcgcagtgtgataccgacaccatgctggcgctcaagcaccagctcgaacttttgcgccaacagcttcatcgcgcgtaa

SEQ ID NO: 2307 - DNA, 444 bp, Enterobacter cloacae
gatgaggaacctgccatgtctttagaaaaagttgtttacactgccaaagccaaagcaaccggaggccgtgatggccgcgcaacgtcttccgatggcgttctggatgtcaaactgggtgtccccaaagagatgggtggcatggggggtgaagtaaccaaccctgaacagctgttcgctgcgggctactccgcctgcttcctgggcgcaatgaagttcgttgcggcacgcgacaaattcgctctgccaaaagatgcctttattgaaggcgaagtggggattggcccgctgccaaccggttttggtatcgaagcgaagctgaacatccacgttgaagggatggacgcagcggaagccaaaaaactggtggatgcggcgcatatcgtctgtccgtactctaacgcgacgcgcggcaatatcgacgtgacgctgaacatcatcgcgtaa

SEQ ID NO: 2308 - DNA, 756 bp, Enterobacter cloacae
tggattccgaggtgcgaaatgaaaaacgtcggcgacctgatgaaacgtttgcagaagatgatgcccgccaacgtgaagcccgccttcaccaccggtgaagagctgctggcgtggcaaaaagagcagggtaaaattcgcgcggctgccctcgcccgcgaaaaccgcgcgatgaaaatgcagcgcacctttaaccgctctggcattcgccctctgcaccagaactgctccttcgagaattataaggtcgagtcgcaggggcagatgaacgccctcaaccaggcgcgccagtatgtggatgaatttgacggcaacattgccagcttcatctttagcggaaaacccggcacggggaaaaatcaccttgcggccgctatctgcaacgagctgctgctgcgcgggaagtcagtgctgattatcaccgtggccgatattatgtccgccatgaaggacaccttcagcaaccgcgaaaccagcgaagaacagctgctgaatgatttaagtaacgtggatttgctggtcatcgacgagatcggcgtccagacggagtcccgctacgaaaaagtgatcatcaaccagattgtcgatcgccgttcgtcgtcaaaacgcccaacaggtatgctgacgaaccacaatatcgacgagatgacccgacttcttggcgagcgggtaatggatcgcatgaagctgggtaacagcctgtacgtcatcttcgactgggacagctaccgcagccgcgtcaccggcaaagagtattaa

SEQ ID NO: 2309 - DNA, 489 bp, Enterobacter cloacae
atcattatgaaaaaacagtttcttatcagcatccttactggcaccctgctggtgactggcgcagcgcaggccgcatcatggcaggagtcgctctccagcgcagcaagtgagttaaccaaagagagcggcacttcccagggcgggctgtcagcctcgtccctcaccggcctgctgagtaacagctcccaaagcctgagcgccggcacgatgaacaatgcggcgggcattctggaatactgcgcgaagcagaaactggcttccgtcaccgataccgaaaacattaaaaaccaggtgctgggtaaactgggtctggacacccaggagcagaaagcggacaccaactatatggacggtattcagggcctgctgaacgcgcaaaatggccagcagctgaacctcagcacccttggaaattcatctctggcgaaacaggtgaaaacgaaagcctgcgatctggtgctgaaacaaggcgttaatttcctctcctga

SEQ ID NO: 2310 - DNA, 531 bp, Enterobacter cloacae
aattgtgagcagcgctggctgatgacggcgttcacccttcgcccgacgcgcatcgacgacgtcgctgccctgcccgccatcgaacgtgcggcggggcagcggtttcgcgacgttcctgagctggcctggctggcagacaatgaggttatttgtgttgaagatcacctcggttacgccggacgcggattaagctggctggcgctggctgacgacaggcctgtgggctttattctcgccgaagctcatccatcgtcgctgtttattgtggaactgtcggttcacctggactggcagggacgaggtctcggacgccagttaatcgcccgtgccgtcgcgcatgcccgcagtctggggctgaactcgctgacgttaacgacgtttcgtgatgtcccgtggaatgcgcccttctacaggcgattagggtttgaaatgctgacgacgctgacgccggaactgcgccagaaacgcgaggaagagacggcgcacggtttagcgtatggttcccgctgcgccatgcgcctgcctctgtaa

SEQ ID NO: 2311 - DNA, 1314 bp, Enterobacter cloacae
aatcaaaaccggacagccggtttgaggagtatgggaatgaaaggtactgtttttgccgtagcgctaaaccaccaaagccagcgtgcagcctgggctgaggcgtttgaaaaagccccctataacgcgccgccaaaaacggcggtgtggtttatcaagccacataacaccgttattcgcgcaggcgagccgattcccttcccacagggagaaaccgtgttaagcggcgcaacggtggcgctggtggtgggcaaaaccgccagcaaagtccgcgttgaagaggcggcggcgtacatcgctggctacgcgctggccaacgaaatcagcctgccggaagagagcttctaccgtccggcgatcaaggccaaatgtcgggatggattttgcccgctcggcgaacctgtcgccgttgataacgtggacaacctgaccatcatcaccgagatcaacggtcgcgaagcggaccactggaacacggccgatctgcaccgcaacgccgccgaactgctgagcgcgctgagcgaatttgccaccctgaaccccggcgatgcgatattgctcggtaccccacaaagccgtgtcgaaattcgcccgggcgatcgggtacgcattctggcagagggatttccgccgctggaaaacccggtggtagtggaacgcgacgttaccattgcttcgcgcacgccgccgcacgccacgctgttcgcactcggcctgaactacgccgatcacgccagcgagctggacttcaaaccgcctaccgagccgctggtgtttatcaaagcgccgaacacctttaatggcgacaaccagacctcggtgcgcccaaacaacattgaatacatgcattacgaagccgagctggtggtggtcatcggtaaaaccgcgcgtaaggtcagcgaagccgaggcgatggactatgttgcgggctacacggtgtgcaacgactacgccatccgcgattatctcgaaaactactatcgcccaaacctgcgggtgaaaagccgcgacgggctgacccccatcagcccgaacgtggtgccaaaagaagccatccctgacccgcacaaccttcgtcttcgcacctacgttaacggtgaactgcgtcaggaaggcaccaccgccgatctcattttcagcatcccattcctgattgcgtatctgagcgatttcatgaccctgcaaccgggcgacatgattgccaccggcacgccgaaggggctgtccgacgtggtaccgggcgatgaagtggtggtggaagtggagggcgtaggccgtctggtaaaccgaattgtcagtgaggagactgcaaaatga

SEQ ID NO: 2312 - DNA, 819 bp, Enterobacter cloacae
aaacaggatatcgccatgctcgacaaacacacccataccctgatcgcccaccgtctgcatcaggcggaacaatcccgggagcagatccgcgcgatctcgctggagtacccggagatcaccattgaagacgcctacgccgtccagcgcgaatgggtgagcctgaaaattgccgaaggccgcgtgctgaaaggccacaagatcggccttacctccaaagcgatgcaggccagctcgcagatcagcgagccggactacggtgcgctgctggacgatatgttcttccacgacggcagcgacatccccgtggatcgctttatcgtcccgcgcatcgaagtggagctggccttcgtgctggcaaaaccgctgcgcggcccgaactgcacgatcttcgacgtctacaacgccacggattacgtcatccccgccctggagctgatcgacgcccgctgccataacgttgacccggaaacccagcgcccgcgcaaggtgttcgacaccatctccgataacgccgccaacgcgggcgtgatcctcggcggccgcccgattaaacccgacgagctggatctgcgctggatctccgccctgctttaccgcaacggcgtgatcgaagagaccggggtcgccgcaggcgtgcttaaccacccggcgaacggcgtggcgtggctggcgaacaaactcgcgccatacgacgtgcagcttgagccaggacaaatcatcctcggcggctcgtttacccgcccggttgccgccagcagaggcgacaccttccacgtcgactacggcaacatgggctccatcagctgccgctttgtgtaa

SEQ ID NO: 2313 - DNA, 540 bp, Enterobacter cloacae
gctgctgaaataacgcagcgggaggtttcaatgcaatctgaagaacgcctgcgttttcgcgacgcgatggccagcctgtcggcggcggtgaatgtggtcaccaccgagggcgatgcgggtcgctgcggcattaccgccaccgccgtctgttcggtcacggacaccccgccttcggtcatggtctgcatcaacgccaacagcgccatgaacccggtcttccagggcaacggcaaactgtgtgtcaacgtgctgaaccacgagcaggagatcatggcccgccactttgccgggatgaccggcatggcaatggaggagcgctttgctctctcctgctggcagaaaggaccgctggcgcagccggtgctgaaaggcgctctggcaagcctggaaggcgagataacccaggtgcaaaccatcggtacccatctggtctaccttgtggagattaagaacatcatcctcagcagcgaggggcacggcctgatctacttcaaacgccgtttccacccggtgatgatggagatggaagccgcggtttga

SEQ ID NO: 2314 - DNA, 2319 bp, Enterobacter cloacae
ccactcaccctcgcttttgaccgctcacgcatcgctttcaaccactcacctatttaccgtgctttatacgcgcgaggatctggcacgatcgctccagcattaatcaatacctcctcacaacgaaccctgacccttttttctttacataaaaaaccaggtcttactatggatactaaaaaactacttaagcacgtgccctgggccatcctcgggatcatcggtgctttctgtctggcggttgtcgcattacgccggggcgagcacgtcagcgccctgtggatcgtggtcgcgtcagtttccgtctatcttgtggcttatcgctactacagcttgtacatcgcgcagaaggtcatgaagctcgacccgacgcgcgccaccccggcggtcattaacaatgacggcctgaactacgtgccaaccaaccgttacgtgctgtttggtcaccacttcgccgccattgcaggcgcgggtccgctggtcggtccggtgctggctgcgcagatgggctacctgccgggtacgctctggctgctggcgggcgtggtgctggcgggggcggtgcaggactttatggtgctgtttatctcctcgcgccgtaacggttcgtcgctgggtgagatgatcaaagaggagatgggccgcgtgccaggcaccatcgccctgttcggctgcttcctgatcatgatcatcatcctggcggtgctggccctgatcgtggtgaaagcgctggccgaaagtccgtggggcgtcttcaccgtctgctctaccgtaccgattgcgctgttcatgggcatctacatgcgcttcctgcgccctggccgcgttggcgaggtgtcggtcatcggtatcgtgctgctggtcgcctccatctacttcggcggcgtgattgcgcacgacccgtactggggcccggcgctgacctttaaagacaccaccatcaccttcgcgctgatcggttacgcgttcatctcagcgctgttgccggtgtggctgattctggctccgcgcgactacctggcgaccttcctgaaaatcggcgtgatcgtcgggctggcaatcgggattgtgatcatcaatcctgagctgaaaatgccagcggtgacacagtacattgacggtaccggtccgctgtggaaaggcgctctgttcccgttcctgtttatcaccatcgcctgcggtgccgtgtctggcttccacgcgctgatcgcctcgggcaccacgccgaagctgatggccaacgaaaccgacgcgcgcttcatcggttacggcgcgatgctgatggagtccttcgtggcgatcatggcgctggttgcagcgtcgattatcgagccaggtctgtactttgcgatgaacaccccaccagcgggtctcggcatcaccatgccaaacctgcatgagatgggcggcgaaaataccgcgctgatcctggcgcagctgaaagacgccagcgcacacgcggcggcgaccgtcagctcctggggcttcgtaatttcgcctgagcagatcatgcagaccgcgaaagacatcggcgaaccgtccgtgctgaaccgcgcaggtggcgcgccaacgctggcggtgggtatcgcacacgtgttccacaaagtgctgccgtgggcggacatgggcttctggtaccacttcggtattctgtttgaagcgctattcatcctcaccgcgctggatgccggtacgcgtgcaggccgcttcatgttgcaggatctgctgggtaacttcgtgccattcctgaagaaaaccgactctctggtggccggtgttctgggtaccgcgggctgcgtaggcctgtggggttatctgctgtatcagggcgttgttgacccgctgggcggcgttaagagcctgtggccgctgttcggcatctctaaccagatgctggcggctgtggccctggtgctgggtaccgttgtcctggtgaagatgaaacgcaccaaatacatctgggtcaccgtggtgcctgcgctgtggctgctgctctgcactacctgggcgctgggtctgaaactgttcagcaccaacccgcagctggaaggcttcttcttcatggctaaccagtacaaagagaagattgccgcaggcggcgcggatctgaccgcgcagcagattgccaacatgaaccatatcgtggtgaacaactacaccaacgcgggtctgagcattctgttcctggtggtggtgtacagcatcatcttctacggcatcaaaacctggatgaaagtgcgtaacgttgagggccgtacggacaaagaaaccccgtacgtgccggtgccggaaggcggcgtgaagacctcctcacaccattaa

SEQ ID NO: 2315 - DNA, 699 bp, Enterobacter cloacae
cttacactgaattcttccgcgagcgtcaggaagcgcgctacggcggaagtggagaaggcggcgtccgctgctgctaaaggagaaaccatgaccccgattgccgttaccctgctgaccggttttctcggcgccggtaaaaccaccctgctgcgccacattctgaacgagcagcacggcttcaaaatcgccgtcatcgaaaacgaatttggcgaagtctccgttgacgatcagctgattggcgaccgcgccacccagatcaaaaccctgaccaacggctgcatctgctgcacccgctctaacgaattagaagacgccctgctggacctgctcgacagccgcgatcgcggtgacatcgtcttcgaccgtctggtgatcgagtgcaccggcatggccgaccccggcccgattattcagacctttttctcccacgagatcatctgccagcgctacctgctggacggtgtcatcgctctggtggatgcggtacacgccgacgagcagatgaaccagttcaccatcgcccagtctcaggtgggctacgccgaccgcatcctgctgaccaaaaccgacgtggcaggtgaaagcgaaaaactgcgcgagcgcctgacgcgcattaactcgcgtgcgcccatttatacggtgacgcacggcgatatcgatctcgctcagctgttcaacaccaacggctttatgctgtga

SEQ ID NO: 2316 - DNA, 588 bp, Enterobacter cloacae
tatgttcaaaggccacatcaacaccggtctggcgcgctgggcgatagccagcctgctgacgctggcgacctgtatcggggtggtaatggccatgacactctgggggttacgcggatgggcgtgatcgattttctgctcgcactggcgcaggacatgctcctggcagcccttcccgccgttggctttgcgatggtgtttaacgtcccgcaacgtgcattaccctggtgtgcgctgctgggtgccattggccacgggtcacgtatgatcatgatgaccgcgggctttaatatcgaatggtcgacgtttatcgcctccatgctggtcggcagcatcggtattcagtggtcccgctggtatctggcgcatccgaaggtgttcaccgtggcggcagtcattcctatgttcccgggtatttcagcctatacggcgatgatttccgccgtcaaaatcagccactttggctacagcgaaccgcagatgatcctgcttctgagcaacttccttaaagcctcgtcgattgtgggcgcgctctccatcggcctgtcgatccccggcttatggctttaccgcaaacgtccacgcgtataa

SEQ ID NO: 2317 - DNA, 555 bp, Enterobacter cloacae
gaaagtgttatgtcctccagaatcctgaccaccagcattgctggcattgatgcctttatgcgcgatcctcgcggtgtgttgacgcacgccgaaggcggcacgctcgcggtatttgccgacaacgccccggcgttttatgcggtcacgccggaacgtctggcgcagcttctggaaattgaagcgaagctgtcgcgcccggcgagcgatgtcatgctggataatcagttttttgacgaacccgccagcgctccggtggccgttccaatggggaaatttcccatgtacgccggttggcagccggacgccgattttcagcggcaggcggccttatggggaatagccctcgcgcagcccgcgacgccagaagagctggcggcctttaccgcttactggcaggctgaaggaaaagtcttccaccatgttcagtggcagcaaaagttcgcgcgcagtctgcaaatcaaccgcgccagcaacaatggccagccaaaacgtgatatcaatgccttttcagaaccggacaaaaaaatccctgatggattccgaggtgcgaaatga

SEQ ID NO: 2318 - DNA, 2334 bp, Enterobacter cloacae
gcaattagccggctaagcgtccggcatgatgaggatctgctgttgtcagagttaatgtcccttgtccttttcctggcttccatcggcgtttatgcctggaaagccggtcgtcacacctggtggtttgtggccaccctggtggtgctcggcatttttattgttttaaacattacgttatatgccagcgattattttaccggcgacggtattaacgacgcggtgctctacacgttgaccaacagcctgaccggcgctggtgtaggtaagtatatccttccgggtctggggctggtggtcgccctggtgggcatcttcgccgcgctggcctgggttctgcgccgtcgccgtcaccgtccgcatcatcatggctacagcctgctggcgctgtgcctggcgctggcctccgtggatgccagccccgcattccatcaaattaccgagctggtaaaatcccagtcgcgcgatggcgacccggactttgcggcctattacaaagaaccctcgaagaagatcgacaatcccagactcaacctggtctatatctacggcgaaagtctggagcgcacctattttgataacgatgctttcccgaacctgacgccagagcttggcgcgctgaaaaaccagggcctcgacttcagccacaccatgcagctccctggcacggattacaccatcgccgggatggtggcctcccagtgcggcattccgctgttcgctccgtttgaaggcaacgcttccgcctcaatgtcgagcttcttcccgcagaacatttgcctcggcgatatcctgaaaaactcgggctatgaaaactactttatgcagggcgctaacctgcgctttgccgggaaagatgtgttcctgaaatcccacggtttcgatcacttgtatggttccgaagagctgaaaaccacggtggccgatccggcctaccgcaacgactggggcttttacgacgataccgttctggatgaaacctggaagaaattcgaggagctttcccgcgccggtaaacgcttctcgctgtttgcgttgaccgtcgacacgcatcatccggatggttttgtctcacgcacctgtaaacgtcagggctacgacattgacggtaaaaacaacaagtcgttcagcgccgtgacctgtagccaggagcatatcgcggcgttaatcgaaaaaatcaaagcgtcgccgtatttcaaaaatacggtcatcgtcgtctcatctgaccatctggcgatgaaaaacagcgcctgggatgagctgaataagctggatcgcagcaacctgttctttgtgctgcgcggcgataaaccgcagcaggagatcattgccgctaaacgtaactcgatggataacggcgctaccgtgctggatattctgggtggcgataacttcattggactgagccgcagtacgctgtcgggccagtccctgtcggaaatcttcctcaacatgaaggaaaaaatcctcgcctggaagccggatatcattcgtctgtggaacttcccgaaagagataaaagacttcaccatcgatcaggataaaaaaatgatcgcgttctccggcagccatttccgcctgccactgctgctgcgcgtgtcggataaccgcgtcgagccgctgccggaaagcgaatactccgcgccactgcgcttccagctggcggaattcgccccgcgcgataatttcgtctgggtcgacaaatgctacaaaatgggccagctctggtcgcaacagctgtcgctgtccaccgactggtgcgtctctcaggggcaactcggcggcgagcaggccgtgcaacacgttgacaaaccgcagtggcagggaaaaaccgcgtttaaagatacggttattgataccgcacgctatcagcgcaacgtagacctgctgaaaatcgtcgacaacgacattcgttataaagcagacagcttcatctttaatgttgccggcgcgccggaagaggtgaagcagttcagcggtatttcgcggccggaatcatgggggcgctggtctaacgcccagttaggcgatgaggtgaaaattgaatatacccatccgctgccggagaaattcgatctggtgatcaccgccagggcatttggtcccaacgcaaaccgtcctataccggtgcgcgtcggcgataaagaacagacgctgacgctgagcaatgatgtcaccaccagcacgctgcacttcgataacccaacgcgcagcaatacgctggtcattgtgccgcccgatccgcagtccactaacgaagggaatattctcggtcacgctccgcgcaagctggggatcggcatggtggagattaaaattgtgagcagcgctggctga

SEQ ID NO: 2319 - DNA, 1140 bp, Enterobacter cloacae
ggacgaagcggaaggcctgcgcctggcgaacgacgtggagtatggcctggcgtcgtacatctggacccaggacgtcagcaaagtgctgcgtctggcgcgcaacatcgaagcgggcatggtgttcgtcaacacccagaacgtgcgcgacctgcgccagccgtttggcggcgtgaaggcctccggcaccgggcgcgaaggcggcgagtacagcttcgaggtattcgcggagatgaagaacgtgtgcatctccatgggcgaccatccgattccaaagtgggggatctgaaaatgggcaaattagcgttagcggcaaaaatcacccacgtgccgtcgatgtatctctccgaactgccgggcaaaaaccacggctgccgccagggcgccatcgatgggcataaagaaattagcaagcgctgccgggagctgggcgtcgacaccattatcgtcttcgacacccactggctggtgaacagcgcgtatcacatcaactgtgcggaccatttctcaggcgtctacaccagcaacgagctgccgcattttattcgcgacatgacctacgactacgacggcaacccggaactcggccagctgattgccgacgaagcggtgaagcttggcgttcgcgccaaggcgcacaacatcccgagcctcaagctggagtacggcacgctggtgccgatgcgctacatgaacgcggataagcacttcaaagtggtctccatctcggcgttctgcacggttcacgacttcgccgacagccgcaggctgggcgaggccatcatcagcgccatcgaaaaatacgacggcaccgtggcggtgctcgccagcggctcgctgtcgcaccgctttatcgacgaccagcgcgcggaggaagggatgaacagctacacccgcgagtttgatcgccagatggacgagcgcgtggtgaagctgtggcgcgaggggcagttcaaggagttttgcagcatgctgccggagtacgccgactactgctacggcgagggcaacatgcacgacacggtgatgctgctggggatgctcggctgggacaaatacgacggtaaggtggagtttctcaccgagctgttcgccagctccggcaccggccaggtcaacgccgttttcccgctgcccgcctaa

SEQ ID NO: 2320 - DNA, 390 bp, Enterobacter cloacae
ggagtcgttatgccgcactttattgctgaatgtaccaacaacatccgcgagcaggccgacctgccgggtctgttcgccaaagtgaacgaggcgctcgccgccacggggatcttcccgctcggcggtatccgcagccgcgcccactggctggatacctggcagatggccgacggtaagcacgattacgcctttgtgcatatgacgctgaagatcggcgcggggcgcagcctggaaagccgggaagaggtcggtgaaatgctgtttgcgctgatcaaaacgcacttcgcagagctaatggcgggccgatatctggcgctctcgttcgagctggacgagctgcacccgacgcttaattacaagcaaaacaacgtgcacgcgttgtttaaataa

SEQ ID NO: 2321 - DNA, 1017 bp, Enterobacter cloacae
tcgaagagaccggggtcgccgcaggcgtgcttaaccacccggcgaacggcgtggcgtggctggcgaacaaactcgcgccatacgacgtgcagcttgagccaggacaaatcatcctcggcggctcgtttacccgcccggttgccgccagcagaggcgacaccttccacgtcgactacggcaacatgggctccatcagctgccgctttgtgtaaggagatgaccatgcaaaacgcattcaaagcggcgctgaaggcgggccgtccgcaaatcgggttatggctggggctgaccagcagctacagcgctgagctactggccggggccggttttgactggctgctgatcgacggagagcacgcgccgaacagcgtgcaaaccatcctgactcagctccaggccatcgccccttatcccagccagccggtggtgcgcccgtcgtggaacgatccggtgcagatcaagcagctgctggacgtgggggcgcaaaccctgctggtgccgatggtgcaaaacgccgacgaagcccgtctggctgtcagcgccacccgctacccgcctgccggcattcgcggcgtcggcagcgcgctggcgcgggcgtcgcgctggaaccgcatcccggagtatctgcatcaggctaacgacgccatgtgcgtgctggtgcaaatcgaaactcgcgaggcgctgaaaaacctgccgcagatcctggacgtggaaggggtggacggcgtgtttatcggccctgcggatctgagcgccgacatgggcttcgccggtaatccgcagcacccggaggtgcaggccgccatagagcaggcgatcgcccaaatcctcagcgcgggcaaagcgcccggcatcctgatggcgaacgagcaactggcaaaacgttatcttgaactcggcgcgctgtttgtcgcggtcggcgtggataccaccctgctcgcccgcagcgccgaagcgctggcggcccgctttaccgatgtcaccacagcagttgataacaataaatccgtctactaa

SEQ ID NO: 2322 - DNA, 1365 bp, Enterobacter cloacae
acgtacgatgtggagcgcaacatgacgacctcaaccctgcacaataaagctgttgaacatcgcgttattaataagctgttccgtcgtttgatcgtgtttctttttatcctgtttgtcttctcgtttctcgatcgcatcaacatcggctttgccgggctgacgatgggcaaagatctgggcctcacgtcgaccatgtttggcctggccgcgacgctgttttacgtgacctacgtgctgtgcgggatccccagcaacatcatgctggcgaagatcggcgcccgccgctggatcgccgggatcatggtggtgtggggcatcgcctctacctgcaccatgttcgccaccagccccgaaacgctctacgtcctgcgcatgctggtgggcattgccgaagccggtttcctgccgggcattctggtctatctcacctggtggttcccggcgtatcaccgcgcccgcgccaacgcgctgtttatgatcgccatgccggtgaccatgatgctcggttcgatcctctccgggtacattctggcgatggacggactgtggaaccttaagggctggcagtggctgttcctgctggaggggctgccgtcggtggtgctcggcgtggtgacctggttctaccttaacgacaccccggatcaggccacctggctggatgatgacgaaaagcaggcactcaaaacgatgatcgcccgcgagcaggagctggccattgcgcatgccgccacgccgcgatcgacgctgcgcgaggtgctgacgcccgccgtgctgctctacacgctggcctacttctgcctgacgaatacgctgagcgcgatcaacatctggacgccgcagatcctgcaaagcttcaacaccggcagcagcaatatcgtgattggcctgctggcggcgatcccgcagttttgcaccatcctcgggatgatctggtggagccgccgctccgacaggctgaaagagcgaaaaaagcacaccatcctgccgtatctgtttgcagcggcgggatggatgctggcctcggcgaccgatcacagcctgatccagctgcttggcatcatcatggcctcaaccggatcgtttaccgccatggcgatattctggaccacgccggatcaggttattagcctgcaatcccgcgcggtggcgctggcggtgatcaacgccatcggcaacgtcgggtctgccgtcagcccattgctgataggtattttgcgcgacgcgaccggcagcttcagctcgggactgtggttcgtggcaggtctgctggtggtgggcgcgctggtgctgacgcgcattccgatgacgcgccgggaaagccttgagcgtgagccggacatcgcggcgcaaaagatccactga

SEQ ID NO: 2323 - DNA, 942 bp, Enterobacter cloacae
ggagccgctatgtgtcagagccccatcacaaacatcgatatcagcaaggagtacgacgaaagtctgggcaccgacgatgtgcactaccagtcgttcgcccgcatggcggccttttttggccgcgacatgcaggcgcaccgccacgaccagtattttcagatgcattttctcgacaccgggcagattgagctccagctcgacgaccaccgttactcggtgcaggcgccgctgttcgtgctgacgccgccgtcggtgccgcatgcgtttatcaccgaatccgacagcgacggccacgtgctgacggtgcgcgaggatctcatctggccgctgttagaagtgctctaccccggtacgcgggaagcgttcggcctgccggggatctgcctttcgcttgccgacaagcctgacgagctggcggcgctgaagcactactggcagctgattgcccgggaatccacggaacagctgcccggtcgcgagcatacgctggtcctgctggcgcaggccgtttttaccctgctgctgcgcaacgcgaagctcgacgaccacgcgtcaggcggcatgcgcggtgagctgaagctgtttcagcgctttaaccagctgacagatgctcattaccacgagcactggacggtgccggagtatgccagcgaactgcatctcaccgaatcccgcctgaccgatatctgtcgccgcttcgccaaccgctcgccgaaacggctgatcttcgaccgccagctgcgggaagccagacgcctgctgctgttttccgacagcacagtgagcgaaattgcctggcagctgggttttaaagatccggcctatttcgcccgtttttttaaccgactgacggggtgctcacccagcgcgtaccgggcgcagaaagtaccggtgtcgcctgttcccctcacccctgccctctcccagatggagagagagtaa

SEQ ID NO: 2324 - DNA, 1686 bp, Enterobacter cloacae
tctctcgcgaaaagtacctgccgttgtcccaatcgtcccttcacgttccgcccctctcacgcttcaattaaacaacaaaaacaaaacataaatttaacaaccatcttccgatacgaggtccctatgaagcctgaagatttccgcgctgatgccaaacgtccgttaaccggtgaagagtatttaaatagcctgcaagatggccgtgagatttatatctacggcgagcgcgttaaggacgtcactacccacccggcatttcgcaatgcggcggcgtccatcgcccagatgtacgatgccctgcacaagccagacatgcaggataccctctgctggggcacggacaccggcagcggcggctacactcataaattcttccgcgtggcaaaaagcgccgacgatctgcgccagcagcgtgacgccatcgccgagtggtcgcgcctgagctacggctggatggggcgtacgcctgactacaaagccgcgttcggctgcgcgctgggggcgaaccctgccttctacggtcagttcgagcagaacgcccgcaactggtacacacgtattcaggaaaccggcctgtactttaaccacgccatcgtcaacccgccgatcgaccgccataaaccggcagacgaggtgaaagacgtttacatcaagctggagaaagagaccgacgccgggatcatcgtcagcggcgcgaaagtggtggccaccaactccgccctgacccattacaacatgatcggcttcggctctgcgcaggtgatgggcgaaaacccggacttcgcgctgatgttcgtcgcgccgatggatgccgaaggggtgaagctgatctcccgcgcctcttacgagatggtggcaggggcgaccggttccccgtacgactacccgctctccagccgttttgacgagaacgacgccattctggtgatggatcatgtgttgatcccgtgggaaaacgtgctgatctaccgcgatttcgaccgctgccgtcgctggacgatggaaggtggcttcgcccgcatgtacccgcttcaggcctgcgtgcgtctggcagtgaagctcgacttcatcaccgctctgctgaagaagtcgctggagtgtaccggcaccctcgagttccgcggcgtgcaggcggatctcggcgaagtggtggcgtggcgcaacatgttctgggcgctgagcgactccatgtgctccgaagccacgccgtgggtaaacggcgcgtatctgcctgaccacgcggcgttacagacctaccgcgtgatggcgccaatggcctatgcgaagatcaagaacatcatcgaacgtaacgtgacctccgggctgatctacctgccgtccagcgcgcgggacctgaacaacccgcagatcgaccagtatctggcgaagtacgtgcgcggctccaacgggatggatcatgtcgaacgcatcaagattctgaaactgatgtgggatgccatcggcagcgagtttggcggacgtcacgaactgtacgaaatcaactactccggtagccaggatgagatccgcctgcaatgcctgcgtcaggcgcaaagctccggcaacatggacaagatgatggcgatggttgaccgctgcatgtccgagtacgaccagcacggctggaccgtaccgcacctgcacaacaacactgatatcaacatgctggataagctgctgaaataa

SEQ ID NO: 2325 - DNA, 1704 bp, Enterobacter cloacae
tttttgccgctaacgctaatttgcccattttcagatcccccactttggaatcggatggtcgcccatggagatgcacacgttcttcatctccgcgaatacctcgaagctgtactcgccgccttcgcgcccggtgccggaggccttcacgccgccaaacggctggcgcaggtcgcgcacgttctgggtgttgacgaacaccatgcccgcttcgatgttgcgcgccagacgcagcactttgctgacgtcctgggtccagatgtacgacgccaggccatactccacgtcgttcgccaggcgcaggccttccgcttcgtccttaaacggcagcaggcaggccaccggcccgaagatctcttcctgcgccacgcgcatgcggttatcgacatccgccagcacggtcgggcgcaggaagttgccgcctttcaggtgcgcaggcagatcggtcggtttgtccgggccgcccgccagcagggttgccccctcttcaatgccgaggcggatatagccggagactttttcccagtgctgctggctgatgagcgcgccaatctgggtgtttggatcggtcgggtcgcccacgcgcaggcggttggcgcgctcggcaaagcgtttgacgaactccgggtagatgctctgctggatgaagatgcgcgagccggcggtgcagcgttcgccgttgatggagaaaatggtgaacagggcggcgtccagcgcgcgctcgatgtccgcgtcttcaaaaatcagcaccggagatttgccgcccagctccatagaatacttcttcagcccggcgtttttcatgatgttacgcccggtggcggtgccgccggtgaaggagacggcgcgcacgtcatgatgacgcaccagcgcgtcgcccgccgtggcgccatagccctgcaccacgttgagcacgcccgccggaatgcccgcttcgagggccagctcgcccagacggtcggcggtcagcggggagagttcagacatcttcagcaccgcggtgttacccagcgcgagacagggcgcgaccttccaggtggcggtcataaacggcacgttccacggcgacaccagcgcgcagacacccaccggctgcaccagggtgtagttgagcatcttgtcgtcgaccgggtaggttttgccgttcatctgctggcacacctcggcgaagaactcgaagttgtgcgaggcgcgcggaatgagcacgtttttggtctggtggatcggcaggccggtgtcggcggtctccatcgcggcaatgtccggcacgttctggtcaatcagatcccccaggcgacgcatcaggcgcgcacgctccttcatcggcaggttggcccatttcgggaacgcctctttggcggcggcaacggcctgatggatttcggcttcgcccccggaggctacttcagccagcacctcgccggaggccgggttagtggtttggaagtactcacttccggcgacgtttttcccgttgatccagtggttaatctttttcattttgcagtctcctcactgacaattcggtttaccagacggcctacgccctccacttccaccaccacttcatcgcccggtaccacgtcggacagccccttcggcgtgccggtggcaatcatgtcgcccggttgcagggtcatgaaatcgctcagatacgcaatcaggaatgggatgctgaaaatgagatcggcggtggtgccttcctga

SEQ ID NO: 2326 - DNA, 1788 bp, Enterobacter cloacae
acttggaaaccgacatattgccgcgcgggacgaagagtaaaaaccctaaattccaggatgattttcgtaaagttttccctttccaggccgaaaattctgtatctgtctgaggaaagagaaaacatgttaaatcgtatcaagattgtcaccagcttactgctggttttagcgatatttggccttttacaactcacatccggtggtcttttcttcaatgccctgaagcatgacaaagagaatttcaccatcctgcaaaccattcgccagcaacaatccaccctgaacggtagctgggtggcgctgctgcaaacccgtaacactctgaaccgcgcgggtatccgctatatgatggatcagaacaatatcggtagcggctcaaccgtcgccgagctgatgcaaattgcctctgcgtctctgaaacaggcggaaaaaaactgggcggattacgaagcgctgccgcgcgacccgcgtcagagcgacgctgcggcactggaaatcaaacgtaattacgatatctaccacggcgcgctggccgagctgatccagctgctgggggcgggcaagatcaatgagttcttcgaccagccgacccagagctatcaggatggctttgagaagcagtacgtcacctatctgcaacagaacgacgcgctgtatcagaccgcggttgaagacagcaacagttcttaccgccaggctatctgggtgctgattagcgtgctggctgcggtgctggtggtgattgttgccgtctggctgggtattcgtcaggcgctgatttcgccgctgaaccgtctgattgacagcattcgtcatatcgccagcggcgacctggtgaagcgcatcgacgtggaaggctccaacgagatgggggaactggctgactccctgcgccacatgcagggcgagctggtgcgtaccgtgggtgacgtgcgtaacggcgcaaacgccatttacagcggtgcgagcgaaatctcgatgggcaataacgatctctcatcccgtaccgaacagcaggctgcctctctggaagagaccgccgccagcatggaacagctgactgccaccgtgaagcagaacgccgagaacgcccgtcaggcgagcaacctggccctgagcgcgtctgaaaccgcgcagaaaggcggcaaggtggtggataacgtggtgcagaccatgcgcgatatcgccggcagttcgcagaaaattgccgatatcatcagcgtgatcgacgggattgccttccagaccaatattctggcgctgaacgcggcggtagaagcggcgcgtgcgggcgagcagggccgcggctttgcggtggttgcaggtgaagtccgaaacctggcgcagcgcagcgcccaggcggcccgtgagatcaagagcctgattgaagactccgtggggcgcgtggaaattggttcaacgctggtggaaagcgcgggtgaaaccatgggtgagatcgtgaatgcggtaacgcgcgtgacggacatcatgggcgaaatcgcgtctgcgtctgacgagcagagccgcggtatcgaccaggttgggctggcggtggctgagatggatcgcgtgacccagcagaacgcctcgctggtggaagagtctgcggcggcggccgcggcactggaagagcaggcgagccgtctgacgcaggctgttgcggtgttccgtattcagcaggaacagatgaaggcgcgcgagttcgcctccgcgaaaagcgttgccgctccggtagtggcgcgtaaaccggcgaccgcagatgcgggcgataactgggaaacgttctga

SEQ ID NO: 2327 - DNA, 456 bp, Enterobacter cloacae
tgtaaggggaaggtgatgcatgactcattaaccatcgcgctgttgcaggcgcgtgaagcggcgatgggctacttccgcccgatagtgaagcggcataatctgaccgagcagcagtggcgtatcgtccgcgtgctggccgagcatccctccatggattttcacgatctggcgttccgcacctgcattttgcgcccaagcctgaccggcattctgacgcggatggagcgcgacggtctggtgctgcgcttaaagccggtgaatgaccagcgcaagctgtacgtatcgctgacgaaagaaggcaacgcgctgtaccagcgtgctcaggctcaggtggaagaggcgtaccagcagattgaggcggaatataccccggagaagatgacgcagctcacggcgctgctggaagaatttattgaacttggaaaccgacatattgccgcgcgggacgaagagtaa

SEQ ID NO: 2328 - DNA, 825 bp, Enterobacter cloacae
ttttgcgttgttgtttggttttgccctgcaccgttcttggcagcaaaagcccagctgatttttaacgtcattgaaagcttctcgcaggttatcttcggcatcatcaacatgattatgcgtctggccccgattggcgcctttggcgcgatggccttcaccatcgggaaatacggcgtcggcacgctggtacagctgggccagctgatcgtctgcttctacatcacctgtattctgtttgtggtggtggtgctcggctccatcgcccgtgcgaccggcttcagcatcttcaaatttatccgttacattcgtgaagagctgctgattgtcctcggcacatcctcttcggagtccgcgctgccgcgtatgctcgataaaatggaaaagctgggctgccgtaagtcagtggtggggctggttattcctacgggctactcttttaacctggatggcacctcgatatacctgacgatggcggcggtctttattgcccaggccactaacagccacatggatatcttccatcagattacgctgctggtggtgcttctgctctcttcaaaaggggcggcgggcgtaacgggcagcggatttatcgtgctggcggccaccatttcggcggtgggccatctgccggtggcgggcctggccctgatcctcggtattgaccgctttatgtctgaagcccgtgcgttaaccaacctggtcggcaatggcgtggcgacgattgtggtggcgaagtgggtgaaagagctggatcacaagaagcttaacgatacgctgaataaccgcacatctgaggacaaaacccccggtttatcctcttaa

SEQ ID NO: 2329 - DNA, 1503 bp, Enterobacter cloacae
tcaggggttcacatgcagggcacaaaaattcgactcttaaccggcggtttgctgatgatggcagcagccagttatgtgcaggcagatgcgctccagccagacccggcctggcaacagggaacactggcgaacggtttccagtggcaggtattatccactccgcaacgtccgagcgatcgcattgaaatccgtctttctgtgaataccggctccctcactgaaagcacccagcagaccggcttaagccactttattcctcgactggcgctcacccagagcggcagtttgcaggcggttcaggtgcgttctttatggcaacaggccatcgatccgaaacgcccgctgcccccggctgtggtctcctatgactacaccatgtttaacctgagcctgcccaacaaccgtaacgatctgcttaaagaagcgcttacctatctatccgatgccaccggcaaactggcgattacgcctgagaccgtaaactatgcgttgagcaacagcgacatggtggcgacctggccgacggataccaaagaaggctggtggcgctaccgcctgaaagggtccactctgcttggccacgacccggcagaaccgctgaaacagccggtggatgcagagcaggtgaaatctttctaccagcagtggtacaccccggatgccatgaccctcattgtagtgggcaacgtggacagccgtgcggtgatagagcagatcaacaaagcctttggcgatctgaaagggaagcgtgaaacgcctgcccctgttcctaccttgtccccgctgcgtcctgagacggtcagcatcatgacggataccgtgcgtcaggatcgtctttcaatgatgtgggatacggcctggcagccgatccgcgagtcttctgcgctgctgcgttactggcgtgcggatctcgcgcgtgaagcgctgttctggcacgttcagcagacgctcagcaagaacaacgtgaaagatattggcctgggctttgactgccgtgtgctgttccagcgcgcccagtgcgccattaacgtggaatcgccgggcgataagctcaatgccaatctcggcgtggtggcgaaagagctggctaaagtgcgtaaagagggcctgtctgaagaggagtttaacgcgctggtggcgcagaaatcccttgaattgcagaaactgttcgccacctatgcccgcgccgataccgatatcttaatcagccagcgcattcgctccttgcagaatcaggtggtggatatcgcgccggagcagtatcagaaactgcgtcaggacttcctgaacggtctgaccgtggagatgctgaatcaggatctgcgccagcagttgtcgcaggatatggcgttgattctgttacagccgaaaggtgagccggaatatgacatgaaagagttgaaggccacctggaacgccatcatggcgacggcgccgcagccagcgcaaacggcagccgatgatttacatcaggatgcgagcgatattccgcagggccagtaa

SEQ ID NO: 2330 - DNA, 822 bp, Enterobacter cloacae
ctcagtgacgagtccagaaaggctatcccatacaacaggacatccgaaatgaagtcagagcaggttatccagcggctgagcactacgcctgaggcaagtattgagaacttgcaggagcatcgctactggctgcaatgtgagcgagcgtacacttatcagcccatctaccgtaccgacggtcggttaatggcgattgaggtgttaacggtcgtcactcatccatcgaatccttcacagcgtattgcaccggaccgctattttgcggaggttgccgtgcgtcagcgtatcgacgtgctggaagagcagctgagaatgctggcgacgaagcaggcgttcttcaagcagcacggtattctggcgtcggtgaacgtggatggccccaccctgatggcgttacgtcagaatgcgacgttgcaggcgctgattgctaccttgccgtggatgcgcttcgagctggtggaacatgttcagctgccgcaggactcctcgtttgcctcgatgtgtgagtttggcccgctgtggctggatgatttcggtaccggtatggccaatttctccgccctgagcgaagtgcgttatgactacatcaaagtggcccgcgatctgtttatcatgctgcgccagacgccggagggacggaacctgtttacgatgctcctgcaactgatgaaccgctattgccagggtgtcattgtggaaggcgtagaaacgctggaggagtggcgcgacgtgcaaaattccccggcagcggcggcacagggttatttcctctctcgtcctgtccccatggataccctggaaaaggtgataaccagcctctga

SEQ ID NO: 2331 - DNA, 762 bp, Enterobacter cloacae
attatgagtgaacgtattgctttagtgacgggcggtagccgcggcctgggtaaaaatgccgttttgaagctggccgcggaagggacaggcattatcctcacctggaacaacagccagcaggaggcgcaggaagttgtgcgcgaaattgagggaaaaggcggaaaagcggcagcattgcagcttaacgtcggcgatacggcaagcttttcgcgctttgctcaaaaggtgaaggatacccttaaacacgtctggcaacgtgacacctttgactatttagtgaacaacgcaggtacagggttatatgcaccctataccgagacgaccgaggcgcagtttgatgatgcgatgaacattcacttcaaaggaccgtttttcctcacgcaacagctgctgccgctcataaaagacggagggcggatcctgaacgtctccagcggactggcccgttttactcagcccggttcaggaacctacgcggcaatgaaaggggcgatggaggtgctgacccgctatcaggcaaaagagcttggcgcgcgcggaatttccgtcaatatcatcgcgcccggcgcgattgaaaccgactttgggggcgggcgagtgcgggataatgcggagcttaaccagctgctggcctcgcagacagcgctgggacgcgtgggcctgcccgatgatattggtgacgccattgcggcgttgctcagtgacaaactgggctggatgaatgcgcaacgtattgaagtttcaggcggtatgtttctgtaa

SEQ ID NO: 2332 - DNA, 687 bp, Enterobacter cloacae
tttgtaacctctccattcattgagttttttcttaaaaaatgcctctgtagaatcccccttcgctattctcagaggagtaaaacgatgcgagtaatcatgtttgacaggcagtcattatttattcatggagcgatgtatagtttgcagaagttaattccgaaaatagatatgacaggaactcgtcagactgatgaattatgggcgcaattatccgcgtcaccctccgctatcgtcatgatagatgggtatttaattcgtgataatggtgtggctttactggaagagattatggatcgctttccaacgtcgcgcgtggtgttggtgttaacgaaaaaagagcggcgttgggttgagcaaatgtttcagcgcaacgtggtggcgataattccccgcaatgcgaatcccgaacgcttttccgcagtgctggattctgtatcgcgaggaatggtctgttttcccggcgagtggctgaagcagcacacctctcaggatgaactggcagtgttaagcgagcgccagcgtgaggtattgaagttactggcggccggagagtccaataaagagattggacgtaatctcaatatcagtgcggcaacggtaaaagcccatcttgagacgcttttccggcgtcttgatgtcaaaaaccggacgcaagccgcgatgtactacacccgggcgacggcctga

SEQ ID NO: 2333 - DNA, 2229 bp, Enterobacter cloacae
attgacgatttgccacagtttacagcagaacggcacagattacccgcaggcccggtaagcgcagcgccaccgggctcttttccgccacgtctggcattgaaatcctctacacttaaccccattactgaacaatatgcacagcgccggatgcgcgcttcattcacctatttcaacaggacagcgtttatgaccaatccattactgacgcctttttcgttgccaccgttttctaaaatcctccctgagcatgtggttccagcggttacgcaatcgctggacaactgccgcgcggcggtagaaagcgtggtcgcgcagggcgggccgtacacctgggaaaatctgtgtcagccgctggccgaagtggacgacgtgctggggcgcatcttctccccggtgagccacctgaattcggtaaaaaacagcccggagctgcgtgaagcctacgagcaaaccctgccgctgctctctgagtacagcacctgggtcggccagcatgaggggctctacaaagcctaccgcgacctgcgcgacggcgaccactatgccgaactgaacacggcgcagaaaaaatcggtcgataacgccctgcgtgatttcgaactgtccgggattggcctgccaaaagaaaaacaggttcgctacggtgaaatcgctgcgcgcctgtccgagctgggcaaccagtacagcaataacgtcctcgacgccaccatgggctggacgaagctgattaccgatgaatctgaactggcgggcatgccggaaagcgcgctggcggcggcaaaagcccaggccgaagcgaaagagcaggaaggcttcctgttaacgctggatatcccaagctatctgccagtgatgacctactgcgacaaccaggccctgcgcgaagagatgtaccgcgcctacagcacccgcgcctccgatcaggggccgaatgcgggcaaatgggataacagcccggtgatggcggagattctcgccctgcgccacgagctggcacagctgctgggcttcgacagctacgcggataaatccctcgccaccaaaatggccgagaacccacagcaggtgctcgacttcctgaccgatctggcgaaacgcgcccgtcctcagggtgaaaaagaactggctcagctgcgcgcctttgcgaaagcggagttcggcgtggacgagcttcagccgtgggatatcgcgtactacagcgaaaaacagaaacagcatctctacagcatcagcgacgaacaactgcgtccgtacttcccggaaaacaaagccgttaacggcctgttcgaggtggtgaaacgcatctacggcattaccgcgaaagagcgtaccgacatcgacgtctggcatccggacgtgcgcttctttgagctgtatgacgataaaaacgaactgcgcggcagcttctacctcgatctctacgcgcgtgagaacaagcgcggcggggcgtggatggacgactgcgtgggccagatgcgtaaagcggatggttccctgcaaaaaccggtcgcctacctgacctgtaacttcaaccgtccggtgagcggcaaacctgcgctgtttacccacgatgaagtgatcaccctgttccacgagttcggtcacggcctgcaccacatgctgacccgcatcgaaaccgctggcgtcgccggtatcagcggtgtgccatgggatgcggtcgagctgcctagccagtttatggaaaactggtgctgggagccggacgcgctggcgtttatctccggtcattacgaaacgggtgaaccgctgccgaaagaactgctggataaaatgctggcagcgaaaaactaccaggcggcgatgtttatcctgcgccagctggagttcggcctgttcgacttccgcctgcacgccgagttcagcccggagcagggggcgaaaatcctcgaaaccctggctgagattaaaaagcaggttgccgttattccagggccaacctggggacgcttcccgcacgcgttcagccatatcttcgcaggcgggtacgccgcaggctactacagctacctgtgggccgacgtgctggcggcggatgccttctcgcgcttcgaagaagaggggattttcaaccgcgaaaccggtcagtcgttcctcgacaacatcctgacccgcggcggttcagaagagcctatggagctgttcaaacgcttccgtggccgcgagccgcagctggatgcgatgctggagcattacggaatcaaaggctga

SEQ ID NO: 2334 - DNA, 462 bp, Enterobacter cloacae
tccgttcggatattaaaacgcgaaccggatcgacttttggtcattctttcactgaactgtctgtcagggcattggggtgcggtagctcaggagccttgcttcgtgggcggacgccggggaggatgtatgattagcaccgtcgcattgttttgggcgttatgcgtggtttgcatagtgaatatggcgcgctacttctcatcgttacgtgcgctgttagtggtacttcgtggttgcgatccgttgctttatcagtatgtggacggtggagggttcttcacctcgcacggacagcccagcaagcagatgcgtctggtggggtatatctactaccaacgctaccgcgatcaccacgatgaagagtttatccgtcgctgcgagcgcctgcgtcgtcagttcattttgaccagcgccctctgtggtctggttgtggtgagtatgattgcgctgatgatttggcactga

SEQ ID NO: 2335 - DNA, 1287 bp, Enterobacter cloacae
aatggctttgtaatatctttttacgctggtgcgaccactgaggaaactttacaatccgcggcagttaacgaagaggattttgacgtggaaaggtttgatgccgtagttattggcgccggtgcggcgggtatgttttgtgcggcgatggccggacaagcgggtcgtcgcgtgctgctgctggataacggaaaaaagcctggccgcaagatcctgatgtctggcggtgggcgctgcaactttactaatctttatgtcgagcctgcggcctatttgagccagaaccgccatttttgcaaatctgcgctggcgcgctatacccagtgggattttatcgaactggtgggtaaacacggtatcgcgtggcatgagaagacgctgggacagctgttctgcgacgactccgcgcaacaaatcgttgatatgctggtggccgagtgcgagaaaggcggcgtagtaatgcgcctgcgcaccgaagtgctggacgtcgcccgtgacgagcagggctacacgctgcaactcaacggtgagaccgtcagcgccgataacctggtgatcgccagcggcggcctctcgatgccggggctgggcgcctcaccgttcggctataaaattgccgagcagtttggcctgaaggtactgcccacccgcgccgggctggtaccgttcacgctgcataagccgctgctggagcagcttcagacactctccggcgtgtctgtaccgtcggtcattacggccgaagacggcacggtgttccgcgaaaacctgctctttacccatcgtggactctcggggccggcggtattgcagatctccagctactggcagccgggggagtttgtctccgtaaacctagtgccggactgcgatctggacgccttcctcaacgagcaacgcgccgcgcacccgaatcaaagcctgaaaaataccctggcgatgcagttgccgaagcgtctcgtggagtgcttgcaggtgttagggcaaattccggatgttgcgctcaagcagctcaacagccgtgagcaggaaacgctggtggagacgctgacgaactggcgcgtacagccaaacggcaccgaaggctaccgcacggcggaagtgacgctgggcggcgtggatacaaacgaactctcatcccgcacgatggaagcccgcaacgtgccgggtctttatttcattggtgaagtgatggacgtgaccggctggctcggcgggtataacttccagtgggcgtgggccagtgcctgggcatgcgcgcaagcgctggctgatgtccgaggacaataa

SEQ ID NO: 2336 - DNA, 861 bp, Enterobacter cloacae
cccgcggcggttcagaagagcctatggagctgttcaaacgcttccgtggccgcgagccgcagctggatgcgatgctggagcattacggaatcaaaggctgattgctacgtgaagatctgcttagtagatgaaacaggcgccggggacggcgccttatctgttctggcggcccgctgggggctggaacatgatgaagacaacctgatggcgctggtgatgacgccggaacatctggagctgcgcaagcgcgatgagccaaagcttggcgggatttttgtcgattttgtcggcggcgcgatggcgcaccggcgtaagttcggcggcggtcgcggcgaagcggtggccaaggcggttggcattaaagggagctatcttccggacgtggtggacgccacggcggggctggggcgcgatgcgtttgtgctggcctcggtgggctgccgggtgcggatgctggagcgtaatccggttgtcgccgcgctgcttgacgacgggctgacgcggggctatgcggacccggaaatcggctcgtggttacaggaacgtttgcaacttattcatgcctccagcctgacggcgctcaccgacatcaccccgcgcccgcaggtggtttatctcgaccccatgttcccgcataagcagaaaagcgcgctggtgaagaaagagatgcgggtgtttcagtcgctggtggggccagatttagatgccgatggcctgctggaaccggctcgtcagctggcgacgaagcgtgtggtggtgaagcgccctgactatgcgccgccgctggcggacgttgcgaccactaacgcggtgaccacgaaagggcaccggtttgatatttattcgggaacaccggaataa

SEQ ID NO: 2337 - DNA, 852 bp, Enterobacter cloacae
ggtacgatcatggctaggggtaggcgtctcaaatcctatttggattatgaaaatgcgctaggtgacggcataggagtgggctatggccaaagttatcagccctggcttagagctcaggacgttaaatcccgtggaaaccgttcgatagtctttggccttaagacgtttcgaaaccatcatctcctttcttctgtcgaaagtaactttttctatctggctgagtttaatgactcggtgattgatatccgggaacaattcccactctttcctctccggcttacccaacaaatagcaaatcatctacattttcaacatcctatggtgaggggagtaagaggagtacctgtcgaagttctgaatgttatgacaaccgattttttactgaccttgagaactcctgaaggcggacttcgatacaaagctatagcagtaaaacataacgagagcatacctgaacgcgaagcccaaaaacttgaaatagagaggatgttttggcagttgattgatgttgagtttcaaatttatgttggctcggaactcaataacgtcgtcggtaaaaacatttgctgggctacttctgtattaagagatggttctgaattttatgataaatatcctcttgataaaatcctatggaagcttaaaccagatgtttatcccatagtaggactacgtgcaatgatttcatcaatctttggggtagatgcacaagaagcgatgatgttattgcaggcaatgattggattaaaaatgataaatgttgatttatcatatccaatactcgaaaccggtctgataaagataatttccaatgaccactatataggactgaacgcaaatggatattattag

SEQ ID NO: 2338 - DNA, 945 bp, Enterobacter cloacae
ggacgcagaataatgaatcttatacggcgcgtttcagcgatatataaagaacaggagttacctgagtatcgtggcaatcccttaattgaagcacttcctgaagcgcttacggaagatgaagtacttctggaaatgagttatttccccgaaattgacgaaaaaatccgctggactgccccggcgaatgttagagagcagtatgtcgaacgtataaagaaattccgttgccctcaaaccaatcttatccaggcttataagatgatcttacgggcacttagggaaagctatgcagctcgtaatcctttaaaaagcggaacaattcaatatcttcattactatggaaatgagcgtcctgatattgagccagaaagtggatattttaaatcccaggctgaaattattacgatagttggaatgagtggttctggaaaaactaccatgattgagcaagtcatggatcatttccctcagattatagaacacagcagctataaaggagtttttcccggcttcagtaagcaaattgtatgggtaaagattaattgtccatacaattcaagtgtgagagacctttgtgaagagattttacaaaaattagatgatgcaattggtattgaacgaactacacctgagattagaaatggtgctctggctcgccagattgcacaaagaattaaatcatcatttttgggtatccttgttattgatgaaatgcagaggcttaaattttcaagaaccgggggtgagagtaagttgattgattttttacatgaaattgtagattccatgggggtatctatggttttttgtggaaatcatccttttgacgagacgctgacaaagaaaatgagaattgccaggcgggcagagtctggtggttacatgaaaattaagaatgttagatacgattcacaagactggcaatcgtttattcattatttatgg

SEQ ID NO: 2339 - DNA, 2085 bp, Enterobacter cloacae
actatagttttagaggcaagttcatcaggaaaggggacaacaatgacaaaaacaaccagggtgatttcctggacagcagggattttcttgttgctgatcgtggtcttaatcatcattatcgccacgtttgactggaaccgcctcaaaccgaccatcaaccagaaagtctcaaccgagctgaaccgccccttcgcaatacgtggcgatttgggcgtcgtgtgggagcgccagaaagaggaaactggctggcggagctgggtgccctggccgcacgttcatgccgacgatattattctcggtaacccgcccgacatccccgaagtaaccatgatccacctgccgcgagtggaagccacgctggcgccgttagccctgttaaccaaaacggtgtatctgccgtggatcaaactccagcagcccgacgcgcggctgattcgcctgtcagagaaaaacaacaactggacgttcgatctcgccagcagcggcgataaagatcagaatgcgcagccctcttcgtggtctttccgcctcgacaatattctgttcgatcgggggcggatcgccattgacgataaagtgagtaaggctgacgtggagatcctcgtcgatccgctgggcaagccgctgccgtttagcgaagtcacgggcagcaaagctaaaggcgatgacagcaaagcgggcgattacgtctttggcctgacggcgaaagggcgctacaacggccagccgctcaccggtaaaggcaaaatcggcggcatgctggcgctcaggagcgagggcacgccgttcccggtgcaggcggattttcgctccggcaatacccgcgtggcgttcgtgggcacggttaacgacccgatgaacatgggcggcgtcgacctccagcttaagtttgccggtgattcgctgggggaactgtacgatctcaccggcgtactgctgccggatactccgccgtttgaaacggacgggcacctggttgccaaaatcaacaccgaaaaatcgtccgtctttgactaccgtggattcaacggccgcatcggcgacagcgatatccacggcacgctgacctacaccaccggtaaaccgcgcccgaaactggagggggacgttgaatcccgccagctgcgtctggccgatcttggtccgctgattggcgtagattcgggcaaaggcacgaagtctaaagaggttaaaaaggacgttcagcctgcgggtaaagtgctgccctatgaccgcttcgaaaccgacaaatgggacgtgatggatgcggatgtgcgcttcaaaggacgtaaaatcgagcatggcagcacgctgccgctgagcaacctctcgacccatatcatcctgaaaaacgccgacctgcgcctgcaaccgctgaagtttggcatggccgggggaaccatttcatcgaatatccacctggagggggataaaaagccgatgcagggaagggcggagatccaggcgcgtcggctgaagctgaaagagctgatgccggacgtggagctgatgcagaaaaccctcggtgagatgaacggcgacgcggatattcgcggcacgggtaactccgtagcggcgctgctgggcagcggaaacggcaacctgaaactgctgatgaacgacgggctggtgagccgtaacctgatggagatcctggggctgaacgtcgggaactttatcatcgggcaaatcttcggtgacgacgaagtacgcgttaactgcgcggcggcaaatctggatctggtcaacggcgtggcgcgtccgcagatcttcgccttcgacacggaaaacgcggttatcaacgtcaccggtaccgccagcatggcgtccgagcagctcgatttaaccatcgatccggaaagcaaaggcattcgtatcatcaccctgcgctcgccgctgtacgttcgcggaaccttcaaagatccgcaggcgggcgtgaaggctgggccgttgattgcgcgtggtgcggtcgccgccgcgctcgctacgctggtgacccctgcggcggcgctgttggcgttgatttcgccgtcagaaggcgaagcgaatcagtgtcggacgattttgtcgcagatgaagaagtag

SEQ ID NO: 2340 - DNA, 1701 bp, Enterobacter cloacae
  unsure (1661)
  unsure (1689)
acgcaaatggatattattaggaattcagtctggctctctcaaggcactgatttgcttgcagagggactttaccgtgttttggattttgacagaaaggtcgatttgttaattttgtttaaaataaaatcagaaagaacgggtaagccaatccctttctcattttcaatgtttaaatattatattgaatcaaatagcataacttgtaaagattatatatatccttcatatatgttagtagatgagaaagaattaacagataaagacagaggaaggcgagatgaaaattacaatatcattaaagatcttgtagatgacagaatgtttctgttcgactatgcattacataaaaagtcgcaccttttaatggattactcaagaaataaaaaaatatcacaatatactatcagaacgcttctggcgttgtattggcgacatgggcaggatatttatgcattgctacccgcattctcgaactgtggcgccgctgggaaaagtagaatcaaacatgaaattaaacttgggaattccaaaaaaaacagagcattacctaatgaacgatcacgtgttttcattcttaatgaaagagatataaataatattagaaaatctctcattacgtatcattataaagttaacggagatacgataaagaaaacattagagagacatattgatttgtattttagggatgaaattaaaacagcaaacctagaaaatagagctccatatgttccttctttaaaacaattttcatactggaataaaaaactcttcactaaagatttctcgataaataagaagaacacgaaaaaagaaatagacctcaaaatgcgggcgcttttaggtagtgtggctaatacaactgttttgccgggtgatgttttcgaaatagactcaactgtcgctgatgtacatcttatttcgagtttaaacagacgaaaagtcattgggcgtcctactatttatacagtggtggatcgtgcaacaagaatgattgttggccttcatgtttctttataccatgcttcatggcgagccgcccgacaagcgttagcaaattgctttatgccaaaaaaagaatattgtagattatttggaatctctattactgatgatgattggccttgttctcacattccattaacattgatgtgtgacaacggggagatgattggtcttaaacctcaggaagagatgacccccctgacaaaacttgagtttgcgccagtcggtagaggcgacagaaaaagcattgttgaacgctgtttcggcattctgaatgatgaggttattcataggcttattggaacaacacgaaggggaaagattgttaaaggagagccaacaccgcaatccagggcttgtttaacgattcaggaggtcacgtctttactgattcgggagatacttgcacataatcagagaacgtatgaggaactggcttatatcaatcccttactgattgaaaatgatctcgtaatatcaccaaaaaatagttggatgataagcttaaagcacgggagattcagcgcaagagccgttggggccgacgaagtgatcgcacgattgttaatccctgtgaacgctaacattaccgccggtgggattcagtacaataatcttttttatgaatgtgatcctgaaattgcatcaggtgtcanagtatttggaagaaccacttgtgaagcnagaatagaatga

SEQ ID NO: 2341 - DNA, 1506 bp, Enterobacter cloacae
cgtcctatgctacatttgtttgccggcctggatttacataccgggcttttattattgcttgctctggtttttgtgctgttttacgaagcgatcaacggcttccacgacactgcaaacgcagtagcaacggttatctacactcgcgcaatgcgatcgcagcttgcggttgttatggcggcggtatttaacttttttggtgtcctcctgggcggactgagcgttgcgtatgccattgtgcatatgctgccaacggatctgctgcttaacgtgagttccggtcatggcctggccatggtgttctctatgctgcttgctgcgattatctggaacctcggtacctggtatttcggcctgccggcatccagctctcacaccctcatcggcgcgattatcggtatcgggttaaccaatgccctgatgaccgggacctccgtcgttgatgcgctgaatatcccgaaagttctcggcattttcggctctctgatcatctcccctatcgtcggtctggtggtggcgggtggcttgattttcatcctgcgtcgctactggagcaacacgaaaaaacgtgcgcgtatccacctgacgccagcagagcgtgagaagaaagacggcaagaaaaagccgccgttctggacgcgtatcgcgctgatcatttccgctatcggcgtcgccttctctcatggcgcgaacgatggtcagaaaggtatcggcctggtgatgctggttctgattggcgtcgcaccggcgggcttcgtggttaacatgaacgcctccggttacgaaatcacccgtacccgtgatgcggtaaacaacgttgagacttacttccagcagcatcctgatttgctgaagaaagcgaccggcgtggaccagctgattccttctccggagtcaggcgcaacgacggcaccgggcgagttccattgccatccggcaaacgcgattaacgcgctggaacgtgcgaaaggcatgctggccgatatcgaaagctatgacaaactggctgttgaacagcgtggtcagctgcgtcgcatcatgctctgtatctccgacgtgaccgataaagtcgcgaagctgccagaggttaatgctgacgaccaacgtctgctgaagaaactgaaaggcgatatgctcaataccattgagtacgcgccaatctggatcatcatggcggtcgcgctggcgctgggtatcggtacgatgattggctggcgtcgtgtggcgaccaccatcggcgagaagatcggtaagaaaggcatgacctatgcgcagggtatgtccgcgcagatgacggcagcggtatctatcggtctggcgagttacaccggtatgccagtctccaccacccacgtactctcttcgtccgtggcaggtacaatgattgttgacggcggcggtttgcagcgtaaaaccgtgaccaacatcctgatggcctgggtgttcaccctcccggcgtccatcctgctgtctggcggtctgtactggatttcgctgaagctgatttaa

SEQ ID NO: 2342 - DNA, 1443 bp, Enterobacter cloacae
gctggatcgtgccggagtaatcgcagccatcggtggaaactattgatttcaggtatacaatcgcggcaattcacgattaaggacaacgctatgactaagcattatgactacatcgcaatcggcggcggcagcggcggcatcgcctccatcaaccgtgcagccatgtacggccagaagtgtgcgctgattgaagccaaagaactcggcggcacctgcgtgaacgtgggttgtgtaccgaagaaagtgatgtggcatgccgcgcaaatccgtgaagctatccatatgtatggcccggactacggctttgacaccaccatcaaccacttcgactgggataaactgatcgccagccgtaccgcctacatcgaccgtattcacacctcgtacgataacgtgctgggcaagaataacgtcgacgtgatccgcggctttgcccgtttcgtggatgcgaagacgatcgaagtgaacggcgagacgatcaccgccgatcacatcctgatcgccaccggcggccgtccgagccacccgcacattccgggcgcggaatacggtattgactccgacgggttcttcgagctgcctgctctgccagaacgcgttgccattgtgggcgcaggttacattgcggttgaactggccggcgtgattaacggcctgggggcggaagcgcacctgttcgtgcgtaaacacgcgccgctgcgcagctttgacccgctgatcgtcgacacgctggtcgaggtgatgaacgccgaaggcccaaccctgcacaccaacgccgtgccaaaagcggtggtgaaaaatgcggacggtagcctgacgctggagctggaagatggccgcagccagaccgttgactgcctgatctgggcgattggccgtgaaccggccaccgacaacttcaacctggccgcaaccggggtgaaaaccaatgaaaaaggctacattgtcgttgataaattccagaacaccagcgtaccgggcatttatgccgtcggtgataacaccggtgccgtagagctgacgccggttgccgtggcggcggggcgtcgtctttccgagcgtctgtttaacaacaagccggacgaacatctggattacagcaacattccgaccgtggtcttcagccacccgccaatcggtaccgtcggcttaaccgagccgcaggcgcgtgagcagtacggcgatgatcaggtgaaagtgtataaatcggcgtttaccgcgatgtataccgcggtcacctcgcaccgtcagccgtgccgcatgaagctggtctgcgtgggcccggaagagaagatcgtcggcatccacggcattggcttcggcatggacgagatcctgcaaggcttcgcggtggcgctgaagatgggcgcaacgaagaaagacttcgataacaccgtggcaatccacccgactgcggcggaagaatttgtgaccatgcgctga

SEQ ID NO: 2343 - DNA, 1332 bp, Enterobacter cloacae
gaaaatattatgcaagcaacagccaccacacttaacgaaggggcggaacatgttccggtcaactcgcgcaataaagtcgtcgtcgcatcgctgattggcaccgccattgagttcttcgacttttatatttacgccaccgctgcggtcattgtctttccgcatattttcttccctcagggcgacccgacggcagccacgctacagtctttagccacctttgctatcgccttcgttgcgcgtccgattggttcagcggtctttgggcattttggcgatcgcgttggccgtaaagtgacgctggttgcctcgctgctgacgatggggatctccaccgtcgccatcggcctgctgccgacctatgaaactatcggcattctggcgcctgtgctgctggcgctggcgcgctttggtcagggtctggggctgggcggggaatggggcggcgcggcactgctggcgaccgaaaacgctccggcgcgcaagcgtgccctgtatggctctttcccgcagctgggcgcaccgattgggttcttctttgctaacggcaccttcctgctcctctcctggctgctgaccgatgaacagttcatgagctggggctggcgtattccgttcgtcttctctgctgtgctggtgctgattggcctgtacgtgcgcgtgtcgctgcacgagacgccggtctttgctaaagtcgccgcggcgaaaaagcaggttaaagttccgctggggacgctgctgaccagacacctccgcgtgaccgtgctgggcacgttcatcatgctggcgacctacacgctgttctacatcatgaccgtttactccatgaccttcagtactgccgccgcgccggtcggcctgggcctgccacgtaacgaagtgttgtggatgctgatgatggcggtcatcggatttggtgtgatggtgcctatcgcgggcctgctggcggataaatttggccgtcgttcaagcatgatcgtcatcacctccctgattattctgttcgcgctgtttgtcttcccgccgctgctgggttcaggtagccctgcgctggtgatggcgtatctgctgattggcctgagcctgatggggctgacctttggcccaatgggcgcgctgctgccggagctgttcccgactgaagtgcgttacaccggcgcctcgttctcctataacgtttcgtcgattctgggcgcctcggtagccccgtatatcgccacctggcttcaggcgaactatggcctgttctatgtgggtgtctatctggcagcaatggcagcgctgacgctgattgcgttgctgctgacgcatgagacgaagcatcaggcgctgtaa

SEQ ID NO: 2344 - DNA, 453 bp, Enterobacter cloacae
ggaaggagtaacactatggcttacaaacacattcttatcgcggtagacctctccccggagagtaaagtgctggttgataaagcagtatccatggcacgtccctacaacgcgaaagtttcgctgattcacgttgatgtgaattactccgacctctacaccggtctgatcgacgtgaatctcggcgatatgcagaaacgcatctccgaagagactcaccacgcgctgagcgagctttctaccaacgcgggctatccgatcactgaaaccttaagcggtagcggcgatctgggccaggtgctggttgatgcgattaagaaatacgatatggacctggtggtatgtggtcaccatcaggacttctggagcaaactgatgtcttccgcgcgccagctgattaacaccgttcacgtggatatgctgattgttccactgcgtgacgaagaagacgagtaa

SEQ ID NO: 2345 - DNA, 1707 bp, Enterobacter cloacae
aagatagccgggaaaaacccgtatttgttacgacaaaaaccggaggtcctgaacaccatgttcaaccagaaactacagactgccgaggatatcgagttcgatattgcagaagagctgcgctatgaaaccgatccctgtgagttaaaactggatgagatgatcgaggcagagccggaaccggaaatgattgaagggctgccggcgtccgatgcccttacgcccgctgaccgctaccttgaactgtttgaacacgtccagtcgtcgcggctgtttgcggacagcaaaacctttcccgactgcgcgccgaagatggatccgctggatattttgatccgctatcgcaaggtgcgtcgccaccgtgattttgacctggcgcgctttgtaaagaatcacttctggctaccggaggactacagcaaagagtacgtctctgatcccggcctgtccctgaaagaacatatcgataatctgtggccggtgctgacgcgcgagccgcaggatcacatcccgtggtcgtcgctgctggcgctgccgcaggcctatattgtgcccggcgggcgattcagcgagacctactactgggactcttacttctccatgctggggctggcagaaagcggtcgtaacgatctgctgaaatgtatggccgataacttcgcctggttgattgagcgctacggccatatcccgaacggcaaccgcacctactatctcagccgctcccagccgcccgtttttgccctgatggtggagctgtttgaagaggacggcgtgcgcggggcgaagcgctatcttgagcacctcaagatggagtacgccttctggatggacggggcggaatcgctgctgctcaatcaggcctatcgcagtgcggttcgtatgccggatggctcattgctcaaccgttactgggacgatcgcgatacgccgcgggatgaatcgtggattgaggacgttgaaactgcccgtcattctggtcgtccgccgaacgaggtgtaccgtgacctgcgtgccggggcagcctcaggatgggattactcatcccgctggctgcgcgatcctgcgcggctggccagcatccgcacaacacaatttatccccatcgatttgaacgcattcctgttcaaactggagagcgctatcgccaacatctccgcgtcgaaaggggataaagagacggctgatctgttccgccagaaagccagcgaccggcgcgcggcggtaaaccgctatctgtgggacgaagagaacggctgttatcgtgattacgactggcggcgtgaagccctggcgctgttctctgcggccagcattgtgccgctgtatgtgggcatggcgacgcatgagcaggctgaacggctgtccgatgccgttaaagcccgtctgctcacgccgggcggtattctcgccaccgaatatgaaaccggggagcagtgggataagccgaacggctgggcgccgctccagtggatggcgatccaggggttcaagcagtacggcaacgactcgctgggagatgagatcgcctggagctggctgcacacggtgaaccattactacaaaacccatcataagctgattgagaagtaccacatcgccagcagcacgccacgcgaaggtggcgggggggagtatccgttgcaggatggcttcggctggacgaatggcgtggtgcggcggttgattgggttatatggtgaaccttga

SEQ ID NO: 2346 - DNA, 351 bp, Enterobacter cloacae
gaggaaacgcttatgacgggttatgcaatgcagatatcttctgctgcaatcgcattaattaaaaaacaacagggtctttccctggagaaataccgtgacgaaaagggaatatgggttataggttatggtcacgtaattcgccagtgggaaaaatttaacggtctcatcacgccgactgaggcggagaatttgctttgtaatgatattcaattatgtgaggcgctgctgcgggaaatgaacaaacgcccattaacccaacagcagcatgacgcactgatattaaccctcttcagttttggggaagagtcccctctgccagagaagatccttcaggccgtcgcccgggtgtag

SEQ ID NO: 2347 - DNA, 675 bp, Enterobacter cloacae
cctctcccgtcgggtgcatgtgtttatggagtggcttaccgaactcacaaaaggttacgtggactagtcgcaagctataattcagtaacatccagctcaacgaaaaggaaaatgcgcgtgacgccggaaaataacccgcaacgaccgactcaacatttagattatgaacccatcaaaaagatggataacgagcctgaagcgccgaaagagcctggaacggccagcaaagcgctgggtaccgtgaccggcatagccgaaaaaattcagcagatacccgcgattgctcacctgatacgcgccgctgagcgctttaacgaccgcatgggaaatcagtttggcgcggcgattacctatttctcgttcctgtcgatgatccccattctgatggtgtcatttgccgccgccggttttgtgctggcgtctcacccgacgctgttgcaggacatcttcaataagatcctgaccaacgtcagcgaccagacgctcgccacaacgctcaaaagcaccatcaataccgccgtgcagcagcgtaccaccgtgggtatcgtcgggttactgattgcgctctattccggggtgaactggatgggcaacctgcgtgaggctattcgcgcccagtcgcgtgacgtctgggagcgtagaccgcaggatcaggagaagatatgggtgaagtaa

SEQ ID NO: 2348 - DNA, 468 bp, Enterobacter cloacae
ctgcgcgactttatttcgctgattgggctgctggtggcgctggtcatcacgctctctatcacctcggtcgccggttccgcgcagcagatgattatctccgcgctgtacctggattacattgaatggctgaaaccggcctggcgcggtatagggcttgcaatctccatctttgctaactacctgcttttcttctggatcttctggcgtttgccccgccatcggccgcgcaagaaggcgctgatccgtgggacgttgattgccgccattggctttgaagtgatcaaaattgtgatgacctatacgcttccgtcgctggtgaagtcgccctccggcgcggcctttggttcggtgctggggctgatggctttcttctatttcttcgctcgcctgacgctgttctgcgccgcgtggatcgccacggctgagtataaagatgacccgcgcatgccgggtaaaacccaccgctga

SEQ ID NO: 2349 - DNA, 882 bp, Enterobacter cloacae
actgtggcaaatcgtcaattcagcggaatatcattacccatgctcagttatcgccacagcttccacgcaggcaaccacgccgacgtcctcaaacacaccgttcagagcctgatcatcgaatcgcttaaagaaaaggataaaccgttcctttatctggacacccacgcgggcgcgggccgttatcagctgagcggcgagcatgccgagcgtaccggtgaatatctggaagggattgcgcgtatctggcagcaggacgatctgcctgccgagctggagccgtacattggcgtggtgaatcacttcaaccgcaacggccagttgcgttactaccctggctccccgctgattgcccgccagctgctgcgcgagcaggacagcctccagttaaccgagctgcacccgagcgacttcccgctgctgcgttctgagtttcagaaagataaccgcgcccgcgtagacaaagccgatggttaccagcagctgaaagccaaactgccgccggtttcccgtcgcggcctggtgctaattgacccaccgtacgaaatcaaaaccgactatcaggcggtggtgaccggcattaacgaaggttacaaacgctttgcgaccggcacctatgctctgtggtatccggtagtgctgcgcgcgcaaattaaacgcatgatcaaagacctcgaagcgacgggcattcgcaaaatcctgcaaattgagctggcggtgcgccctgacagcgaccagcgcggcatgaccgcgtccggcatgatcgtcattaacccgccgtggaagctcgaagcacagatgaacaacgtgctgccgtggctgcacaaaacgctggtgccagccggtacgggtcacgccaccgtgagctggatcgtgccggagtaa

SEQ ID NO: 2350 - DNA, 573 bp, Enterobacter cloacae
caaccttataatcatttgcaatgtctccggaggatcgtcatgcccgccttaaccaccgcgcgtctcacctgctcgccgctgcaagagcaagactggcccttttttctgtcgctacagcaaaatcctgaggtaatgcgttttgtcgcccctgcgcgtagcgaggcggacattcgggaagcctttgagtctcgtctgttgccgtggacgccgggcagttcgcactggctctgccttatggtgcgtgagacggccagccagacgccgctgggcgtaaccggatatgtgcaccgggaagcagattgtgcagaagtcggttttctctttgcgccttctgcgcaggggaaaggttacggctttgaatctctgcgggctgtgtgtgattttgcgctgactcagggcaatatccgtcggctcaccgcgaccgtgacggcgggaaatatcgcctccaggcgactgctggaaaaaacaggttttcagctggaaggtgagttgcgcgagagttatttcctttcagggcaatggcataacgactggctattcggtttactgaaaaaggaattcccgttcagttaa

SEQ ID NO: 2351 - DNA, 909 bp, Enterobacter cloacae
ccaacatctatggataaaatacacgcaatgcagcttttccttcgggtcgcggaactggagagtttttcccgcgcggcggagacgttaagcctgccgaaggggagcgtatcgcgacagatccaggcactggaaaacgcgctgggcacgcagctgctgcaccgcactacccgccgcgtcagcctgacgcaggacggcatggtttattacgagcgcgccaaagatctgctgatgaatctggacgaactggacggcatgttcctgcacgacccttcaaccatcagtggtcggctacgtgtggatatgcccgttgccattgcgcgaaatgtcgtcattccgaaactgcctgcatttttacaacagtttcccggcattgaactggagctgagtagcagcgatcgtctggtcgatgtcatccgcgaaggatttgactgcgtggttcgcgtgggaaacttaaaggactccgggcttatcgcccgcccgcttgggaagctctcggtgattaattgcgccagcccggattatctgacgcgatttggctaccctgagacgctggacgatttggcttcgcatgccctcattcactactccgccacgctgggcacccgtccgcagggttttgagtattacaacggcagcgcgacccggtgggtaaaaacgggaggcgtattgtcggttaacagcacagaaacctaccaggccgcctgtatcgccgggcttgggattattcaggtcccgcgcgtcggggtgcgtgatgccctgcgcacgaaaaaactcgttgagatcctgccgcaatatcgggctgaaccaatgcccgtctccctcatttatccccaccgccgtaacctctcccgtcgggtgcatgtgtttatggagtggcttaccgaactcacaaaaggttacgtggactag

SEQ ID NO: 2352 - DNA, 990 bp, Enterobacter cloacae
ttgaccataaaaaacacacagcgcacactacccttaattactttgttcaggttcacgactatgtctaaaaaaattgccgtgattggcgaatgcatgattgagctgtcccagaaaggcgcggaagtcagccgcggttttggtggcgatacattgaacacctccgtttacattgcccgtcaggtctcccccgacgcgctgagcgtgagctacgttaccgcgctgggaacggacagcttcagccagcagatgctggaagcctggcagggtgaaaacgttgggacctcgctgatccagcgaatggaaaaccgcctgccgggtttgtactacatcgaaaccgacagcaccggcgagcgcaccttctattactggcgtaatgaagcggccgccaaattctggctggaaagcgaggccgccgctgccatttgcgaagaactggcgaccttcgattatctctacctgagcgggatcagcctggcgatcctgagccaggagagccgtgaaaagctgctgtcactgctgcgcgaatgccgtgccaatggcggtaaggtgattttcgataacaactaccgtccacgtttgtgggccagccgcgaagagacgcagcaggtctaccagcagatgctcgaatgcaccgatatcgccttcctgacgctggatgatgaagatgctctgtggggcgaaaaaccggttgatgaggtcatcgcccggacgcaggctgccggggtcagcgaagtggtgatcaagcgcggggcggagtcttgcctggtggcggttgcaggtgaagccgtgacagaggtcccggcggtgaagctggcgaaagagaaagtgatcgataccactgcggcgggagattctttcagcgcggggtatctggcggtacgtctgacgggaggtacgccggaagcggcggcgcagcgcggtcatttaacggccagcacggtgattcagtatcgcggagcgattattccgcgcgaggcgatgcctgcttaa

SEQ ID NO: 2353 - DNA, 318 bp, Enterobacter cloacae
aaactgctccagccacagcagggtcggcaggtcgaggtggttgctcggttcgtccagaagcagcagatccggatcgcttatcaacgcccgcgccagcagcaaccgcgtatgctgaccgccgctcagcgtggcggattgcagcgccgtttcctgcgtcgtaaagcccattccggccagcagcgtctcggccttccagcgaagactgtcgcgctcaccggtcggcagctgcgccagcaccgcatccagcatggtcaggggataaagggtctccggcagatgttgttccacgcgcgccagcaggcaatgtccagccagtga

SEQ ID NO: 2354 - DNA, 702 bp, Enterobacter cloacae
cactgctcgtcgattgaggtctttgacgcgctggtgatcctgtctgttctgctgtgggtgccagacattcacgacacgacaaccacccggctgacagaacaattccatttcctgaagaaaccggaaccgtggttgatttttgccgctacgatgtttggcaatgccggggtgtttgcctggtttagcttcgtgaagccgtttatggtcaacgtgtcaggcttttccgagggcgtgatgaccgcgatcatgatgctgatggggctgggcatggtgctgggaaatgtcttcagcggcaagctgtcgtcgcgctttagcccgctgcgcattgctgccaccaccgacctggtgattgtggcttcgctgctggcgttgttcgcctttggcgagcttaaaacagcttcactggtaatgggattcgtgtgctgcgccgggctgtttgcgctctctgcgccgctgcaaatactgctgctgcaaaatgcgaaaggcggcgagatgctgggggccgcaggcggacaaatggcgtttaacctcggcagcgcaattggcgcgtatttcggtggaatgatgattacgctcggctttagctggagttatgtcacgctgccggcagcgatcttatccttctcagcgatgacctctctgttgatgtatggttatttatgtgccaaaaagcgtcaggccaacgcaggagcgctggcctga

SEQ ID NO: 2355 - DNA, 909 bp, Enterobacter cloacae
atcgagcaaatggaggtcaaaatggatcgcgttattgccgcccaggtgtacaaccgcatctgtgagctggggagtttaagcgcggcggcgcgggcgctggggatctcccgtccgatggtgagccgttatctggagcagatggagaagtgggccggggcgcggctggtgaaccgctccacccgcaagctgacgctgacggcggcgggggagaaggtcctgcaaaagacccgcacgctctcgcaaatttctcaggaaattgaagatcagtcagtgaaggatttaccctcaggcacgcttcgtgtcgcctgcgcgcactttacggcgatgcatattatcgttccggtgctgcccgatctgttgcagcgttaccctcagctgcgcattgagctggatgttaacaatcatccggtaagtctggtgggcgagcgaattgacgtggcgatccgcatcaccgataaccctgaaccgggcatgatcgcccgccgactgggagagtgtcggtccgtactttgcgcctcgccgcactaccttgccagtcggggcgttccagtgcagctggaggatttatcccggcacaactgcctgcattacagcttttttgccggtcagtcgtggcgttttttgacgccagaaggggagtcggtcacgacggcggtcagcggcaatctcagcgccagtatctcgtcattgctgatggaggcggcgataaaccactgtggtattgccatgctgcccgagcgcgaggccgacgcggcgctacggcagggcagcctggtgccggtgctcggcgcctttacgccaaaaccgatcggtatttttggtatttatcagtcgcgagactatcagcctgcggcgcagcgtgtgttcctggatgcacttgcaaaccaccttgccacgcgctcggactag

SEQ ID NO: 2356 - DNA, 447 bp, Enterobacter cloacae
gccaaaaggagagcaagaatgacgattcataagcacggttcagcacactggtctggcgacatcaaacgcggcaaagggacggtctcaacagagagtggcgtccttaaccagcaaccttacggctttaacacccgcttcgagggcgaaaaagggactaacccggaagagctgattggcgcagcgcacgcggcctgtttctctatggccctgtctctaatgctgggcgaagcgggttatactgccgattccatcgataccacggcggatgtctcgctggataaaaccgacagcggttttgccatcagcaaagtggcgctacaaagcaaggtgacggtaccgggtatcgatccgcagcagttcgacggcattattcagaaagcgaaggcgggttgtccggtatcgcagctgttgaaagccgaaatcacgctggattacaaactgaactga

SEQ ID NO: 2357 - DNA, 795 bp, Enterobacter cloacae
cgcgggcaaacgctcctcttttacatcacaacaaaggttatgagtatgaatacaacgcttgcaggaaaaatcgctctggtgaccggtggcagcaccggtattggtctcgcaacggcacaggagctggcggcgcagggagcgaaggtctatatcaccggacgtcgtcaggccgaactggatgctgcccgggcagacattggcgccgcggcggtagctatccgcgcggacgtctccagaatggccgatctggatgcggtttacgcgcagattgctaaagaagaaggacgactcgatattctgttcgccaacgccgggggcggcgacatgctgccgctgggcgctatcaccgaagagcagtttgaccggatttttgccaccaacgtgcgcggcgtgctgttcaccgtccagaaagcgctgccgctgctctcatctggttcatccattatcctcaccggatcgacggtttcgattaaggggacggcgaattttagcgtctacagcgccagtaaagccgccgtgcgtaactttgcccgctcctgggcgctggacttacagggccgcgggatacgcgtcaacgtcgtcagccctggccccgtgaaaacgcccggtcttggcgatctggttcccgaagaacagcgtcagggattatacgatgcgctggcggcccaggtaccgctgggtcgcctgggcgcgccgggcgaagtcgggaaagccgtggcgtttctggcgtccgatgccgccagctttattaacgccacggagctgtttgtcgatggcgggatggcgcaaatctag

SEQ ID NO: 2358 - DNA, 378 bp, Enterobacter cloacae
cacccagtcccagccagaaggcaggcgtcgagatgcccgtcatcgccatcagtcgcaccaggtgatccagccagcggttacggtacaccgccgataaaatgcccagcggcacgccaatcaccagggccagcagcaaagagcagaaggccagttccagcgtggcggggaaaaaggctttcaaatcttccgcaacggggcgaccggtgcgaatggatgtgcccagatcgccatgcgccagcgcctctacatagcggccaaactgaatatagagcggttgatccagccccagctgctggcggatgccctgcacgatttcatcgctggcgcggtcaccggccagcaggcgggccggatcgccggggatcaggtgtgaaataa

SEQ ID NO: 2359 - DNA, 1506 bp, Enterobacter cloacae
aagctctggggaaaaaagagggagccttacatggcgaatttgccctggcgggtcagcgtgcgcctgatggctctcgcaaaaaaaatagcgatggtcatcgggatcattgtgctcgttctgctttcggtgcgggtttatctttcgcagcaggggccagccctgcatcactggcacacctggcgggctgatgaaatgtctgtgcaggagatggataacgcgaccttcgcagcgtatgtcgcgcgggaaaacgccatcttcaccgctctcgacgctgaggtgacggcgaaagtcccccccgcagagcgcacgccgctgaaccgttattaccgccagagcctggtgtggccaggacacttttccccggatgcaaaccggtcgttcgtgctgatgcctgccggaaagccgcgcgggggggtggtattgctgcacggtctgacggattcgccctacagcgtcaggcatctggcagagaattatcaacagcacggctttgtggccgtagtgcctcgtttgcccggacacggcacggcaccgggcgcgctgacagacgttgactgggaggcgtggctggcggcaacgcgcctcgcggttcgtgaagcgacacgcctgacggggaacgatctccccctgcatctggtgggctactccaacggcggggcgctggcgatgaaatatgccctcgacgcccttgatgcgcctgcactgcgtcaacctgagcagatcgttttgctctcaccgatgattggcgtcacggcgtttgcgcgctttgccggattcgccgggctaccggctatgttaccggcgtttgccaaagccgcgtggctcaacatttcgccagaatataatccttataaatacaattcgttcccggtgaatgcggcacgtcagtcctggctgcttacccaggcgctgcatgagcagataaatcgcggtgttcatgatcacaaactggcgcagcttccgccgatacttgctttccagtcggtcatggattcaacggtcagtacccgcgccgtggtcagcgggctgtttgaccagcttccggcaaacggcagcgaactggtggtttttgatatcaaccaggccgggagtttccgtccactgttcaggccatcatcctggacggcggtggctgacctgctgccggaggcaaaaagacgttacagtgtcacaattgtgaccaatgccagccccgacaggtttgatatggtggcaaagaaaacgccagcgggcagcacccgggaaacggtgatgccgctgtcggtcgcgtatccgcaggaggtttattccctgtcacatgttgccattccgttcccgcaggatgacgatctttatggccgccatcctgcggtgaaaaaccgctacggtatcagcctcgggacgatagccctgtggggagaaacatcggttctgagcgtcggcaaagatgcgctgatgcgcgtgacgtcgaatccgttctacgactatatgcagacgcggatcgacagccgtatcggtgataattaa

SEQ ID NO: 2360 - DNA, 1215 bp, Enterobacter cloacae
gtcacaccggggaactgtgttaaacagtaccgttcaggcgtataccccataccggaccccgtttctgtgctgacaactctcatttatcgaagccagctgagcttaacctgcacctccgcagcgttaagcgcgctggttgaacaggccaggatccgtaacacggagcagggcatctcaggcattcttctctcccgtggacgtgacgttctgcaaattctcgaaggcacggaacagcgcgtcgtcgcgctttttaactccatccgtgcggatgaccggcataccggcgtagtggagctgatgcgcgattacggcccgcgcagacgtttcgaagacgtgggaatgctgctgtttgacctggacgttcagaccccgaaagcggttctggcgtcggttctgcattacagcaagctggaaagttatctgacttctgaggagcgggtcttcaaattcattcagacctttatcaccggtaaaaccgctatcccacccgcttcggactatgagcctgataaatggacgctttcgcgagagcgcgcgccgtttggtaaagggttaggtctgctggcgggacagccctgccagtttgcgctgcaacccattgtcgagccgtccgaaggcaagatcagttctctcgaagcgcttatacgcggaaacgacggcggcagcccggagcatttcttccgtagtctcgatcgtgaactgatttacgaagtcgacctgcaaaccaaagcctggacctttgcgctggcgcaaaagctcggcatcggcagccacaaactggcggtgaacctgctgccaatgtcgctggttaacgtgccgggcgcggtagagttcctggtaacgcagatcaaaaagcacaatctacagccggagcaggtgatcattgaagtcactgagaacgagatgatctcaggcttcaaccagtttaacagcgcgattaaacagctgcgggcggaaggggttgggctggcgatagatgattttggttccggctatgctggtctttcgctgctcacgcggttccagccggataaactcaaaatcgacagagagatcgtcagcgatatccacctgagcgggcccaagcaggcgattgtgaagtcgataatcagctgctgcaccgatctggagattacgctggtcgcagaaggcattgagcagataggagcgtggtgctgtattcgtccacgaggagaccagaaccgcgtcaggcgc

SEQ ID NO: 2361 - DNA, 513 bp, Enterobacter cloacae
gccatggcgttttacagttctggtgtggaatatggcattcatagcctgatgtgtatggtggatgcaaaaggcaatgaacgtgagatgagcgtccgggagatggcggccttgcagggcgtgccctacgactatcttggaaaaatcttcacccgtttatcacgcgcggggctggttatcagcaccgaaggcaaagggggaggcttccggctggcgcgtccggccgagctgatcagcgtgctggacgtggcgcacgccatcgacggcgagaagaatatgtttgagtgtcgggaagtgcgtcagcgcctggcggtgtttgatgaaacgccacctgcctgggtctgtgacggcccgtgtggggtgcgctcggtcatggacagcgcgcagcagcggatggaagaggagttagggcgccataccatcctggatctggcacggaagatgtatcgaaaagcgcctgacacgttccagatcgaagttcaggagtggatttccgatcgccgttcgtccacgtga

SEQ ID NO: 2362 - DNA, 1536 bp, Enterobacter cloacae
ccgctggctggatcacctggtgcgactgatggcgatgacgggcatctcgacgcctgccttctggctgggactgggtgttatcgttctgttctacgggcaactgcaaattctgcccggcggcggcaggctggacgactggctcgatccgcccgcccacgttaccggtttttatctgctggacgctctgctggaaggcaacggcgaggtgtttttcaacgccctacagcacctgattctaccctccctgaccctggcctttgtgcatctgggtattgtggcgcgtcaggtacgttccgcgatgctggagcaactgagcgaggattatattcgtaccgcccgcgcgagcgggttgccggggtggtacatcgtgctgcgctacgccttacccaacgccatgatcccctccattaccgtgctcgggctggcgctgggcgatctgctgtacggggcagtccttaccgaaaccgtgtttgcctggccgggaatgggagcctgggtggtgacctccattcaggcgctggacttccctgccgtcatgggcttcgcggtcgtggtatcgctggcctatgtcttcgtcaatctggtggtggatctgctgtatctgtggatcgacccgcgaatcgggcgcggaggtgccgaatgatgttaactcaggaaacgcccgtccctgtcagcaccgctaaacagcgcattaactgggcaaagctattctggatgttacgcaaaagcccgctcacgctgatcggcggggtgattatgatcgtgatgctgctgctgatggtggtctcgccgtggatagtcccgcacgatccgaacgcgctggatctgaccgcgcgattgcaggcgccttcagcccagcactggtttggcaccgatgaggtgggccgggatctgttcagccgcgtgctggtgggcagccagcagtccatcacggcggggctggcggtggtggtgattgcgggcggcatcggttctctgctcggctgtttgtccggcgtactcggcggacgcggcgacgccatcattatgcgtatcatggacattatgctctccatcccctcgctggtgttgacgatggcgctggccgccgcgctcggcccaagcctgtttaacgcgatgctggcgattgcgattgtacgcattccgttttacgtgcggctggcacgcgggcaaacgctgttggtgcgccagttcacctacgtgcaggccgcccgcacctttggcgcatcgcgctggcacctgatcagctggcatatcctgcgtaacgcccttccgccgctgatcgtacaggcgtcgctggatatcggcagcgccattctgatggccgccacgctgggctttattggattaggcgcgcagcagccgaccgccgaatggggcgcgatggtggccgtggggcgtaactacgtgcttgaccagtggtggtactgcgcgtttccgggggcggcaattctgatcacggcggttgggtttaatctgtttggcgatggtcttcgcgacctgctggatcccaaatcaggagggaagcagtcatga

SEQ ID NO: 2363 - DNA, 987 bp, Enterobacter cloacae
tttccacgggcgcagaaggccaacaggctgcctgctggtacccacaacaggagagacgccatgtctgaggtactgctggaactggatagcgtgcatgtgaattttcctgcgcgcaaaaactggctggggcgcgtgacggagcaggtacacgccctcaacggcatggatctccggatccatcgcggcgaaacgctgggcgttgtgggggaatccggctgtggaaagagcacgctggcgcaactgctgatgggcatgctcaaaccgagtacaggtgcctgtcagcgcgcaaatgcggcaggcggtatgcagatggtatttcaggacccgctctcgtccctcgatccgcgtttacccgtctggcgcatcatcaccgagccggtgtggatacagcaacgccgcagcgaacgggagcgtcgtcagctggctgagacgctggcgcagcaggtgggcattcgagcagaatatcttgaccgcctgccgcatgcgttttcgggcggacagcgccagcgcatcgctatcgccagggcgctctcttcagatcctgacatcatcgtgctggatgaacccaccagcgcgctggatatttctgtccaggcgcagatcctcaatttgctggttgccctgcaacagcagcgaaatctgacctacgtattgatctcgcacaacgtctcggtggtccggcacatgagcgaccgggtggcagtgatgtatctggggcagatcgtggagctgggtccggcggaccaggtgctgagtcagccgcggcatccgtatacgcagctgctgcttgactccgttccccgtaccggagaaccgctggacgaagatctggcattacgcaaaaccgatcttcccggtaatcgccacctgcccgttggctgctacttccgcgaccgctgcccgctggcgatgcagggatgtgaacggccgcagccgcttcagcccgcagccgaaggccgaagcgtacgctgctggcgtaaccgctag

SEQ ID NO: 2364 - DNA, 921 bp, Enterobacter cloacae
tcagaggagatctatgtggatcagctaatggcaatgcgtgcctttacgcgggtggttgaatccggaagctttacccgagcggcagactccctgaacatgccgatagccacgctgagcaagctggtaaaatcacttgaagcgcacctggaaacacggctgctgcatcgcacgacgcgccgggtggtcacgacggcagaaggcatggaatactacgagaaagcgctacgggtattaattgatatagaggacattgataccgcctttcgcgcatcgtgctgcacgcccaaaggccatttgcgtattgacgtggggggctcaaccgcccgggacgtgctgatccccctgctgccggatttttttcagcgctacccggatctgcgcattaacctgggggtagccgatcgtccggtagatttaatcagcggaaacgtggactgcgtgatccgcggcggcccgctggatgactcttcgcttatcgcgcggcatatcggtgatgccgggatgatcgcctgcgcggcgccgggctatcttaaagctcacggcatccctgcctatccgcaggagctgcgcaacggccataagctgattagctacctttccccggttaccggacgcgcatttccgttccgcttccttgaccggggtgagcccctggagatcagcgttccgcaccaccttggggtcaatgaaagcaacgcacatctggccgcggcgctggcgggtttagggattattcagacgtttggctatgctgcgagagcgcatctggaaacgggcgcgctggtagagatcctgagcgactggcgtcctaaggcgtatccttttcacgtggtctatccccagagtcggcatttaacgcatcgcctgagagtgtttattgcgtggcttgccgaggttttccctgcggcagtgaaaggttag

SEQ ID NO: 2365 - DNA, 1785 bp, Enterobacter cloacae
taccaaccgaccgcaccccgtagcacaggccagaaagatgacaaacagcagtgtcagggacggatcttcttaaaaagagtgagtgacatggacaacaaactgaaaaaacatcgttccctttatattccttacgccggtccggttttactggagtttccccttctgaacaaaggcagcgcctttagcatggaagagcgcagcagctttaacctgctgggcctgctgcctgaagtggttgaaaccattgaagaacaggcggaacgcgcctggatccagtatcagggttttaaaaccgaaatcgataagcacatctacctgcgtaatatccaggacaccaacgaaaccctcttctaccgcctggtgcagaaccatctcgaagagatgatgcccgtcatttacaccccaaccgtcggcgcggcatgtgaacgcttctcggagatctaccgtcgttcccgcggcgtgttcatctcttatcagaaccgtcacaacatggatgacattctgcaaaacgtgccgaaccacaacatcaaggtgatcgtggtaaccgatggcgaacgtattctgggccttggcgaccagggcattggcgggatgggtattcccatcggtaagctctcgctgtacaccgcctgcggcgggatcagcccggcctacaccctgccggtggtcctggacgtggggaccaacaaccagcaactgctgaacgatccgctgtacatggggtggcgtcacccgcgcattaccgacgacgagtactatcagtttgtggatgatttcatccaggccgtgaagcaccgctggccggacgtgctgttgcagttcgaagacttcgcacagaaaaacgccatgccgctgctgaaccgctaccgcgatgagatctgctcgttcaacgatgacattcagggcactgcggcagtgaccgtcggtacgctgattgctgcgagccgtgcggcaggcagccagctcagctatcagaaaattgtcttcctgggtgcaggctccgcgggctgcggcatcgccgagcaaattattgcccagacccagcgcgaaggcttaagcgaagagctcgcccgctcccgcgtctttatggtggaccgttttggcctgctgaccgacggtatgccaaacctgctcccgttccagaccaaactggtgcagaagcgcgagaacctgaaaaactgggatacggataacgaggtgctctcgcttcttgacgtggtgcgcaacgtgaagccggatattctgatcggcgtatccgggcagaccggcctcttcacggaggagatcattcgcgagatgcataagcactgcgaacgccctatcgtgatgccgctatcgaacccgacctcacgcgtggaggcgacgccgcaggatatcatcgcctggaccgaaggcaatgcgctggtcgcgaccggcagtccgttcgatccggtggtgtggaaggacaagctctaccccattgcgcagtgcaataactcctatatcttcccgggtattggtctgggagtgatcgcttccggcgcgtcccgcatcaccgacgaaatgctgatgtccgcgagcgaaacgctggcaggtcactcaccactggtgaataacggtgaaggcctggtactgccggagctgaaagacattcataaagtgtcccgcgcaattgccttcgcggtaggcaaaatggcgcagcagcaaggcgtcgcggtgaaaacctctgccgatgcgttgcagcaagcgattgatgataatttctggatgccggaataccgtagctatcgtcgtacttcgatttaa

SEQ ID NO: 2366 - DNA, 1716 bp, Enterobacter cloacae
gcaacaatgagcactctactcactgcacattctttacgtgttgataccgcgtttggcacgctcttcgactctctctcctttacgttgaaaaaaggcgaccgcattggcctgctgggtgataacggctgcggaaaaagtacgctgctgaaaatcctcgacgggacgcagtcccctgctgccggaaccgtttcactggctggacattgcctgctggcgcgcgtggaacaacatctgccggagaccctttatcccctgaccatgctggatgcggtgctggcgcagctgccgaccggtgagcgcgacagtcttcgctggaaggccgagacgctgctggccggaatgggctttacgacgcaggaaacggcgctgcaatccgccacgctgagcggcggtcagcatacgcggttgctgctggcgcgggcgttgataagcgatccggatctgctgcttctggacgaaccgagcaaccacctcgacctgccgaccctgctgtggctggagcagtttttacagagctggtccggcagctttgtgctggtttcacacgacaggcaactgctggacgcgataaccaacggcagctggatcctgcgcgataaaacactgcactacttcgcccttccctgcactgccgcccgtcaggcgctggaggcgaaagacgaaagcgatgcgctgcggcataaggcagagcaaaaagagatcgaccgcgtcacggccagcgccaaacgcctcgcgacctggggcaaggtctacgacaacgaagatctctcccgtaaggctaagcagatggaaaaacaggtcgaacggcttaaagaaaaccagacggaactgacggcgggaagcccgtggaccttaaccctgcgcggggacgcgcttcgggccgaccgcctgctggaaataaccgacctcggcgtccccccggcgccgggtctgccagacctgtttaccctcgtcagcgcgcggctgaagagcggcgatcgcgtggcgattgtgggtcgtaacggctgcggaaaatcgtcgctgctgaagcttatctggcgacattttcgcgacgagatctcggacgagcggcttaagcgtcatccgcgcgtttcacccggctactacgaccagacgctgcatcagttgccagacgatacggcgctgcttgatgcgctggagcctttcgcgccagatccgcagacccgtaaaatggcgctcatcagtgccggcttcccgtgggcgcggcacgggcaaaaagtcagtacgctgagcggcggggaacgttcgcgcctgctgttcgtcggcctgacccttgcccgttatagcctgctgatgctggatgaaccgaccaaccacctggatatggagggcaaagaggcgctggcggaaacgctgcaacagtttgaaggcggagtgctgctggtgagccacgatcgtcagttaattagccagtgctgtaaccgcttctggctgattgaggacggcaggctgagcgaatggcacgatgcggaggcggtctttgagcgcctgcgtgaggacgccggtccggctgtacctgaggcatcgaacgccgcattgaaggcaccctcttcagcgtcagacgatctgctcgaacgccttgtcgccctggaaacgttgctggaagaagatttggcgcgtaagcccaaatatcaaaaaccgcagttgcaggcgcaatggcgaaaagagattgaggagatagaagcccaactgtaa

SEQ ID NO: 2367 - DNA, 1050 bp, Enterobacter cloacae
gtaacggcccacgccggggggaagtgtatgacgttctggagcattgtgcgccagcgctgctgggggttaatcctggtggtggccggtgtctgtattattacttttattatttcacacctgatccccggcgatccggcccgcctgctggccggtgaccgcgccagcgatgaaatcgtgcagggcatccgccagcagctggggctggatcaaccgctctatattcagtttggccgctatgtagaggcgctggcgcatggcgatctgggcacatccattcgcaccggtcgccccgttgcggaagatttgaaagcctttttccccgccacgctggaactggccttctgctctttgctgctggccctggtgattggcgtgccgctgggcattttatcggcggtgtaccgtaaccgctggctggatcacctggtgcgactgatggcgatgacgggcatctcgacgcctgccttctggctgggactgggtgttatcgttctgttctacgggcaactgcaaattctgcccggcggcggcaggctggacgactggctcgatccgcccgcccacgttaccggtttttatctgctggacgctctgctggaaggcaacggcgaggtgtttttcaacgccctacagcacctgattctaccctccctgaccctggcctttgtgcatctgggtattgtggcgcgtcaggtacgttccgcgatgctggagcaactgagcgaggattatattcgtaccgcccgcgcgagcgggttgccggggtggtacatcgtgctgcgctacgccttacccaacgccatgatcccctccattaccgtgctcgggctggcgctgggcgatctgctgtacggggcagtccttaccgaaaccgtgtttgcctggccgggaatgggagcctgggtggtgacctccattcaggcgctggacttccctgccgtcatgggcttcgcggtcgtggtatcgctggcctatgtcttcgtcaatctggtggtggatctgctgtatctgtggatcgacccgcgaatcgggcgcggaggtgccgaatga

SEQ ID NO: 2368 - DNA, 867 bp, Enterobacter cloacae
cagcgaggcggtatgacgaccaaacctgaggtgttgagccgtatcgaagcgacctttagccagctcaccccaagcgaaaagcgggtggcaagctggatgctggcgcacgtcgggcagatcccctttgaaacggcagagagcgtggcgctggccacggccaccagcgggatcaccgtcggacgctttctgcgcaagctgggctaccgcaacctggacgacgccaaaaaaagcctgcgcgatccccaccagccctggggcattaacgagcgtctcgactcctggaagcagcaacagccgctgtcggatcgccttcagaactccctgtcgctggaggtggacgccattgcccatgtctaccagttggcgcaaagcgaaacgttcaggcaggtggtccagcaacttacccatgccgacgccgttttcgtgctggggatccagtccacgcgcgggatcgccaatgcgttcttcagccatctggagtatctgcgcccgcgggtgagctattcagaagggctctccggtagctgggtggagtcgcttaactccggctttgcgaacccgtatatcgtgctgacggatacccgcgcctactccgccattgcccgccagtactgccgcgtggcgagcgaaaaaggcctggcgatggcgctgatcaccgatatctggtgcccgtgggcgcgggattacccgattgatttactccaggtgaagaccgataccggccatttctgggattcgctggcgccggtgagctgtctgttcaacctgctgctgtcgggcgttgtggaggcgctgggggatgcgctgccggaacgtctggcaatcaaccgacaactacaacaagagtttggtcaatttgaacgctaa

SEQ ID NO: 2369 - DNA, 585 bp, Enterobacter cloacae
aggagcggagctatgcctgaagagagtcaactgattgatgtggcgaaaacctttcccacgctgcatatcgatctgaaatacgcgaccgccgataacatcactggccgcccgatctaccagcacgccgcgtgcctgttgcatacggatgccgccaccgcgctggcgaaagcgatcggcatcgccgcgctggccggtctgaagctggtggtttacgacgcctaccgcccccagcaggcgcagtcgcaactctgggatgcctgccccaatccggaatacgtggtagatgtcgcaattggctctaaccacagccggggcaccgccattgacgtcacgctgatggatgaacacgacaacgtgctggatatgggcgccgggtttgacgaaatgcacgaccgttctcatgcctggcacccttccgttccgcctgaggcgcagcgaaatcgtctgctcctgaatgccgttatgtacggcggcggttttgtgggcatcagcagcgaatggtggcatttcgaactgccgaatgccgcaagctacccgctgttagatgaccagttcgcctgttatccgaccacacactcactgtaa

SEQ ID NO: 2370 - DNA, 1548 bp, Enterobacter cloacae
ttctggagccccgccatgaaaacaacgctgcttacaaccctgattgccgctacgctcgccctgagcgcccctctcgcgctggcggcggtgccaaaagatatgctggtgattgggaaagctgccgatccgcaaacgctggatccggcggtcactatcgataacaacgactggacggtgacctacccctcgtaccagcgtctggtgaaatacaagcctggcaccacggaggtggaaggcgatctgtcgacgggctggaaggcgtctgacgaccagaaagagtggacgttcaccctggcagataatgcaaaattctccgacggcacgccggtgaccgccgaagcggtcaagctgtcgtttgaacgtctgctgaaaattaaccagggaccttccgaagcgttcccgaaagatttgaaagtggacgcggtggatgagcatacggtgaaattcaccctcagccagccgttcgccccgttcctctacacgctggccaatgacggcgcgtcgatcgtcaacccggcggtgctgaaagccaatgccgccgacgacgcacgcggtttcctggcgcaaaacaccgcgggttccggaccgtttatgctgaaaagctggcggaaaggtcagcagctggtgatggtgcccaacccacactggccgggtgaaaagccgcacttcaagcgtgtctcggtcaagattatcggtgaaagcgcctcgcgtcgcctgcaactttcccgtggcgatctggatatcgccgacgccctgccggtggatcagcttgccgctctgaagcaggaaggcaaagtggccgtggcggaatacccgtccctgcgggtgacctacctctatctgaacaacagtaagcctccgatgaatcaggtggatttgcgccgcgcggtctcctgggcgaccgattatcaggggatggtgaaaggcattctcagcgggaacggcaagcagatgcgcggcccgatcccggagggcatgtggggctttgatgcgaacgccatgcagtacagctttgacgaggccaaagccaaagcggcgctggagaaagtcaacgataaacccgccagcctgacgttcctctactccgataacgacccgaactgggagcctatcgccctctccacgcaggcgagcctgggcaagctggggattaacgtcaagctcgagaaactggcgaacgccaccatgcgcgaccgcgtcggcaaaggtgattatgacattgcgattggtaactggagcccggacttcgctgacccgtacatgttcatgaactactggttcgaatcggacaaaaaagggctgccgggtaaccgctcattctatgagaacaaagaggtcgatgcgctgttgcaggcggcactgaaaaccaccgatcaggcggagcgcaccaaagattaccagcaggcgcagaaagtggtgattgacgaggcggcttacgtttatctgttccagaagaactatcagctggcgatgaacaaagaggtcaaaggcttcacctttaatccgatgcttgagcaggtctttaacatcgccaccatgagtaagtaa

SEQ ID NO: 2371 - DNA, 1044 bp, Enterobacter cloacae
tctgtttggcgatggtcttcgcgacctgctggatcccaaatcaggagggaagcagtcatgagtgattccgtattatcgattgaagatttgcatctgagcttccccatttttcgcggtgacgtccacgcgctcaaccacgtctcgctggagattggccggggtgaaattgtcggcgtggtgggcgaatccggctcgggaaaatcggtcaccgcgatgctggcgatgcgcctgctgccggaaggcagttaccatgttcaccatggccgggtcaccctgctcggggaagatgtcctgaacgcgtcggaaaaacagcttcgtcagtggcgcggcgccagggtggcgatgatttttcaggagccgatgacggcgcttaaccctacgcgccggattggcagacaaatggtggaggtgatccgccagcatcagtcgctttcccgccgcgacgcgcagcagaaggcgatcgccctgctgggcgagatgcaaatcccggatgcggcacaggtgatggatcgctatccgtttgagctttccggcggcatgcgccagcgggtgatgatcgcccttgccttctcctgcgagccggagctgatcattgccgatgagccgaccaccgcgctggacgtgaccgttcagcgtcaggtgctgcggctactgaaacacaaagcgcgcgccagcgggacgtcggtgctgtttatcagtcacgatatggcggtggtgtcgcagctttgtgaccggatgtacgttatgtacgcgggcagcgtgatcgaaagcggcagcacgcagactttgatccaccatcctgtacacccctattcgattggcctgctgcggtgtgccccggaaaatggtgaaccgcgcgagatcctcccggccattcccggcacggtgcctaacctcagccacctcccgcgcggatgtgcctttcgcgaacgctgttttgctgccggggcgaaatgcagcgaaacgccgcgcttaatttccacgggcgcagaaggccaacaggctgcctgctggtacccacaacaggagagacgccatgtctga

SEQ ID NO: 2372 - DNA, 930 bp, Enterobacter cloacae
gcatctcctgtttcaggaattctggcaaatgaagagatccgtacaatagagactttcctgaagaacagagacatgaccatgactatcgcccgccttgctttgctgacaacccttttcactccggccgtctttgccgcgccgttgaccgttgatacgtacaacccgcaggaaaaaggcatttttgccgtttcttccacgctggtgtctggcccgaaagaggcggtactgtttgacgcccagttcagcgtgaaagatggcgaagcgctggtggaaaaaattcgccacagcggtaaaacgctgaacaaaatcgtgatcacctccggcgatccggatttctatttcggcctgcaaccgctggtgaaagccttccctaatgccaaagttgtcgccacgcaacaggtggtggaccatatcagggccacaaaagacgcgaagctcgccttctgggggccacagatgaaagacggcgcgccgtcacagctctacttgccgcaggtgcttgcctcaaccacctttatgattgatggtgaaagagtgaatattgaagagcctgagagctatgcggcgtacgtctggatcccatccgcaaaaaccatcctcggcggcacgggcgtctcgtggggtattcacgtctggacggcagatacccaaacgccggaaagccgcaaacagtggcagcagacgctggatagcatggcagcccttaagcccgaacacgttattccgggccactaccttgggacaccgccagcgggtaccggcgctatcgactttacccgtcgctatctacatcagtttgaacaggccctcatgacacataaagcgtcaaccggcgtcattagcacgatgaaaaaacagtggccgaatctggcggaagccagttcgctggaattgagtgccaaagtgaataccggcgaaatgaagtggtaa

SEQ ID NO: 2373 - DNA, 267 bp, Enterobacter cloacae
attacgattttgcacgccgtaacattaaacagacaacgacacggaggcagcatgtttacttattacccggcacataccacagcagcacaacccgaactcgttaacgcgattgcgcagggtcttcaggcagagcacggtgttgttaccgaagatgacattttgatggaactgaccaagtgggtggaagccacagacaatgacatcctcagtgacatctaccagcaaaccatcaactatgtggtcagcgggcaaaatgcacctttgtaa

SEQ ID NO: 2374 - DNA, 1023 bp, Enterobacter cloacae
aaggagaaacacatgaaggctgctgttgtcactcaggatcatcaggttaatgttacagagaaaaccttacgcgcgcttaaacatggtgaagcgctgctgaagatggagtgctgtggcgtgtgccataccgatctccatgttaagaatggcgattttggcgacaaaaccggggtgatcctcggccacgaagggattggtatcgtcaaagagattggtcctggcgtcacgtcgctaaaagtaggcgaccgtgcaagcgtggcgtggttctttgaaggctgtggccactgtgaatattgtaataccggcaacgaaacgctgtgccgtgacgtgaaaaacgcgggttactccgttgacggcggcatggcggaagagtgcatcgtaaccgcggattacgcggttaaagtcccggacgggctggactccgcggcggccagcagcatcacctgcgccggggtcaccacctacaaagcggtaaaagtctctgacatcaaacccggccagtggattgcgatctatggcctgggcggtctgggcaacctcgcgctgcaatacgccaaaaatgtcttcaatgcgaaggttatcgccattgacgtgaatgacgagcagctgaagctcgctgccagcatgggcgcagacttaaccgtgaactcccgcagtgaagatgcggcaaaagtgattcaggagaaaaccggcggtgcgcatgcggcggtggtgacggcagtagcgaaagcggccttcaactctgccgttgacgcagttcgcgccggaggccgcgtggtggctgttggcctgccgccggaagcgatgagcctggatattccacgtctggtcctggatgggattcaggtggtgggctctctggtgggtacccgtcaggatctgctcgaagccttccagtttgcggctgaaggtaaggtgattccgaaagtcacgatgcgcccactggaagatatcaacgccatctttaaagagatggaacagggccagatccgtggccgtatggtgattgatttacgttcttaa

SEQ ID NO: 2375 - DNA, 1221 bp, Enterobacter cloacae
cgcactaaaggatcgagtatgaaaaagcagattttaattgtgggtagtgggttttccggtatgtgggctgcggtcagcgccgcgcgcctttctgctctggcgggtaacaatagcctcagcattgccgtgctggcccctgttgcggagctacgcgttcgcccacgcttctatgaagagaacgtgtcgacgatggtcgcgccgctgaccgaactgtttgctgagctgggcattacctttattgcgggcgaagcacaacgtattgatacctcgtctaaaaccgttttgtatcgcgattcaaacggcgcgattgctgacgtcgcctgggaacgtctgatcctcgcaaccggtagccagactaaacgtcctcctgttgccggtctggctgaatacgcctttgatatcgaccaactcgactccgccaggttattcgagcaacatcttgattcgctggtttcgcgcccctccaccccggagcgtaataccgtggtcgtgtgtggcggcggctttaccggcatcgagctggcaacggaactccctgcccggctccgcactcgcttcggcgccaatacaaagactaaaataatcgtagttgaaaggggtgcaaccattggcgggcgttacagcgaggcgctgagaaacaccattgaagaagcaagcagcgcgctgggcgttgaatggcgtttaaacagtgaagttgaagccatcgatgccagcggcgtaacgctgaaaaacggagaacgcattgccagcgccactgtagtgtggacggcaggggtagaagctaaccccctcagcctgcaaattgacggggaacgcgacactcagggacgccttatcgtcaccgacacattgcaggttcctgcgcatcgggaggtttacgcgacgggtgatatggcgcatgccaaaacggacgatgtgggcaacacggcgctgatgacctgccagcacgcgatccagttggggaaattcgccggacacaacgcggcggccagcctgttaaatgtggagccgtacccttaccgtcaggtgaactacgttacctgtctggatttgggtagctggggcgcggtatacaccgagggctgggaccagcgcattaaatccgtgcgcgaggaaggcaaaaagatcaaagttgccatcaccaacgaactgatttacccgccagcagcagacaaagcggttgcttttgccgccgctgacccgctggcgaaattcgtgtag

SEQ ID NO: 2376 - DNA, 2112 bp, Enterobacter cloacae
acagaacgccaacttattggtacagaacaaataacttttcttcagtcaggcataaatgccttacgtcgggttgtcataaactatagtgtagtagtgttaacgctgtccggggcgttccaaccaggagagatcataatgtccacaggaaaattcattttacattcaggctatatcccgtcaggagatcagcccgaagcaatagccagactgatagcgggagtcgaagcaggagcgacacatcagacacttcaggggataaccggttcgggtaaaaccttcaccatggcgaatgtgatacaccgtttgcagcgccctacattaatactggctcctaacaagacgttaaccgcacagctttatctggagatgaagcagtttttcccagaaaatgctgtcgaatacttcgtttcttactacgacttttttcagccagaagtctatatccccggaagtgaccgctttatcccgaaagattccgctatcaacgatcatcttgaaaggttacggttatctacgaccaaggcattgattgaacgtcaggatgtgatagtcgtcgcttccgtctcttcgatatacggattaggtgatccggacgcatacagagagatccagatcccggtatacccgggacgacaactcgcccagcgggagttaattcatcaactggcacgtctgcagtatgcccgtacagacaaaactctgggacgggcgatgttccgggttcgcggtgacgttattgatatattccctgccgattccgaacatcaggccatcagggtcgaactttttgatgatgttatagaatccgcaaaatggattgatcctgtcagtgggaaaattgcgggcgacattgaacattatttaatatcacccaaaacactctttgttacaccgaccgcaaaaataccctcagccaccaaaagcattcttactgacatggagaaacgggttgctgaacttaacaaagcaaatcgtctgatagaggctgagcgcttatacgaacgcgtcaacaatgatgttgaaatgatccgtgaactgggttactgctcaggtatggaaaactattcctgctatttcagcgacagaaatccggaactcccaccgacaacgctgctggattacctgccaaaaaatggcctgctctttgttgatgaatcgcacgtaatggtcccgcaaatctcagccatgtacagtggcgatcagagtcgcaaggatactcttatcgatttcggcttccgtctgccctcctcaaaaaacaatcgacccctgagttttgctgagtttgagaagattaagccccagactgtctttgtttccgcaaccccaggtaaatatgaattgcagaaatcaaagaaaaatgttgttcagcaaattatccgccccaccggtttactggatcccgaaattgaggtccgaagcaaagaccagtgtgtggagaacttacttgaagaaatccgtcattgcgtcaacagaaacaatcgtgtcctggtgacagtgctgaccaaaaagaccgcagaagaactgaatgattttctgacagaaaatgggatcctgtcccgatatctgcattctgatatcaaaacagatgaaagacaggaaattatcaatggattacgggccggggaatttgatgtcttaatcggcatcagtctgctgcgtgaaggactcgacatccctgaagcctcactggtcgcgatacttgatgctgaccatgcaggttttttacgttcatcacacgcacttattcagatgattggacgtgtggcacgtaatgtggagggtaaagccgtactctatgcaaacaggatcactccggccatgaaacaggcgatggatgaaacgcacaatcgcagggaacgtcagatagcctataacctggaacatcatattaaaccagtgacttcagttcgtaagcggagtactgaacaggatgaaagcgtctatcctgccactcatacagaggcattctgttcaacgctatcagagttgtgtgaaagaattactgttaaagaaaagcaattactggcgatcgagaattcaggtgaggagaaggatatagaaaaattaagaacagaactgagtgatttgtatcgtcaatttatattcatgtaa

SEQ ID NO: 2377 - DNA, 2709 bp, Enterobacter cloacae
gcaccacatggaaaagaaacaatgacggtaggatcacgctggtttaaatttgattttcataaccataccccggcctcagatgactacaaagtcccagatctccagccccgggaatggctgctggcttacatgcggcaacaggtcgactgtgttgtcatcagtgaccataacagtggggcatggattgacgtgttgaaagcggaactggcgaacatgtcccgggacgccagttccggtgaactggcagacttccggccgctgactttgtttcccggtgtggagctcacggccaccggcaacgttcatatcctcgccgtgttgcacacccagagcaccagtgccgaggtggaacggctactggcacagtgcaacaacaactgtcctatttcgcgtgaaacccccaaccatcatcttgtgcttcagctgggacccgcgggcattatcagtaatatccgtcgtaacccggaagctatttgtatcctcgcacacattgatgcggcgaaaggcgttctgacaagccttactaatcagggggaactgacggccgcttttcagtcaaatcctcatgcagtggagatcagacaccgggaggaggagattacgaacgggactcaccggcgtttaattgcggatttgccatggcttcggggatcagatgcgcaccaccctgaacaagcgggagtgcgcacctgctggctgaagatgtccgagcctgattttgacggtctcaggcacgcattactcgatccggaaaactgcgtgctgtttgatgataatccaccggaggcaccagcttcacatttgcgcagcctgacattcaggacccgtctttgccagccggcagatcagtatggagcctccgttgagtttagcccgttttacaatgcggtgattggctcccggggcagtggtaaatccacgcttatcgaaagtattcgtctggccatgcgaaaaaccgaagggctgactgtgtctcaacgcaacaagttgaaccagtttagtcagatggggatgggcatggatgcggattctttcatcgaatgtgtgttccgcaaagaaggcacagattttaggctcagctggcgacccgatggtcgtaatgaattgcatattttcagcgaaggtcagtgggtgcaggacaatcactggtcaccagatcgttttcccctctcaatatacagccagaaaatgctctacgaactggcgtcagacacaggggcattcctgcgcgtctgtgacgagagtcaggtagtcaacaaacgcgcctggaaagagcgctgggatcaactggaaagggaatacctgaatgagcaaataacgctgcgtggtcacctggccagccagacgatcgcagataaactgcagggggagttgtctgatgctgaacgggccgtcagtcagttgcggtcgagcgcttactatccggtttgcacccgcctggccacggctcgggctgaactgtctgcagcaacgcttcctctggagcatcatgaacagcatgtcgctggtctgagggcgcaggagaaagagccagtacaagtcccggagctccaggtggagccgtctgcgacactgacagcatttatgacgcgtctttctgacgtacagcaaaagtatgaccagcgtcttgacacactgttgtcggactatgccgcggaactcagtaccattaggcaggacccccctcttctcgcactggaagaggcggtgcgtaaccaggaggaaactgtacaacgtgaggccatggtgctacgagaacagggactcaatccgaatgtcctcgatgagctgatgacgcgctgtgagtcgctgaagtcggaactgagaaattacgccgatcttgacgggacgatcgcggcctcagcagcgagatccacaggattactggctgaaatgcgtaaccaccggatggtattgacggaaaagcggaaggcgtttctgtcctctctgtctctcagcgcgctggatattaaaattctgccgctctgtgccccacacgaagacaccgtatctggttatcaggcggtaaccgggatcggcaactttgccgatcgtatctatgatgatggtgacgggagcgggctgcttcatagcttcatcagcttgcgcccgtacagtccgctaccgtcggcaacggaaaacaaatatcttgcgctggatacgcttaaagctctgcatcttgccatccatcgcgaggagccgggagcagggtcagagctccacggagctttcagaaatcgccttaaaggtctgaatgatgcgcaactggatgccctgcaatgctggtatccggatgatgggatccacattcggtaccagacgcccggaggagggatggaagatatttcctctgcctcaccgggacaaaaaggggcgagcatgttgcagttcctgctgtcatatggcaccgatcccctcctgctggatcaaccagaagacgacctggactgcctgatgctgagcatgagcgtgatccctgccatcatggcaaacaagaaacgccgacagctgattatcgtgtcgcattctgccccaatagtggtcaatggtgatgcggaatacgttatcagtatgcaacacgaccgctctggcctgcacccggggctttgtggagcgcttcaggagacgccggtgaaggaactgatttgccgacaaatggagggaggggaaaaagcatttcgttcccgctatgagcggatactcagctga

SEQ ID NO: 2378 - DNA, 441 bp, Enterobacter cloacae
cgcgcctttccgggattatcaagcggctggccgccagacgttccccgaagtaaaccgttgcagatatccctgcatgactggttggtggagaaaagagccactctgtcgaaaaaatcccggttaggcgaggcgttcgcttatgcactgaaccagtgggatgccctgtgttactactgcgatgatggtctggcagagccggataataacgctgctgagcgcgcgctacgagcggtctgtctgggcaagaaaaactacatcttcttcggcagtgatcatggtggtgaacgtggtgccctgctgtatggtctgatcggaacgtgcaggctgaacggtatcgatccagagggttaccttcgccatatcctgagcgtattgccggagtggcccatcaacaaagtggccgaactgctgccatggaacgtagatctcaccaataaatag

SEQ ID NO: 2379 - DNA, 1050 bp, Enterobacter cloacae
tctgctcctctgaatacaggggagcttatgatcacttttgagattcgtatggaaattaaagtcctgcacaagcggggaatgagtatccgggccattgccagggagctgggtatttcgcgcaatactgtccgcagccacctgaaagccaaatctgaaaagccgcagtattcaccacgcccggcaccatcatcactgctcgatgaataccgtgattacatctctaagcggatcagcgatgcgcatccctacaaaatcccggcgaccgttattgccagggaaatcatggagctgggctatcgtggagggcttactatcctgagagagttcatccgtaaacagaccctgccagcacaggcagaaccggtcgttcgcttcgaaaccgagcccggacggcagatgcaggttgactgggggaccatgcgaaacggcaagtcacccctgcatgtgttcgtcgctgttctgggatacagcagaatgctttacatcgagttcaccgacaacatgcgctacgacacgctggaagcctgtcaccgcaatgcgttcagcttcttcggcggtgtaccgcaggaagtcctgtacgacaatatgaaaacggtggtgctgcagcgtgatgcttaccagaccgggcagcaccggttccatccttccctgtggcagttcggcaaagagatgggcttctctccccgcctgtgccgtcccttcagggcgcagactaaaggcaaggtggagaggatggtgcagtacgcccgcaacagcttctatatcccgttaatgacacgcctgcgtccgatggggatcaccgtcgatgttgaaaccgcaaaccgttacggcctgcgctggctgtacgatgtggccaatcaacgtaagcatgaaactatccagacccgcccctgcgatcgctgggtggaggaacagcaatccatgctggcactgccaccggagaaaaaacagtatgacgtgcaggttgatgaaagcctgatgaccttcgacaggcagccgttgcatcatccgctctccatctatgacacgttctgcagaggagccgcatga

SEQ ID NO: 2380 - DNA, 243 bp, Enterobacter cloacae
cgtagcgagataaattccagttggcgtacattacccgatgtttttctcaaaaccatccgtctgcctcgcgatctggattttgagggcgtcagcgagctgaagattgttcgggagggggactgtatcatcctgcgtcccgtccggccgacctggtgctcgttcgcgcagcttgaaaaagccgaaccggactttatggtggaacgtggggacgttgtcagcgatgaaggtcgatttgacctgtga

SEQ ID NO: 2381 - DNA, 762 bp, Enterobacter cloacae
acgccgaaacttctcattgttatccttacgtttcttaaggagaagaatatgacagagcaaaataatttcggtcaatatataggcagtcaccttgacgatgacgtcactctttcattacctgatttgcgccaattaccagggcgttattgcactctgcagttgctgtccacccgtcacgggaatgacctcttccagggatggcacagtatagaggattcacgtgactggacctatcttccggatgaaagaccgccgacaaaacaggcaacccacagttatattcagcaactcattcaacagaagggagtatatcattacgccattatagaaaataattcagaaaatgctgtgggaactctttctctgtataacctcgacaataaaaatgacgtagcagaaataggaggcgtacatcttactccagttatcaaacgaacttcagtcagtacagaagcaattttcctgatactatcatatgtttttgatgtgcttaaatatcgtcgctgtgaatggcaaaccgacaggctcaactctcagggtatgagatctgccgagagattagggttccagaaagagggtgtactgcgtaataaacaaatacttaaatcaaggagcgtggacgttgtaatgtattcaatcattcaggatgaatgggaaagaatatccagtgcgataactatctggcttagaactgtcaacttcgatgaccggggacatcaaatacatcctttacggcattacctggcgacaacagagccctga

SEQ ID NO: 2382 - DNA, 267 bp, Enterobacter cloacae
atgaaaataatgaatgcagagattgagaggcaaatctggcatcacaatctttcctatttattgcttgcccagcgggttctgaatcattacgaagacacagccctgtttcggctaggtatcgacaagtgtaccggagataaactcctgcagttgtcgttgcccgaactggttcgtcttgctgaacgtccggagctgattaccgtactcagactcagggatcaccaccagatagatgtattactcagtcagtccactggaatgggatga

SEQ ID NO: 2383 - DNA, 1113 bp, Enterobacter cloacae
catatgaaatcacgtgcagctgtagcatttgctcctggtaagcccctcgagatcgttgaaattgatgtggagccgcctcgtaagggtgaagtactggtaaaaatcacccataccggcgtctgccacactgatgcatttaccttgtccggtgatgatccggaaggtgtgttcccggcagtactgggtcatgaaggtgcgggtgttgttgtggaagtcggcgaaggggtcaccagtgtgaaacctggcgatcatgttattccgctttacacggcagaatgcggcgagtgtctgttctgtaaatccggaaaaactaacctgtgtgtctctgttcgcgccacccagggtaaaggacttatgcctgatggcacgacccgtttctcttacaagggccagcctcttttccactatatgggctgctctacattcagtgagtataccgtcgtcgcagaagtgtctttagccaaaattaatccacaggcgaatcatgaacatgtctgtctgctgggttgtggcgtaacgacaggtatcggtgcggttcacaacactgcgaaagtacaaccaggtgacacggttgctatttttggcctgggtggtattggccttgcagcggtacagggcgcgcgtcaggcaaaagcgggtcgtatctttgccatcgataccaatccggagaaatttgacctggcccgttcatttggtgcaactgactgcattaacccgaaagactacgacaaacctatccaggacgttctcattgaactgacaggctggggtgtcgaccatacgtttgaatgtatcggtaacgtaaacgtaatgcgttctgcacttgaagcggcacaccgtggctggggtcagtccgtcgttatcggtgttgcgggtgcaggtaaagaaatctccactcgtccattccagctggtcaccggccgtgtatggaagggttctgcctttggtggtgttaaaggtcgtacccagctgccgggcatggttgaagatgcgatgaaaggcgaaatctatctcgcaccattcgtgactcataccatgggccttgaagagattaatgacgccttcaacctgatgcatgaatgcaaatctattcgtacagtgatccactactga

SEQ ID NO: 2384 - DNA, 1362 bp, Enterobacter cloacae
ctggccgtcagaaaaagagagagtcttatgaaagagtcagcattatctgctatccgttctgatatgcaatcacccgaaaccgtgtacgggatgccggctcataaagacagaacggccgctgtcaatgaagtacatgcgcgtccgcacctgcttatcacatcaccacagaccctgttgcagtttgctttcatgactaaaggcgaccagtcaggtgaccagcggttcatggttgagctgtcagatcgtcttggtttaacaccatcagaaaattcagcacccctgcacggtatcacgtggcgggaaggcgctttgtattgtgaaaaacacggtgagttttccacctacttatggagtaccacatgcgatccgcgtgacggacagttaaggggagagaaccccttccggcatggtttcacgccaccgggttcggttatctgtggtacccgtctggatattctgccatggactgcagaatctgaggctgcagtaacgaatttagatcctgtcagcaggtgctattcagtaacagaaaatggccgtgccgcaattatctctgattttcgccaggataaagacgggctgacacgcattctgatacttgaacgggacctgacagaggcacagctgggtgcactggttcagcggctgcttgagattgaaaattatcgcacgcttgctttgctttctttaccacttacaagaaccatggcctctgaactgaggcgagtggaaaaccgactggctgaaattacagaagaaatgcgcaccggagagcatcgtaaaaatgaacagttgctctctgcgttgaccaatcttgccgcagaacttgaagccggcgctgcagcgaatctgtaccggtttggcgcaagccaggcctactatgaaattgttgaggaaaggctgaatacgctctccgaaacgccggttccaggctactacacctggtctgattttttgcaacggcgcattgccccagccatgcgaacctgccgttctgtgaaagaacgacaggcgaagctgtctgacaaactcatgcgggctatttcgttacttcgctcctggatagatgttgaactggaacatcagaaccgtgacctgctggcttcgatgaataaccgggccagacaacagctacatctgcagcaaaccgttgaaggattgtctgttgccgccatttcatattatgtggtgagtctgatttcgtatctggtgaaaggggttcccgggatccacgatgtcatgccacctgagctggcggttgccattctcgtgcccttcattgtgctcgcgatttggtgggtggtgcgaagaataagaaactcgcacaccgaccctgaacataacgaaaaccgctctgactga

SEQ ID NO: 2385 - DNA, 372 bp, Enterobacter cloacae
ttgcgctcagaaacccgggccgctatcagagtgtatccgcattctcaccgatcgtcgcaccttctcaggtgccctgggggagaaaatgcattgtctgcttatctgggtgatgatcgggaatactggaagcagtacgacacggttgagttgatccgtaaagcgcaggaaaggctacctctgcttgtagaccaaggactgaatgatgagtttctgaagactcagcttcagccggagagactgaagagcgtttgtgaggacaccggtcatccgttgacgcttaacctgcgtccgggacacgatcacagctattactttatctccagctacattggcgaccacattgcacatcatgcagcagcactgacgcgctaa

SEQ ID NO: 2386 - DNA, 2655 bp, Enterobacter cloacae
actatgtcaaagaaactttttggtgcccccccaaccctgacagacgccagtaattctgttgtggtacgtggtgccagggagcacaaccttaaagaggtggatgtctctgttccgcgtgatgcacttgttgtcttttcgggggtctctggttccggtaagtcttcactggcttttggaaccatttatgctgaggcgcaacgacgctactttgaatcggttgccccgtatgcgcggcgcctcattgatcaagccggtgttccggatgtggatgccattgatggactcccccctgcagttgcccttcaacaacagcgaggaaccagcaatgcacgctcttctgtcggcagtgtgaccaccttatcgagcctggtgcgcatgatgtattcccgggcgggagcctatccggcagaacaacctatgctctatgctgaggatttttctcctaacacgcctcagggagcatgtccatcctgccatggtctcggacatatctatgatgtgacagaagcactgatggtacctgatccgtcactcagtatccgggacagagccattgcctcctggccacctgcctggcacggacaaaatcttcgcgacattctggtgacactgggctatgacgtcgatatcccctggaaagagttatctgaagaagagcgacactggatcctgtttactgaagataccccgacggtgccggtctaccccggactcagcccggaagacacacgtgtcgcagtcagggaaaaaatgactccgggttatatggggacgtttacaggggcgcgacgttatgttctgcatacctttgcacacacccaaagtgcactgatgaggaaacgcgtctccagttttatggaaggtaaactgtgtcctgtctgccacggaaaaaggcttaaaccggaatcattgtcagtcacttttgctggagtggacatcggtgagtttatgcagatgcctttagaccagctggctgagttgcttcttcctatctcccggggggatttcagtacgcatcatgccggggctgatactgacagggatatcacccgccgggaccggacagaacgcgcaggttccggcagagcagtccattctgtaacgccggatgtccgccggacctcagcattatcgacagagaaacgactggctgctcaacgactgaccagaggtgttatggaccggctgtatcagttgcagaaactgggacttggttatctgacattagacagaacaacgccaacactctccgcaggggaactccagcgattgcgtcttgccactcagcttagctccatgttgtttggggtcgtctatgttctcgatgaaccatcagcaggcctgcaccctgcagacagccatgcactttacgatgctctggagaacctgcgggatgccggaaactcagtgtttgtcgttgagcatgatcttgacctgatgcgacgggcgcaatggctggttgatgtgggacccgctgcaggagaacagggcggtcatattctctacagtggtgtacctgaaggtctgaaagctattgctgaatccagaacggcgcggtatttgtttgatgaaatcaggccaccacaatcatacgcccgacagccagcaggatggttaaaattacaggatattcaccgtcacaacctgaagggactggacgcctgtattcctctgggggtactgaccgctgttacaggtatttcgggttccggaaagtctagtctgattgctcaggccttacctgagctggtgctttcctcgcttggccatgaaccagaagacgtgttatccgagggcagtgatgctgagggaccaaccgttactgagaaaacttacggtacgctgacaggcgacaccggactgatcaaacgtctggtgcaggttgaccagaaaccgataggccggacaccgcgttctaacctggcgacatataccggactgtttgaccatattcgtaagctctttgccggaacacctgctgctaaaaactatcattatgatgccggacagttttctttcaatgtggcaaaaggtcgctgtgaaacctgtgagggtgaagggttcgtcagcgttgaactcttgtttatgcccagtgtgtatgccccttgtccgacatgtcatggcgcacgctataacccggatacgctcagggttcgctggaaggagcgaaacattgcggaagtcttgcagatgacagtggatgaagcctgcagcttctttgctgatgtagaacccgtggcgcgacctctgcgcctgctgggcgaaatcggtctgggatatctgcgtctgggtcaaccagccactgagttatccggaggagaagctcaacggataaagctggcaaccgaactgcaacgtagccaacgtggccatacgctgtatgttctggatgaaccgaccaccggactccatgcgtcagacgccgaccgtctgcttgtgcagttgcagcgtcttgttgagacagggaataccgtagttgtgattgaacacgatatgcgtgcagtcgtgcaggctgactgggttatggacattggtcccggagcaggtcatgagggaggcaacctggttgcagaaggtacacccgcccaggtatcacaggtttgtgaaagccgcacggcaccgtttattgcccgggagttgtcacggaactggtaa

SEQ ID NO: 2387 - DNA, 279 bp, Enterobacter cloacae
gaaatgcccagtactccggaagagaaaaaaaaggtactgacacgggttcgccgcatcagagggcagattgatgctctggaaagagcacttgaaaatggtgctgaatgccgcgccattctccagcaaattgctgccgttcgtggcgcatctaacggattgatggctgaggttctggagagtcacatacgagaaacctttgaccagaatgacaactatagccatgaagtcagtaaatcagttgacgatacgattgaactggttcgcgcctatcttaaatag

SEQ ID NO: 2388 - DNA, 804 bp, Enterobacter cloacae
cacgttctgcagaggagccgcatgatggtcgaactgcaacatcaacggctgatggtgcttgccgaacagctccagctggacagtcttatcggcgcagcgccggcgctgtcgcaacaggcggtggatcaggaatggagctacatggacttcctggagcacctgttacatgaggagaaactggcccggcatcagcgtaaacaggcgatgtacacgcggatggcagccttcccggcggtaaagacgttcgaggagtacgacttcaccttcgccaccggcgctcctcagaagcaaatccagtcgctgcgatccctgagcttcatagagcgtaacgaaaacatcgtgttgctggggccatcgggcgtgggaaaaacgcatctggcgatagccatgggctacgaagcagtacgggcgggcatcaaggttcgcttcacaacagcagcggacctgctgctacagctgtccacttcacagcgtcagggccgttacaaaacgactctcaatcgtggtgtcatggccccgaagctgcttatcatcgatgaaataggttatctgccgttcagtcaggaggaagccaagctgttcttccaggtcatcgccaaacgttacgagaagagcgcgatgatcctgacctccaacctgccgttcgggcagtgggatcagacgttcgccggtgatgcagcgctgacatcggcgatgctggaccggatcttacatcactcacacgtcgtgcaaataaaaggggaaagctatcgactgaagcagaaacgaaaggccggggttatagctgaagctaatcctgagtaa

SEQ ID NO: 2389 - DNA, 219 bp, Enterobacter cloacae
cctgtgaacaagatctacatgctcgacaccaacatctgctcgttcatcatgcgcgagcagtcggaagtggtgctgaagcgcctggagccggcggtgctgcgtgaccagcgtatcgtggtctcggttatcacttactccgagatgcgctttggcgccacaggtccgaaggcctccccaccccgcgagcagttggttgacgcgttctgtgtgccgttctga

SEQ ID NO: 2390 - DNA, 288 bp, Enterobacter cloacae
cagggacaatcaatgccacattctccagaagaaaagaaacaggcgcttgtccgggtacgacgtatcaaaggtcagattgcagcgctggaacaggcgattgaaaacgaagcggaatgttcttcattgttgcagcaactggcttcggtacgaggagccgttaaaggcctgatgactgttgttctggaaagctatctcagggaagaatttcccgatacgaacaaaagaagggggtcgcagacgaaatctatcaacgacgctatttccattgttcgctcatatctccgttaa

SEQ ID NO: 2391 - DNA, 621 bp, Enterobacter cloacae
ctgagttgttacgttgttgctgaattgtcctgtcgttatacggagaaaattatggaacgtcttgaacatcatgccagctttgatgggtggcaggaagtttatcagcatgagtctggcacgcttggctgcacgatgaaatttggtgtttatactccaccccaggcgcttaacggtaatgtaccggtactctactggctttccggtctgacctgtacggaacagaattttattaccaaatcgagcgttcagcgttatgccgcagagcatgggatcatgattgtggcaccagacaccagtccgcgtggcaccgatattcctgatgatcctgactacgctctcggtcagggggccggattctatgttaatgcaacccaggagccctgggcgacacattacaaaatgtatgactatgtggtaaacgagctcccgtccctgattgaagaatggttcccggcgtctgataaaagaagtatcagtggacattcgatgggcggacatggcgccctgatgattgcgctcagaaacccgggccgctatcagagtgtatccgcattctcaccgatcgtcgcaccttctcaggtgccctgggggagaaaatgcattgtctgcttatctgggtga

SEQ ID NO: 2392 - DNA, 633 bp, Enterobacter cloacae
acgcctgatgcagatgatgccgcaggtactgcctgcgccggatgcgatgggaccacctgcacccgtaccggctccggcgacggggttaacgcagccgctgccggatgcgccgccaccgccgcaagtctcgggtggagggcagtagtggccagttatcgtagccaggggcgctgggtaatctggctctcattcctcgttgcactgttgctgcaaattatgccctggccggacgacattcttgttttccggccaaactgggtattgctcattttgctctactggatccttgccctgccgcaccgcgtaaatgtcggcacaggttttgtgatgggtgccatactggatcttatcagtggctctacgcttggcgtccgcgccttatccatgagcattattgcgtatctcgtcgcactcaaattccagctctttcgtaaccttgcgctctggcaacaggcgctggtggtgatgttgttgtcgctcgctgcggatatcgttgttttctgggcagagtttttagtgatcaacgtctctttccgaccggaagtgttctggagtagtgtagtaaacggtgtgctctggccgtggctgttcctgctgatgcgtaaaattcgccagcagtttgccgtgcaataa

SEQ ID NO: 2393 - DNA, 603 bp, Enterobacter cloacae
aaggtttctatgacgtctttgtatcttgcctccggttctccgcgtcgccaggaactgctcgcgcagttgggtgtctccttcgaacgcatcgttaccggtattgaagaaaaacgtgctgagggtgaaagcgctcagcagtatgtctctcgtctggcgcgtgaaaaagcgcaggcgggcgtggcatgcgtgccgcgtgacttaccggtgctgggtgcggataccattgtcattctcaatggtgaggtgcttgagaaaccccgcgacgcagaccatgcggcgcggatgctgcgtaacatgtccggacaaacccatcaggtgatgacggcggtagcgctggcagacagccagtacgttctggattgccttgtggtaacggaagtgacgttcagagtcctcaccgacgaggagatcgccggctatatcgccagcggtgaacctatggataaagcaggtgcatacggtattcaagggttgggtggctgttttgtcaggaagataaatggcagctatcacgccgtagtcggcttaccgctggtggaaacgtatgagttgctgagcaattttaactcactgcgtgagggaagggataattatgacggctga

SEQ ID NO: 2394 - DNA, 1446 bp, Enterobacter cloacae
atgagtctgaacctggtaagtgaacatttgctcgcagcgaacggcctgagccatcaggacctgttctccattcttggtcaactgaccgaacgccgcctcgactacggcgatctctatttccagtcgagctatcacgaatcctgggttttagaagacagcatcattaaagatggctcttacaacatcgaccagggcgtcggcgtgcgcgccgtcagcggggagaaaaccggttttgcttatgccgatcagattagcctcgccgcacttgagcagagcgcgcaggccgcgcgcaccattgtgcgtgataccggagatggtcgcgtgaaaacgctgggtgaagtgcagcacgctgcgctctataccagcatcgacccgctgcaaagcatgagccgcgaagagaagctcgacatcctgcgtcgcgtggacaaagtggctcgcgcggcggataaacgcgtgcaggaagtctctgccagcctgaccggtgtttatgaactgatcctggtggcggcgacggacggtaccctggcggcggatgttcgcccgctggtgcgtctctctatcagcgtgcaggttgaagacgacggcaagcgcgagcgcggctcaagcggtggcggcggtcgttttggctatgactggttcctcggcgacgttgacggcgaagcgcgcgcggatgcgtgggcaaaagaagccgtgcgcatggcgctggtcaacctgtctgccgtggcggcacctgccggtacgctgccggtggttctgggcgcaggctggcctggcgtgctgctgcacgaagcggtcggtcacggccttgagggtgatttcaaccgtcgcgggacgtccgtattcagcggtcagatggggcagcttgtctcctccgaactgtgtaccgtggtggatgatggcaccatgctcgaccgtcgcggctcgatttctatcgacgatgaaggcacgccgggccagtacaacgtgctgatcgaaaacggcgtactgaaaggctacatgcaggacaagcttaacgcgcgcctgatgggcgtagcgccaacgggtaacggtcgtcgcgaatcctatgcgcacctgccgatgccgcgcatgaccaacacctacatgttgccgggcaaatccacgccgcaggagattatcgaatccgttgattacgggatcttcgcgccaaactttggcggcggtcaggtggatatcacctccggcaaatttgtcttctctacctcagaggcgtatctgattgagaagggcaaagtgaccaaagcggtgaagggcgcaaccctgattggctccggcattgaggccatgcagcagatttccatggtgggtaacgatctgaagctggataacggcgtgggcgtttgcggcaaagagggccagagcctgcctgtgggcgtcggtcagcctacgctgaaagtagataatctgacggtgggcggcacggcgtaa

SEQ ID NO: 2395 - DNA, 231 bp, Enterobacter cloacae
cctgcactctctttaatcaaggtcaacatgagtctgtttcccgttatcgtggtgttcggtttgtcgttcccaccgatatttttcgagcttcttttatcactggcgatcttctggctggtgcgcaaggtgctggtccctaccgggatttatgatttcgtctggcatcctgcattgttcaataccgcgctgtattgctgcctgttctatttaatatcgcgcatgtttgtctga

SEQ ID NO: 2396 - DNA, 2031 bp, Enterobacter cloacae
tgccagccaggattcgatcttccgtcaaatcgcccatcgcctgcgcgagtttggttgatcgctatgggcattttttccatcgccagccagcacatccgcttcgccgtgaagctggcatgcgccattgtgctggcgctgtttgttggcttccatttccagcttgaaacgccgcgctgggccgttctgaccgccgcgatcgtcgccgccggtcctgccttcgcggcgggtggcgaaccttactccggggcaattcgctatcgcgggatgctgcgtattatcggcacctttatcggctgtatcgccgccctgaccattatcatcctgatgatccgcacgccgctgctgatgctgattgtatgctgtatctgggcgggtttttgcacctgggtctcttcgctggtgaaggtggagaactcgtacgcctggggtctggcgggatataccgcgctgattattatcatcaccattcagagtgaaccgctgcttgctccgcagttcgccgtggaacgttgcagcgagattgtcattggtatcgtctgcgcgattgtcgcagacctgctcttctctccgcgatccatcaagcaggaagtcgatcgtgagctggacgcgctgattgttgctcagtaccagctcatgcagctgtgcattaagcacggcgacagcgaagaggtcgacaaggcctggagtgcgctggtgcgccgcacgcaggcgctggaagggatgcgcagtaacctcaatatggagtcttcccgctgggagcgggccaaccgtcgtctgaaagcgatcaataccgtctcgttaacgctgatcacccaggcgtgtgaaacctacctgattcagaacacccgccccgaagtggtaacggatactttccgcgaactgtttgatgagcctgtggagacggtgcaggacgtgcatcgacagcttaaacgcatgcgtcgtgtgattgcgtggacaggagaacgggatacgccagtcaccatttatacctgggtaggcgccgcaacgcgctacctgctcctgaaacgcggcgtgattagcaacaccaaaatcagtgcggcggaagaagaggtgttacagggcgaagtggtgatcaaacctgaatccgccgagcgccatcatgcgatggttaacttctggcgtaccaccctggcctgtatactcggcacgctgttctggctgtggaccggctggacgtctggcagcggcgcgatggtgatgattgccgtcgtcaccgcgctggcgatgcgtctgcccaacccgcgcatggtcgcgatcgattttctgtacggcaccattgcggcgttacccattggcgcgctctacttcctggtgattattccctcgacgcagcaaagcatgcttttgctctgcatcagcctggcggtgatggcgttctttatcgggattgaggtacaaaaacgccgtctgggatcgttaggcgcactggcgagtacgattaacatcatcgtgctggataacccgatgaccttccatttcagtcagttcctggatagcgcactaggtcagctggtgggctgtttcctggcaatgatggtgatcctgctggtgcgggataactctcaggcgcggacagggcgcgtgctgctgaatcagtttgtatcggccgccgtatcgtccttgaccaccaacaccgcgcggcgcaaggagaaccacctgccggcgctctatcagcagctgttcctgttgctaaataaattcccgggcgatgtcgcccgcttccgcctggcgttaaccatgattatcgcgcaccagcgtctgcggaacgcgccagtgccgatcaacgacgatttgtccgccttccaccgccagctacggcgcacggcggaccatgtgatatcggcatccagtgatgacaaacgtcgccgctactttaagcaactgctggaggagctggatatctaccaggagaaactgcggatctgggaagcgccgccgcaggttaccgagccggtagagcggctggtgtttatgctgcaccgctaccagaatgcgctgacagacagctaa

SEQ ID NO: 2397 - DNA, 963 bp, Enterobacter cloacae
gttaaccataataaggagtttaggatgaaagtcgcagtcctcggcgctgctggtggtatcggccaggcgcttgccctactactgaaaacccaactgccttcaggctcagaactctccctgtacgatattgctccggtaaccccaggtgtggcggttgacctgagccacatcccgacagctgtgaaaatcaaaggcttctccggtgaagatgcgcgtcctgcgttgcagggtgccgacgtggtgctgatctccgcgggtgttgcacgtaaaccgggtatggatcgttcagacctgttcaacgtcaacgcgggcatcgtgaaaaacctggttcagcagatcgctgaaacctgcccgaaagcgtgcatcggtatcatcaccaacccggtgaacaccaccgttgccatcgcagcagaagtactgaagaaagcaggcgtttacgacaagaacaaactgttcggcgtaactacgctggatatcatccgctccaacaccttcgtggctgagctgaaaggcaagcagccaacggaagtggaagtgccggttatcggcggtcactctggcgtgaccatcctgcctctgctgtcgcagatcccgggcgtgagcttcaccgagcaggaagtggctgacctgactaaacgcattcagaacgcaggcaccgaagtggtggaagcgaaggcgggtggcggttctgcaaccctgtctatgggtcaggcggcggcacgtttcggcctgtctctggttcgcgcgttgcagggcgaaaaaggcgttgttgaatgcgcctatgttgaaggcgacggtgaacacgcgcgcttcttctctcagccgctgctgctgggtaaaaacggtgttgaagagcgtaagtctatcggcacgctgagcgcgtttgagcaaaacgcgatggaaggcatgctggatacgctgaagaaagacatcacgctgggcgaagagttcgttaacaagtga

SEQ ID NO: 2398 - DNA, 1020 bp, Enterobacter cloacae
cctatgaagccaatttttagccgtggcccgtcgctacagtttcgcctgatcctggcggttctggttgcgctcggggtcattattgccgatagccgcctcggtacgttcagccagatccgaacgtacatggataccgccgtcagtcctttctactttatttcaaatggtccccgtgaactgctcgactccgtgtcgcaaacgctctcatcgcgtgaccagctcgaactcgaaaaccgtgcgttacgccaggaactgctgctgaaaaacagcgagctgctgatgctggggcaatataagcaggaaaacgcacgcctgcgtgaactgcttggctcgccgctgcgccaggatgaacagaaaatggtcacccaggtgatctccaccgtaaacgatccgtacagcgatcaggtggtgattgataaaggcagcgtgaacggcgtatacgaaggtcagcctgtcatcagcgataaaggcgtcgtgggccaggttgtggcggttgccaaactgaccagccgcgtgctgctgatttgcgatgccacccatgcactgccgattcaggtgctgcgtaacgatattcgcgtgattgccgccggtaacggctgcacggacgatctgcaactggaacatctgcccgccaacacggatatccgcgtgggcgacgtgctagtgacgtccggtctgggcggtcgtttccctgagggctacccggttgcggttgtctcttccgtgaagctcgacactcagcgtgcctacaccgtgattcaggcgcgtccaacggccggcttgcagcgtttgcgctacctgctgctgctatggggcgccgatcgtaacggagctaacccgatgaccccggaagatgtgcatcgcgtggcgaatgaacgcctgatgcagatgatgccgcaggtactgcctgcgccggatgcgatgggaccacctgcacccgtaccggctccggcgacggggttaacgcagccgctgccggatgcgccgccaccgccgcaagtctcgggtggagggcagtag

SEQ ID NO: 2399 - DNA, 1506 bp, Enterobacter cloacae
gcaattttaactcactgcgtgagggaagggataattatgacggctgaattgttggtaaacgtaacgccatcggaaacccgtgtggcctacattgatggtggcattcttcaggaaattcatattgagcgtgaagcgcgacgcggaatcgtaggcaatatctacaaaggtcgtgtcagtcgtgtcctgccgggtatgcaggcggcttttgtagatattgggctcgataaggcggcgtttttacatgcctccgatatcatgccgcacaccgaatgtgtggcaggcgaagagcaaaagcagtttgccgtgcgcgacatctctgagctggtgcgtcagggccaggatctgatggtgcaggtggtaaaagatccgctgggcactaaaggcgcgcgtctgaccaccgacatcaccctgccttcacgctacctggtgtttatgccgggggcgtcgcacgtcggcgtgtcacagcgtattgagagcgaaagcgagcgtgagcgcctgaaaaaggtggtcagcgcctactgcgacgagcagggcgggtttattatccgtaccgcggcggaagggatcagcgaagaagatctcgcctcggatgcggcctacctgaagcgcgtctggaccaaagtgatggagcgtaaaaaacgcaaccagacccgctaccggctgtacggtgagctggcgctcgctcagcgcgtattacgtgatttcgccgacgcccagcttgaccgcatccgcgtggactcccgtctgacgtacgaagccttactggagttcaccgccgagtacatcccggaaatgccgggtctgctggagcattacaccggacgccagccgatatttgacctctatgacgttgaaaacgaaatccagcgtgcgctggagcgtaaggttgagctgaaatcgggtggctatctgatcatcgatcaaaccgaagcgatgaccaccgtcgatatcaacaccggcgcgtttgtcggccatcgcaacctcgatgacaccatcttcaacaccaacatcgaagcgacgcaggccatcgcgcgtcagcttcgcctgcgtaatctgggcggcattatcatcatcgactttatcgatatgaacaatgaagatcaccgccgtcgcgtgctgcactctctggagcaggcgctgagtaaggaccgcgtgaaaaccagcatcaatggcttctcgcagctcggtcttgtggaaatgacccggaaacggacccgcgaaagcgtggaacatgtcctgtgtaatgagtgtccaacctgccatggacgcggaacggtaaagacggtggagacggtctgctacgagatcatgcgtgaaattgtccgtgtccatcatgcctacgactcagaccgttttctggtctatgcttcccctgcggtggcggaggccctgaaaggggaagagtcgcacgcgctggcggaagtggaaatctttgtcggcaaacaggtaaaagtgcaaattgagccgctctataaccaggagcagtttgacgtcgtcatgatgtaa

SEQ ID NO: 2400 - DNA, 3849 bp, Enterobacter cloacae
acgcagttcgctgcgagatttaaggctgacaaggagagacgcgtgaggcgattgccggggattttactgcttacaggggcaacgctggtcgtgattgtcgcgttgctcgtgagcgggctgcgtctcgccttgccgcatctggacagctggcgtccgcagatcctggcaaaaatcgaatccgccaccggcctgccggtggacgtgagtcatatcgaggcaagctggcagaactttggcccgacgctagatgcgcgggatatccacgccagcctgaaagatggcggccacctcaaaatcaaacgcgtcaccctggcgctggatgtctggcaaagcctgctgcatctgcgctggcagtttcgcgatctcaccttctggcaacttcagctgatgactaacacgccgctgcaaagcggcgacagcgatcgagggctggaaaccagccgtatcagcgatctgttcctgcggcagttcgatcatttcgatctgcgcgacagcgaagtgagctttattactctttccggtcagcgcgctgagctggcgatccctcagctgacctggttaaacgggaaagatcgccaccgcgccgaggggcaggtgaatctctccagcctgaacgggcagcacggggttatgcaggtgcggatggatctgcgtgacgacaatggcctgctgaacaacggcagggtctggctacaggcggacgacgtggacgtgaagccgtggctcggtgagttgctacagcagaacatgcagctggagaccgcgcgcttcagcctggaaggctggatgacgctgacgaacggggcgttcgccagcggcgatatctggcttaagcaggggggcgcgagctggaaaggggaaaaccatcagcatcaactttccgtcgataacctcaccgcacacgtgacgcaggataaaggcggctggcagttcgctattccggatacgcgcatctccatggataacaaaccctggccgcgcggcgcgctgacgctggcgtggatgccggaacaggacgtcggcgggataaacggtaaacgcagcgacgagctgcgtatccgcgccagtaacctggatctgacggcgatcgaagggctgcgttcaatggccgcaaaactttcaccggagctgggcgaaatctggctggcgacgcagccgagcgggcagataaaccggctggcgctggatattccgctccaggctacggaaaagacgcgttttcaggcggcatggaaaaatctcgcatggaaacagtggaaattgctgccgggtgccgagcacttcagcggtaaactggaaggcagcgtggaaaacggcaggctgacggcagaaatgcaggacgcgaaaatgccgtacgaaacggtcttccgtgcgccactggagatcgaaaagggaaatgccactctcaactggctgaagaatgacaaaggttttcagctcgatggccgcgatattgatgtaaaagccaaagcggtacatgcccgcggtaatttccgttatctacagcctgaaggcgatgagccgtggctgggtattctggcgggcatcagcacggatgacggttcgcaggcgtggcgctacttcccggaaaacctgatggggaaagcgctggtggactatctcagcggcgctattcagggcggccaggcggataacgccacgctggtctacggcggcaacccgcacctgttcccgtataagcacaacgaaggccagttccaggttctggtgccgctacgcaacgccacctatgccttccagccagactggccggcgctgaagaatctggatattgaactcaacttcctgaatgacggcttgtggatgaagacggacagcgtcgcgctgggcggcgtaacggcaagcaacctgacggcaaacatcccggattattccaaagagaagctgctgattgatgcggatattaaggggccgggtaaagcggttggcccgtactttgaagatacgccgctgaatgactccctggcagccacccttcagcagttgcagttagatggcgatgtgaatgctcgcttacatctggatatcccgctggacggtgaattgaccaccgccaaaggcgacgttcgccttaataacaacagcctctatatcaagccgctggacagcaccctgaaaaacctcagcggtcagttcagctttgttaacggcacgctgaaaagtgagccgcttaaagcgacctggttcaatcaacccgttaatatcgatttctccaccaccgagggcgataaagcctaccaggtggcggtcaatatggacgcgaactggcagccgtcacgcatggatgttctgccgaagccgattgagaatgcggtggacggtgcggtgtcatggaatggcaaggtcgccatcgacctgccttatcatgccggtgcgcgctataacgtcgacattacgggcgatctaaaaaacctcagcagccagcttcccgcgccgctgaataaaaaaagcggtgaagcattgcccgtcaacgttaaggttgcgggcaaccttaacagcttcgatttaaccggaaacgcgggcggaacaaaccacttcaacagccgctggctgcttaaccgcaagctgacgctggacagggcgatctggacgacggacagccgtaccacgccgccgctgccggagcaggcgggcgttgaactgaatctcccgtcgatggatggcgcagagtggctggcactgttccagaaaggtgtcgggcaaaacgtcgaccaaacggcgcagttcccgcagtccattactttgcgcacgcctgcgctgacgctgggcggacagcagtggaacaacctgagtattgtctcccggccgacggtaaacggctcaaaggtcgaggcgcaggggcgtgagatcaacggttcgttgatcatgcgcgatcacgcgccatggcaggcggctatccgttatctctattacaatccgacctttacggcgtctaaagcagagtcgacaagcacttctcctgtcagtggcagtgggacgtcgcgcgtggatttcagcggctggcccgatctccagctgcgctgcgcggagtgctggctgtggggacagaaatatggccgtatcgacggtgattttgccattcagggaaatacgctgagcctctctggtgggctggtggataccggctttggccgcatgactgccgcgggcgaatgggtgaacaaaccgggtgaacaacgcacctcgctgaaaggcgatattaaaggcaataagctggacgccgcggctaacttcttcggcattagcacgccgcttcgcggatcgtccttcgatgtgaattacgatctgcactggcgcgctgcgccgtggacacccgatgaagcttcgcttaacggcatcctgaaaaccaacttcggtaagggtgagattgccgacgtgagcacggggcgcgccgggcagatcctgcgcctgctgagttttgatgcgctgctgcgcaagctgcgcttcgatttcagcgacaccttcagcgaaggtttctactacgattccattcgcagtacggcgtggatcaaagacggcgttctgcatacggacgatacgctggtggatggcctggaagcggatatcgccatgaaaggctcggtcaacctcgtgcgtcgcgaactggatatggaagccgtggtggcgccggaaatatccgcaagcgtgggcgttgcggcggcctttgtggtgaacccgattgtcggtgcggcggtgtttgccgccagtaaagtgctggggccgctgtggagcaaggtctctattctgcgctatcgcattaccggtccggtcgataaaccgcagattaacgaggtgctgcgccagccgcgcaaagaagcaccgcaatga

SEQ ID NO: 2401 - DNA, 960 bp, Enterobacter cloacae
tatcgcgcatgtttgtctgaggttgatgtgaaaacgctaacaagaaaaatctcccgcactgccatcactatggcgctggtcatcctggcgttcatcgctatttttcgcgcctgggtttattacaccgaatccccgtggacgcgcgatgcgcgtttcagcgcggaggtggtcgcgatagcgcccgatgtcgccggtctcattacggcagtcaacgtccacgataaccaactggtgaaaaaagatcaggtgctgttcaccatcgaccagccgcgctatcaaaaagcgctggaagaagcggaagccgacgtggcgtattacaacgcgctggcctctgaaaaacgccgtgaagcaggacgccgtaacaagctgggcatccaggccatgtcccgggaagagattgaccagtccaataacgtgctgcaaaccgtgctgcatcagctggcaaaagcgcaggcgacgcgcgatctggcgaagctcgatctggaacgtaccgttatccgcgccccgtccgatggctgggtgaccaacctcaatgtctatgcgggcgagtttatcacgcgcggctctacggccgtggcgctggtgaaacagaactctttctacgtcctcgcctatatggaagagaccaagctggaaggcgtgcgtccgggctatcgcgccgaaatcacgccgctcggcagcaaccgggtcctgaagggaaccgtggacagcgtggccgcgggggtgaccaactccagcagtaccaatgattcaaaagggatggcgaccgtcgattctaacctcgagtgggttcgtctggcgcagcgcgtaccggtacgcattcgtctggatgagcagcagagcaacctctggcccgcaggcaccacggcgacggtggtgatcacgggtgaaaaagaccgtgatgccagccaggattcgatcttccgtcaaatcgcccatcgcctgcgcgagtttggttga

SEQ ID NO: 2402 - DNA, 1983 bp, Enterobacter cloacae
tgctcacttgcccccccttcaacccacggagtaatctcaaggatgcgattaacgacgaagttctcagcttttattaccttgctgacggggctgaccatatttgtcacgctaatcggctgctcgctgagcttttacaatgccatccaggataagctggttaaccgggttgaatcggttgcatcggttatcgacactcgcctgataacgtcctccttcccggcgctttcgcgtgagctggatgagttaatggtgcctgtggatatagtgcagatcgacattaaacaggggaagcagaccgttttcagccatacccgccagggcagctatcgtcctgccggcacggtagatcagtatcgggacgtcacggttaattcacttaaacatccgggtatgacaattcatctgatgtaccaggatccgatgagcaactatttacgctcgcttatgaccaccgcgcccttaaccatcgcagttgcctttatcgtactgctgattttcctcgccgttcgctggcagcgtcgtcaactttccggccaggaactgctggaaacacgctccgtgcggatactgaatggcgagcggggtccgcaggtgcggggatcggtttatgaatggccatcacgcaccagtagcgccctggacgtgctgctctccgaaatccagtttgccagcgatcagcgtagccgtatggacacgttgattcgctcttatgccgcgcaggataacaaaacgggcctcaacaaccgtctcttctttgataatcagctggctacgcttcttgatgaccccgaaaaggtgggtacgcatggcgtggtaatgatgattcgcctgcccgactttgatctgctccgtgatacctggggtcagcgcgtggcggaagagaacctctttacgctgattaacctgctgtccacctttattatgcgctaccccggcgcgttactggcacgctaccaccgcagcgattttgccgtcttgctgccgcatcgcaccttaaaggaatccgagagtatcgccagtcagctgctgaaagccgtcgatgcgctgccccagagcaaaatgctcgacagagacgacatggtgcatataggcatctgtgcctggcgcggcggtcagtcgacggagcaggtgatggaacatgcggaagcggcaacgcgtaacgccgtattgcagggggcgaacggctgggcggtctatgatgatacgctgccggagaaagggcgcggcaacgtgcgctggcgaaccctgattgaacagatgctgagccggggcggaccgcgcatctatcaaaaaccggcggtcatgaagagtggtcatgtccatcatcgtgagctgatgtgccgtatttttgatggcaccgaagaggttatctccgcagaatatctgcccatggtgttgcaattcggattgtccgaagagtatgaccgtcagcaaatcacccgcctcattccgtttttatcgtactggcctgaagaaaatctggctttacaggtgaccgtcgaatcgctgatccgtccgcgcttccagcgctggttacgtgacacgttaatgcaatgcgaaaaatcgcaacgcaaacgcattatttttgaacttgcagaggcagatgtaggtcaacacatcagccggttgcgcccggtggtgcgtttaatcaatgcgcttggggctcgcgtggcggtaacccaggcgggtctgacgctggtgagcaccagctggatcaaagagctggatgttgaattattgaagctgcatccgggtctggtaaggaatattgaaaaacgcacggaaaaccagctgctggtacaaagcctggtggaagcgtgcaaaggaacgcaaacgcaagtatttgccacaggcgtacgttcacgaagtgaatggcagatgttgacagagcgcggcgtgacgggcggtcagggggatttttttgccgcctctcagccgcttgacaccaatgtgaaaaaatatttgcaaagatactctgtttga

SEQ ID NO: 2403 - DNA, 1170 bp, Enterobacter cloacae
caaaggaaacgtgctgcactaattttcaccgtagcagacgatttttgcgccttgtcgctgctgcgtgtggttggtaaagtaagcggattttgttttccgccccagctttcaggattatcccttagtatgttgaaaaaatttcgtggcatgttttccaatgacctgtccattgacctgggtaccgcgaatacccttatttatgtaaaaggacaaggcatcgtattgaatgagccttccgttgtggccattcgtcaggatcgtgccggctcgccaaaaagcgtggccgcagtaggtcatgatgcgaagcagatgctgggccgtacgccgggcaacatcgccgcgatccgcccaatgaaagacggcgttattgctgacttcttcgtgaccgaaaaaatgcttcagcacttcatcaagcaggttcacagcaacagcttcatgcgcccaagcccgcgcgtgctggtgtgtgtgccggttggcgcgacccaggttgaacgccgtgcaatccgtgaatctgctcagggtgccggtgcgcgtgaagtcttcctgattgaagaaccgatggctgcggcaattggtgcgggtctgccggtttctgaagcaaccggttctatggtggtggatatcggtggcggtaccactgaagtggccgttatctccctgaacggcgtggtgtactcctcttccgtgcgtatcggcggcgaccgtttcgacgaagctatcatcaattacgttcgccgtaactacggctctctgatcggtgaagcgaccgcagagcgcatcaagcacgaaatcggttctgcctacccgggtgatgaagtgcgcgagatcgaagttcgcggtcgtaacctggcggaaggcgtgccacgcggattcaccctgaactccaacgaaatcctggaagcgttgcaggagccactgaccggtatcgtgagcgcggtgatggttgcgctggaacagtgcccgccagagctagcctccgatatctccgagcgcggtatggttctgaccggtggtggtgcgctgctgcgtaacctcgaccgcctgttaatggaagagacaggtattcctgtcgtagttgcagaagatccactgacttgcgtcgcccgtggtggtggcaaggcgttggaaatgatcgacatgcacggcggcgacttgtttagcgaagagtag

SEQ ID NO: 2404 - DNA, 1674 bp, Enterobacter cloacae
gcaactgctggaggagctggatatctaccaggagaaactgcggatctgggaagcgccgccgcaggttaccgagccggtagagcggctggtgtttatgctgcaccgctaccagaatgcgctgacagacagctaacgaagagaaaaccgacgccaaaagcgtcggtttttttgtggctatacttattcttgcaggttcaaacattcaggaagggaggacacatgacaacccaggctcttcaggacagtattctttttcagaccgggtatctggtcaacggtatctggaaaacactcgacaccacgtttgatgtgctaaacccggccacgggcgaggtcattgcgaaagtggcgaaagcaggaaaagccgaaaccgaagaggccattgtggccgcgacgaaggcctttcccgcatggcgcgcaaaaacggcaaaagagcgttccgcgatcctctatcgctggtatgaactgattatcgagaacaaaagctggctcgggcggctgatgactaccgagcagggcaagccgctgaaagaggctgaaggtgaggtggactacgctgccagcttcattcagtggtttgccgagcaggccaagcgcgccaacggtgaaatcattcctccggttaaacctggctcccgtattctggccactcgtgaacctgtcggggtggttgctgctatcacgccatggaatttcccgatggctatgctcacccgtaagctcggcccggcgctggcagcaggatgtaccggcgtgatcaaacctgcaaacaacacgccgctgagcgcctttgcgctgctgacgctggcgaagcaggccggtgtgccggatggtgtgctgaatgcggtcgcggggagcacctcagaaattagcgacgccattatggccagccatgacgtgcgcaaaatctcgtttacgggttcaaccgccgtcgggaaaacgctggttcgcaattccgcagagaccatgaaaaaggtatcgatggagctgggcggtaatgcgccgtatatcgttttcgaggacgcggatattgatgccgccgtcaaaggcgcgatcgccaataagttccgtaacgccgggcaggtctgcgtcagcgtaaaccgtttctatattcaggagacggtctatgacaagttcgtcaatcaacttgccgatgcggtgaaggcgctgaaggtgggtaacggtctggacgagggcgtcgttgtcggcccgctgattgagccttcggctgtcgagaaagtgcgtgagcacgtcgaagatgcggtagcgaagggcgccacggtgctggctgggggtaaaccgcacgaacttggcggcaacttctggatgccaaccgtactcggtgactgccatgaaggcatgaagctggcagaagaggagacctttggtcccgtagccgcctgcttccgcttcacgtcggaagacgaagtggttatgcgcgctaacaatacgccttacgggctggcggcctacttttatacccagaatctttcgcgcgtgttccgcgtctcacaggccattgagagcggcatgatcggaattaatgaatgtgcggtctcgaccgaactgggtccgtttgggggcgtaaaagagtccgggctgggccgcgaggggtccgtgctggggctggaggagtttctggaagttaaaaccctgcatatcgggggattataa

SEQ ID NO: 2405 - DNA, 315 bp, Enterobacter cloacae
acagggcggcatttgccgcccgcctgtaccgggtggctggcaatgaaaatttatacctttgattttgacgaaattgagagtcaggaagacttctatcgcgagtttattcgggcgttcgacctggagcggggcagcgtaagcaatcttgatatgctgtgggatgtggttaccggcgacaggctgccgttaccgctggaaatcgaatttacccatctgcctgaaaaactgcgcagacgctttggcgcattgattttattgtttgatgaagcggaggaggagctggaagggcaactgcgtttcaacgtgcgccagtga

SEQ ID NO: 2406 - DNA, 1125 bp, Enterobacter cloacae
tgtccggataactcatgttatgctgcaaaccgttccttttttaacgacacacgcatcatgcttttaaagctctttcgttcaattgtcattggtttgatcgttgccggtctgctgctggtggctatgccatctttacgccagttcaacaaactgtcggctcctcagttcgacagcacggatgaaacgcctgcgacgtacaatcaggcggtacgccgtgccgcccccgccgtggttaacgtctataaccgcgggcttaacagttctgctcataaccagctggagatccgcacgctcggttccggtgtgatcatggatgaccggggctacatcatcaccaataaacacgtcattaacgatgccgaccagattatcgtcgccttgcaggatggccgcgtgtttgaagccctgctggtggggtcggacagcctgaccgatctggcggtgctgaagatcaacgccaccggcggtctgccgactatcccgattaatcgcaaacgaacgccgcatatcggcgatgtggtactggcgatcggtaacccgtacaacctgggccagaccatcactcaggggatcatcagcgcgaccggtcgaatcggcctgaacccgtcagggcggcagaacttcctgcaaaccgatgcctctatcaaccacggtaactccggcggtgcgctggtgaactctctgggcgaactgatgggcattaacaccctctccttcgacaagagcaacgacggcgaaacaccggaagggattggctttgccattccattccagctggcgaccaagatcatggacaagctgatccgcgatggccgcgtgatccgtggctacatcggtattggtgggcgtgaaatcgcaccgatgcatacgcagggcggtggtatcgatcagatccaggggattgtggtcaacgaagtggcgcctggcggcccggcggccaatgcaggtatccaggtgaacgacgttatcctttccgtcaacggtacgccagcggtctctgcgctggaaaccatggaccaggtggctgagattcgcccgggctccatcatccctgttgaagtcatgcgtaatgacaagaagctgacgatccaggtcaccatccaggaatacccggccactaactga

SEQ ID NO: 2407 - DNA, 1062 bp, Enterobacter cloacae
catattcgcgctaaccctcctcctccgtcatgcttagaaaaacgcctgacggaggatgccatgaaaacccgaaaactgacggaagccgacgtaacgtctgaatctgtctttatgctacagcgccgccagatcctgaaaatgcttggcatcagcgccactgccctgacgctcacccctgcggcccatgccgatctgctcgactggtttaagggcaacgatcgcccgaaagccccctccggcgcaccgcttgacttcaccaaaccggcacagtggcagaataaactgacgctgacgccggaagataaagtcaccggctataacaacttctatgagtttggtcttgataaggccgatcctgccgccaacgccgggagcatgaaaaccgatccctggacgctgaagatagatggcgaggtggcaaaaccggtgacgctggatcatcatgacctcaccacccgcttcccccttgaagaacgcatttaccgtatgcgctgtgtggaagcctggtcgatggtggtgccgtgggtaggtttccctttgcataaactgctggcgctggttgagcccaccagcaacgcgaagtatgtttctttccagacgcggtatgctccggacgagatgccaggccagaaggatcggtttatcggcggcgggctggagtatccctacgttgaaggtttacgtctcgacgaagccatgcatccgcttacgctgctcaccgtcggggtttatggcaaagcgctgccgccgcaaaacggggcgcccattcgcctgaccgtaccgtggaaatatggtttcaagggcatcaaatcgatcgtcagcattaagctcacccgtgaacgcccccccaccacctggaacctggcagcgcctgacgagtatggtttttttgccaacgttaacccgcacgttgaccatccgcgctggtcgcaggcaacagaacgttttatcggttccggcggcgcgctggatgttaaacgccagccaacgctgctgtttaacggctatgcggatgaggtggcatccctctaccgtggtctgaacttacgggagaacttctaa

SEQ ID NO: 2408 - DNA, 243 bp, Enterobacter cloacae
gtgcgtttaacggcaaagcagataacctggctgaaggtactcctgcatttagccggattgctcccctttatctggctcttctgggcagccagccagggacagttcagtgccgatccggcgaaagatattcagcattttacgggtcggatggctctgaaatttttgctggcgaccttgctcgtctcaccgttggcgcgctacgctaaacagccagttttcaccagggatggcgatcacgtcaag

SEQ ID NO: 2409 - DNA, 1425 bp, Enterobacter cloacae
catcaagatgtttttggggccgttctttttcattccaggatacgagagtcagcatcgatgaagaaaaaaaaccagctgttgagcgccttagcgttaagtgtcgggttatctctctcggcgtccttccccgccagtgcggcactgccttcgcaggtgcctggacaagaagccattcccagccttgcgccgatgcttgaaaaagtcctgcctgcggtagtcagcgttcaggtggaagggacggcacgccaaagccagcgtattcccgaagagctgaagaaatattttggcgaagacgcgccggatcagcaggctcagccgtttgaaggtctgggctcaggggtgattatcgacgcggctaagggctatatcctgaccaataaccacgtgatcagccaggccgataaaatcagcgttcagctgaacgatggccgggagtttgacgccaaactgatcggcggtgacgatcagagtgatatcgccctgctacaggtacaaaaccccagcaacctgacccagatcgccattgctgattccgataagctgcgcgtcggtgattttgctgtcgcggtcggtaacccgttcggcttaggccagaccgccacctccggaattgtctccgccctggggcgcagcggcctgaatctcgaaggcctggaaaatttcatccagaccgatgcctccatcaaccggggcaactccggcggtgcgctgcttaatctgaacggtgagctgatcggcatcaacaccgctatcctcgcgccaggcggcggcagcatcgggattggttttgccattccgagcaacatggcgaaaactctgtctcaacagctgattcagtttggcgaggttaagcgcggtctgctgggcatcaaaggcatggagatgagcgccgatatcgccaaagcctttaagctcaacgtccagcgcggggcgtttgtcagcgaagtgttgcccaactcaggctctgcgaaagcgggcgtgaaatccggtgacgttattgtcagcctgaacgataaaccgctgagcagcttcgctgaattacgttcgcgtattgccaccacggagcctggcgctaaagtgaagctgggcctgatccgcgagggcaaaccgctgaccgtggaagtgacgctggacaagagcacctcctcttccgccagcgcagaacagatctccccggctctacagggcgctacgctgagcgatggtcagcttaaaaacggcacgaaaggcatttctgtcactaccgttgagaagagcagcccggccgcgcaggcaggtttgcatcaggacgacgtgatcgtgggcgtgaaccgtactagcgtgcagtctattgccgaaatgcgtaaggtgctggagagtaaaccggcggtcattgccctgcaaattatccgtggcaacgataccctctacattttactgcgttaa

SEQ ID NO: 2410 - DNA, 219 bp, Enterobacter cloacae
cttatgcgaagctcgtctaagcaagaagaattagtgaaggcgtttaaagcgctactcaaagaagagaaattcagttctcaggggagaaattgttcaggcgttgcaggaacaaggcttcgacaacatcaaccagtcgaaggtctctcgcatgttaaccaagtttggagcggtgcgtacgcgcaacgccaaaatggaaatggtttattgcctgcctgctga

SEQ ID NO: 2411 - DNA, 984 bp, Enterobacter cloacae
ggaccctgtatgcaggctttgatcttagaacagcaggacggcaaaaccgttgcctcggtgcaagccattgaggagaaccgcctgccggagggcgacgtgaccgtagatatcgactggtccagcctgaactataaggatgcactggcgattacgggaaaaggtaaaatcatccgaaatttcccgatggtgccaggaatcgactttgcaggccgcgtgcataccagtgaagatccgcgttttcacgccggacagcaggtgctgctcaccggctggggcgtaggtgaaaaccactggggcggactggcagcacaggcgcgcgtcaaaggtgactggctggtcccgatgccgaaaggcctggacggtcgtaaggcgatgatcatcggcacggcaggcttcaccgccatgctgtgcgtgatggcgctggaagaggccgggattcgtcctgactcgggcgaaattgtcgtcaccggcgccagcggcggcgtgggcagcacggccgtcacgctgctgcacaagctggggtatcaggtcgccgccgtctctggccgcgaaagtacgcatgattatctacgtcagctgggcgcaagccgtattctgagccgcgacgaattcgccgagacccgcccgctggaaaaacaggtctgggctggcgcagtagataccgtcggcgacaacgtgctggcgaaggtgctggcgcaaatgaattacggcggctgcgtggcggcctgtggtctggcgggtggttttgccctgccgacgacggtgatgccatttattctgcgtaacgtgcgtcttcagggtgtcgattcggtcatgagcccagccgagcggcgggctgaggcctgggaacgtctggtgcaggatctgccagcctcattctatgagcagagcgccactgagatcaccctgagccaggcgccagagttcgccaataaaatcatggacaaccagttccacggtcgtgcgctggttaaaatcgcctaa

SEQ ID NO: 2412 - DNA, 474 bp, Enterobacter cloacae
gaaacatcaccttccagccctcgccgtgtaaaacaaccaacacccggcggaacaacaagacaacgggagaagttcatgacctgggaatatgcgctaatcggtttagtcgtcggcatcatcattggtgctgtggccatgcgtttcggtaaccgcaaattgcgtcagcagcagtcactgcaatacgaactggaaaagaacaaagccgaactggaagaatatcgcgaagagctggtcagccactttgcccgtagcgctgagctgctggacaacatggcgacagattatcgccagctctaccagcacatggcgaaaagctccagcagcctgctgccggaaatgaccgcggagaccaaccccttccgcaatcgtctggctgattctgaagccggtaacgatcaggcaccggttcagatgccacgcgactattcagacggcgcgtccggcctgctgcgcggtggcgtaaaacgcgattaa

SEQ ID NO: 2413 - DNA, 438 bp, Enterobacter cloacae
aggcgtttaaagcgctactcaaagaagagaaattcagttctcaggggagaaattgttcaggcgttgcaggaacaaggcttcgacaacatcaaccagtcgaaggtctctcgcatgttaaccaagtttggagcggtgcgtacgcgcaacgccaaaatggaaatggtttattgcctgcctgctgaacttggcgtgccaacgacctccagcccgctgaaaaacctggttctggacatcgactataacgatgccgtggtcgtgatccacaccagcccgggcgcagcccagctgattgcccgcctgctggactcgctgggtaaagcagaggggatcctcggaaccatcgccggtgatgacaccatttttaccaccccggcaaatggtttctcggtgaaagacctctacgaagcgattctggtcctgttcgaacaggagctgtaa

SEQ ID NO: 2414 - DNA, 270 bp, Enterobacter cloacae
ataatcatgaaaattaaaaccactgtagctaccctgagcgtactgtcagtcctgtcattcggtgcgtttgcagccgacaccattaatgccgaacaggcacaatcccgtcaggctatcgggactgtttctgttggtgccatcggtacgtctccgatggacatgcacgaaatgctgaacaaaaaagcggaagaacagggtgcgtcatcttatcgcatcatcgaagcgcgcagtggcgaccactggcacgctaccgcagaactgtacaaataa

SEQ ID NO: 2415 - DNA, 537 bp, Enterobacter cloacae
aaacggtttacgctgacgcagacctgcccggcgttacggaacttattggcgatcgcgcctttgacggcggcatcaatatccgcgtcctcgaaaacgatatacggcgcattaccgcccagctccatcgatacctttttcatggtctctgcggaattgcgaaccagcgttttcccgacggcggttgaacccgtaaacgagattttgcgcacgtcatggctggccataatggcgtcgctaatttctgaggtgctccccgcgaccgcattcagcacaccatccggcacaccggcctgcttcgccagcgtcagcagcgcaaaggcgctcagcggcgtgttgtttgcaggtttgatcacgccggtacatcctgctgccagcgccgggccgagcttacgggtgagcatagccatcgggaaattccatggcgtgatagcagcaaccaccccgacaggttcacgagtggccagaatacgggagccaggtttaaccggaggaatgatttcaccgttggcgcgcttggcctgctcggcaaaccactga

SEQ ID NO: 2416 - DNA, 930 bp, Enterobacter cloacae
ataatggaacgtctaaaacgcatgtccgtctttgcgaaagtggttgagcaaggctcttttaccgccgcagcacgtcagctacaaatgagcgtctcatccattagccagacagtgtcaaaactggaagatgagcttcaggtgaagctgctcaaccgcagcacccgcagcatcgggctgacggaagcgggtaaaatttactatcagggctgccgtcgaatgctgcatgaagtgcaggacgttcacgagcaactctatgcctttaacaacacgcctatcggcacgctgcgtatcgggtgttcttcaactatggcacaaaatgttctcgctgccatgacggcggaaatgctgaaagagtatcccggtttaaccgttaatctggttacgggcattccggcaccggacctgattgccgatgggttagacgtggtgatccgcgttggcgcgttgcaggactctagcctgttctcgcgtcgactgggcagcatgccgatggtggtctgcgcttcgaaaagctacctggcacagtatggcgtgccggagaaacctgccgatctgagcaaccactcgtggctggaatacagcgttcggccagataacgaatttgaactgatcgcgccggaagggctttccactaaactgctgcctgaaggccgcttcgtcaccaacgatccgatgaccatctcacgctggctggtggccggggccgggatcgcctacgtaccgctgatgtgggtgatcaacgagatcaacagcggcgtgctggagatcctcttcccgcgctaccagtccgatccgcgtccggtgtacgcgctctatacggaaaaggacaagctgccgctgaaggtgcaggtctgtattaactatctgacggactattttgtggaagtggcggagctgtttcagggcatgcggggcagaaggaaagagtag

SEQ ID NO: 2417 - DNA, 1731 bp, Enterobacter cloacae
atagatgataattattgttccgggtttttcatgcgccagcttaaccgtcttaaccagtatcagcgtctgtggcacccgtctgccggcgcaccgcagcaggtgaccatcagtgaacttgccagccgctgcttttgcagcgagcgacatgttcgcaccctgctgcgccaggcgcaggaggcgggctggctaagctggcacgcccgctccggacgaggtaagcgtggggaattacgctttcacgtcaccccggattcgttgcgtaatacgatgatggaagaggccctgaaaagtggacagcagcacaacgcgctggagctggcccagctcgcacctgaagatttgcgatcgctgctgcatccgtttatgggcggacagtggcagaacgatacgccgacgctgcgtattccctactatcgctcgctggagccgcttcagccggggtttctccctggccgggcggagcagcatctggcgggacaggtattctctggtttaacgcgttttaatggtaacagcagtgaacccacgggcgatctggcgcatcactgggaagtctctgctgacggcctgcgctggcatttctacattcgctccaccctgcactggcataacggcgataaaatagagacggcacagctccggcaaagcctgacggcgctgttatcgcagcccggcatgggcacgctgttccgcagcgtcttacgtatcgaaaccacgcacccgcagtgcctgacgtttattctccatcaacctgactactggctggcgcacaggctggcaacctactgtagccgtctggcgcatcccgattaccccgtggtgggcagcggtccctttcggctgagcgtttttgagcctgaactggtgcgtctggaaagccacgagcagtatcatcttggccatccgttgcttaaggctatcgagtactggatcacgccccagctttttgactacagtctgggcaccagctgtcgccacccggtgcaaatcgccattggcgaggccgacgagctggccagcctgcggctggtgagtaacagcaccagtctgggcttctgctacctcacgctgaaacagagtccacgtctgagcgaacttcaggcaaagcggctgattaatatcattcatctctcaacgctgctgcacacccttcccctgaacgaagggctcatcactcctaccgaggaactgcttcccggctgggcgatcccccagtggcctgatttaaccgacgttgcgctgccagaggcattgacgctggtctaccacctgccggttgagcttcacaccatggccagccagttaaaagcataccttacgcggcagggttgtgaactgaccgtcatctttcatgacgccaaaacgtgggacgggtgccagcagcttgccgatgcagacatcatgatgggagacagactgattggcgaagcgccggcgtacacgcttgagcagtggctccgctgcgatgcgctctggccgcatctgctgagcgcaccggcattcgcccatttgcaggccacgctggatgcggtgcagtcgcaggccgacgagcgtgaccgacacgcaggacttcaggctatattcagccggttaatggagacagccgtcctgacgccgctctttaactaccagtatcaaatcagcgcgcctccgggcgtcaacggcatacgccttaacactcgcggctggtttgacttcaccgaagcctggcttcctccaccaaacgcgtga

SEQ ID NO: 2418 - DNA, 699 bp, Enterobacter cloacae
tctatgaaacgtgccgtcgtcgtgttcagcggaggacaagattccaccacctgcctgattcaggcgcttcaccagtatgatgaagtgcactgcgtcacttttgattatggtcagcgtcatcgcgctgaaatcgatgtcgctcgtgaactggctctcaaactgggcgcccgcgctcataaagtgctggacgtgacgctgttaaatgaactggccgtcagcagcctcacccgcgacagcattccggtgcctgattacgaacctgatgccagcggcattccgaacaccttcgtaccgggccgcaacattctcttcctgaccctgacggcaatatacgcttatcaggtgaaggccgaagcggtgatcacgggcgtgtgcgaaaccgacttctctggctacccggactgccgggatgaattcgtgaaagcactcaatcacgccgtcgatctgggaatggcaaaagagacccgcttcgaaacgccgctgatgtggctggataaggctgaaacctgggcgctggccgactactggggcaagctggatgtcgttcgcaacgagaccctgacctgctacaacggcattaaaggggacggctgtgggcagtgtgccgcctgtaacctgcgcgcgaacggtctgaatcattattttgcggataaagcgggcgttatggccgcaatgcagaaaaagaccgggctgaaataa

SEQ ID NO: 2419 - DNA, 1107 bp, Enterobacter cloacae
caacaattttttctgtgcttttcgctatgctgggcacaaaatgacaaacggataactacgatgaatagcacctgggttaaacatgccatcagcgaaataaatgccgactatcagcgctcggcagacacccacttaatacgcctgcctctgcctggatttcccggtattcagctctatctgaaagatgaaagtacccatcctaccggtagcctgaagcatcgcctggcgcgttcactctttttatacggtttatgtaacggctggattaaagaaggcaccacgattattgaatcgtcgtccggatcaactgccgtctccgaagcctactttgcccgcctgttgggtctgccgtttatcgccgtgatgccctcatgcacggcgaaacgtaaagttgaacagatcgaattttacggcggacgctgccactttgtggacagtgcctgcgaaatctatgcggcctccgaaatgctggcccgcgaactgaatggtcactatatggaccaattcaccttcgccgagcgcgccaccgactggcgcggcaataataacattgcggacagcattttccgccagatgacccacgagccgcatcctcttccctcttacattgtcatgagcgcgggcacgggcggaacctccgccaccatcggacgttatatccgctgtcagggttatgatacgcagctgatggtggttgacccgcaaaactcggtgttcctcgattactggcaatcccgcgatgcgagcctgcgcagccccgtggggagcaagatcgaagggattggtcgcccgcgcgtcgaaccctcgttcattccggacgttgtggatgaaatgctccgcgtgccggatgccgccagcgtcgcgacggcgcactggctggagacacagcttggccgtaaagtcggggcttctaccggcaccaatatgtggggcgcgctacagctggccgcgaggatgcgtgaagaaggccgtaccggctctgtcgtcacgctgctgtgcgacagcggggagcgatacctggacacctattacaacgcagaatgggtgcaggccaatattggcgatgttgagccgtggaaagcgcagatttcgcagctggtgaaataa

SEQ ID NO: 2420 - DNA, 1566 bp, Enterobacter cloacae
aacagcatgcgaacccgacatctggtcagcctggtgacaggcgtactgatcttctctgtgctggtccctgtgtgcctcagtatctggctggcgcatcgtcaggctgaggagaaatttgtggacgcgctggacagctatgcctcgcgtgtcctgatccgtaccgacagagtcgttgcgcaagcaaaacaggcgctcacgcacctacagacattccacgccccgccctgcactcccccgcatttacgcgaaatgcgccgggtcgcgttctcatggcgctatatccaggaagtgatgtatatcgataacctgaaaccgctctgctcatcgcttgaacaatccagtgatacggcgatcttaccgcccccaatgcggatcaccgaaaatggttatagcgcgtggctcacctcgcaaaacgacctcggcattcagcgttatatggccgttctggggaaaggacattatctggtaatggtcgatccggcgtcgcttgtggatgttgttccgtttggtgaaatctcaatggatgccgccctggtgggcagctcaacccatcatatatttgccagaagcaatgttctcgacccgtatattctctctgtcgttaaggagcagcaggacgttacgcgcgtgcaatacaacggctcaatgtacgtgatgaaacctgtacccgaactggggtttacggtgatcgcgtgggcgtcgttaaaaccgctggcggcttcctggcaccagcaactgatcatctggctaccggctggcatactgctaagcctggttgctgcccttattgtcctgcgcatcctccgccgtttgctgtccccgcgtcaccgcctgatcgacgcgatcaacaaccgggagatcgaggttcactaccagcccatcgtggcgctgtgtagtggaaaactggtgggtgctgaagcgctgatgcgctggccccagccggagggcagtaacctgtcgcctaatctctttgttccgctggctgagcagacagggcttatttcaacgctgacgcggctagtggtaaatgaggtatttgaggatctaggcgcctggctgcaccatcacccggaactgcatatttctgtcaaccttgcgccatcggatttaacgtcccccgagctgcctcgccagctgagtcagttgctcaacaaatggggcgtccacccgcgccagatcgcccttgaattaaccgagcgcgggtttgccgatcctgccgtcagcgtacctgctatcgctgcatttcgccgcgccgggcacgctatctacattgatgattttggcacgggttactccagcctgagctatttgcaggatctggatgtcgatactctgaagattgataaatcctttgtggatgcgctggagtacaagcacgtgactccccacatcatcgaaatggccaaatcgcttaaactggcgatggtcgcagaaggcattgaaactgaagggcagatcgaatggttgcatcgccacggcgtgcagtacggccagggctggtatttcagcaaggcgctgcctaaagaggatttcattctctgggccgcgcacaacctcaggaaataa

SEQ ID NO: 2421 - DNA, 1539 bp, Enterobacter cloacae
accgacataaagttgtaccagacgacgtaccattttctcttctccgaagtaccaggttccatcttcggtgaaaatggcactatgattaatgtccagttttcaaatagtggactgcacatgtcatcacgtcgttttggaagccagtctctggtacgcctgttagggcactggcagcaagcctcttcccgtaccccgctgtggcgccagctggctgacgcgttacgcctgttgattctggatggcaggctggcgctaaacacgcgcctgcccggagagcgagagctggccaccgcactgagcgtaagccgcaccaccatcagcagcgcgctggcgcatctgcgggaagaaggttatctggagagccgtcacggcagcggttcgcgggcgatcctgccagacagccgcgccgtgcccacgctttccacagccagtgcggcgctggatctctcaaccgccgcgctcaacgcggggccagagatccaccaggcctacgcccacgcgctaacggccatcacgccgaatctggcgctgaccgggtacgatcagcttgggcttccggcgctgcgtgaagctatcgccgcccgctacaccgcacgcggtctgcccacccgggcagacgaagtgatggtggtgaacggcgccgtcagcggctttgccctgatcttaagaatgatgaccggtcccggggatcgcgtggtggtggatcatcccacttacccgctggcaatagccgccattcagggagcgctatgccggcccgtgggcgtctcgctgcctgaaacgggttgggataccgacggttttgccgcaacgctcgcccagaccgccccgcgtctggcctatctgatgccggattttcataatccgaccgggcgttgcatggatgccgcgacgcgccagaccataaccgacatcgccgcgcaaacccgcaccacgctggtggtggatgaaaccatggtcgatctctggttcgatgctcccccgccgccgccgctggccgcctttaacccggaggccgcggtgatgacgctgggttccgcaggcaaaagtttctggggtgggctgcgtctcggctggatccgcgcctcgtcccgcactatcgccacgctcgcgcagacgcgcgacacgctggatctgggttctccggtgctggaacaactggccacgctgtggcttatcgaaaacagtgaaaccttcctgcctgcccggcgggaaatgctggcagaacgtcgcgaccgctgcggccagatgctgcgggaacatttccccgaatggcggtttcaggaagcggagggagggctctcatactggattgaattacccggcatgctggcgacgcagctggcggcacgcgccgagacgacaggcatcattatgggcaccggcacgcgctttgggctttcaggcgcgtttgaccgctatctgcgaatgcccttctcactcagtccgccggaacttgaagaggcattattgcggatcaaaccgctgtggcgtgcgttaaataaaagtgtagcgccagtaaaacggagcctggtgtaa

SEQ ID NO: 2422 - DNA, 330 bp, Enterobacter cloacae
tttcccgcaggagaaacaatggacgaacatgacactttcccacagcgagtgtggcaaatcgtggcttcgattccggaaggctgtgtcacgacctatggggaagtcgcccggctggcgggttctccgcgcgcggcgcgtcaggttggaggcgtgctgagaaggctaccggagggaagcacgttaccgtggcaccgggtcgtcaatcgccatggtgccatttccctcaccgggccagacttgcagcgccagcgtcaggcattactctcagaaggggtgcaggtgtccggggcaggacagattgatatgcagaagtatcgctgggagtactga

SEQ ID NO: 2423 - DNA, 942 bp, Enterobacter cloacae
gattattctacccatcggaccactatcgtttctgcgttatactcagcgtatctttcgccacggcgtttattgaggaccactatgagtcaggcactgaacaatctgctgacattgctgaacctggaaaaaatagaagaagggctttttcgcggacagagcgaagatttaggcttacgccaggtttttgggggccaggtcgtggggcaagcgctatatgccgctaaggagacagttccggcagaccgtctggtgcactcattccacagctactttttacgccccggtgacagcgctaaaccgattgtgtacgacgtggaagttctgcgtgacggccaaagcttcagcgcccgtcgcgtggcggccatccagcatgggaaacccatcttctacatgaccgcctccttccaggcgccagagccgggctatgaacatcaaaaaaagatgccgcctgccccgtcgccggacgatctgaaatcggaaaccgaaatagcccgcgcactcgcgcatctgttgccgccgcaggtaaaagagaagtttctgtgcgataaaccgctggagatccgcccggtcgaatttcataacccaatgaaggggcataccgctgagcccgcccgtcaggtgtggatccgcgccaacggcagcgtaccggcagacttgcgcgtgcatcagtatctgctgggttatgcgtcggatttcaacttcctgccggttgcgctacagccgcacggtgtgggcttcctcgaaaaagggatgcaggtagccacaattgaccattccatgtggttccaccgtccattcgatatgaatgaatggctgctttacagcgtggaaagtacctctgcgtccagcgcgcgcggttttgttcgcggggaattttacacccaggatggtgtgctggtggcttctaccgtgcaggaaggtgtgatgcgtaatcgcgggtga

SEQ ID NO: 2424 - DNA, 504 bp, Enterobacter cloacae
cgctgtaatcgcgtaatcacttgcactgcggcaaaaatttgccaggataaagaggtcataccagttatgacctctgaacctataacaacgaaaggctattgcgctatgcagacacaaatcaaagtccgtggttatcacctcgatgtttaccagcacgtcaataacgcccgctaccttgaatttcttgaagaggcgcgctgggacggcctggagaacagcgaaagcttcctgtggctaaccgcacacaacatcgcgtttgtggtcgtcaatatcaacattaactaccgccgcccggctgtgctgggggatgtgctcaccgtgaccagtgaggttcaacaactgaatggcaaaagtggtgtattgagccaggtcgttacgctggagccagaagggcagattgtggccgatgcgctgatcacctttgtctgtatcgatctcaaaacccagaaagcgttgccgctggaaggggagttgcgcgaaaagctggagctgatgatcgcgtaa

SEQ ID NO: 2425 - DNA, 363 bp, Enterobacter cloacae
attactggaaagatcatcaaaaggataaactccatgagcaaaagtgagcgaaaattctcaagtaccgtcagccatgatgaagctgtagtcaaaatgctgcgcgaaaatccttcttacgcgcaactctatctgcaaattgcactggatgaaatttacgaggaccaggggatcccagcctatttgattgccctcagacgcgttatcgaagcgcgcggcggtattggagagatttcagccaaagcggggctttcacgtcagcagctataccgtaccctgtccgaaaatggtaacccaacgctgactacactgatgaaaattacccgtgctgccggtgtaaaactgttcgacagcacggtcaggtag

SEQ ID NO: 2426 - DNA, 621 bp, Enterobacter cloacae
tcggcatttatttcgctgatggcatgtttaacccaggtgctattcatcgtagttatccgtttgtcattttgtgcccagcatagcgaaaagcacagaaaaaattgttgctatctgacctttaaaatagaatgtaaggagaataattttctcttcgaggtggctatgttagataaaattgaccgtaagctgctttctttgctgcaaagcgactgtaccctctctttgcaggcgctggcagatgccgttaatctgaccaccacaccgtgctggaagcgcctcaagaagctggaagatgatggcattctgctgggacgtgtggcgctgctggatcccgaaaaactggggcttggactgaccgccttcgtcctgataaaaacgcagcatcacagcagcgaatggtactgccgcttcgtcacgcaggtttccgacatgcccgaggtgctcggcttctggcgcatggcgggggaatacgactatctgatgcgcgttcaggtggcagatatgaagcgctacgatgatttttacaagcggctggtcaatagcgtaccgggcttgtccgatgtcacctccagcttcgccatggaacagattaaatacaccacagcgttacccattgaataa

SEQ ID NO: 2427 - DNA, 1785 bp, Enterobacter cloacae
cttcttaaaataccttcaggaaaagaccgcgtgcgattatttgcccaattaagctggtactttcgtcgggagtggcaacgctacctcggcgcagtggccctgcttattatcattgccattctgcaactgttcccccccaaagtggtgggctacgtcgtggatggcgttaccgaacaacattacaccgccgcacgggtgatgatgtgggtcggtacgctggtgctgacggccgtggtggtttacctgctgcgttatgtctggcgcgtgctgctgttcggtgcgtcctatcagcttgccgttgagctgcgcgaagacttttaccgtcagctgagccgccagcaccctgagttttatctgcgtcaccgtaccggggatctcatcgcccgcgccactaacgatgtagaccgcgtggtgtttgccgccggtgaaggggtgttaacgctggtggattccctggtgatgggctgtgcggtattgattgtgatgtctacgcaaattagctgggagctcacgctgctggcgctgctgccaatgccgctgatggcgctggcaattaaccgctacggcgagcagctccatgaacgctttaagctggcgcaggcggcgttctcgtcgctgaacgatcgcacccaggagagcatgaccagcatccgcatgatcaaagcgtttggtctggaagaccgccagtccgcgctgtttgccgccgacgccgccgataccggcgcgaaaaacatgcgcgtggcgcgtattgatgcccgtttcgatccgacaatttatattgcgattggtatggcgaacctgctggcggtgggcggcggcagctggatggtggtgcgaggcaccatgaccctcgggcagttaaccagctttgcgatgtaccttgggctgatgatctggccgatgctggcgctggcctggatgtttaatatcgttgaacgtgggagcgccgcttacagccgtatccgcgccatgctggcggaagtgccggtcgtgaacgatggcagcgagccggtaccggaaggtccgggtattctcaaggctgatatccgcgcctttatctacccgcaaacggaacatccggtgcttgagaacgtcagtttcacgctgcgtcctggtcagatgctgggcatctgcggcccgacgggctccggtaaaagcaccattctgtcactgattcagcgccattttgacgtgagcgaaggcgatatccgtttccacgacatccctctgccacgtctgctgctggatgactggcgcagccgcctggcggtcgtcagccagacgccgtttttgttttcagacaccattgccaacaatattgcgctcgggtgtccgacggcgacacaggaccagatcgagcacgtggcgcgtctggccagcgtccacgaggatattctgcgcctgccgcagggctacgacacggaagtgggtgagcggggcgttatgctctccggcggacaaaaacagcgtatctctattgcccgcgcgctactgctggacgctgagatcctgattctggatgatgcgctgtccgcggttgacgggcgtactgaacatcaaattctgcataaccttcgccagtggggagaggggcgcacggtcatcattagcgcgcaccgtctgtcggcgcttaccgaagccagtgaaattctggtgcttcagcacgggcatattgcccagcgtggtcagcatgagcagctcgccgggcagaccggctggtatcgggatatgtaccgctatcaacagcttgaagccgcgctggatgaggaggtggccgatgcgtaa

SEQ ID NO: 2428 - DNA, 582 bp, Enterobacter cloacae
aacgacatcggatgggatcgatcccgccggtgcattgatgataaggagacttcaatgaaactcgtgcctatgttaagcggtgttgcaatggcggtggcgttgtccgcctgtgcggataagagtgccgatgtagcggtaccaacggcgaccccaaacgggattaacaccctttcacagcaagctattcgacagcccaacgtgtccggtaccatctggatcaaacagaaagtcgctctgccgccggacgcggttttaacggtcacgttatccgatgcgtctctggcggatgcaccgtctaaagtccttgctcagcgtgcagttcgtacagagggtaaacaggcgccgttcagcttcgtgctgccgtacaacccgtctgacgtccagcctaacgcgcgtatcctcctgagcgcggcggtaacgatcaacgataagctggtctttatcaccgataccgtacaggaagcggtcaacaaaggcggcaccaaaatcgacctgaccctggtaccggtgcagcaaactgaagtgcctgttgcaacgcaaaccaatcagccgactctgcctacacccccaacacagatgtaa

SEQ ID NO: 2429 - DNA, 1122 bp, Enterobacter cloacae
  unsure (97)
  unsure (98)
  unsure (99)
  unsure (100)
  unsure (101)
  unsure (102)
  unsure (103)
  unsure (104)
  unsure (105)
  unsure (106)
  unsure (107)
  unsure (108)
  unsure (109)
  unsure (110)
  unsure (111)
  unsure (112)
  unsure (113)
  unsure (114)
  unsure (115)
  unsure (116)
  unsure (117)
  unsure (118)
  unsure (119)
  unsure (120)
  unsure (121)
  unsure (122)
  unsure (123)
  unsure (124)
  unsure (125)
  unsure (126)
  unsure (127)
  unsure (128)
  unsure (129)
  unsure (130)
  unsure (131)
  unsure (132)
  unsure (133)
  unsure (134)
  unsure (135)
  unsure (136)
  unsure (137)
  unsure (138)
  unsure (139)
  unsure (140)
  unsure (141)
  unsure (142)
  unsure (143)
  unsure (144)
  unsure (145)
  unsure (146)
  unsure (147)
  unsure (148)
  unsure (149)
  unsure (150)
  unsure (151)
  unsure (152)
  unsure (153)
  unsure (154)
  unsure (155)
  unsure (156)
  unsure (157)
  unsure (158)
  unsure (159)
  unsure (160)
  unsure (161)
  unsure (805)
tggcgtaactgtgtcagaatagagacttctcttttcacgacgccagaatgtatgaaagcgatcactctttatgacgttgcccgcgtggcaggcgttnnnnnnnnnnnnnnnnnnnnnnnnnnnnnnnnnnnnnnnnnnnnnnnnnnnnnnnnnnnnnnnnnggtccggcaggccatggcggcgctacactatgtgcccaaccgtggcgcgcagcagctggccgggaaacgcacccgcacgctggggctgatgaccagcgatctggcgctacatgcgccgtcgcaaatcgcctcagctgtaaaatcccgggcagtggagcagggggctagcgtactcatctccatggtggagcaacccgcgcagtgtcaggctgctttgcaggaattactggcgcagcgcgtagaggcgctgctggtgaacgttccgctggaagatgccctggcagaaatgcttcaggaaatggcctcgccgaccccggttctttttctcgatgtgtcccccacagctcgggttaacagtctcgttttcaatgccgaacagggcgctgccctgggggcagagcatctgctttcgctggggcaccagcgaattgcgctgctcgccgggccggaaagttctgtctctgcccgggctcgtctggcgggatggaaaaccacgctggctcaggccggcgtggaggcgtttgcggtggcgcagggcgactggagcgcggcttcgggctatgagaaagggcatcagctcctggcgggcgcgcagctgccggaggcgatcttcgtcgctaacgatcagatggcgcttggcgttntacgcgcctgtgcggaaaaaggcgttgcggtaccggggcagatctcggttgtcgggtttgatgatacggctgacagcgcgtggttttcacctccgctcaccaccgttcggcaggcgttccgcgaggccggtgagcgcagcgtggagtggctgatggcacctgcccatcacgacgaatgctggcaggaacaacttcccgttacgttgatcgtgcgtcattccaccgcgccgcgcgccgcacagcaggccgatcgtgaagatcttgcgcaacagctcagaacgctggcgctgctggcggagaaactggcgcgcagctag

SEQ ID NO: 2430 - DNA, 2034 bp, Enterobacter cloacae
tgtgccttttttgtttgtccagacctgatttgtgcgagtttatgcgagttgtgggctgacaattgccctgttttcttgtcacaatacgcctttacgcgcgacggtcaggattttccgtcagcgtcaggtaaccagtcacctacagcggagtgttgttacaccatgatggacagcttacgcacggctgctaacagtctcgtgctcaagattattttcggtatcattatcgtgtcgttcatattgaccggtgtgagtagttacctcatcggcggtggcgcgaactacgccgcaaaagtgaatggccaggaaattagccgtgggcagttcgagaacgcttttgctggtgaacgtaaccgcatgcagcaacagctgggcgaccaatactctgaacttgcagccaacgaaggctatatgaaaaacctgcgtcagcagacgctaaaccgccttattgacgaggcgctgctggatcagtacgcgaaaagcctgggtctgggcatcagcgatgagcaggttaaaaaagccatcttctcgacgcaggctttccagtctaatgggaagttcgacaacgcgcgttacaacagcattgttaaccagatgggtatgacggctgaccagtacgctcaggcactgcgtaaccagttgaccacgcaacagctgatcaacgcggtggtgggcaccgatttcatgctgaaaggtgaaactgaaaagctggcggcactggtggcgcagcaacgcgtggtgcgtgaagcgacgattgatgtcaacgcactggcagcgaaacagcaggttagcgacgctgaagttaatgcttactacgagcaaaacaagaacaacttcatctctccggaacagttccgcgtaagctatatcaagctggatgcagctgcgatgcaggaaaatgcgactgacgccgagatccagtcttattacgaccagcatcaggatcagtttactcagccgcagcgtaaccgttacagcgtgatccagaccaaaacggaagcagaagcgaaagccgtgctggatgagctgaacaaaggcgctgatttcgccaccttagcgaaagcaaaatctaccgacattatttctgccaaaaacggcggtgatatgggctggctggaagagtcaactaccccggatgagctgaaaaatgcaggcctgaaagagaaaggccaactgtctggtgtaatcaaatcctccgtcggcttcctggtggcgcgtctggacgatgttgtggcggcgaaaaccaagccgctgactgacgttcgtgatgatatcgctgcgaaagtgaagcaggagaaagcgctggatgccttctatgctctgcaacagaaagtgagcgatgccgcaagcaacgacaacgaatcactggcgggcgctgagcaggctgctggcgtgaaagcggttgagacgggctggttcagccacgaaaacctgccggaagaactgaacttcaaaccggtttcagatgccattttcaatggtggtctggtcggtgagaatggtacgccgggcagcaactcagatatcattactgttgacggtgatcgtgcgttcgtactgcgcgtcagcgagcacaaagccgaggcagtgaagcccctggcggaagtgaaagatcaggtggtggcgctggtgaaacacaacaaagcggcacagcaggcaaaactggatgcagagaaaattctggccgacctgaaagccggtaagaacgatgcgctgaaagcggctggcctgagctttggcgaagcaaaaacgctgagccgtaccggtcaggatcctgtcagccaggcggcgtttggtctgagcctgccggcgaaagacaaacctgtctttggcaccacgaccgatatgcagggtaacgtggtggttctggcgctggatgaagtgaaagccggcacgctgccagacgcgcagaagaaggccatggttcagggaattacccagaacaatgcccagattgctttcgaagcgttgatgagcaacctgcgtaaagaagccaaaatcaagctgggtgatgtggtcactcaggagcaataa

SEQ ID NO: 2431 - DNA, 2046 bp, Enterobacter cloacae
ttctggatgatgcgctgtccgcggttgacgggcgtactgaacatcaaattctgcataaccttcgccagtggggagaggggcgcacggtcatcattagcgcgcaccgtctgtcggcgcttaccgaagccagtgaaattctggtgcttcagcacgggcatattgcccagcgtggtcagcatgagcagctcgccgggcagaccggctggtatcgggatatgtaccgctatcaacagcttgaagccgcgctggatgaggaggtggccgatgcgtaagtttggacagatgtggccgacgttaaaacggctgctggcctatggctcaccgtggcgcaaaccgctttccatcgccgtgctcttgctgtggatcgccgcgattgcggaggtgaccggtccgctgcttatcagctatttcatcgataacatggtagcgaaaagctatttgcctctcggcctggtcgccgggctgggcgtggcgtacgtcgggctacagctgacggcggcagggctgcattacgcgcagtcactgctctttaaccgggccgccgtgggcgtggtgcagcagctgcgcacggacgtgatggatgccgcgctgcgccagccgctgagcgagtttaatacccagccggtcgggcaggttatttcgcgcgtcaccaatgacaccgaggtgatccgcgacctctatgtaaccgttgttgcaacggttctgcgcagtgccgcgctaattggcgcgatgctggtggcgatgttcagcctggactggcggatggcgctggtggcaatcaccattttcccggcggtgctgatcgtgatggtgatttaccagcgctacagcacgccgatcgtgcgccgcgtgcgcgcttaccttgcagatatcaatgatggcttcaacgaagtgatcaacggcatgagcgttattcagcagtttcgccagcaggcgcgttttggtgagcgaatgggggaagccagccgctcgcattatatggcgcggatgcagacgttacgcctggacggtttcctgttacgtccgctgctgagcctcttctcggcgctggtgctgtgcggactgctgatgctgttcggcctgacgacgcgcggaaccatcgaggtgggggtactgtacgcgtttatcagttacctcggacgccttaacgaaccgctgattgaactcaccacgcagcagtcgatgctgcaacaggcagtggtcgcgggcgaacgtgtattcgagctcatggacaggccgcgtcagacctatggcgatgacgaacgcccgctggaaagtggatccatagcgtttgatcatgtctcgtttgcctaccgcgacgaccagcttgtcttgcaggatatcaacctcgaggtaccgtcgcgtggttttgtcgccctggttgggcataccggcagcggcaaaagcacgctcgccagtttgctgatgggctactatccgttgacgcagggggagatccgtctggacggacggccgcttgcctcgcttagccacaacgcgttgcgtaagggcgtcgcgatggtgcagcaggatccggtggtgctggcggataccttttatgccaacgtgacgctgggacgtcctttcacccctgagcaggtatgggaggtgctggaaacggtgcagctggcggatctggcgcgcgggttaagcgaggggatcaatacccggctgggtgagcagggcaacaacctctccgtcgggcaaaagcaacttctggcgctggcgcgcgtgctgattgagacgccgcaggtgttaattctggatgaagcgacagcaagcattgactccggtaccgagcaggcgatccagcaggcgctggctgccgtgcgggatcacactacgctggtggtgatcgcccaccgcctgtcaacgatcgtcgatgccgataccattctggttctgcaccgtggccaggccgttgaacggggtacgcacagagcgctgcttgaggcaaaaggacgctactggcagatgtatcagttgcagctggcaggtgacgaactggccgccagcgtgcgcgaggaagagtcactcagcgcctga

SEQ ID NO: 2432 - DNA, 1338 bp, Enterobacter cloacae
cgaagcggcgttgtaagtaactcctggcacacagtgatagggatcgagaaaatgaagaaagcaacaatgaaaacaggtctggggtcgctggcactgctgccgggcctggcaatggctgcacctgctgtggcagacaaagccgataacgcctttatgatgatttgcaccgcgctggtgctgttcatgacgattccggggatcgcgctgttttacggcggcctgattcgcggcaagaacgtactctccatgctgacgcaggttgccgtcacgttcgcgctggtgtgcgtgctgtgggtagtttacggttactcgctggccttcggggagggcaacgccttcttcggcaacgttaactgggcgatgctgaaaaatatcgaactgaccgcggtaatgggcagcttctatcagtatattcatgtcgcgtttcagggctcattcgcctgcatcaccgtggggctgattgtgggcgcgctggctgagcgtatccgcttctctgcggtactgattttcgtggtggtctggctgacgctctcctatatcccgattgcgcatatggtctggggcggtggtctgttggcttcccatggcgcgctggactttgcgggtggtaccgttgtgcacatcaacgccgcggtagcaggcctggtaggcgcctacctgattggcaagcgcgtgggcttcgggaaggaagcattcaagccgcacaatctgccgatggtctttaccggcaccgccatcctctactttggctggttcggcttcaacgcaggttcagccagcgccgctaacgaaatcgctgcactggccttcgtgaataccgttgtggcaaccgccggcgctatcctctcatgggtatttggcgagtgggccgttcgcggcaagccatcgctgctgggtgcctgttccggggcgattgccggtctggtaggtattacgccagcgtgcggttacgtgggcgtaggcggtgcgctgctgatcggtatcgtcgcaggactggcggggctgtggggcgttaccgcactgaaacgtgttctgcgcgttgacgatccgtgtgatgtattcggcgtgcacggtgtgtgcggcattgtcggctgtatcatgaccggtatctttgctgcccaatctctgggcggtgtgggttacgcagaaggcgtaaccatggggcatcaggtgcttgtacagctggaaagtatcgcgatcaccgttgtctggtcgggtgttgtggcctttatcggttacaagctggctgatatgaccgttgggctgcgcgtgccggaagagcaggagcgcgaaggtctggacgtcaacagccacggcgagaatgcctataacgcataa

SEQ ID NO: 2433 - DNA, 678 bp, Enterobacter cloacae
aaactggacattaatcatagtgccattttcaccgaagatggaacctggtacttcggagaagagaaaatggtacgtcgtctggtacaactttatgtcggtttaggcctgtacgggctttcaaccgcgatgtttattcgttcggatctgggtgtcgacccttgggatgtctttcaccttggcgtcgccatccagacagggatgagcatcggcacggtgattattttaaccggggcagcggtgctgctgctgtggatcccgctgcgtcagctgccggggctgggcactatcagtaatgtgatttgtattggtctggcggcagatgcgtcaatggcgctgatccctgagctcacctcgctgcccgtgcgcatcaccctgctggtttccggcattgtggttaacgcccttgccaccgggatgtatatcggcgcgggttttggcgcaggcccgcgcgacggcctgatgaccggcatacacgcccggctgggctggtcgatccgcagcgtgcgtaccgcgatcgaggtgactgtgttgatcgtcggctacctcctcgggggagcgtttggcgttggaaccgtgctgtatgcattaaccatcggcccgctgatccagctctgtttgccgtggtttcgccagagaccgcgcattcagaaagctgcacagccggagcggattgtttaa

SEQ ID NO: 2434 - DNA, 3111 bp, Enterobacter cloacae
  unsure (64)
  unsure (65)
  unsure (66)
  unsure (67)
  unsure (68)
  unsure (69)
  unsure (70)
  unsure (71)
  unsure (72)
  unsure (73)
  unsure (74)
  unsure (75)
  unsure (76)
  unsure (77)
  unsure (78)
  unsure (79)
  unsure (80)
  unsure (81)
  unsure (82)
  unsure (83)
gcgcttcgcaaagaggttgatatgtcttctacattgccgctgactctcagcgcacttctggcgnnnnnnnnnnnnnnnnnnnngggtgtgacgcagtggaatcgtctggccgcacacgcgccttttcatagctggcgcgatgaaaccttcgcccgcgaggataagccttcgcggagcaagcgtctgcttaacggcatctggcgattcagctttttcccggcgccagagcaggttccggaggcatggataacggacgatctggctgatgccgttgagatgcccgtgccgtcgaactggcagatgcagggatttgatactcccatctataccaacgtcacctatccgataaatgtgaacccgccctatcttccggctgaaaacccaaccggttgttactcgctcacatttgagatggatgacgcctggatgtgcagcgggcaaacccgcattatttttgacggggtgaattcagcttttcatctgtggtgtaacggccagtggatgggctattcgcaggacagccgtctgcctgctgagttcgatctcagcgcggtgctgcgaccggggcagaaccgcctggcggtaatggtgttacgctggtgcgacggaagctatctggaagatcaggacatgtggcggatgagtggcattttccgtgacgtctcgctgctgcacaagccggaaacgcgaattgccgattatcagatcgtgaccgatctgaatgccgaatgcgatcgggcgatactccgggttgacgttgcgctggaaggcacacgctacgccgaatgcgaggtggcgtttaccctgtggcgtaacggcgaagcctgcgcgcaaaccacgcagcagcccggatcggccatcgtggacgaacgcggcagttgggcagaacggcttagggtggcgatacccgtgaacgctcctgcgctatggagcgctgaaacaccggaatgctatcggctgacaatatcgcttcgggatgcgcagggtaacgtgctggagactgaagcctgcgatgtcggtttcagacgcgtcgaaatcagcaacggccagctgaagcttaacggcaaaccgctgctgatccgcggcgtgaaccgtcacgaacatcatcctgagaaggggcaggtgatggatgaggcgaccatgcgccgcgacatcgaactgatgaagcagcataacttcaacgccgtgcgctgctcgcattatccgaaccatcctctgtggtacacgctttgcgatcgctacggcctgtacgtggttgatgaggcgaatattgaaacccatggcatggtgccaatgagccgcctggcggacgatccgcgctggctgcctgccatgagcgaacgcgtaacgcgtatggtgcagcgggaccggaatcatccgtccatcatcatctggtccctggggaatgagtccgggcatggggcgaatcacgatgcgctgtaccgctggctgaaaaccaccgatcccacgcgaccggtgcagtatgaaggcggcggcgccagtacggcggcaaccgatattgtctgcccgatgtacgctcgcgtcgatcaggatcagccgttcccggcggtgccaaagtggtcgattaaaaagtggattggtatgccggacgaaacccgtccgctgatcctgtgcgagtatgcccacgcgatgggcaacagctttggcggctttgccagctactggcaggcattccgcagccatccccggttgcagggcggctttgtctgggactgggtcgatcaggcgctgacgaaaaaagcggaagacggcacggtattctgggcctacggcggcgattttggcgataagcccaacgaccgtcagttctgcctcaacgggctggtgtttcccgatcgcactccgcatcccgccctttacgaggcgcagcgtgcccagcagttctttacctttacgctggtgagcaccgctccgctggtcgtcgagatccagagcgattatctgttccgtcatactgacaacgagtatctgcgatggtcggtggcgcgtgacggtgcggtactggcttccggcgaaacacccctttctgttgcgcccgaggggacgcagcacgttgagatcccgctgcctgaacttgtcgctgagccgggcgaggtctggctcaacgtggagatcgttcagccgcaggccacgtcgtggtcgccgcccggccaccgttgtgcctgggatcagtggccgctcccggcgccgctgtaccttgcgccaccgaaagcaggcggaacccctccgcagctaacggtggaggacgaagcgctggacattactcatcagcagcagcgctggcagtttagccgtctcaccggaaacttgacccagtggtggaacgagggcgctgaaacgctccgttctccgctaacggataacttcacccgcgcgccgctggacaatgacattggcgtcagcgaggcgacccgcatcgatccgaacgcgtgggtggaacgctggaaagcggcagggatgtatgagatgtccgcgcgcctcctccagtgtgaagcggagcagcataaccgtgaggtgatagtgaccacgcagcacgtctgggagcatcagggtaaagcgctatttatgagctgcaaggtctggcggattgatgaccacggggtgctgcaaggtgatgtgcaggtgacggtggcgtctgacattcctgagcccgctcgcgtgggcctgagcgttatgctggcggatatcccggaaacggtgcgctggctgggactaggcccgctggaaaactatccggacagaaaactggcggcgcagcagggacgctgggcgttaccgctggaagagatgcagacgccgtatatcttcccgacggagaacggtttgcgctgcgacacccgcgagctgacgtttggctcccatcagttgcagggacagttccatttctccctgagccgttatagccagcggcagctgcatgagacaacgcatcagcacttgctgcgggaagaggctggctgctggttgaatcttgatgcgtttcacatgggcgtagggggggacgactcatggagcccgagcgtagccccggccttcattctgcaaaaccgccggctgcgctacacgtttagctggcagcagaacggctga

SEQ ID NO: 2435 - DNA, 522 bp, Enterobacter cloacae
ccatggaaaccgcgtgtgttccggggcaaaggcaagttgacctacaccggttcgctgggtgaagtgatgcaggagtccatccaggcggcgctgaccgtggtgcgcgcgcgtgcggaaaaactgggtatcaacccggatttctacgaaaaacgcgatattcacgttcacgttccggaaggggcgacgccgaaagatggcccaagcgcgggtattgccatgtgtactgcgctggtttcctgcctgacaggtaatccggttcgtgctgatgtggccatgaccggtgaaattacgctgcgtggtcaggtactgcctatcggcgggttaaaagaaaaactgctggcggcacaccgcggtgggatcaaaaccgtattgatcccttacgagaataaacgcgatctggaagagattccggacaacgttattgccgatttgcagatccatccggtgaaacgcattgaggaagttctgactctcgcactgcaaaatgaaccgtccggaatgcaggttgtaaccgcaaaatag

SEQ ID NO: 2436 - DNA, 360 bp, Enterobacter cloacae
ggtcatagcaggactgatataactgctgcgcggtcgcgctgtgaaggattcaggtgcgatataaattataaagagaggaagagaacagtgaataaatctcaactgattgacaaaattgctgcgggtgctgatatttctaaagcggcagctggacgtgctttagatgctttaattgcttctgttactgaatctctgcaagctggggacgacatttcactggtaggcttcggtacttttgcggttaaagagcgtgcagcccgtactggccgcaaccctcagaccggcaaagagatcaccattgctgccgctaaagtgccgggtttccgtgcaggtaaagcgctgaaagacgcagtaaactga

SEQ ID NO: 2437 - DNA, 501 bp, Enterobacter cloacae
cgttctgcaaaaactaaaggccgctttcgcggctttttccatttctgcaatctgctgtttgtccctgttttcccgtgcggctatcgtggcatggctgtcaacaaacaaggagaaaacagcatgaaatgtggaatcaaagcactgttaattacactggctattgccacttccgggatgagtgcgggcgcgctggcggcgtcaccctcgtctaaagcccaggctgcacaaactcaggccgatgcaacgtcacaaggtcaggttaaagccaacgcgacggccagcacgaaagccattgaggacgagggtacgcgggtcagtattaatactgcctctgcggacgatcttgcccgcgtaatgaatggcgtgggcctcaaaaaagcgcaggccatcgtcagctatcgtgaagagtatggtcctttcataacccttgacgatctcaagcaggtgccgggtatgggcagcgcgctggttgagcgcaatctcgcacacctgacgctgtaa

SEQ ID NO: 2438 - DNA, 381 bp, Enterobacter cloacae
aagacaagaagggttttcagggataaaatcatgaacagggactacgttgttaaacgttaccgaacccgcgacggaaaaataccgtttgaggattgggtagcaaagttgagacgaaaggatccggagctggcgtttcggatccttctgcgaatcgaccgcgctgagaaggggaattttggcgattaccgttatctcagagagggtgtctgggagttgaaggttgatagtggtcccggttatcgagtctattttgcggtccagcatcgggaaatcttattgttgctgatcggcggtgacaaaaagagccagaaagcggatgtgatgctggcaatagattactggaaagatcatcaaaaggataaactccatgagcaaaagtga

SEQ ID NO: 2439 - DNA, 843 bp, Enterobacter cloacae
ccgcatcacatttcgggagtaatcatggctcggctcgctgcatttgatatggacggcacgctgttaatgccagatcaccgtttaggggagaaaaccctgaaaactcttaagcgcctgcgcgagcgtgaagttaccctgacgtttgctactggtcgtcatgtgctggagatgcgccatctgctggggacatttgccctcgatgcgttcttgatcaccggcaacggaacgcgcattcactccgtcgacggcgatgtgctgcaccgtcaggatctgaatccggaggtggcggacattgtcctgcacagcacctgggatacgcaggccagcgtgcatgtttttaatgatgaaggctggtttaccgggcgtgagatcccggccttgctgcacgctcacgtttacagcggctttaaatatcagcttatcgatttgcgccgcattccggcacacaaggtgaccaagatctgcttctgtggcgatcacgacgatctctgccgtctgcgtattcagcttaacgaggcgctgggcgaacgggcgcacctgaccttctcggcggtggactgtcttgaagtgctgccggtgggctgtaacaaaggatccgcgctggcggtgctgagcgatcatctggggctgacgatgcaggactgtatggcctttggtgacgccatgaacgaccacgagatgctgagcaacgtaggtcgtgggctgattatggggaacgcgatgccgcagcttatcgccgcgctcccgcatttaccggttatcggacactgtcgtaacgaagcggtgtcccattttttgacgcattggctggacaaaaataacctcccatattcccccgaatag

SEQ ID NO: 2440 - DNA, 375 bp, Enterobacter cloacae
ctgcggccattaccgaattctgactggaggggatatatgaagctggttacggtggtaatcaaaccattcaaactcgaagacgtgcgtgaagcgctgtcttccatgggtattcagggactgactgtcaccgaagtgaaaggctttgggcgtcagaaaggtcatgccgagctttatcgcggggcggaatacagcgttaacttcctgccaaaagtgaaaattgatgtggcgattgccgacgatcagcttgatgaggtgattgatgtcgtcagcaaagcggcctacaccggaaaaattggcgacggcaaaattttcgttgccgaactacagcgcgttattcgcatccgtaccggcgaatctgacgaagcggcgttgtaa

SEQ ID NO: 2441 - DNA, 1119 bp, Enterobacter cloacae
aacgcaagggcgttgttcatgaataaggttgttttatattgtcgcccggggtttgagaaagagtgcgccgcggaaatcaccgataaagcggcgaagcgtgaagtctttggattcgctcgcgtcaaagagaacgcgggctatgtggtatttgaatgctatcagcctgatgatgccgacaagctggcgcgcgaactgccgttcagctcattgattttcgcccgtcagatgtttgtcgcgggtgaactgctgaaagatcttccgccggaagatcgcatcacgccgattgttggcctgttgcagggcgtggtggagaagggcggcgatttgcgcgtggaagtggccgacaccaacgaaagcaaagagctgatgaagttctgccgtaagttcaccgtgccgctgcgcgcggcgctgcgtgatgcgggtgtgctgacaaactacgaaacgccaaagcgcccagtcgtgcatatcttctttattgcgccaggatgttgttacgcaggctactcgtataccaccaataactcgccgttctttatggggatcccgcgtctgcgcttcccggcagatgcgccgagccgttcaaccctcaagctggaggaggcgtttcacgtctttatcccggcggacgagtgggacgaacggctggcaaacggcatgtatgccgtcgaccttggcgcgtgcccgggcggctggacctatcagctggtgaaacgcaacatgtgggtatcgtccgttgataacggcccaatggcgcaaagcctgatggacaccggacaggtcacctggctgcgtgaagacggtttccgctatcgcccgaaccgcaacaacatctcctggatggtgtgcgacatggttgagaaaccggcgaaagtggccgcgctgatggcctcctggctggtgaacggctggtgtcgcgagaccattttcaacctcaagctgccgatgaaaaagcgctatgaggaggtgtcgcagaacctggcctacattcagcagcagctggatgaacacgggattaacgcggaaatccaggcgcgtcagctttatcacgaccgcgaagaagtgacggtgcatatccgtcgctggtgggcggccgtgggggggcgtcgcgacgagcgataa

SEQ ID NO: 2442 - DNA, 462 bp, Enterobacter cloacae
gcagggagcacgtattgtagctggaatgctgcgaaacgaaccgggagcactgtttttacagtgctcccttttttatttctgtcttccgcaatgctatgcttcgcgccattccgtttttcagttgaggtatatatgtcgcatcatgacagcgttcgtgcgcagttgcacgccatcgaagcccttatgcgccagcatcagctgtggcaggataacgcgccgcagccagacgcgttcgccagcacccaaccgttttgtctggatacgctggacccgttcgagtggctccagtgggtcttaattccgcgtatgcacgcgctgctggaaggtggccacgcgttgcccgcgtcttttgccgtctctccctattacgaaatggcgctggaagcgacccacccggcgcgtgccatgatgctggtggagctggagaagctggatgcgcttttcgccggtgacgatgcatga

SEQ ID NO: 2443 - DNA, 1383 bp, Enterobacter cloacae
catcaaacgaatcgaactgaaacctgttggggagcgcggatgatgacaacgcaatcaagcccgatcgtgacggacatgaaggtcatcccggtggcggggcaggacagcatgctgctcaacattggtggcgcgcataacgcctggttcacccgcaacattgtggtgctgaccgacaacgcagggaacaccggcgtcggggaagcgcctggcggagaggtgatttaccagacgctggtcgacgccatcccgcacgtggttgggcaggaggtcgcccgtctcaacaaggtggttcagcgggtgcataagggcaaccactcggcggattttgataccttcggcaaaggtgcctggacgtttgaactgcgcgttaacgcggtggcggcgctggaggcggctctcctcgatttactgggaaaggcgctgaacgtgccggtctgcgaactgctggggccaggcaaacagcgtgatgcggtaacggtgctgggctatctgttctacgttggcgaccggactaaaaccgatctgccgtatctggaacgctcgccgggtagccacgagtggtatcacctgcgtcatcaggaggcgctctctggcgaggcggtggtacgcctggcagaggcggcgcaggatcgctacggctttaaagacttcaagctgaaaggcggcgttctgccgggcgagcaggagattgacagcgtgcgcgcgttgaaaaaacgcttcccggaggcacgcatcaccgtcgatccgaacggcgcctggctgctggatgaagctatcgcgctgtgcaaagggctgggcgacgtgctgacctacgcggaagatccgtgcggtgccgagcagggcttttctggccgcgaggtgatggccgaattccgccgcgctaccgggctgccggttgcgaccaacatgatcgccacaaactggcgcgaaatgggccatgcggtgatgctgaatgcggtggacataccgcttgcggacccgcacttctggaccctttccggcgcggtgcgcgtggcgcagctgtgcgatgactggggcctcacctggggctgccactccaataatcatttcgacatttcgctggcgatgtttacccacgttggcgcggcggcgccgggcaacccgaccgccatcgatacgcactggatctggcaggaaggcgaagcgcgcctgaccaaaaatccacttgaaatcaaaaacggcacaattgccgtaccggatgcgccggggctgggcgtggagcttgactgggatcagatccacaaggcgcatgaagcgtataaaaaactgccgggcggcgcgcgcaacgacgcaggcccgatgcagtaccttatccccggctggacatttgaccgtaagcgccctgtatttggacgtcactga

SEQ ID NO: 2444 - DNA, 1350 bp, Enterobacter cloacae
aaggatcgaacgatgagcacattttctacccctgtagttacctccatgcagatcattcctgtcgcgggacatgacagcatgctgatgaacctgagcggcgcccatgcgccgttcttcacccgtaatattgtggtgatcaaggacaactcagggcataccggtgtcggtgaaatcccgggcggggagaagatccgtaaaacgctggaggacgccattccgctggtggtgggtaaaacgctgggcgagtacaaaaatgtgctgactcgcgtgcgcacgacctttgccgatcgtgatgcgggtggccgtggtctgcaaacgtttgatctgcgcaccactatccatgtggtcacgggcattgaagccgcgatgctggatctgctgggccagcatctgggcgtcaatgtcgcctccctgctgggcgacggccaacagcgcagcgaagtggaaatgctcggctacctgttctttatcggcaaccgcaaactcaccccgctgccgtaccagagccagccggacgaaaaatgcgactggtatcgtgtgcgtcacgatgaagcgatgaccccggacgcggtggtgcgcctggcggaagccgcgtatgaaaaatatggctttaatgacttcaagctgaaaggcggcgtactggcgggtgaagaagaagcagaggcgatcgccgcgctggcgaagcgcttcccgcaggcgcgcgtcacgctggatccgaacggtgcctggtcgcttgatgaggcgatcaaaatcggtaagcagcttaaaggcgtgctggcctacgcggaagatccgtgcggcgccgagcaggggttctccggacgtgaagtaatggcggagttccgtcgcgccaccgggctgccaaccgccaccaacatgatcgcgaccgactggcgtcagatggggcacacgctctcgctgcaatcggtggacattccgctggcagacccgcacttctggacgatgcagggctcggttcgcgtggcgcagatgtgccatgagttcggcctgacctggggctcccactccaacaaccacttcgacatctcgctggcgatgttcacccacgtggcggccgctgcgccgggcaacattaccgccatcgacacccactggatctggcaggagggcaaccagcgcctgaccaaacagccgtttgaaatcaaaggcggcatggtgcaagttccagctacgccggggctgggcgttgagctggatatggaccaggtcatgaaagcgcatgagctttaccagaaacacggcctgggcgcgcgtgatgacgcgctggcgatgcaatacctgatcccagagtggagattcgacaataaacgtccgtgcatggtacgataa

SEQ ID NO: 2445 - DNA, 1653 bp, Enterobacter cloacae
cttctcaggttcagcatgacaacgaactatatttttgtgaccggcggggtcgtatcctctctgggtaaaggcattgccgcagcctccctcgcagccattcttgaagcccgtggcctcaatgtgaccatgatgaaactggatccgtacatcaacgtcgatcctggcaccatgagcccaacccaacacggggaagtgttcgttactgaagacggcgctgaaaccgatctggatcttggccactacgagcgtttcatccgtaccaaaatgacccgtcgtaacaactttacgactggccgtatctactctgacgttctgcgtaaagagcgccgtggtgactacctgggcgcgaccgtgcaggtcatcccacacatcactaacgccattaaagagcgtgtccttgccggtggcgaagggcatgacgttgtgctggttgaaatcggcggtaccgtgggagatatcgaatccctgccattcctcgaagcgattcgtcagctggcggtagatattggtcgtgagcacgcgctgttcatgcacctgacgctggtgccttacatggcggcagcaggtgaagtgaaaaccaaaccgactcagcactctgttaaagagctgctctccatcggtattcagcctgacatcctggtttgccgttccgatcgcgcgattccggcgaacgaacgtgcgaaaattgcattgttctgtaacgtgcctgaaaaagccgttatttcaatgaaagatgtcgattccatttataaaatcccgggcctgttgaaatcacagggtctggacgattatatttgtaaacgattcagcttgaactgtccggaagctaacctgtctgaatgggagcaggtgatttacgaagaagccaatccgggcggcgaagtgactatcggtatggtcggcaagtacatcgaactgccagatgcctataagtcagttatcgaagcgctgaaacacggtggtctgaagaatcgcgtctctgtgaacatcaagctgattgattcgcaggatgtggagacgcgcggcgtcgaaattctcaaagatctggatgcgattctcatccctggcggcttcggctaccgtggtgttgaaggcaagatcgccactgcacgctatgcgcgtgaaaacaatattccatacctcggtatctgcctgggtatgcaggttgcgctgattgaatttgcgcgcaacgtagcgggaatggaaaacgcgaactctacggaatttgtgccagactgtaagtaccctgttgtggcgctgattacggaatggcgcgacgaagacggtaacgtcgaagtccgtaccgagaagagcgatctgggtggcaccatgcgtcttggcgcacaggcctgccagctgtccgacgatagcgtggtacgcaagctgtacggcgagccggtcatcaccgagcgccatcgtcaccgctatgaagtcaacaacatgttgttgaaacaaattgaagctgcgggtctgcgtgttgcgggccgttccggggatgatcagttagtcgagatcatcgaagtgcctaaccatccgtggttcgtggcctgccaattccacccggaatttacttcaacgccgcgtgacgggcatccgctgtttgcaggcttcgtgaaagccgccagcgagtaccagaagcgtcaggcgaagtaa

SEQ ID NO: 2446 - DNA, 1350 bp, Enterobacter cloacae
  unsure (1261)
ttttcacaattaaaaatatatgtggtaaaaattttcatcaataaccagggggataaaaaaatgatgcaaatgttcagcggagcgtcttccggcggatggtttgaaaaagcgcagcgctttggcaaatcctttatgttacccatcgccatactgcccgcagcaggtctgttgctggggatcggcggggcgctatcgaatccgaatacgcttaccgcgtatccatttttagacgttggctggctacaggccatctttaccatcatgagcagcgcaggctcgattgtgttcgcaaacctgtcggtactgttcgctgttggggtcgccgttgggctggcaaaaaacgataaaggcacggcggggctggcggcattactcgcttatctggtgatgaatgccactatcaatgcgctgctgatcctgaccggaaaactggcgcatgagaacccgggcgccgtagggcagggcatgacgctgggtattcagacgcttgaaacgggcgtgtttggtggggtagttattgggctggtgacctgcgcactgcatcatcgatttaataaaatcgcgcttccgcaattcctgggcttttttggcggctcacgcttcgttcccattatcagctcactggcggcgatactcgtcggcgcgctgatgaccgtggtctggccgcattttcagaagctgatctttggcctcggcgggctggtggatgccaccggctatctggggactttgctgtacggcttcatcctgcgcatgcttggcccgtttggtttgcaccacatcttctatcttccgttctggaccaccgcgcttggcggcagtgaaattgttaacggtcacctggttgagggcacgcagcggatcttcttcgcccagctcgccgacccgaacacgcagcatttctatgagggcacgtcgcgcttcatgtccgggcgctttattaccatgatgtttggtctgctgggcgcctgccttgcgatgtaccacacggccaggccggagaacaaaaagcgggttgccgggctgctgctctctgcggcgttaacctcattcctgacgggaattaccgagcccatagagttctcattcctgtttattgccccggtgctgtacgtcattcatgcgctgtttgacgggctggcgttcatgctcgcgcacattctgcacatcaccatcggacaaactttctccggcgggtttattgatttcgtgctgttcggcattttgcagggagaagcgaaaactaactggatgttcgtcncgctggtgggcgtaccgtggttcttcctttactactgtaccttccgctatctgatcaaacgttttgattttgccacgccgggcccgtga

SEQ ID NO: 2447 - DNA, 1389 bp, Enterobacter cloacae
accaggcgaaagctatgtttcaggagtgcaacaatgagtacattaagccacgcggcgagcagcgctgagaagcgcaccaacgcccgctactggatagtggtgatgctgtttatcgtcacctctttcaactacggcgaccgtgccacgttatccattgccggctctgagatggcaaaggacatcggacttgatccggtgggtatgggttatgttttctccgcattttcatgggcctacgtaatcggccaaatccctggcggctggctgctggaccgctttggctcaaaacgggtctatttctggtccattttcatctggtcaatgtttaccctgttacagggcttcgtggatatctttagcggcttcggcattatcattgcgctctttaccctccgcttcctggtgggcttagcggaagcgccatcgttccctggcaacagccgtattgtggccgcctggttcccggcgcaggagaggggaacggcggtagcgatctttaactcggcgcaatactttgcgacggttattttcgcgccaatcatgggctggctgacgcatgaggtgggctggtcacacgtcttcttcttcatgggcgggctggggatcgtcatcagcttcatctggctgaaagtgatccacgaaccaaaccagcatccgggcgtgaacaagaaagagctggactacattgctgaaggcggggcgctgatcaacatggatcagaaaacccagaaagctaaggtcccgttcagccagaaatgggggcagatcaaacaactcgtcggctcacgaatgatgatcggtatctatctcggccagtattgcattaacgccttaacctatttcttcatcacctggttcccggtttacctggtgcaggcgcgcggcatgtcgattctgaaggcggggtttgtcgcctccgtgccggccatctgcggcttcgtgggtggggtgcttggcggggtcatctccgactggttgatgcgtcgtaccggttcgctgaatattgcgcgtaaaacgccaatcgtgctcggcatgctgctctccatgaccatggtgttctgtaactacgtcagcgcggagtggatgattatcggctttatggcgatggccttcttcggtaaaggcattggcgcactgggctgggcggtgatggcagataccgcgccgaaagagatcagcggcctgagcggcggtctgttcaacatgtttggcaacatttccggcattgtcaccccaatcgctatcggttacatcgtcggcaccaccggctccttcaatggtgcgctgatttatgtaggcgtccatgcgctggtggcggtactcagttacctggtgctggtgggtgacatcaaacgaatcgaactgaaacctgttggggagcgcggatga

SEQ ID NO: 2448 - DNA, 1566 bp, Enterobacter cloacae
ctgaccaatggattcacggttttgcaggttcataccgtactcgctggagacggccagcggttcgataatgctggccccggcatcttcaagctgtctctgcaaatcgttatagcgatgcaccacaaagaaaatgctcagcagcaaaccgatgagaacggtaggagcgaggatcaaaatcatcatgcgcgcgcgcaggctgtagttggtcatggagttccgttatgggacaatcaggctaattatgtttatttgagaacaatctcggcgatggcgcaattctactctgcaaaacgacgcgtgacgacgcgtcagatcataactgttgaagcctctgacctcgatccttttggacagggggtggcgcgtcacaagggtaaaacactgtttatcacaggtttgctgccaggagaacgtgcagatattacgctgacggaagacaaacgccagtatgcgcgcggtcaggtcaagcgccgtcttaatgatagcccggagcgcgtgacgcctcgctgcccccattttggcgtctgcggtggctgccagcaacagcatgccagcacggaattacagcaaaaaagtaaaagcagcgcgctggcccgcctggtcgggcacgacgtgaatgacatcattgccgatcggccctggggctaccgtcgccgcgctcgcctgagcctcagctaccagcccaaaaccgagcggctggagatggggtttcgcaaagccggctccagcgatatcgtctctgtcacgcagtgccctgttttggtgccccatcttgaggcgttgctcccggacgtgcaccactgtcttgcatcgctggatggcgtgcgttcgctcggccatgtcgaactggtgctggccaacagtggcccgctgatggtgctgcgccacaccgcgccgctgtcaaaggcggatcgcgaaaaactggaacgcttttcgcattctcatgagcttgcgcttttcctcgcgccgcaaagcgagatacttgagcaggtcagcggagaagcgccctggtatgcgtcagacgggctacgcttaacgttcagcccgcgggattttatccaggtcaacgacggcgtgaaccaacagatggtggcgaacgcgttggaatggctcgacgtacagcctactgaccgggtgctcgatctgttctgcggcatggggaactttaccctgccgctggcccgcagagcagcaagcgtggtcggagtggaaggcgttgaggcgctggtggcgaaaggccaggagaacgcccaacagaacggtttgcaaaatgtgacattctttcatcaaaatcttgaggatgatgtcactcagcaaccgtgggctaagcagggctttgataagatcctgctcgatccggcgcgcgcaggtgcgccgggcgtgatgcagcatataattaaactcgcgcctgaacgcgtggtctatgtttcctgtaacccggcgacgcttgcccgtgacagcgaagcattattgagcgggggttaccagattcggcgtctggcaatgctggacatgttcccgcacactggtcatctggaatcgatggtgttgttcgagcacatctaa

SEQ ID NO: 2449 - DNA, 2280 bp, Enterobacter cloacae
gtttggcttgtcgacttcgacaggcccttgtccctaaaggagaggacgatggttgcggtaagaagtgcacatttaaataaagctggtgagtttgaccctcaaaaatggatcgcaagtctggggatttccagccagcagtcgtgtgaacgcttaaccgaaacctgggcctattgtttacgcacaacgcaggggcatccggacgctgaactgctgttgtggcgcggcgtggagatggttgaaattctctccatgctgaacatggacatcgaaacgctacaggccgcactgctgttccccctggcggacgccgacgtggtgacggaagacgtcctgcgtgaaagcgtcggccagtccgtcgtggcgctcatccacggcgtgcgtgatatggcagccattcgtcagcttaaagccgcgcaaactgactctgtctcttccgagcaggtggataacgttcgtcgtatgctgctggcgatggtagatgatttccgctgcgtggtgatcaagctggccgaacgggttgcccatctgcgtgaagtaaaggatgcgccggaagacgagcgcgtcctggccgccaaagagtgtacgaatatctatgcgccgctggcgaaccgtctgggtatcgggcaactgaagtgggagctggaagattactgcttccgctacctgcatccggcggaatacaaacgcattgcaaaattgctgcacgaacgccgcattgaccgcgagcactatatcgaggaatttgtcagcgggctgcgccagtcgatgaaagaggagaatgtgcgcgccgaggtctacgggcgtccaaagcacatctacagcatctggcgcaaaatgcagaagaaacacctcgcctttgacgagctgtttgacgtgcgcgcggtgcgtatcgtggcggagcgtcttcaggactgctatgccgcgctggggatagtgcatactcatttccgccatctgccggatgagttcgatgactacgtcgcgaacccgaaaccgaatggctatcagtctatccataccgtggtgctcggccctggcggcaaaacggtggaaattcagatccgtaccaaacagatgcacgaagacgccgagctgggcgtggcggcgcactggaaatacaaagagggtacctccggtggcggtcgctccggtcacgaggaccgtatcgcctggctgcgtaagctgattgcgtggcaggaagagatggccgactccggcgaaatgctcgacgaagtgcgcagtcaggtcttcgacgatcgcgtctacgtctttaccccgaaaggggacgtggttgatttgccggcaggctccacgccgctcgatttcgcctaccacatccacagcgatgtggggcaccgttgcatcggggcgaagatcggcggacgtatcgtaccgtttacctaccagctccagatgggcgatcagattgaaatcatcacccagaagcagccaaacccaagccgcgactggctgaatccgaacctcggttacgttaccaccagccgtgggcgctctaaaatccacgcctggttccgcaagcaggatcgtgacaagaacatccttgccggtcgtcagatcctggacgacgagctggaacatatcgggataagcctgaaagaggcggagaagttcctgctgccgcgctacaacttcaacgagctcgacgaactgttagcggcgattggtggcggcgatatccgcctgaaccagatggtgaacttcctgcaagcgcagttcaacaagccaagcgcagcggagcaggatgcggcggcgctgaaacagctccagcagaaaacctacgctccgcagcagcgcagcaaggacaatggccgcgtggtggttgaaggggtgggtaacctcatgcaccatattgcccgctgctgccagccgatcccgggagacgatattgtcggctttatcacccaggggcgtgggatctcgattcaccgctccgactgcgatcagcttgcagagctgcaatcgcatgcgccggaacgtatcgtggaagccgtctggggggagagctactcggcgggttactcgctggtggtgcgcgtcactgccaacgaccgcagcggcctgctgcgcgacatcaccaccattctcgccaacgagaaggtcaacgtgctgggcgttgccagccgcagcgatacccgcgagcagcttgccaccatcgatatgactatcgaaatctataaccttcaggtgctgggccgcgtactcggcaaactgaatcaggtgccggatgtgattgacgcgcgtcgtctgcacggtggctaa

SEQ ID NO: 2450 - DNA, 1371 bp, Enterobacter cloacae
aacggcaacgcgtacctttggtacgcgttgtttgtctggagttttagtttaacttgtactgaggaaaatctaatgtccaaaatcgttaaagtcatcggtcgtgaaatcatcgactcccgtggtaacccgaccgttgaagctgaagttcatctggaaggtggtttcgtcggtatggcagcggctccatcaggtgcttctacaggttcccgcgaagcgctggaactgcgtgatggcgacaaatcccgtttcatgggcaaaggcgtactgaaagcggttggcgctgttaacggtcctattgctcaggctatcgttggcaaagatgctaaagatcaggctggcatcgacaagatcatgatcgatctggacggtactgaaaacaaatctaacttcggtgcgaacgcaatcctggccgtttccctggcgaacgccaaagcggcagcagcagctaaaggcatgccactgttcgagcacatcgctgaactgaacggcaccccaggcaaatactctatgcctgtaccaatgatgaacatcatcaacggtggtgagcacgcagacaacaacgttgatattcaggaattcatgattcagccagttggcgcgaaaaccctgaaagaagcggtacgtatgggttctgaagtgttccacaacctggctaaagttctgaaagctaaaggtatgaacacggctgttggtgacgaaggcggctacgcgccaaacctgggttctaacgcagaagcactggctgttatcgctgaagcggttaaagcagcaggctacgagctgggcaaagacatcaccctggcgatggactgcgcagcatctgaattctacaaagacggtaaatacgttctggctggcgaaggcaacaaagcgttcacctctgaagagttcacccacttcctggaagacctgaccaaacagtacccaatcgtttctatcgaagacggtctggacgagtctgactgggatggtttcgcataccagaccaaagtactgggcgacaaaatccagctggttggtgacgatctgttcgtaaccaacaccaagatcctgaaagaaggcatcgagaaaggcatcgttaactccatcctgatcaaattcaaccagatcggttctctgaccgaaacgctggctgcgatcaaaatggcgaaagacgctggctacaccgcggttatctctcaccgttctggcgaaactgaagacgctaccatcgctgacctggctgttggtaccgctgctggccagatcaaaaccggttctatgagccgttctgaccgtgttgctaaatacaaccagctgattcgtatcgaagaagcgctgggcgaaaaagcaccttacaacggtcgtaaagagatcaaaggccaggcataa

SEQ ID NO: 2451 - DNA, 936 bp, Enterobacter cloacae
catctaagccagataaccatgtccaagcgattgccaccccttaatgcattacgtgtttttgatgcagcagcacgccacctcagcttcacccgcgcagccgatgagctttttgtgacacaggccgcagtaagtcatcaaatcaagtctctggaggattttctggggcttaagctgttccgtcgacgcaaccgttcgttgctgttgaccgaagaagggcagagctattttcaggatattaaagagattttttcccagctgacggaagccactcgcaagcttcaggcccggagcgcaaaaggcgctctgactgtgagtttattgcccagttttgccattcagtggctggtgccgcgactctcaagctttaactcaacttatccgggaatcgatgtccgaatccaggcggtggaccgtcaggaagacaagctggcagatgatgtggacgtggcgattttttacggtcgcggtaactggccgggcttgcgtgtggaaaaattatacgcagaatatctgttgccggtctgttcaccgctgctgctgacgggggataaagcgctcaaaacgcccgccgatctggcgcaacatacgcttttgcacgatgcgtcgcgtcgcgactggcaaacttatacccgccagttaggtcttaatcatataaacgtgcagcaggggcccatttttagccacagcgcgatggtgctacaggctgccattcacgggcagggcgtggcgttggcaaacaacgttatggcgcagtccgaaattgaggcaggccgtctggtttgcccatttaacgatgtactggtcagcaagaatgcattttatctggtttgtcatgacagtcaggcagaactgggtaaaatagccgctttccggcagtggatactggcgaaagcggcaagcgagcaagaaaaattccgcttcaggtatgaacaataa

SEQ ID NO: 2452 - DNA, 435 bp, Enterobacter cloacae
cgtttgtgtgccgggcacgcatcaattcaggacttaaacatgaccagccgattcatgctgattttcgccgcggtgagtggctttatttttgtagctctgggcgcgtttggcgcgcatgtcttaagcaaatctctgggcgttgtggagatggggtggatccagaccggccttgaatatcaggcgttccacacgctggcaatttttgggctggcggtggcgatgcagcccgccatcagcatctggttttactggagcagcgtctatctggcggtgggtacagtactgttcagcggcattctttactgtctggcgctgtcgcatttacgcctgtgggcgtttgttacacctgtcggcggcgtcagcttcctggcgggttgggtgttaatgtttatcggagctatccgtctgaaacgcaagggcgttgttcatgaataa

SEQ ID NO: 2453 - DNA, 606 bp, Enterobacter cloacae
ccactttacaggtacacttatgggctgagtttatcctgtcttacaagaagagagaaatcggtggatatcgaaactgcaaatgccctgacgtccttcacgacccgctattgcgatgcctggcatgaaaagcgggggacgtggccgcaaagtactgacttatgtggcgtgccgtcaccgtgcattatcgcttcgcaggatgattacgttatctggcaaccgaaaccgttcatgggcgagcagaatgtaaatgctgttgaacgcgcgatggaccttgtgatacaacctgcgcttcatgcattttataccacgcagtttgccggggatatgactgcatgttttgcaggacagccgctgacgctgctgcaaacctggagcgaagacgatctgcaacgcgttcaggaaaacctcattggtcacctggtcacgcaaaaacggcttaagctctctccgactctctttattgcgacgctcgacagtgaactggacgtcatttctgtctgcaacctgtctggcgaggtcattaaagagacgctcggcacccgcaatcgcgacgttctcgcgccttcacttgcggatttccttacccgaattgagccgcttctgtaa

SEQ ID NO: 2454 - DNA, 792 bp, Enterobacter cloacae
cgatgcatgacgcttgagatcctttatcaggatgagtggttagtggcggtgaataaaccgtccggctggctggtgcaccgtagctggctcgatcgcgatgagaaagtggtggtcatgcaaaccgtgcgcgatcaaatcggtcagcacgtttttactgcccatcgtctcgatcggccaacctctggtgttctgctgatggggctttccagtgaggccgggcgcctgctggcgcagcagtttgaacagcaccagatccagaaacgctaccacgccatcgtgcgtggctggctgatggattccgccacgcttgattatcccctggtggaggaactggataaaatcgccgataaatttgcccgcgaagataaaggcccgcagccagcggtgaccgactatcgtggtatggcgaccacagaactgccggtggcgaccagcaaatttccgaccacgcgatacagtctggtggagcttttgcccaaaaccgggcgcaagcaccagcttcgccgtcaccttgcacatctgcgccaccccattatcggcgacagcaagcacggcgatctgcgccagaaccgcagcgcggccgagcactttggctgtaaccggctgatgctgcacgccagcgagctacgcctgacgcacccgtttaccggcgaaccgctgactattcgcgcggggctggacaaggtctggatgcaggcgctgtcacagtttggctggctgggacaactccccgaaaatgaaagggttgagtttgccgcaggcaacgttcaggatgaacagcaagcgcaataa

SEQ ID NO: 2455 - DNA, 465 bp, Enterobacter cloacae
ttacgggagcaaagcatggctgaagtaggcatttttgtcgggacaatgtacggcaactcgctgctggtggcggaggaagcggaagcaatcctcgtaaaccagggccataaagcaacggtctatgaagatccggagctggcggactgggaaaagtataaagataaatacatcctggtggtgacctccaccaccgggcagggcgatctaccggacagcatcgtcccgcttttccagggcattaaagaccagcttggctatcagccagatgttcactatggcatcattgccctcggcgatagctcttacgccaatttctgcggcggcggtaaacagttcgacgcgctgttgcaggaacagagcgctcagcgcgtcggagagatgttgctgattgatgcgggtgaacaccctgagccagaaagcgagtcaaatccctgggttgaacactgggccacgctcctgaactaa

SEQ ID NO: 2456 - DNA, 1155 bp, Enterobacter cloacae
ggatggcttatgaaaattgttatcgctccggactcgtataaggaaagcttgagcgcgctggaggtggcgacagcgatagaggtcggttttcgcgaaattttcccgtcagcgcactatgtcaaattaccggttgccgatggtggcgaagggacggtggaagcgatggtggcagccacgcatgggcgtcttgtccatgttcctgttaccgggcctttgggtgaacgcgtggaagggtttttcgggttatccggagacgggaaaagcgcctttatcgagatggcggcagcgagcggtctggagcttgttgctcctgcaaagcgtaacccgttaatcaccacctcctggggaaccggggaactgatccgtcatgcgctggatgcgggcgttaagcatatcattattggcattggaggcagcgcgaccaatgacggtggcgcaggcatggtgcaggcgctgggcgtaaaactgctggatgcgaaagcgcagcccgttgggccgggcggcggcgaactggcaagccttgcgcatatcgatcttagcgggctggacaagcggctggcagactgtcgaattgaagtggcctgcgatgtaaccaaccccctgatcggcgagactggcgcttctgcggtatttggtccgcagaaaggggcgacgccggagatggtcaggacgctggacaacgcgcttgcgcattacgcaaaaattatcgcccgggatctggatattgacgtcttaaacctggcgggcggcggtgcggctggcggaatgggggcggcgctgtatgcattttgcggcgcacagctccgtcaggggattgagattgtcaccgatgccctgcatctcgatgaacaggtcgcggacgccgatctggtgatcacgggcgaagggcgtatcgacagccagacgatccacggaaaagtgcccgttggcgtggcgagagtcgcgaaacgctataacaagccggttattggcattgccggcagcctgacggcggatgttggcgtggtgcatgagcacggactggatgccgtattcagcgtgatttacaccatctgctcgctggaggatgcgctggaaaatgcgcaacagaatgtacagatggccgcaaggaatattgcggcggtgataaagatggggcaggggatgtcgcgttaa

SEQ ID NO: 2457 - DNA, 834 bp, Enterobacter cloacae
ggcaacgccgccacccggctcaggcatttaatggaatctgttatgactcaaatcgaccgcctgcttggcatcatgaaacgcctgcgcgatccggaaaacggctgcccgtgggataaagagcagactttcgccaccattgcgccttacacgctggaagagacctacgaagtgctggacgccatttcacgcgaggatttcgacgatctgcgcggtgagctgggcgacctgctgttccaggtggtgttctacgcgcagatggcgcaggaagaggggcgctttaactttgacgatatctgcgccgctatcagcgacaagctggagcgtcgtcatccgcatatctttggtgatgcctccgcaggcaacagtgcggaagtgctggcgcgctgggagcagataaaaagcgctgaacgcgctgaaaaatcccagcactcggcgctggacgacattcccctgaaccttcccgcgctgatgcgcgcgcacaaaattcaaaagcgctgctcggcggtagggtttgactggacctctctcggcccggtgctggaaaaagtacacgaagagatcgacgaagtgatgcatgaagcgcagcaggccgttgtggatgaagcaaagctggaagaggagatgggcgatctgctgtttgcaaccgtcaacctttcacgccacctcggtgtaaaagcggaaaccgccctgcaaaaagcgaacattaaattcgaacgacgctttcgcgaagttgagcggattgtggcctcgcgcggcctggaaatgagcgggattgacctcgacgcgatggaagaagtctggcaggaagtaaaacgccaggaacatgatctctaa

SEQ ID NO: 2458 - DNA, 1374 bp, Enterobacter cloacae
ggagctcacttgattacacatattagcccgcttggctctatggatatgttgtcgcaactggaagtggacatgcttaaacgcaccgccagtagcgacctttatcaactgtttcgtaactgttcacttgccgtactgaactccggaagcctgaccgacaacagtaaagagctgctgtcccgcttcgaaagttttgatatcaacgtgctgcgccgcgagcgcggggtgaagctcgaagtgatcaacccgccggaagacgcttttgtcgacgggcgtattattcgctcacttcaggcaaacctgtttgccgtgctgcgcgacattctgtttgttaacggacagatcagcaatgccggacgtttccagcatcttgacctggaaagttccgttcatatcaccaacctggtcttctccattctgcgtaacgcccgtgccctgcacgtgggcgaagcgccgaacatggtcgtctgctggggcggtcactccattaacgaaaccgaatacctgtatgcccgccgcgtagggacgcagctcggcctgcgcgaactgaatatctgtaccggttgcggtcctggcgcgatggaagcgccgatgaaaggcgcggcagtaggacacgcacagcaacgctataaagaaggccgttttatcggcatgaccgagccatcgatcatcgccgctgagccgcctaacccgctggttaacgaactgattattatgccggatatcgaaaaacgtcttgaggcgtttgtccgtatcgcgcacggcatcatcatcttcccgggcggcgtaggcacggcggaagagctgctttatctgctggggatcctgatgaacccggccaacaaagatcaggttctgccgctgatcctgaccggcccgaaagagagcgccgactacttccgcgtgctggacgagtttatcgtgcatacgctgggcgaagatgcgcgccgtcactaccgcattattattgacgatgccgcagaagtggcccgtcagatgaaaaaagcgatgccgctggtgaaagagaatcgtcgtgataccggggatgcctacagttttaactggtccatccgtatcgcaccggatcttcagatacccttcgagccgtcgcatgagaacatggcgaacctcaaactctatccggatcagccggtggaagtgctggctgccgacctgcgtcgcgccttctctggcatcgtggcggggaacgtgaaagaggtagggatccgcgcaattgaagagttcgggccgtataagatccacggtgacccggagatgatgcgccgcatggatgacatgttgcagggctttgtcgctcagcaccgcatgaagcttccaggctctgcctatattccgtgttacgaaatcatcaagtaa

SEQ ID NO: 2459 - DNA, 1371 bp, Enterobacter cloacae
acgaatttcatattaccgtcaggcactttttcatcggatttgactaaaaacctgacaatttgcttcctccaggagatacagatggaaaccactcaaaccagcaccgttgcttcgattgaatcccgaagcggttggcgcaaaacggataccatgtggatgcttggcctgtacggcacagcaatcggcgctggtgtactgttccttcctatcaacgcaggtgtcggcggtatgatcccgctgatcatcatggccctcatcgctttcccgatgaccttctttgcacaccgcggcctgacccgcttcgtgctgtccggtaaaaatccgggcgaagacatcactgaagtcgttgaagaacacttcggcgtcggcgcaggtaagctgattaccctgctctacttcttcgcgatttacccgattctgctggtgtacagcgttgctattaccaacaccgttgaaagctttatgatgcaccagcttcagatgaccccgccgccgcgtgcgattctgtccctgatcctgatcgtcggtatgatgaccatcgtgcgcttcggcgagcagatgattgtgaaagcgatgagcgtgctggtgttcccgtttgttgcggctctgatggtgctggctctgtacctgatcccacagtggaacggcgctgcgctggaaaccctgtctctgagcagcgcatccacgaccggcaacggtctgctgctgaccctgtggctggcgatcccggtgatggtattctccttcaaccactcgccaatcatctcttccttcgcagtagcgaagcgtgaagagtacggcaatggcgcagagaagaagtgctccagcatcctggctcgcgcgcacatcatgatggtactgaccgtaatgttcttcgtgttcagctgcgtgctgagcctctccccggcggatctggcggcggcgaaagagcagaacatctctattctgtcttacctggcaaaccactttaacgcaccgctgattgcgtggatggcgccgatcatcgcgattatcgccatcaccaaatccttcctgggccactacctgggcgcacgtgaaggcttcaacggcatggtgattaaatctctgcgtggtaaaggcaagaccattgaaatcaaccgtctgaacaaaatcactgcactgttcatgctggtgaccacctgggcggtagccaccctgaacccaagcattctgggcatgattgaaaccctgggcggcccgattatcgcgatgatcctgttcctgatgccgatgtacgcgattcagaaagtgcctgcgatgcgcaaatacagcggccatatcagcaacgtgttcgttgttgtgatgggcctgattgccatctccgctattttctactcgctgttcagctaa

SEQ ID NO: 2460 - DNA, 774 bp, Enterobacter cloacae
acagaagggagattatctgtggccgttcatttgcttatcgtcgatgctcttaacctgattcgccgtattcatgcggtacagggcacaccctgcaaggacacctgtttacacgcgctggagcagcttatccgccacagtgaacccacccatgcggtcgcggtttttgatgacgaagcccgcaacacgggctggcggcaccagcgcctgccggactacaaagccgggcgtgcgccgatgccggacgatctgcacgcagaaatgcccgctatccgcgcggcctttgagcagcgcggcgttccgtgctggggcgcccacggtaatgaggctgacgatttagccgcaacgctggcggttaaagtcgcgagcgccggacatcaggcgactatcgtttcaaccgacaaaggctactgccagctgctctcccccactatccgtattcgcgactattttcaaaaacgctggctggacgcgccgttcattgccagcgagtttggcgtatcgcctgagcaactgccggattactgggggctggcggggatcagcagctctaaagtgccgggtgtcgccggtattggacccaaaagcgccgcacagctgctgacggagtttcagagtctggaagggatgtacgcccggctgaacgaggtgccggataaatggcgcaaaaagctggaggcgcataaagaaatggcgtttatctgccgggaggtggcgacgctacagacggatttacaactggacgggaatttacagcagttaaggttagagcgttaa

SEQ ID NO: 2461 - DNA, 834 bp, Enterobacter cloacae
ggatctagcatgtcggaccatgaaaacctgctgctgaagctacgccaggaggcttccgggtacagcccaacgcaacaaaaactgggggagtttgtcctcaacgatcctgccagggtgctctacctgacgatcaccgagctggcgcgtgaaagcggcaccagcgaggccagcgtcacacgcctttgccgcacgctgggctgtaagggatataacgaatttaaaatggcgcttgcgctggatattcagcagggtttgccggagcgtcaggcaggagatgcaatagataacgtggtggatgagtctgtccaggcgctgcaagataccgcaaaactcctcgaccgggcccagcttgaacaggcgacactggccctgcatcaggcgcagtcagtgcaaatttacggagtggcggccagcgcgattctgggggaatatttgcattacaagctgctgcgactcggcaaacctgcacagctgtttagcgatatgcatcgcgccgccatgaatgcgacgacgctctcgaaagagacgctggtggtggccatctcaagttcgggatcgacccgcgatttactccacgtcgtgaagctagcccgcaagcggggcgttaaggtactggcgctcagcaatacgccccgcagcccgctggcctccctgagcgatttacagctggttgcagccaaacccgagggaccgctgagcgcgggtgcgctcaatgccaaggttggcgtgatgctgctggttgaactgctaaccacttcccttattgcagtagacagccattacggtgacgttagccagcaaacggcaagcgccacgttgccgcttctgctatag

SEQ ID NO: 2462 - DNA, 846 bp, Enterobacter cloacae
aacatgtcttacgaaaatcatcaggcgttaacgggcttaacgctgggaaaatcgaccgattaccgcgacacctacgatgcaagcctgttgcagggcgtgccgcgcagtctgaaccgcgatccgctcgggctgcacgctgacgcgctgccgtttgtcggcggcgacatctggacgctgtacgaactctcctggctgaatgcgcgcggtctgccgcaggtggccgtgggccacgtcgagctggattacgccagcgtaaacctggtcgaatccaagagctttaagctctatctcaacagctttaaccagaccaaatttaacagctgggacgaggtgcaacagacgcttgaacgtgatttaagcgcgtgcgcgcaggggaacgtaaccgtctcgttataccgtctgcatgagctggaaggtcagcccatcgcccatttccacggcacctgcatcgacgatcaggacattgaggtggaaagctatgaatttagcagcgactacctggaaaacgcggcgggcggaaaagtggtcaacgagacgctggttagccatctgctgaaatccaactgccttatcacccatcagccggactggggctcggtacagatccagtaccgcggcccgcagattgaccgtgaaaagctgctgcgttacctggtgtcattccgtcatcacaacgaattccacgagcagtgcgtggagcgcatcttcaacgacatccagcgtttctgccagcccgaaaagttgagcgtttacgcccgctacacccgtcgcggcggtctggatatcaacccgtggcgcaccaataccgattttgtgcctgccaccggacgacttgtgcgccagtaa

SEQ ID NO: 2463 - DNA, 1299 bp, Enterobacter cloacae
acagccattacggtgacgttagccagcaaacggcaagcgccacgttgccgcttctgctatagaaaacaaaaaacccgccgaagcgggttttttcgtaagaacgaaggttcaggcttatgcctggcctttgatctctttacgaccgttgtaaggtgctttttcgcccagcgcttcttcgatacgaatcagctggttgtatttagcaacacggtcagaacggctcatagaaccggttttgatctggccagcagcggtaccaacagccaggtcagcgatggtagcgtcttcagtttcgccagaacggtgagagataaccgcggtgtagccagcgtctttcgccattttgatcgcagccagcgtttcggtcagagaaccgatctggttgaatttgatcaggatggagttaacgatgcctttctcgatgccttctttcaggatcttggtgttggttacgaacagatcgtcaccaaccagctggattttgtcgcccagtactttggtctggtatgcgaaaccatcccagtcagactcgtccagaccgtcttcgatagaaacgattgggtactgtttggtcaggtcttccaggaagtgggtgaactcttcagaggtgaacgctttgttgccttcgccagccagaacgtatttaccgtctttgtagaattcagatgctgcgcagtccatcgccagggtgatgtctttgcccagctcgtagcctgctgctttaaccgcttcagcgataacagccagtgcttctgcgttagaacccaggtttggcgcgtagccgccttcgtcaccaacagccgtgttcatacctttagctttcagaactttagccaggttgtggaacacttcagaacccatacgtaccgcttctttcagggttttcgcgccaactggctgaatcatgaattcctgaatatcaacgttgttgtctgcgtgctcaccaccgttgatgatgttcatcattggtacaggcatagagtatttgcctggggtgccgttcagttcagcgatgtgctcgaacagtggcatgcctttagctgctgctgccgctttggcgttcgccagggaaacggccaggattgcgttcgcaccgaagttagatttgttttcagtaccgtccagatcgatcatgatcttgtcgatgccagcctgatctttagcatctttgccaacgatagcctgagcaataggaccgttaacagcgccaaccgctttcagtacgcctttgcccatgaaacgggatttgtcgccatcacgcagttccagcgcttcgcgggaacctgtagaagcacctga

SEQ ID NO: 2464 - DNA, 1398 bp, Enterobacter cloacae
cagttcgtcgagctcgttgaagttgtagcgcggcagcaggaacttctccgcctctttcaggcttatcccgatatgttccagctcgtcgtccaggatctgacgaccggcaaggatgttcttgtcacgatcctgcttgcggaaccaggcgtggattttagagcgcccacggctggtggtaacgtaaccgaggttcggattcagccagtcgcggcttgggtttggctgcttctgggtgatgatttcaatctgatcgcccatctggagctggtaggtaaacggtacgatacgtccgccgatcttcgccccgatgcaacggtgccccacatcgctgtggatgtggtaggcgaaatcgagcggcgtggagcctgccggcaaatcaaccacgtcccctttcggggtaaagacgtagacgcgatcgtcgaagacctgactgcgcacttcgtcgagcatttcgccggagtcggccatctcttcctgccacgcaatcagcttacgcagccaggcgatacggtcctcgtgaccggagcgaccgccaccggaggtaccctctttgtatttccagtgcgccgccacgcccagctcggcgtcttcgtgcatctgtttggtacggatctgaatttccaccgttttgccgccagggccgagcaccacggtatggatagactgatagccattcggtttcgggttcgcgacgtagtcatcgaactcatccggcagatggcggaaatgagtatgcactatccccagcgcggcatagcagtcctgaagacgctccgccacgatacgcaccgcgcgcacgtcaaacagctcgtcaaaggcgaggtgtttcttctgcattttgcgccagatgctgtagatgtgctttggacgcccgtagacctcggcgcgcacattctcctctttcatcgactggcgcagcccgctgacaaattcctcgatatagtgctcgcggtcaatgcggcgttcgtgcagcaattttgcaatgcgtttgtattccgccggatgcaggtagcggaagcagtaatcttccagctcccacttcagttgcccgatacccagacggttcgccagcggcgcatagatattcgtacactctttggcggccaggacgcgctcgtcttccggcgcatcctttacttcacgcagatgggcaacccgttcggccagcttgatcaccacgcagcggaaatcatctaccatcgccagcagcatacgacgaacgttatccacctgctcggaagagacagagtcagtttgcgcggctttaagctgacgaatggctgccatatcacgcacgccgtggatgagcgccacgacggactggccgacgctttcacgcaggacgtcttccgtcaccacgtcggcgtccgccagggggaacagcagtgcggcctgtag

SEQ ID NO: 2465 - DNA, 2769 bp, Enterobacter cloacae
cggaactccatgaccaactacagcctgcgcgcgcgcatgatgattttgatcctcgctcctaccgttctcatcggtttgctgctgagcattttctttgtggtgcatcgctataacgatttgcagagacagcttgaagatgccggggccagcattatcgaaccgctggccgtctccagcgagtacggtatgaacctgcaaaaccgtgaatccattggtcagttaatcagcgtgctgcaccgccgtcattcagagattgtgcgcgccatttccgtttacgatgagcataaccgtctgttcgtcacctcgaatttccatctggatcccacgtcgctgaaaatcccggatggtacccccttcccgcgtcatcttacggtgttgcggcgaggcgatatcatgatcctgcgcacgccgattatctccgaaagctattcacccgatgaatccgcccagtccgatgcgaagtccagcaataatatgctgggatatgtggcgctggagctggatcttaagtcggtacggctccagcagtacaaagaaatattcatctccggcgtgatgatgctgttctgcatcggcatagcgctgatcttcggctggcgactgatgcgcgacgtcacggggcctatccgcaacatggtgaataccgttgaccggatccgccggggtcagctcgacagccgcgtggaaggctttatgctcggcgagctggatatgctgaaaaacggcatcaactcaatggcgatgtcgctggcggcttatcacgaagagatgcagcacaacgttgaccaggccacctctgacctgcgcgaaacgctggagcagatggagatccagaacgtggagctggatctggcgaaaaaacgtgctcaggaggcggcgcgtattaagtctgaattcctggcgaacatgtcgcacgagctgcgcacgccgctgaacggggtgattggctttacccgtctgacgctcaaaagcgagctgaacccgacccagcgtgaccatctgcataccattgaacgctcagccaacaacctgctgaccattattaacgacgtactggacttctcgaagctggaagcgggcaagctgattctggagagtattcccttcccgctgcgcagcacgctggatgacgtggtcacgcttcttgcccactcatcgcatgataagggtctggaactgacgctcaatattaaaaatgatgtgccggataacgtcattggcgacccgctgcgcctgcaacaggtcattaccaatctggtgggcaacgcgattaagttcaccgagagcggcaacatcgacattctggtcgaaaaaagggcgctcagtaataacaaagtccagattgaagtgcagatccgggataccggcatcggtattccggagcgcgatcagacgcgtctgttccaggctttccgccaggccgatgcgagcatttcccgtcgtcacggcggaacgggcctggggctggtgatcacccaaaagctggtgaaagagatgggaggcgatatctccttccacagccagcctaaccggggctcaaccttctggttccatatcaaccttgatcttaacccgaacgtgcagaccgacggcccggtcaccgggtgcctgaaggggatgcgtctggcctatgtggaaccgaacgccgcggcagcgcagtgtacgcttgatgtattaagcagcacgccgctggaggtcatctacagcccgaccttctccgcgctggcgaacgatcattacgacatcctgttgttggggattccggtgacgtttaccggagaactgaccatgcagcaggaacgcctggcgaaggcggcctcaatgacggactacctgctgctggcgctgccgtgccacgcccaaatcaacgccgaagagctgaaaaacgacggagcggcggcgtgtctgctgaaacccctcaccgccacacggctgttacctgcgttgaccgaatattgccgtctgacgcatcagtccctgccgctggaaaatgacgaacataagctgccgatgacggtgatggccgtggacgataacccggcgaacctgaagctgattggcgtgctgcttgaggatcaggttcagcacgttgagctgtgtaccagcggcgccgaagccgtggaacaagccaaacagatgcagttcgacctgatcctgatggatattcagatgccgggcatggatggcatccgcgcctgcgagttgattcgccagcttccgcaccagcagcagacgccggtgattgccgtgacggcgcacgcgatggcggggcaaaaggagaaactgctgggtgcgggcatgaacgattatctggcgaaaccgatcgacgaagagaagctgcacagcctgctgctgcgctacaagccggggcacattggcgggacatacaccattacagctgaatcgccggagatcagcgttaaccagaatgccacgtttgactggcaactggcgctgcgccaggcggcaggcaaacccgatctggcccgcgatatgctgcaaatgctggtggacttcctgcctgagatccgtaacaaggttgaagaacagctggtgggtgaaaaccccgaaggactgctggaagccattcataaactgcatggcagctgcggctacagcggcgtaccgcggttgaaaaatctctgccagttgcttgaacagcagctccgcgcgggtacgccagaatccgatctcgaaccggagttcctggagctgctggacgagatggacaacgtgacgcgggaagcaatgaaggtgttggggagctaa

SEQ ID NO: 2466 - DNA, 1383 bp, Enterobacter cloacae
agcaatggacgcatcatgattagcgtattcgatatcttcaaaatcggtattggtccttccagctctcacaccgtcggaccaatgaaagccggtaaacaattcacggatgacttgattgcacgcggcattttgcacgacatcacccgcgtggttgtcgatgtatatggttccctttccctgaccggtaaaggccaccataccgatattgccattatcatggggctggcgggtaatctgccggataccgttgatattgatgcaatacctggctttatccaggacgtgaacacccacggtcgtttgctgctggcgaacggcgagcatgaggttgaattcccggttgatcactgcatgaatttccatgcggataacctgtcgctgcacgaaaatggcatgcgcattaccgcgctggccggcgacaaagcggtttacagccagacgtattactccatcggcggcgggtttatcgtcgacgaggaccattttggtcaaagcaccaattctgctgttgatgtgccgtacccttacaaaaacgcggccgacttacagcgtcactgccaggagacagggctttctctctccggcctgatgatgaaaaacgagctggccctgcacagcaaagaggaactggaacagcacttcgctaacgtctgggaagtgatgcgcagcggcattgagcgcgggatcaccaccgaaggcgtgctgccgggtaaactgcgtgttccgcgtcgtgcggctgcgctgcgccgcatgctggtcagcgccgacaaaaccaccaccgatccgatggccgtcgtcgactggatcaacatgttcgcgctggcggtgaacgaagagaacgccgcgggcggccgcgtcgtcaccgcaccaaccaacggggcgtgcggcattgttccggcggtcctggcgtattacgacaagtttatccgtgaagtgaacgcaaactcacttgcacgctacctgctggtcgccagtgcgattggctcactgtacaagatgaacgcctcaatttctggcgcggaagtaggctgtcagggtgaagtgggcgtagcctgctctatggcggcggcgggtctggccgaattgctgggcgcaagccctgcgcaggtttgtatcgcggcggaaatcggcatggaacataacctggggctgacctgcgatccggtcggcggacaggtccaggtgccatgcatcgaacgtaacgccatcgcctcggtgaaagcagtgaacgcggcccgtatggcgctgcgtcgtaccagcgaaccgcgcgtctgcctcgacaaggttatcgaaaccatgtacgaaaccggcaaagatatgaacgccaaataccgcgaaacctcccgcggtggcctggcgatgaagatcgtcacctgcgattaa

SEQ ID NO: 2467 - DNA, 501 bp, Enterobacter cloacae
cgtgctgttttacgaaggattgcacggcggcgtggtgacgcctcagtcatattcgacgtggcgcgccacgtggatttgctggtgggggtggtgccgattgttaaccttgagtggatccagaagctgacgcgtgacatgagcgagcgcggccattcgcgagaggcggtcatggactcggtggtgcgctccatggaagattacatcaacttcctgacgccgcagttctcccgaacccacattaacttccagcgcgtccccaccgtggacacctccaacccgttcgccgcaaaaagcatcctttccctggacgagagctttgtggtgatccacttccgcaacctggaaggcattgattacccctggctgctggcgatgctacaaggttcgtttatttcgcacatgaatacgttagtggtgcccgggggaaaaatggggctggcaatggaacttatcatgacaccgctggtgcagcggctgatggaaggaaagcaaatcgcgtga

SEQ ID NO: 2468 - DNA, 822 bp, Enterobacter cloacae
  unsure (725)
  unsure (729)
  unsure (736)
  unsure (759)
  unsure (764)
  unsure (788)
  unsure (793)
  unsure (794)
acccggtgcggaaggccccagttccagcgtctcgatatcgggttcagcgggccccttacctttttcaaggaggcagctggcctgaaaattgacactacgttgttgctcccagagacgggatttttgcttgtcggtgagttttttcactacgcctccctgaatagtccgtttgccacaagtataagcagcaaaacgcgctttcgcagggagggcggaaagacacgggcaggatatgcccgtgtggacgaacgattacggcagcactttcgcggagagaatgacgacaggcttagtcggcacattctggtatggaccgacatcgtgagtctgaacctgagagatcttatccgccacgtccatgcctttcaccactttgccaaacaccgcgtagccaaagtcgcgctgaccgtggtccaggaaggcgttatcagccacgttgaggaagaactggctggtggcgctgtctttgtccgccgtacgcgccatcgagatggtgccgcgcttgttcagcaggccgttgtcagcttcatttttgatgggcgggttaggctgtttctgctgcatctgctcgttaaaaccgccaccctgaatcataaagcccgggatcacgcggtggaatgtggtgttgttataaaaaccactgttcacgtagtcgaggaagtttttcaccgaaacaggggctttctggctatccagctccagctcaatattccccgcaaaagtantcancaggacntgagggtctcctttggctgccancgcancaggggaaacggcaaaaagagcanacccnnctgcaacaaccggccattgttgatttga

SEQ ID NO: 2469 - DNA, 222 bp, Enterobacter cloacae
atgatgaaggatacaacgatcgaagcgagactggctgagctggaaagccgcctggcttttcaggacatcaccatcgaagaactgaaccagaccgtgacggcccatgagcttgaaatggcaaaactgcgcgatcacatgcgcctgctgacggaaaagctgaaggccacgcagccgtcaaacattgcctctcagtcagaagagacgccaccacctcattattga

SEQ ID NO: 2470 - DNA, 654 bp, Enterobacter cloacae
ggcgtaaaaaaagcgggattatcccgcttttttattttccgcagtacggaatcagtggcaaccgcagccgccgttaccgcaaccacctttaccgtggccgtggtcatgaccatggtcgtggccgtgaccaccgcagcagccgtcatggccgtgatcgtggtcatggtcgtgaccgtgcgcaccgtgaacgtggccatgagccagctcttcttcagtcgcttcacggatcgcaacaacttctacgttgaacttcaggttctgacccgccagcatgtggttgccgtcaaccacaacgtggtcgtcttcaacttcagtgatttcaaccggaaccggaccctggtcagtttccgccaggaagcgcatgccaacctgcaactcgtcaacgcccatgaatacgtctttaggaacgcgctgaaccaggttgtcgtcatactgaccgtaagcgtcgttcgcgcctacagcaacgtcgaatttgtcgccaacttcatggccttccagcgccgtttccaggccggaaatcagggaaccgtgaccatgcaggtagtccagcggcgcactcaccggagactcatcaaccaacacaccgtcttctgtacgtacctgataggccaggctgaccaccaggtcttttgctactttcatgatatctcctga

SEQ ID NO: 2471 - DNA, 222 bp, Enterobacter cloacae
aaaatgattattccctggcaggatctctctcccgacacgctcgataatctgattgaaagctttgtcttgcgcgaaggcaccgattatggtgaacatgaacgttcgcttgaacaaaaggtcaacgatgttaagcgccagcttaaaagcggcgacgtggtgctggtatggtccgaactgcatgagacggtcaatatcatgccccgcaacgcgtttcatggctga

SEQ ID NO: 2472 - DNA, 531 bp, Enterobacter cloacae
tctttacacttttccagtcagggagttgctatgtctgccagacatccggttattgccgttacgggttcgagtggggcgggaaccactaccaccagcctcgccttccgcaagatcttcgcccagcttaacttacgggcggccgaggtagaaggcgacagctttcaccgctacacgcgcccggagatggatatggccatccgcaaggcgcgcgatctgggtaaacacatcagctacttcggcccggaggccaatgacttcggcctgctggagcaaaccttccgtgaatacgggcaaagcggtaccgggcagtcccgcaagtatctccacacctacgatgaagccgtgccctggaaccaggtccccggcacgttcacgccctggcagccgctgccggaaccgactgacgtgctgttttacgaaggattgcacggcggcgtggtgacgcctcagtcatattcgacgtggcgcgccacgtggatttgctggtgggggtggtgccgattgttaaccttgagtggatccagaagctga

SEQ ID NO: 2473 - DNA, 639 bp, Enterobacter cloacae
cagcgcatggtgcttggcaaaccgcaaacagacccgactctcgaatggttcttgtctcattgccacattcataagtacccatcaaagagcacgctgattcaccagggtgaaaaagcggaaacgttgtattacatcgttaaaggctcggtggccgtgctgatcaaagatgaagaagggaaagagatgatcctttcttatctgaaccagggcgattttatcggtgaactgggcctgtttgaagaaggccaggaacgtagcgcctgggttcgtgcaaaaacagcatgtgaagtggctgaaatttcttataagaaattccgtcagctgattcaggtcaaccctgacatcctgatgcgtctctcttcccagatggcacgccgtctgcaagtgacctctgagaaggtaggtaacctcgccttcctggacgtaaccggtcgtatcgcgcagacgctgctgaacctggcgaaacaaccagacgccatgactcaccctgacggtatgcaaattaaaattacccgccaggaaatcggtcagatcgtcggctgctcccgtgaaacagtgggccgtatcctgaagatgctggaagatcagaacctgatctccgcccacggtaaaaccatcgtggtttacgggacccgttaa

SEQ ID NO: 2474 - DNA, 2145 bp, Enterobacter cloacae
ttccggtcaaacggcgtgccgccgcagggtggcacgccgtttttgtctctactcctcatgtggcgcaggctgatctatcacccggaagttaactacgcactgcgacaaacgctggtgttgtgtcttcccgtggccgtgggcctgatcctcggacatcttcagcaaggcctgctgttttccctcgtgcccgcctgctgcaacattgccggtctggatacgccccataaacgcttttttaaacgtctgattattggcggctgcctgtttgccggctgtagccttgccgtacagctcttactggcccgcgacattcctctgcctctgatcctgaccgtgctggcgatgacgctcggcgtcaccgccgaaatcagctcgctacacgcccgcctgcttcccgcgtcgctgattgccgccatcttcaccttaagccttgcaggcaacatgccggtgtgggagccattgctgatctacgccctcggcacgctgtggtacgggctgtttaactggttctggttctggctgtggcgggaacagccgctgcgcgaatccctgagcctgctctacgtgcagcttgctgaatactgcgaagcaaaatacaccctgctcactcaacataccgacccggaaaaatccctgccgccgctactggcgcgccagcaaaaagtggtggatctgatcagccagtgctatcagcagctgcacatgcttgccgccaacaaaaatcatgaatacaagcggctgctgcgaatcttccaggtcgggctggatttgcaggagcatatctccgtcagccttcataatccggaagaggtgcaaaagctggtggagcgcagccatgcagaagcggtgatccgctggaacgcgcagaccgtcgcggcccgcctgcgggtgctggctgacgatatcctctatcaccgctacccgacgcgctttaacatggacaaacagctcggcgcgctggaaaagattgcgcgtcagcacgcggataacccggtcgggcaatttgctgcctggcatttcagccgcatcgcccgggtgttacgcacccagcgcccgctttatgcccgcgacctgatggccgataagcaaaaacggctgccgctgctgcccgcgctcaaaagctatctttcactgaaatcttctgccctgcgcaatgccgcacggatcagtgtgatgctgagcatcgccagcctgatgggaatggccctgcacctgccgaaaccctactggatcttaatgaccgtactgtttgttacccagaacggctatggcgccacgcgggtgcgcattctgcatcgggcgggcggcacgatggcggggctgattatcgcgggcgtgacgctgcacttccacgtgccggagggctataccctggccggtatgctggcaatcacgctggtgagctatctgattatccgcaaaaactacggctgggcgatggtgggctttacggtgacggcggtgtatacccttcaactgctcacgcttaacggggaacagtttattattgcccgtctggtcgatacgctgattggctgcctgatcgcctttggcggcatggtctggctgtggccgcagtggcagagcgggctgttgaggcagaacgcccacgacgcgctggaagctgaccagcaggccattcgtctgatcctgagcgatgacccacaaccctctccgctggcctacgagcgcatgaaggtcaaccaggcgcataacgccctgtttaactcccttaaccaggccatgcaggagccgggctttaacgcgcactatctggctgacatgaagctgtgggtcacgcacagccagtttatcgtcgagcatatcaatgccatgacgacgctggcgcgggagcacacgatgctgacgccggatctggcgcagcgctatttgcagtcgtgtgaaattgcgttgcagcgctgtcagcagcgcctggagtatgatgcaccgggcgagtcaggggattcgaacattctggaagcgccggagacgctgacccatgggccgatgagcacccttgagcagcatttacagcgcgttctcggccacctgaacaccatgcacaccatttcgtcggtggcatggcgtcagcgcccgcatcacggaatttggttaacgcgccggttaaaacgaaccgcgtattag

SEQ ID NO: 2475 - DNA, 1938 bp, Enterobacter cloacae
caaattaacatagtcggaacatacggcgcttctatgattgttttctcctcgttacaaattcgtcgcggcgtgcgcgtcctgctggataacgcgactgctaccatcaacccgggccagaaagtggggctggtcggcaaaaacggctgcggtaaatccaccctgctggcactgctgaaaaacgagataagcgcggatggcggtaactttaccttcccgggcaactggcagctcgcctgggtgaaccaggagacgcccgcgttgagcgaacccgcgctcgactatgttatcgacggcgaccgtgaataccgcaagctcgaagcagagctcaacgccgccaacgaacgcaacgacggccacgccatcgccaccgtccacggcaagctggacgccatcgatgcctggaccattcgctcccgcgcctccagcctgctgcacggcctgggtttcagcaacgaacagcttgaacgcccggtgagcgatttctccggcggctggcgtatgcgccttaacctggcgcaggcgctgatctgccgctccgacctcctgctgctcgatgaacccaccaaccacctcgatctcgatgcggttatttggctggagaagtggctcaagagctatcagggcactctgattctgatctcccacgaccgcgacttcctcgatccggtggtggataaaatcattcatatcgaacagcaaagcatgttcgaatacaccggcaactacagctctttcgagcgccagcgcgcgacgcgccttgcccagcaacaggcgatgtatgaaagccagcagcagcgcgtggcgcacctgcaaagctttgtggatcgcttcaaggccaaggcgtcaaaagccaagcaggcgcagagccgcatcaagatgctggaacgcatggagatgatcgctcccgcgcatgtggataacccattccacttcagtttccgcgagccggagagcctgccgaacccgctgctgaaaatggaaaaagtgagcgcgggctatggcgatcgcattatcctcgactctatcaagctcaacctggtgccaggttcacgcattggcctgctggggcgtaacggcgccggtaaatcgacgctgatcaagctgctggcgggcgagcttaacccggtcagcggcgaaatcggcctggcgaaaggcatcaagcttggctacttcgcccagcatcagctggaatttttacgcgcggatgaatcgccgatccagcacctggcgcgcctggcgccgcaggaaatggagcagaagctgcgcgactacctcggcggctttggcttccagggcgataaggtgactgaaaatacagcgcgtttctccggtggtgaaaaagcgcgtctggtactggcgctgatcgtctggcagcgtccaaacctgctgctgcttgatgaaccaaccaaccacctcgatctcgacatgcgtcaggcgctgaccgaagcgctgattgagttcgaaggggcgctggttgtcgtgtcgcacgatcgccacctgatccgctccaccaccgacgatctctatctggtacacggcggcaaagtcgaaccgtttgacggcgacctggaagactaccagcagtggctgacggacgtgcagaagcaggaaaaccagccggaagagtcagcgaaagacaacgccaacagcgcccaggcgcgtaaagaccagaagcgccgtgaagcggagctgcgcacccagacgcaaccgctgcgtaaagagattgcccgcctcgaaaaagagatggaaaagctcaacgccacgcttgctgccgtcgaagagaagctgggcgacagcgaactgtacgatcagagccgcaaagcggagctgacggactgtctgcaaactcaggcgaaaaccaaatccagccttgaagagtgcgaaatggcatggctggacgcgcaggaacagctggaagcgatgctgcaagccgactaa

SEQ ID NO: 2476 - DNA, 948 bp, Enterobacter cloacae
cacgccgggagggttatgagcttcgataccacgagcgagattacattccgtaagctcagcatcttcatgacgttcatggagaagggcaatatcgcacgtaccgccgaaacgctcggcctgagcggtgtcagcgtgcaccgcgcgctgcataccctcgaagagaacgtccgctgcccgctctttgctcacaaagggcgtaacctgattgccctcccctccgcatggacgctgctggagtattgtcaggaggtgatgcaggtgatggagcgcgggctggaagagtcgcgcaagatcgccggtatcggccagggacggttgcgcgtcggcacgctctactcgctgactctggaaaccgtgccgcgtctgataatgggcatgaagctgcgccgtccggatctggagatggatctgacgatgggctcgaacgaaaccctgctccatatgctggatgagggatcgctggatgcgattttaatctctatctccgagagcgatatcgaccgtaacagcctcgaagtgcttcctctgttccatgacgatattttccttgccgcaccggcttctgccacgctgaataccagcggccccgccgatctgcgtgattataaagatcagaagtttgtcgccctcgcggaagggttcgccacgtatgcggggtttcaggaagcgtttcatatcgccggttttgagccggagattgtgacgcgcgtgaacgatatcttctcgatgctgagcctggtgcaggcgggggtcgggtttacgctgatgccgggcaggatgaagaaagtgtacgaaaattcggtgcagctactgaagctggcgcagccgtaccagatgcagcagctgattgcgatcgtctttgcccgcaaccgcgagcaggatccgagcctgcgggcgctggccgcggaagggcggatgtatgccagaagtttgcaggatagtgcctga

SEQ ID NO: 2477 - DNA, 1050 bp, Enterobacter cloacae
tttctgacaagaatcagcatcgcccttatgacccaaatcattccctcagacttcgacattgcagccgaagagagcgcagagttcgtgcccatgcgcggtgtggctaaccctcacctgcaaaccatgctgccgcgcctgatccgccgcaaggtacagttcaccccgcactggcaacgcctggatttgccggatggcgactttttggatctcgcctggagcgaagatccggatcgggccagacataaaccccgtctggtagtgtttcacggtctggaaggcagcctgcacagcccttacgcacacggactcattgaggcggcgaaagcccgcggctggcttggggtggtgatgcattttcgcggatgcagcggcgagcctaatcgtcagaaacgcatttatcactcgggtgaaaccgaggacggcacctggttcctgcgctggctaagagacaatttcggcgaggcgccaacggcagcggtggggtattcgctgggcggcaatatgctggcctgtctgctggcgaaggagagcgacgccgtaccgctggatgcggcggtgattgtctctgcgccgtttatgctggagcagtgcagctatcatatggaaaagggcttttcgcgagtgtaccagcgctacctgctcaacctgctgaaagccaacgccgcgcgcaagctgaaggcctatccggatacgctgcctgtgacgctgcaacagctcaaacgcgtgaagcgcctgcgcgagtttgatgatttgatcacctcgaaaattcacggttttgccgatgcgattgactattaccgtcagtgcagcgccatgcctttactgaatcaaatcacgaaacccacgctgattatccacgccaaagatgatccgtttatggatcatcactcgatcccggcgcccgatcatctgccggccaacgtggagtatcagctcacccaattcgggggacacgtcggttttgtcggcggcacgctgcgtcggccaaaaatgtggcttgagacgcgtattcccgactggttaacggcctatctggacggtaaaaaatga

SEQ ID NO: 2478 - DNA, 318 bp, Enterobacter cloacae
ttgaaagctttgtcttgcgcgaaggcaccgattatggtgaacatgaacgttcgcttgaacaaaaggtcaacgatgttaagcgccagcttaaaagcggcgacgtggtgctggtatggtccgaactgcatgagacggtcaatatcatgccccgcaacgcgtttcatggctgatctttacacttttccagtcagggagttgctatgtctgccagacatccggttattgccgttacgggttcgagtggggcgggaaccactaccaccagcctcgccttccgcaagatcttcgcccagcttaacttacgggcggccgaggtag

SEQ ID NO: 2479 - DNA, 573 bp, Enterobacter cloacae
  unsure (32)
  unsure (33)
  unsure (38)
  unsure (62)
  unsure (67)
  unsure (90)
  unsure (97)
  unsure (101)
tgctcaaatcaacaatggccggttgttgcagnngggtntgctctttttgccgtttcccctgntgcgntggcagccaaaggagaccctcangtcctgntgantacttttgcggggaatattgagctggagctggatagccagaaagcccctgtttcggtgaaaaacttcctcgactacgtgaacagtggtttttataacaacaccacattccaccgcgtgatcccgggctttatgattcagggtggcggttttaacgagcagatgcagcagaaacagcctaacccgcccatcaaaaatgaagctgacaacggcctgctgaacaagcgcggcaccatctcgatggcgcgtacggcggacaaagacagcgccaccagccagttcttcctcaacgtggctgataacgccttcctggaccacggtcagcgcgactttggctacgcggtgtttggcaaagtggtgaaaggcatggacgtggcggataagatctctcaggttcagactcacgatgtcggtccataccagaatgtgccgactaagcctgtcgtcattctctccgcgaaagtgctgccgtaa

SEQ ID NO: 2480 - DNA, 690 bp, Enterobacter cloacae
tcgttcgtccacacgggcatatcctgcccgtgtctttccgccctccctgcgaaagcgcgttttgctgcttatacttgtggcaaacggactattcagggaggcgtagtgaaaaaactcaccgacaagcaaaaatcccgtctctgggagcaacaacgtagtgtcaattttcaggccagctgcctccttgaaaaaggtaaggggcccgctgaacccgatatcgagacgctggaactggggccttccgcaccgggtttaccccatctgtgtcttattcaccgccatttattccgcaacgaaatgaaaggcgcgggcgagctgcgcaccgccgaaatttccaagggcgacattcctttttgccatttcgagtacatcgagaaagtgggtaatgagctgatggcttcgctggaaagtgataaatatctggtaggccttcagaaagaagagtttacagacagaatcagtcattactactgtgaaatcaacatgctacatccgtttatgagcggtaatggcgtggcccagcggatcttctttgaacaactggctattcatgcgggctacgtgctgaactggcaggggatcgacccggacgactgggctgccgccaaccagagcggggcgatgggggatttgaccgccctgaacgtcatcttcgccaaagttgtgagcgaagcgcgggaatctgcgtaa

SEQ ID NO: 2481 - DNA, 594 bp, Enterobacter cloacae
aatagggcggccattttttcaggagccgccatgattctgctgattgataactatgattcctttacctggaacctctaccagtatttttgcgagctgggggcagaggtggttgtccgccgtaacgatgagatcgcgctggatgacattgacgcgctggcacctcagaaaatcgtgatttcgcccgggccgtgtaccccgtcggagtccggcatctcgctggcggtaatccaacactatgcgggcaaactgccgattctgggcgtctgcctgggtcaccaggccattgcgcaggtctttggcgccaccattgtccgtgccgcgaaagtcatgcatggcaaaacctcaccgatcacacacaccggtaccggcgcattcctggggctaaacaatccgttaaccgtgacgcgctaccattctctgattattgatccgccgaccctgccggcctgctttgaggttaccgcctggagcgagacgcaggagatcatgggcattcgccaccgcgagtacgatctggaaggtgtgcagttccacccggaaagcattctcagcgaacaggggcacgcgctgctggccaatttccttaatcgctga

SEQ ID NO: 2482 - DNA, 1266 bp, Enterobacter cloacae
ttatattttcacaataactgtgacataaaaatggatggtcatgacatggcaactgaacaaccagcaattacccgcgcgacattcgatgaagtgatcctgccgatttatgcaccggctgagtttatcccggtgaaagggagaggcagccgcgtctgggatcagcagggcaacgagtatgttgatttcgcaggcggtattgcggtgacggcactgggccattgccatcctgcgctggtggacgcgctgaaaacgcagggcgaaacgctgtggcacaccagcaacgtgttcaccaacgaaccggcgctgcgtctggggcgtaagatcatcgatgccaccttcgccgaacgcgtgctgtttatgaactccggcaccgaagccaacgaaactgcctttaagctggcgcgctactacgcaaccacgcgtcatagtccgtacaaaaccaaaatcatcgccttccataacgccttccacggtcgctcgttctttaccgtttccgtgggcggccagccgaagtattccgacggctttggtccgaaacctgcggatatcatccacgtgccgtttaacgatctgcacgccgttaaagcggtgatggacgatcacacctgtgccgtggtggtcgagcccattcagggggaaggcggcgtcacggcggccaccccggaatttctgcaagggctgcgcgaactgtgcgacgagcaccaggcgctgctggtgtttgatgaagtgcagtgtgggatggggcgtaccggggatctgttcgcttatatgcactacggcgtaacgccggatattctgaccagcgcgaaagcgctcggcggcggtttcccggtcagtgcggtactcactacccaggatatcgcttccgcatttcatgtgggctcacacggctccacctacggcggtaatccgctggcgtgtgccgtggcgggtgcggcgttcgatatcattaatacgccggacgtcctgaatggcgtgaatgcgaaacgcgatctgtttgtgaaacatcttcagcagattgacgaacagtttgatgtcttcagcgaaatccgcggaatggggctgctgattggcgccgagttgaagcctcagtataaaggccgcgcgcgcgatttcctgcacgccgccgcgcacgaaggcgtcatggtgctcaatgccgggccggacgtgatgcgctttgcgccatcgcttgtggtggaagacaaagacatcgaagacggattaacccgttttgccgcggcggtcgcgaagatcgtcagcggctaa

SEQ ID NO: 2483 - DNA, 411 bp, Enterobacter cloacae
gtgaatatgcaagcgcgtgtgaaatgggttgaagggttaacgttcctgggcgagtctgcttccgggcatcaggttttgatggatggcaactccggcgataaagcgccaagcccgatggagatggtgctgatggcggcgggcggatgcagcgcgatcgacgtggtgtcgatcctgcaaaaaggccgtcatggcgtgaccgattgtgaagtgaagctgacgtcagaacgtcgcgaagaggcgccacgcctgttcacgcatattaatctgcactttatcgtcaccggcaaagaactgaaggatgcggcggtctcgcgtgcggttgacctgtctgcggagaaatactgctctgtggcgttaatgctggagaaagcggtaaacatcacccattcgtatgaagtgatagaggcttaa

SEQ ID NO: 2484 - DNA, 885 bp, Enterobacter cloacae
cccacctgcgaaattccggagctggtaatgaaacttctgccccagatccaggttgaaggcggtgccgaatggctggcgcgaaccgccacgcagtgtctgattgacgaagcacgtttaagcccgaaacccggtctggtggacagccgggggaacggcgcgcaccacgatttatcgcttgcgctgatggagcgctccgctcgcagcctgacccccacgtttcaggcgctggcacagcagagctggcagcgtccggcggatattgccctccggcaaaccgttggccgcctgggtcgcgaaggtgaacggcagatgatggccgctaccgacggcgtgaacacgcaccgtggcgcgatctgggcgctgggattgctggtgagcgcggtggcgatgctgggcggcgatgcccgggcgcaaaccgtcgcgaacaccgccgctcagctggcgaagctgccggatgacgtggcgccgaaagtgttcagcaaggggttacgcgtcacgcaccgctaccgtgtaccgggtgcgcgtgaagaggctcagcaggcgtttccgcacatcatgcagcgcgcgctgccgcagcttcgcctcagccgtctcaacggcagcagcgaaacgcaggccagactcgacgcgctgatggcgatcatgacctcgctcaccgacacctgcgtgctgtcgcgcgccggcatggaggggctggacgccatgcagaacggcgcccgtgcagtgctgaacgccggaggatgcgcaacgctcgccggccagcaggcgctggcgcggttagaccgtcagatgctggcgcttaacgcctcgccgggcggagccgcagacctgcttgccgccacgctgtttcttgaccgcgtcgaaacgccctattcaaagcattaa

SEQ ID NO: 2485 - DNA, 309 bp, Enterobacter cloacae
gaggatgttatggaaaaaatcacattgaccgtgcccgccagccgcgaagtaagcggcagggcgctggcaggggtagtcggttccggggatatggaggtgcttttcaccgccgaaccgggccagaccttaaccattgatatcaccacctccgtcgacaacagccgcgggcgctgggaggcgttgttcaaccgcctgcaaaccgtcagcagcctgcccgcaggtaagctgactatccacgacttcggcgcgacgccgggcgtggcacgcattcgtatcgaacaggtctttgaaggggtgaatcatgcgtga

SEQ ID NO: 2486 - DNA, 828 bp, Enterobacter cloacae
agcgctttttgcccgggaggtgaaatgatgactaactcaattagccgtggcgaactctggctggaaactctggccccgaacgcgaaacgtctggaggggttatgcccgtccgtgcaggccgcagacggcgagctgaacggtgaaacggtgcgttttgtcgccgtggtgccggacgtcaacaaccacttcccgcgcgcggcgcaaggggaagtcggcctgctggaaggctggacgctggcaaaagtggtcagcgaaaccgtcgccgctgatgcagataaagccgtgaagcgcccgattgtggcggtgatcgatgtcccaagccaggcctatggccgtcgcgaagaggcgtttggcatccaccaggcgctggccggcgccgctgccgcctacgctaatgcgcggctggcaggtcatccggtgattggtcttatcgtcggtaaggccatgtccggcgcgtttctggcgcacggctaccaggctaaccgtctgattgccttcaacgataaaggcgtgctgatccacgccatgggcaaagagtctgcggcgcgcattacgctgcgtaccgttgaggcgctggaaaaactggcggcaaccattccgccaatggcgtacgacatcagcaactacgccacgctggggctgctttccgacctgctggatatcagcaatccggatgccccttccgaaagcgatctgacgcgggtgaaaaccaccctgcaacaggccatcagtgacgctcgtcaggacaccacgttgaaaaaccgtctgggtgctgacaaccgccgcagctcagcgctcgtacgtgaacgtatgcgagccagctggtaa

SEQ ID NO: 2487 - DNA, 963 bp, Enterobacter cloacae
tttatgacttacgtaattgttcatgctcttgcaccgattttcgtcatcatgctgctgggattctgggccggtaaggcaaagatggtcgataacaaaaatgtttccctgctgaatatcttcgtgatggattttgcactcccggccgcgctattcagcgccaccgtgcaaaccccgtggaccggcatcgtggcgcagtcgccgctgatcctggtgctcaccctggcgatgtggatcacctatgcggtcatctacttcctcgcgacaaacgtatttaaaaaatccccgcaggatgcggccgtgctgacgctgaccgtcgccttgccaaactacgcggcgcttggcctgccgattctgggcagcgtgctgggcgaaggctcttcaacgtcgctgtccgtggcggtctccatcgcctgtggttcagtgctgatgaccccgttctgcctgctgattctggagcgtgagaaagcgcgcgccgaaggcaataactccggttcaacgctttccatgctgccggtgctgatgtggcgctccattaaaaaaccgatcgtgatgggcccgctgttgggtgtgatcctgtccgctatcggcatcacaatgccggagctggtgctggcggcgattaaaccgctgggactgtccgcgaccgctgcggcgctgttcctgaccggcgtgatcctctctgcccgtaagctccagatcaacaccatggtgatcacttctactatcgccaagctgctgatccagccagcgattgcctggggtatcgttttaatcttcggtctgcacggctccgtggctatcaccgccatcctgatgattgcgctgtctgcgggcttctttggcgtggtgttcggtaaccgctttggcgtgcagtcgccggatgctgaagccgtgctgctgttgagctccatactgtgtatcctgtcgctgccgctgtttatctcgctgacttcaggaatgtaa

SEQ ID NO: 2488 - DNA, 1950 bp, Enterobacter cloacae
gctgacggcggcgatgtgccgtatgcactggatgagcccgattattatctactgggcacggcggcaggatccgaaagcgctggcgagccatgccagggcctatggcgaatggctggcgtcaccgattccggcgggaggacgctaatggacggttcgaatttactccttgccggggtgctgtttttgttcgccgccgtcgtcgcggtcccgcttgccgcgcgtctcggcattggcgcggtgctgggttatttgctggcggggatagccattggcccctgggggcttgggtttatcagcgatgtggatgaaattctccacttctctgaactgggcgtggtcttcctgatgttcatcattggccttgagctgaacccctccaagctgtggcagctgcggcaatctatttttggcgtcggggcggcgcaggtgttactcagcgcggccattctcgcgggactgctgatgttgacgcagttttcctggcaggccgcggtgattggcgggatcggtcttgcgatgtcgtcgacggcgatggcgcttcagctgatgcgcgacaaagggatgaaccgcaacgaggcggggcaactgggcttttcggtgctgctgttccaggatttagcggtgatcccggcgctggcgctggtgccgctgctggcgggatccggagacgatcatttcgactggatgaagatctccatgaaggtgctggccttcgcggggatgctgatcggcggacggtttttactgcgtccggtattccggtttattgcagcatccggcgtgcgcgaggtattcaccgccgcaacgctgctgctggtgcttggctcagcgctgtttatggatgcgctggggctgtcgatggcgcttgggacgtttatcgccggggtgctgcttgcggaaagcgagtaccgccacgagctggagaccgccatcgatccgtttaaggggctgctgctagggctgttctttatctcggtgggtatggcgcttaatcttggcgtgctctatacccatctgctgtgggttattgcgagtgtcgccgtgctggtggcggtcaaaacgctggtgctgtatctcctcgcgaggatttacgggctgcgcagctcggaaagaatgcagttttccagcgtgttaagccaggggggagaatttgcgtttgtgctgttttccacggcgtcgtctcagaagctgttcaaagatgaccagatggcgctgctgctggtgacggtcacgctgtcgatgatgaccaccccgctgctgatgaagctggtggacaaactgctgtcgcgccgcctgaatcccgcagacgatgaagacgaagcgccgtgggtggaagatgataaaccgcaggtgatcgtcgtgggctttggccgcttcgggcaggtgattggtcgcctgttgatggcaaataaaatgcgcattacggtgctggagcgcgatatcagcgccgtcaacctgatgcgcaaatatggttataaggtgtactacggcgatgcgacgcagcttgagctgttgcgctcggcgggcgcagaggctgcggagtccatcgtcatcacctgcaacgatccggaagacacgatgaagctggtggagctgtgccagcagcatttcccgcatctgcatattctggcgcgtgcgcgtggacgtgtggaggctcacgaacttttgcaggcgggtgtgaaacacttctcccgcgaaaccttctccagcgcgctggagctgggacgcaaggcgctggtttcgctgggtatgcatcctcatcaggcgcaacgcgcccagatgcatttccgcaggctggatatgcgaatgctgcgtgaactgatgcccgtgcacagcgacacggcgcagatctcccgcgtgcgggaagcgcgtcgcgaactggaggagatcttccagcgtgagatgcaacaggaacgacgccagctcgacggctgggatgaatttgaataa

SEQ ID NO: 2489 - DNA, 1671 bp, Enterobacter cloacae
atcaggaggttaataatgttatctgggcaaacacccacccggcaatggaacacccgacgcagtgagaaagcgcgtcgtctggcgtccgtaccggtgcagggcaaggtactgccaaccggcgatcttgtcgccatgctggaaaaactgatcgcaccaggcgacaaagtcgttctggaaggcaacaaccagaagcaggcggatttcctttcccgttcactggcggaagtgaacccgcaaatcgtgcacgatctgcatatgatcatgccgagcgtgggccgcagcgaacatctggacatctttgagaaaggcatcgcccgcaagctggacttctccttctccggtacgcaaagcctgcgcatttcgcagctgctggaggatggtcagctcgaaatcggggcgattcacacctacatcgaactctactcacgtttatacgtcgacctttcgccaaacgtggcgctgattgccggttttaaagcggaccgcaaaggcaacctctataccggggcgagtaccgaagataccccggcgctggtggaagccgccgcgttccacgacggcatcgtcatcgcgcaggtgaacgagctggtggatgacgagtgcgaccttccgcgtgtggatattccgggctcgtggattgattttgtggtggttgccgataagccgttctttatcgaaccgcttttcacccgcgacccacgcctgatcaaacaggaacacatcctgatggcgatgatggcgattaaaggcatctacgccgaacaccaggtgcagtccctgaaccacgggattggctttaataccgcagcgatcgaactgctgctgccaacctacggcgaacagctcggactcaaaggcaaaatctgtaaacactggactttgaacccgcatccaacgctgatcccggccatcgaaagcggctgggtggagagcgtccactgcttcggcggcgagctggggatggaagagtacatccgcgcccgtccggacgtgttctttaccggtgctgacggctccatgcgctctaaccgcgccttctgtcagctggctggtcagtacgcggtcgatatgtttatcggttccacgctacaggtcgacggttacgctaactcctcaaccgtgacccgcggccgtctctccggcttcggcggcgcgccaaacatgggccacgatccgcacggtcgtcgccacgccacaccggcctggctgaacatgatcaccgagcctgacccgatgcagcgcggtaaaaagctggttgtgcagatggtggaaaccttccaggcgggcgtgaagccaaccttcgtggaaaaactcgacgctgttgacgtcgcgaaagcctccggtatgccgctggcgccggtcatgatttatggcgatgacgtcacccacgtgctgacggaagaggggattgcttacctctaccgggcgaaagatctggaagagcgtcgcgccatggtcgccgccgtggcgggtatcaccgatatcggtctgggcgttgacgccaaacgcgtggcggaactgcgccagagcggcaaggttgtgtatccggaagatatgggcattcgtcgtaccgatgccactcgctctctgctggctgcgggcagcgtggctgacctcgttgagtggtccggtggtctgtataacccacctgcgaaattccggagctggtaa

SEQ ID NO: 2490 - DNA, 837 bp, Enterobacter cloacae
atcatgcgtgatgacagcagctttatcgaactaaaagcgcgccagcgtgcacaggcgctgctcgacgacggcagctaccgcgaactgctggatccgttcgaaggcattatctcgccatggcttgggccacaggggattgttcctcaggctgatgatggcatggtggtcgcgaaagggaccatcaacggccagcctgcggtggtggtggcgattgaaggcaccttccagggcggcagcatgggcgaagtgtccggcgccaaaatggcggcggcgctggagctggcggcggaagataaccgcaacggcattccgactcaggcggtactgtgcctcgaaaccggtggcgtacgtttgcaggaagccaaccttggcctggcggcgattgccgatatccacgccgcgatcgttgacctgcgtcgctataccccggtcgtcgggattgtcgccgggaccgtaggctgcttcggcgggatgtctatcgccgcggcgctgtgcagctatctgattgtgacccgcgaagcgcgtcttggcctcaacggcccgcaggttattgagcaggaagcgggcattgaagagtacgactcccgcgaccgtccgtttatctggagcatgaccggcggcgaagtgcgctatgaaagcgggctggtggacgcgctcgtcggcgacggcgtgaacgcggtgaaagccgcgatgaacgaggccatcgccaaaggcgtaccggcgaaacatcgcaccgataactacgacgattatctgaaccgtctgacgaatttcgacacccgcaaacaggccgatgccgaacagattaaagcgctttttgcccgggaggtgaaatga

SEQ ID NO: 2491 - DNA, 1059 bp, Enterobacter cloacae
ctggcaggctcagctcagtcgtgcgttgtgccgggcggatacacaggtggatacgcccgagggcggattcgcgctggcggaatggttacgcgacggcaaaacgctgctaaaaacgcaatatgggccgcgcctggtagcggatccatggcacagggaggagtaatgaaaatattgtttacctttccggggcagggcacacagcacgaaggtatgctgcaaaacctgccgggaacagagctggagcaggcccgtgctgtgctgggggcggaagttgataccctggacagcgcatcctcgttaacccacacccgcgcggttcagctttcgctgttgattgcaggcgtggcttgggcgcgcgagctggaacgtcgcggcgtgtcgccggatatcgtcagcgggctgtccattggcgcttatcctgcggcggttatcgccggtgcgctggactttacggacgcgctgaagctggtggcgctgcgcggcgatctgatggagcaggcgtatccccacggctacggcctgacggcgataatggggttgaccctgccccaggtggaaaacctgattcaggggacaggaacctatatcgctaacctgaacgccgaaacgcagatcgtgattgccggagccgatgacggcatggcgcaggtagccgaacgcgcgctggcgaagggcgcgaacaaggccaaacggctggcggtaagcgtgccgtcgcactgtgaattgctggcggaaccggcgcagaagctggccgcggcgtttgaatcagtcacgctttcacgcccccgctgcgcgtacctgagcggcagtaccgggcgcgtgctttggcagccagagaaaattgccgacgacctggcgatgaatatggcgcgaaccgtgcgctggcaggaggcggtgatttccgctaacgagcgcgaagcgcgtctggcgattgagatgccgcctgggggtattctgacctgtctgacgcggcaggcggcgtgggaaggcgaatccatttcgctggagcgcagcggagtggatgtggcggtgcatctggcgggtcggcttcagcggtga

SEQ ID NO: 2492 - DNA, 792 bp, Enterobacter cloacae
cgccttggccttgaagcgatccacaaagctttgcaggtgcgccacgcgctgctgctggctttcatacatcgcctgttgctgggcaaggcgcgtcgcgcgctggcgctcgaaagagctgtagttgccggtgtattcgaacatgctttgctgttcgatatgaatgattttatccaccaccggatcgaggaagtcgcggtcgtgggagatcagaatcagagtgccctgatagctcttgagccacttctccagccaaataaccgcatcgagatcgaggtggttggtgggttcatcgagcagcaggaggtcggagcggcagatcagcgcctgcgccaggttaaggcgcatacgccagccgccggagaaatcgctcaccgggcgttcaagctgttcgttgctgaaacccaggccgtgcagcaggctggaggcgcgggagcgaatggtccaggcatcgatggcgtccagcttgccgtggacggtggcgatggcgtggccgtcgttgcgttcgttggcggcgttgagctctgcttcgagcttgcggtattcacggtcgccgtcgataacatagtcgagcgcgggttcgctcaacgcgggcgtctcctggttcacccaggcgagctgccagttgcccgggaaggtaaagttaccgccatccgcgcttatctcgtttttcagcagtgccagcagggtggatttaccgcagccgtttttgccgaccagccccactttctggcccgggttgatggtagcagtcgcgttatccagcaggacgcgcacgccgcgacgaatttgtaa

SEQ ID NO: 2493 - DNA, 597 bp, Enterobacter cloacae
cccaaaacgacaacaatacacaaaaacagaaccgggaggggaatgatgtctcagacagcgaaagtgctgctgctgtatgcccatccggaatcacaggactcggtggcgaaccgggtgctgcttaagccggccacacagctcagtaacgtaacggtgcacgatctctacgcgcactatcccgatttttttatcgatattccttacgagcaggaactgctgcgtcagcacgacgtgattgtgttccagcatccgctttatacatacagctgtccggcattgctgaaagagtggctggaccgcgtgctgagccggggcttctccagcggggtggggggcaaccagctggcgggaaagtactggcggagtgtcattaccaccggtgagccggaaagcgcttaccgtcacgacgggctgaaccgttaccccatgagcgacattctgcggccgtttgagctgacggcggcgatgtgccgtatgcactggatgagcccgattattatctactgggcacggcggcaggatccgaaagcgctggcgagccatgccagggcctatggcgaatggctggcgtcaccgattccggcgggaggacgctaa

SEQ ID NO: 2494 - DNA, 564 bp, Enterobacter cloacae
ccggaattaacgggtcccgtaaaccacgatggttttaccgtgggcggagatcaggttctgatcttccagcatcttcaggatacggcccactgtttcacgggagcagccgacgatctgaccgatttcctggcgggtaattttaatttgcataccgtcagggtgagtcatggcgtctggttgtttcgccaggttcagcagcgtctgcgcgatacgaccggttacgtccaggaaggcgaggttacctaccttctcagaggtcacttgcagacggcgtgccatctgggaagagagacgcatcaggatgtcagggttgacctgaatcagctgacggaatttcttataagaaatttcagccacttcacatgctgtttttgcacgaacccaggcgctacgttcctggccttcttcaaacaggcccagttcaccgataaaatcgccctggttcagataagaaaggatcatctctttcccttcttcatctttgatcagcacggccaccgagcctttaacgatgtaatacaacgtttccgctttttcaccctggtgaatcagcgtgctctttga

SEQ ID NO: 2495 - DNA, 198 bp, Enterobacter cloacae
tgggtacttatgaatgtggcaatgagacaagaaccattcgagagtcgggtctgtttgcggtttgccaagcaccatgcgctgttatcctctgttataagctgtcaccagagtcataagatgcatccggactctggggttgcaatcgaattcttacccatacctgggaagtcggctgtcgtaacgtttcgcagccagtaa

SEQ ID NO: 2496 - DNA, 696 bp, Enterobacter cloacae
agccgtgctgctgttgagctccatactgtgtatcctgtcgctgccgctgtttatctcgctgacttcaggaatgtaatcatgaccacaacattacgcccacacgacctcatctggcttaccgcgcgcgacgccctggaagggattactgaatcctgggtggacgcggcctggcataccgggctaccggtagtggtacggcgtgatgttgataatgaaggccgtattcccgttggcgtgcgcggattgcgccgcgaccagcgggcggccggatgggtgaagcctgagaacgtgttgcgcgtggtgtcgcccgaagatttgagcgttgccgccgacctgctgcgttcgccgtttatcacccagccgccggttcaggtggcgcttcagcttgcgcagcagtcatggccgtggacgtgggggataaccggcagtacgggttacgcgctggcgaccggcattccggtgatccacgccgacagcgatctcgatctgctgatccgcgccccgtgtaccgtttcccctgaggcgtttactgactggcaggctcagctcagtcgtgcgttgtgccgggcggatacacaggtggatacgcccgagggcggattcgcgctggcggaatggttacgcgacggcaaaacgctgctaaaaacgcaatatgggccgcgcctggtagcggatccatggcacagggaggagtaa

SEQ ID NO: 2497 - DNA, 672 bp, Enterobacter cloacae
gtttttttaagcttaagggtacacgggtgcagatttccgctacaatctgcgccagcaattttcccacgctcaggagatatcatgaaagtagcaaaagacctggtggtcagcctggcctatcaggtacgtacagaagacggtgtgttggttgatgagtctccggtgagtgcgccgctggactacctgcatggtcacggttccctgatttccggcctggaaacggcgctggaaggccatgaagttggcgacaaattcgacgttgctgtaggcgcgaacgacgcttacggtcagtatgacgacaacctggttcagcgcgttcctaaagacgtattcatgggcgttgacgagttgcaggttggcatgcgcttcctggcggaaactgaccagggtccggttccggttgaaatcactgaagttgaagacgaccacgttgtggttgacggcaaccacatgctggcgggtcagaacctgaagttcaacgtagaagttgttgcgatccgtgaagcgactgaagaagagctggctcatggccacgttcacggtgcgcacggtcacgaccatgaccacgatcacggccatgacggctgctgcggtggtcacggccacgaccatggtcatgaccacggccacggtaaaggtggttgcggtaacggcggctgcggttgccactga

SEQ ID NO: 2498 - DNA, 423 bp, Enterobacter cloacae
cgggtggaaggaggttgccggtacgccacaactgatgcaggacgccgtctaatgagtaacgcaccgcaactttatgccctttatcagcaactccttgagcagagccagttgatgttgcgactggcccggcagggactatgggatgatctgatcatctgtgaaaccgactatgttaatgcggtgcactcactggctcgtctcactcaggaaagtgaaccttcgacgcagattcaggagcagcttcgcccgacgctgcgggtgatcctggacaacgaaggccaggtaaaaacgttgctgcaagccagaatggatgagctggcgaagctggttggtcaatcctccatccagaaaaccgttctctccacctacggtaaccagggcggtcatgtcctggttccgcaaagtaatagcgatatcaattag

SEQ ID NO: 2499 - DNA, 1713 bp, Enterobacter cloacae
cgtaaaccaccaggatttaagaggtgcgcaatgagtgcgacagcagcatcgacagcgccacagaataaatcactcgagtggatgaaccgccttcgcgccaaccctaagatcccgttgattgtggcaggcgctgccgccattgcgatcgttgtcgcgatggtcttatgggcaaaaagcccggattaccgcacgctctacagcaacctttccgaccaggatggcggtgccatcgtcacccagttaacccagatgaacatcccgtatcgctttgccgataacggcggtgcgcttgaagtaccggcagataaagtgcacgagcttcgcctgcgtctcgcccagcaggggctgccaaaaggcggcgcggttgggtttgagctgctggatcaggaaaaattcggcatcagtcagttcagcgagcaggttaactaccagcgcgcgctggaaggtgagctggcccgtacgattgaaaccttaggcccggtgaaaagtgcccgtgtgcacctggcgatgcctaagccgtccctgtttgtccgcgaacaaaagtccccttctgcctctgtgaccgttaacctcgaacctggccgtgcgctggatgaagggcagatcagcgccgtcacgcacctggtctccagcgcggtggccggtctgccgccaggtaacgtcacgctggtggatcagagcggtcatctgctgacgcagtccaacaccgccgggcgcgatctcaacgacgcccagctgaaatacgccgccgacgtggaaggccgtcttcagcgtcgcattgaagcgattctgggcccggtggtcggcagcagcaatgtgcacgcgcaggtcaccgcgcagattgatttctcgaataaagaacagaccgaagagcagtacgctccgaacggggatgcctcccgcgccgtgttacgctcgcgtcagatcaatgagacggaacaggtcggcggccagtatcctggcggtgtgccgggcgcgctctctaaccagcctgcgcctgccaacgccgcgccaatctccaccccgccggcaaacccgcagaacggtcagcaaacgaatcagcagacgacctcgaccgcgaacagtaccggcccgcgtaacagcagccgtaacgaaacgaccaactacgaagtcgaccggaccatccgccataccaaactgaacacgggcgatattcagcgtctctctgttgccgtggtggtgaactacaaaacgctgccggacggtaaaccgctgccgctcacggcggagcagatgaagcagatcgaagatttgacccgcgaagcgatgggcttctctgaaaaacgtggcgataccctcaacgttgtgaactcaccgttcaacccggtggatgagaccggtggcgaactgccgttctggcaacagcaggcgttcttcgatcagctgatgtccgcaggccgctggctgctggtgctgattgtcgcgtggctgctgtggcgtaagggcgttcgtcctcagctacagcgtcgtgctgaagccgagaaagccgcgctggaacagaagaacgcgcgtccggacgaggaagaagcggttgaagttcgtctcagcaaagatgaacagatgcagcagcgtcgtgctaaccagcgcatgggcgcagaggtgatgagccagcgcattcgcgaaatgtcagataacgatccgcgcgtcgtcgcgctggtcatccgcggttggatgggtaacgaacatgagtaa

SEQ ID NO: 2500 - DNA, 1215 bp, Enterobacter cloacae
atgatcacactgcaacaactgctgatgaccgacagcgacccgtccggcggcacgcttgccgggaaaggcgctgagggcgcgcaagattttctctctctgctggcgggcgcgctgaccgagaccactggcaaaggcaaagatgctccgctgacgctggccgatctaaaagcggcgggaagcaagctgtcgacagcggcacaggaaaaaaacggtgataccacgctccaggccaaaatcgccgagctgctctcccgccaggagacgctgaccggtgaagataccgccgtctccctgcaaagcctcgtctccggcctgaaacccgccgcgaatacggatgcgctgaaggcgctaacccagccggaggcgaaaacaaacagcgagaccacgactgaagaagaggagctggccgggttaagcgcgctgatggcgatgttaccgcaccagcagaccaccaccccggtagcgacgcagcctgcgagcaccggggagatcgccccccgtgccgccctcccctctgcgctagcccagacggataacggccagcatcagccgcttagccatgcgttaacgggtcaggaaaaaatgccggttcaggacagcgacacctcgctgcccgccacggcagccgttacgccagccgtcgccgccgtcgcggagaagcaggacgtagcgagcgcggcgtcgcctgccgccagcccaaccgcgacgcttgccccgatcgtcagtcacctggcgccttcacagcctgccgctaccgttgcgacagcgccggtgttaagccagccgctgggcacgcacgaatggcagcagaatctgagccagcacatcaccctgttcaccagacagggacagcagaccgcagagctgcgtctgcacccggaagatctgggtcaggtgcaaatttcgcttaagctggatgacaaccaggcacagttgcagatggtttcgccccacagccacgttcgcgcggcgctggaagcggccctgccgatcctgcgcacgcagcttgcggaaaacggcattcagctttctcaaagcagcgtcagcagcgagggctttgccgggcagcagcagtcctcatccgggcagcaacagcacgcttcgcgttccggccagcatggcgggtttaacgatgagagtgaagagttattgcctgcccctgccgccctgcaatccgccgcacgcggcagccgtgccgtagacatctttgcctaa

SEQ ID NO: 2501 - DNA, 441 bp, Enterobacter cloacae
atacggcgtacgtatcaccgacatcattaccccttccgaacgtatgcgtcgtctgagccgttaagtatgaaaacccaggcaacactgtccgcgccctccgccgtacccggctcaccgctgctccaggtgagcggcgcgctgttcggtattattgcctttatccttatcgccgcctggctggcaaagcgtttcggtctggcggggaaaacggccggtacccgcgggttgaaggtcagcgccagcaccccgctaggaccgcgcgaacgcgtggtcattgtggaggtggaagatgcgcgactggtgctgggcgtgaccgcctccagcattaacgttcttcacaccctgccccctgcgcctgccacggtggaggctaacgcccaggcccctgcggatttccagtccgttatgaagagtttgctcaagcgtcccgggagatcctga

SEQ ID NO: 2502 - DNA, 387 bp, Enterobacter cloacae
tggttccgcccgcgaccattgccctgccctttaagatcatgctgttcgtgctggtcgacggctggcagctgctggtcagctcgctggcgcagagtttctacagttgaggagcgcgcaatgacgcctgagtcggtcatgatgatgggcacggaggcgatgaaagtcgcgattgccgtcgccgcgcccctgctgctggttgcgctagtcaccggtctgattatcagtattctccaggccgccacgcagattaacgaaatgaccctgtcgttcatcccgaagatcattgccgtcttcgtggcgattatcgttgccgggccatggatgctcaatttgctgctggactatatgcgcaacctgttcaccaatctgccttacatcatcggctga

SEQ ID NO: 2503 - DNA, 792 bp, Enterobacter cloacae
cggacgatgctgcatttcaccagcgatcagtttgttcagtggctcgggatctatttctggccgatgctgcgcatcatggcgctgatctccaccgcccccatactcagtgaaaagtcggtgcctaaacgcgtcaaaattgggctgggcatggttatcacgattatcgttgccccttccctgccggcggtggatatcccgatcttttccccgaatgcgatctggattgccctgcaacaggtgatgattggcgtagcggtcggattcacgatgcagctcgccttcgccgcggtacgaacggcgggtgaacttatcggtttgcaaatgggcctgtctttcgcgacgttcgttgacccgggcagccacctgaatatgcccgtgctggcacgtattatcgacctgctggcgatgctgttgtttctctcgttcaacggccacctgtggctcatctcgatgctggtggacaccttccacacgctgccgattggcgacaacccggtaaacagcaacgcgtttctggcgctggtgagggctgccgggctgatcttcctcaacgggctgatgctggcgctgccgatcattaccctgctgctcaccgttaacctcgcattaggtttactcaaccgaatggctccgcagctgtcggtattcgtcatcggctttccggtgacgttgacggttggccttttattaatgtcattattgatgccacttatcgcccccttctgcgaacatttattcagtgagatattcaatctgttagcggatattgttagcgaacttccacgcaaataa

SEQ ID NO: 2504 - DNA, 633 bp, Enterobacter cloacae
gggtatgccatgtcaacgatcattatggatttatgcagatacacccggctagggttaaccgggtacttagcaagcagaggggttagaaagagagacatcaacgatgcacacaccgttgaagaactcgcagccgcttgtgacgcccacaagcccggcgtggtgtttattaatgaggactgtttcattcacgaccccgctaacagtcagcacattaagcagatcattaatcagcatcctaagaccctgtttattgtttttatggcgatcgccaatattcatttcgatgagtatttgttggtgcgtaaaaacttattaatcagctcgaaatcgattaaaccagagtcacttgatgacattctgggcgattatttgaataaagaagttaagaatgtaggggcgattaacttacccaccctatcattaagcagaactgaatcaagtatgctaagaatgtggatggctggacaagggacaattcagatctcagaccagatgaatatcaaggcaaaaacagtatcgtcacacaaaggaaatattaaaaggaaaattaaaacgcataataagcaagtgatataccatgtcgtacgcctgacagataatgtgacgaatgggattttcgttaatatgcgctaa

SEQ ID NO: 2505 - DNA, 927 bp, Enterobacter cloacae
attttggttatgagtataaacctgcgccgcgtgtgggtttgtcgggatcgtttccacttaaacggcgcttcaatgcctattttttttaagatttttcttaggaaaaatcatcatccgggagacattatgccttcgcttgaggagactcttcttgtctttaccgacctcgacggcacgctgttggattttcacacccttgactggcagcctgcggccccgtggctggaaaaattaatggatgaacagataccggtcattctgtgcagcagcaaaaccgcgtccgagatggatgacatccagcaggaactggggcttggcgggctgccctacattgcggaaaacggcgcggtgatccagcctgacgtacggtgggaaaacgccgcacggttcatctcagaaaagaagcatgacgagatccggcagtgtattgcccgggtacgccaggagatgcatctgaaattcaccaccttcgatgatgtggacgagcacgtagtcgccgaatggaccgggctgagtcgtccccgttcggtgcttgcgcgcaagcacgaggcttccgtgacgctgatctggcgtgacagtgatgaacaaatgaaatactttgccgccgaactcgcccggcagcggctgaagatcgtccagggtgcacgcttctggcatattctggacacctgctgcggcaaagacgtggcggttcactggcttgtggaccagtatcgcctgcacgagggctacgaaccgacgacgctaggcctgggcgacggccccaatgatgccccgctgctggacagcgtaggcttcgccgtggtggtgaaaggcttcaaccgggagggcatcagccttataaacaacgatccagcccgggtttatcacactcagcacaccgggccgaccggctggtgcgagggacttgattactttttgaggtga

SEQ ID NO: 2506 - DNA, 1422 bp, Enterobacter cloacae
ggaataaatatggcaagtatttctacgttgggagtcggatcaggtttgcagttaggcgacattctggacagtctgaccgctgcacaaaaagcacagctgacgccgatctctaagcagcaaacttcctatacagcaaaacttagtgcctacggcacgctgaaaagtgcattggaatccttccagacggcaaatactgcacttagcaaagccgatctgtttacagcgactaccaccgccagcagcagcacagccttcagtgccacaaccagcggcagcgcgattgcgggtaaatacaccattaacgtatcgcagcttgcgcaggcgcaaaccctgacaacagctaaaacgcaaagtgataataaaacggcgattgcgacagcggacagcaccatcaccattcagcaaggtggtgacaagaaacctgtcactattaatatcagtgcggaaaactcatctctgagtggtatccgagatgcgatcaacaaagcggatgctggcgtaagtgccagtattattaacgtcggtaatggtgagtatcgtctgtccattacgtcgaaagataccggtaaagacaatgccatgactattagtgtcagcggcgatacggcacttcagtccttcatgggctacaacggtaatagcgcagataccgctaacggcatgatggaaagcgttacggcccaaaatgcgctattgaaagttaataacgttgatattgaaaacagcagcaatacaatcagtgatgcgctggaagatatcactctcaacctgaacgacgtgacaaccggtaatcagaccttaacgatcactaccgataacactaaagcgaccaaagcgataaacgactgggtgacggcgtataactccctgcaagatactttcagcagcctcacaaaatatactgctgtggacgcgggttcagacgctcagaataccagcaacggcgcgttattaggcgacagtacgctacgcactattcagactcagttgagaagcgtgctgaataaccctcacaccagttccaatatcaagacccttgctcaagctggcatcactaccgacccaagcaccggtaaactggaagtggatgatgacaagcttagcgcggcaatgaaaaacagcgcggctggtatcaaagacctgctgatcggtgacgggaaaacatccggtatcaccaccaccgttggaacaaaccttacaggttggctctccagcaccggcatcattcaggctgccaaagatggcgtcagtaaaaccctgaacaatttaactaagcaatataacgcggccagcgagcgtatcgacaccatggtagcgcgttataaagaacagtttacgcaattagacgtcatgatgaactcgctgaactctaccagcagttacctgacgcagcagttcgaaaatacgtccagcaacaagtag

SEQ ID NO: 2507 - DNA, 438 bp, Enterobacter cloacae
acgctaatcagacccgagggggataacatgtacggcgcaaaaggcacgcaagcctacgcaaagatagaagttgaaagcgcggtgatgagcgccagccagcagcagctggttatcatgctatttgatggagccctcagcgcgctggtacgcgcgcgtctgttccttgcagacggtaatatcccggcaaaagggctggcgctctcaaaagccatcaacattatcgaaaacgggctgaaggttggcctggtggaaaataatggggatgagcttacgcaaaacctgattgccctttatgcctatatggtacgtcgcctcctgcacgccaacgtgaataacgacgccagcgccatcgaagaggtggaaaacctgctgcgcaatatcgctgacgggtggaaggaggttgccggtacgccacaactgatgcaggacgccgtctaa

SEQ ID NO: 2508 - DNA, 1077 bp, Enterobacter cloacae
gccagcgcattcgcgaaatgtcagataacgatccgcgcgtcgtcgcgctggtcatccgcggttggatgggtaacgaacatgagtaatacgcttacaggcaccgataagagcgtcatcctgctgatgaccattggggaagatcgcgcggcggaggtgtttaaacacctctcccagcgagaagtgcagatcctcagcgcggcgatggccaacgtgcgccagatctctaacaagcagctgaccgaggtgctggcggagtttgagcaggaagccgagcagtttgccgccctcaacgtcaacgccaacgaatacctgcgctccgtgctggttaaggcgctgggcgaagagcgcgccgccagcctgctggaagatattctcgaaacgcgcgacaccgccagtggcatcgaaacgctcaactttatggagccgcaaagcgctgccgatcttattcgcgacgagcacccgcagattatcgccaccattctggtccacctcaaacggggccaggcggccgatattctggcgctgttcgacgagcgcctgcgccacgacgtgatgctgcgtatcgccaccttcggcggcgtccagccagccgcactggcggagctgaccgaagtgctgaacaacctgctcgacggccagaacctcaagcgcagcaaaatgggcggcgtgagaacggcagcggaaatcatcaacctgatgaaaacgcagcaggaagaggcggttattacggcggtacgcgagttcgacggcgagctggcgcagaaaattatcgacgagatgttcctgttcgaaaacctggtcgaagtggacgaccgcagcatccagcgcctgcttcaggaggtggactccgaatcgctgcttatcgccctcaaaggcgccgagcagccgctgcgcgagaagttcctgcgcaacatgtcccagcgtgcggccgatatcctgcgcgacgacctggccaaccgtggcccggtacgtctgtctcaggtggaaaacgaacagaaagcgatcctgcttattgttcgtcgactggccgaaaccggcgagatggtgattggcagcggagacgacacctatgtctga

SEQ ID NO: 2509 - DNA, 1443 bp, Enterobacter cloacae
gggcgatctggatgccagcgtcgcgacccgctggcaggaactgtgccgcctggcggcaccgggagtcgtctgatgaccgctcgccttacgcgctggcttaacacgcttgataattttgaaacgaagatggcgcagctgccatccgttcgtcgttatggacgcctgacgcgcgccaccggtctggttctggaagccacggggctgcaacttccgctcggcgccacctgcgtgattgagcggcaggacgggggggagacgcgtgaagtggaaagcgaagtggtcgggttcaacggtcagcgcctgtttctgatgccccttgaagaagtggaagggattttgcccggcgcccgcgtctacgcgaaaaacattagcggtgacggcctgcaaagcggcaaacagctcccgctcggtccggcgctgctgggccgcgtcctggacggaagcggcaaaccgctcgatggcctgccctcccctgataccaccgaaaccggcgcgctgatcacccaacccttcaacccgctgcaacgcacgccaatcgagcacgtactggataccggcgtgcggccgattaacgccctgctcaccgtgggacgcggccagcgtatggggctgtttgccggttccggcgtgggtaaatcggtcctgctcggcatgatggcgcgttatacccaggcggacgtgatcgtcgttggcctgattggtgagcgtggtcgcgaagtcaaagatttcatcgaaaacattctgggtacggagggccgcgcccgctcggtggtgatcgccgcgcctgcggacgtgtcgccgctgctgcgtatgcagggtgccgcctacgccacgcgtattgcggaagatttccgcgaccggggccagcacgtgctgctgattatggactccctgacccgctacgcgatggcgcagcgtgagattgcgctggccatcggcgagccgcccgcgaccaaaggctacccgccgtcggtcttcgccaagctcccggcgttggttgagcgcgcggggaacggcatcagcggcggcggctccatcaccgcgttctatacggtactgaccgaaggtgatgaccagcaggacccgattgccgactccgcgcgcgcgatcctcgacggccatatcgtgctgtcgcgccgtctggccgaagccgggcactacccggcgattgatattgaagcgtcgatcagccgtgcgatgacggccttgatcaccgagcaacactacgcccgcgtgcgtaacttcaaacaactgctctccagcttccagcgcaaccgcgatctggtaagcgtcggggcgtacgccaaaggcagcgacccgatgctcgataaagcgattgccctctggccgcagctggaggcatttctgcaacagggtatttttgaacgcgccgactgggaagattccctccaggcactggagctgattttcccgcaggtgtaa

SEQ ID NO: 2510 - DNA, 465 bp, Enterobacter cloacae
cacaggtggagggcgaaggtcatggcgcagaacagcgcgttatcaacgctgaaagatctggctgaaaaagaagttgatgatgccgcattgcagcttggcgcaatgcgacgcgggtgccagcaggctgaagaacagttgaagatgttaatcgactatcagcatgaatatcgcaccaaccttaacaccgacatgacgcagggcattggtagccagcgctggattaactatcagcagtttatccagacgctggaaaaggcgattgagcagcatcgccagcagcttaaccagtggacgcaaaaagtcgataccgcgctgaatttctggcgcgagaaaaaacagcggttgcaggcctggcaaaccctacaggaccggcagattgcagcctcgaccctggcggaaaaccgtctggatcagaaaaaaatggatgagtttgcccagcgcgcatcaatgaggaaacctgaatga

SEQ ID NO: 2511 - DNA, 528 bp, Enterobacter cloacae
gccggacacgggataatcaccgtattaagctgtaccgaaacaggaagctcgtatcagatgacagactccgctatcaccaaaaaaagcaagcgttccatctggatcccgctgctggtgttgattaccctcgcggcctgcgccaccgcaggctacagttactggcgtatgcagcaggaaccctccagcgcggccgccaaagctgaagcgccgcctccaccggcgccggtcttctacccgctggatacgttcaccgtgaacctgggcgatgcggatcgcgtgctttacgtgggtattacgctgcgtctgaaagatgaagcgacccgtgcacgtctaaacgactacctgccagaagtgcgtagccgtctgctgctgctgttttctcgtcaggatgcctccgcgctcgccaccgatgtgggcaagcaaaagctggtcgatgccatcaaacagacgctggcgaccccgctggtaaacggccaacctaagcaggaagtcactgacgttctgtatacagccttcattctgcggtaa

SEQ ID NO: 2512 - DNA, 426 bp, Enterobacter cloacae
ggaacagcccaaatgagtgacatgaacaatccgtccgatgaaaacagcggagcactggacgatctgtgggctgacgcgttaaacgagcagaaaacgacgccgacgaaaagcgcggcagacgcggtctttcagcagttaggcggcggcgacgtcagcggcacgttgcaggacatcgacctgattatggacattccggtcaagctcaccgttgagctgggtcgcacccgcatgaccattaaagagctgctgcgcctgacgcagggttccgtggtggcgcttgacggtttagcgggtgagccgctggatattctgatcaacggctacctgattgcacaaggcgaagtggtggtggtggccgataaatacggcgtacgtatcaccgacatcattaccccttccgaacgtatgcgtcgtctgagccgttaa

SEQ ID NO: 2513 - DNA, 1560 bp, Enterobacter cloacae
ccgtttcgttcgccaggcatttctgccaaacctgctccatacttgagtttcgcgacctcatggagatggtgcatgcgcaacccaacacttttacaatgttttcactggtactaccccaccggcggtgaactgtggcgagaagtcacggcattagcccccaatctgaacgaaatcggcatcaatatggtctggttaccgccggcctacaaaggggcatccggcggctattccgtcgggtatgactcttatgaccttttcgacctcggtgagtttgaccagaaaggcagcgtcgccaccaaatacggcgataaagcccagttgctggaggccatcaacgccttaaaaagtaaccagattgcggtgcttctggacgtggtggtcaaccacaaaatgggggccgatgagaaggaacccgtccgcgtgcagcgcgtggatgcgcaggatcgcacccaaatcagcgatgagatcatcgaatgcgaagcctggacgcgctacacctttcccgttcgggccggccagtattcgcagttcatctgggattacaaatgctttagcggtatcgaccacattgaaaaccccaatgaggacggtatcttcaaaatcgtgaacgactacactggcgaaggctggaacgatcaggtcgacgacgagatgggcaatttcgattacctgatgggtgaaaatattgattttcgcaaccacgcggtgacggaggagatcaaatactgggcgcgctgggtgatggagcaaacccactgcgacggcttccgccttgacgcggtaaaacacatcccggcctggttctataaagagtggattgagcacgtccaggaggtggccccgcagccgctgtttatcgtggcggaatactggtcacacgaagtggataaattgcagcactacatcaatcaggtggacggcaaaaccatgctgtttgatgcgccactgcaaatgaaatttcacgaagcctcacgccagggacgcgactacgatatgagccagattttcaccggtacgctggtggaagccgatccgttccatgccgtgacgctggttgccaaccacgacacccaacccttgcaggcgctggaagccccggttgaagcctggttcaaaccgctggcctacgcgctcatcctgctgcgtgaaaacggcgtgccgagcgtgttctacccggatctttttggcgccagctatgacgacaccggcggggatggcgagacgtatcacatcgatatgccggtgattgaacaactccacgagcttatcctcgcccggcagcgttttgcccacggcgtgcagacgctgtttttcgatcatccaaactgtattgcgttcagccgcagcgggactgaggagcacccgggctgtgtggtggtgctgtcgaatggtgatgacggcgagaagacgatctgcctcggggaaaattacggcaataagacctggcgtgattttttaggcaaccgcgaggaaaccgtgaccacggcggcggatggcgaagggacgttcttctgtaacgggggaagcgtcagcgtctgggtgattgaggacgcgctgtag

SEQ ID NO: 2514 - DNA, 729 bp, Enterobacter cloacae
ttggcagcggagacgacacctatgtctgatgaactgtcgtggaagcgctggacgcctgacgacctctcccctcccagcgcagagttcacccctgccgttgtgtcgtccgacgagggtgacgccggggcgggcgaacccgagctgagtgaagaggaacagcgcgcccagttgctggcccagatgcaaatgcaggcgcacgaacagggcttcaatgcagggatgaacgaaggccgtcagaccgggcacgcacagggttatcaggaagggctggcgaaaggtttagagcagggcatcgagcaggcgcgccagcagcaggcgccgctacatgcccgcatgcagcagctggtgagcgagtttcagcatacgctggatgcgctcgacagcgtgattgcctcgcgcctgatgcagatggcgctggaggcggcccgtcaggtgatcggccagacgccgatagtggataacgccgcgctgattaagcagatccaggggctactccagcaggagccgctgttcagcggcaaaccgcagctgcgcgttcatcctgatgatttgcagcgcgtggaagagagcctcggcgcgacgctgagcctgcacggctggcggctgcgcggcgatccgtcacttcatcatggaggctgtaaggtctcggcggatgagggcgatctggatgccagcgtcgcgacccgctggcaggaactgtgccgcctggcggcaccgggagtcgtctga

SEQ ID NO: 2515 - DNA, 1068 bp, Enterobacter cloacae
acggccaacctaagcaggaagtcactgacgttctgtatacagccttcattctgcggtaacgacatgggcgacagtattctttctcaggcagaaatcgatgcgctgctcaacggcgacagcgataagagtgacgaaccgaaaccgggtctgaccggcgacgataatattcgtccctacgatcccaatacccagcgtcgcgtggtgcgcgagcgtttacaggcgctggagatcatcaacgaacgtttcgcacgtcagttccgtatggggctgtttaacctgctgcgtcgtagcccggatatcaccgtcggtgccatccgcattcagccgtatcatgagtttgcccgcaacctgccggtgccaaccaaccttaacctgatccatctgaaaccgctgcgcggtaccggcctggtggtgttttcgccaagcctggtgttcatcgcagtggacaacctgttcggtggcgatggtcgtttcccgaccaaagtggaaggccgcgagtttacccataccgaacagcgcgtgattaaccgcatgctgaagctggcgctggaatcctacagcgacgcgtggaaagcgattaacccgctggaagtggagtacgtgcgttccgagatgcaggtgaaatttaccaacatcaccacctccccgaatgacatcgtcgtgaataccccgttccacgtcgagatcggcaacctgacgggcgagttcaacatctgcctgccgttcagcatgattgaaccgctgcgcgaactgctggtgaacccgccgctggagaactcacgtcacgaagatcagaactggcgtgagaacctggtgcgtcaggtgcagcactcgcagctggagctggtagccaactttgccgacatctccatgcggttatcgcagatcctgaaattacaacccggcgacgttttgccgatagataaacccgaccgcattattgcccatgtggatggcgtacccgtgctgacaagccagtacggcacgattaacggccagtatgcgttacgcgttgagcacttgatcaacccgattttgaattcgctgaatgaggaacagcccaaatga

SEQ ID NO: 2516 - DNA, 804 bp, Enterobacter cloacae
cgcccaggcccctgcggatttccagtccgttatgaagagtttgctcaagcgtcccgggagatcctgatgcgccgtttgttattccttacgctggcaggcctgggcctgttcgcgccctctgtgtatgcgcaactgccggggctggtttccacgccgctggcgaacgggggacaaagctggtccctgtccgtgcagacgctggtgttcatcacctcgctgacctttatcccggcgatcctgctgatgatgaccagcttcacccgcatcatcattgtgtttggtctgctgcgaaatgcgctcggcacaccgtccgcaccgcccaatcaggtgctgctgggtttagccctgttcctgacctttttcattatgtcgccggttatcgacaagatttacaccgaggcgtaccagccgttcagcgaagataaaatttccatgcaggttgccctggaaaagggggctcagccattacgtgaatttatgcttcgccagacgcgtgaagcggatttggccctgtttgcccgtctcgctaacacgggcgagttacagggaccggaagcggtgccgatgcgcatcctgctgccagcgtatgtcaccagcgagctgaaaaccgcgttccagattggcttcaccattttcattccgttcctgattatcgacctggtgatcgccagcgtcctgatggcgctcgggatgatgatggttccgcccgcgaccattgccctgccctttaagatcatgctgttcgtgctggtcgacggctggcagctgctggtcagctcgctggcgcagagtttctacagttga

SEQ ID NO: 2517 - DNA, 258 bp, Enterobacter cloacae
ctgttgagacggttaaatgaggagcccgccatgaagactgacaaagagtacagcgacaccattaagcgtgaggttgaagtggatgtcgatgccctgcttgccgccatcaatgaaattagtgagtccgaagttcatcgcgcggaggataattcagaccgtgtcgtggtcaatggtcgggattaccatacctaccgtgaactggctgaagcattcgagctggatatccatgactttagcgtctcggaaacgaaccgctaa

SEQ ID NO: 2518 - DNA, 348 bp, Enterobacter cloacae
tggtgtcgctgtactctttgtcagtcttcatggcgggctcctcatttaaccgtctcaacagctaagtatagaccgcacacaaaaacgccattcgcgccaggcggcgatgccaggcaatgtaatttgttctacactggctcaaaaccacaggaggaatgtatgaaggtcaacgatcgggtaaccgtcaaaacggacggtgggccgcgccgcccgggcgtggttctggcaatagaagagtttaatgaaggcacaatgtatctggtgtcgctggaagattacccgctcggcatctggttcttcaacgaactggggcacccggatgggatctttgtggaaacggcggaatag

SEQ ID NO: 2519 - DNA, 309 bp, Enterobacter cloacae
cgcgccatcatgccgagcaggaccgatttacccacgccggaaccggcaaacagccccatacgctggccgcgtcccacggtgagcagggcgttaatcggccgcacgccggtatccagtacgtgctcgattggcgtgcgttgcagcgggttgaagggttgggtgatcagcgcgccggtttcggtggtatcaggggagggcaggccatcgagcggtttgccgcttccgtccaggacgcggcccagcagcgccggaccgagcgggagctgtttgccgctttgcaggccgtcaccgctaatgtttttcgcgtag

SEQ ID NO: 2520 - DNA, 336 bp, Enterobacter cloacae
aaaaccatccaggggagagtcatggctatacagggcattgaaggggtactcagtcagttacaggcaacagcgatgaccgcccgtaatcagagcgtggctgaccagccgccgggcgtcagtttcgccggtcaactgcatgcggcgctggaccggatcagcgacaagcaaaacgcagcccgtacccaggctgagagatttacccttggcgaacccggcgtggcgctcaacgatgtgatggccgatctgcaaaaagcgtcggtgtcattgcagatggggttgcaggtgcgtaacaagctggtgtcggcataccaggaagtgatggggatgcaggtttaa

SEQ ID NO: 2521 - DNA, 489 bp, Enterobacter cloacae
tcaatacctatcttacgctggcagcctgatggctttaatgccacaatatttttttcttcgcatgcaggaaagatgatgaaaaaagtagcaattgtggctgcaatgctgacgttagcgggatgcgttcaggtcgaaaactatcaggaagtggttaagcatccggcaccttcgcaactggcaggttactggcagtcgaaaggtccgcagagcgcgatggtgagcccggaagcgatcgccacgctggtggtgacgccagaaggggatacgctggattgccgtcagtggcagcgcgttatcgcggtgccgggtaagatcatgctgcgttcagatgattattataacgtgacgcgtaagctggatgtctatccgctggagcgtgatggggcggcgctggagtatgacggtatggaactgtacaaggttgaccgtccaacggtggaatgcgcagattacctgagtaagaatccgctggagagtaagcttccgtaa

SEQ ID NO: 2522 - DNA, 810 bp, Enterobacter cloacae
cccctcatttcacccactattcacccgattaaaacccctccagaatcggataatcatgccgataactcaactaacgcagggctgtttatcgtgaattcactctataccgctgaaggtgtaatggataaacactcgctgtggcagcgttatgttccgctggtgcgtcacgaagcattgcgcctccaggtgcgtttgccggcgagcgtggaactggacgatctgctacaggcgggcggtatcgggttattgaatgcagttgaccggtacgacgctctgcaaggaacggcatttacgacttacgcagtgcagcgtattcgtggtgcgatgctggacgagctgcgcagccgcgactgggtgccgcgcagcgttcgccgcaacgcgcgcgaagtggcgcatgcgatggggcagctggaacaggagctggggcgcaacgcgacggaaaccgaagtagcggagcgtctgggcattcctgttgaagagtatcgccagatgttgctcgataccaataacagccaactcttctcttatgatgagtggcgcgaagagcatggcgatagcatcgagctggtgaccgatgaacaccagcaagagaacccgttacaccatttactggaagggaatttacgccagcgcgtgatggaagcgattgaagctttaccggaacgtgagcaactggtgttaaccctctattaccaggaagagctcaatctcaaagagattggcgccgtgctggaggtgggcgagtcacgggtgagccagctgcacagccaggccattaaacgcctgcgcacaaaactgggtaagttatag

SEQ ID NO: 2523 - DNA, 567 bp, Enterobacter cloacae
caaccaggagttatcatgacggtgcagcaatctaaaagacggcctttaagccgctacctgaaagactttaaacacagccagacgcattgcgcccactgtaaaaaattactcgaccgcatcacgctggttcgtcgcggtgaaatcgtgaataagattgcgatttcccgcctcgacacgctgatggatgaagccgcctggcttgaagagcaaaaagagtgggtagcgctttgccgtttctgtggcgatctccattgcaaagagcaaagcgacttcttcgatattatcggcttcaagcagttcctgtttgaacaaaccgagatgagtcacggcaccgtgcgtgaatacgtggttcgcctgcgccgcctgggtcagcatttgaccatgcaaaatatctcccgcgatctgctgacgaccggatacctggatgaaaatctggagccctggctgcccgccaccagtaccaacaattaccgcatcgcgctgcgaaagtatgcacaatataaagtccagatgccgggcgtcataaagcagaaagtccgcgccggaacaacttctgatatatattaa

SEQ ID NO: 2524 - DNA, 1059 bp, Enterobacter cloacae
aagcgccttttttatttctcgcgcgtctgcgtgcataatgaaataacaattgtttgcgtgaccggaggaaccatgtcactacagaatttaacgcgctttccccgtctggaatttatcggcgcacccacgccgctggagtttctcccgagattttctgactatctggggcgcgatattttcattaagcgtgacgatgtgacgcccatggcgatgggcgggaataagctgcgcaagctggaatttctcgccgccgatgccctgcgcgagggggcggatacgctgatcaccgccggggcaattcagtctaaccacgttcgccagacggcggcagtggcggcgaagctggggctccactgcgtagccctgctggagaacccgatcgggacgcaggcagagaattacctgactaacggtaaccgtctgctgctggatctgttcaacgtgcaggttgaaatggtcgacgcgttgaccgacccggcagcacagctcgacgagctggcgacgcgtctggaagcgcagggttttcgtccgtacgtgatcccggttggcggctcgaatgcgctgggtgccctcggctatgttgagagcgcgctggaaatcgctcagcagtgcgaaggcgcggtaagtttatcctcggtggtggtggcgtccggcagtgcggggacccatgccggtttagcggtcgggcttgagcagctgatgccggaggtcgagctgattggcgtgacggtttccagaagcgttgcggaccaaaagccgaaagtcgtcaccctgcaacaggcggtggctgaacagcttgcgcttcaggcgaaggcggaaatattgctgtgggatgactatttcgcgccgggctatggcacccccaatgatgaagggatggaggccgttaagctgctggcccgtctcgaaggtattctgcttgacccggtctataccggtaaggcaatggcgggcctgatcgacggcatcgcccggaagcgctttaaggatgaaggacctattttgtttgttcatactggcggagcgcctgcgctgtttgcctatcatcctcatgtctaa

SEQ ID NO: 2525 - DNA, 690 bp, Enterobacter cloacae
aaatcaggtagaaaaataataatgcaagaaagtattcaactggttattgattcgctgccgttcttgcttaaaggcgcggtgtttactttacagctcagtatcggcgggatgttcttcgggctggtgctcgggtttgtgctggcactgatgcgcatgtccaacatctggccggtgcgatggctggcgcggttttacatctccgtgttccgcggaacgccgcttatcgcccagctgtttatgatttactacgggctgccacagttcggtatcgagctggatccgatcccggcggcgatgattggcctgtcgctgaatacagcggcgtacacctctgaaacgctgcgtgcggcgatctcctccatcgataaagggcagtgggaagcggcggccagtatcgggatgaccccgtggcagacgctgcgccgggcgatcctgccccaggcggcgcgcgtggcgctgccgccgctgagcaacagctttatcagcctggtgaaagacacctcccttgcggcgaccattcaggtgccggagctgttccgtcaggcgcagctgatcacctcgcgtacgctggaagtgtttactatgtatctggcggcctcgctgatttactgggtgatggcgacggtgctgtccgctctgcaaaactattttgaaaaccagcttaaccgccaggagcgtgatccaaaatga

SEQ ID NO: 2526 - DNA, 509 bp, Enterobacter cloacae
taacattaagcgctgatcctgccagctgcgtggtgaagacgctgtttgatcaggcgaaaatactggcgaagcagtgtgaacagcagtcgctgcctttctcggtcattcagatcgatcttgactgcttcaagagtatcaatgatcggttcgggcatcaggcgggtgataaggtgttgtcccatgccgcggggctgattgccagcacccttcgtgataaagatattgccggacgcgtcgggggggaagagttctgtgtggtgctgcccggcatgacgcttgaagaggcggcggaagtcgcagagcagatccgcgagcgtatcgacagcaaagagatcctgattaagaaaagtaccaccctgcgcgtgagtgcgtcgtttggcgtctctggtgcgcaggagaagggcaattatcacttcgaaaatctgcaatccaccgccgatgcgcgtctgtatgaggcgaaacagcgcgggcgtaaccgggtcatctggcaagatcacctcaaaaagtaa

SEQ ID NO: 2527 - DNA, 1728 bp, Enterobacter cloacae
acaacaggaaacgaaatcatggcacaagtcattaataccaacagcctctcgctgatcactcagaacaacatcaacaagaaccagtcttcaatgtctactgccattgagcgtctgtcatccggtctgcgtatcaacagcgcaaaagatgacgcagcaggccaggcgattgctaaccgcttcacctccaacatcaaaggtctgactcaggctgcacgtaacgctaacgacggcatctctgttgcacagactactgaaggcgcactgtctgaaatcaacaacaacttacagcgtattcgtgagctgaccgttcagtcttctaccggtactaactcccagtctgacctggactcaattcaggatgaaatcaaatcccgtctggacgaaattgaccgcgtatctggtcagacccagttcaacggcgtgaacgtgctggcaaaagacggctccatgaaaattcaggttggcgcgaacgatggccagaccatcaccatcgacctgaaaaaaatcgactctgatactctgggtctgaacggcttcaatgtaaatggtaagggtactattgctaataaggcagcaactgttagtgatttgacttccgctggggcaaaactgaatgccactaccgggaattatgatctgaccaccacaaataaagatcttactactgatgttgctttcagtaagttgaaaacaggcgataccgttacaactaacggtgctacttatacttatgacgcgaaagcaggtaacttcactactactaagtcaaccgctggtgctgacgaagcagctaaaactgcaaaccgtgatgcattatctgctaccttaaaagcggatcctggtcagacagtaagcggtacttataccactaaagacggtaccgtcaactttgataccgactctgccggtaatattactattggcggtaaagcagcttacgttgatgcttcaggtaacctgaccaccaacaatgctggcggcgcagcagacgctacgatgaaagcactgcttaagacagctagtgaaaatactgacggtgcgaccttaaacttcaaaggtactgagtatactgttgcgccaggtgttgatgccaccgatactggagttgtgagctacaaagctaccgttagctccgatgtagttttagctgaaactaaagctaatgctaccaatatctccatgaactcaggtgttctgactaaaaacttagccttcgacgcgacaggtgcttccactgataatacttttgtcgatgacgcaggcaatatcactagcgttgaagactacacagtgtcttatgcagttaataaagacaatggaaatgttactgttgcagcttattcatcagcgacagatacgaacaaaacctattctccaacaattggagcagcagtaaatgttacctcaaccggtaaaatcactacggaagcaactagcgtaggtactgctacaactgatcctctggcatcactggacgacgccatcagttcaatcgataaattccgttcttcactgggtgcggtacagaaccgtctgagctctgcggtaaccaacctgaacaacaccaccaccaacctgtctgaagcgcagtcccgtattcaggacgccgactatgcgaccgaagtgtcaaatatgtctaaagcgcagatcatccagcaggccggtaactccgtgttggccaaggctaaccaggttcctcagcaggttctgtctctgctgcaaggttaa

SEQ ID NO: 2528 - DNA, 855 bp, Enterobacter cloacae
cgttgcaggcgatttctctacactactcaaaaattccactgtatcggagtacttatgaaattagcacttctgggtcgtcaggcgctgatggggatgatggccgttgcgctggtcgcggggatgagcgtgaaaacgttcgcggcagagaatctgctcaacaaagttaaagagcgcggcacgctgctggttgggctggaaggaacctatcctccgttcagcttccagggtgacgacggtaaactgaccggttttgaagtggagtttgcgcaggagctggcaaaacacctcggcgttaaagcctccctgaaacccaccaaatgggatgggatgctggcgtcactggattccaaacgtattgacgtggtgattaaccaggtaaccatttctgacgaacgtaagaagaagtatgacttctccacgccgtacaccgtgtccggtattcaggcgctggtgaagaaaggtaacgaaggcagtatcaagtccgcagcggatctgaaaggtaagaaagtcggcgtcggtctgggcaccaactacgaagagtggctgcgccagaacgtgcagggcgtggacatccgtacctacgatgatgacccgacgaaataccaggatctgcgcgtaggccgtatcgacgccattctggttgaccgcctggcagcgctggatctggtgaagaaaaccaacaattccctggctgtcgcgggtgatgcgttctcccgtcaggagtccggcgtggcggtgcgtaagggtaacgaggatctgctgaaagccatcgatggcgccattgctgagatgcagaaagacggtagcctgaaggcgctttctgagaagtggttcggcgcagacgtgacgaaataa

SEQ ID NO: 2529 - DNA, 759 bp, Enterobacter cloacae
tccaaaatgagtgcaattgacgtcaaaaacctggtgaaaaaattccacgggcaaacggtgctgcatggcattgatcttgaggttgagcagggcgaagtggtggcaattatcggcccgagcgggtcaggcaaaaccacgctgctgcgcagcatcaatttactggagcagcccgaaggcgggacgatccgcgtgggtgatatcaccattgataccgggaaacctatcagccagcaaaaagggctgattcgccgcctgcgccagcatgtcggcttcgtgttccagagctttaatctcttcccgcaccgcacggtgctggaaaacattattgaagggccggtcatcgtcaagggggaacctaaggaggacgcgacggtccgcgcccgcgagctgctggcgaaggttggcctggcagggaaggagacgagctatccgcgtcgcttatctggcgggcagcagcagcgtgtcgccattgcgcgcgcgctggcgatgcgccctgatgtgatcctgtttgacgaacccacatccgcgctcgatcctgagctggtcggggaagtgctgaacaccatccgacagctggcgcaggagaaacgcacgatggtgattgtgacgcatgaaatgagcttcgcccgcgacgttgccgatcgggctattttcatggatcaggggagaatagttgagcaggggccagctaaagcgctgtttgccaatccgcagcagccacgtacccgtcagttccttgaaaaattcttaatgcagtag

SEQ ID NO: 2530 - DNA, 444 bp, Enterobacter cloacae
cgcaacacgctgtcccggtgcgggaagctaaccatcgggccaaagttggtgctttcatcgaacagatcgcccgcgcggatgcggcccacgcgctcaacgattttttgctcaaacgcggctttgaacttcgcgggcacgaacacgcgggtgccattggtgcacacctggccggagctgaagaaattggccatcatggcgatatctgccgcgagatccagatccgcatcgtcaaacactatcagcggggatttaccgcccagctccatcgtcacctctttcagggacgaggccgccgagttggccatcacttttttgccgctggcgacgccgccggtaaaggagactttggcgatgcccggatgctcggtcaggtactggccagtctccgcgcctacgcccggcaggacgttaaacacgccgtccggcaggcccgcttcggtgtag

SEQ ID NO: 2531 - DNA, 933 bp, Enterobacter cloacae
tcacctcaggagacttctgcgatgcatccacggcaaggattgaagcgtctgttgctcggcgcgctgctcatgaccgcgaccaccacgggcgcgctggcggctgaaaagttccaggtcatcaccacttttaccgttatcgctgatatggcgaaaaacgtggcgggggatgccgcagaggtcacctccatcaccaaaccgggcgcggaaattcacgaataccagcccaccccgggcgatatcaaacgcgcgcagaaggcacagctgatcctggcgaacggcatgaatctggagctgtggttccagcgcttttatcagcatctgaacggtgtgccggaggtgattgtcaccaaaggcatcaccccgatgggcatcagcgaagggccctataacggcaagcccaatccgcacgcgtggatgtcgccggacaacgccctgatttacgtcgataacatccgcgacgcgctggtgaagtacgatccggccaacgcacagacgtatcagcgcaacgctgatgcttacaagcagaagatcaccgccactctcgaaccgctgcgcaagcaggtcgcggagataccggaagacaaacgctggatggtgaccagcgaaggggctttttcctatctggcgcgggatttgggcctgaaggagctttacctgtggccgatcaacgccgatcagcagggcacgccccagcaggtgcgcaaggttatcgatctggtgaaaaaacatcacattccggcggtgttcagcgaaagcacggtctccgataagcccgcccgtcaggtggcgcgtgaaaccggcgcccactatggcggcgtgctgtacgtcgactctctgagcgcggaaaacggcccggtgccaacctatatcgatctgctgaacgtcaccacccgcacgctggtgcagggcatccgcgacgggatgaaggagtaa

SEQ ID NO: 2532 - DNA, 1167 bp, Enterobacter cloacae
acgcctgaaaattctcttcttcacgctgctggcggtctctaccgtggcggcgctgcaaaccgtcggcgcgtttctggtgatctgtctggtggtcacgcctggcgcgaccgcgtggctgctgaccgatcgcttcccgcgcctgctgatgattgccgtcgccattggcagcatcaccagcttcctcggcgcgtgggccagctattacctggacggcgccaccggcggcattatcgtggtcgcccagacgctgctgttcctgctggcgttcgtctttgcgccgaagcacggactgcttgccagccgtcgtcgggcgcgggaggcacacccatgatgacgctgctcctcgaacccttccagtttgcgtttatgaacaacgcgctgctgatttcactcctggtggccgtgccctgcgcgctgctgtcggtttttctggtgctgaaaggctgggcgttgatgggcgacgccatgagccacgcggtgtttcccggcgtcgtgctggcctggatgatgggcctgccgctggcgctgggcgcgttcgtggccggtctgttctgcgcggtcgccaccggatacctgaaggataacagccgcatcaaacaggatacggtcatggggatcgtcttttccggcatgttcggcgccgggctgatcctctatatcgctgtcaaacctgaggtgcatctcgaccacattctgttcggcgatatgctgggtattaacgggatggacattctgcaaagcggtctcgtcgcggggatgattgcgctggtgattggcctgaagtggcgcgattttctgctgttctgctttgactatcagcaggcgcaggcgagtggcctgcgcacccgctggctgcaccacggcttactgtgcatggtttcgctgaccattgtggcgacgctgaaagcggtggggatcattctgtcgatttccctgctgattgcccccggcgcggtggcggtgctgattacccgacgctttcacatggcgctgctggtggcggtcgccgtttcagcgctggtgtcggtaagcggcgtttatgcctcgttttatctcgacagcgcgcctgcgccgaccattgtggtcctgttcgcgatggtgtttatcgtgacgtttgtggtgaccagcgtgaaggctcgtcgccaggagcgtgtgacagcagagtga

SEQ ID NO: 2533 - DNA, 1380 bp, Enterobacter cloacae
ccagcaaggccagagagtgaatcttcttattcattgtacgtcccgcttttatggttatttaatgagcgcgcttcccacagcgcgggcattacggtattgcaaatgcaaatagttatcaataatattatcaataaaatttgctctgaaacaaaaaagactgttaaacatggggttataagggtgacggtgttaacaaccggaagtgaagcgtggtggcaggcgaaaaacgggccggaacgggaacgtcatcaggaaaactatcgcgtgacattctggtggcgggacccggcgggaacgcagaaaagctcgacggtgaaacgcgtctggctttacgtcaccggcgtgaccgatcaccatcaaaatgcccgtccgcaatcccttgaacgtgtcccggataccgacgtctggcagtggcagggcgagttcagccccgaatggcgcggcagctactgttttatcccctccgataacgaaaacgattttgccgatgcagtgtttgaaggcgagcagccggaccgcatggcgctgcgcgaaggctggcgtaaactgttgccgcacgcggtgtccgacccgctgaatccgcaaagctggcgcggcgggcgcgggcacgccgtctcggcgctggagatgccggaggcgcccgtacagcccggctggaaccatcccgataccccttacaataagcctgtctgtattgattggcacagcgcgcgtctgaagaaccgtcgtcgcgtgtggatttttaccaccggggatgaaagccccgagcgcccgctggcggtgctccttgacgggcagttctgggccgaaagcatgcccgtctggcctgctctggcgtcgctcacccatgaaggcaaactgccgcctgcggtttatgtcttaattgacgtcattgacaccgcacaccgcagccgcgagctgccgtgcaaccctgatttctggctggcagtgcaggaagaacttctcccgcaagtgaaaagcatggccccgttcagcgaccgcgccgaccataccgtggtggcgggtcagagcttcggcggactctcttccctctatgcgggcctcaactggccgcagcgttttggctgcatcctcagccagtccggatcctactggtggccgcaccgcggcgcgcagcaggacgggctgctcatcgaacaactcaaagcgggtgaaaaaaccgctcgcgggctgcgcatcgtccttgaggccgggcgcaacgagccgcttattttgcgcgcaaaccaggcgatcctcgccgaactacacactcagcaaccggttttctggcgtcaggttgacggcggacacgatgcgctttgctggcgcggtgggctgacgcaggggctgatgaccctctggcagccgcttattcaataa

SEQ ID NO: 2534 - DNA, 3885 bp, Enterobacter cloacae
gccgttttattttgcgggggagcgcgcatgaaccgtctccctcttgtcgccgcccagccggggatttggatggcagagcagctttcctccctgccaaacgcctggagcgtcgcgcactataccgagctgaaaggcgctatcgatgcgccattgctggcaaaagccatcgctgaaggcatgatgcaggccgacaccctgcggatgcgttttgccgaagatcacggtgagctgtggcagtggatcgatgaggccatgctcctgccggagccgtccatcgtgcgcgttgactcccacgacgccgccgtggcgctgatggaggccgatctcaaccagaacctgcgcgttgacagcggtcagccgctggcgtttcaccagctgatccaggtgggagaaagccactggtactggtatcagcggtatcatcatctggtggtagatggcttcagtttcccggccattacgcgtcagatcgccgccatttacgctgcgtggcataaaggggaacccgcgcccgcctccccgtttaccccgttcgccgaggtggtggaggagtatcagcgctatcgcgacagtgaggcgtatcagcgcgacggtgctttctgggccgtacagcgccaacagcttccttctccggtctcgctctcttccgcgcccctgcctggacacgccgccaccaccgacatcctgcgcctgaaaatggcgatggacggacgtgctttcagccagcttgcacagatggcaggccaggcgcagcgtaccgatctggcgcttgcgctggtggtgctgtggctgggccgcctgaccggacggctggactacgccgccgggtttatctttatgcgccgcatgggctctgccgcgctgaccgcgaccggaccggtgctcaacgtcctgccgctggcggtgaatattcgcccgcacgagagcctgccggaactggcgctgcgcctggcgaaccagctgaaaaagatgcgtcgccatcagcgttacgacgccgagcagatcgtgcgcgacagcggacgtgccgcaggcgatgaagccctgtttggtccggtgctgaacgtcaaggtgttcgattatcagctggatatcgacggcgtggaggccattacccacacgctggcgaccggcccggtgaacgatctggagcttgcgctgttcccggacgagcagggcggactgagcattgagatcctcgccaacgggcagcgttacgacgaggcgacgctaaagggtcacgcggtgcggctgaacgcaatgctgacgcagtttgccgccaacccggacctgcgctgtggcgacgtggaaaccctttcagagcaggaatacgcccggctggcgcgcatcaacgataccgggctggcgctgccgtccaccacgctggcggatctggtcgcggagcaggcgagcaaaacgccggacgcccccgcgctggcggatgcccatactgaactgaactaccgccagatgcgcgagcaggtggtcgcgctggcaaacctgctgcgcgcgcgcggcgtgaagccgggcgacagcgtggcggtggcgcttccgcgctcggtattcctgacgttagccttgcacggcattgtggaggcgggcgccgcgtggctgccgctcgacaccggctacccggacgatcgcctgcggatgatgctcgaggacgcgaagccgtccctgctcattaccaccgacgagcagcttccgcgctttagcgatctgccgatcgccacctttagttacaacacactattaccgacctcgggtgctgaaccgctgcgcctggcgaagccggagcaaaccgcgtacatcatctttacctccggttcgacgggacgtccaaaaggggtgatggtcggccataccgccatcgttaaccgcctgaagtggatgcaggatcattatccactgacggcgcatgacgtggtggcgcagaaaacgccgtgcagctttgacgtgtcggtgtgggagttctggtggccgtttatcgccggggcgaagctggtgatggccgagccggacgcgcaccgcgatccgcaggcgatgcagagcttcttcgcagaatatggcgtaaccaccacccacttcgtgccgtcgatgctggcggcgttcgtcgcctcactgacgccggaaaacgcccactgttgcaggacgctgaagctggtgttctgtagcggcgaggcgttgccgactgcgctgtgccgcgagtgggaacagctcacccatgcgccgctgcacaacctctatggcccgaccgaagcggcggtggacgtcagctggtatccggcgtacggccccgagctggcggcggtggaagggaacagcgtgccgatcggcttcccggtgtggaatacggggctgcgcattctggacgcgatgatgcgcccggtgccgttcggcgtggcgggggatctgtatctcaccggcatccagctggcgcaggggtatctgggacgccccgaccttaccgccagccgctttatcgccgacccgttcgcgccgggcgagcggatgtaccgcaccggtgatgttgcccgctggctggataacggcgcggtggaatatctgggccgcagcgacgaccagctaaaaattcgcggccagcgcatcgagctgggtgaaatcgaccgggcgatgcttgcgctgccggacgtggcgcaggccgtggcgcacgcctgcgtgttcaaccaggcagcggcgacgggtggcgatgcccgccagctggtggggtacgtggtttctgaatctggcttaccgctggaccgcgacgcgctgcttgcatcactcaaagcccagctgccaccgcatatggtgccggtggtgctgctgcaaatcagcgcgctgccgttaagcgccaacggcaagctggatcgcaaggcgctgccgctgccggagctgaccagcagaacttccggtcgcgcacctgagacgcaaaccgaagtggccgtggcgcaggcgttttcttccctgctgggctgcgcggtgaatgatatcgaggccgatttctttgccctcggcggccactcgctgctggcgatgcgcctcgcggctcagctcagccgtgcgttcagccgtaaggtcacgccggggcagattatggtcgcctcgacggtaagcaagcttagcgccctgctggactcgcagatgagggacgagcaggcgcagcgtctggggtatgaaacccttctgccgctgcgtgaaagcaacggcccgacgctgttctgcttccatccggcgtccggctttgcctggcagtttagcgtcctggcgcgctacctcagcccgcgctggtccatcgtcggcattcagtcgccgcggccaaacggcccgatgcagcagtgcgcggatctcgatggggtgatcgaacatcatctgaacacgttgcgtaagcagcagccgcaggggccgtattacctgttcggctattccctcggcggcacgctggcgcagggcattgcggcccgcctgcgcgagcagggtgaagcggtggcgttcctcggcctgctggatacctggccgccggaaacccagaactgggcggagaaagaggccaacggcctcgacccggcggtgctggcagagatcgagcgcgagcgtcaggcgtttatcgccgcccagcaggggcagggctccagcgagctgtttaacgccattgagggcaactacgccgacgcggtgcggctgctcaccaccgcacacagcgcgcgctttgacggtaaagcgacgctgtttgtcgccgagcgaacgcgaacccaggatcctcaggccgcgtgggcgccgtgggtgggcgagctggaggtctacagccaggactgcgcccacgtggatattatttcaccgcaggcgtttgagaaaattgggccggtactgaaggaaattttaggatag

SEQ ID NO: 2535 - DNA, 954 bp, Enterobacter cloacae
gcgcgccttcagcggcgtgctgcgccacgtggtgctcagcggctcggaagatcgcattattaccgacgacgaacgccccttcgtggcgcaccgacaggaggccaaatgaacgcgcttctcgaacccttcggctacgagtacatgctcaacgcgatgtgggtctcggcgatggtgggcgggctgtgcgcgtttctctcctgctatctgatgcttaaaggctggtcgctgatcggcgatgcgctgtcgcactccatcgtgccgggcgtagcgggcgcttacatgctcgggctgccgttctcgctgggggcgtttttatcgggcgggctggcggcgggcagcatgctgtttctcaaccagcgcagccgcctgaaggaggacgccattatcgggctgatcttctcctcgtttttcgggctggggctgtttatggtctcgctcaacccgacctcggtgaacattcagaccatcgtcctcggcaatattctggctatcgccccggaagatatcgtccagctggcgattatcggcgtggtgtcgatagttatcctgctgttcaaatggaaagatctgatggtgaccttttttgatgagaaccacgcccgcgccatcggcctgcgtcctgaacgcctgaaaattctcttcttcacgctgctggcggtctctaccgtggcggcgctgcaaaccgtcggcgcgtttctggtgatctgtctggtggtcacgcctggcgcgaccgcgtggctgctgaccgatcgcttcccgcgcctgctgatgattgccgtcgccattggcagcatcaccagcttcctcggcgcgtgggccagctattacctggacggcgccaccggcggcattatcgtggtcgcccagacgctgctgttcctgctggcgttcgtctttgcgccgaagcacggactgcttgccagccgtcgtcgggcgcgggaggcacacccatga

SEQ ID NO: 2536 - DNA, 249 bp, Enterobacter cloacae
ccctctggcagccgcttattcaataacggagtctgtatggaattcagcaatcctttcgataatccgcagggacagttcgccattttgcaaaatgaccaggggcagtacagcctgtggccgcagcagtgcgagttgcccgcgggctggcgcgtggtctgcgaaccgcaatctaaggaggcgtgccagcagtggctggcggaacagtggcagacgcttgagccgttttattttgcgggggagcgcgcatga

SEQ ID NO: 2537 - DNA, 1521 bp, Enterobacter cloacae
acctcccggttaaaatatggactggaatttacccatctcaacctggatggacttcacctgggtgtaactctgaagcgtcatgacgccgttctcacggccaatgccggagtgtttgtagccgcccaccggcatctccgcggcggattcgccccaggtgttgatccagcagatgcccgcttcgagctgatgaatagcgccgtgggcgcggttcagattggcggtgacaatgcccgccgccagaccgtagtcggtgtcattggcgcggcgaatggcttcttcgtcagtgtcataggtaagaatggacatcaccgggccgaagatctcttcgcgcacgatggtcatttcgtcggtgcagtcggtgaacacggtcggggccacccacgcgccgttgtcaaagccgtcacccttcagcacgtcaccgccgcacagcacgcgcgcgccttcctctttgcctttggtgatgtagcgcaacacgctgtcccggtgcgggaagctaaccatcgggccaaagttggtgctttcatcgaacagatcgcccgcgcggatgcggcccacgcgctcaacgattttttgctcaaacgcggctttgaacttcgcgggcacgaacacgcgggtgccattggtgcacacctggccggagctgaagaaattggccatcatggcgatatctgccgcgagatccagatccgcatcgtcaaacactatcagcggggatttaccgcccagctccatcgtcacctctttcagggacgaggccgccgagttggccatcacttttttgccgctggcgacgccgccggtaaaggagactttggcgatgcccggatgctcggtcaggtactggccagtctccgcgcctacgcccggcaggacgttaaacacgccgtccggcaggcccgcttcggtgtagatttcagcaagcttcagggcggtaagcggtgtcacttcgctcggcttgaagatcattgcgttgcccgccgccagcgccggcgcggatttccacagggcgatctggatcgggtagttccacgcgccgatgcccgccaccacgcccagcggctcgcggcgggtgtagacgaacgaggtgtcgcgcagcgggatctggctgccctccagcgccgggatcagccccgcgtagtactccagcacgtccgcgccggtgacgatgtcgacggtcgaggtttcggaatacgctttaccggtgtcgagggtttccagcgttgccagctcgtcgttacgctcgcgcaggatatcgacggcgcgacgcaggatgcgcgagcgctccatggcggtcatcgccgcccagattttttgcccgcgctttgcgctttcgacggcgcggtccacgtcttcgcgcccggcggcctgcacggtcgccagaacttcaccgttcgccgggttgatggtctcgaaggtgcgaccgctggtggcggatgtataaccaccattgatataaagctgctgttctgccattcgggacataaattctcctcggttagtcggtcggtaaatgctggctga

SEQ ID NO: 2538 - DNA, 2043 bp, Enterobacter cloacae
ggatactggatgacagacctttcacaagacagagaaaaagacaaaatcaacccggtcgttttttatacgtccgccgggctgattttgttgttttccctgacgactattttctttcgtgatttttctgccgagtggattgggcgcactctggactgggtgtcaaagaccttcggctggtactatctgctggccgcgacgctttacatcgtgttcgtggtctgcattgcctgctcgcgcttcggttcggtgaagctcgggccagagcagtctaagcccgagttcagcctgctgagctgggccgcaatgctgtttgccgcaggcatcggcatcgacctgatgttcttctccgtggcggaaccggtcacgcaatatatgcagccgccggaaggggcagggcagacgatggaggccgcgcgccaggcgatggtctggacgctgttccactacggcctgacgggctggtcgatgtacgccctgatgggcatggcgctcggatactttagctatcgttataatttgccccttaccatccgctccgcgctgtacccgattttcggcaaaaagatcaacggtccgattggccacagcgtcgacattgcggcggtgatcggcaccatcttcggcatcgccaccacgctcggaattggcgtggtgcagctcaactacgggctgagcgtgctgtttgacatcccggattcgatggcggcgaaggcggcgctgattgcgctgtcggtgattatcgccaccatctcggtgacctccggcgtggataaagggattcgcgtgctctccgaactgaacgtcgcgctggcgctggggctgatcctgttcgtgctgtttatgggcgacacctcgttcctgctcaatgccttagtactgaacgtgggtgattacgtgaaccgctttatgggcatgacgctgaacagcttcgcctttgaccgtccgacagagtggatgaacaactggacgctgttcttctgggcgtggtgggtggcgtggtcgccgtttgtcggcctgttcctggcgcgtatttcgcgtgggcggaccatccgtcagttcgtgatgggcacgctgattatcccgttcacctttaccctgctgtggctgtcgattttcggcaacagcgcgctgcacgagatcatccacggcaatgcgacttttgcccaggaagcgatggcgcacccggagcgcggcttctacagcctgctggcgcagtacccggcgttcacctttagcgcgtccgtagcgaccatcaccggcctgctgttctatgtcacctcggcggactctggcgcgctggtgctggggaacttcacctcgaagctcaaggacattaacagcgacgcgccgaactggctgcgcatcttctggtccgtcgccatcggcctgctgacgctcggcatgctgatgaccaacggtatctctgcgttgcagaacacgacggtgatcatgggcctgccgttcagcttcgtgatcttcttcgtgatggccgggctgtataaatcgcttaaggtggaagactaccgccgcgtcagcgccagccgcgacaccgccccgcgtccgctgggcgcgcaggacaggctgagctggaaaaaacgcctctcgcgcctgatgaattaccccggtacgcgctacaccaaacagatgatggagacggtctgtttcccggcgatggaagaggtggcccaggagctgaagctgcgtggcgcctacgtggagctgaaaaacctgcccccggaagagggcgaaaatctggggcacctggatctgctggtgcacatgggcgacgagcagaactttgtctatcagatctggccgcagcagtattcggtacccggctttacctaccgggcgcgcagcgggaagtcgacctactaccggctggagaccttcctgctggaaggcagccaggggaatgatctgatggattacagcaaggagcaggtgattacggacattctggaccagtatgaacggcacctgaactttatccatctgcacagggaagcaccggggaatagcgtgatgttcccggatgcctaa

SEQ ID NO: 2539 - DNA, 348 bp, Enterobacter cloacae
tgcttattatatcttttactagaggtgtactatgtacgcctttatgttgttccgaggtataaaatgagcatctttgatgaacttaaaacttcgcttgaagaggcggttgagatccacagcggaaggaaagccgcttcccgggtaacccgctatgaagttgctgatgtgcgcgccatcagagagcagctcaatatcacgcaaagcgaaatggcgaaggcgcttggcacgagcgtcgatacgataaagagctgggagtctaaacgtcgcaacccaaccgggctggcggcgaaggtacttaatgtgattcgggagaatcctgcattttataaggcacttgccgggcagtga

SEQ ID NO: 2540 - DNA, 948 bp, Enterobacter cloacae
aaccggcgcccactatggcggcgtgctgtacgtcgactctctgagcgcggaaaacggcccggtgccaacctatatcgatctgctgaacgtcaccacccgcacgctggtgcagggcatccgcgacgggatgaaggagtaatcatgcagaaaggtattgttgtaaccgacgtgaccgtgacctaccgcaacggccacacggcgctgcgcgacgcgtcgttcagcgtgccgggcggatcgattgctgccctggtgggggtgaacggttccggcaagtccacgctgtttaaggcggtgatggggtttgtgcgggcggcgagcggcactatctccattctggggctgccgcctcaccgggcgctgcgtcagaacctggtcgcctacgtgccgcagtcggaagaggtcgactggtcgtttccggtgctcgtcgaggacgtggtgatgatgggccgctacgggcatatggggtttctgcgtcgtcccaaagaatgcgataagcagatcgtcaccgacgccctgaagcgtgtggatatgctcgagctgcgccatcggcagattggcgagctgtccggcgggcagaagaagcgcgtgtttctggcccgtgcgattgcccagcagggcgaggtgatcctgctcgacgagccgtttaccggcgtggacgtcaaaaccgaagccaggatcatcagcctgctgcgggagctgcgcgacgagggtaaaacgatgctggtctcgacccacaatctgggctcggtcacggaattctgcgattacacggtgatggtcaaaggcaccgtgctggcgagcggcccgacggatatcacctttaccgccgagaatcttgagcgcgccttcagcggcgtgctgcgccacgtggtgctcagcggctcggaagatcgcattattaccgacgacgaacgccccttcgtggcgcaccgacaggaggccaaatga

SEQ ID NO: 2541 - DNA, 354 bp, Enterobacter cloacae
cggcgaggcgttgccgactgcgctgtgccgcgagtgggaacagctcacccatgcgccgctgcacaacctctatggcccgaccgaagcggcggtggacgtcagctggtatccggcgtacggccccgagctggcggcggtggaagggaacagcgtgccgatcggcttcccggtgtggaatacggggctgcgcattctggacgcgatgatgcgcccggtgccgttcggcgtggcgggggatctgtatctcaccggcatccagctggcgcaggggtatctgggacgccccgaccttaccgccagccgctttatcgccgacccgttcgcgccgggcgagcggatgtaccgcaccggtga

SEQ ID NO: 2542 - DNA, 1263 bp, Enterobacter cloacae
actcaaggctttgtcatgaatcaaaaatcctggctgcttaacctcagcctgctcaaaacacacccggcgtatcgcgccgtttttatcgctcgctttatctccattttgtccctcggtttgcttggtgtggccgtgccggtgcaaatccagaccatcactcactccagctggctggtagggttatccgtcaccttaaccggcggggcgatgtttatcggcctgatggtgggcggcgtgctggcggaccgatacgagcgtaaaaagcttatcctgctggcgcgcggcacctgcggggtgggctttgtcgggctgtgtctgaacgccatgctgccggagccgtcgctggtggccatttacgtgctgggattgtgggacggcttttttgcttcgttaggcgtgacggcactgctggcggccacgcccgcgctggtcgggcgcgagaacctgatgcaggcgggggcgatcaccatgctcaccgtgcgcctcggctcggtgatttcgccgatggtcggcggtctgctgctggcgaccggcaacgtggcgtggaactacggccttgccgcagccggaacctttatcaccaccctgacgctgctgcgtctgccgctcctgccaccgccgccgcagccgcgcgagcatccgctgaagtccctgatggccgcgattcgttttctgttcagcaacccgttgattggcggcattgcgctgctcggcggcctgctgacgatggcgagcgccgtgcgcgtgctgtacccggcgctggcgggcgagtggcagatgagcgcctcagagattggcgtgctgtacgccgccattccgctcggcgccgcgtgtggggcgctgaccagcggcaacctggcgcagagcgcgagaccggggctgatcatgctggtggcgacgctggcctcgtttatcgcgattggtttcttcagcctgatgccggtgtgggcgctgggggtgatgtgtctggtgatttttggctggctgagcgcggtcagctcgcttttacagtacaccctgatccagacccagacgccggaagggatgctcgggcgcattaacggcctgtggaccgcgcagaacgtgacgggcgatgcaattggcgcggcgatcctcggcgggatgggggcgataatgaccccggtggcgtcggcgagcagcagcgggtttgtgttagcgatgattggcgcgatcttactggtgacgctggtggaattgcggcggttcaggcaggaggttgcgttgaacgacggtgcggcctga

SEQ ID NO: 2543 - DNA, 996 bp, Enterobacter cloacae
gaagcattatcttcaataaaatcaggatgccgctctgtgaaaatcgctgccgtttgccgcaatgcccttcttttaacaggactttttgttttaggactaacctcagccgccgccgacgactggccgcgccaggtctccgacagccgcggcgttcacacgcttgagagcaaaccgacgcgcattgtctccaccagcgtgaccttaaccggctccctgctggccattgacgcgccggtcattgccagcggagcgaccacgccgaacaaccgcgtggcggatgcgcagggctttttacgtcagtggggcgatatcgcgaagcagcgtaaggttgcccggctgtacatcggcgagccgagcgccgaagcggtcgcggcccagatgccggacctgattttgatcagcgccacaggcggggattccgcgcttgcgctctacgatcagctttccgccatcgcgccgacgcttatcatcaattacgacgacaaaagctggcaggaactgctgacccagctggggacgatcaccgggcaggagacacaggccgcagagcgcatcgctgccttcgataaacagctcgcccaggtgaagcagcagatgaagctgccgccacagccggtgaacgccatcgtttacaccgccgcggcacacacggcgaacctgtggacgacagactccgcgcagggcaagctgctgcaccagctgggctttacgctggcggacctgcctgccggtttgcagacctcaacaagccagggcaagcgccacgacattattcagctgggtggagaaaatctggcgacggggctgaacggcgaagggctgttcgtgtttgccggcgaccagaaagacgtgaatgcgatttacgccaatccgctgctggcgcatctgccgtcggtgaagaacaagcgcgtctgggcgctgggaacggagacgttccgcctggattattacagcgcgatgctggtgttagacagattgaatgcgttgtttaagtag

SEQ ID NO: 2544 - DNA, 1320 bp, Enterobacter cloacae
caccgcgaccgccctcggcaaccgcgtggcgcgtacgcagctgacgggcctgcttgccatcaccgtgctgtgcggcagcgcgaccgccgtggtcggcccgattgcctttatcggcctgatgatgccgcacatggcgcgctggctggtgggggcggatcaccgctggtccctcccggtaacgctgctggcgacccctgccctgctgctgtttgccgacgtgctgggccgcctgctggtgccgggcgaactgcgtgtctcggtggtcagcgcctttatcggcgcgccggtgctgatcttcctggtacgacgcagacgcgggggtggcgcatgatggccccgtcacgtcgtttactcaccagcgtcgccctgctggtcgtcgcctgtctgctgctggcggtctggagcctgcaaagcggtgccgtaacgcttgatttcgcgcaggtctttcacgctctcaccggcagcgcgccgcgtaacatcaccatggtggtcaccgaatggcgactgccgcgcgtggcaatggcgatcctggttggcgcggcgcttggcgtcagcggcgcgatattccagtcgctgatgcgtaaccccctcggcagcccggacgtgatgggcctgaataccggcgcgtggagcggcgtgctggtggcgatggtgctgttcgggcagcatctcacggccattacctttacggcgatggcgggcggcattctcacctccctgcttatctgggccctggcctggcgcaacggcatcgacaccttccgcctgatcatcatcgggatcggcatccgcgcgatgctgatggcgtttaacacctggcttctgctacaggcgtcgctggaaaccgcactctccgccggactgtggtacgccggttccctcaacggtctgacgtgggtaaaaacctggcccgccgcgccgctgattatcctgatgtttatcggcgcgttgctgctggtcaggcgcatgcggctgctggagatgggcgacgacagcgcctgcgcgctgggcgtgagcgtagagcgctcgcgcctgatgctgatgctggtggcggtcttgctgaccgcagcgtctaccgccatcgccgggccgatctcgtttattgcccttgtcgcgccgcatatcgcgcggcgacttagcggcaccgcgcgctggggattaacccaggcggcgctgtgcggtgcagtattactgctggccgccgatctctgcgcccagcggctgtttacgccttatcaactgccggtgggcgtggtgaccgtcagcctcggcgggatttacctcatcgtcttgctcgttcaggagtcacgcaagaaatga

SEQ ID NO: 2545 - DNA, 663 bp, Enterobacter cloacae
gacacattttatattgaacgtccaatcaaaaaccgctttaatagattaccaacgctgatgaatggagtggcaaaaatgcccaaagtggggatgcagccgatccggcgcaggcagctaatcgatgccacgctggaagcaattaatgaagtgggaatgcatgacgcaaccatcgcgcagatcgcccgtcgggcgggcgtatccacggggatcatcagccactatttcaaagataaaaacggtctgctggaagcgaccatgcgcgacatcaccggtcagctgcgcgacgcggtattaagccgtttacgcgccctgccggacggcagtgcagagcagcgcttgcaggcgattgtcggcggcaattttgatgaaactcaggttagcggcgcggcgatgaaggcctggctggccttctgggccagcagcatgcatcagccgatgctctaccgtttgcagcaggtcagcagccgtcggttgctctcaaacctggtgtacgagttccgccgcgagctgccgcgtgaacaggctgaagaggcgggctacgggctcgccgcactgattgacgggctgtggctgcgcgctgcgctcagcggcaaaccgctggataaaaccctggcccagtcgcttaccagccactttatcagccagcatttaccgaccgactaa

SEQ ID NO: 2546 - DNA, 1059 bp, Enterobacter cloacae
ccaaataagatagataacgataatcactatcattatcaaatcatggatgttgctatgtcgttttcctcttctgcggtgcgcgcccttgccgtgcccgttttattgctactgctaatccttgcgattgcactcagcctgctggtcggcgcaaaaccgctgcccgcgtccgttattgtcgatgcgctatccggtacctgtcagagcgccgactgcaccatcgtgctcgacgctcgcctgccccgcacccttgccggcctgctggccggtggtgcgctcggccttgccggtgccctgatgcaaaccctcacccgcaacccgctggcggaccctggcattctcggcgtgaactctggtgccagtttcgccattgtgctcggcgcggcgctgtttggtttcacctctccgtctgaacagctggtgatggccttctgcggcgcgctggccgcctcgctggtggtggcgtttaccggcagccagggcggcggacagctcagcccggtacgcttaacgctggcgggcgtagcgctcgcggcggtactggaaggcttgtccaacggcatcgccctgctcaacccggacgtgtatgaccagctgcgcttctggcaggcgggttcgctggatattcgtacccttgaaaccttaaaagtggtggtgatcccggcgagcgtcgctgccgccgtggcgctctgtttaagccgggcgctgaacagcctgagcctcggcagtgacaccgcgaccgccctcggcaaccgcgtggcgcgtacgcagctgacgggcctgcttgccatcaccgtgctgtgcggcagcgcgaccgccgtggtcggcccgattgcctttatcggcctgatgatgccgcacatggcgcgctggctggtgggggcggatcaccgctggtccctcccggtaacgctgctggcgacccctgccctgctgctgtttgccgacgtgctgggccgcctgctggtgccgggcgaactgcgtgtctcggtggtcagcgcctttatcggcgcgccggtgctgatcttcctggtacgacgcagacgcgggggtggcgcatga

SEQ ID NO: 2547 - DNA, 1593 bp, Enterobacter cloacae
ttgacgggctgtggctgcgcgctgcgctcagcggcaaaccgctggataaaaccctggcccagtcgcttaccagccactttatcagccagcatttaccgaccgactaaccgaggagaatttatgtcccgaatggcagaacagcagctttatatcaatggtggttatacatccgccaccagcggtcgcaccttcgagaccatcaacccggcgaacggtgaagttctggcgaccgtgcaggccgccgggcgcgaagacgtggaccgcgccgtcgaaagcgcaaagcgcgggcaaaaaatctgggcggcgatgaccgccatggagcgctcgcgcatcctgcgtcgcgccgtcgatatcctgcgcgagcgtaacgacgagctggcaacgctggaaaccctcgacaccggtaaagcgtattccgaaacctcgaccgtcgacatcgtcaccggcgcggacgtgctggagtactacgcggggctgatcccggcgctggagggcagccagatcccgctgcgcgacacctcgttcgtctacacccgccgcgagccgctgggcgtggtggcgggcatcggcgcgtggaactacccgatccagatcgccctgtggaaatccgcgccggcgctggcggcgggcaacgcaatgatcttcaagccgagcgaagtgacaccgcttaccgccctgaagcttgctgaaatctacaccgaagcgggcctgccggacggcgtgtttaacgtcctgccgggcgtaggcgcggagactggccagtacctgaccgagcatccgggcatcgccaaagtctcctttaccggcggcgtcgccagcggcaaaaaagtgatggccaactcggcggcctcgtccctgaaagaggtgacgatggagctgggcggtaaatccccgctgatagtgtttgacgatgcggatctggatctcgcggcagatatcgccatgatggccaatttcttcagctccggccaggtgtgcaccaatggcacccgcgtgttcgtgcccgcgaagttcaaagccgcgtttgagcaaaaaatcgttgagcgcgtgggccgcatccgcgcgggcgatctgttcgatgaaagcaccaactttggcccgatggttagcttcccgcaccgggacagcgtgttgcgctacatcaccaaaggcaaagaggaaggcgcgcgcgtgctgtgcggcggtgacgtgctgaagggtgacggctttgacaacggcgcgtgggtggccccgaccgtgttcaccgactgcaccgacgaaatgaccatcgtgcgcgaagagatcttcggcccggtgatgtccattcttacctatgacactgacgaagaagccattcgccgcgccaatgacaccgactacggtctggcggcgggcattgtcaccgccaatctgaaccgcgcccacggcgctattcatcagctcgaagcgggcatctgctggatcaacacctggggcgaatccgccgcggagatgccggtgggcggctacaaacactccggcattggccgtgagaacggcgtcatgacgcttcagagttacacccaggtgaagtccatccaggttgagatgggtaaattccagtccatattttaa

SEQ ID NO: 2548 - DNA, 720 bp, Enterobacter cloacae
gggcatcaggccgcaccgtcgttcaacgcaacctcctgcctgaaccgccgcaattccaccagcgtcaccagtaagatcgcgccaatcatcgctaacacaaacccgctgctgctcgccgacgccaccggggtcattatcgcccccatcccgccgaggatcgccgcgccaattgcatcgcccgtcacgttctgcgcggtccacaggccgttaatgcgcccgagcatcccttccggcgtctgggtctggatcagggtgtactgtaaaagcgagctgaccgcgctcagccagccaaaaatcaccagacacatcacccccagcgcccacaccggcatcaggctgaagaaaccaatcgcgataaacgaggccagcgtcgccaccagcatgatcagccccggtctcgcgctctgcgccaggttgccgctggtcagcgccccacacgcggcgccgagcggaatggcggcgtacagcacgccaatctctgaggcgctcatctgccactcgcccgccagcgccgggtacagcacgcgcacggcgctcgccatcgtcagcaggccgccgagcagcgcaatgccgccaatcaacgggttgctgaacagaaaacgaatcgcggccatcagggacttcagcggatgctcgcgcggctgcggcggcggtggcaggagcggcagacgcagcagcgtcagggtggtgataaaggttccggctgcggcaaggccgtag

SEQ ID NO: 2549 - DNA, 978 bp, Enterobacter cloacae
cggcaccgcgcgctggggattaacccaggcggcgctgtgcggtgcagtattactgctggccgccgatctctgcgcccagcggctgtttacgccttatcaactgccggtgggcgtggtgaccgtcagcctcggcgggatttacctcatcgtcttgctcgttcaggagtcacgcaagaaatgacagatttaaccacccgcttgcgcggcgaaaacttgaccctcggctacggcaaaaaaatcattgcccgggacttatccgtcgccattccggacggccacttcaccgccattatcgggccaaacggctgcggcaaatcaacattgctgcgcacgctgagccgcctgatgtcgccggttgagggcagcgtgttcctcgacggggagcagatccagcgcttcgccagcaaagaggtggcgcgccgaattgggctgctggcgcaaaacgccaccacgccgggggatattaccgtgcaggagctggtctcccgcgggcgctatccgcaccagccgctgtttacccgctggcgcaaggaggacgacgaggccgtgaagcgcgcgatgcaggcgacgggcatcaccgagctggcccagcaaagcgtcgataccctctccggcggacagcgccagcgcgcgtggatcgcaatggtgctggcgcaggaaacctcgatcatgctgctggacgagccgacgacctggctggatatcagccatcagattgacctgctggagctgctgagcgagctgaaccgtacgcaggggtacaccctggcggcggtgttgcacgacttaaaccaggcgtgccgctacgcgacacatctgattgcgctgcgcgacggcgagattgtggcgcagggcgcgccgaaggagattgtgacgccagagctgatcgcgcggatctacggcatgcgctgcatgattattgacgatccggtggcgggtacgccgttggtggtgccgcttggaaaacgtgcggtctga

SEQ ID NO: 2550 - DNA, 327 bp, Enterobacter cloacae
acgcctgacgctcgcgctcgatctctgccagcaccgccgggtcgaggccgttggcctctttctccgcccagttctgggtttccggcggccaggtatccagcaggccgaggaacgccaccgcttcaccctgctcgcgcaggcgggccgcaatgccctgcgccagcgtgccgccgagggaatagccgaacaggtaatacggcccctgcggctgctgcttacgcaacgtgttcagatgatgttcgatcaccccatcgagatccgcgcactgctgcatcgggccgtttggccgcggcgactgaatgccgacgatggaccagcgcgggctga

SEQ ID NO: 2551 - DNA, 2265 bp, Enterobacter cloacae
ataaccataaaagcgggacgtacaatgaataagaagattcactctctggccttgctggtcaatttagggatttatggtgtcgcgctgcccgccatggcagacgacaacaccgcctccgcgcagcacgaagacaccatggtgatcactgccgccgagcagaatttgcaggcgccgggcgtgtcgaccatcaccgccgatgagatccgcaaaaacccgccagcgcgcgacgtggcggaaatcatccgcaccatgccgggcgttaacctgaccggcaactccaccagcggccagcgcgggaacaaccgtcagattgacattcgcggcatgggcccggaaaacaccctgatcctgatcgacggcaagccggtcaccagccgcaactccatccgtctgggctggcgcggcgagcgtgatacccgcggcgataccggctgggtcccgccggagatgatcgagcgcatcgaagtgatccgtggcccggctgctgcccgctacggtaatggtgcggcgggcggcgtggtgaacatcatcaccaaaaaatttgacgaccagtggcacggctcctggaacacctacctgaacgcgccagagcataaagacgaaggttccaccaaacgcaccaacttcagcctgagcggcccgctgggcggggatttcagcttccgcatgtacggtaacctggataaaacccaggccgacgcgtgggatatcaaccagggtcaccagtctgaccgcacgggcgcttacgccaacaccctgcccgcaggccgtgaaggtgtggaaaataaagacatcaacggcgtggtgcgctgggacttcgcgccgatgcagtcgctggagtttgaagcgggctacagccgccagaacaacctgtatgcgggcgacacgcagaacaccaacaacgacaacgcgctggtgaagaagaactacggtaaagagactaaccgtatctatcgtcagaacttcgccgtgacctggaacggcggctgggataacggcatcaccaccagcaactgggcgcagtacgagcacacccgcaactctcgtctgggtgaagggctggcgggcggtctggaaggcctgttcaacagcaataaattcaccgataccgatctggccgacgtgatgctgcacagcgaaatcaacctgccgattgatttcattgtgaaccagaacctgacgctcggcaccgagtggaaccagcagcgcatgaaggactcaacctcctttacacaaacccagcaggggggcaccatcccgggcatgagcgaagatcgtagcccgtacacgtcagcggagatcttctccctgtttgccgaaaacaacatggagctgaccgacagcaccatgctgacccctgccctgcgcttcgaccaccatactattgtgggtaataactggagcccgtccctgaacctgtcgcaaggtctgggggatgacttcaccctgaagatgggcatcgcgcgcgcctataaagcgccaagcctgtatcagaccaacccgaactacctgctgtacagtaaaggccagggctgctacgccagctccgacggcgtgggctgctacatgatgggtaacgacgatctgaaagcggaaaccagtatcaacaaagagattggcctggagtggaaacgcgacggctggctggctggcgtgacctggttccgcaacgactatcgcaacaagattgaagcgggctacgcgccgattggccagacgtccaccggcaaagtcaccaccgacatctaccagtgggaaaacgtgccgaaggcggtagtggaaggtctggaaggctccctgaacgtgccggtcagcgacaccatcaactggaccaacaacatcacctacatgctgcaaagtaagaacaaggagaccggcgatcgtctgtcgatcatcccggagtatacgctgaactctaccttgagctggcaggtacgtcaggatgtctcattgcagtcgaccttcacctggtacggcaagcagcagccgaagaagtacaactacaaaggtcagccggtgaccgggtctgagaaagacgaagtcagcccgtacagcatcgttggtctgagcgcgacctgggacgtgaccaaaaacgtcagcctgaccggcggcgtggacaacgtcttcgacaagcgccagtggcgcgcgggtaacgcccagaccacgggtaataccacgacgggtgcgtatatgtacggcgcgggtgcgtatacgtataatgaaccgggtcgcacctggtacatgagcgtaaatacgaggttctga

SEQ ID NO: 2552 - DNA, 762 bp, Enterobacter cloacae
tgtttgctccctctccctttgggagagggctggggtgagggcatcaggccgcacaatactgaagggaaaaccatgcacaccacccacagcacattttctctcgctggccacaccctccaccgcatcaccttcgaccccaccacctttacggatgccgatctcctctggctcccccaccacgcccagttggctaacgccggacgcaaacgcaaggccgaccacctcgcaggccgcatcgccgccgcgcacgccttacctgactacaccatgcccgccatcggccccagcggggaaccgctctggccgcaaggaatttccggcagcatcacccacagcggcacgcaggcgatagccgtcgtcacgcaatacccggcgcttatcggcatcgattgtgaaacgatcctctccgaaaacgaagccagggaaatcaaagacggcatcattgatacacaggaagaacctgtgctttcccgcctgggatacccgttcgccctcgccctgacgctggtcttcagcgccaaagagagcctgtttaaggccctctttccgcaggtacaggcctggatgggttttgactgcgcccgcgttaccatgctcgacgataagacgcttacgctggcattgacctgtcaactagcagactttcaagaaggcaccgccttccccctgcactggcagcagcacggcgaacaggtcatcactctgctgtcacacgctcctggcgacgagccttcacgctggtcaccacaaacgtcacgataa

SEQ ID NO: 2553 - DNA, 1722 bp, Enterobacter cloacae
agtccatccaggttgagatgggtaaattccagtccatattttaaccgggaggtttatttgcaatttgactacatcattatcggggccggctctgccggcaacgtactggcaacacgactgactgaagatccaaacaccaccgtcctgctgcttgaagcgggcgggccggactaccgctttgacttccgcacccagatgcctgccgcactggccttcccgttgcagggcaagcgctacaactgggcgtatgaaaccgagccagagcctttcatgaacaaccgccgcatggagtgcggacggggtaaagggctgggcggctcgtcgctgatcaacggcatgtgctacgtgcgcggcaatgcaatggatctggacaactgggcgaaagaaccgggtctggagcactggagctatctcaactgcctgccctactaccgcaaggcagagacccgcgacgtggggccgaacgactaccacggcggcgacggtccggtgagcgtcaccacctctaagccgggtgtgaacccgctatttgaagcgatggtggaggcaggcgtgcaggcgggctacccgcgcaccgacgatctcaacggctatcagcaggaaggctttggcccgatggatcgcacggtcacgccgcagggccgacgcgccagcaccgcgcgcggctatctggatcaggccaaaccgcgcccgaatctgaccatccgcacccacgccatgaccgatcacattatctttgacggcaagcgcgcggtgggcgtcgagtggctggaaggcgaaagcaccattccgtcaaaagcgacagcgaagaaagaggtactgctgtgcgcgggcgccatcgcgtctccgcagatcctccagcgctccggcgtgggcaacgctgaactgctgaagcagtttgatatcccgctggtacatgatttacccggagtgggtgaaaacttgcaggatcacctggagatgtatcttcagtatgaatgtaaggagccggtctccctctaccctgccctgcaatggtggaaccagccgaagattggcgcggagtggctgtttggcggcacgggcgtgggcgcgagcaaccacttcgaagcaggcgggtttatccgcagccgcgaggagttcgagtggccgaacattcagtatcacttcctgccggtggcgattaactacaacggctcgaacgcggtgaaagagcatggttttcagtgccacgttggctccatgcgctccccgagccgcggccacgtgcgcatcaagtcgcgcgatccgcaccagcatccggcgatcctgttcaactacatgtcccacgagcaggactggcaggagttccgcgacgcgatccgcatcacccgcgagatcatgcaccagcctgcgctggacaagtatcgcggtcgtgaaatcagcccgggcgtcgaatgccagaccgacgaacagctggacgagttcgtgcgcaaccacgccgaaaccgccttccacccgtgcggtacctgcaagatgggctacgacgaaatggcggtggtcgacggcgaaggccgcgttcacgggctggaagggttacgcgtagtggatgcgtcgattatgccgcagattatcaccggcaacctgaacgccaccaccatcatgattggcgaaaagattgccgacgccattcgcgggcgcgagccgctggcgaagagcacggcggcgtattatgtggcgaacggggcgccggttcgccgttaa

SEQ ID NO: 2554 - DNA, 435 bp, Enterobacter cloacae
agcacatttgaggtggttatgaaaaaaattgcatgtctttcagcactggcagctgttctggctgtttccgcaggtaccgctgtagcggcaacttctactgtaactggtggttacgctcagagcgatatgcagggcgtgatgaacaaaaccaacggtttcaacctgaagtaccgttacgagcaagacaacaacccgctgggtgtgatcggttctttcacttacaccgagaaagatcgtactgaaaatggctcttacaataaaggtcagtactacggcatcaccgcgggtcctgcttaccgcctgaatgactgggcaagcatctacggtgttgtaggtgttggctacggtaaattccagcagaccgaaaaccagggtctgaaccgtactgcaagcaacagcgactatggtttctcctatggcgcaggtatgcagttc

SEQ ID NO: 2555 - DNA, 531 bp, Enterobacter cloacae
gcagatcccattctaaaccttatggagtcgaccatgttaaaccagctggaaagcctgactgagcgcgttggaggaagtaacaccctggtggatcgctggctacatgtgcgcaagcatctccttgtggcgtattacaatctggtcggtcttaagcctggcaaagaatcctttatgcggctgaacgaaaaagcgctggatgatttttgtcagagccttgtcgactacctctccgacggccatttcaacctttatgaacgcattatccgcgaaatggaagggacaacgccgtatttagcggccagtaaactctgtccgctgctggaagccaacacccagcggatcatggactactacgattccgcgctggagaacgctatcgatcacgataactatcttgagtttcagcaggcgctttccgaccttggcgaagcgctggaagagcgattcacgctggaagacaagctcatcgccctcgtgctggacaacaacctgaatatcagcaccagcgataacgttgcgcgccctgcttga

SEQ ID NO: 2556 - DNA, 1899 bp, Enterobacter cloacae
gctatgtctactgcaaaactgacccgccgcgaacagcgcgaacacgcacaacgcttcatcgacaccctggaaggcaccgctttcccgaactcgaaacgcatctacatttccggctcacaggctgatatccgcgtcccgatgcgcgaaatccagctcagcccgacgcttatcggcggcagcaaagacaacccgcagtttgaagacaacgaagccgtgccggtgtatgacacctcgggcccgtacggcgatcctgatgttgctatcaacgtccagcagggtctggcaaagctgcgccagccgtggatagaggcgcgtaacgactgcgaagaactgagcgtgcgcagctctgcgtacaccaaagaacgcctggccgacgacggtctggacgcgctgcgctttaccggcctgctgacgccgaaacgcgctaaagcgggcaaatgcgtaacccagctgcactacgcgcgccagggtatcgtcacgccggagatggagttcatcgccatccgcgaaaacatgggccgcgagcgcatccgcagcgaagtgctgcgccaccagcatccgggtgaagggtttggcgctcgcctgccggagaacatcacgccggaatttgtgcgtgatgaagtggccgccgggcgcgccattatccccgccaacatcaaccacccggaatccgagccgatgattatcggccgcaacttcctggtgaaggtcaacgccaacatcggcaactcagcggtgacgtcatccatcgaagaagaggtggaaaagctggtctggtcgacgcgctggggcgcggatacggtgatggacctttccaccggccgctatattcacgaaacccgcgaatggatcctgcgtaacagcccggtgccgattggcaccgtcccgatttatcaggcgctggagaaggtcaacggcatcgccgaaaacctcacctgggaagcgttccgcgacacgctgctggagcaggcggaacagggcgtggactacttcaccatccacgcgggcgtgctgctgcgctacgtgccgatgacggcgaaacgtctgaccggtatcgtctcacgcggcggttcgattatggcgaaatggtgcctttcccatcatcaggaaaacttcctctacgaacacttccgcgaaatctgcgaaatttgcgccgcgtacgacgtctccctgtcgctgggcgacggcctgcgtcctggctccatccgcgatgctaacgacgaggcgcagtttgccgagctgcacacgctgggcgagctgaccaaaatcgcctgggagtacgacgtgcaggtgatgattgaaggcccgggccatgtgccgatgcagatgatccgtcgcaacatgaccgaagagctggagcactgccacgaagcaccgttctacacgctggggccactgacaactgacatcgcgccgggctatgaccacttcacgtcaggcattggggcggcgatgatcggctggttcggctgcgccatgctctgctacgtgacaccgaaagagcacctcggcctgccaaacaaagaggacgtgaagcagggactgattacctacaagattgccgcccacgcggcggatctggcgaaaggccatccgggcgcgcaaattcgcgacaacgccatgtccaaagcgcgctttgaattccgctgggaagaccagtttaacctggccctcgatccgttcaccgcccgcgcctaccacgacgaaaccctgccgcaggaatcgggcaaagtcgcgcacttctgctccatgtgcggaccaaaattctgctcgatgaaaatcagccaggaagtacgcgattacgccgccgcgcagaccattgaagtcggcatggcggacatgtcggaaaccttccgcgcgaaaggcggcgaaatctacctcaaaaaagaggaggcataa

SEQ ID NO: 2557 - DNA, 945 bp, Enterobacter cloacae
cgcagctggcggcccacgttaagcgccttgccgattaccccaccgttgccatcggcgggatcagccttgaacgcgcgcccgccgtgctggaaaccggcgtcggcagtatcgccgtcgtcagcgctatcacccaggccgcagactggcaggccgccaccgcacggcttttacaactggcaggagcaggcgatgaaagatcgtgattttatgcgctacagccgccagatcctgctggaggatatcgccattgacgggcagcaaaagctgctcgccagccgggtactgattgtcggtctgggtggattaggcgcccccgccgcgctgtatctggctggcgcgggcgtgggcacgctggtgctggccgatgacgatgaggtacatctcagcaatctgcaacggcaaatcctcttcacgacagaagatgttaaccagcctaaagcgcacgttacgcgccagcggctgaaccagcttaaccccgatatcgaactggtcgcgctccagacgcggctgagcggggaagatctgcaacgcgaagtggcccttgccgacgtggtgctggactgtacggacaatatggcgacgcgtcaggccatcaacgcggtctgtgttgcgcagaacacgccgctgatcaccgccagcgcggtcggtttcggcgggcaaataatggtgcttacgccgccgtgggcacagggctgctaccgctgcctgtggcctgacgaggctgaaccggagcgtaactgccgcacggcaggcattctgggcccggtggtgggcgtgatgggtactcttcaggcgctggaggccatcaagttgctcagcggcatggagacagaacgcaacacgctgcggctgttcgacgcccgctccagcggatggcgtcatctggtgttaaaccgcgccagccactgcccggtatgcggaggccgcaatgcgcattctgtttaa

SEQ ID NO: 2558 - DNA, 357 bp, Enterobacter cloacae
tgccgtactggaaaaagcgctcaaacttctggagtcataatggaagacttagaaaccacgatcatggaactgctggtcaacgcaggcgcggcgcgcagcgcggctctgacggcgttgcagatggcgcgaaaaggcgactttgacgaagccgagaaagcgatggaagagtcgcgtgaatatgtgaaacatgcgcatacgatccagacgcagcttatcggtcttgacgaagggacaggaaaactgccggttaacctgatcaccgttcattctcaggaccacctgatgaacgcgatggtaattcaggatctggcgggcgacatgattgagctttatcgacgcatcccgctggtaaactga

SEQ ID NO: 2559 - DNA, 237 bp, Enterobacter cloacae
accgcgccagccactgcccggtatgcggaggccgcaatgcgcattctgtttaacgatgagccgatgacgtgcgacgacgatcttaccgttgccgccctgctcgacacgctgcgccagctgaagccgggaacggcgctggcgctcaatcaacagatcctgccgcgcgagcggtgggaacatcagcaggtcaatgaaggcgaccagatcctgctgtttcaggttatcgcagggggctga

SEQ ID NO: 2560 - DNA, 1800 bp, Enterobacter cloacae
gagcggcagccagctggtgacactggcgatgaagcgcgtggatttgcgtcagcacaacgatgccatacttgcgccgttacgggaggcaggcgtgacgctcttaccgaatacctccggtgcgaaaacggccgaggaagcaattttcgctgcgcaactggcgcgggaagcgctcggcacccgctggctgaagctggaaattcatccggacgcccgctggctgttgcccgatccgatcgaaaccctgaaagcggcagagaagctggtgcagcagggatttaccgtcctgccctactgcggtgccgaccccgtgctgtgcaagcgtctggaagaggtcggctgcgcggccgtaatgccgttaggggcacccattggctccaaccagggactggagacccgcgcgatgctggagatcatcatcgagcaggcgaccgtgcccgtggtggtggatgcgggcatcggcgtacccagtcacgccgcgcaggcgctggagatgggggccgatgcggtgctggtcaataccgcgattgcggtggccgacgacccggtgatgatggcgcgtgcgttccgccttgcggtggagtccggtctgctggcacgccagtccggccccggctcgcgctgcgttcaggcgcaggccaccagcccgctgaccgattttctggaggcgctctgatggctacctttaccgatcgctggcgtcagctgaactgggacgatattgccttacgcatcaacagtaaaacctctgcggacgtagagcgggcattaacagccaaacatttgacccgcgaggatttgatggcgctgctttctccggcagccggcgcgtaccttgaaccgatggcgcagcgcgcgcaacgcctcacccgccagcgttttggcaacacggtgagcttttacgtgccgctctatctttctaacctgtgcgccaacgactgcacctactgtggtttctccatgagcaaccgtattaagcgtaaaacgctggatgagcatgagatcgcccgcgagtgtgcggctattcgtgagatgggttttgaacatctcctgctggtgacgggtgaacatcagggcaaagtggggatggactattttcgccagcatcttccggccatccgccgcgaatttgcctcgttgcaaatggaagtgcagcctttgtcgcaggaggaatatgcggagctgaaaacgctcgggctggacggcgtcatggtctatcaggaaacctaccacgaggcgacctatgcccggcatcacctgaaagggaagaagcaggatttcatcttccggctggaaacgccggacaggctggggcgcgccggtatcgataaaattgggctgggcgcgcttatcggtctgtccgacagctggcgggtggactgctatatggtggcggagcatctgctgtggctacagcagcgctactggcaaagccgctattccatctctttcccgcggctgcgtccgtgtacgggaggcgttgaacccgcttcgctgatggatgagcgccagctggtgcaaaccctgtgtgcatttcgcctgttcgcgccggaagtggaattgtcgctctccacgcgtgaatcacccgcgtttcgcgaccgcgcgatcccgctggcgatcaataacgttagcgccttttccaaaacgcagccgggcggttacgcggacgatcacccggaactggaacagtttgcaccgcacgacggacgacggcccgaagcggtggcggaagccctgactgcccaggggctacagcccgtgtggaaagactgggatagctggctgggaagagcctcgcattag

SEQ ID NO: 2561 - DNA, 1656 bp, Enterobacter cloacae
atcatctcgtcggtaatcgccttctgtataatttactaccagcaaccggacagcgactatgctgagggtatcgacagacgcaacgcgtctaccatctggattgatgtacaactcatggcactccacagtaaaaagctctcttttacgcggccaattatggtcagcttcgcggggatcctgctcagttttgcgctgatcgccatcctggttatcctttcacagagaaaggattttcttgaggattatcataagattaatggtaacttcacccataatctggcggtaaactataccgaatccatcctgcgagaaaatgactatattcttggtcgtgctgcgatgtacttcgcccgtaacgacagagtaaatcagacaattaatatcgacccgacacacggtttgcagatgttgatgcatttgcagaacctgatgccgacggtgtcgtctatctctctggcggacacagtagggcgccatctgcgcgcgccggaagtgctgccaacggagaagggtaagtcgttcgacgcccggacccgtccatggtttatcggacaagcggaagccagtaactttccgcactacacccgcccctatctggactattttacccaacatcctacggtcactctctataagccggtcatttcaccggaaggccgcctgaagggcacgctcgctttccatcttgatttaacatccatggggtataccctgcgccagatggtggcgccggttcagggtgagttttttgttgtggagcgtgacggcgctgttgtgctgcatccggacacgggggcgctctttaagcagtacgtaagcgaagcgctgatggacaaaatgaccagcggcgagggccatcttttcgaccccaaaagtaaaacctggtattactactactctttcaccaatccggactggtttgtgatttatcgggtctccgatgccacgcttaccgtcatcacccggcatgaaaccaccgtcgtcggctggggatttgcgctggcggcaatcatcatcattctgttcgggctttatcttcgtcatgcctcgcgttctgtgctgatgaacattatcaacgccatcaaaaccggagacgtcaatcaggcgccacgtcttgaggcgatgctcagccataccattcgaaccaataaagaacgcgagctggcctatgtccgacaggccacccatgatgcgctgacaggctgcaagaaccgccgtgcgttcgacaacgatgtggatgagctgctgaccgctcatcaacccttcgttctggcgctggtcgatatcgataacttcaaatctattaacgacacctggggccacctgagcggggatattgtgctgcgcaacgtggcacgcgaaggtattcagatcatgcagccgcaccacgtttccgtttaccgctacggtggagaagagttcggcgtgatcttcccggccgagctgatgaactccgcgcacgcgctactggaagcctggcgcaccgccgttgaaaagcggacctggcgggaagagaacctgcgagtgaccttcagcgccgggacgggagagtggcacttcgaaccgctggaacaatttatcggtagcgtagatgaagcgctgtataccgctaaacaacagggtaaaaaccgcatcgtaagcacggccagccgataa

SEQ ID NO: 2562 - DNA, 342 bp, Enterobacter cloacae
ttatcaataaacacatgtagatcgaggctgactatgaagaacatcgttttatgctgtgcagcgggaatgtcaaccagcatgctggttcaacgtatgaaagatgccgcgcagaaaaaaggagtcgaagtaaccattaaagccgttccggtcgcggagttcaaagataacatcgcgacggctgatatcgtattactggggccacaggtcaaatacgaacaggcaaaactccaggcgcaggccgatccgctcggaaaaaaggtcgcggtcatcgacatgatggattacggcatgatgaaaggtgatgccgtactggaaaaagcgctcaaacttctggagtcataa

SEQ ID NO: 2563 - DNA, 1734 bp, Enterobacter cloacae
acgttgatctccacgcctggtgaaaacgttttcgttaagatgctcgcgctttacaaggatgcctcgtcaggtgtgttagatgagtttttcacagggaaaattcatctaacgctctctgtaatcgtgaaatccaggggatttaccatgcaacaacgtcgtccagtccgccgcgctctgctcagtgtttctgataaagccggtatcgtcgaattcgcccaggcactttccgcacgcggtgtggagctgctttctacaggtggcaccgcgcgcctgttagcagagaaaggtctgccggtaaccgaagtgtccgattacaccggtttcccggaaatgatggatggacgcgtcaaaaccctgcatccgaaagtccacggcggtattcttggccgtcgcggtcaggacgacgccattatggaacagcacgatatcgcgcctatcgatatggtcgttgttaacctctacccgttcgcccagaccgtcgcccgcgaaggctgctctctggaagatgcggttgaaaatatcgatatcggcggcccgaccatggtgcgctccgcagccaagaaccataaagatgtggccatcgtggtgaagagcagcgactacaacgccattattaatgagatggatgccaacgaaaggtccctgacacttgaaacgcgtttcgatctcgccatcaaagccttcgagcataccgccgcctacgacagcatgatcgccaactacttcggtagcctggtaccggcttaccatggtgaaagcaaagatccctctggccgcttcccgcgcaccctgaacctgaacttcattaagaagcaggatatgcgttacggtgagaacagccaccagcaggctgccttctatatagaagaagaggtaaaggaagcctccgttgcgaccgcccagcaggttcagggcaaagccctttcctataacaacattgccgacaccgacgccgcgctggaatgcgtgaaagaattcagcgagccggcctgcgttatcgtcaagcacgccaacccatgcggcgttgcggtaagcacttctattctggatgcctacgatcgcgcctacaaaaccgacccgacctccgcgttcggcggcattatcgcctttaaccgcgagctggatgcggaaaccgcgcaggccatcatctcccgccagtttgtcgaagtgatcatcgcgccgtccgcatcagaagaagcgctgaaaatcactgcggcaaaacagaatgtgcgcgtgctggtttgcggtcagtgggcggaacgcgtgccgggcctggacttcaagcgcgtgaacggcggtctgctggttcaggaccgcgatctggggatggtgacagaagccgacctgcgcgtggtgaccaaacgtcagccgaccgaacaggagctgcgtgacgcgctgttctgctggaaagtggcgaagttcgtgaagtctaacgcaattgtttacgccaaagagaacatgaccatcgggataggcgcaggccagatgagccgcgtttactctgcaaaaattgccggtatcaaagcaggcgacgaaggcctggaagtgaaaggctccgccatggcctctgacgccttcttcccgttccgcgacggtatcgacgctgcggctgcggtgggcatcacctgtgtgatccagcctggcggttcaatccgtgatgacgaagtgattgccgctgccgacgagcatggcatcgcaatgatcttcaccgacatgcgccacttccgccattaa

SEQ ID NO: 2564 - DNA, 1308 bp, Enterobacter cloacae
ttcccggagcagaaaatgaaagtattagtgattggtaacggcgggcgcgagcacgccctggcgtggaaagcagcgcagtctccgcaggttgaaaccgtctttgtggcaccgggtaatgccggtacggcgctggaacccgcgctgcaaaacgtcgccatcggcgtgaccgatatcccggcactgctgagctttgcccagaccgagaacatcgatctgaccatcgttggcccggaagcgccgctggtgattggcgtcgtagacgccttccgcgcagctggcctgaaaatctttggcccaacggagggtgccgcacagctggaaggctcaaaagccttcaccaaagattttctcgcgcgtcataacatcccgacggcggaatatcagaatttcactgaagtggagcctgctctggcctggttacgtgagaagggcgcgccgattgttatcaaggccgacggtctggccgcgggtaaaggcgtgatcgtcgcgatgaccctcgaagaagccgaagccgcggttcaggatatgctggcaggtaacgcctttggcgatgcgggccaccgcatcgtgattgaagagttcctcgacggcgaagaggcgagctttatcgtgatggtcgatggcgagcacgttctgccgatggccaccagccaggatcacaagcgtgtgggcaatggcgataccggccccaacactgggggaatgggcgcttactctcctgctcccgttgttaccgatgaggtgcatcagcgcaccatggaccgcatcatctggccaaccgtgaaagggatggcggcggaaggcaatacctacaccggtttcctttatgcaggcctgatgatcgacaagcagggtaacccgaaggtgatcgaattcaactgccgctttggcgatccggaaacccagccgatcatgctgcgcatgaaatccgacctggtggatctgtgccttgcggcctgcgaaggcaaactggatgagaaaacgtcagagtgggacgagcgtgcctctttaggtgtggtgattgctgcgggtgggtatccgggtagctacaacactggagatgagatccacggcctgccgctggaagagattgacggcgcgaaggtgttccacgccggtacgaagctggctgacgatgaccgcgtgctcaccaacggcggccgcgtgctgtgtgcgaccgcgctgggccagaccgtggcagaagcgcagaaacgcgcctatgcgctgatggcggatattcactggaacggcagcttcagccgtcaggatatcggttatcgtgctattgcgcgggagcagggagagtaa

SEQ ID NO: 2565 - DNA, 717 bp, Enterobacter cloacae
agtcggcatggcggacatgtcggaaaccttccgcgcgaaaggcggcgaaatctacctcaaaaaagaggaggcataatgtaccagcctgatttcccccctgtccccttccgcttagggctttacccggtggtggacagcgtggcgtggatagcgcgcctgctggaggcaggcgttcgcacgatccagctacgcattaaggataaacgcgatgaagaggtggaggccgacgtgatcgccgctatcgcgctgggacgtcgctaccacgcccgcctgtttatcaacgactactggcggctggcggttaaacaccaggcgtacggcgtgcatctgggacaggaagatctggaaacgaccgatctcaacgcgatccgtgacgtcggtctgcggctgggcgtttctacccatgacgatatggagatcgacgtggcgctggcagcccgcccctcttacatcgcgctcggtcacgttttcccgacgcaaaccaaacagatgccgtccgctccacagggcttgacgcagctggcggcccacgttaagcgccttgccgattaccccaccgttgccatcggcgggatcagccttgaacgcgcgcccgccgtgctggaaaccggcgtcggcagtatcgccgtcgtcagcgctatcacccaggccgcagactggcaggccgccaccgcacggcttttacaactggcaggagcaggcgatgaaagatcgtga

SEQ ID NO: 2566 - DNA, 885 bp, Enterobacter cloacae
agccgggaacggcgctggcgctcaatcaacagatcctgccgcgcgagcggtgggaacatcagcaggtcaatgaaggcgaccagatcctgctgtttcaggttatcgcagggggctgagatgttacgtattgccgacaaagtctttgattcacatctgtttaccggaaccggaaaattcgcctccccgcagctgatggtggatgccattcgtgagagcggcagccagctggtgacactggcgatgaagcgcgtggatttgcgtcagcacaacgatgccatacttgcgccgttacgggaggcaggcgtgacgctcttaccgaatacctccggtgcgaaaacggccgaggaagcaattttcgctgcgcaactggcgcgggaagcgctcggcacccgctggctgaagctggaaattcatccggacgcccgctggctgttgcccgatccgatcgaaaccctgaaagcggcagagaagctggtgcagcagggatttaccgtcctgccctactgcggtgccgaccccgtgctgtgcaagcgtctggaagaggtcggctgcgcggccgtaatgccgttaggggcacccattggctccaaccagggactggagacccgcgcgatgctggagatcatcatcgagcaggcgaccgtgcccgtggtggtggatgcgggcatcggcgtacccagtcacgccgcgcaggcgctggagatgggggccgatgcggtgctggtcaataccgcgattgcggtggccgacgacccggtgatgatggcgcgtgcgttccgccttgcggtggagtccggtctgctggcacgccagtccggccccggctcgcgctgcgttcaggcgcaggccaccagcccgctgaccgattttctggaggcgctctga

SEQ ID NO: 2567 - DNA, 4167 bp, Enterobacter cloacae
atcgcaatgaaatggtttaagcgtgatagcaacaggtattgcggaaagtattcaattttccggtccacaaaatggtgttgcacaaactgtcccttcgtcggacagatgggtcgacttgtcagcgagctgaggaaccctatggtttactcctataccgagaaaaaacgtattcgtaaggattttggtaaacgtccacaagttctggacattccatatctcctttctatccagcttgactcgttccagaagtttatcgagcaagatcctgaagggcagtacggcctggaagcagccttccgttccgtgttcccgattcagagctacagcggtaattccgagctacagtacgtcagctaccgccttggcgaaccggtgtttgacgttcaggaatgtcagatccgtggcgtgacctattccgcaccgctgcgcgtaaaactgcgtctggtgatctacgagcgcgaagcgccggaaggcaccgtaaaagacattaaagaacaagaagtctacatgggtgaaattccactcatgacggacaacggtactttcgttatcaacggtactgagcgtgttatcgtttcccagctgcaccgtagcccgggcgtcttcttcgacagcgataaaggtaaaacgcactcttccggtaaagtactgtataacgcacgcatcattccttaccgtggttcatggctggacttcgaattcgatccaaaagacaacctgtttgtccgtatcgaccgtcgtcgtaagctgcctgcaaccatcattctgcgtgcactgaactataccactgagcagatcctggacctgttctttgagaaagtgatctttgaaatccgcgacaacaagttgcagatggagttggtgccggaacgtctgcgtggtgagaccgcgtcgttcgacatcgaagccgacggcaaagtgtatgtggaaaaaggtcgccgtatcaccgcgcgccacatccgccagctggaaaaagatgatatcaaacacatcgaagttccggttgaatacattgcaggaaaagtagccgcgaaagattacgttgatgaatcaactggcgagctgatctgcccggcgaacatggagctgagcctggatctgctggctaaactgagccaggctggccacaaacgtatcgaaacgctgttcaccaacgatctggaccacggtccgtacatctctgagactgtacgcgtcgacccaaccaacgatcgtctgagcgcgctggtcgaaatctaccgcatgatgcgtcctggtgagccaccaactcgcgaagcggctgaaagcctgttcgagaacctgttcttctccgaagaccgctacgatctgtccgcggttggtcgtatgaagttcaaccgttctctgctgcgcgacgagatcgaaggttccggtatcctgagcaaagacgacatcattgaagtgatgaagaagctcatcgatatccgtaacggtaaaggcgaagtggacgatatcgaccacctcggcaaccgtcgtatccgttccgtaggcgaaatggcggaaaaccagttccgcgttggcctggtacgtgtagagcgtgcggtgaaagagcgtctgtctctgggcgatctggataccctgatgcctcaggatatgatcaacgccaagccgatttctgcggcagtgaaagagttcttcggttccagccagctgtctcagttcatggaccagaacaacccgctgtctgagatcacgcacaagcgtcgtatctccgcactcggcccaggcggtctgacccgtgaacgcgcaggctttgaagttcgagacgtacacccgactcactacggtcgcgtatgtccaatcgaaacgcctgaaggtccaaacatcggtctgatcaactccctgtccgtgtacgcacagacgaacgaatacggtttcctcgagaccccgtatcgtaaagtgaccgacggtgttgttactgacgaaattcattacctgtctgctatcgaagaaggcaactacgttatcgctcaggcgaactccaacctggatgacgaaggccactttgtagaagatctggttacctgccgtagcaaaggcgaatccagcttgttcagccgcgaccaggttgactacatggacgtatccactcagcaggtggtatccgtcggtgcgtccctgatcccgttcctggaacacgatgacgccaaccgtgcattgatgggtgcgaacatgcaacgtcaggccgttccaactctgcgtgctgacaagccgctggttggtaccggtatggaacgtgctgttgccgttgactccggtgttacagcagttgctaagcgtggcggtaccgttcagtacgttgacgcatcccgtatcgttatcaaagttaacgaagacgagatgtatccgggcgaagcgggtatcgacatctacaacctgaccaaatacacccgctctaaccagaacacctgtatcaaccagatgccatgtgtgtctctgggtgagccagttgagcgcggcgacgtgctggcagatggtccgtccaccgacctcggtgaactggcgctcggtcagaacatgcgcgtagcgttcatgccgtggaacggttacaacttcgaagactccatcctcgtctcagagcgtgtggttcaggaagatcgtttcaccaccatccacattcaggaactggcatgtgtgtcccgtgacaccaagctggggccagaagagatcactgccgacatccctaacgtgggtgaagctgcgctctccaaactggatgaatccggtattgtttacatcggtgcggaagtcaccggcggtgatattctggtaggtaaggtgacgccgaaaggtgaaacccagctgacgccagaagagaaactgctgcgtgctatcttcggtgagaaagcgtctgacgttaaagactcttctctgcgcgtaccaaacggtgtttccggtacggttatcgacgttcaggtcttcactcgtgatggcgttgagaaagataagcgtgcgctggaaatcgaagagatgcagctcaaacaggctaagaaagacctgtctgaagaactgcaaatcctcgaagcaggtctgttcagccgtatctatgcggtgctggttgccggtggcgttgaagctgagaagctcgacaaactgccacgcgatcgctggctggaactgggcctgaccgacgaagagaaacagaatcagctggaacaactggctgagcagtatgacgaactgaaacacgagttcgagaaaaaactcgaagcgaaacgccgtaaaatcactcagggcgacgatctggcaccaggcgtgctgaagattgttaaggtgtatctggctgttaaacgtcagatccagcctggtgataagatggcaggtcgtcacggtaacaagggtgttatctctaagatcaacccgatcgaagatatgccgcacgatgctaacggtacgccggtagatatcgtactgaacccactgggcgtaccgtctcgtatgaacatcggtcagattctggaaacccacctgggtatggctgcgaaaggtatcggcgataagatcaacgccatgctgaaacagcagcaggaagtcgcgaaactgcgcgagttcatccagcgtgcctatgatctgggtaccgacgttcgtcagaaagtcgacctgaacaccttcagcgatgaagaagtgctgcgtctggcagagaacctgcgcaaaggtatgccaattgcaacgccggtattcgacggtgcaaaagaagctgaaattaaagagctgctgcaactgggtggtctgccaacgtctggtcagattacgctgtttgacggccgtaccggtgaacagttcgagcgtccggtaaccgtaggttacatgtacatgctgaaactgaaccacctggtcgacgacaagatgcacgctcgttctaccggttcttacagcctggttactcagcagccgctgggtggtaaggctcagttcggtggtcagcgcttcggggagatggaagtgtgggcgctggaagcatacggcgcagcatacaccttgcaggaaatgctcaccgttaagtctgatgacgtgaacggtcgtactaagatgtataaaaacatcgtagacggcaaccatcagatggagccgggcatgccagaatccttcaacgtactgttgaaagagattcgttcgctgggtatcaacatcgaactggaagacgagtaa

SEQ ID NO: 2568 - DNA, 612 bp, Enterobacter cloacae
ttttcgattcgagacatcatcatgttacaaaacccgattcatctgcgccttgaaaagctggaaagctggcagcacgtgacgtttatggcttgcctgtgcgagcgcatgtatcccaactatgccgcgttctgcaagcagacagcgtttggcgaaggccagatttatcgtcgtatcctggatttaatctgggagacgctgacggtcaaagacgcgaaggtgaattttgactctcagctcgaaaagctggaagaggctattccggctgcggatgatttcgacctgtatggcgtctacccggccattgatgcctgtgtggcgttgagcgagctgatccactcccgtctgagcggtgaaaccctggaacacgccattgaagtcagtaaggcatccattaccaccgttgcgatgctggaaatgacccaggaaggccgtgaaatgaccgacgaagagctgcgtgctaacccggcggtagaacaggaatgggacattcagtgggagattttccgcctgctggcagagtgtgaagagcgtgatattgagctgatcaaagggctgcgcgcggacctgcgcgaggccggcgagagcaatattggtataatttttaaccaatga

SEQ ID NO: 2569 - DNA, 276 bp, Enterobacter cloacae
cttatgaacaagactcaactgattgatgtaattgcggacaaggctgatctgtctaaagtgcaggctaaagctgctctggaatctaccctggctgctattactgagtctctgaaagaaggcgatgctgtacaactggttggtttcggtaccttcaaagtgaaccaccgcgctgagcgtactggccgcaacccgcagaccggtaaagaaatcaaaatcgccgcagctaacgtgccggcatttgtttctggtaaagcactgaaagacgcagttaagtaa

SEQ ID NO: 2570 - DNA, 4266 bp, Enterobacter cloacae
cgcccgacagcagagtgtgctaactccgacgggagcaaatccgtgaaagacttattaaagtttctgaaagcgcaaactaaaaccgaagagtttgatgcgatcaaaattgctctggcttcgccagacatgatccgttcatggtctttcggtgaagttaaaaagccggaaaccattaactaccgtacgttcaaacctgagcgtgacggccttttctgtgcgcgtattttcgggccagtaaaagattacgagtgcctgtgcggtaagtacaagcgcctgaaacaccgtggtgtgatctgtgagaagtgcggcgttgaagtgacccagaccaaagtacgccgtgagcgtatgggccacatcgagctggcgtctccgaccgctcacatctggttcctgaaatctctgccgtcccgtatcggcctgctgctggatatgccgctgcgcgatatcgaacgtgttctgtacttcgaatcttatgtggttatcgaaggcgggatgaccaatctggaacgtaaccagatcctgaccgaagaacagtatctggacgcgctggaagagttcggtgacgaattcgacgcgaagatgggtgcggaagctatccaggccctgctgaagagcatggatctggagcaagagtgtgaaactctgcgcgaagagctgaacgaaaccaactccgagaccaagcgtaaaaagctgaccaagcgtatcaaactgctggaagcgttcgttcagtctggtaacaaaccagagtggatgatcctgaccgttctgccggttctgccgccagatctgcgtccgctggttccgctggatggtggtcgtttcgcaacgtcagatctgaacgatctgtatcgtcgcgtgatcaaccgtaacaaccgtctgaaacgtctgctggatctggctgcgccggacatcatcgtacgcaacgaaaaacgtatgctgcaggaagcggtagatgccctgctggataacggtcgtcgcggtcgtgcgatcaccggttctaacaaacgtcctctgaaatctttggccgacatgatcaaaggtaaacagggtcgtttccgtcagaacctgctcggtaagcgtgttgactactccggtcgttctgtaatcaccgtaggtccatacctgcgtctgcatcagtgcggtctgccgaagaaaatggcactggagctgttcaaaccgttcatctacggcaagctggagctgcgtggcctggccaccaccatcaaagccgcgaagaaaatggttgagcgtgaagaagctgtcgtttgggatatcctggacgaagttatccgcgaacacccggtactgctgaaccgtgcaccaactctgcaccgtctgggtatccaggcctttgagccggtactgatcgaaggtaaagctatccagctgcacccgctggtttgtgcggcctataacgccgacttcgatggtgaccagatggctgttcacgtaccgctgacgctggaagcccagctcgaagcgcgtgcgctgatgatgtctaccaacaacatcctgtctccagcgaacggtgaacctatcatcgttccttctcaggacgttgtactgggtctgtactacatgacccgtgactgtgttaacgccaaaggcgaaggtatggtgctgactggccctaaagaagctgagcgtatttatcgcgctggcctggcctctctgcatgcgcgcgttaaagtgcgtatcaccgaatacgaaaaagatgaaaacggcgaattcgttgcgcacaccagcctgaaagacacgaccgttggccgtgccattctgtggatgatcgtaccgaaaggtctgcctttctccatcgtcaaccaggcgctgggcaagaaagcgatctccaaaatgctgaacacctgttaccgcattctgggtctgaagccgaccgttatcttcgctgaccagacaatgtacaccggctttgcttatgcagcgcgttcaggtgcatctgttggtatcgatgacatggtcatcccagagaagaaacacgagatcatctctgaagcggaagctgaagttgctgaaatccaggagcagttccagtctggtctggtaaccgcaggcgaacgttacaacaaagttatcgatatctgggctgcggcgaacgatcgtgtatccaaagcgatgatggataacctgcaaaccgaaaccgtgattaaccgtgacggcgtagaagagcagcaggtctccttcaacagcatctacatgatggccgactccggtgcgcgtggttctgcggcacagattcgtcagctggcaggtatgcgtggtctgatggcgaagccagatggctccatcatcgaaacgccaatcaccgcgaacttccgtgaaggtctgaacgtactccagtacttcatctccacgcacggtgcgcgtaaaggtctggcggataccgcacttaaaacggcgaactccggttatctgacgcgtcgtctggttgacgttgcgcaggatcttgtcgtcaccgaagacgattgtggcaccctcgaaggtatcaccatgacccctgttatcgagggtggtgatgttaaagagccgctgcgcgatcgcgtactgggtcgtgtgaccgcggaagacattctgaagccgggcaccgcagacattctggttccacgcaacaccctgctgcacgaacagtggtgtgacctgctggaagcgaactctgttgactccgtgaaagtgcgttccgttgtatcctgtgacaccgactttggtgtgtgtgcgcactgctacggtcgtgacctggcgcgtggccacatcatcaacaaaggtgaggctatcggcgttatcgcggcacagtccatcggtgagccgggtacacagctgacgatgcgtacgttccacatcggtggtgcggcatctcgtgcggctgctgaatccagcatccaggtgaaaaacaaaggtagcatcaagctcagcaacgcgaagtcggttgtgaactccagcggtaaactggttatcacttcccgtaacaccgagctgaagctgatcgacgaatttggtcgtaccaaagagagctataaagtgccttacggtgcggttatggcgaaaggtgatggcgagcaggttgctggcggtgaaaccgttgcaaactgggatccacacaccatgccggtaatcaccgaagtaagtggtttcatccgctttactgacatgatcgacggccagaccattactcgtcagaccgacgagctgaccggtctgtcttctctggtggttctggattctgctgaacgtactaccggcggtaaagatctgcgtcctgcactgaaaatcgttgatgctcagggcaacgacgttctgatccctggtaccgatatgcctgcgcagtacttcctgccgggtaaagcgattgtacagctggaagatggcgtacagatcagctctggtgataccctggcgcgtattcctcaggaatccggcggtaccaaggacatcaccggtggtctgccacgcgttgcggacctgttcgaagcacgtcgtccgaaagagcctgcaatcctggctgaaatcagcggtatcatctccttcggtaaagagaccaaaggtaagcgccgtctggttatcacgcctgtagatggcagcgagccgtacgaagagatgattcctaagtggcgtcagctcaacgtgttcgaaggtgaacgcgtagaacgtggtgacgtggtttccgacggtccagaagcgccgcacgacatcctgcgtctgcgtggtgtgcatgctgttacccgttacattgttaacgaagtacaggacgtataccgtctgcaaggcgttaagattaacgataaacacattgaagttatcgttcgtcagatgctgcgtaaagcgaccatcgaaaacgcaggcagctccgacttcctggaaggcgagcaggttgaatactcacgcgttaagatcgctaaccgcgatctggaagcgaacggcaaaattggcgcgaccttctcgcgcgatctgctgggtatcaccaaagcgtctctggcaaccgagtccttcatctctgctgcatcgttccaggaaaccacgcgtgtcctgaccgaagcggctgttgcaggtaaacgtgatgaactgcgcggtctgaaagagaacgttatcgtgggtcgtctgatcccggccggtaccggttatgcgtaccaccaggatcgtatgcgccgtcgcgcagcgggcgaactgccagctgcaccgcaggtgactgctgaagatgcatccgcgagcctggcagaactgctgaacgcaggtctgggcggttccgacaacgagtaa

SEQ ID NO: 2571 - DNA, 1092 bp, Enterobacter cloacae
cggactgacgcaataaggaactgcaaaatgaccgaactgaagaacgatcgttatctgcgtgcgctgctgcgccagcccgttgatgtcaccccggtgtggatgatgcgccaggcgggacgctatctgccagagtacaaagccacgcgtgcgcaggcgggcgattttatgtcgctgtgcaaaaacgccgagctggcctgtgaggtgacgctccagccgctgcgccgcttcccgctcgatgccgccattcttttttcggacattctcaccattccggatgcgatgggccttgggctctatttcgaaaccggcgagggcccgcgctttacctctccgatcaaaagcaaagccgacgttgataagttgccgatccccgatccggaaggcgagctgagctatgtgatgaacgccgtgcgcaccattcgccgcgagctcaaaggcgatgtgccgctgattggcttctccggtagtccgtggacgctggccacctacatggtggaaggcggcagcagcaaagcctttaccgtcatcaaaaagatgatgtacgccgagccgctggccctgcatgcgctgctcgacaagctcgcgaagagcgtcacgctctacctcaacgcgcagattaaagcaggtgcgcagtcggtgatgattttcgacacctggggcggcgtgctgaccggacgtgattatcagcagttctccctgtactacatgcacaaaattgtcgatggcctgctgcgtgaaaacgaaggccgtcgcgtgccggtgacgctgtttaccaaaggcggcggccagtggctggaagcgatggcggccaccggctgcgacgcgctgggcctcgactggaccaccgatattgccgatgcgcgccgtcgcgtgggggacaaagtggcgcttcagggcaacatggacccgtccatgctctatgcacagcctgcccgtatcgaagaggaagtgtcgactatactgtctggtttcggccagggtgaaggccacgtctttaacctcggccacggcattcatcaggatgtgccgcctgaacacgcaggcgtatttgtggaggcggtgcatcggctttctgcccagtatcataagtaa

SEQ ID NO: 2572 - DNA, 681 bp, Enterobacter cloacae
ggagtggttatggatctcgcgtcgctacgcgctcagcaaatcgaactggcttcatcggtgatccgtgaggatcgtctggatacggaccctccgcggtacattggcggggcggacgtcgggtttgagcagggcggtgaagtgacgcgagcggcgatggtggtgctgaaatacccgtcgctggagctggtggagtacaaggtggcgcgtatcgccaccaccatgccctatatccccggctttctctccttccgcgaatatcccgcgctgctggccgcttgggaacaactctcgcaaaaacctgacctgctgtttgttgatgggcatggtatctcccatccgcgtcgcttaggcgttgccagccactttggtctgctggtggacgtgccgaccatcggcgtggcgaaaaaacgcctgtgcggcgcgtttgagccgctctctgccgaaccgggcgcgctggcgccgcttattcataaaggcgagcagctggcgtgggtctggcgcagtaaagcgcgctgcaacccgctgtttatcgcaaccgggcatcgggtgagcatggacagcgccctggcgtgggtgcaacgctgtatgaagggctaccgtttaccggagccaacccgctgggctgacgccgtggcctcttcacgtccggcattcattcgttggcaggaaattcagccgtga

SEQ ID NO: 2573 - DNA, 258 bp, Enterobacter cloacae
gtgaagactactcgtatggaacacccgggcgctgctgctcgtctgttcaaagagttcgcgaaagcgaatgcaaaatttgaggtcaaagctgcagcctttgaaggtgagttgatcccggcatcgcaaatcgatcgcctggcaaccctgccgacctacgaagaagcaattgcacgcctgatggcaaccatgaaagaagctgcggctggcaaactggttcgcactctggctgctgtacgcgatgcgaaagaagctgcttaa

SEQ ID NO: 2574 - DNA, 366 bp, Enterobacter cloacae
atgtctatcactaaagatcaaatcattgaagcagtagcagctatgtccgtaatggacgttgtagagctggtttctgcaatggaagaaaaattcggtgtttctgctgctgctgctgtagctgtagctgcgggcccggctgaagctgctgaagaaaaaactgaattcgacgtaattctgaaagctgctggcgcgaacaaagttgctgtaatcaaagcagtacgtggcgcaactggcctgggtctgaaagaagctaaagacctggtagaatctgctccagctgcgctgaaagaaggcgtgagcaaagacgacgcagaagcactgaaaaaatctctggaagaagctggcgctgaagttgaagttaaataa

SEQ ID NO: 2575 - DNA, 795 bp, Enterobacter cloacae
agcgaaggtagtgcaatagatatggatcgtattattgaaaaatcagatctgggttggtggatcgtcagtcacgagcaaaagttgtggctgcccggtggggagataccctacggtgcggcagaaatcttcgatctcgtcggccaacctgcgctgcggatcggcgagtggcagggcgatccggtatggttgatcctacaggctcgtcgtcaggatatgggatccgttcgtcaggtgttggatcgggatgtcggcctgttccagctggcggggcgcggcgtgcagctggcggagttttaccgctcgcacaaatactgcggctactgcggccacaccatgcacccgagcaaaaccgagtgggcaatgctttgcggccactgccgtgaacgctactatccgcaaatcgcaccgtgcatcattgtcgccatccgccgtgatgattccatcctgctggcgcagcatacccgtcatcgcaacggcattcatactgtcctcgccgggttcgtggaagtcggcgaaacgctggaacaggcggtggcgcgcgaggtgatggaggagagcggcattaaggtgaaaaacctgcgctatgtgacgtcgcagccgtggccgttcccgatgtccctgatgaccgcgtttatggcggaatacgacagcggcgagattgttatcgataagaaagagctgctggaggcgaactggtatcgctacgacgatttaccgctgctgcccccgccgggaacggtggcgcgtcgcctgatagaagataccgtggcaatgtgtcgggccgagtatgagtag

SEQ ID NO: 2576 - DNA, 708 bp, Enterobacter cloacae
gtaagacgcgtggcagtgaacagttttaacgaaggggcggcaacgccccttttgtcattctggcgtggaccgctcgcgctggcaggcgtactgttgctctctgcctgtagccatgattcctcactccccccgtttaccgccagcggctacgctgacaaccagggtgcggtcaggatctggcgcaaagattccagcgatgaagtccatatgctcaccgcgttcagcccatggcataacggcaatacctcgaccgcagaataccgctggcagggcgatgccctgtcgctcattgaactgaatatctacagtaagactcccgaacacgtgaaggtgcgtttcgacgaccacggcgagctgagctttatgcagcatgaggtcagtggactgaaaaagcagctttccagcgatcaggtcgccctctacagctaccgtgctgaacaacttcgccagaccagcgatgcgctgcgtcagggccgcgtggtgctgcgtcaggggcgctggcatgccgacggcacggtgaccacctgcgaagggcagacggtgaagcctgagcttgaatcctgggcaaccgaacacattcagcgtcgtcagcggcattcatctgtggaggtgagtgtggcatggctggaagcgccggaaggctctcagctgttgctggtggcgaatgaagatttctgcacctggcagccgacagaaaagagtttttga

SEQ ID NO: 2577 - DNA, 897 bp, Enterobacter cloacae
gcaccaccgggcatcagggttcgcacatctttagctccttcagtcagggtaactgctttatcgtgctggagcgcgatcgcggccacgttgaggcgggcgaatgggttgaagtggaacgctttaaccacctgttcggaggctgacatgacgatggaactgagcgacccggagatgatgcgctataaccgccagatcgtgctgcgcggatttgatttcgagggtcaggaggcgctcaaggcggccagcgtgctggttgttggtcttggcgggctgggctgcgcggcagcgcaatacctggctgcggcgggcgtcggcagcatgacgctgctggatttcgacaccgtgtcggtgtccaacctgcaacgccagacgctgcacagcgacgcgacggtcggtcagcctaaagtggaatcagcacgcacggcgctggcgcgcattaaccccaacgttcagttcaccctgattgacgcgatgctggatgacgacgcgctgtttgcgcagattgcacggcatgacctggtgctggactgcaccgataacgtcgccattcgcaaccagctcaatgcgggttgctttgcccataaaacgccgctgatttccggcgctgccatccgcatggaggggcaaatcaccgtcttcacctacgctgaaggagagccctgctaccgctgcctgagccgtctgtttggcgagaatgcgctgacctgcgtcgaggcgggcgtaatggcgccgctggttggcgttatcggttccttgcaggccatggaggcgatcaaagtgctggcgcactatggcacgcccgccgcgggtaaaatcgtgatgtatgacgcgatgacctgccagtttcgcgagatgaagctaatgcgtaatcccgggtgtgaggtgtgcgaaggttaa

SEQ ID NO: 2578 - DNA, 915 bp, Enterobacter cloacae
tccgagggcaaaaaaatgatcttcaatatacagcgttactccacccacgacggcccaggtattcgaaccgtggtattcctgaaaggctgctcgctgggctgtcgctggtgtcagaacccggaaagccgctcccgcagccgggacgtgctgtttgatgcgcgtctttgcctggacggctgtgaactgtgtcagcaggccgcgccggggtgtgttgaacgcgcgctgaacgggctggtcattcatcgtgagaagcttaacgacgagacgctcactgccctcaccgactgctgtccgacccaggcgcttaccgtctgcggtgaagagaagcaggtggaggagattatggccaccgtgctgcgagacaagcccttctacgaccgcagcggcggcgggatcaccctttccggcggcgagccgtttatgaatcctgacctggcgcacgccctgtttaaagccagccatgaacaaggcattcattccgccgttgaaacctgccttcacgtgccctggcactatatcgagccgtcattaccgtacgtcgatctgttcctcgccgacctgaagcatgtcgacggagatgttttcaagcagtggacggacggttcggctaagcgcatcctggacaacctgaaacgcctggccgccgccgggaaaacgatcaccatccgcgtgccgctgatccagggctttaacgccgatgaagcgtccgttaccgccattaccaatttcgccgccgatgaactcggcgtcgatgatattcattttctgccgtatcacacgctgggcatgaacaaatacaccctgctcggccaaccctactctgcccctgacaaaccgctggataaccctgccctgctggacttcgcgcagcagtacgcctgccagaaagggttaaccgcgaccttacgaggataa

SEQ ID NO: 2579 - DNA, 2403 bp, Enterobacter cloacae
acgtcgcgcgaagcgcgcctgatagtggatgtattgcatatgaaaaccctgaaaaactggacccttgatacgcagtcggcaaaccatctggaactgctggtcgatagccagcaccgcctgtgcctgtatgtgctggaagagaacctgttccgcgtgctgatcaagcgtaaaggcgagctggcgctggaccgcacctggagcatcgcaccggaaaaagacgtgccgtgggaaggtcgccgtcgtgacgatatcagcggcttctcctgccccgcctggacgctgacgcagcaggacgatacgttaaccgtggcaaccgagcagctgcgcgtcaccgtccaccagccgctgtggctggagtggcactaccgcaatgacgcgggcgagtggcagccgctggtcaatgaccgcccgaccagcgcctacctgctgaacgcccacggtgacggcgtggcgcactatctcagccgccgtaaggatgaacgtttttacggtctgggtgagaaagcgggcgatttacagcgcaacggcaaacgctacgagatgcgtaacctggacgcgatgggctataacgcagccagcaccgatccgctgtacaagcacatcccgttcaccctcacccgtcgcgacgacgtgagctacggtctgttctacgataacctgagcagctgctggctggatctgggtaacgagatcgacaactatcacaccgcctaccgccgctggcaggcggaagcgggcgatattgactactacctctttaccggcaagcgcgtgctggacgtcactaaagcctttgttcgcctgaccggaaaaacgctgttcggaccgaaatggagcctgggctacagcggctcaaccatgcactacaccgacgcgccggacgcgcagaatcagctgatgaacttcatccgcctgtgcgaggagcatgccattccgtgcgactcgttccagctctcctccggctatacctcgattaacggcaagcgctacgtctttaactggaactacgacaaagtgccgcagccaaaggtgatgagccaggcgttccacgacgcggggctgcggcttgcggccaacatcaagccgtgtctgttgcaggatcatccccgctacggcgaagtggcggaacgcggcctgttcattcgcgattcagaaaccgatgcgcctgaacgttccagcttctgggatgacgaaggatcgcacctcgacttcaccaacccgcagacggtgcagtggtggcagaacggcgtgaccacgcagctgctggagatgggcatcgactccacctggaacgacaacaacgagtatgaagtgtgggacggggaagcgcgctgctatggcttcggcaaggagatcgccatcaagcacattcgcccggtgatgccgctgctgatgatgcgcgcctcgctggaagcgcagcagcgctttgcgccggaaaagcgtccgtatctgatctcccgctccggctgcgccgggatgcagcgctacgtccagacctggagcggcgacaaccgcaccaactgggacaccctgcgttataacatccgtatggggctgggcatgagcctgtccgggctgttcaacgtcgggcacgacgtcggcggtttctccggcgacaagccggacgccgagctgttcgtgcgctgggtgcagaacggcgtgatgcacccgcgctttaccattcactcgtggaacgatgaccacacggtgaacgagccgtggatgtatccgggcgtcacgcctgccatccgcggcgcgattgagctgcgctaccgcctgctgccgtatctttacaccctgctctggcaggcgcacgccgacgacgaaccgatgctgcgcccgaccttcctcgaccacgagcacgatgcgcaaaccttcaaagaatgcgacgacttcctgctgggccgcgacctgctggttgccagcgtcgtcgaagccgggcagcgcgagcgccgcgtctggctgccggataacgaaaccggctggtacgatttttacacccacgcgtggtatgcgggcgggcaagcgatcgtccttgatgcgccgctggaaaaactgccgctgctggtgcgcgccggggccggtctgccgctcagcgagcgcatccgtcacgtgagcgccgataaagacgatacccgtgagctgaagctgttcccggtgaaaggcgtcggcacaacctcggggctgctgtttgaagacgacggtgaaagctggggctacctgaacggcaatgcgctgtgggtggaatgggaaatggtgtgcgatggcgcaaccatcaacctgaaggtgaacgctcgcggcgactatcgtccggcatggaaggcgctgaaggtatcattaccggcgggggaaaaacgtacgctgcgggtgaatggagttgaagggggcgagtgggtggtgtag

SEQ ID NO: 2580 - DNA, 1329 bp, Enterobacter cloacae
cctatgagcaatgttacgcacccgccgaaaatcggctttgtctccctgggctgcccgaagaacctggtggactccgaacgcatcctgactgaacttcgcactgaaggctatgacgtggtgccaagctacgacaacgccgacatggtgatcgtcaacacctgcgggttcatcgacagcgcggtccaggagtcactggaagctattggtgaagccctgacggaaaacggcaaagtgattgtcaccggctgcctgggcgcaaaagaagaccagatccgtgaagtgcacccgaaggtgctggagatcaccggtccacacagctacgagcaggtgctggaacatgttcatcactacgtccccaaaccaaagcacaacccgttcctgagcctggtgccggaacagggcgtgaagctgacgccgcgccactacgcctacctgaaaatttccgaaggctgcaaccatcgctgcaccttctgcatcatcccgtcgatgcgtggcgatctggtgagccgtccgattggcgaggtgctggcagaagccaaacgcctggccgacgcgggcgtgaaggagctgctggtcatctcccaggacacctccgcctacggcgtggacgttaaacaccgttccggtttccacaacggcgagccagtgaaaaccagcatggtcggcctgtgcgagcagctggctaagctcgggatctggacgcgcctgcactacgtctacccgtacccgcacgttgacgatgtgatcccgctgatggcggaaggcaaaatcctgccgtatctggatatcccgctacagcatgccagcccgcgcattctgaagctgatgaaacgtcctggctccgttgaccgccagctggcgcgcatcaagcagtggcgtgagatctgcccggatcttaccctgcgctccacctttattgtcggcttcccgggtgaaaccgaagaagatttccagatgctgctcgacttcctgaaagaggcgcgtctggatcgcgtcggctgcttcaagtacagcccggttgaaggcgcaacggccaacgagctggcggaccaggtaccggaagaggtaaaagaggagcgctggaaccgctttatgcagctgcaacagcagatctctgctgaacgcttgcaggagaaagtgggccgcgaaattctggtgattatcgacgaagtggacgaagaaggcgcgattggccgcagcatggcggatgcgcctgaaatcgacggcgcggtgtacctgaacggcgaaaccaacgtcaagccgggcgatattattcgcgtgaaggtcgaaaacgccgacgagtatgatttgtggggcagccgggtttaa

SEQ ID NO: 2581 - DNA, 555 bp, Enterobacter cloacae
ccccagaaacgacaggctggccgccgagataatcgacacgcctatgcgcatggtgaaatagaccacgatagacgagaccgttcccggcagaatatggctgaacaggatggtggcatcgctggctcccatgctgcgcgccgactcgataaaggtctgctgcttcagcaccagcgtgttgccacgtaccagacgcgcgaaagcgggaatcgagaataccgccacggcgatgatgacgttcgccatgccgctgcccatcaccgccaccacggcaatcgccagcagaataccgggaaaggcaaacagcacatcacagatacgcatgatgatgcggtcccaccagccttcgtagtacccggccgccagccccaacacggtgccaattgctgcgcccatcagcaccgcaaagaccccggccgccagcgagatctgcgcccctaccagcacgcggctgaaaatatcgcgcccgagcgagtccacgccaaaccagtgcatcatcgacggtccatcgttcagccggtcgtaatcgaagtagttttccgcatcaaacggggctaa

SEQ ID NO: 2582 - DNA, 1173 bp, Enterobacter cloacae
ccgcgaccttacgaggataaacttatgaccaccctgaatctcaacaccctcagcgagcgcattaaggcgcacaaaacggctctggtgcatatcgtgaagccgccggtctgtaccgagcgcgcccagcattacaccgaaatgtaccagcagcacatggacaagccgatcccggtgcgccgcgccctggcgctggcgcatcacctggccaagcgtaccatctggatcaagcacgacgagctgatcatcgggaaccaggcaagcgaagtgcgcgccgcgccgatcttcccggaatataccgtctcctggattgagaaagagattgacgacctggcggaccgtccgggcgcgggctttgcggtgagcgaagagaacaagcgcgtgctgcatgagatctgcccatggtggcgcggccagacggtgcaggatcgctgctacggcatgttcaccgacgagcagaaaggcctgctggaaaccggcatcatcaaagccgaaggcaacatgacctccggcgacgcgcacctggcggtgaacttcccgctggtgctggagaaagggctggacggcctgcgcgccaaagtggccgagcgccgctcacgcatcaacctgacggtgctggaagacctgcacggcgatcagttcctgaaagccattgatattgtgctggaagccgtcagcctgcacatcaaacgcttcgccgatctggcgcgcgagatggcctccagcgaaacccgcgaaagccgccgcgacgagctgctggcaatggcggaaaactgtgacgtaatcgcccacgagccgccaaaaaccttctggcaggcgctgcagctgtgctactacattcagctaatcctgcaaattgagtccaacggtcactccgtatcctttgcccgtatggaccagtatctctatccgtactaccgccgcgacgtggagctgggccagagcctggaccgcgagcacgccatcgagctgctgcacagctgctggctgaagctgctggaggtgaacaaaatccgctccggctcgcactccaaagcctctggcgggcagcccgctgtatcagaacgtcaccatcggcggccagaagctggtcaacggcgagccaatggacgcggtcaacccgctctcctacgcgattctggaatcctgcggtcgcctgcgttccacccagcctaa

SEQ ID NO: 2583 - DNA, 879 bp, Enterobacter cloacae
atttgtgctccccgtcaccttgttattagaatgtttcaaaacgcagtgacccaggagcatagtatgaccgtaaaagttatcgtcaccgatatggacggaactttccttgatgatgccaagcagtacgatcgtgaccgcttccaggcacagtttaaacagcttaaagcccgcaacattgaatttgttgtcgccagcggcaaccagtattaccagctcatctcgtttttcccggaactgaaggatcaaatctccttcgtggcggaaaacggcgcgctggtcttcgatcacggcgaacagattttccacggcgaactgacccgccatgagtcgcagatcgtgattggcgaactgctgaaagacaaagggctgaacttcgtggcctgcgggctggagagcgcctacgtcagcgataaagcgccggacgcgttcgtggcgctgatgtcaaagcactatcaccgcttaaagcgcatcagcgattaccgcgacattgacgacgtgctgtttaagttctccctgaacctgccggacagcgatattcctaatctggtggataaactccacgtctccctggacggcatcatgaagccggtcaccagcggctttggctttgtcgatttaattatccccggcctgcacaaagccaacggcatcagccgcctgctgaagcgctggaaaatctctccgcaagagtgcgtggccattggcgacagcggcaacgatgccgagatgctgaagctggtgaaatattcctttgcgatggacaacgcggcggaaagcatcaaagaaatcagccgctacagcactgacgacaacaaccatcagggcgcgctgaacgtcattcaggccgtgctcgacaaccactctcctttcgacgtctga

SEQ ID NO: 2584 - DNA, 1347 bp, Enterobacter cloacae
cacctgaacctccgtccccttaccgtccgtcttgtggagagtaaaatgagtcaggacatcaataacaccattgcgacaagcaaaacccgtcgcgtcatcaagaacctgcgctggtacgtgctggtgctgtttttgctgggcgtcaccgttaactacatcacccgaaattccttaggtattctcgctccggaactgaaagagagcctcgggatcaccaccgagcaatactcctggatcgtcggcgcgttccagatcgcctataccattttccagcccctgtgcggctggctgattgacgtcattggcctgaagattggctttatggtctgcgccgggatctgggcgctgatgtgtattttccacgcgggcgccggaagctggctgcacctggccatactgcgcttctttatgggggcttcagaagccgctgccaccccggcgaacgccaaaaccatcggcgaatggttcccgaaatcagagcgtcccgttgctgctggctgggcgggcgtgggcttctccatcggcgcgatgctggctccgcctatcatctactttgctcacgcctcgttcggctggcagggcgcgtttatgtttaccggcgtgctggcgctgctgtgggtgatcctctggtgggcgttctaccacaaccccgagcagcacccgaacctgagcaaggacgagctggcgtttatcaagcaggataacgaaccagcgccggtcaaattgcccttcctgaccgcgctgaaaaccgtttcaaaaaacaaacgtttctacggtatcgccattccggcctttatggcagaacccgcctgggcggtgctgagcttctgggtgccgctgtacctcgccaaagagcacggcatggacctgaagcagattgcgatgtttgcctggctgccgttcctcgccgccgacctcggcagcgtggcgagcggctacctgacgcgtctgtatacccgcctgttcggctgctcccgcgtgaactcggttgtcgccagctccgtgaccggcgcgttcctgatgatctcgctggccatcgtggccattacccgcgacccgtatatcaccatcgtgctgatctccatcggcggcttcgggcaccagatcatctcctgcatgctcagcgccctggtcgtggagtcattcgacaaaggccagatggcgaccgtcaacggcatgcgcggctcggcggcgtggatcgccagcttcctgttctcgctgttaatcggtgtgaccgccgacaaaatcggctttaacccgctctttatcgccatggggttctttgacctgattggcgctctcttcctggtagcatttattgctgaacgtcgcgcgaagcgcgcctga

SEQ ID NO: 2585 - DNA, 1236 bp, Enterobacter cloacae
atggagttgaagggggcgagtgggtggtgtagtgcggcctgtagccctcaccctaaccctctcccacagggagaggggataaaatgtaggccgggtaaggcgaagccgccacccggctattttttaactctcgatacctttactgcgcaggtaatcttcgtagttaccggtgaagtccaccacgcgctctggcgtaatttcgatcacgcgggtcgccagcgagctgacgaactcacggtcgtgagagacgaagatcagggtgccctgatacatctccagcgccatgttcagggattcgatcgattccatatccaggtggttagtcggttcgtccatcaccagaatattcggtttttccatcatcagcttgccgaacaacatacggcccttttcaccaccggagagcactttggcgggctttttgatgtcgtcctggctgaacagcagacgccccagaatgctgcgtaccgcctgctcatcgtcgccttcctgcttccactggctcatccagtcgaagacagtcagatcgttttcgaattcatattcatggtcctgcgcgtagtaaccaatctgcgcgttttcagaccatttcacggttccgttgtccggttgcagttcacccaccagggttttcagcatagtggatttacccacgccgttggcgccgaggatggcaatcttctcgcccacttccagcagcaggttgaagtttttgaacagcgggccttcatcgaagcctttggtgagagcttccacttccagcgcgttacggaacagcttcttgtcctgctcgaagcggatgaacgggttctgacggctggaggctttaacctcttccagcttgattttgtcgatctgacgcgcacgcgaggtcgcctgacgcgacttagaggcgttggcgctgaagcggctgacgaaggattgcaggtccgcaatctgcgctttcttcttggcgttgtcggccagcagacgttcacgtgcctgggttgccgccgtcatgtactcatcgtagttgcccggataaacgcgcagctcgccgtagtccagatccgccatgtgggtacacaccatgttcaggaaatgacggtcgtgcgaaatgatgatcatggtgctgtcgcgatcgttcagcgtctgctccagccagcggatggtgtcgatgtccaggttgttggtcggttcgtcgagcagcaggatgtccgggttagagaacagcgcctgcgccagcagcacacgtag

SEQ ID NO: 2586 - DNA, 690 bp, Enterobacter cloacae
ttgttaggtttatctcaccatggcgaaaagctgactcggattcacatctcatcgggagtaaatatgattacgctgtggggcaggaacaattcgactaacgtgaagaaagtgctctggacgctggaggagctggatttaccgttcaaccaaattatggctggcatggcgttcggggtgaataaagacgccgactatctggcgatgaacccaaacgggctggtgccgttgctgcgcgatgacgagacagacgccacgctgtgggagtccaataccattgtgcgttatctcgccgcgcagtacggccagggtcgcctgtgggttgaaaatccggcccagcgcgcgcagggcgaaaaatggatggactgggcaaaccagacgctttcccccacgcaccgcgtgatcctgatggggcttatccgtacgccggaagccgatcgtgattatcccgccattcatgccgcccaggatgcgtgtgagtcgctgtttgcgatgatggacgacgaactggcgaagcatacctggttctccggcgacacgttcggcgtgggcgatatcgccgtcgcccccttcgtctggaacctcactaacatgggtctcagctggaccccgcgccctcaccttgagcgctggatccagcagctcagcgagcgccctgcatatcgcaacgtggtgatgatcccggtgacctga

SEQ ID NO: 2587 - DNA, 1287 bp, Enterobacter cloacae
ccgcacttttctgccataatgagcgctttcgttgttactccgcaggagcccaccatggattttaccgccggactgatgccgcttgagacggcactctcgcagatgcttgatcgtattactcccctgcacgacgttgagacgctgccgcttgtgcgctgttttggccgtattgccgcgcgcgatatcgtctcgccgctgaacgtgccggggttcgataacgcggcgatggacggctatgccgtacgtctggcggatctgcaaacgggtcagccgctgccggtggcagggaaagcgtttgccgggcagccgttcaacggtgagtggccagcggacacctgcgtgcgcattatgaccggcgcgccggtgccaacgggctgtgaagccgtggtgatgcaggaagagaccgaacaaacggacgacggcgtgcgttttaccgccagcgtcaaagcgggacaaaatatccgccatatcggggaagatattaccctgggcgcaacggtctttgccgccgggcaaaagctgacggtcgccgaactgccggtgctggcatcgcttggcatcgcggagattgacgtggtccgcaaagtgcgcgtggcggtgttctccacgggagacgagctacagcttccgggtcagccgctgaacgaggggcagatttacgacaccaaccgtctggcggtgcacctgatgcttgagcagctgggctgcgaggtgattaacctcggtatcattcctgacgatccgcaaaaactgcgcgcggcgtttatcgacgctgacgcctctgccgacgtggtgatcagctccggcggcgtttcggttggcgaagcggattacaccaaaaacttgcttgaagagctgggtgaaatcgccttctggaagctggcgattaagccgggcaaaccgttcgcgtttggtaaacttccgcacagctggttctgtggcctgccgggtaacccggtctctgccgcgctgaccttctaccagctggtgatcccgctgctggctaagctttcaggcaacaatgccagcccgctgccggaacgtgtgcgcgtgcgggcggcaacgcgcctcaaaaaatcaccgggccgtctcgatttccagcgcggcattctggcgcgcaacgccgacggcgagctggaggtgagcaccaccgggcatcagggttcgcacatctttagctccttcagtcagggtaactgctttatcgtgctggagcgcgatcgcggccacgttgaggcgggcgaatgggttgaagtggaacgctttaaccacctgttcggaggctga

SEQ ID NO: 2588 - DNA, 1455 bp, Enterobacter cloacae
acaaaatccgctccggctcgcactccaaagcctctggcgggcagcccgctgtatcagaacgtcaccatcggcggccagaagctggtcaacggcgagccaatggacgcggtcaacccgctctcctacgcgattctggaatcctgcggtcgcctgcgttccacccagcctaacctgagcgtgcgctaccacgcgggcatgagcaacgacttcctcgacgcctgcgtgcaggtgatccgctgcggcttcgggatgccggcgttcaacaacgatgaaatcgtcattccggaattcatcaagctcggcgttgaacgcgacgacgcctacgactacgcggccattggctgtatcgaaaccgcggtgggcggcaaatggggctaccgctgcaccggtatgagctttatcaacttcgcccgcgtgatgctggccgcgctggaaggcggccgcgacgccaccagcggcaaggtgttcctgccgcaggagaaagccctctctgccggtaacttcgataacttcgaggaggtgatggcggcgtgggacacccagatccgctactacacccgcaaatccatcgaaattgaatacgtggtggacactatgctggaagagaacgtccacgatattctctgctcggcgctggttgacgactgcatcgagcgcgcgaaaagcattaagcaaggcggcgcgaagtatgactgggtttccggcctacaggtggggatcgccaacctcggcaacagcctggcggcggtgaagaagctggtgtttgaccagggtgttatcggtcagcaacagctggcggcggcgctggcggatgacttcgaggggctaacccacgagcagctgcgccagcgcctgatcaacggcgcgccgaagtacggcaacgacgacgacagcgtggacctgctgctgacccgcgcctacgaaacctacattgaagagctgaagcagtatcacaacccacgctacggccgcggcccgattgggggtaactactacgcgggcacgtcgtctatctcagcaaacgtgccgtttggcgcagcgaccatggcgacgccggacgggcgtaaggcgcatacccctctggcggaaggggccagcccggcttccggtaccgaccacctcgggccgacggcggtgattggctccgtgggtaaactgccgacggaagcgattcttggcggcgtgctgcttaaccagaagctgaacccgtcgacgctggaaaacgacagcgatcgccagaagctgatggtgctgctgcgcaccttcttcgaggtgcataagggctggcatattcagtacaacatcgtctcgcgcgaaacgctgctggaagcgaagaaacacccggaccagtaccgcgacctggtagtgcgcgtcgcgggctactcggcgttcttcaccgccctgtcaccggatgcgcaggacgatattatcgcccgtactgagcatacgctgtaa

SEQ ID NO: 2589 - DNA, 1293 bp, Enterobacter cloacae
acatttttactttcgaatgaaagatgcgaggcagttatgacctttaccagtgaaaccttgccggcggatcacaaagcggcaatccgtcagttgaaacgtgagttacgcgcgcagatcggcgacgtgcaggcggtgttcgacaagctcagcgacagcattgccacccgcgtggcggaaattaacgccctcaaaaataaaggtgaatccgtctggccggtaattccgtttaacgatgtgaaaaacggcacgattaccgacgcgcagcgcgaggccgttaagcgccgcggctgcgcggtgattaaaggtcacttcccgcgcgagcaggcgctggcgtgggatcagtcgatgctcgactacctcgatctgaacaagtttgacgaggtgtacaaagggccaggcgataacttcttcggcaccctgaccgcctcccgtccggagatttacccgatctactggtcgcaggcgcaaatgcaggcgcgccagagcgaagaaatggcgcaggtgcagtcgttcctgaaccgcttatggacgttcgagagcaacggcaagcagtggttcgacccggacgtgagcgtgatttacccggatcgtatccgccgccgtccgccgggaaccacctcgaagggactcggcgcgcataccgactccggcgcgctggagcgctggctgctgcctgcctaccagcaggtctttgcccgcgtgtttgacggcaacgttgagaaatacgatccgtggaacgccgcgcatcgtaccgaagtggaagagtataccgtcgataacaccaccaaatgctcggtgttccgcaccttccagggctggacggcgctgtcggacatgatccccggtcaggggctgctgcacgtggtgccgatcccggaagcaatggcctatattctgctgcgtccgctgctggacgacgtgccggaggacgagctgtgcggcgtggcgccggggcgcgtgctgccggtttccgagaagtggcacccgctgcttatcgaggcgctgaccagcattcctgcgctggaggcgggtgattcggtgtggtggcactgcgatgtgatccactccgtcgcgccggtggataatcagcagggctggggcaacgtgatgtatatccccgccgcaccgatgtgcgagaaaaacctcgcctacgcgaagaaggtcaaggaagcgctggaaaccggcgcgtcgccgggagacttcccgcgcgaggattatgaaaaaacctggcaggaccgctttaccgtgaacgatctcaacatccacggcaaacgcgcgctgggcatggtctag

SEQ ID NO: 2590 - DNA, 1887 bp, Enterobacter cloacae
ataagggggcattgcgtgccgcaccgtgaagagctggacaactgcgaagtgctggctgtccaccaactgaatattgcgtttcaggaagagcggcagttcatccccgcagtacagaatttatcgttttcgctcaggcgcggcgagacgctggcgattgttggcgaatcaggttccggtaaatccgttaccgcgctggcgctgatgcgtctgcttgagcagacgggcgggcaggtcaccagcgagcggatgctgttgcgccgtcgcaaccgtcaggttatcgatctcaacgagctgagcgcgtcccggatgcagggtgtgcgcggggcagatattgcgatgatttttcaggagccgatgacctccctgaacccggttttcccggtgggcgagcagattgccgaatctatccgcctgcatcagggactgagcggtgatgaggcgctcaacgaagcaaaacggatgctggagctggtgcgtatccctgaggcgcacgcgattttgtcccgctacccgcatcagctttccggcggcatgcgccagcgggtgatgattgcgatggcgctgtcgtgccgtccggcggtactcattgcggacgaacccaccacggcgcttgatgtcaccattcaggcccagatcctgcaactgattaaggtgttgcagcaggagatggagatgggggtgattttcatcacccacgatatgggggtggtggcggacattgccgatcgggtgctggttatgcatcagggcaatgccgtggaaaccggcacggtggagcaggtctttcatgcgccggtgcattcttataccaaagcgctgctggcggcggtcccgcgtctgggggccatgaatggcagtgattttccgcgccgttttccgctgatctcacagaccgaacagggtaagcaggaagacgaaaccgagcaggatacggtggttcccggcaggccaatcctcgaagtgcgtgacctggtgacccgtttcccgctgcgtagcgggatcctcaatcgcgtgaagcgcgaagtgcatgcggttgaaaacgtcagttttgatctctggccgggcgaaacgctggcgctggtgggggagtccggctgcggtaaatccaccaccggacgggcgctgctcaggctggtggcgtcgcaggaggggagcatcaccttcaacggtgagcgcatcgacacgctccctaacagtaaattgcaggcggtacgccgggatattcagtttatattccaggatccttatgcgtcgctcgatccgcgccatacggtggggtactcgattatggagccgctgcgggtgcataacctgctcgacggtgaagacgcgcagcgccgcgtcgcgtggctgctggagcgcgtgggcctgaagccggagcatgcctggcgttatccgcacgaattttctggcggtcagcgacagcgtatctgcatagcccgggcattagccctgaatccgaaggtggtgattgcggatgagtccgtgtcagcgctggatgtctccatccgcgcgcaaatcatcaatctcctgctcgatttacagcgggatttaggcattgcgtttctgtttatctcccacgatatggcggtggtggagcggatcagccatcgcgtggcggtgatgtacatggggcaaatagttgaaatcggcccccgtcgggcggtgtttgaaaacccgcagcacccgtacacccgcaagctgatggccgccgtaccggttgccgatcctgagcatcgtcacgcccagcgcgtgctgttgcaggacgaaatgccgagcaatattcgtaaacggggcgaaacccttgagcgcgtggcgctgcgtgaggtgggtcccggtcattttgtcgcaccaccgcgtcagggcaatgcattctcgcggttataa

SEQ ID NO: 2591 - DNA, 414 bp, Enterobacter cloacae
ggtaacatggctgacaggggaggaaatagcatgtccgttgacagactgaaacgcgatctgcttaacaagctgatcaacgcccgaatcgacctggctgcatatctgcaactccgcaaggcgaaagggtatatgtcagtcagcgaaagcgaaaatctgcgtgataacttctttgaactttgcaatttcatgcgtgaaaaagcacccatcctgaaagcgcactacgctgaaagcgaattagtggcgctgcgccgcgccgccgaggtgctctccatcgccggggtctgtttgatgaacggacgtcacgactgcccgaattttattgccgttaacgcggataagcttgaaaactgcctgactacgctcgcgctttgcatcatgtgtctgaacaagccggaaacgcttgcccggcactga

SEQ ID NO: 2592 - DNA, 690 bp, Enterobacter cloacae
gtgcaggctaaatttgagggtgacatcatggaactttatctcgacacatctgacgttgcggcagtcaaaaagctggcgcgtatcttcccgctggcgggcgtgaccactaacccaagcattgtggcggcgggtaaaacccccctggaagagctgctgcccgcgctgcacgacgcgctgggcggcaagggccggctgttcgctcaggtgatggcgaagactgccgaggggatggtggaagacgcgcgtaagctgcgcgcgataatcaatgacctggtggtgaaagtgcccgtgaccgctgaagggctggcggcgatcaagatgctgaaagcggaagggatcccgacgctgggtacggcggtgtacggtgccgcgcaggggatgttgtccgcgctggcgggggctgagtatgtggccccttacgtgaaccgcgtggacgcgcagggcggggacgggatccagacggtggtcgaaatgcaacagttgctgaccctgcacgcgccgcagtcaaaagtgctggcggcgagttttaaaaccccgcgccaggcgctggactgcctgctggcagggtgcgagtccatcacgctgccgctggacgtggcgcagcagtttattacctctccggcggtggatgcggcaattgtgaagtttgagcaggactggcagggggcgtttgggcggacgtctatttga

SEQ ID NO: 2593 - DNA, 945 bp, Enterobacter cloacae
tgcgaaatgagtaaagcggttatcgcaattcatggcggtgccggggcaatcacccgtgcacagctcagtcccgagcaggagaagcgttatattgatgcgctgaacgccattgtggaaacaggccagcggatgctggaagcgggcgacagcgcgctggacgtggtgaccgaagcggtgcgcctgctggaggagtgtccgctgtttaatgccggtattggctcggtctttacgcgcgatgaaacgcacgagctggatgcctgcgtgatggacggcgtcaccctgaaagcgggcgcggtagcgggcgtcagccgtctgcgtaatccggtgctggccgcgcgtctggtgatggaacaaagcccgcatgtgctgctggccggggcgggggcggaaaaatttgccgtcgagcacgggatggacacggtctcgcccgagcttttttccaccgaggagcgttaccggcaactgctggaggcccgtacagcggggatgacgcagctggaccatgccgcgccgctcgatgaacgcagcaaaatgggcacggtaggcgcggtggcgctggataaagccggtaacctcgccgccgcgacgtcgacaggcggcatgaccaacaaacttcccggtcgcgtcggcgacagcccgctgccgggggccgggtgttacgccaataacgccaccgcggcggtgtcatgcaccggcaccggcgaagtgtttatccgcgcgctggcggcctacgacattaccgcactaatggattacggcggattaagcctgagtgaagcctgcgagcgggtagtgatggagaagctgccggcgctgggcgggattggcggcttaattgcggtggatcgggagggcaacgtggctctgccgttcaacagtgaagggatgtaccgggcgtgggggtatgccggcgatgcgcccagcacaggcatttatcgtgaataa

SEQ ID NO: 2594 - DNA, 942 bp, Enterobacter cloacae
cgcggatttaaaataaaactcatgctgaattatgtgtgtaaacgcctgctggggcttatcccgacgctgctgattgtggccgtgctggtgtttttgtttgtccatatgctgcccggcgatccggcgcgtttgattgccggaccggaagcggatgcgacggttattgaactggtgcgtaaacagctcggtcttgaccagccgctgtacaggcaatttctgcgttacattggcaatgtccttcagggcgatttcggcatctcaatggtgtcgcgtcgtccggtgtcggaggagattgccagccgctttatgcctaccttctggttaacgattgccagtatgagctgggcggttgtgtttggcctgggcgcggggattgtcgccgccgtctggcgcaaccgctggccggataagctcggtatggcgctggcggtcaccggcatctctttcccggcgtttgcgctgggcatgctactgatgcagattttctccgttgagctgggctggttgccgaccgtcggggccgacacctggaagcactacattcttccctctatgacgcttggcgcggccgttgcggcggtgatggcccggtttacccgcgcctcgtttgtcgacgtgctgagcgaagattacattcgcaccgcgcgggcaaaaggggtgagtgagaaatgggtcattctgaagcatggttttcgtaatgcgatgataccggtggtcacgatgatggggctacagttcggcttcctgctgggcggctctattgtggttgagaaggtctttaactggccggggctggggcgcctgctggtcgactcggtcgatatgcgtgactatccggtcattcaggctgaagtcctgcttttctcgctggagtttattcttatcaacttagtggtggatgtgctgtacgccgccattaacccggccatcaggtataagtaa

SEQ ID NO: 2595 - DNA, 1152 bp, Enterobacter cloacae
tctttaagccatatgtcgataaaggagtgcgttatgcctcgatcctcgctgattttccttccagtcttgttattcccgctttcactgcttgcagcgcctgagacggttaaggtcgacgtgctacagacaaaactggatcacccctggtcgctggcgtttctgccagataacaaggggctgctcatcacgctcaaagacgggcagcttaagcactggcaggcagggaaagggctctccgatccgattgtcggcgtgccgaaagtgtgggcgagcggccagggcggactgctggacgtcgcgctggccccggattttgcacaatcacggcgggtctggctcagcttcgccgaggcaggtaatgatggcaaagcgggtaccgcggtgggctatgggcggttgagcgatgacctgtcgcgcattgagggcttccaggtggtgttccgacagatgccgaagctctctaccggcaaccactttggcggacggctggtgttcgacggcaaaggccatctctttattggcctgggtgaaaacaaccagcgcccgacggcgcaggatctggacaagcttcagggcaaggtggtgcgcctgacggaggacggaaaagtgccaccggataatccgtttgtgaacaccgccggagcgcgcccggaaatctggtcctatggcattcgcaacccgcagggaatggcgatgaacccgtggagtgacacgctgtggctcaacgaacacggaccacgcggtggggatgagattaacattcctgagaagggcaaaaactacggctggcccctggcgacgcacgggatcaattacagcggcctgaaaatcccggaagcgaaaggcgagcacgttgagggcactgaaaaaccgctgtttgtctggaaagtgtcgcccgccgtcagcggcatggcgttctacaacagcgacgtcttcccgcagtggaaaaacaagctgtttatcggcgcgctgaaggagaaagacgtcatcgtgctgagcgtgaagggcaatagcgtgacggaggatgggcgaattcttggggataaagatcagcgtatccgcgatgtgcgcgtcgggccggatggttatctgtacgtgctgaccgacgagacggacgggcagctttggaaagtcagcccgtccgggtcgtaa

SEQ ID NO: 2596 - DNA, 345 bp, Enterobacter cloacae
tgcgctattactcatcgcttcttgcgacacggtgattgtgacgtgatttttagaatggacactcgggtggcatttatgacgcaaaaaacttcttctctgcgcagcctggcggcaggctcggcgctgcttttcctttttgccccaacgcttcatgcggcggaacagacagcgcccgaagcgccgcctgttgatgcgcgcgcctggatcctgatggattacgccagcgggaaagtgctggcggaaggtaacgccgacgaaaaactcgacccggcgagcctgacgaaaattatgaccagctatgtggtcggcgttttcactcacgtggggcgcagcatccgcgatcac

SEQ ID NO: 2597 - DNA, 1632 bp, Enterobacter cloacae
tgccgcgtttatcacacttttcgcaggaatctctccgtgttagttaccagcaacgtcactatgcagtttggcagtaagccgctgttcgaaaatatttccgtcaaatttggcggcggcaaccgttacggcctgattggtgccaacggtagcggaaaatccacctttatgaagatcctcggcggtgacctggagccaacgctcggtaacgtgtcgctcgaccctaacgagcgcatcggtaagctgcgtcaggatcagttcgccttcgaagagttcaccgtgctcgacaccgtgatcatggggcatgcggagctgtgggaagtgaagcaggagcgcgatcgtatatacggtctcgctgagatgagcgaagaagacggttacaaagtggccgacctggaaacgcaatacggcgaaatggacggctactctgcggaagcgcgtgcgggcgaactgctgctgggcgtcggcattcctgttgaacagcattatggtccgatgagcgaagttgcgccaggctggaagctacgtgtgctgctggcgcaggcgctgttctctaacccggacatcctgctgctcgacgaaccgaccaacaacctggacatcgacaccatccgctggctggagcagacgctgaacgatcgcgacagcaccatgatcatcatttcgcacgaccgtcatttcctgaacatggtgtgtacccacatggcggatctggactacggcgagctgcgcgtttatccgggcaactacgatgagtacatgacggcggcaacccaggcacgtgaacgtctgctggccgacaacgccaagaagaaagcgcagattgcggacctgcaatccttcgtcagccgcttcagcgccaacgcctctaagtcgcgtcaggcgacctcgcgtgcgcgtcagatcgacaaaatcaagctggaagaggttaaagcctccagccgtcagaacccgttcatccgcttcgagcaggacaagaagctgttccgtaacgcgctggaagtggaagctctcaccaaaggcttcgatgaaggcccgctgttcaaaaacttcaacctgctgctggaagtgggcgagaagattgccatcctcggcgccaacggcgtgggtaaatccactatgctgaaaaccctggtgggtgaactgcaaccggacaacggaaccgtgaaatggtctgaaaacgcgcagattggttactacgcgcaggaccatgaatatgaattcgaaaacgatctgactgtcttcgactggatgagccagtggaagcaggaaggcgacgatgagcaggcggtacgcagcattctggggcgtctgctgttcagccaggacgacatcaaaaagcccgccaaagtgctctccggtggtgaaaagggccgtatgttgttcggcaagctgatgatggaaaaaccgaatattctggtgatggacgaaccgactaaccacctggatatggaatcgatcgaatccctgaacatggcgctggagatgtatcagggcaccctgatcttcgtctctcacgaccgtgagttcgtcagctcgctggcgacccgcgtgatcgaaattacgccagagcgcgtggtggacttcaccggtaactacgaagattacctgcgcagtaaaggtatcgagagttaa

SEQ ID NO: 2598 - DNA, 1125 bp, Enterobacter cloacae
cacacacgctatgaaaattttttcatttcgcaaatggagccagatcacaaaatggacaaaaggctaaaaatcaccgaaatcgcggcccgtacgcagctctccatcagcaccgtttcgcgggtgctggcggggaaagcgaataccagcgaaaaagcgcgtgcaaaggtgctggcgtgcgcgcgcgagctgggggtaatggacggcatggcggcagggcgtctgctgcttaacagcctggtggtttttgccccgcagcgcgctttcgacgagcggtccgacatcttttactaccgcgtgatccagagcgtgagcaaagcacttgcctcccacgaggtccggttgcgctactgcgcgctggaggagaacgacagcgacgcccagctgtttctggcgcggatgaacgagccggacacgcaggcggccattcttcttggtattgacgatccgcatatccacgatctggcggtggacgtgggcaaaccctgcatgctgattaactgccgcgaccggcacatgcgtctgcctgccgttgcgccggatcaccgcgccatcggcgagcgggcggcggagtacctgttcgagatggggcaccgcgaggtgatgaacgtgctgtgcctacgtcgctacaccatggagctgcgcctgtcggggattcgcgacgcgtggcagtcccacaacctggcgttcaacgacaagcgcgatctgctggtggtgccaagcttcagcgccagagagacggagcagctggtgagcgattggctaaatcagcagcagggaaaagacctgccgacggcattcctggttggcggcgactttatggcggcgggcaccatcagcgccttaaaaaaccacggcctgcgcgtaccgcaggacgtctcggtgatgagcatcgacggctttaacctggcggcgattcaggatgttccattaacggccgtgcatgttccccgcgatgagctgggaacggaagcggtacacatgctccagcagcggctcatgcgcccggacgcgccggtaggcacattgctgctgaacggcacgctgaccgtgcgggagtcggtacggcggatacgtcagggaaaacgacgcaccgccgtggagcgggaagggctgtacgacagctag

SEQ ID NO: 2599 - DNA, 1623 bp, Enterobacter cloacae
ggtgggtcccggtcattttgtcgcaccaccgcgtcagggcaatgcattctcgcggttataacttacaacaggcaggagaacacaatggttccttttgttgctcgtcaatggctgcttgccgcgagcgtgacggctgcgctggccgccgcccccgcgttcgcggcgaaagatgtggtggtggctgtggggtctaacttcacgacgctggatccgtatgatgctaacgacaccctttctcaggcggtggcaaaatctttctaccaggggctgttcggcctggaccgcgagatgaagctgaaaaacgtgctggcggaaggctataccgtgtcggacgatgggctggtctataccgttaagctccgtaccggcgtgaagttccaggacggcaccgacttcaacgccgaggcggttaagatcaacctggaccgtgccagcaatccggagaacggccttaagcgctacaacctgtataaaaatatcgccagcaccgaggcggttgacccggcgacggtgaagatcgtcctgaaagagccgttctcggcgtttatcaatattctggcgcatcccgcgacggcgatgatttcgcccgccgccctgaaaaaatacggcaaagagattggcttccacccggtgggaaccgggccgtacgaactgcttacctggaaccagaccgattttgtgaaggtgaaaaaattcgccggatactggcagcaggggctgccgaagctggatacaatcacctggcgtccggtcgtggacaacaatacccgtgccgcgatgttgcaaaccggcgaagcgcagtttgccttcccgatcccttacgaacaggcggcgctgctggcgaaaaacagcaagctggagctggtggccagcccgtcgattatgcagcgctacatcagcatgaacgtcacgcagaaaccgttcgataacccgaaggtgcgcgaagccatcaactacgccattaaccgtcaggcgctggtgaaggtggcctttgccggttacgccactcccgcgacgggcgtgatgccgccagccatcgagtatgcgcagagctaccagccatggccgtacgatccggcgaaagcgcgggagctgctgaaagaggcgggctatccgaacggctttagcaccacgctgtggtcgtctcataaccacagtaccgcgcagaaggtgctgcaatttacccagcagcagctggcgcaggtgggcattaaagccagggtcacggcgatggatgccggacagcgagcggcggaagtagaaggcaaagggcagaaagagagcggcgtgcggatgttctacaccggctggacggcttcaaccggcgaagcggactggtccctgtcgccgctgttcgcttcccagaactggccgccaacgctgttcaataccgcgttctacagtaatccgcaggtggataaagatctggccgatgccctgaaaaccaccaaaccggaagagaaagcgcgcctgtacaaagaggcgcaggacattatctggaaagagtcgccgtgggtgccgctggtggtggaaaaactggtctcagcccacaacaaagcgctgaccggtttttacatcatgccggatacgggctttagctttgatgacgcggatttaaaataa

SEQ ID NO: 2600 - DNA, 963 bp, Enterobacter cloacae
tggtggatgtgctgtacgccgccattaacccggccatcaggtataagtaagatgcgattactgaactggcgtcgccaggccattttaaacgctatgccggggatcaggccggaccatattcgcaccccgtggattgagttctggcgtcgattccgtcgtcagcccgtcgctatggtcgccgggttgtttgtgttactgctgatcctggtggcgattatcgccccctggttagccccgtttgatgcggaaaactacttcgattacgaccggctgaacgatggaccgtcgatgatgcactggtttggcgtggactcgctcgggcgcgatattttcagccgcgtgctggtaggggcgcagatctcgctggcggccggggtctttgcggtgctgatgggcgcagcaattggcaccgtgttggggctggcggccgggtactacgaaggctggtgggaccgcatcatcatgcgtatctgtgatgtgctgtttgcctttcccggtattctgctggcgattgccgtggtggcggtgatgggcagcggcatggcgaacgtcatcatcgccgtggcggtattctcgattcccgctttcgcgcgtctggtacgtggcaacacgctggtgctgaagcagcagacctttatcgagtcggcgcgcagcatgggagccagcgatgccaccatcctgttcagccatattctgccgggaacggtctcgtctatcgtggtctatttcaccatgcgcataggcgtgtcgattatctcggcggccagcctgtcgtttctggggttaggcgcacagccgccgacgccggagtggggcgcgatgctgaacgaggcgcgggcggatatggtgattgcgccacacgtggcgatcttcccgagcctggcgattttcctgaccgtgctggcgtttaatttactgggggatgggctgcgcgacgcgctggatccgcggataaaagggtag

SEQ ID NO: 2601 - DNA, 828 bp, Enterobacter cloacae
tttacagggacgaattgtcctgcgtcggggaaatggacactcatgattgaactgttactgcccggctggctggccgggattatgcttgcctgcgccgcgggtccactcggctcgtttgtcgtctggcgcagaatgtcctatttcggcgatacgctggcccatgcttcattgctgggtgtcgcgtttggtttattactggacgtgaacccgttttatgcggtgattgtcgtcacgctgctgctggctgccggtctggtctggctggaaaaacgccctcacctggcaattgataccctgctcggcattatggcgcacagcgccctgtcgctgggcctggtggtagtgagcctgatgtcaaacatccgcgtagatctgatggcctacctgtttggcgatctgctggccgtcacgcccgaagatctcatttccattgccattggcgtggcggtggtgctcgggatcctgctgtggcagtggcggagtttactggcgatgaccgtcagcccggatctggcctttgtcgacggcgtgaagcttcagcgcgtgaagctgctgttgatgctggtgacggcgttaaccatcggtgtggcgatgaagtttgtcggcgcgctgatcatcacgtcgctgctgataatccctgccgccacggcgcgccgttttgcgcgtacgccggagcaaatggccggtatcgcggtgattatcggaatgattgcggtgacgggcgggttaaccttctcggcgttttatgacacgccagcggggccgtcggtggtattgtgcgcggcggtgttgtttattttcagtatgatgaaaaagaccgcgcagtag

SEQ ID NO: 2602 - DNA, 300 bp, Enterobacter cloacae
cactgtacaaataaccagtataaattctctttaaaaatacagtcgtttccggaggtctttatgttcgttgagctggtctatgacaagcgtaatgttgatggtttggttggcgccagagagattattctggcagagctgacgaagcgagtgcaccagatcttccctgatgccgaagtgagggtgaagccgatgcaggcgaacggcttgaatagcgatgccagcaaaagcgatcgggaaaagctgaaccgcatgctggaggaaatgtttgaagacgcaaatatgtggctggtgaatgattag

SEQ ID NO: 2603 - DNA, 762 bp, Enterobacter cloacae
attgacatgacgactttagtttctcttgaaaatgtttcggtctcattcggccagcgccgcgtcctttctgacgtgtcgctgaatctgaagcccggcaaaatactcacgctgctcggccctaacggtgcaggcaaatcgacgctggtgcgcgtcgtattaggcctggtagcccctgacgcaggtgttatcgtccgcgaagacaaattgcgtatcggctatgtgccgcaaaaattacatcttgatgccaccctgcccctgacggtgagccgcttcctgcgcctccgtcccggtacgcgtaaagcggatatcctcccggcgctgaaacgcgttcaggcgggacatcttgttgaggcgcccttgcaaaagctgtcgggcggtgaaacccagcgcgtattgcttgcccgtgccctgctcagcagccctcagctgctggtcctggacgagccgacgcagggtgttgacgtcaacggtcaggttgcgctgtacgatctgattgaccagctccgtcgggagcttaactgcgcggtgctgatggtctcccatgatctgcatctggtgatggccaaaaccgacgaagtactgtgcctgaaccatcacatttgttgttccggcacgccggaagtggtgtcaatgcatcccgaatttatctccatgtttggccatcgtggcgccgaacagctgggcatctatcgccataatcacaatcaccgccatgatttacagggacgaattgtcctgcgtcggggaaatggacactcatga

SEQ ID NO: 2604 - DNA, 594 bp, Enterobacter cloacae
aaaagcaatcatttgacgggagcgacgatgtttacacttgatgccaccaaaaccgcccttgtggtcattgatttacaggaaggcattctgccttttgccggtggtccgcacaccgctgacgatgtggtcagccgcgctgcgcgcctggcagaaaaatgccgcgccagcggctcgcctgttgttatggtgcgcgtcggctggtccgctgatttcgccgaagcgttaaaacagccggttgatgctcaggccccggcgcaggcgctgccggacaactggtggacatatcctgtctcgctcggtaaacgcgacagcgatatagaagtcaccaaacgccagtggggcgcattctacggcaccgacctggagctccagctgcgccgtcgcgggatcgacacgattattctgtgcgggatctccaccaatatcggtgtggaatccaccgcccgtaacgcctgggagctgggctttaacctggtgatcgcggaagatgcgtgcagcgcagcctctgcggatcagcaccagtgcagcatgacccatatcttcccgcgtatcggtcgcgtgcgcagcacggatgagatcctcagcgcgttatga

SEQ ID NO: 2605 - DNA, 822 bp, Enterobacter cloacae
ataaaggtcggtttgggagatgaggttacagcaaactttgcaagcctcgaaattggagccaaaaaaccctcttctgcaagctttgttgatttccattttctgggtacgaacgactacgatggacgaattttgtgtagctctggtatctcaggaaccgcaggcgccggagcaatgacatattacgggggatctcaccgctttgtaggttccgtctcgttcgatcactctgccaccttcaattcttctgttgacgcaaaagggatcgttgcaggtgtaacgtcccttaacgtacgagcttcgagcgacacccaatattctcacgtctggttctatggtgcgtcaggtccatcacgtggggttatctatgctgtcaaggatggttctatccgactcaggcccgataacaacgataatggtggcgcgaatggctatagcttcagtttcggagctgatggtaagtttacctgcgtcacgatgaatcagacctcagacgagcgcgtgaaattcgataaagagcccgtcagtaaagcactggagaagatttgttccctgacgggttatacgttcggcattcagctcacagaatcggagtcggtacgcagcgcaggcatcatcgcccaggatctggaaaaggttctgcccgttgctgtaagttctggcgggactggcactacgccagcaggagaggaaattaacgaccttaaaaccgtggactacagtgctatgagcgccctgtatgttgaggccatcaaggagctgaccgaacggttaaaaatcatcgaaaaagaactggccgaccttcgcggtgcgacagttgtctaa

SEQ ID NO: 2606 - DNA, 216 bp, Enterobacter cloacae
ccagttaaagggataaccggcgcggtactgcgtctgattgttttgcttgcggactccgtagatctggacgctgctttcctgtccgccgaccagggctgttccggtgcatacgggttgctgcttctcaataacgccagcgcaaccggagagcaataccgctaccgccaggcaaagaatcatatttttcatagtggttatatcccagggcgttcatga

SEQ ID NO: 2607 - DNA, 396 bp, Enterobacter cloacae
cgaacaggccagcatgccgggttcgcctctgtggcgattaatcaagggagtttaaccatggcagtcgaaaccttcagctggtgcccaaaggttgcctctcaggttgatacaagtttccgtacccgaaaggcgcagtttggcgatggctatgcgcaggtggccggagacggtatcaaccctgtaacacctcaatggagcgtgagctttaccggcgacgaggcttacattcaggccattaaaaactttctgaacaggcatgccgggtggaagtcatttatctggaaacctccgcttgagccctcaggcttatggcgcgcggaatccttccagatatctacccacggcaacaagaaatataccctcagcagtacattcatacaggcataccatccatga

SEQ ID NO: 2608 - DNA, 597 bp, Enterobacter cloacae
ggatttgatgtaatggaaagaaaaaccgtcattaaactcagtggttcaatggctcagcgatttggcaggacccaccgccgcgcgttaacgtctgccagtgaggtattcagggcgctatctaacaccattgatggctttgatgcttatctgcgagaagctcgggcgaaggggctggattttgttattttccgggatcgtcgcaatatcggacacgaagagtttgagcttctgggcccgggtgatgagctgagaatcatcccagtaataaggggcagcaaaagagctggagttttccaggcattactcgggacggctttagtcgctgctgccatctggatgccaggggtcagtatcgcagcgagtaacctcatgttttccgttggggctgcaatggctgttggcggtgtggtgcagatgctctctcctcaggtttcaggtctgcgaatgcgtcaggaacctgataacaaaccctcctatgcgtttggtggtcccgttaacacgacagcatctggcaatcccgttcccctgctttatgggcaacgggaaattggcggcgccattatatccgccggggtttatgcagaagatcagcaataa

SEQ ID NO: 2609 - DNA, 465 bp, Enterobacter cloacae
agaaggaagagaaaaactgatatggcatataagcgtcccgtttcggttctggtggtcatttatgcagaagacacgaagcgggtgctgatgttgcagcggcgcgacgatccggatttctggcagtcggttaccggcagcctggaagagggggagaccgcaccgcaggccgccgcgcgtgaagtaaaggaagaggtcgccattgatgttgcttacgagcaactgaccctgaaggactgtcagcgcacggtggagtttgaaatttttagccatttacgtcatcgctatgcaccgggaattgagcgcaatacggaatcatggttctgccttgcgcttccccatgagcgggagatcgtgttcacggaacacctgacctaccgctgggtggatgcggcggatgccgccgcactgaccaagtcgtggagcaaccggcaggcgattgaagaatttgtaattaacgctgcctga

SEQ ID NO: 2610 - DNA, 768 bp, Enterobacter cloacae
gaaggcgcgatttttggagaactttttatggcaggtcatagtaagtgggccaacaccaaacaccgcaaagcggcacaggatgccaaacgcggtaaaatctttaccaaaatcattcgtgagctggtgacagcggcgcgtctgggcggcggcgatccggcctctaacccacgtctgcgcgcagcggtggataaagccctgtccaacaacatgacgcgtgacaccctgaaccgtgcaatcgcacgtggcgtgggcggtgatgaagacgcgaacatggaaaccatcatttatgaaggttacggtcctggcggtacggcggtgatggttgagtgtctgtccgacaaccgtaaccgtaccgttgcggaagtgcgccacgcgttcaccaaaaccggcggcaacctgggcactgacggttctgtagcgtacctgttcagcaaaaaaggcgtcatctccttcgagaaaggcgacgaagatgcgatcatggaagcggcgctggaagccggtgcggaagacgtggtgacctacgacgacggcgctattgatgtttacaccgcatgggaagagatgggtgccgtgcgcgatgcgctggaagcggctggcctgaaggcggataacgctgaagtctccatgatcccgtctaccaaagcggacatggatgcggaaaccgcaccgaaactgctgcgtctgatcgacatgctcgaagactgcgacgacgtacaggaagtgtaccacaacggtgaaatctctgatgaggttgcagcgactctctga

SEQ ID NO: 2611 - DNA, 870 bp, Enterobacter cloacae
cgcggagaaaagccaggtgcagcacatggtgcgtaccctgctgaagctccctgcgaacccgcaggccgacgccgcggatgcgctggccattgcgattacccactgtcacgtcagccagaatgcgatgcaaatgagcgagtcgcggctcaatctggcgcgaggcaggttacgataatgacaaatcaggctggatgtttatccagcctttttttattatgtcggcagataatttcttccagaacgcaggagcgtcacgtgataggcagactcagaggcatcatcattgaaaaacaacccccgttagtgctgctggaagtgggtggcgtgggctatgaagtccatatgccgatgacctgcttctacgagcttccggaggcgggcaaagaggcggttgtctttacccagtttgtggtgcgtgaagacgctcagctgctgtacggattcaataacaaacaggaacgcaccctgttccgcgaattgatcaaaaccaacggcgtcgggccgaagctggcgcttgcgattctgtccggtatgtcagcgccacagtttgtgaacgccgttgagcgtgaagatccggctgcgttaattaaacttccgggcatcgggaagaaaactgccgagcgtttaattgtcgagatgaaggaccgctttaaaggtctgcatggcgatctgttcacgccggcagccgatctggtgctgacttccccgggcgcgcctgcatcggatgatgatgccgagcaggaagcggttgccgcgctggtggcgctgggctataaacctcaggaggccagccggatggtgagcaaaattgctaaaccggatgccagcagtgaaaccctgattcgtgaagcgctgcgcgctgcattgtga

SEQ ID NO: 2612 - DNA, 3492 bp, Enterobacter cloacae
atggcaactttacgtgagttaataatcaaaatttccgctaactcgcaatcattccagacggaaatttcccgcgcttcacgtatggggcaggattattaccgcaccatgcaaaatggtggccgtcaggctgccgctgccgcccgagagagcgaaagggcgttatctgatctgaccgctgggtttgcatcggcaggaagagccgctgctgctgctacggccgcttttgcgactggtaagctcgtgcagattgctgatgagtggaattcagtaaacgcccgtcttaagcaggcatcatcttcagctgatgattttgctgcctctcagcgccagttaatggaaatcagccaaagaactggcaccgcgttttcagacaacgcaaaccttttttcacgcgcagctgcttcaatgcgtgagtttgggtatagctctgacgaagttctgaaaattaccgaagctgtttctaccggccttaaactttcgggggctaatactcaggaagcgagttctgttatcactcaattcagccaggctctggcgcagggcgttcttcgcggtgaagaattcaacgccgttaacgaagcaggtgatcgtgttatccgcgcacttgccgccggaatgggcgtggcccgcaaagacctgaagagcatggctgaccaggggcaacttacgattgataaggttgttcctgcattaatgagccagttgggctcattacagggtgagtttgccagcatgccgcaaacagtttccggatccctgcaaaaagtcacaaactcgttcatggcatgggttggaggtgtcaaccaggctacaggtgctaccgatgcgctatctggtggcctagacggagttgcccaaacgcttgattcatttacctcttcggcagtaagcggcgcactaagtgatgttgcagacaatatgtccacgatcacaacagtggcgggtgcacttgttggcgttgggctggcaaggtatctcagtggagtagtaactagcgccacgagcgcaaccggcgcgctaatttctgcggctaagtcagaggttgctcttgccgttgcacaggataaggctgcgcagtctgccgttgccgcctcaagggcggaggtttatagggctcagcaagctgtacagagatcgcgtagcgcagatgttcaggctgcgcagcaagagaaaattgctgcggcagaagcaaaagtcactgcagcccaggccaggctgactaccgctctagccagcggttctgctacagagaaagtcagagccagaacagcgcttgagcgtgcgcaggcaggtctggtggcagcaaaaaacgccgatgcacaggctatcgctgaaagacgcctggcttccgcggaggccgccagagaccggaaccttgcaaatcgtgttaccacccaaagcaatctcaatagtgtcacatctgttggcacccgccttttaagcagtgccctcgggctcattggcggcgtgccgggattggtgatgcttggagccggtgcctggtatgcggtgtatcaaaatcaggagcaggctcggcgctctgctcaggagtatgccagcacgatagatgaagtcagtaaaaagacgagggcaatgacccttcctgaagcttcagataatgcagagaaaactcgtgccgcactgaatgaacaaaacaggctaattgatgaacaaaagagcaaggttgaaagcctgaaagagcagatagctggttatcagtcagtgattagtaatcccggtccaactaccagcggtggtttcatgattaaccacctgacatatttggacactgtgactcgtgggctggctacggctacagagcagttatctgttgagcaagaaagacttgctcagatgcagcaagaatccgcttctattcaacaggttctggaagggcttgaacatcgccgggtggcactcattcgagaagaggctgctaatcaaaaccgggcttatcaatctctcctgttgatgaatgggcagcatgacgaatttaaccgtctgctggggctgggaaatcagctattaatggctcggcaagggctggcgaacgtccctctcagacttcctcaggccgacctcgacaaaaagcaaaccgatgccctcgaaaagagccgtcgggatcttgagttgtcacgcctgaagggtgaggccaaagagcgcctgcgtctgagttatgcagccgatgacctggggttaaccagtgatccgcaattccagacaggccgtcaggagttgattaataacggtcttgctgaatggcggaataatgaggccaacaaacctaaggcgaagggtggtaaaaccgaaggcgagaaaaccgaggatgtgtataagcgccttatcaagcagcaaaaagagcagattgccctgcaaggccagaatactgaactggcgaaggttaaataccaggttagccagggcgagcttgcttctctgacagaagcccagaaaaagacggtattgcagaatgctgcgctcattgaccaggttaaattgcgtgagcaactgcgaaattacgaagccaaccttgctgacagtaacgccagcgcccgcgcagccaatgaagcgcaactgctgggctatgggcagggagccaggttccgtgaaagacttcaggagcagttcaatctgcgtaaggagtttgagcagaagaataccgatcttctccgccagcgtcaggctggtgaaatcgacgagacgttctatcagcaggggctggcacttaataagcgctaccttgaagagcgcctgcgcgaccaggaaggatattacgcagcttctgatgcgcagcgtgacgactggatgacggggttgtcagaaggttatgcgaactgggtggacgaagctacggattattcttccatggctgctgacggcatgaagcaggctatggggggcgctgtcaccacgatcaccgacatgctcaatggcaacgttgacagttggaaggactggggcgtcagcgtgctgaagattatccagaacgttctggtcaatatggctgttgctaacggcgtcagttcaattggctccctgttcagttttggtgcctcgtctgccgctaccgccagcagcggtactgcaattcagaacgctggcgcgaacttcacctttaacgcgaagggtaatgtttacgactctccttccctgagcgcttacagcaatggcgtttttcagacgcctcagttgtttgcctttgccaaaggtgcgggggtttttgccgaggcaggcccggaagccattatgccgctcactcgggcagctgatggttcgctgggcgttcgggcagttggtgctcctcaggtttctggcggtgtgccttcggttaactttggcgatatcaatattcagggcggatcaccgcaggcggccagtcagggtactgccggagcagcaggcaggcagcttaaggatgccatcactggtgtcattaacgaacaggccagcatgccgggttcgcctctgtggcgattaatcaagggagtttaa

SEQ ID NO: 2613 - DNA, 762 bp, Enterobacter cloacae
acagctggattatgggggcttccccggcgcttcacttctgagaggataaccatgcgtgagaaaacagtcagcgccatactggcgcacgcggcctcatcgtgtccagacgaatgctgtggcgttgtcatacagaagggacgggtagagaaatacatcccttgcagaaatcaggctgaatccccgactgagcagtttgaattgtctcctgaagattatgcagcggctgaagagcagggcacagtagttgctatcgtgcacagccatcctggtgacggcgcgacaacccagcccagtgaactcgacatgctgatgtgcgatgccactgaattgccgtgggtaattgcatcctggccggaaggggatattcgcactgtcatgcctcgcggcgatcgcccgctaactggtcgccagtttgtgctcggtcatgccgactgctggtctctcatcatggattatttccgcactgagcacggtattacgttaccgaattacagcgtggatcgtcactggtgggagcagggcgaaaacctctacatggacaactggtatgagtgtgggttcagggagttcgacgggccttcccagccaggtgacatggtaatcatgcaggtacagtccacagtcccaaaccatgcgggtattttgcttgagggtaatgtgctccttcaccacatgtatggccagctaagtcagcgcattccatacggtggctattatcgtgaccgtaccatcaaaattcttcgctataaggatttgatgtaa

SEQ ID NO: 2614 - DNA, 3873 bp, Enterobacter cloacae
cggtggcttttttatggacgcgatatgacgacgacaatcatcaaaggccgcggtaaaggtggcagcaatcagacccgaacacccattgaagcaccggacagcattcagtccattgcaagggcaaaggtgctgattgcgcttggagagggtgagttcgctggcgggcttgatggtaaaaacatttttcttggtgactcatcttcctacacgcctcttcagaacgccgacggaagttataacttcaataatgtgaaatatgagttccgttccggtactcaggaccaggactacattcagggcttccccggcattgaaaacgaacttcaggtttcatacgagctgaaacaggctgtgccgtacgtgcgcgcggtatccaacacgcagctctctgcgctgcgaattcgcctgggatggccaactcttttactccagaaaaacaacggcgataaagtcggcacccgcgtagagtatgctatcgatctgtcggtcgatggcgggccgtatgaaacggtggttaacggtgctgttgatgacaaaaccacgtcgctttatgagcgcagtcaccgcgtcaatcttccgaaagcctcgactggatggcagttgcgggttcgcagaatcacgccggattccacgagcgtgaatatcgtcgacaccatgcgcgttgtggccgttactgaaattattgacgccaaacttcgctacgttaacacagcgctgctgtatgtagagtttgacgcaacgcagttccctaatggcattcctcaggttgtgtgtaatccgaaagggcgaatcatccgtgtacctgatacttatgatcccgaaacccgcacttattctggtacatgggagggcgtatttaaatgggcatggacggataatcctgcctggatttattacgacatcattctgaacgagcgcttcgggctgggtcaaagaattgatgcgactcagatagacaaatgggagctttatcgcatcgcccagtattgcgatcaactggtaccagatggcaagggcggaagtgggacggagcctcgttttcgttgcaacgtttatatccaggaccgtaatgacgcctggactgtacttcgtgatctggcgggtatatttcgcggcatgacgtactggggcgacaataagatgtatgtcctggctgatatgccacgggatgtgtggcacatctataaccacgccagcgttgttgaaggaaaatttacctttgcggatccgagtgaaaccacccgaaacactgccgcgctggtgaactggtcagaccctgccaaccactataaagacacgcctgagcctgtttacgataacgatctggccatgcgcttcgattatcgtcagctcgaaatgactgcgatcggctgcaccaggcagtcagaggcaaaccggcgggggcgctgggcgctgctcactaacggtatcggcgaggtggtgaccttcagcacgggcatggacgttccacctgtcggggaggtgatcggcgtggctgctaacgagctggccggaagaactatcggcggcagggtgagtggggttaacggccgcaacataaccctcgatcgcgccgctgatgtgaaggccgggaaccggctgtttttgaatcttccatcaggcacagctcaggccagaaccgtccaggccgttaacggaaacacagtcactgtcaccacaccctacagcgaaacgccggaggctgaatgtaactggggtgtggactctgacgatctgtttatagcgcttttccgtgttacgggaacgcgggacaacaacgacggcactttcgaggtcaccgggacgacttacaaccctgatatctattccgctgttgataccggcgcaagactggacgagcggccagtcagtgtcattccaccgggggttcaggctcccccaggaaatattgtcgtagacagttactctacggttaaccagaacattgcgattaccactatgcgcgttgcctgggattctgttcagggtgcagttgcgtacgaggcggaatggcggcgtgacagcggcaactggattagtgtgccccgaacgtcttctctcggctttgaagtgcagggtatctactcgggtcgctatctggtccgtgtcagggcggtgaacgccagcgacgtttcatcagtatgggtgacatcatcagaagtaaatcttacgggtaaagtgggcaatccgccgaaaccggtcggcttcatcgcttctgataatgtggttttcggtatcgagctgagctggggattcccggcgaacaccgacgacacgctgaagacggaaattcagtacagcctgaccgggacggaagacgatgcgatgctgctggcagacgtaccctatccgcagcgcaagtatcagcagatgggccttaaggcagggcagactttctggtaccgggcgcagctcgtagatcgaagcggaaacgaatcagggtatacagactttgtgcgcgggcaggccagcattgatgtatccgatatcaccgatgcgatcctggaggagattaaagattccgaggtatttaaggatctgattgaaagtgctgtagacagtaacgagaaactggccgagctttctgatgcaattaaggagaacgccgatgggctggctgccgccgtaggttcgaataagcagacagcagaagcaatcatcggcaacgcgctggctattgccgatgttatcgtgcgccagacagcccaacagggcgctaactctgcgacattcgaacagctccgggaggtgatcgctactgaaacggaggcgcgcgtaacggatgttacccgtcttgaggcaaaaactgcgcagaacgaggcaggagttaccgaggtaaggcaggctctgtcagatgaagctcaggcaagggctactgctgttgaccagctcactgcgagtactcaggtcatttctgataaagctgattcggcttcgagtaaagctgacgctgcatcaggtaaggcagatgcggccgagcaagccagctcgcaaaatactgctgatatcaccacgttgcgacaggttgtcaccgacacgacttcatcaatggcatcccgtctggaggaactgggagcaagaaccgatactgccagcggcggcatccagaataacgctatcgcgctaataacgagtacgctggcgcaggttgatcagcgggtgagactcagcgcgcagtacggtgacagcaaggccagcatcgatcgtcttgataacgtcatggcaagcgacagggaggcaacggcgcgttcgctgctgagtttgcagactgacgtgaacggcaacaaggcatccatcaacagcctgaaccagaccttctccgattaccagcaggccaccgccacgcagataaacggcatcacggcgaccatcaacggacatacctcagcgatcaccaccaacgcgcaggccattgcgaacgtcaatggcgacctgaaggcgatgtacagcatcaaggtcgggttatccagcaatggccagtattatgcggcagggatggggatcggtgtagagaatacgccgtccggcatgcagtcgcaggtcatcttcctggctgaccgcttcgccgtcactcaccaggccggagccacggtgaccttaccgttcgttatccagaacgggcaggtaattatcagggatacggtaataggtgatgccactatcacccgagcgaaactggctgaaacaatcagctcggttaattacgttcagaaccaggctgggctgtccataaacttcagaacgggcacgcttgagaactacggttcaaccgctggggaaggggcgatgaagcagactaatcaaacgatcagtgtcaaggatgccaacaatgtgttgagggttcagatcgggagaatcacgggaacatggtaa

SEQ ID NO: 2615 - DNA, 606 bp, Enterobacter cloacae
tttttttgcagaaaatattgggtgaaaaacatgcaaattggctacgtaagggtgtcaacaaatgaccaaaatacggatctccagcgacaagctctcgaacgcgcaggatgtgaacaggtttttgaggaaaaaatgagcgggacggtagcgaaccggccagcgcttaaaaagcttcttcgaacgctgaatgagggcgacacgcttgtggtgtggaagttggatcgccttgggcgaagcatgcggaacctggtactgctggtcgacgaactccggcagcgcggcattcacttcaaaagccttactgacagcatcgacacttccagcccaatggggcgtttcattttccacataatgtcagcattggccgagatggagagggagttgatcgtggaacgtacccgggcaggattggcggcagcccgggagaagggacggataggtggcaggcgcccgaaattaaccccagagcaatgggctcaggctggcaggttgatcgcaaacggagtggatcggaagcaggtggcgatcatttacgatgtggccgtttgtactctatataaaaaattcccagtaaataaagacgttacacgaacttcaacacattaa

SEQ ID NO: 2616 - DNA, 543 bp, Enterobacter cloacae
atccgttacaggagacgcgtgatgtcgattattctcgggattgacccaggctcacgcgtcaccgggtatggcgttatccgtcaggtgggacgccagttaacctacctcggcagtgggtgtattcgcaccaaagtggacgatctgccgtcgcgcctgaagctcatctatgcgggcgtgtcggagatcatcactcagtttcagccggactatttcgccatcgagcaggtctttatggcgaaaaacgctgactcggcgttaaagctcggtcaggcgcgcggcgtggcgattgttgccgccgtgaaccaggatctgccggtgttcgagtatgcggcccgtcaggttaagcagacggtggtgggcattggtagcgcggagaaaagccaggtgcagcacatggtgcgtaccctgctgaagctccctgcgaacccgcaggccgacgccgcggatgcgctggccattgcgattacccactgtcacgtcagccagaatgcgatgcaaatgagcgagtcgcggctcaatctggcgcgaggcaggttacgataa

SEQ ID NO: 2617 - DNA, 477 bp, Enterobacter cloacae
gtattttgccgggcttcagattcagcgacacgtcagaaaggacgcggcgctggccgaatgagaccgaaacattttcaagagaaactaaagtcgtcatgtcaatttaagcttgcagaagtcatcgaatgttataatatcacattccacgcattcattacgatgattagtcgcattatgttacagaaaaatacgcttcttttcgcagctttatccgctgctctctggggtacaacagcacaagatgttaacgccgctgttgtcgcttcgcttaaaccgcttggatttatcgcctctgccatcgcggacgggatcactgagacacaggttctgctgcctgacggggcttccgagcatgattattctctgcgtccatctgatgtaaaacgcttacagaacgcggacttagtcgtctggattggtcccgagatggaagggtccatacgtagcccctcggtggacggcggatccgcaatagtg

SEQ ID NO: 2618 - DNA, 855 bp, Enterobacter cloacae
gccctcaggcttatggcgcgcggaatccttccagatatctacccacggcaacaagaaatataccctcagcagtacattcatacaggcataccatccatgagcatttcatctgatgtccagaaactggaaccgggtaagcgcgtccgcctgattgaggttgacggttcagctttcggtgccggtattcttcgctttcacaacgagacaatcccgcacaccgaggcggaaatcatcgccgcaggcggtgatgagtcaaagctcgagccgaagtcggtgtggtggcagggggaggagtatggcgcgtggccgtatgaactgaccggcatatctgtcagcagtgacggccagagttcacgaccgtctctcaccgttgcaaacatcagcggtacgattggctcgctgtgccgaagatttcaggggatggctaaagctaaggtgatcatccatgacactttcgcacactatctggacgccagaaacttccctgatgggaacccgactgcgaatcccaacgaggagcgcaaacaggtttattacatcgaccgtaagtcaggatcagacgatgaaaccgtagagtttgagctttccagtccagccgatctgcgcgggcaactcattccgacccggcaaattcagccaatgtgcacgtggtgcatgcggggctggtacaaaaccgggaacggctgcacctacgccgggcaaaacggctggttcgataaagacggcaatcgggtggacgatccttcacaggatgtttgctccggattgctgtcaacgggctgtaaacctcgcttcggagagaatgaacagctggattatgggggcttccccggcgcttcacttctgagaggataa

SEQ ID NO: 2619 - DNA, 1821 bp, Enterobacter cloacae
cctgcgagacaggcgacaatcagcctgcggctaattaagggatatctcatgcgtacagaatattgcgggcagctgcgtcagtcccacgtcgggcagcaggtcaccctgtgtggttgggtcaatcgtcgtcgcgatcttggtagccttatctttattgatatgcgtgaccgcgaaggtatcgttcaggtgttcttcgatccggatcgcgctgatgcgttgaagctggcttctgagctgcgcaatgagttctgcattcaggtgacgggcaccgtgcgtgcgcgtgacgagaaaaacgtcaacgccgacatggcgaccggcgctatcgaagtgctggcgtccgatctgacgatcatcaaccgcgcggaagcgttgccgctggactccaaccacgtcaacaccgaagaagcgcgtctgaaataccgctacctggatctgcgtcgtccggaaatggctcagcgcctgaaaacccgtgcgaaaatcaccagcctggtgcgccgttttatggatgaccacggtttccttgatatcgaaaccccgatgctgaccaaagccacgccggaaggcgcgcgcgattacctggtgccatcccgcgtccataaaggcaaattctatgcgctgccgcagtctccacagctgttcaaacagctgctgatgatgtctggcttcgatcgctactatcagatcgtgaaatgcttccgcgacgaagacctgcgcgctgaccgtcagccagaatttacccagatcgatgtggaaacctccttcatgaccgctgagcaggtgcgtgaagtgatggaagccctggtacgtagcctgtggaacgacgtgaaaggcgtcgaactgggcgatttcccaatcatgaccttcgcggaagccgagcgtcgctacggctccgacaaaccagacctgcgtaacccgatggagctggtggacgtggcagacctggtgaaagccgttgagttcgcggtctttgctggcccggctaacgatccgaaaggccgcgtggcggcactgcgcgtgccgggcggagcggctctgagccgtaagcagatcgacgactacggcaacttcatcaagatctacggcgcgaaaggtctggcctatattaaagtgaccgagcgtgcgaaaggtctggaaggtatcaccagcccggtggcgaaattcctgaacgcggacatcgtggaagcgatcctggagcgcaccggcgcgcaggacggcgacatgatcttcttcggcgcagataacaagaaagtggttgcggatgcgatgggcgcgctgcgtctgaagctcggcaaagacctgaacctgaccgacgaaagtaaatgggcgccgctgtgggtgatcgacttcccgatgtttgaagacgacggtgaaggcggcctgaccgcgatgcaccacccgttcacctcgccaaaagacatgacgccggcagagctgaaggcagcaccggaagacgcagtggcaaacgcctacgatatggtcatcaacggctacgaagtgggcggtggttccgtgcgtattcacagcggtgaaatgcagcagaccgtgttcggcatcctgggcatcaacgaacaggagcagcgcgagaagttcggcttcctgctggacgcgctgaaatacggtacgcctccgcacgcgggtctggctttcggtcttgaccgtctgaccatgctgctgaccggcaccgataacatccgtgatgtgatcgccttcccgaaaaccactgccgccgcgtgtctgatgaccgaagcgccaagctttgccaacccggccgcactggctgagctgggcattgaggtggtgaagaaggaagagaaaaactga

SEQ ID NO: 2620 - DNA, 1014 bp, Enterobacter cloacae
aggatgattgaagcagaccgcctggtatcggcaggcactattcagccagatgacgtggtggatcgcgcgatccgtcccaaactgctggatgagtatatcggccagccgcaggttcgttctcagatggagattttcatccaggcggcaaagctgcgcggcgatgcgctcgatcacctgctgatttttggtccgccggggttaggtaaaaccaccctggcgaatatcgtcgccaacgaaatgggcgttaacctgcgtaccacttccggcccggtactggagaaagcaggggacctggcggcgatgctgactaacctcgaaccgcatgacgtgctgtttatcgacgagatccaccgtctttctccggtggtggaggaagtgctctatccggcaatggaggattaccagctggatatcatgatcggtgaaggtccggccgcgcgctcgatcaaaatcgatctgccaccgtttaccctgattggcgccacgacccgtgccggctcgctgacttctccactgcgtgaccgttttggtatcgtgcagcgtctggagttttatcaggtgcccgaccttcagcatattgtggggcgcagcgcgcgctacatggggctggatatgagcgaagagggggcgtttgaagtggcgaagcgctcccgcggtacgccgcgtatcgccaaccgcctgctgcgccgggtgcgtgactttgccgaggtgaagcacgacggcactatatcggccgagatcgccgcccaggcgctggatatgctgaacgtcgatgctgaaggttttgactatatggaccgtaagctgctgctggcggtgctggataagttctttggcgggccagtagggctggataacctggcggcggcaattggcgaagagcgtgagactatcgaagatgtgctggagccgtatctgatccagcaaggcttcttgcagcgtaccccgcgcggtcgtatggcgacggtgcgggcgtggaatcatttcggcattacgccgcccgcgatgccgtaa

SEQ ID NO: 2621 - DNA, 591 bp, Enterobacter cloacae
agaaggcagcggacgactgatcggcgtgcaggcagtggccccggaagcgggcgaactgatccagacggccgcactggcgattcgcaaccggatgacggtgcaggaactggccgaccagttgttcccctacctgacgatggtcgaagggttgaagctcgcggcgcagaccttcaacaaggatgtgaagcagctttcctgctgcgccgggtgaggacaaggaggtgtgcgatgagcgcctacacggtatcgcaactggcccataacgctggggtgagcgtacatatcgtgcgcgactacctggtgcgcggcttgttacggccggtggcctgcaccacgggcggctacggcgtgttcgacgatgcggccttgcaacggctgtgcttcgtgcgcgcggccttcgaggcgggtatcggcctggatgccctggcgcggctgtgccgtgcgctcgacgcagcggacggcgcacaagccgcagcgcagcttgccgtgctgcgccagttggtcgagcggcggcgcgcggcgttggcccatctggacgcgcaactggcctccatgccagccgagcgggcgcacgaggaggcattgccgtga

SEQ ID NO: 2622 - DNA, 1323 bp, Enterobacter cloacae
tctgcaccaatctcgactatgctcaatactcgtgtgcaccaaagcgaggtgagcatggcggcggacaccccacggattccagaacaaggcgtggccactctgcctgatgaggcttgggagcgtgcgcgccgtcgtgcggagatcatcagtccgttggcgcagtcggagacggtcgggcacgaagcggccgatatggcggctcaggcgctgggcttgtctcggcgccaggtatacgttctgatccggcgtgcccggcaaggcagcggcctcgtgacggatctggtgcccggccagtccggtggaggtaaaggtaaggggcgcttgccggaaccggtcgagcgcgtcatccacgagctactgcaaaagcggttcctgaccaagcagaagcgcagcctagcggcctttcaccgcgaagtcactcaggtgtgcaaggctcaaaaactgcgagtgccggcgcgcaataccgtggccttacggatcgctagccttgacccgcgcaaggtcatccgccggcgggaaggccaggatgccgctcgtgacctacaaggtgtgggcggcgagcctcctgccgtgaccgcgccgctggagcaggtgcagatagaccatacggtcatcgacctgatcgtggtcgatgaccgcgaccggcaacctattggccgcccgtacctgaccctcgccatcgacgtgttcacccgctgcgtgctcggcatggtcgtcacgctggaagcgccgtctgccgtttcggttggcctgtgcctcgtgcatgtcgcctgcgacaagcgcccttggctggaaggactgaacgtggaaatggattggcagatgagcggcaagcccttgctgctctacctagacaacgcggccgagttcaagagcgaggccctgcgccggggttgcgagcagcatggcatccggctggactatcgcccgctgggacagccgcactatggcggcatcgtggaacggatcatcggcacggcgatgcagatgattcacgacgaactgccgggaacgaccttctccaaccctgaccagcgcggcgactacgattccgaaaacaaggccgccctgacgctgcgcgagctagagcgctggctcacattggcggtcggcacctaccacggttcggtgcacaacggcctgctccaaccgccggccgcgcgctgggccgaggccgtggcgcgtgtcggcgtaccggccgtcgtcacacgcgctacttcgttcctggtcgattttctgccgatcctccggcgcacgctgacccgcaccggctttgtcatcgaccacatccactactacgccgatgggcactgttgcaaatag

SEQ ID NO: 2623 - DNA, 495 bp, Enterobacter cloacae
aatgtaaggcctttgaataagacaaaaggctgcctcatcgctaactttgcaacagtgcccgccgatgcgctcaagccgtggattgcgcggcgtgaacgctggccgtcctttctgatccggcgcgatccgcgcgacatcagccgtatctgggtcctggaaccggagggacagcattacctggaaattccctaccgtaccttgtcgcatccggctgtcaccctctgggaacaacggcaggcgctggcgaaactgcggcagcaagggcgcgaacaggtggatgagtcggcgctgttccgcatgatcggccagatgcgtgagattgtgaccagcgcgcagaaggccacacgcaaggcgcggcgtgacgcggatcgccgccagcacctcaagacatcagctcggccggacaagcccgttccgccggatacggatattgccgacccgcaggcagacaacttgccacccgccaaaccgttcgaccagattgaggagtggtag

SEQ ID NO: 2624 - DNA, 1563 bp, Enterobacter cloacae
cactgtttcccgtctggatatggcgggagaaatcaaggagtgataaacgtggcgatattgagcgcaattcgacgctggcattttcgcgatggtgcgtcgattcgggaaatagcccgacgaagcggcctgtccaggaacaccgttcgcaagtatttgcaaagcaaggtggttgaaccgcagtacccagcgcgagacagcgttggcaagttaagtccttttgagcccaagttaaggcagtggctctccaccgagcacaaaaagacaaagaagctgcgcagaaacctgcgcagcatgtaccgggatttggtcgctttgggctttaccgggtcttatgaccgagtgtgtgcctttgcccgacagtggaaagattccgaacagttcaaggcgcaaacctcgggcaagggttgtttcatccccttgcgctttgcttgtggcgaagccttccaattcgattggagtgaggactttgcccgcatagcgggcaaacaggtcaaacttcagattgcccagtttaagttggcccacagccgggcctttgtgcttcgggcttactaccagcaaaaacatgaaatgctgtttgatgcccactggcatgcctttcaaatcttcggtggcattcccaagcgcggcatctacgacaacatgaagaccgctgtggattcggtggggcgtggcaaagagcgcagggtcaatcagcggttcactgccatggtcagccactacctgtttgatgcgcagttctgtaatccagcatcgggttgggagaaaggccagattgagaagaacgtgcaggattcccgccaacgcctgtggcaaggggcaccagactttcaaagccttgctgatttgaatgtgtggcttgagcatcgctgcaaagcgctgtggtctgagctgcgccaccccgaattggaccaaaccgtgcaagaggcctttgccgatgaacaaggcgagttgatggcgctacccaatgcctttgatgcattcgtggagcaaaccaagcgagtcacttcaacctgccttgttcaccacgagggcaatcgctacagcgttcctgccagttacgccaacagggccatcagccttcggatttatgcagacaagctggtgatggctgccgaaggccaacacattgccgagcatccaagattgtttggcagtggccacgctcggcgtggccacacacaatacgactggcaccattacttgtctgtgcttcagaagaaacctggggcgttgcgcaatggtgcgccatttgctgaattgccacccgcgttcaagaagcttcaatccatcttgctgcaacgccccggcggtgaccgtgacatggtggaaattctggcccttgtattgcaccacgatgaaggtgcggtactcagtgctgtggaattggcattggagtgtggcaagccatcgaaggagcatgtgcttaatctgttgggacgtttgaccgaagaacctccacccaaaccgattccaattcccaaggggttaaggctgacattggaaccacaggccaacgtgaaccgctatgacagtttaaggagagcccatgatgcagcatga

SEQ ID NO: 2625 - DNA, 1020 bp, Enterobacter cloacae
caagccatgaaaaccgccactgcgccgttaccaccgctgcgttcggtcaaggttctggaccagttgcgtgagcgcatacgctacttgcattacagcttaccaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcgcccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcagctgtcgcgtgcacgggcatggtggctgaaggaccaggccgagggccgcagcggcgttgcgcttcccgacgcccttgagcggaagtatccgcgcgccgggcattcctggccgtggttctgggtttttgcgcagcacacgcattcgaccgatccacggagcggtgtcgtgcgtcgccatcacatgtatgaccagacctttcagcgcgccttcaaacgtgccgtagaacaagcaggcatcacgaagcccgccacaccgcacaccctccgccactcgttcgcgacggccttgctccgcagcggttacgacattcgaaccgtgcaggatctgctcggccattccgacgtctctacgacgatgatttacacgcatgtgctgaaagttggcggtgccggagtgcgctcaccgcttgatgcgctgccgcccctcactagtgagaggtag

SEQ ID NO: 2626 - DNA, 510 bp, Enterobacter cloacae
acaagcgtggaacacatctacgccgcaggcgactgcaccgaccagccgcagttcgtctatgtggcggcagcggccggcactcgcgccgcgatcaacatgaccggcggtgacgcggccctgaacctgaccgcgatgccggccgtggtgttcaccgacccgcaagtggcgaccgtaggctacagcgaggcggaagcgcaccatgacggcatcaaaactgatagtcgcacgctaacgctggacaacgtgccgcgcgcgctcgccaacttcgacacgcgcggcttcatcaaactggtggttgaagaaggcagcggacgactgatcggcgtgcaggcagtggccccggaagcgggcgaactgatccagacggccgcactggcgattcgcaaccggatgacggtgcaggaactggccgaccagttgttcccctacctgacgatggtcgaagggttgaagctcgcggcgcagaccttcaacaaggatgtgaagcagctttcctgctgcgccgggtga

SEQ ID NO: 2627 - DNA, 927 bp, Enterobacter cloacae
caaactgccgcccgagacgcgccaacccgtttccggctacctgtggggtgcgctggccgtgttgacctgcccctgccatctgccgattctcgccgccgtgctggccgggacgaccgccggtgccttccttggcgagcattggggtgttgccgcgctcgcgctgaccggcttgttcgttctggccgtaacgcggctgctgcgcgccttccggggcggatcatgacgagttcgcagcccgccggatggacggcggccgagttggcgcaggcggcggcgcgcggacagcttgacctgcattaccagccgctggtcgatctgcgcgatcaccggatcgctggcgcggaagcgttgatgcgctggcggcatccgaggcttggcctgttgccgcccggccagttcctgccgctggccgagtcgttcggcctgatgccggaaataggcgcgtgggtgctgggcgaggcctgtcgccagatgcacaagtggcaaggaccggcatggcaaccgttccgtcttgccatcaatgtgtccgccagccaggttgggccaacgttcgacgacgaggtaaagcgggtgctggccgatatggccctgcccgccgagcttctggagatcgaactgaccgaatcggtcgcattcggcaatccagccctgttcgccagtttcgacgccttgcgcgccatcggcgtgcgcttcgccgccgacgacttcggcaccggctattcctgcctgcaacatctgaaatgctgccccatcaccacattgaaaatcgaccaatcctttgtcgccaggctcccggatgatgcccgtgaccaaactatcgtgcgggcggtgatccagctcgcgcacgggctgggcatggatgtcattttcagaagacgactgcaccagttgattgggcgtaatggctgttgtgcagccagctcctga

SEQ ID NO: 2628 - DNA, 738 bp, Enterobacter cloacae; identical to SEQ ID NO: 1033

SEQ ID NO: 2629 - DNA, 276 bp, Enterobacter cloacae
ccagttggaaaatcgcttcgagccgatgatgctgccggtatgggaggccaacgacgattgctgctcactgctggccagcttcgccgcttcgctcccgctgcgccggccttccccaattgccacgctggacatggctcgctacctgctcacacgcagcgagggcaccataggggaactggcgcacttgctgatggcggcggccatcgtcgccgtggagagcggcgaggaagcgatcaaccatcgcacactcagcatggcctgttgagttgcatctaa

SEQ ID NO: 2630 - DNA, 204 bp, Enterobacter cloacae
agaccgctgtggattcggtggggcgtggcaaagagcgcagggtcaatcagcggttcactgccatggtcagccactacctgtttgatgcgcagttctgtaatccagcatcgggttgggagaaaggccagattgagaagaacgtgcaggattcccgccaacgcctgtggcaaggggcaccagactttcaaagccttgctgatttga

SEQ ID NO: 2631 - DNA, 795 bp, Enterobacter cloacae
ggagagcccatgatgcagcatgaaggccatgtgagaatcctcaaatccttgaaactctttggcatggcacacgccattgaggagttgggcaatcagaattcaccagcatttaatcaagccttgcccatgctggacagcttgattaaagctgaagtggcagagcgtgaagtacgttcggtgaactatcaattgcgggtggccaagttccccgtgtatcgggacttggtgggctttgacttcagtcaaagcctggttaatgaggccacggtcaaacaattgcaccggtgcgacttcatggaacaagcccagaacgtggtgctgattggtgggccaggcacaggcaagactcacctggccacagccattggtacacaagcagtgatgcacttgaaccgacgggtgcgtttcttctccaccgtggatttggtcaatgcactggagcaagagaaatcatctgggcgtcagggacaaatcgcaaaccgtctgttgtatgccgatttggtgattctggatgagctgggatatttgccttttagccaaaccggtggggcactgctgtttcacctgctctcaaagctgtacgaaaaaaccagcgtgatactgaccaccaacttgagcttctcggaatggagccgagtgtttggcgatgaaaagatgacaacagcgttgttggaccgactaacccaccactgccacatcctggaaaccggcaatgaaagttaccgcttcaaacacagttcaactcagaataagcaggaggaaaaacagacccgcaaactgaaaatcgagacataa

SEQ ID NO: 2632 - DNA, 348 bp, Enterobacter cloacae
aaaccgccactgcgccgttaccaccgctgcgttcggtcaaggttctggaccagttgcgtgagcgcatacgctacttgcattacagcttaccaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcgcccgtcgcggcgcttgccggtggtgctga

SEQ ID NO: 2633 - DNA, 3024 bp, Enterobacter cloacae
cttcggcatcagccgcgaaaccttgtaccagtacctgcgggaagactgaccatgccacgccgctcaatcctgtccgccaccgagcgcgaaagcctgctggcactgccagatgccaaagacgaactgatacggcactacacgttcaacgaaaccgacctgtcggtgatccgtcagcgtcgcggcgccgcgaatcgattgggcttcgctgtgcagctttgctacttgcgattccctggcacctttttgggcgtcgatgagcctccgtttccgcccctgttgcgcatggtggccgcgcaactcaagatgccagtggaaagttggagcgagtacggccagcgcgaacagacacggcgggagcacttggtcgagctgcaaacggtttttgggttcaagcccttcaccatgagccactatcggcaagccgtgcatacattgaccgagctggccttgcagaccgacaaaggcatcgtgctggcgagcgcacttgtcgagaatctgcggcggcagagcattatcctgcccgccatgaatgccatcgagcgcgcaagcgccgaggccatcacccgtgccaaccgacgcatttacgcggcgctgaccgattctttgttatcaccccaccgtcagcgcctggacgaacttctcaagcgcaaggacggcagtaaagtgacgtggctggcatggctgcgccagtcgcctgccaaaccgaactctcgccacatgctcgaacatattgagcgcctgaaatcctggcaagcacttgatctgcccgcaggcatcgagcggcaggttcaccagaaccgcctgctcaaaatcgctcgtgaaggtggccagatgacgcctgctgatctggcaaagttcgaggtgcaacgacgctatgccacgctggtagcgctggccatcgaaggcatggccaccgtcaccgatgaaatcatcgaccttcacgatcgcatcatcggcaagctgttcaacgcggccaagaacaagcatcagcagcagttccaggcttccggcaaggcgatcaacgacaaggtgcggatgtatgggcgcatcggtcaagcgttgattgaggccaagcaaagcggcagcgatccgttcgccgccatcgaggccgttatgccctgggacaccttcgccgccagcgtcaccgaagcgcaaacattggcgcggcctgccgactttgatttcctgcaccacatcggtgaaagctatgccacgctacgccgctacgcgccgcagttcctgggcgtgctcaaattgcgggctgcgcccgccgccaagggtgtgctcgatgccatcgacatgctgcgcggcatgaacagcgacagcgcgcgcaaggtgcccgccgatgcgccaaccgcattcatcaagccgcgctgggcaaagctggttctgaccgacgacggcatcgaccggcgttactacgagttatgcgccctgtcggagctgaagaacgcgctgcgctccggtgatgtctgggtgcagggttctcgccagttcaaggacttcgacgaatacctggtgccggtcgagaagttcgccactttgaagctggccagcgaattgccgctggcagtggccaccgactgcgaccaatacctgcatgaccggttggaattgttggaggcgcaactcgccacagtcaaccgcatggctgcggccaacgacttaccggatgccatcatcaccaccgcgtcaggcctgaagatcacgccgctggacgcggcagtaccagacgccgcgcaagccatgatcgaccagacagctatgctgctgccgcacctcaaaatcaccgagttgctgatggaggtcgatgaatggacgggcttcacccgccacttcacacacctgaagaccagcgacacggccaaggacaaaaccttgctgttgacgacgatcctggccgacgcgatcaacctgggtctgaccaaaatggccgagtcctgccctggcaccacctacgccaagctgtcttggctgcaagcctggcacatccgcgatgaaacctattcgacggcgctggccgagctggtgaatgcgcagtttcggcaacccttcgccggcaactggggtgacggcaccacgtcatcgtcggacggccagaacttcagaaccggcagcaaagcagaaagcactggtcatatcaacccgaagtatggaagcagtccaggacggactttctacacccatatctccgaccagtacgcgcccttcagtgccaaggtggtcaacgtgggcattcgtgattcaacttacgtgcttgatggcctgctgtaccacgagtcggacttgcgcatcgaggaacactacaccgacacggcaggcttcaccgatcacgtgtttggcttgatgcatttgctgggatttcgcttcgcgccgcgtatccgtgacttgggcgaaaccaagctattcatccccaagggcgatgccgcctatgacgcgctcaagccgatgattagcagcgacaggctgaacatcaagcaaatacgcgcccattgggatgaaattctgcggctggccacctccatcaagcaaggcacggtaacggcttcgctgatgctgcgcaaactcggcagctacccgcgccagaacggcttggccgtggcgttgcgcgagctggggcgcatcgagcgcacgctgttcattttggattggctgcaaagcgtggagctgcgccgccgcgtccatgcggggctgaataagggcgaggcgcgcaacgcgctggccagggcggtcttcttctaccgattgggtgaaatccgcgaccgcagttttgagcagcagcgctaccgggccagcggcctcaatctggtgacggcggccatcgtgttgtggaacacggtatatctggagcgtgccaccagtgctttgcgtggcaacggcacggcgctggacgacacattgttgcaatatctgtcgccgctggggtgggagcacatcaacctgaccggcgattacctatggcgcagcagcgccaaggtcggtgcggggaagtttaggccattgcgaccgctgccaccggcttag

SEQ ID NO: 2634 - DNA, 1032 bp, Enterobacter cloacae
ggacaggctttcattcggagaaccatcatggaaaacattgcgcttattggtatcgatctgggtaagaactctttccatattcattgtcaggatcatcgtgggaaggccgtttaccgtaaaaaattcacccgaccaaagctaatcgaatttctggcgacatgcccggcaacaaccatcgcgatggaagcctgtggcggttctcactttatggcacgcaagctggaagagttagggcattttccaaagctgatatcaccgcaatttgtccgcccattcgttaaaagcaacaaaaatgacttcgttgatgctgaagctatctgtgaagcagcatcacgtccatctatgcgtttcgtgcagcccagaaccgaatctcagcaggcaatgcgagctctgcatcgtgtccgtgaatccctggttcaggataaggtgaaaacaactaatcagatgcatgcttttctgctggaatttggtatcagcgttccgcgaggtgctgccgttattagtcgactgagtacccttcttgaggacagtagtttgcctctttatctcagccagttactgctgaaattacaacagcattatcactatcttgttgagcagattaaagatctggaatctcagttgaaacgaaagttggacgaagatgaggttggacagcgcttgctgagtattccctgcgttggaacgctgactgccagtactatttcaactgagattggcgacgggaagcagtacgccagcagccgtgactttgcggcggcaacagggctggtaccccgacagtacagcacgggaggtcggacgacattgttagggattagcaagcggggcaacaaaaagatccgaactttgttggttcagtgtgccagggtattcatacaaaaactggaacaccagtctggcaagttggccgactgggtcagggagttgttgtgtcggaaaagcaactttgtcgtcacctgtgctctggcaaacaagctggccagaatagcctgggcactgacggcgcgacagcaaacttacgaagcataa

SEQ ID NO: 2635 - DNA, 561 bp, Enterobacter cloacae
cgctggggtgagcgtacatatcgtgcgcgactacctggtgcgcggcttgttacggccggtggcctgcaccacgggcggctacggcgtgttcgacgatgcggccttgcaacggctgtgcttcgtgcgcgcggccttcgaggcgggtatcggcctggatgccctggcgcggctgtgccgtgcgctcgacgcagcggacggcgcacaagccgcagcgcagcttgccgtgctgcgccagttggtcgagcggcggcgcgcggcgttggcccatctggacgcgcaactggcctccatgccagccgagcgggcgcacgaggaggcattgccgtgaacgcccctgacaaactgccgcccgagacgcgccaacccgtttccggctacctgtggggtgcgctggccgtgttgacctgcccctgccatctgccgattctcgccgccgtgctggccgggacgaccgccggtgccttccttggcgagcattggggtgttgccgcgctcgcgctgaccggcttgttcgttctggccgtaacgcggctgctgcgcgccttccggggcggatcatga

SEQ ID NO: 2636 - DNA, 873 bp, Enterobacter cloacae
ggagtggtagccgtggacgaatatcccatcatcgacctgtcccacctgctgccggcggcccagggcttggcccgtcttccggcggacgagcgcatccagcgccttcgcgccgaccgctggatcggctatccgcgcgcagtcgaggcgctgaaccggctggaagccctttatgcgtggccaaacaagcaacgcatgcccaacctgctgctggttggcccgaccaacaatggcaagtcgatgatcgtcgagaagttccgccgcacccacccggccagctccgacgccgaccaggagcacatcccggtgttggtcgtgcagatgccgtccgagccgtccgtgatccgcttctacgtcgcgctgctcgccgcgatgggcgcgccgctgcgcccacgcccacggttgccggaaatggagcaactggctctggcactgctgcgcaaggtcggcgtgcgcatgctggtgatcgacgagctgcacaacgtgctggccggcaacagcgtcaaccgccgggaattcctcaacctgctgcgcttcctcggcaacgaactgcgcatcccgttggttggggtaggcacgcgcgacgcctacctagccatccgctccgatgaccagttggaaaatcgcttcgagccgatgatgctgccggtatgggaggccaacgacgattgctgctcactgctggccagcttcgccgcttcgctcccgctgcgccggccttccccaattgccacgctggacatggctcgctacctgctcacacgcagcgagggcaccataggggaactggcgcacttgctgatggcggcggccatcgtcgccgtggagagcggcgaggaagcgatcaaccatcgcacactcagcatggcctgttga

SEQ ID NO: 2637 - DNA, 618 bp, Enterobacter cloacae
ttgacatattccgtcaaaggtaatagatttcatcctgacacttttgcctttggaggcatcttgcaaggtcaacgcatcggctatgtccgcgtcagcagcttcgaccagaacccggaacggcaattggagggtgttcaggtggcgcgggtgttcaccgacaaggcttctggcaaggacacccagcgtcccgagctggaaaggctgctggccttcgtccgcgagggcgacaccgtggtggtgcatagcatggacaggctggcacgcaaccttgatgacctgcgccgcatcgtccaagggctgacacaacggggcgtgcgcatggagttcgtcaaagaagggctgaagttcaccggcgaggactcaccgatggccaatctgatgctgtcggtcatgggagccttcgctgagttcgagcgcgccctgatccgcgaacgtcagcgcgagggaatcgtgctggccaagcagcgcggtgcctaccggggacgaaagaaatcgctgaacagcgaacaaattgccgagttgaaacggcgagttgcggcaggcgaccaaaaaaccttggtggcccgtgacttcggcatcagccgcgaaaccttgtaccagtacctgcgggaagactga

SEQ ID NO: 2638 - DNA, 435 bp, Enterobacter cloacae
gcgcactccggcaccgccaactttcagcacatgcgtgtaaatcatcgtcgtagagacgtcggaatggccgagcagatcctgcacggttcgaatgtcgtaaccgctgcggagcaaggccgtcgcgaacgagtggcggagggtgtgcggtgtggcgggcttcgtgatgcctgcttgttctacggcacgtttgaaggcgcgctgaaaggtctggtcatacatgtgatggcgacgcacgacaccgctccgtggatcggtcgaatgcgtgtgctgcgcaaaaacccagaaccacggccaggaatgcccggcgcgcggatacttccgctcaagggcgtcgggaagcgcaacgccgctgcggccctcggcctggtccttcagccaccatgcccgtgcacgcgacagctgctcgcgcaggctgggtgccaagctctcgggtaa

SEQ ID NO: 2639 - DNA, 447 bp, Enterobacter cloacae
catcaaggcccgatccttggagcccttgccctcccgcacgatgatcgtgccgtgatcgaaatccagatccttgacccgcagttgcaaaccctcactgatccgcatgcccgttccatacagaagctgggcgaacaaacgatgctcgccttccagaaaaccgaggatgcgaaccacttcatccggggtcagcaccaccggcaagcgccgcgacgggcgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttggtaa

SEQ ID NO: 2640 - DNA, 930 bp, Enterobacter cloacae
tgcgtggggctttgtaggtatggggctcataattgctgcctttttgctcgcccgatccccatcgtggaagtcgctgcggaggccgacgccatggtgacggtgttcggcattctgaatctcaccgaggactccttcttcgatgagagccggcggctagaccccgccggcgctgtcaccgcggcgatcgaaatgctgcgagtcggatcagacgtcgtggatgtcggaccggccgccagccatccggacgcgaggcctgtatcgccggccgatgagatcagacgtattgcgccgctcttagacgccctgtccgatcagatgcaccgtgtttcaatcgacagcttccaaccggaaacccagcgctatgcgctcaagcgcggcgtgggctacctgaacgatatccaaggatttcctgaccctgcgctctatcccgatattgctgaggcggactgcaggctggtggttatgcactcagcgcagcgggatggcatcgccacccgcaccggtcaccttcgacccgaagacgcgctcgacgagattgtgcggttcttcgaggcgcgggtttccgccttgcgacggagcggggtcgctgccgaccggctcatcctcgatccggggatgggatttttcttgagccccgcaccggaaacatcgctgcacgtgctgtcgaaccttcaaaagctgaagtcggcgttggggcttccgctattggtctcggtgtcgcggaaatccttcttgggcgccaccgttggccttcctgtaaaggatctgggtccagcgagccttgcggcggaacttcacgcgatcggcaatggcgctgactacgtccgcacccacgcgcctggagatctgcgaagcgcaatcaccttctcggaaaccctcgcgaaatttcgcagtcgcgacgccagagaccgagggttagatcatgcctag

SEQ ID NO: 2641 - DNA, 753 bp, Enterobacter cloacae
cgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagggcagtcgccctaaaacaaagttaggccgcatggacacaacgcaggtcacattgatacacaaaattctagctgcggcagatgagcgaaatctgccgctctggatcggtgggggctgggcgatcgatgcacggctagggcgtgtaacacgcaagcacgatgatattgatctgacgtttcccggcgagaggcgcggcgagctcgaggcaatagttgaaatgctcggcgggcgcgtcatggaggagttggactatggattcttagcggagatcggggatgagttacttgactgcgaacctgcttggtgggcagacgaagcgtatgaaatcgcggaggctccgcagggctcgtgcccagaggcggctgagggcgtcatcgccgggcggccagtccgttgtaacagctgggaggcgatcatctgggattacttttactatgccgatgaagtaccaccagtggactggcctacaaagcacatagagtcctacaggctcgcatgcacctcactcggggcggaaaaggttgaggtcttgcgtgccgctttcaggtcgcgatatgcggcctaa

SEQ ID NO: 2642 - DNA, 387 bp, Enterobacter cloacae
gcgtgcataataagccctacacaaattgggagatatatcatgaaaggctggctttttcttgttatcgcaatagttggcgaagtaatcgcaacatccgcattaaaatctagcgagggctttactaagcttgccccttccgccgttgtcataatcggttatggcatcgcattttattttctttctctggttctgaaatccatccctgtcggtgttgcttatgcagtctggtcgggactcggcgtcgtcataattacagccattgcctggttgcttcatgggcaaaagcttgatgcgtggggctttgtaggtatggggctcataattgctgcctttttgctcgcccgatccccatcgtggaagtcgctgcggaggccgacgccatggtga

SEQ ID NO: 2643 - DNA, 603 bp, Enterobacter cloacae
cggaccctggtcaggttccgcgaaggtgggcgcagacatgctgggctcgtcaggatcaaactgcactatgaggcggcggttcataccgcgccaggggagcgaatggacagcgaggagcctccgaacgttcgggtcgcctgctcgggtgatatcgacgaggttgtgcggctgatgcacgacgctgcggcgtggatgtccgccaagggaacgcccgcctgggacgtcgcgcggatcgaccggacattcgcggagaccttcgtcctgagatccgagctcctagtcgcgagttgcagcgacggcatcgtcggctgttgcaccttgtcggccgaggatcccgagttctggcccgacgccctcaagggggaggccgcatatctgcacaagctcgcggtgcgacggacacatgcgggccggggtgtcagctccgcgctgatcgaggcttgccgccatgccgcgcgaacgcaggggtgcgccaagctgcggctcgactgccacccgaacctgcgtggcctatacgagcggctcggattcacccacgtcgacactttcaatcccggctgggatccaaccttcatcgcagaacgcctagaactcgaaatctaa

SEQ ID NO: 2644 - DNA, 411 bp, Enterobacter cloacae
agcagcaagggcttgccgctcatctgccaatccatttccacgttcagtccttccagccaagggcgcttgtcgcaggcgacatgcacgaggcacaggccaaccgaaacggcagacggcgcttccagcgtgacgaccatgccgagcacgcagcgggtgaacacgtcgatggcgagggtcaggtacgggcggccaataggttgccggtcgcggtcatcgaccacgatcaggtcgatgaccgtatggtctatctgcacctgctccagcggcgcggtcacggcaggaggctcgccgcccacaccttgtaggtcacgagcggcatcctggccttcccgccggcggatgaccttgcgcgggtcaaggctagcgatccgtaaggccacggtattgcgcgccggcactcgcagtttttga

SEQ ID NO: 2645 - DNA, 204 bp, Enterobacter cloacae
aaggccgctaggctgcgcttctgcttggtcaggaaccgcttttgcagtagctcgtggatgacgcgctcgaccggttccggcaagcgccccttacctttacctccaccggactggccgggcaccagatccgtcacgaggccgctgccttgccgggcacgccggatcagaacgtatacctggcgccgagacaagcccagcgcctga

SEQ ID NO: 2646 - DNA, 210 bp, Enterobacter cloacae
gccgccatatcggccgcttcgtgcccgaccgtctccgactgcgccaacggactgatgatctccgcacgacggcgcgcacgctcccaagcctcatcaggcagagtggccacgccttgttctggaatccgtggggtgtccgccgccatgctcacctcgctttggtgcacacgagtattgagcatagtcgagattggtgcagatcacttctga

SEQ ID NO: 2647 - DNA, 477 bp, Enterobacter cloacae
tccgccccggaaggcgcgcagcagccgcgttacggccagaacgaacaagccggtcagcgcgagcgcggcaacaccccaatgctcgccaaggaaggcaccggcggtcgtcccggccagcacggcggcgagaatcggcagatggcaggggcaggtcaacacggccagcgcaccccacaggtagccggaaacgggttggcgcgtctcgggcggcagtttgtcaggggcgttcacggcaatgcctcctcgtgcgcccgctcggctggcatggaggccagttgcgcgtccagatgggccaacgccgcgcgccgccgctcgaccaactggcgcagcacggcaagctgcgctgcggcttgtgcgccgtccgctgcgtcgagcgcacggcacagccgcgccagggcatccaggccgatacccgcctcgaaggccgcgcgcacgaagcacagccgttgcaaggccgcatcgtcgaacacgccgtag

SEQ ID NO: 2648 - DNA, 411 bp, Enterobacter cloacae
ggtcgtatgtctgaagcactcaaatcgttaaacaatattcgtactcttcgcgcccagggccgcgagctgcctttagaagtacttgaggaaatcctcgaaaagcttaatgtcattgttgatgagcgtcgtcaggaagaatcatccaaagctgccgaactgcaagctcgtcaggagaaacttgacgccctgcgtaagttaatggaagaagatggtatcaacccggaagagctgcttggctcattccaggccaaatctacggctaccaagaaaagccgtgaaccacgcccggccaaatactcatttactgatgaaaatggcgaaacaaaaacgtggactggacagggccgcacccccaaagctctggcagaacaaattgcagccggtaaaagtcttgatgatttcctgatctaa

SEQ ID NO: 2649 - DNA, 1548 bp, Enterobacter cloacae
ttcatgtattcgtatgaagatcgccttcgagccgtgaggttgtacctgaagcttgggcgccggatgagcgccacactacggcagctgggataccccaccaagaactcgctgaaggcctggttggcagaattcgaacggaatcaggatcttcgccgaggctatcaacggataaaacggcagtacaccgatgagcaaaagcaacgggcagtagatcactatatcgaacaaggctactgcctgagtcacacaatccgaagcctgggctacccaagccgcgaggccttgcgtgcctggatccgtgatttacgccctgaattcgctaggacggtcgtcggcagcagcgctcccacagtcgcccgctctcgcctcgagaagcagcaagccgtcattgcactgaacctgcgcgtaggttcggcaaaggatgtggccgacactgtcggtgtatcgcgaccaacgttgtataactggcagcatcgattacttggcaaagtgcccctaaaacccatgacaaagaagaaaggtgacacctcgctcgagcagcggcatgaggcactactcagggaactggccgaactggagagccagaaccagcggcttcgcatggagaatgcaattctggagaaggcgagtgaattgataaaaaaagacatgggcatcaaccccctcgaactgacaagccgagaaaaaacgaaggtggttgatgccctcagagtcacgtttccattagccaatctgttgtgcggcctgaagctggcgcgcagcacatacttctatcaacgcctgcggcagacgcggcccgacaagtacacgcaggtgcgtgaggtcattcggactatcttcgaggacaactaccgctgctatggctatcgacgcattgatagtgccttgcgccttggtggcatgcgtgtgtccgagaaggtcgtgcgtcgcttgatggcgcaagagcgtctggtcgtgagaacaccgcgccgccggcgcttctcggcgtatgctggcgacccgacaccagcggtcccgaatctgctgaatcgcgactttcacgcgtcggcgccgaatacgaaatggttgaccgatctgacggaaatacacattccggcagggaaggtctacgtctcgccgatcgtcgattgcttcgatgggctggtggtggcctggaatatcggcaccagcccggatgcgaacctggtcaataccatgctggatcacgcggtacggacactgcgacccggtgagcatccggttatccattcggacaggggctcgcattatcgctggcctgcgtggatccgccgcactgaaaatgcccaattaacgcggtcgatgtccaaaaagggctgctcgccagacaatgctgcatgcgagggctttttcggacgattgaagaccgaactaatctacccgaggaattggcagcacgtgacgctgaaagacctcatgacgcgaatcgatgcctatatccactggtacaacgagcgccgcatcaaagtgtcgcttggcgggcgtagtcccatcgagtatcgtcatgcggtcggattgatgtccgtataa

SEQ ID NO: 2650 - DNA, 714 bp, Enterobacter cloacae
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgcccatcggcgtagtagtggatgtggtcgatga

SEQ ID NO: 2651 - DNA, 1233 bp, Enterobacter cloacae
cccagcatcattaaggaaatcataatggggttcaggttcagaaagtcgatcaacattattcctggcgttcgcctcaacctgagtaacggtgcaccgagcctgagtgtcgggccgagaggtgcttccgtttcttttggtagccgggggacctatgccaatctgggcttgcccggtaccgggctgagttaccgtacccggcttgaccgggccgcgcgttccggaggtggaaaccggacggcaaccgacccggggctcagacaggcgcttgagcaggaagccgctgaactcatgtcagcggtaaccgcaatccgtaatattcacgagctgacgccggatccaaaaacaggcatcagctgggcagagctggaagcagtatacctgcataacagaacgtcgccttttcaggttccggcaccggtgcgtccagaaaagccagactaccttgcattgccggaaaagcctgccgagagcgaaggcattagttttctgggtaaatggtttgaatcggaatcagctaaagctgagcgccacgccgaaaatcttcgccggtggcagcaggagctgattgatgtggagcgtgagaatacccttcgacagcaccggtaccagcaacaacggacggcctgggccgaacagtatgcaaactggaagtttgaagcagaagaacatgaaaaacggctcgccacggctcaggcagatgcccggcagcagttccggacagacgccgcgtttttcgaatcatacctggcgggtgtgctggcagaaactgaatggccgcgtgaaacgattgttgcatttgaagtaaagccggagctatcagcagtcctgctggacgttgatttagctgagattgaagatttccctgataagatttacggcgttaatgcccggggcacggagctgacggaaaaagccatgacgcaaaaagccgtacgcgaaaactatgcccgccacgtccatggctgcttgttccgcctggtcggtatcgttttacatacgctacctttcgacaacgtgattgtgtcaggctttacgcaacgggtcagtaagcggaccggctatctggaggatgagtatatcctgtcctgcaaatgcactcgcagccagatgtcgtcagtaaattttgcaggcatagaacacattgatccggttgaagcgttaggcgatcacccggttattcgaaagatgagcagtaccttcatttttcagcctattgaaccactaaccctttaa

SEQ ID NO: 2652 - DNA, 651 bp, Enterobacter cloacae
ggggatatcatgtctgtcagtctgagcaaaggccagggcgtaagcctgaaaaaaaatgaatacgatctctcgtccgttactatcggcctcggttgggatattaatgaggaaaagaaaggttttctcggcgggatctttggtaaaaaagaagaagaatacgaccttgatgtgatcgctttcctgtgtaattcagccggaaaggtgaccgatctcggcaatgtggaaaatggtaaaccaacgcttgtgaatggcgatatcatctttttcaacagccttcgccataagtcaggcaatatctggctgacgggcgataaccgaaccggagccggtgacggtgacgatgagcaaattattgtgcgcctgaattcccttgacgctcagtacgagaaaattgtgttcatcgttcagatctacaatggtgaaaagctccagcagcactttggtaaagttcagaatgccttcatccgggcagtagatgcccgtaatattgaaatggcacgattcgatctttctggcggacccgccttcgccagccagcgctccatggtctttgccgagctgatacgcgaggctacaggctggaaactcagggcaattggtgagccttcagaatcagattcgtttgtctcgcacctgaggaattacatgtga

SEQ ID NO: 2653 - DNA, 1152 bp, Enterobacter cloacae
ggcgtatttatgtctgatatcctcgaagatatgatttatcgccgtaccctctcatgcggtacgattcaggtaacccgcgaccagggtgaagtttcgctcgatgacctgtttgacatcgctgaaagacgtaacccgaaacgcgcctttctgtttgtcagcaaagtactcggcaggcacattcccgtgccaccctcagtcatgcggcaggcctacagacagcttgccagccagttcccctcgacactgacaggacccgtactgtttatcggtatggctgaaaccgccgttgggcttggggccggtgtatttgatgaagtgcgccaccagcatcctgaatctgtctatctgacctctacccgtcacccggttgatggcacgttgctttgcgagttcaaggaagaacacagccacgccaccgatcatctgatctatctgccagatgatgaagagaaaagacgtcgtgttaccaacgcacgaacgctggttttgattgatgacgaggcaaccaccggtaatacctttattaacctgctttcagccctgcgtaataccggcaagcttcaacatattgaacaggttatagccgttacgcttaccgactggagtggcaaagccttgtccgagcgcagcaccttaccagtcacttcggtttctcttgtaagcggtaagtggggatggaccccattacctgatgcacctgtcccggacatgccgaaagtcaacgtaacttcacgaggagaatgggacatccagggaaaacagtcctggggccgactggggatgctcgcacctgcggccgatctcggccatgaggtctccgtccacaagggggaacgtattctggttctcgggaccggggaattcgtctgggagccgttcctgcttgctgaacggctcgaagctgccggagcacaggcattttatggatcgaccacccgctcccctatcgccgttggttatgccattgagtccgccatttcctttacggataactacgggctgggcatccccaattttgtctataacgtcgcccaccagcagtttgaccgcattcttgtgtgtactgagacacccgcagaaagtattgacacgcagcttcttaaagcgctggctgaggttgcggccgtcgtggagattgttacctatgaataa

SEQ ID NO: 2654 - DNA, 186 bp, Enterobacter cloacae
cgcttacactttatgttacagcatcctatcctgattaaccgcccgatcgtggtgacgccactggggacccggctgtgtcgtccttcagaagtggtgctggatattcttccggatgcacagaaacacgcgttcaccaaagaagatggtgaaaaagtcgttgatgatgcaggtaaacgactgaaataa

SEQ ID NO: 2655 - DNA, 279 bp, Enterobacter cloacae
tctgcttcatggagaggagcaatttgtctcagccgatgccggctaccaaggagcgccacagcgcgaggagctggccgaggtggatgtggactggctgatcgccgagcgtcccggcaaggtaaaaaccttgaagcagcatccgcgcaagaacaaaacggccatcaacatcgaatacatgaaaaccagcatccgtgccaaggtggagcacccgtttcgcatcatcaagcggcagttcggcttcgtgaaagccagatacaaggggctgctgaaaaacgataa

SEQ ID NO: 2656 - DNA, 1191 bp, Enterobacter cloacae
cttcacgaggagaatgggacatccagggaaaacagtcctggggccgactggggatgctcgcacctgcggccgatctcggccatgaggtctccgtccacaagggggaacgtattctggttctcgggaccggggaattcgtctgggagccgttcctgcttgctgaacggctcgaagctgccggagcacaggcattttatggatcgaccacccgctcccctatcgccgttggttatgccattgagtccgccatttcctttacggataactacgggctgggcatccccaattttgtctataacgtcgcccaccagcagtttgaccgcattcttgtgtgtactgagacacccgcagaaagtattgacacgcagcttcttaaagcgctggctgaggttgcggccgtcgtggagattgttacctatgaataaacccgttgttctgagcgaccttgacgacacgctctttcagacccgtcgtaaaatggtggacgagctggccctggagccattccgtaccggtgccgttgatcgcaccctgaatccacgaagctttatgacggaagaacagtccatgttggtggactggctcctggagcaggctgaactcatacccgttaccgcacggggaactgaagaaatcagccgcgtacggatccctttccactcctgggcaatcaccactcacggggccgtcattctcacgccagaaggcaaacccgacgaggagtggaaggcccatatgctcggccagctggctccctatcaggaaaagctgacatcgatgcagcgtctgatcactgaaatgatggacgcaaaagggatcaatgcctgggcaaggctgaacttcgaatacggtgaaacggcggtttatatggtgatgaagcaccgcgacagcacccgccttgacgagctcaatgccattgcagatgagatagaaacggtgtttccgaccgagggcttctacatccaccgcaacagtaataacgtggcctggcttcccaccgcggttgagaaagggctggcagtcagatggcttcttgaaaaacttcgggctgaacgcggagtcttccccgtaattggtctgggcgacagcctgagcgatcatcgttttatgaaactgtgcagctggtttggcatcccgcgtcagagtcagtttgcagatgccatttcacagcgaatttttggagaaaattaa

SEQ ID NO: 2657 - DNA, 1035 bp, Enterobacter cloacae
aaagggaatagttgttacagaaatggggggaaccctcggccagtatcgggctgtaaccattatcaagaaggtactctgatgaaaaatcgtctttctccctggaatctgggagccacgctatacatgcctgcaacacgggaagatattgctgatgccgtcctgcacgggaaaatcccgggtttgcgctctctggtgatttgcctggaggatgctgtcagtgaagcagacatccccatcgccctcaaaaatctggagcacctgctgcacgagctcagtaacagcatgcgtagcctgggtaaaaatgactggcctctggtgttcattcgccctcggcatgccgaaatgggcagatggttaaaagcgcattatgatctttccgctgtcgatgggtttgtgttgccgaaatttaccctcagttcgttagctgaatggtgggatatcatgggcgggactcacctgtgcatgatgccaacgctggaaacagaagacgtctttgacgtggttcagatgcgcgagctggccactcgcctggtggaacatccctgccacgaccgcattattgcgcttcgaatcggcggcaacgatcttatgaacgttgtgtcgcttcgccgcccccgggacctgacgctgtatgacagcccgatgggctacgtcatcaaaatgctcgtttcagtcttcggcccgcgtgattttgccctgaccgcgcccgtatgtgagcatattgacgatcatgccgttatggccagagagctggctcttgatatggcacatgggcttgttgggaaaacggccattcacccgggtcagatagaggtcattcaaaacgcgctgatggtcactcagggtgagtattctgacgctctgcggatcctgaactctacccaggccgtgtttaagtcgcagggagcaatgtgtgaacccgccacacatcgccgctgggcggctggcattctggacagagctcgtttttatgggttacagaacgagcaaagcgctgatggaatcagattacttaccgtgacccagcatcattaa

SEQ ID NO: 2658 - DNA, 501 bp, Enterobacter cloacae
accactaaccctttaagcaggctaaatcttacgatgcaattaaataccagacaggcccggatttttaagcttgccaacttactgggcaccggcaagcccgtttccgctgccgacattataaccagtctggaatgctcagagccgacattaacccgggccctcaaagagctacgcgagtcatattctgcggagatcaaatacagcaaggcaggtcattcctaccatctcgttaatccgggccagctggataaaaagacccttcgccggatgaatgaagcgctcgcacagaatgctgaactgaaaaccggtgagtctacagggaaggtcgtactcgataaggataaaaaaacagccgtgtccttatcgctacgcatgcggatcttaagaaaaattgaccgtctggctgcgctgagtggctcgacccgaagtgaagcggtagagaagctggctctgcactccgttgacgaactgataaaagaatacagcgctaaaaagtcctga

SEQ ID NO: 2659 - DNA, 747 bp, Enterobacter cloacae
gtatttaatctccacccgacagatgtcgtgccgttttatcaaatcaacaaaccctggcctcttcctgaaactactctcctcttccgatctcttaagaaggaattacatttgagacgcttacccgtatatctgctactcgacacgtccggctctatgcacggagagcctatcgaagcggttaaaaatggcgttcagacgctgcttaccacgctgaaacaggatccgtatgcactcgaaacggctcacgtgtcagtgatcacctttgattcttcagcccgacaggcagtccccctgacagacctcctgagtttccagatgccagcactaacagccagcggcaccacgtctcttggcgaagcgctttccctcacggccagctccattgccaaagaagtacagaaaacgacggctgacactaaaggtgactggcgtccccttgtattcctgatgacggatggaagtccgaatgatgactggcgtaaaggcctgaatgactttaaagcggccagaaccggcgttgttgtggcatgtgcagccgggcatgatgccgataccagcgtcctcaaagaaatcactgaaatcgtggttcagctcgatacagctgacagttcgacgattaaagctttctttaaatgggtcagtgcgagcatttcggtaggcagtcagaaagtggagtccagcaaaaaagaagtgatcggtcttgaagacctgccaccgccgccgccagaagtaaatgtggtcttataa

SEQ ID NO: 2660 - DNA, 687 bp, Enterobacter cloacae
gccttcagaatcagattcgtttgtctcgcacctgaggaattacatgtgatgcgccgcctgcctgtttaccttgttatcgacacatccggctcgatgcgcggtgagtcaatccattccgttaacgttggaattcaggcgatgcttagcgctcttcgccaggatccctacgccctcgaaagcgttcatatctccattatcacctatgacaatgaggcgcgtgagttcattcctctcacgccgctggaagacttccagttttctgacatcgttgtgccaagcgcaggcgggacgttcaccggtgctgcccttgaatgtctgatgcagtgtgttgaacgggatgtacgtcgctcagatggtgataccaaaggagactggcgtcctctggtattcctgatgactgatggaaccccttctgatgccctggcgtacggtgaagcggtaaaagcgattcgcggccggggattcggatccatcattgcctgcgccgttggtcctaaagcaggccatgagcacttaaaacagctcaccgataaggttgtgtctctggagacgctagattcaaccgcgtttgcaggtttctttaaatgggtatcggccagcgtgtcttccggcagcacaagcgcggggattaataacggaactgatacccttccccctcctccaccagaaatccagctggtgctctga

SEQ ID NO: 2661 - DNA, 1125 bp, Enterobacter cloacae
cagacagaaaggtgctgtttccgggcagcacctttctgtacagcaacgttttctgctggccgtaccagccgtacgaggaaaattatgagacgccttcccgtgttttttgtcctggactgttcagagtccatgattggtgaaaacctgaaaaaaatgactgatggtctgcaaatgatcgtcggagatttaagaaaggatccacacgcacttgaaacagcctgggtctcggtaatcgcatttgccggtgtagcccgtacgattgtacctcttcacgaaattgcctcgttctaccctccccgccttcccgttggcggcggtacgagccttggagctgcattgcgtgagctgaccgtgcaaattgatacccaggtcagaaaaaccactcatgaggctaaaggcgactggaaacccgtcgtgtatctccttaccgacggacgtccgactgacgacacaaccgcagaagtgaagcgctggaaggatcactacgcgagtaaagtgaatctcattgccgttggcctggggccgtcagcggacctgaatatcctgcggcaactgacagagaatgtcatgctgttcaccgaatctcaggaaggggactttacccgcttcatcaaatggatcacggcctcggttacggcgcacagccgcagcgtcggggacgacaaacaacctgagctcagccagactgaatacatagtccggctggccaaggacgagccagtaaaagcgtacgacgaaaactgcgttacgcttaccggccgttgcagcaagacccgtcgtccgtacctgatgaagtatgaacggccaccagcaagggtttccgggctcgatttcagtctgaacctgaacagctttaatattgccggatgctatcccatcgatgaggactattttgcgtggtcagatgccaccgctaccggtttgcaggtaaataccagcgaactgcatggcgtaccgggttgcccccactgcggtaatgccagtgcgtttgccctgtgctcatgcggaaagttgctgtgtattgacggcccggatgacgtgatctgcccgtggtgtgaaacaggcctgtcattcagcaatgatggcggaaacactaacttcgacgtaaacagagggagaggttga

SEQ ID NO: 2662 - DNA, 1590 bp, Enterobacter cloacae
gcgactggcttaactttttctccacagggaaccatgatgaccgcactattgcggtgttgtggtaagggatacgctttttcggtgatcaatatggcaaatatcgttacgtgcaaaacaaaggacggcgaaacagtccagtatgttgacgaggtaattggttcgggctcgatgaaggatgtttacttttcgcctgataaatcatacgtcgtcgctttttatcataaaccgcagaacgagcaggcccgggatcggattgatatgatcaccggacgctacaggcaaaacatttttggccagtccggaggtgaatactggaaggacctgttttgctggccgacccatgttgttgagcatgggcataaaatcggcatcgtggttccaacctacaaaagctactttttctttaaatacggctctaaaaacgatgattttcttggcataaaaggtcgtgaaaaggaaggcaaatggtttgccagcgccagcaaccagaacaaatttctcgacccacgtgaacgaggcaatacgcttacctatctcaaggtctgtctgctgctgacaagagccgtcagaaggatgcatgcggcaggtctctgtcacagcgatctaagctataaaaacgtgcttatcgatccagaaatgggacatgcctgcatcattgacgtagacggcctggttgtccctggaaagtatcctcccgacgtggtgggcaccccggattttatcgctccggaagtggtgaaaaccagtcatctttccaaagaggatccgaaccgcgtattgccaagcattactactgaccgtcatgcgctgtcggtgcttatctacatgtatctgttcttccgtcatccgctacgtggcggaaaaatacatgacatgtcggatgaagtacgtgatgagaccttatctatgggtgagaaggcactcttcattgaacatccgacagacaaaagcaatgcagtcaaagtcagtcagctatcgtccttttcactgccctgggctgacccggagaaaattccttacaccatcatgggcccttatctgacacctttgtttgagcgcgcctttatagatggcttacacgatgccactaaacgcccgaccgccgatgagtgggaaagcgccctggttaaaacagtcgatctgatacagccctgccagaacaaggcgtgtgaacagaaatggtacgttttctcgggtaagacaaagccggtttgtccctactgcggtacgccatacaagggtaaattaccggttctaaatttatattcttcccgaaaggaaggcagttatcgtcctgacgaccaccggttgatggtgtggagcgggcagtcaatctatgcgtggcatgtgaatcgcctcattgcgccaaatgagcgcacaaccgatgcacaaaggaaacgagttgggtattttgttttccataacgatcagtggtggttagtaaatgaaggcataaataggcttatgtcattaccggataaacgacagattgccattggtgaaaaaattgaactgacgaataacgctcagtttgttctgtcaaaggaggaaggcggcaggctggtcgtcgttcagttagtagaaaactaa

SEQ ID NO: 2663 - DNA, 1026 bp, Enterobacter cloacae
tatgagatcatcatattcatccggagcgcatcccagagggacatcatgagccatcaactcaccttcgccgatagtgaattcagcactaagcgccgtcagacccgaaaagagattttcctctcccgcatggagcagattctgccatggcagaatatgaccgctgtcatcgagccgttttatcccaaggcgggcaatggccgacggccctatccgctggagaccatgctgcgtattcactgcatgcagcattggtacaacctgagcgacggtgccatggaagatgccctgtacgaaatcgcctccatgcgcctgtttgcccgattatccctggatagcgccctgccggatcgcaccaccatcatgaatttccgccacctgctcgagcagcatcaactggcccgtcaattgttcaagaccatcaatcgctggctggccgaagcaggcgtcattatgacccaaggcactttggtggatgccaccatcattgaggcacccagctctaccaagaacaaagagcagcaacgcgatccggagatgcatcagaccaagaaaggcaatcagtggcactttggcatgaaggcccacattggtgtcgatgccaagagtggcctgacccacagcctagtcaccaccgcggccaacgagcatgacctcaatcagctgggtaatctgcttcatggagaggagcaatttgtctcagccgatgccggctaccaaggagcgccacagcgcgaggagctggccgaggtggatgtggactggctgatcgccgagcgtcccggcaaggtaaaaaccttgaagcagcatccgcgcaagaacaaaacggccatcaacatcgaatacatgaaaaccagcatccgtgccaaggtggagcacccgtttcgcatcatcaagcggcagttcggcttcgtgaaagccagatacaaggggctgctgaaaaacgataaccaactggcgatgttattcaccctggccaacctgtttcgggtggaccaaatgatacgtcagtgggagagatctcagtaa

SEQ ID NO: 2664 - DNA, 1236 bp, Enterobacter cloacae
agactggttggtatattgccacccatcagatgtttatgcaactccagtgcgcgacgtccagtcgatgatactgccgggctgtgcaaatccctgccgggatactcctttttgttttttgtgaggtatacgatgagtaagcttttcaccccctacaatctgtctggcctggcgttaaaaaaccgtgtagtcatggcaccgatgacccgcacccgcaccatgaatgacgtgccggatgaggtcgtggctttgtactatgcacagcgtgcttctgctggcctgctcatcaccgaagggatgccggtttcagaagaaggccggggttacctttatacccctggtatctacaacgacgaacacgtccagggctggcgtaaggtgacacaagcggttcacgccaaaggtggctgtattttcgcgcagctctggcacgtcggccgtatgtctcacgtctctcttcagccaggccacatagcgccggtttcagcgggcaccgttcaggcggtcaataccaccgtttttgcgctgaccgaatccggagaaccgggcccggttgtaccaagccagccacgcgcgctggaaacgcatgaagttaaacgcatcactgcagacttcgtgcactccgcacgcctggcgatggaagccggctttgacggcgtggaaatcatggcggcaaacggattcatctttgaccagttcctcagtagcgaactgaacacccgcaccgacgaatacggcggctcggtggaaaatcgtcagcgtttcctgctggagaccattgacgccgtggcggaagctgtgggtaacagccacgttgccgtgcgcctgtcaccgttcggccgcatttatgacctcgcgccgtatgaaggtgaagagcaaacctggtcagccatcaccgacgcgctcggtcagcgggaactggcctacgtacacctttactatcagccggtgtacaccaaagcgccacttccggaaggcttccgccgccgttttcgcaacacgtttaaaggcaccatcatcgctgccggcggttttacccgtgatatcgcagagcaggctctggaagatgatgagctggatctggtggcatttggtgtgccctacatcgctaacccggatctggttgaaagaatgcaaaacggctggccactggcagaaagtgaccgcgccacctactacggcgtcagtggttccccggaaaaaggctataccgattacccggtctggcaggcgcaataa

SEQ ID NO: 2665 - DNA, 420 bp, Enterobacter cloacae; identical to SEQ ID NO: 227

SEQ ID NO: 2666 - DNA, 786 bp, Enterobacter cloacae
tggagtcagaaaatgaacacttttttcaaaggtaaaaaactgctcgtcgtcggcggtaccagcggcatgggcctggccgtggcacgcatggtactggaagcgggcggcagtgtcgtgctgaccgggaataaaaaagacaaagccgaagcggtgcaaaaagaactgagccctctgggaccggttgcggtcatcgcggcgaacctgatgaccgaagaaggtatggaaactatccgtcaggaaattaatgctcaccatcgcgatatcagcctgatggtgaatgccgccggtatcttcatgcccaaaggatttaccgagcacagctttgccgattatgacatgtatctttcgctgaaccgagccacgttctttattacacaggatgtcgtgaagaacatgctcgccgcgaagctcgaagggtctatcgtcaacgtcggttcgattggtgctcaggctgcactgggtgactcgccggcctcggcctattcaatggcaaaagcgggtctgcatgccctgacgcgtaatctggcgattgagctggccagcgcgggtattcgtgtcaacgcggtgtctcccgggattgttcatacgccgatatacgaaggcttcatggacaaagcggatatcgcagatgctatgaagtcgctgagcgatttccacccgctgggacgcgtcggaactgccgaagatgtggcaaacactattctcttcctgttgtctgacaaaacctcatgggtgacgggcgctatctgggatgtcgatgcgggcatcatggcggtcagacgataa

SEQ ID NO: 2667 - DNA, 300 bp, Enterobacter cloacae
gctgtgggtcaggccactcttggcatcgacaccaatgtgggccttcatgccaaagtgccactgattgcctttcttggtctgatgcatctccggatcgcgttgctgctctttgttcttggtagagctgggtgcctcaatgatggtggcatccaccaaagtgccttgggtcataatgacgcctgcttcggccagccagcgattgatggtcttgaacaattgacgggccagttgatgctgctcgagcaggtggcggaaattcatgatggtggtgcgatccggcagggcgctatccagggataa

SEQ ID NO: 2668 - DNA, 384 bp, Enterobacter cloacae
tcgggcaaacaggcgcatggaggcgatttcgtacagggcatcttccatggcaccgtcgctcaggttgtaccaatgctgcatgcagtgaatacgcagcatggtctccagcggatagggccgtcggccattgcccgccttgggataaaacggctcgatgacagcggtcatattctgccatggcagaatctgctccatgcgggagaggaaaatctcttttcgggtctgacggcgcttagtgctgaattcactatcggcgaaggtgagttgatggctcatgatgtccctctgggatgcgctccggatgaatatgatgatctcatatcaggaacttgttcgcaccttcccttgtacaggcatcactcctttttgcacatgactcattaa

SEQ ID NO: 2669 - DNA, 711 bp, Enterobacter cloacae
ggaatcattatgcaaacgctgaaacccacccttaccatcgatatctggtcagatttggtctgcccgtggtgctggattgctaaaaaaagatttgaacagggtctgaatcgctttgaatttcgcgaccaggtggtgatccgccatcacagctaccgtctggccggtggtactcccgcgatgccttttaaggatgccatcgttaaaaagctgggcagtcagcattcagcggagctgatgatgaatcaggtgggcaccgccggtaaatctgaatgtctgatctacaacttcgacggcatgatgtttggtgatacagaagatgcacacaccctgctggttgccgcgcgtaaggccggaattgcggacgcggtggaagaacgtttttatcatggcagtatcaccgaaggtcgctctctctttgaccgtcagcagctcgttgccatggccgtagaagccggtatgccgaaagctgacgctgaagccgccctggaaaatgacgattttcgcgccaccgtttccgacgatgaagcccacgcacagtctattggcctcagcggcgttccggtttttgtgatgaacgaaaaatatgccatcagcggggctcaggcagcagataactttttgaatgccctgcgtcaggtctgggatgaacagcaaaccgaattttcagccactgcgggtcagacctgcggaacggatggctgcagtatttaa

SEQ ID NO: 2670 - DNA, 483 bp, Enterobacter cloacae
acccgccgctccagcctgccgcgaggccatgacatgcgaggtgactgtcggcggtgccagcctgcgtctgtccggggatttatcacctgcacttctgaaaacgctgatccgcgagctgaccgggaggagccgatgatacccttaccgtcaggcactcgtatctggctggttgccggggtcaccgatatgcgtaagtccttcaatggtctgggcgaactggtccagcatgttcttgatgacaatccgttctccggccacctgtttatcttccgtggtcgtaaaggtgacaccgtgaggatcctctgggctgatgctgacggtctgtgtctgtttaccaaacgtctggaagagggacagttcgtctggcctgctgtacgcgacggcaaaatcgccatcacccgctcacaactcgccatgctcctcgataagctggactggcggcaacctaaaactgcacgccttaactcactgacgatgttgtaa

SEQ ID NO: 2671 - DNA, 1623 bp, Enterobacter cloacae
aaagcgcatgaccgcattataaatggggtcatgagtcaggactatctcgcccgtatcgctgcgctggaagacgcgcttcgccagaaagacagccagctcagtctcgttgctgagactgagtcgttcctgcgttcggcgctggcccgcgcagaagagaaaatagagaacgaagagcgtgaaatagaatatctgcgggctcagatagaaaaactgcgccgaatgctgttcggtacccgttcagaaaagctacgccggcaggtcgaagaagccgaagccctgctgaaacagcaggagcagcaaagcgatcgttacaacggccgggacaatgatcagcaggttccgcgtcagttgcgccagtcccgtcatcgtcgcccgttaccggaacatcttccccgcgaaataaacagactggagccagctgaaaccagctgtcctggttgcggtagtgatatggcctatctcagcgaagtcagcgcggagcaactggagctggtctccagcgccctgaaagtgatccgcacggtcagagtgaaaaaggcctgtacccgatgcgactgcgtcgttgaagcgccagcgccctcacgtcctatcgaccggggcatcgccgggccgggtctgctggcccgcgtgttaacggccaaatactgtgaacacctgccgctgtatcgccagtgcgaaatctttgcccgtcagggtgtggatctgagtcgtgcgctgctctccaactgggtggatgcgtgctgccggttaatggccccgctggatgaagccctctaccactacgtgatggactgccgcaaactgcatacggatgacactccggtgcccgtgctggcgccgggcagaaagaagacgaaaaccgggcgtatctggacatatgtccgtgataacagaagcgcgggttcatcagatccgccagcggcatggttcgccttctcaccggaccgacaggggaaacaccctcagcaacatcttcggcactatcatggcgtgctgcaggcagatgccttcgcagggtacgacaggttgttcagcgcagagcgtgaaggtggcccgttgacagaagcggcatgctgggctcatgcgcggcgcaaaatccatgacgtctatatcagcacccggacggccacagcagaggaggctctgaagcgcatcagtgagttatacgcgatagaagaggaaatacgcggccttccggcatctcagcggctggccgccagacggtcccgaagtaaaccgttgctgatatccctgcatgactggttggtggagaaaagagccactctgtcgaaaaaatcccggttaggcgaggcgttcgcttatgcactgaaccagtgggatgccctgtgttactactgcgatgatggtctggcagagccggataataacgctgctgagcgcgcgctacgagcggtctgtctgggcaagaaaaactacatcttcttcggcagtgatcatggtggtgaacgtggtgccctgctgtatggtctgatcggaacgtgcaggctgaacggtatcgatccagagggttaccttcgccatatcctgagcgtattgccggagtggcccatcaacaaagtggccgaactgctgccatggaacgtagatctcaccaataaatag

SEQ ID NO: 2672 - DNA, 828 bp, Enterobacter cloacae
acaatgcagcagttacagaacgttattgagtccgcttttgagcgtcgcgccgacatcactccggcaaatgtggataccgtgacccgtgaagcggtaaaccaggttatttccctgctggattccggcgcgctgcgcgtggcagaaaaaatcgacggtcagtgggttactcatcaatggctgaagaaagctgtgctgctctctttccgcatcaacgataaccaggttatcgacggagcagaaagccgctacttcgataaagtgccaatgaaatttgcggattacgacgaagcgcgcttccagaaagagggcttccgcgtagtaccaccggcagccgttcgtcagggggcattcatcgcacgcaacaccgtgctgatgccatcctacgtgaacatcggcgcctacgttgacgaaggcaccatggtggacacctgggctaccgtcggctcctgcgcgcagatcggtaaaaacgttcacctgtccggcggcgtgggcatcggtggcgttcttgagccacttcaggctaacccaaccatcatcgaagacaactgcttcatcggcgcacgttccgaagtggttgaaggcgtgatcgtcgaagaaggttctgtgatctccatgggcgtgtacattggccagagcacccgtatttacgatcgcgaaaccggtgaaattcactacggccgcgttccagccggttccgttgtggtttccggcaacctgccgtctaaagatggcaaatacagcctgtattgcgcggtcatcgtgaaaaaagtggacgcgaaaacgcgcggtaaagtaggcatcaatgaactgctgcgcaccatcgattaa

SEQ ID NO: 2673 - DNA, 423 bp, Enterobacter cloacae
ttattcataggttatgttgagatcaagggtaccgctatgtacgataatctgaaaagtctgggcattaccaatcctgatgaaattgatcgttatagtcttcgccaggaagccaataacgatattttgaaaatctattttcacaaggacaaaggagagttcttcgccaaaagcgtgaagtttaaataccctcgccagcgtaagaccgttgtcgctgacggtatcggtcagggatataaagaagtacaggaaatcagccctaacctgcgctacgtgatcgacgaactcgatcaaatctgccagcgcgatcgcagcgaagtcgatctgaaacgtaagatccttgacgacctgcgtcacctggaaagcgtagtcaccaataagatcagcgagattgaagcggatcttgagaaattgacgcggaaataa

SEQ ID NO: 2674 - DNA, 2742 bp, Enterobacter cloacae
gtgataagaagccggcgaatgccggcttttttaatggcgatagctttttcttatgggtggcgcacgatgagtaatctcttacccgaacagtatgctaacacagcacttcccaccctccccgaccagcctgataacccgggcgtctggccaccgcatgaactgacctgcgcgcatatcaaagcccacatggaggttttccatcgctggctgggaagcgcatttgacgcaggcgtttcggccgagcagctcattgaagcgcgcaccgaatttatcgaccagctcctgcaacgtctctggatcgactacggtttcggacaggtgagcgacgtcgcgctggttgctgttggcggctatggccggggtgaactgcatccgctctctgatatcgacctgctgatcttaagccgtaaaaaactgccggacgatcgggcgcagaaaatcggtgaactgttgaccctgctctgggacgtaaagctggaagtgggccacagcgtacgcacgctggaagagtgtctgctggaagggttatctgacctgaccgtcgccaccaacctgattgaaacccgcctcctgattggcgacgtggcgctgttcctcgaactgcaaaagcacatctttagcgacggcttctggccttcggaaaaattcttcgccgcgaaagtcgaagaacaaaaccagcgccaccagcgctatcacggtaccagctataatctcgaaccggatattaaaagcagccccggtggcctgcgcgatatccacacgctgcaatgggtcgcccgtcgccattttggggcaacatcgctggacgaaatggtcgggtttggttttctgaccgaagctgaacgtaacgaactcaatgagtgtctgcatctgctgtggcgcatccgttttgccctgcacctggaagtcacccgctacgataaccgcctgctgtttgaccgacagctcagcgtggcgcagcgcctgaattaccagggcgagggcaacgagccggtcgagcaaatgatgaaggatttcttccgcgtcacccgccgcgtctctgagctgaaccagatgctgttacagctgttcgatgaggcgatcctcgcgctgacggcagacgaaaaaccgcgtccgattgatgacgaatttcagctgcgcggcacgctgatcgatctgcgcgacgaaacgctgttcattcgcgaaccggaagcgatcctgcgaatgttctataccatggtgcgcaacagcacgatcaccgggatctactccactaccctgcgtcatctgcgccatgcacggcgtcatctgaagcagccgctgtgttacatcccggaggcgcgctcgttgttcctgaggatgcttcgtcatccgggcgccgtcagccgcggactgctgccaatgcaccgtcacagcgtgctgtgggcctatatgcctcagtggtcgcatattgtcgggcagatgcagttcgacctgtttcacgcctatacggtggatgagcacacgatccgcgtcatgctgaagctggaaagtttcgctaaagaagagacgcgatcccgccatccgctgtgcgttgatctgtggccacgtctggcacacccggagctgatcctgatcgctgctctgttccatgatatcgccaaaggtcgcggcggcgaccactccgtactcggtgcccaggacgtgctgaaatttgccgagctgcacggcctgaactcgcgtgaaacgcagcttatcgcctggctggttcgccatcatctgctgatgtcggttaccgctcagcgtcgtgatattcaggatccggaagtgatcaagcagttcgccgaggaagtgcaaacggagaatcgcctgcgctacctggtctgcctgacggtagccgatatctgcgccaccaacgaaaccctgtggaacagctggaagcagagcctgctgcgcgagctgtacttcgccaccgaaaaacagctgcgtcgcgggatgcagaataccccggacatgcgcgagcgtgtgcgccatcaccagttgcaagcgctggccctgctgcgcatggataacatcaacgaagaggcgctgcatcagatttgggcgcgctgtcgcgccaactactttgtacgccacagcccaaaccagcttgcctggcacgtccggcatctgctgaagcacgacctgacgaaaccgatgattctgcttagcccgcaggccacacgcggcgggacggagatctttatctggagcccggaccggccttatttgtttgcagcggtctgtgccgagctggacaggcgtaacctgagcgttcacgacgcgcagatttttaccacccgcgacggcatggcgatggacacctttattgtgctggagccggacggcagcccgctatcgtcggacaggcatgaggggatacgctttggccttgagcaggcgattacgcagcgcagctggcaacctccgcagccgcgccgtcaggcggcaaaactgcgccactttaccgtcgataccgaggtcaatttcctgccgacccataccgaccgtaaatcgttccttgagctgattgcgctcgaccagccagggctactcgcccgcgtcggccaggtttttgccgatctgggaatttcgcttcacggcgcccgaattacaacgattggcgaacgagtagaagatttatttataatcgcgacggccgaccggcgtgcccttaataatgacctgcaacttgaagtgcaacaacggttgacagcagccctcaatccaaacgataaagggtga

SEQ ID NO: 2675 - DNA, 747 bp, Enterobacter cloacae
ccgcatgatagactatgcatcttaacaaggcacatcgcgagtaaatctatgaaaatcggcattattggtgcaatggaagaagaagttacgctgctgcgtgacaaaattgagaaccgtcagaccctctccctcggtggctgtgagatctacaccggccagctgaacggtgttgacgtggctctgctgaaatcaggcatcggtaaagttgcagcggcactgggcgcgaccctgctgcttgagcgctgcaagcctgacgttatcattaatacaggttctgcgggcggtctggcgccgacgctgaaagtgggcgatattgtggtttccgacgaagcgcgttaccacgatgcagacgtcaccgcattcggctacgaatatggtcagcttccgggctgcccggccgggtttaaagcggatgataagctgattgccgccgctgaaagctgcatcaacgagctgaacctcaatgcggtgcgtggcctgatcgtcagcggcgatgcctttatcaacggctctgttggtctggcgaaaatccgtcataacttcccgcaggctgtggccgttgagatggaagccacggccattgcgcacgtgtgccataacttcagcgtgccgttcgtggtcgttcgcgcgatctctgacgtagcggaccagcagtcccacatcagcttcgacgagttcctggccgttgcggccaagcagtccaccgtgatggtggaaaccctggtgcagaaactggcgcgtgggtaa

SEQ ID NO: 2676 - DNA, 723 bp, Enterobacter cloacae
acgcgccagcccgcgtattatcctcgccgcaaaacaactctgcgccgaactggcagagagtcactcaaacagataaatacccccttcgaggatttaacgatgctcgtgtattggctggatattcttggcacagccgtttttgctatctccggcgttttgcttgccggaaaactacgcatggatccttttggcgtactggtgctcggcgtcgttacggcggtgggaggcggaacgatccgcgatatggcgctggcaaatggcccggtattttgggtaaaagatcccacggatctggtggtggcgatggtcacctgcctgttaaccatcgtgctggttcgtcagcctcgcagactgccaaaatggatattaccggtgctggatgccgtcggtctggcggtctttgtgggaataggcgtgaataaagcctttattgccgggactggcccgctggtggcgatctgtatgggcgtgttaaccggcgtgggcggagggattattcgcgacatactggcgcgagaagtcccgatgatcctgcgaacggaaatctacgcgacggcctgtatcatcggggggatcgttcacgccacggcgtattacacctttgctgtcccgctggagaatgcggcgatgctggggatggtggtcacgctggtgatccgtttagcggcgatacgctggcacctgaagctgccgacctttgcgctggatgaaaattcaagatag

SEQ ID NO: 2677 - DNA, 831 bp, Enterobacter cloacae
tattgtcgaaaaaatcgacaccgatggacagattacatggctatctctattaagacacctgaagaaattgaaaagatgcgcgtcgccggtcgtctggccgcggacgtgctggaaatgattgagccgtttgtgaaaccgggcgtcagcactggcgaactggatcgcatctgtaacgactatatcgtcaacgagcagcacgcgatctccgcctgccttggctatcacggtttcccgaaatccgtctgcatctctattaatgaagtggtttgccacggcattccggatgacgagaagctgctgaaagatggcgacattgtcaacatcgacgtgaccgtcatcaaagacgactaccacggcgacacctctaagatgttcatcgttggcaagccaacgattctgggcgagcgtctgtgcaaagtaacgcaagagagcctctacctggcgctgaaaatggtgaagccgggtattcgcctgcgtactatcggcgccgcaattcagaaatttgtggaagcggaagggttctccgtggtgcgcgaatactgcggtcacggtattggccgcgtcttccatgaagagccgcaggttctgcactacgatgcagacgacggcggcgttgtgctgcaaaagggcatgaccttcaccatcgagccaatggtcaacgccggtgactaccgcatccgcaccatgaaagacggctggacggtgaaaaccaaagacagaagcttgtctgcccagtacgagcatactattgtggtaacagacaacggctgcgaaattatgacgttgcgcaaggatgacaccatcccggcgatactgacgaacattgagtga

SEQ ID NO: 2678 - DNA, 840 bp, Enterobacter cloacae
tggtggaaaccctggtgcagaaactggcgcgtgggtaaggtgtcattcagggcgctggtcgccctgcttctgttcgctccggcctggctcatcgccgcgccgcgggtgatcactctctcccctgccaatacggaactggcttttgccgccgggatcacgcccgttgcggtgagcagcttttccgattatccaccgcaggccgcccaaatcgaacaggttgccacctggcagggaatgaatctggaacgcatcgttgcgctaaagcccgatctggtactcgcctggcgcggcggtaatgccgaacggcaggtaaaccagctctcttcgctgggaataacggttaaatgggtggacgcggtgagcatcgaacaggtgtcgcaaaccctccgtgacctcgcgcccttcagccctaccccccaacgcgccggacaggctgcacagcagatgctcaacgactatgccgcgctaaaagcccgatacggcacgcaaccgaaacaacgcgtttttctgcaatttggcagccagccgctgttcactaccgggaaaggttcgatccagaaccaggtgcttgaaacctgtggaggtgaaaatatctttgccgaaagccgggtcccctggccccaggtcagtcgtgagcaggttctggcgcgacaaccgcaggccattgtggtggtcggaaatgcgagcgagattcctaaaatagaacaattctggcatcggcagcttaaaattccggtcatcgcactcaacagcgactggtttgaacgcgccagcccgcgtattatcctcgccgcaaaacaactctgcgccgaactggcagagagtcactcaaacagataa

SEQ ID NO: 2679 - DNA, 360 bp, Enterobacter cloacae
ttctcttccggcgcaccgggcggcatatttgccccgatgctggcgctgggaacgctgctgggcacggcgtttggcatggcggcagcggttggcttcccggcctatcatctggacgcggggacgtttgcggtggcgggaatgggggcgctgctggcggcctccctgcgcgcgccgcttaccgggatcgtactggtgctggaaatgaccgacaattaccagctcattttgccaatgatcattacctgtctcggcgcgacattattagcccaattcctgggtggaaaaccgctatactccaccattcttgcccgtaccttggcgaaacaggaagctgaacaggccctgaagcagaatacttga

SEQ ID NO: 2680 - DNA, 1545 bp, Enterobacter cloacae
ggggaaacgcattctcacgcgggggagcacatggcaccaatcgattttcgcaccaaaattaactggcaccgacgtttccgttcgccacagggcgataagagcgaacatgagatcctgcgcatttttgaaagcgatcgcggacgcatcatcaattcgcccgccatccgccggttacagcaaaaaacccaggtgttcccgctggagcgtaacgccgcggtgcgtacgcggttaacgcactccatggaagtgcagcaggtggggcgctacattgcgaaagagatcctcagccgccttaaagagcaacgtctgctggaaacctacggactggatgaactcaccggcccgttcgaaagcatcgttgagatggcctgcctgatgcacgatatcggcaatcctccctttggtcatttcggcgaggccgccatcaatgactggtttaaacagcggctttttccctctgatgccataagccagccgctcagcgatgaccgctgtgtggtacgcgatttaagcctgcgtgaaggtgaagatagcctgaacgatctgcgccgtaaggtgcgccaggatctgtgtcatttcgaaggtaacgcgcaggggatccgtttggtgcactccctgatgcgcatgaatctgacctgggcccaggtgggctgtattcttaaatacacgcgtcccgcgtggtggaccggagaaacgcccgccacgcatagctacctgatgaaaaaaccgggctattacttatcggaagaagcatatatcgcgcggttgcgtaaagaactgtctctgacccccaatggccgttttccattgacatggattatggaagcggctgatgacatttcttattgcgtggccgatctggaagacgcggtggaaaaaagaatattcagcgtcgaggagctgtatcagcatcttcatgatgcctggggagagcatgaaaaaggttctctgtttgcgcaggtcgtcgagaatgcctgggataaatcgcgttcaaattcgctgagccgcagtaccgaagatcagttctttatgtatttgcgagtaaacacgctgaataaactggtgccgtatgcagccgcccgtttcattgataatttgccgatgatatttagcggggaatttaatcacgccctgctggaagatgagagcagttttagccagcttcttgaattatataaaaacgtggctgtccgccatgttttcagccacccggatgtcgagcagctggagctgcaaggataccgggttatcagcgggttgctggagatttatggcccgctgctccagctgacggtcgatgagttttgcgagctggtcgaaaatgaacgtgttcgccgcctgccgattgaatctcgtctctatcagaagctttcaacccgtcaccggctggcatacattgaggccgtcagtaaaatagatcgtcattcttcccaatggccagtcatggaatattattatcgctgtcgtcttatccaggactatatcagcgggatgacagatttgtatgcctgggatgaataccgcaagcttatggccgttgaataa

SEQ ID NO: 2681 - DNA, 1491 bp, Enterobacter cloacae
aacgaatctgagttacacagcaattttgcgttatctggtaaatcgagattgagaaacatgaaaaaaaccacattagcaatgagtgcactggctctgagtttaggtttagcgctgtcccctctggcgacggcggccgagacagcttcctcggcagcgactgcgcagcagatgccaagcctggccccgatgctcgaaaaagtgatgccatcggtggtgagtattaacgttgagggcagcacaaccgtcaatacgccgcgtatgccgcgtaatttccagcagttcttcggcgacaattcgccattctgccaggacggttcgccattccagagctccccgttctgtcagggcggcggtgcaggggatgacggcatgggcggcggccagcagcagaaattcatggcactcggctcgggcgtgattattgatgcagccaaaggctacgtggtaaccaataaccacgtggtggataatgctaacaccattaaggtgcagatgagcgatggccgtaaattcgatgccaaagtggtcggtaaagacccgcgctccgatatcgcgctgattcaaatccaggatccgaagaacctgacggcgattaagcttgccgactctgacgcgctgcgcgtgggtgactacaccgtcgccatcggtaacccgtttggtctgggcgaaaccgtgacctcgggtatcgtctcggcgctgggacgtatcggcctgaatgcggaaaactatgaaaacttcatccagacggatgcggccattaaccgtggtaattccggcggtgcgctggttaacctgaatggtgaactgatcggtatcaacaccgctatcctggcaccggacggtggcaacatcggtatcggctttgctatcccgagcaacatggtgaaaaacctgactgcgcagatggtgcaatatggacaggtgaaacgcggtgagctgggtatcatgggtaccgagctgaactccgagctggcgaaagcgatgaaagtagacgctcagcgcggcgcattcgtaagccaggtcatgccgaactcctcggcggcgaaagccggcattaaagcgggtgacgtgatcacctctctgaacggtaaaccgatcagcagctttgccgccctgcgtgcggaagtgggttctatgccaatcggcagtaaagtgaccctcggcctgctgcgtgaaggtaagccggttaacgtgagcctggaactgcaacagagcagtcagaatcaggtggattccagcaccatcttcagcggtattgaaggtgctgagatgagcaacaaaggggcagataaaggcgtggtggtgaacaacgtgaaagcgaactcacctgctgcccgtatcggcctgaaaaaaggtgatgtgatcatgggcgctaaccagcagccggtgaaaaacatcgctgaactgcgcaaaattctcgacagcaagccgtccgtgctggcactgaatattcagcgtggtgatacttctatttatctcctgatgcagtaa

SEQ ID NO: 2682 - DNA, 648 bp, Enterobacter cloacae
cagtctcaggaaagaaacatggctaccaatgcaaaacccgtgtacaaacgcattctgcttaagctgagtggcgaagcgctgcaaggatcggaaggcttcggtattgacgcaagcatccttgatcgcatggcacaggaaatcaaagaactggtcgaactgggtattcaggttggcgtggtcattggcggtggcaaccttttccgtggtgctggtctggcgaaagcggggatgaaccgcgtagtgggcgaccacatgggtatgctggcaaccgtgatgaatggcctggcgatgcgtgatgcgcttcatcgcgcctatgtgaacgctcgcctgatgtccgctaatcctttgaatggcgtatgcgataactacagctgggcagaggccatcagcctgctgcgcaacaaccgcgtggtgatcctctccgccggtacgggtaacccgttctttaccaccgattccgcagcctgcctggcgcggtatcgaaatcgaagccgatgtggtgctgaaagcgaccaaagtagatggcgtgtttactgccgacccggcaaaagatccttcagcgaccatgtacgatcagctgagctacagcgaagtgctggaaaaagagctaaaagtgatggatcttgccgcctttacgctggctcgtga

SEQ ID NO: 2683 - DNA, 582 bp, Enterobacter cloacae
gacaagttttcaaggatccgtaacgtgattaacgacatcagaaaagatgctgaagtacgcatggacaaatgcgtagaagcgttcaaaaaccaaatcagcaaaatccgtactggccgagcttccccaagcctgctggatggcatcatcgtagaatactacggtacgcctacgccactgcgtcagctggcgagcgtgacggtagaagatacccgtaccctgaaaatcaacgtgttcgatcgctcaatgagcccggccgttgaaaaagcgatcatggcatctgacctgggtctgaacccaagctcagcgggcgcggatattcgcgtaccactgcctccgctgacggaagagcgtcgtaaagacctgatcaaagtggttcgcggtgaagctgagcagggtcgcgtttccgtacgtaacgtgcgtcgcgatgcgaacgataaagtgaaagccctgctgaaagaaaaagagatcagcgaagatgacgatcgtcgttcacaggacgacattcagaaaatgaccgacgcggccatcaagaaaattgatgcggcgctggcagaaaaagaagcggaactgatgcagttctga

SEQ ID NO: 2684 - DNA, 1428 bp, Enterobacter cloacae
cagccttaccgcggctgttcctgtatttgcttgcctgcttttactggtgtttgggacgatataacggaaggttttatgctgagcattctctggaatctggcggcgttcattgttgcactgggtgtactgattaccgtgcatgaatttggccatttctgggttgcccggcgctgtggtgtgcgggtggagcgattctcgattggctttggcaaatcgctctggaagcgtaccgataagcatggcaccgagtttgtcattgctctgattcccctgggcggctatgtcaaaatgctcgacgaacgcgttgagcctgtcgccccggaacttcgccatcgcgcgtttaacaataaaactgttggacaacgtgctgccatcatcgctgccggcccggtagccaatttcatcttcgctatcttcgcctactggctggtgtttatcatcggcgtgcctggcgtgcgcccggtcgtgggcgaaatcaccacgggttctattgcggcaacggcgcaaattacaccgggaatggaacttaaagcgattgatggtatcgaaacccctgattgggatgccgtgaggttacaactggttgccaaaatcggtgatgagcagacaaccgtcagcgtatcgccatttggttccgaccagcggcaggaaaaagtgctggatttacgccactggcgctttgagccagacaaagaggaccctgtcgccgcactcgggattcgaccgcgcggcgcgcagatcgagccggtattagccgaagtacaggccaaatcggcagcgagtaaagcaggtttacaagcgggtgacaggatcgttaaagtcgatggtcagccattaacacaatggatgacctttgttactctggtgcgcgataatccaggcaagccgctcgcgctggaagtggaaaggcaggggagttcgctctcactgactctcaccccggataccaaatcgggcggcggtaaggcggaagggtttgccggcgttgtgccgaaagtgatcccactgccagatgagtacaagacaatacgccagtatgggccgtttagcgccatcgttgaggccacggataaaacatggcagctgatgaagcttacggtcaacatgttggggaaattgataaccggtgatgtgaaactgaacaacctcagtgggccaatttcgattgctcagggggctgggatgtcagcggagttcggggtgatttactatctcatgttccttgcgctgattagcgtgaacctggggataatcaacctgttcccgcttcccgtactagatgggggccatttgctgtttttagcgattgaaaagctaaaaggcggaccggtatccgagcgagttcaagactttagttatcgcattggctcgattttgctggtgctgttaatggggcttgcacttttcaatgatttctctcggttgtaa

SEQ ID NO: 2685 - DNA, 585 bp, Enterobacter cloacae
gcgcaaaatcgatcaacaagactaagcgttcatccgtttaacgctaaatttcccggcctgtcggctttgtttataaaccggcaggccgtgttattattgctacttagtacatttgacaggaagagtattttgactacttacactcatactctgcatattgaagagattttagaacttctgccgcaccgctatccgtttttactggtagaccgtgtgctggattttgaagaaggtcgttttctgcgcgcagtgaaaaatgtctccgttaacgagccgttcttccaggggcacttccctggtaagcctatcttcccgggggtattgatcctggaagcgatggcacaggctaccggtattctggcgtttaaaagcgtaggtaaactggaaccgggtgaactctattacttcgcgggtatcgatgaagcgcgcttcaagcgtccggtcgtgcctggtgatcaaatgatcatggaagtcacttttgaaaaaacgcgtcgcggcctgactcgcttcaaaggcgtagctatggttgacggcaaagttgtttgcgaagcgacaatgatgtgtgcgcgtagccgggaggcctga

SEQ ID NO: 2686 - DNA, 792 bp, Enterobacter cloacae
tacgtgattgataaatccgcctttattcatcctaccgccattgtggaaacgggtgccatcattggtgccaatgtccacatcggcccgttttgtattgttggaccccatgtcgaaattggtgagggtacagtactgaaatctcacgttgtcgtgaatggtcataccaccattggctgcaacaatgagatctatcagttcgcctccatcggcgaagttaaccaggatcttaagtatgctggcgaaccgacccgcgtggaaatcggcgatcgtaaccgcattcgcgaaagcgtcaccattcatcgtggtacaacgcaaggcggtggattgacgaaggtgggcagcgacaacctgtttatggttaatgcgcacattgcgcacgactgtaccgtgggtagccgctgtattctcgccaacaacgcaacgctggcgggacacgtatcggtcgatgatttcgccattattggcggcatgaccgcagtccatcagttctgcatcattggtgcacacgtgatggtcggcggatgctccggtgtggcgcaggacgtcccaccgtttgtgattgcgcagggcaaccatgccacgccgtttggcgtgaacattgaaggtctcaagcgtcgtggcttcagccgcgaagcgattaccgcgatccgcaacgcgtacaaattgctgtaccgtagcggtaaaacgctggaagaggctaagccggaaattgccgagctggcgaataagcaccctgaagtgaaaacgttcatggaattctttgaacgttcaacccgtggtctgattcgttaa

SEQ ID NO: 2687 - DNA, 3501 bp, Enterobacter cloacae
gtaacgcgggatttgaagatggctgaaccacgtttcgtacacctgcgggtgcatagcgactactccatgatcgatgggctggcaaagaccgggccgctggtaaaaaaggcggcctcgcttggcatgcctgcgctggcgatcaccgattttaccaacctgtgtggcctggtgaagttctacggaacggcgcatggcgcaggattaaagcccatcgtcggtgcggattttcatgtgcagagcgacctgctcggcgatgagatgacgcaaatttccgtgttagccatgaataacacgggctatcagaacctcactctgctgatctcaaaagcctaccagcgcggctacggcgcactgggcccatggattgaccgcgactggctggcagagctgaacgaaggtttgctgctgatctccggtggtcgtatgggggatgtcggcaaatgtctgctgcgcggtaacaacgcgctggtggatcagtgcgtctcgttctacgaagagtatttcccggatcgctattacctggagctgatccgtaccgggcgtgcggacgaagagagctatctgcatgcggccgtcgccctggcggaagcgcgtggcctgcctgtagtggccaccaacgatgtgcgcttccttgaggcgggcgattttgacgcgcatgaaattcgcgtcgctatccacgacggcttcaccctcgacgatccgaaacgcccgcgcaactactcatcgcagcaatacatgcgcagcgaagaggagatgtgtgagcttttctcggacatcccggaagcgctggaaaacagcgtagagattgccaagcgctgtaacgtcaccgtgcgtctcggcgaatacttcctgccgcagttcccgacgggcgacatgaccaccgaagatttcctggtcatgaaatcgaaagagggtctggaagagcgtctggaattccttttcccggatgaagcggtccgtaaagagaagcgtcctgaatatgacgagcgcctggatattgaactccaggtgatcaaccagatggggttccctggctacttcctgatcgtgatggagttcatccagtggtcgaaggataacggcgtgccggtaggcccgggccgtggttccggtgccggctcgctggtggcgtacgcactgaaaatcaccgacctcgatccgttggaattcgacctgctgttcgaacgtttcctcaacccggaacgtgtctccatgcccgactttgacgtcgacttctgcatggaaaaacgcgaccaggtgattgagcacgtggccgatatgtacggtcgtgatgcggtttcacagatcattaccttcgggacgatggcggcgaaagcggttatccgcgacgtgggccgcgttctgggccacccgtacggttttgtcgatcgtatctctaagctggtcccgcccgatccgggcatgaccctggcgaaagcctttgaagccgaacctcagctgccggaaatctacgaagccgacgaagaggtgaaagcgctgatcgacatggcgcgcaagctggaaggcgtcacgcgtaacgccggtaagcatgcggggggcgtggttatcgccccgaccaaaatcaccgacttcgcgccgctgtactgcgatgaagcgggccagcatccggtcacccagttcgacaagaacgacgtggaatacgccgggctggtgaagtttgacttcctcggcctgcgtacgctcaccatcatcaactgggcgctggagatgatcaacgcccgtcgcgagaagaacggcgaaccgccgctggatatcgcggctatcccgcttgatgacaagaaaagtttcgacatgctgcaacgctcggagacgacagccgtcttccagcttgaatcccgcggcatgaaagatttgattaagcgtctgcaacccgactgcttcgaagatatgatcgcgctggtggccctgttccgtccggggccgttgcagtcggggatggtggataactttatcgaccgtaagcacgggcgcgaagaaatttcctacccggacgttcagtggcagcatgaaagcctgaaaccggtactggagccaacctatggcatcatcctgtatcaggaacaggtgatgcagatcgcccaggtactttcgggttatacccttggcggcgcagacatgctgcgtcgtgcgatgggtaagaaaaagccggaagagatggccaagcagcgctccatctttgaagatggagcgaagaaaaacggcatcgatggcgaactggcgatgaaaatcttcgacctggtggagaaattcgccgggtacggatttaacaaatctcactccgccgcctatgctttggtttcgtatcagacgctgtggctgaaagctcactatcccgctgagtttatggcagcggtaatgactgccgatatggacaacaccgagaaggtggttggcctggtggacgagtgctggcgcatggggctgaagatcctgccgccggatattaactcgggcctgtatcattttcacgttaacgatgacggggaaatcgtctatgggatcggcgcgatcaagggcgtgggtgaggggccgatcgaggcgatcattgaagcgcgtaacaacggcggctacttccgtgagctgttcgatctgtgcgcccgtaccgataccaaaaaactgaaccgccgcgtgctggaaaaactgatcatgtccggcgcgtttgaccgtctggggccacaccgcgccgcgctgatgaactcgctcggcgatgcgctgaaggcggccgatcagcatgcgaaagcggaagccattggccaggcggatatgttcggcgtgctggcggaagagccagagcagatcgagcagtcctattccaactgccagccgtggccagaacaggtagtgctggatggagagcgggaaacgttaggtctgtacctgacgggacacccgatcaaccagtatcttaaagaaattgagcgctatgtcggcggccacaggcttaaagacatgcatccgacagaacgtggtaaaatcaccacggctgcggggctcgtgattgctgcaagggtaatggtcaccaagcgcggcaatcgtatcggcatctgtaccctggatgaccgttccgggcgtctggaggtgatgttgttcaccgacgcgctggataaataccagcaattgctggaaaaagaccgcatacttatcgtcagcggacaggtcagctttgatgacttcagcggggggcttaaaatgaccgcccgcgaagtgatggacattgacgaagcccgggaaaaatatgctcgcgggcttgctatctcgctgacggacaggcaaattgatgaccagcttttaaaccgactccgtcagtctctggaaccccaccgctcggggaccattccagtacatctctactatcagagggcggatgcacgcgcgcggttgcgctttggtgcaacgtggcgtgtctctccgagcgatcgtttactgaacgatctccgtggcctcattggttcggagcaggtggaactggagtttgactaa

SEQ ID NO: 2688 - DNA, 972 bp, Enterobacter cloacae
tacaggaatactatgagtctgaatttccttgatttcgaacagccgattgcagagctggaagcgaaaatcgattctctgacagccgtgagccgtcaggatgaaaaactggatattaacatcgacgaagaagtgcatcgtctgcgcgaaaaaagcgtagaactgacgcgcaaaatctttgccgatctcggcgcatggcagatcgcccagctggcgcgacatccacagcgtccgtacaccctggattatgtccgcctggcgtttgacgaatttgacgaactggcaggcgaccgcgcatacgctgacgataaagctatcgtcggcggtatcgcgcgtctggatggacgtccggtgatgatcattggtcatcagaaaggccgtgaaaccaaagagaaaatccgtcgtaacttcggtatgccagctccagaaggctaccgtaaggccctgcgtctgatggagatggctgagcgtttcaatatgccaatcatcaccttcatcgacacgccgggtgcttacccgggggttggcgccgaagagcgtggtcagtctgaagccatcgcacgcaacctgcgtgagatgtctcgcctgaaagtgccggtcatctgtaccgttatcggtgaaggtgggtccggcggtgcgctggcaattggcgtgggcgataaagtgaatatgctacagtacagtacctattccgttatctctccggaaggctgtgcctccatcctgtggaaaagtgccgataaagcgccgctggctgctgaagcgatgggcatcattgccccacgtctgaaagagctgaagctgatcgacaccgttatccctgaaccgctgggtggcgcgcatcgtaagccggaagtgatggctgcttccctgaaagcgcagctgctggcagacctggcggacctggacgtgctgagcacagaagatctgctcaaccgtcgttatcagcgtctgatgacctacggttacgcgtaa

SEQ ID NO: 2689 - DNA, 372 bp, Enterobacter cloacae
cagtcgcagtattcatgggagcataagatgagtgatgacgtagcgttgccgctggaatttaccgaagcagcagcgaaaaaagtgaaaaccctgattgccgacgaggacaatccggatctgaaactgcgtgtttatattaccggcggcggctgtagtggcttccagtatggttttacctttgacgaccaggttaacgatggtgatatgactatcgagaaacagggcgtcgcgctggtggttgatccgatgagcctgcaatatctggtgggcggttcagtggactacactgaaggtctggaaggttcgcgctttgtggtgactaacccgaatgcgaccagcacctgcgggtgtggttcttcgttcagtatttaa

SEQ ID NO: 2690 - DNA, 777 bp, Enterobacter cloacae
tatgggatacgtggaggcataaccccaactttcaatatagaggttttaaacatggcaactgtttccatgcgcgacatgctcaaggctggtgttcacttcggtcaccagacccgttactggaacccgaaaatgaagcctttcatcttcggcgcacgtaacaaagttcacatcatcaaccttgagaagactgtaccaatgttcaacgaagccctggctgagctgaacaagatctcttcccgtaaaggtaagattctgttcgttggtactaagcgcgctgcaagcgaagctgtgaaagatgctgctaacagctgcgaccagttcttcgtgaaccatcgctggttgggcggcatgctgaccaactggaaaactgttcgtcagtccatcaagcgcctgaaagatctggaaacccagtctcaggacggtactttcgataagctgactaagaaagaagcgctgatgcgcactcgtgaactggacaagctggaaaacagcctgggcggtatcaaagatatgggcggcctgccagacgcgctgttcgtaatcgatgcagaccacgagcacatcgcaatcaaagaagctaacaacctgggtatcccggtattcgctatcgttgataccaactccgatccggacggtgttgacttcgttatcccgggtaacgacgacgcaatccgtgctgttagcctgtacctgagcgctgtagctgctaccgttcgtgaaggccgttcccaggatctggcttctcaggcggaagaaagcttcgtagaagctgaataa

SEQ ID NO: 2691 - DNA, 936 bp, Enterobacter cloacae
ataggggcccattatcggccccttttttcaatttatactgtttggctcccggccgggcagttcacatctcccgaggatttaagaatggctgaaattaccgcatccctggtaaaagagctgcgtgagcgtactggcgcaggcatgatggattgcaaaaaagcgctgaccgaagcgaacggcgacatcgagctggcaatcgaaaacatgcgtaaatccggtgcgatcaaagcagctaagaaagcaggcaacgttgctgctgacggcgtgatcatcactaaaatcgacggcaactacggcatcattctggaagttaactgccagactgacttcgttgctaaagatgctggtttccaggcatttgctaacaaagttctggacgcagcggttgcaggcaaaatcactgacgttgaagttctgaaagcacagttcgaagaagagcgtgttgcgctggttgctaaaatcggtgagaacatcaacatccgtcgcgttgcttccctggaaggtgacgttctgggctcttaccagcacggcgcgcgtatcggtgttctggttgcggctaaaggcgctgacgaagagctggttaaacagctggcaatgcacatcgctgcaagcaaaccagaattcgttaagccagaagacgtgtctgctgaagtggtagagaaagagtaccaggttcagctggacatcgcgatgcagtctggtaagccaaaagaaatcgcagagaaaatggttgaaggccgcatgaagaaattcaccggcgaagtttctctgactggccagcctttcgtaatggatccaagcaagtctgttgctcagctgctgaaagagcacaacgctgatgtaactggcttcatccgcttcgaagtgggcgaaggcatcgagaaagttgagactgacttcgcagcagaagttgctgcaatgtccaagcagtcttaa

SEQ ID NO: 2692 - DNA, 330 bp, Enterobacter cloacae
tcctctccgccggtacgggtaacccgttctttaccaccgattccgcagcctgcctggcgcggtatcgaaatcgaagccgatgtggtgctgaaagcgaccaaagtagatggcgtgtttactgccgacccggcaaaagatccttcagcgaccatgtacgatcagctgagctacagcgaagtgctggaaaaagagctaaaagtgatggatcttgccgcctttacgctggctcgtgaccacaaactgccgatccgtgtcttcaatatgaacaagcctggcgcgctgcgtcgcgttgttatgggcgaaaaagaaggcactttgatcacggaataa

SEQ ID NO: 2693 - DNA, 768 bp, Enterobacter cloacae
aaacgcgttatgttgtctgcgaatcaaccaataagcgaaaacttgccagcacatggctgtcgccatgttgcaatcatcatggatggcaatggccgctgggcgaaaagacaagggaagatacgagcctttgggcataaagctggggcgaaatctgttcgccgcgccgtttcttttgccgccaataacggcattgatgcgttaacgctctatgcttttagcagtgagaactggaatcgacctgcgcaggaagtgactgcgttgatggaactgttcgtgtgggcgctcgatagcgaagtaaaaagcctgcaccgccacaacgtccgcttgcgtattattggcgaaaccagtcgttttaactcacgtttgcaggaacggattcgcaaagcagaagcgctgacggaaaataataccggcctgacgctcaatatcgcggcgaattacggcggacgctgggatattatccagggggttcggcatctggctgagcaggttcaggaagggctgttaagacccgaccagattgatgaagaggcgctgagtcagcaaatctgcatgaatgagctggcacccgtggatttggttataaggacagggggggagcatcgcattagtaactttttgctgtggcaaattgcctacgccgaactttactttacggatgttctttggccagattttgatgaacaagactttgaaggtgcgctgcatgcctttgccaatcgagagcgtcgtttcggcggcaccgagcctggtggcgataacgcctga

SEQ ID NO: 2694 - DNA, 861 bp, Enterobacter cloacae
cttttgctgaagtatcgcctgatttccgcttttgtattaatacccgtcgtcatcgcagcgctgtttttactgcctccggtgggattcgctattgttacgctggtggtgtgtatgctcgccgcgtgggaatgggggcagcttagcggctttacctcgcgcactcagcgggtatggctggcggtactctgtggttttttactggccctgatgctgtataccttgcctgaatatcatcacgatgttcaccagccgctggttgccggatccttatggatatcgctggcctggtggattgctgcgcttgttttagtgcttttctatccgggctctgcggcgatctggcgtaactctaaagtgttgcgccttattttcggtctgctcacgattgttccctttttctgggggatggttgcgctgcgcgcctggcactatgacgaaaaccactacagcggcgcgatatggctgctttatgtgatgattctcgtctggggggctgactccggggcctatatgtttggtaaactattcggcaaacataaactggcgccaaaggtttctccgggcaaaacctggcaaggcttcattggcggcctgtttacggcagcgattatctcctggggctatggcgtctgggcgaatcttgaggttgccccctccacgctgctggtatgttcgattttcgcggcgctggcatcggtgctgggtgatttaaccgagagtatgtttaagcgtgaagcagggattaaggacagtggtcacctgattccaggacatggcggaatactggatcgcattgacagccttaccgcggctgttcctgtatttgcttgcctgcttttactggtgtttgggacgatataa

SEQ ID NO: 2695 - DNA, 1449 bp, Enterobacter cloacae
gaagaacgcataataacgatggcgatgaaaaagttgctcatagcgtcgctgctgtttagcagcgcgactgtatacggtgctgacgggttcgtagtgaaagatattcatttcgaaggccttcagcgtgtcgccgttggtgcggccctcctcagtatgcctgtgcgccccggcgatacggttaatgatgaagatatcagtaacaccatccgtgctctgtttgccactggcaactttgaggacgtccgcgtcctgcgcgatggtgatacgctggtggttcaggtaaaagaacgtccaacgattgccagcatcactttctccggcaacaagtcggtgaaagatgacatgctcaagcagaaccttgaggcatcgggtgttcgtgtgggggaatctctggaccgcacaacccttgcagacattgaaaaaggtctggaagatttctattacagcgtcggtaaatacagcgcgagcgttaaagcggttgttacaccgctgccacgtaaccgtgtcgacctgaaactggtcttccaggaaggtgtttctgcgaagatccagcagatcaacatcgtgggtaaccacgcgttcagcaccgacgaactgatctccaacttccagctgcgtgacgaagtgccgtggtggaacgtggtgggcgatcgtaaataccagaaacagaaactggcgggtgaccttgaaaccctgcgcagctactatctggatcgcggttacgcccgtttcaacatcgattcaactcaggtgagtctgactccggacaagaaaggtatctacattaccgttaacatcactgaaggcgataagtacacgctttcaggtgttgaagtcagcggcaacctggcaggacattcagctgaaattgaatctctgaccaaaattcagccgggcgatctgtacagcggatctaaagtcaccaaaatggaagacagcattaagaagctgctcggccgttatggttatgcgtatccgcgtgtgcaaacgcagccggaaattaacgacacggataaaaccgttaagctgcacgttaacgttgatgcgggcaaccgtttctatgtgcgtaagatccgcttcgaaggtaacgatacctctaaagactctgttctgcgccgtgaaatgcgccagatggaaggggcatggctgggaagcgatctggtagaccagggtaaagagcgtctgaaccgtctgggctatttcgaaacggtcgataccgatactcagcgtgtaccaggtcgtccggatcaggttgatgttgtttataaagttaaagaacgtaataccggtagcttcaacttcggtattggttacggtactgaaagtggcgtgagcttccaggtcggtgttcagcaggataactggctgggtacgggctactctgtcggtatcaacgggacgaaaaacgactaccagacctactctgagttctctgttaccaacccatag

SEQ ID NO: 2696 - DNA, 1002 bp, Enterobacter cloacae
ttcaccgttgacggtgtaagcctgggcggtcgtatcttctataacgactttaaagcggatgacgcggacctctcctcgtataccaacaagagttacggtctggatggtacgctcggcttcccggttaacgaatacaacaccctgcgcgcaggtttagggtacgtgcataacgacctgtccaacatgcaaccgcaggtggcgatgtggcgttacctggactccatcggtcagtcggcgagtacgtccagcgatgacaacggtttcgccgcggatgacttcaccttcaactacggttggacctacaaccgtcttgaccgtggctacttcccgacggaaggttcacgtgtcaacctgaacggtaaagtgactatcccgggctcggataacgagttctacaaggtcacgctggatacggcgtcctacttcccaattgatgaagaccacaagtgggttgttctgggtcgtacccgttggggttatggtgacggtattggaagcaaagaactgccgttctatgaaaacttctacgccggtggttcaagcaccgtgcgtggcttccagtccaataacattggtccgaaagcggtttattacggcggtaatgacgaagataactgcaacaaaccggctacggacggagcaggcaataagaacgtatgtagttccgatgatgcagtaggtggtaacgctatggccgtggcgagcctcgagttcatcacgcctacgccgtttatcagcgacaagtacgcaaactctgtccgcacctctttctttatggatgcaggtacagtgtgggataccaactggcagaacacgactgaaacgcgccttgctggtgtgccggactacagcgatccgagcaacattcgcatgtccgcaggtatcgcattacaatggatgtcaccgctggggccgttggtcttctcttacgcccagccgtttaagaaatacgatggagacaaagcggagcagttccagtttaacattggtaaaacctggtaa

SEQ ID NO: 2697 - DNA, 561 bp, Enterobacter cloacae
aacgatcgccttgccacgcaaagaacggtacccctcgggtgccaatgggatggtaaggagttaattgtgaaaaagtggttattagctgcaggtctcggtttagcgatggcaacttctgctcaggcagcggataaaattgcaatcgtcaacatgggtaatttgttccagcaggttgcacagaaaaccggtgtttctgcaacgctggaaaacgaattcaaaggccgtgcgagcgaactgcaacgtatggaaggtgatcttcagtccaagatgcagcgtcttcagcgtgatggttctaccatgaaagcgagcgagcgcagcaaactggaaaaagacgtcatgtctcagcgccagaccttctctcagaaagcgcaggctttcgagcaggatcgtcagcgtcgttctaacgaagagcgtggcaaactggtgacgcgtattcagtctgccgttaaagcagtcgcagccgatcagagcatcgatctggttgttgattcgaacgccgttgcattcaacagcagcgatgttaaagacatcaccgctgatgttctgaaacaggttaaataa

SEQ ID NO: 2698 - DNA, 1029 bp, Enterobacter cloacae
gtaatgccttcaattcgactggctgatttagctcagcagttggatgcagaattacacggtgatggcgatatcgtcatcaccgctgttgcgtccatgcaatctgctaaagcaggcactattaccttcatggtaagccctaagtaccgtgaacacctggcccagtgccaggcgtctgccgttgttctgacgcaggacgatcttccgtttgccactagcgctgcactggtagtgaaaaatccctacctgacctatgcgcgcatggcccaaattcttgataccacgccgcagccggcacagaacattgcagccagtgctgcgattgatccgacggctcagctgggtaacaacgtatcagtcggcgcaaacgccgttatcgaatccggcgtcgtgctgggtgataacgtggtgattggcccaggctgctttgttggaaaaaatacgaaaattggcgcagggactcgtctgtgggccaatgtctctgtctaccatgaggttgaggttggcgagaattgtctcgtacagtccagcacggtgattggttctgacggatttggttacgctaacgatcggggtaactgggttaagatccctcagctgggtcgcgtgattatcggcgatcgtgtggagatcggcgcttgcaccaccatcgaccgcggtgcgcttgacgacaccattattggtaacggtgttatcatagacaaccagtgccagattgcacataacgttgtgattggcgacaataccgcagttgcgggtggtgttatcatggcaggcagcctgaaaattggccgttactgcatgattggcggtgccagcgtgatcaatggccatatggaaatatgcgacaaagtcacggtgacggggatgggcatggtgatgcgtccaatcactgagcctggcgtttattcctccggtattccgctgcaaccgaacaaggtctggcgtaaaacagctgcactggtgatgaatattgatgatatgagcaagcgactcaaagcgattgagcgcaaaatcgatcaacaagactaa

SEQ ID NO: 2699 - DNA, 630 bp, Enterobacter cloacae
gcaggcggccgatgcggtgctggagttagcacaatgatggaatttatttatccccatacccacctcgttgccggtgtggatgaagtcggtcgtggcccgttagtgggtgccgttgtgaccgcggcggtgatcctcgatccagcccgcccgatcgttggcctgaacgactcgaaaaaactgagcgaaaagcgtcgtttagcgctgttcgatgaaattaaagagaaggcgctggcctggagtctcgggcgcgcagaaccgcatgagattgacgatctaaacattttgcacgctaccatgctggcgatgcagcgtgccgttgcgggcctgaagattgtgcctgagtatgtactgttcgacggtaaccgttgcccggcgctgccgatgccttccatggctgttgttaaaggcgatagccgcgtcgcagaaatcagtgcggcgtcaatcattgccaaagtgacgcgcgatgctgaaatggccgcgctggacctcacttatcccgcgtatggtttcgcccagcacaagggatatccaacggctttccatctggaaaagctggctgaacatggcgcaactgaacatcatcggcgcagctttggcccggtgaaacgcgcgctgggactggtgtcctga

SEQ ID NO: 2700 - DNA, 2136 bp, Enterobacter cloacae
accatgaacatcattgccatcatggggccacacggcgtcttttataaagacgaacccatcaaggagctggagcaagcccttaaagcacgcggatatcagctgatctggccgcaaaacagcgccgacctgctgaaatttatcgaacacaatccgcgcatctgtggcgtgatattcgactgggacgaatacgacatggagttgtgcagcgatatcaataagctcaacgaatatcttccgctgtacgcctttatcaacactcactcgaccatggacgtgagtgcgcacgatatgcgtatggcgctgtggttcttcgaatactcactcggcgttgccgaggacattgcgacccgcattcagcagtacaccggtgaatacctcgataacatcacaccgccgtttacgcgcgcattgttcacctatgtgaaagaagggaagtacaccttctgtacgccaggccatatggcgggaacggcctatcaaaaaagcccggtgggatgcctgttctacgatttcttcggcggtaacacgctgaaggcggacgtgtcgatttcggtcaccgagttaggctctctgctggatcataccggcccgcatctggaagctgaagagtacatcgcccggacctttggcgccgagcaaagctacatggtgaccaacggtacctcaacctcgaacaaaatcgtcgggatgtacgccgcgcctgccggcagtacgctgctgattgaccgaaactgccataaatcactggcgcatttgctgatgatgagcgacgtggtgccgctctggctgtcgcctacgcgtaatgcgctgggtattctcggcggcattcctcgccgcgagttcgcgcatgaagccattgaaaataagatcgcggctatccccgaggcaagctggcctgtgcatgcggtgatcaccaactccacctatgacgggctgctttacaacacgaactggatcaagcagacgctggacgtgccgtcgattcactttgactccgcgtgggtgccttacactaatttccacccgatttactcgggtaaaagtgggatgagcggcgagcgggtgccgggcaaggtgttcttcgaaacgcagtcgacgcacaaaatgctggccgcgttttcccaggcgtctctcattcacatcaagggtgagtacgacgaggacaccttcaacgaagctttcatgatgcacacgaccacgtcgccaagctacccgctggtggcgtccatcgaaacggcggcggcgatgctgcgcggtaatccgggtaaacgcctgatcaatcgttcggtggagcgggcgttgcatttccgaaaagaggttcagcgacttaaagatgaagcggacggctggttctttgatatctggcagccggaagagattgatgaggcagaatgctggcccgtcgcgccgggggagagctggcacggttttcgggatgctgatgcggaccacatgttcctcgatccggttaaggtgacaatcctgacgccgggcatggatgagcagggtgtgatgggtgaggaagggatcccggcagcgctggtggcgaagttccttgatgagcgcggcgtggtggtggagaaaaccggcccctataatctgctgttcctgttcagcatcgggatcgataaaacccgcgcgatggggctgctcaggggactgatggagtttaagcgcgcatacgatctgaacctgcgggtgaagaacatgctgccggatctctacgcggaagatcctgacttctaccgcaatatgcgtattcaggatctggcccaggggattcacaggctgatccgccagcacgatctgccgcgcctgatgttgcaggcatttgatgttctgcctgaaatgaagctgacgccgcacagggcgtggcagcgccaggtgaaaggggaggttgaaaccgttgagctggagaacctggtcgggcgggtatcggccaacatgatcctgccttatccgccgggcgtgccgctgctgatgccgggtgaaatgatcactgaggagagccgggcggtgctcgatttcctgctgatgctctgttcggtggggcgccactatcccggctttgaaacggatattcatggcgcgaaacgcgacgataacggcgtgtactgggtgagagtcctaaaataa

SEQ ID NO: 2701 - DNA, 402 bp, Enterobacter cloacae
aaaggagaaactatgctgggtttaaaagcggttcatcatattgcgatcattgccaccgattatgcgaaaagtaaggcattctactgcgacgttctcggctttacgctgttgagcgaggcctaccgtgaggagcgcgactcctggaaaggcgatctggcgttaaacggtcaatatgtgattgagctgttctcttttcctttcccgccagcgcgtccttcacgcccggaagcctgcggcctgcgccacctggccttcagcgtcgatgacctggacagcgcggtaaaacatctggaagctcacggcgtggcctgcgaagcgattcgtgtcgatccctttaccgataaacgtttcacttttttcaacgatccggacggcctgccgctggagctttatcagcagtaa

SEQ ID NO: 2702 - DNA, 1200 bp, Enterobacter cloacae
ctgaacttccctatgcttgagctctgctcacgggagggttttatggctggctggcatcttgataccaaaatggcgcaggatatcgtggcgcgaaccatgcgcatcattgataccaatatcaacgtaatggatgcccgtgggcgcattatcggcagcggcgatcgtgagcgtattggggaattgcacgaaggggcgttgctggtgctctctcaggggcgcgtggtcgacatcgatgacgccgtggcgaaacatctgcacggggttcgtcaggggatcaacctgccgctgcgtctggaaggagagattgttggcgttatcggtctgaccggcgatcctgaatcgctgcgtaaatacggtgagctggtctgcatgacggcggagatgatgctggagcagtcgcgtctgatgcacctgctcgcccaggacagccgcctgcgcgaagagctggtgatgaatttgattcaggcggaggagcatacgcctgccctgagcgagtgggcgcagcgtctgggtatcgacctgaatcagccgcgcgtggttgccgttattgaggtggatagcggccagcttggcgtggacagcgccatggtggaactacagcagctgcaaaacatgctggcgacgccggagcgtaacaacctggtggcaatcgtctctttaacggaaatggtggtgctcaagcctgcgcttaatcagtttggccgctgggacgcggaagatcatcgtcgccgcgttgagctgctcatcgagcgcatgaaggagaacggacagctccgttttcgcgtcgcgctgggaaattactttaccgggccggggagtatcgcccgttcatggcgaacggcgcgcaccaccatgatggtgggtaaacagcgcatgccggagagccgcagttatttctatcaggatctgatgctgccggtcctgctcgacagcctgcgcggtggctggcaggccaacgagctggcgcgcccgctgatgcgtctgaaagcgatggacaacaacgggctgctgcgccgcacgttgcaggcgtggttccggcataacgtgcagccgctggcaacgtcaaaagcgctgtttattcaccgtaatacgctggagtatcggcttaaccggatctcggaactgacggggctggatttagggaattttgacgaccggctactgctgtatgtggcgttgcagctggatgagcagagataa

SEQ ID NO: 2703 - DNA, 1272 bp, Enterobacter cloacae
acgccgttcagaaggacattgagtcttgctggcggcgttttgcttttatctgatctaacttttgggcatctcatgaagcatctcactctcctcggctcgaccggctctatcggttgcagcactctcgacgttgtacgtcataatcctgacagctacaccgtagccgcgcttgtggccggaaaaaacgtgcagcgaatggtcgaacagtgcctggagtttaccccccgttttgcggtgatggatgatgaagagagcgcccgccaggtaaaagcgctgttgcaggagaagggctgccgtaccgaggtgctcagcgggcaacaggcggcgtgcgatatggccgcgcttgatgaagttgatcaggttatggcggcaatcgtcggggcggcgggtcttctgccgacgcttgccgcgatcgatgcgggaaaagatgtcctgcttgcgaacaaagagtcgctggtcacctgcggacgcctctttatggacgcggtaaaacagcgtggggcacgtcttttgccggtcgatagcgagcacaacgccatttttcagagtttaccccaaccttttcaacaaaacctggggtacgctgacctggagcagaatggcgttgtgtcgattctgcttaccgggtctggtggcccgttccgtgaaacgccactgtctgaattgagcgcaatgacgccggatcaggcatgtcgtcatccgaactggtcaatggggcgtaagatctccgtcgattcggccaccatgatgaacaaaggtctggaatacattgaagctcgctggctgttcaatgcgtcggcgaaacagatggaagtgctgatccacccgcagtcggtgattcactcgatggtgcgctatcaggacggcagcgtgctggcccagctgggcgaaccggatatgcgtacgccaattgctcatacaatggcgtggccaaaccgcgtaaaatcgggcgttaagcctctcgatttttgcaagctgagttcactgacgtttagcgagcctgattacgaccgttatccctgtctgaaactggcgatgacggccttcgatcaggggcaggcggcgacaacggcgcttaatgcggccaatgaagtgaccgttgaagcattcctgaatcagcagatccgcttcactgatatcgccgcgttgaatttatccgtgctggagatgatggatttgcgtgagccgcagagcgtggaagaggtgctggccgtggatgaacaggcacgcattgttgcgcgtaaacaggtgacacgtctcgcaagctggtga

SEQ ID NO: 2704 - DNA, 1176 bp, Enterobacter cloacae
acgttcaacccgtggtctgattcgttaatggtcgacagtcgtccgcttaccatcgccctggtcgccggagaaacctccggcgatattcttggtgcaggtcttatccgcgcgcttaaagcccgtgtacccaatgcccgctttgtgggcgtggctgggccgctaatgcaggccgaaggctgcgaagcctggtatgaaatggaagagctggctgtgatgggcatcgtcgaggtgctgggccgcttgcgtcgcctgctgcatatccgcgccgaccttacccgccgctttaccgacctcaagcccgatgtatttgtcggcattgatgcgcctgatttcaatattacccttgaagggaacctgaaaaagcaggggatcaaaacgatccattacgtcagcccatccgtgtgggcgtggcgacagaaacgcgttttcaaaatcggacggtccaccaatctggtgctggcttttctgcctttcgaaaaagcgttttacgacagatttaatgtcccgtgccgttttatcggtcataccatggcggatgccatgccactggatccggataaaaacgcggcgcgtgacgaactgggcatcccgcatgatgtgcattgtctggcgctgctgccaggaagccggggtgcggaagttgaaatgctcagtgccgatttcctgaaaacggcgcaaattcttcgcaagacttaccccgatcttgaagtggtcgtgccgctggtgaatgccaaacgccgggagcagtttgagcgtatcaaagccgacgtcgccccggatcttcacgtccgcctgctggacggaaaagggcggcaagctatgtttgcgagcgatgccgcactgctggcttccggcacggctgcgctggagtgtatgctggcaaaatgcccaatggtggtcggttatcgcatgaagccgtttaccttctggctggcaaaacgtctggtaaaaacagattacgtatctctgccaaacctgcttgcgggtcgcgagctggtgaaagagctcttgcaggatgaatgccagccgcaggcgctggcagatgcgctgctgccgctgctggccaacggtaaaaccagccaccagatgcatgataccttccgtgaactgcatcaactgatccgctgtaatgctgatgagcaggcggccgatgcggtgctggagttagcacaatga

SEQ ID NO: 2705 - DNA, 1077 bp, Enterobacter cloacae
tttcctatgaccttacccgctatcgcgcacgccgtttcaccctaccgccagctgctggtggggttcagcggtggcctggattccaccgttttgctgcaccgtcttaagctctggcgcgaccgtgagcctgacgtccagctgcgggcgatgcatatccatcacggcttaagcccccatgccgacgactgggtggcgcactgcgaagcggtgtgctcagggtgggagatcccgctgatcgttgaacgcgtcacgcttgaggatgaggggctgggtattgaggcgcaggcgcggaaagcccgctacgccgcgttttctggcgcattacagcctggagaagcgttggtcaccgcgcagcatctggacgaccagtgcgagacgtttttactggcgctcaagcggggcagcgggcctgcgggtttatccgccatgcctgagcgcgctgattttgctgaaacagagctcatccgcccgctactgggtgagacgcgcgcatcactggaagcctgggcgcagcagcatcatctgtgctggattgaagacgacagcaatcaggacgacagttacgaccgtaacttcctgcgcctgcgcgtcttaccgctgctgagtgagcgctgggcgcatttttccgaagcggcggccagaagcgccatgctgtgtgctgaacaggaaagcttgctggatgagttgctgagcggggagctgaatacactgattaccgctgacggtgccctgaacgttgcgccgttgaaggtgatgagccccgtgcgtcgggctgctctgattcgccgctggctggcttaccaccgtgcggttatgccgtcccgggcgatgctcaaccgtatctgggaggaagttgcacaggcgagggaagatgccgcaccgtgtatacacctgaatggttatgacgtcaggcgttataaagggcaactctggtgggtaaaatctgtgccgtcgctggctgacgttgtgctcgactggccgtcgccggaaaaagcattaacgctaccgatgaatgccggtgtcgttgcgttaagtcattcgttcttcacccacaggggatggcagcaccgcgcttag

SEQ ID NO: 2706 - DNA, 273 bp, Enterobacter cloacae
aaaaggccaatcaccatcctcggccgccaaaattcgctggggcatccccgcatcggtctcacagtcgccaagaaaaacgttaagcgtgcgcatgaacgcaaccggattaaacgtctgacgcgtgaaagtttccgtgtacgtcagcacgaactgccttcaatggatttcgtggtggtggcgaaaaaaggggttgccgacctcgataaccgtgctctctcggaagcgttggaaaaattatggcgccgccactgtcgcctggctcgcgggtcctga

SEQ ID NO: 2707 - DNA, 1137 bp, Enterobacter cloacae
  unsure (378)
  unsure (504)
gtatgcggtgaaacttgggctacagcgtacagaacgccggtgcgaaaccgctgggaaatctctacctttggtcagctgaagcagtccatcaatctgccgtctcaccgtgataccggaagcagcaactttgcgctgcataccttccgtggcgcggcttactccacgccagataccaagtacgagaaatacaaattcgacaccattgccgataacgaaaacctgaacgtcagctctaaaggcggttgggtcgcaatgctgcaacagtatttcgcgacggcgtgggtaccgaataacgacggtacgaactacttctataccgcgaacctcggcaacggtattgcagccatcggctacaaatctcaaccggttctggtgcanccgggtcaaaccggtaaactggcaagcaccctgtgggtcggcccggaaatccaggacaaaatggctgccgttgcgccgcacctggatctgaccgtggattacggttggttgtggttcatctctcanccgctgtttaagctgctgaagttcatccacagcttcctgggtaactggggcttctccatcatcgttatcacctttatcgttcgtggcatcatgtacccgctgactaaagcgcagtacacctccatggcgaagatgcgtatgctacagccgaagattcaggctatgcgtgagcgtctgggcgatgacaaacagcgtcagagccaggagatgatggccctgtataaagcagagaaagtgaacccactgggtggttgcttcccgctgctgattcagatgccaatcttccttgcgctgtactacatgctgatgggttccgttgagctgcgccacgcgccgttcgccctgtggatccatgacctgtccgcacaggacccgtactacatcctgccgatcctgatgggcgtgacgatgttcttcattcagaagatgtctccgaccaccgtgaccgacccgatgcagcagaagatcatgacctttatgccggtcatcttcaccgtgttcttcctgtggttcccgtcaggtctggtgctgtactatatcgtcagcaacctggtgaccatcatccagcagcagctgatttaccgtggtctggaaaaacgtggcctgcatagccgcgaaaagaaaaagtcctga

SEQ ID NO: 2708 - DNA, 1377 bp, Enterobacter cloacae
acgagagcaaccatgagccataacgacactatcgtcgcccaggcaaccccaccgggacgcggtggtgtaggcattctgcgtatctccggcctgaaggcgcgtgaggtggccgaagcggtgctgggtaaactgccaaagccgcgctacgctgattatctgccgtttaaagatgctgacggcacaccgctggaccagggcattgcgctgtggttccccggcccaaactcctttaccggcgaagatgtgctggaacttcagggccacggcggcccggtgatcctcgacctgctgttaaaacgtattctgaccctgcctggcctgcgcattgcgaagccgggtgagttctccgagcgtgctttcctcaacgataagctcgacctggcgcaggccgaggcgattgctgatctgatcgacgccagctccgaacaggcggcccgctccgcgctgaactcgttgcagggcgcgttttccgcacgcgtgaatcaccttgtggaagcacttactcacctgcgaatctatgtcgaagcggctatcgacttcccggacgaggagatcgacttcctctcagacggtaaaattgaagctcagctcaaccaggtgatgaacgatctcgatgccgtccgcgccgaagcgcgccagggcagcctgctgcgtgaaggcatgaaggtggtcattgccggacgccccaacgccgggaaatcgagcctgctgaacgccctggcgggccgtgaagcggcgatcgtcaccgacatagccggcaccacccgcgacgtgctgcgcgagcatatccacatcgacggaatgccgctgcacatcatcgacaccgctggcctgcgcgatgcgagcgatgaagtcgagcgtatcggtatcgaacgcgcctggcaggagatcgagcaggccgaccgcgtgctgtttatggtggacggcaccacaaccgacgccgttgacccggctgaaatctggccagactttatcgcccgtctcccggctaaactgccgatcaccgtggtgcgcaacaaggccgacgttaccggcgaaacgctgggcatcagcgatgtgaatggtcactcacttattcgcctgtcggcccgtaccggtgaaggcgtggaagccctgcgtagccatctcaaacagagcatggggttcgacaccagcatggagggtggcttcctggcgcgtcgtcgtcacttgcaggcgctggaagaggcggctcgccaccttgagcagggtaaagcccagctgatcggcgcgtgggccggtgaactgctggcggaagagctgcgtctggcgcaacagaacctgagcgagatcaccggggagtttacgtcggacgatctgcttggacggattttctcgagcttctgcattggtaagtaa

SEQ ID NO: 2709 - DNA, 1287 bp, Enterobacter cloacae
ttcccgttaatacagggtgatttccaccagggaaatcaccattgtccaaatggcaactcgcctaatcccctttcaccccctatcctgcatgcttgcatctatggggggtttatggcgcgttttctgttttgtagtttcgcattagttctgctttatccgtccggcattgatatgtatctggtggggctaccgcatattgcccgcgatctgggtgccagcgaggcgcaactgcacatcgcgttttcggcctacctcgcgggaatggcgtcgtcgatggtatttgccgggaaaatcgcggataaagcaggccgccagcccgtcgcgattacgggtgcagttatctttgcgctggcatcagtactctgttcagtggctcaggaaagcacaatgttcctgtcaggacgttttatccagggcattggcgcaggcggctgttacgtggtggcctttgccattctgcgcgataccttgagcgcccagcgccgcgccaaggtgctgtcgatgctgaacggcattacctgcatcatcccggtgctggcaccggttgtaggctacctgattatgcttaaatttccgtggcagagtcttttctggaccatggcagccatgggcgccatcgtctttatcctgtccgtgacggtgctgaaagagacccatcccggttcgcaacagccatatcacaccgcaaccctccatccggctgaaaagctggtgaatcgctttttcctgagtcggctggcaatcaccacgcttagcgtggcggtgatcctcacctatgtaaacgtttccccggtgttgctgatggagacgatgggcttcgatcgcggtgagtattcaacggtgatggcgctaaccgcgatggtgagcatggcggtttcattctcaacgccctttgcgctcaacatcttccgccagcgcacgctgatgctcacctcacagacgctgtttctcgccgcaggcgtgatcctggcgaccgccacctcacacgctgtaatgctggtgggcattactctgatctgcgccggattctccgtcggctttggtgtggcgatgagtcaggcgcttggccccttctcgctgcgggcaggcgtggccagctcggtgctgggcattgcgcaggtctgcggttcttcgctatggatttggctggcggcggtgatcggccttaacgcgctgaatatgctgatcggggttctgattggctgtagcatactctgcattaccttacttatggtcatccagcccgcggcgcactatgaagaagcccatcagcagtctcgatcttaa

SEQ ID NO: 2710 - DNA, 777 bp, Enterobacter cloacae
ccgactacgaccattatcaaggagcgaaaaatggctacgcactttgcacgaggaacattaacggaagggcatctcgtatcggccagactttcttcagcctgtcacagtgaggcgctcaaactacctgaacaccgcaggacgcggtttttagcttccagagcgctcctcgcagaactgctttttatgctctacggcactagcgaactaccggacatactcacccagccagaaggtcgcccggtttttgcggacccggcactcccccatttttccattgcgtacaccggcaacattgttggcgtcgcgctgacgactgaaggtgattgtggcctggatatggagctgcaacgcgtcacgcgtagcttccatggtgctaacgcgctcgatgaatacccgctctccagcaatgaaaagctgtggatacgtaaccagaacgaccctgttgaagccagagcgcagctcatcacccttcgccagagcatccgcaaactgaacggcgcggcgtcagacgacgccagcctgttgcagctgctccccggctccggacgcctgcgcgcgacaaaagcctcgctggtagaggcgctcagcgacgctgaggacgtactgatctggtccgttgcggtgagccccgccatcgaacggctgaaaatctgggaatttgacagtattcgcggttggcgtagtcttccggatgtccctgagcgcgccaacgagcccgccgcgcgcctgatgcgattaaccagtttaccggcagaaaaagcatacacccatagctga

SEQ ID NO: 2711 - DNA, 603 bp, Enterobacter cloacae
tccgtccagggtcatcatgatgaaacaggagtaatcatgtctgatacgttgaaagttgttacgttactgggaagcctgcgcaaaggttcttttaacgggatggttgcccgtacgctgccgcagctggcgcctgcgggaatggagatcagtgccctgccgtccattggcgacatcccgctttatgatgctgacgttcagcaggaagaagggttcccgcaaagcgtggaagcgatagccgagcagatccgtcaggctgacggcgtggtgattgtgacgcctgagtataactactcggtgccgggtggtctgaagaacgccattgactggctgtcccgtttaccggagcagccactgtctggtaaacctgtgctgatccagaccagctcaatgggcgccattggcggcgcgcgctgccagtatcacctgcgtcagatcctggtgttcctggatgcgatggtgatgaacaagccggaatttatgggcggcgtgattcagaacaaggtcgacccgcagacgggtgaagtggtggatcagagtacgcgtgaccatctctctggccagctgaccgcgtttggggattatattaagcgggtgaaggcgtaa

SEQ ID NO: 2712 - DNA, 606 bp, Enterobacter cloacae
taccagagaacactaacgatggattcgcaacgcaatcttcttatcatcgctttgttgttcgtgtctttcatgatctggcaggcatgggagcaggataaaaatcctcaaccccagcagcagaccacgcagaccacgaccaccgcagcgggtagcgccgccgaccagggcgtaccggccagtggccaggggaaacagattacggttaagaccgatgtgcttgagctgactatcaacacccgtggtggtgatgttgagcaggcgctgctgttgacctacccgaaagaactgaagtctaccgaaccgttccagttactggaaaccacgcctgaatttatctaccaggcgcagagcggcctgaccggtcgtgacggcccggataacccggctaacggtgcgcgtccactgtataacgtcgagaacgacacctttgtgctggctgatggccaaaacgaactcgttatcccgatgacctataccgacgccgcaggcaacaccttcaccaaaaccttcaccctgaaacgcggtgagtatgcggtgaaacttgggctacagcgtacagaacgccggtgcgaaaccgctgggaaatctctacctttggtcagctga

SEQ ID NO: 2713 - DNA, 306 bp, Enterobacter cloacae
ccggcaccacccgcgacgtgctgcgcgagcatatccacatcgacggaatgccgctgcacatcatcgacaccgctggcctgcgcgatgcgagcgatgaagtcgagcgtatcggtatcgaacgcgcctggcaggagatcgagcaggccgaccgcgtgctgtttatggtggacggcaccacaaccgacgccgttgacccggctgaaatctggccagactttatcgcccgtctcccggctaaactgccgatcaccgtggtgcgcaacaaggccgacgttaccggcgaaacgctgggcatcagcgatgtga

SEQ ID NO: 2714 - DNA, 1029 bp, Enterobacter cloacae
ttggctgtagcatactctgcattaccttacttatggtcatccagcccgcggcgcactatgaagaagcccatcagcagtctcgatcttaatcttttactttgcctgcaacttttgttgcaggagcgcagcgtcaccaaagccgcgaagcggatgaacgtgacgccgtccgcggtgagtaaatcgctggcgaagctgcgcgactggttcgacgatccgctgtttgtgaaaacgcctttagggctattgcccacaccgctgacggtgagtctggaacaggatttggccgactggatgcagattggcaaccagatcctcgataaattccaccatagctctcctggcgggcttaagtttgtgctcgccgccgaaacaccgctgatgctgatccgctttaataccctgctggagcaggtgaatgaacgctacccacaggcgacggtgaagctgcggcaatgggattacgattcgctggacgccattacgcgcggagaagtggatctgggcttcaccgggcgtgaaacgcaccctcgctcgcgcgaactgctaaagctgatgccgtggtttatcgactacgaaatcctgttcagtgaccgtccgtgcgtgtatttgcgcgaggatcatcccgcgctccaggaagcgtgggatctggagacgtttctgcgctacccgcatatcagcatcttctgggaacgcagtgacacctgggcgctcgacgaggtgctaagggagatgggccgggagcgtaacatcgccatgagtttgcccggttttgaacagtcgatgtttatggcggcccagccggatcacaactacatagccactgcgccgcactactgccatcactacaaccaactccaccagcgtaatctggtctgtctgcccattcccatcgatgaggcgcaggcagaaaagctcaccgtacccttcacgctgatctggcataaacggaacagccataatccgaaaatcctctggctgcgtgagacgattaaagcgctgtataccgcaccagatcaggtttttgcctaa

SEQ ID NO: 2715 - DNA, 288 bp, Enterobacter cloacae
ccgtgctctctcggaagcgttggaaaaattatggcgccgccactgtcgcctggctcgcgggtcctgatagccctcattcgggtctatcaacgcctgattagtccgctactcgggccacactgccgtttcacgccaacatgctcaagctacggaattgaggcattgcgcaggtttggagtgataaaaggcagttggttgacggtgaaacgcgtattaaaatgccaccctttacacccaggtggagacgaccccgtccctccaggaccttttgataccagagaacactaa

SEQ ID NO: 2716 - DNA, 741 bp, Enterobacter cloacae
ttttgcttatacggcaacgattgcgtcccggtgaactgccgtacgaaaacgttaaacttgttaaaagggaaaggcatgtccggaattgaagcggtatttttcgactgtgacggtacgctggtcgacagtgaggtcatttgttcccgcgcgtatgtcgccatgttccaggaatttggtattacgctcgatctcgaagaggtgtttaaacgctttaagggcgtgaagctgtacgagatcatcgacatcattaacgaagagcacggggtggatctggcgaaagcggatctggaaccggtgtaccgcgccgaggtcgcacgcctcttcgacgccgagctggaagttatcgctggcgctaacacgctgctggatgcgatgacggtgccgatctgcgtggtctctaacggcccggtcagcaaaatgcagcactcgctcggcaagctgaatatgttgcaccacttcccggaaaaactgttcagcggctacgatatccagcgctggaagccggatccggcattgatgttccacgcggcgaaggcgatgaacgtcaacgtggagaactgcatcctggtggatgactcgtctgcgggcgcgcagtcggggattgatgcggggatggaggtgttttacttctgcgccgatccgcacaacaagccgatcgatcatccaaaagtgacgacctttaccgatctggcgcaactgccagcgttgtggaaggcgcgcgggtgggatattactcgctga

SEQ ID NO: 2717 - DNA, 594 bp, Enterobacter cloacae
attatggagagtttcatgaaattaaacgttatagccacttcactggttttatcttccgtcctgttttcaggtgcgacattagcggctgacggtactgttcatttccgtggcgaggtgattgattctacttgtacagtcacgactgataccagtaatcagactgttaatattggtcgtgtatcggtaaaaaccttcgcgggtattgattccaccgcgtctgttaaagatttccacatccgtctggaaggctgcccggcaacctatactcaggcggcggtacgctttgacgggacggaagataaagataccatcggtaaaggttatctttcaatcggtacgccggtgaacgaagacggtacggacggtgagttcactggcagcggcgacgccattgcggcgacgggcgtggcgataaaactgttcaacctgagcgatgataccgcgatccctttgtataacaattctaaatacgttgccattgcagatggtaaagcggatatgggattcaaggcgaaattcgtccagactctggcaacagtgacgccgggtactgcgaatgctgactctcagtttactattgaatacctgaaataa

SEQ ID NO: 2718 - DNA, 963 bp, Enterobacter cloacae
tttatggctgcaaccaagcctgcatttaaccctccgggtaaaaaaggtgacatgattttcagcgcgctggtgaaactggctgcgctgattgtgctattgctgctgggcggcattatcgtgtccctgattttctcctcctggccgagcattcaaaaatttggtttcgccttcctgtggaccaaagagtgggatgcgccgaacgatatttacggtgcgctggtgccgatttacggcacgctggtgacctcttttatcgccctgctaattgcggttccggtgagcttcggtattgccttgttcctgacggaactggcgccaggctggctgcggcgtccgctgggtatcgccattgaactgctggcggccatcccaagtatcgtttacggcatgtggggcctgtttatttttgctccgctgtttgcaacgtacttccaggagccggtcggtaacgtgctttctgccgttccgtttgtgggggcgctgttctccggcccggcattcggtatcggcattctggcggcgggtgtgatcctcgccatcatgattattccgtacattgcggcggtcatgcgcgatgtcttcgaacaaaccccggtgatgatgaaagagtccgcctacggcatcggctgcaccacctgggaagttatctggcgcatcgtccttccgttcaccaaaaatggggtgattggcggcattatgctgggcttaggtcgcgcgctcggtgaaaccatggcggtcacctttatcatcggcaacacctaccagctcgatagcgcttcgctctatatgccggggaacagtattacttctgcgctggcgaacgaatttgccgaagcggaatccgggctgcacgtcgcggcgctgatggaactgggcctgatcctgtttgttatcacctttattgtgctggctatctccaagctgatgattatgcgtctggctaaaaacgagggggcacgctaa

SEQ ID NO: 2719 - DNA, 831 bp, Enterobacter cloacae
gttcagcgatacggatgcgctgttcacccgtccggcgaagaaacaaaccgaagattatattactggccgctacggttgatttgccttagtgcatgtggagaaaccatggacaacctcaatcttaataaacacatttccggccagtttaacgcagagctggaaagcattcgcacccaggtgatgaccatgggcggcatggtcgagcagcagctttctgatgcgatcacggcgatgcacaaccaggacagcgagctggcgaagcgcgttattgaaggcgaccacaacgtcaatatgatggaagtcgccatcgacgaagcctgcgtgcgcatcattgcgaagcgtcagccgacggcgagcgacctgcgtctggtgatggcgatcatcaaaactatcgccgagctggagcgtattggtgacgtggcggataaaatctgccgcaccgcgctggagaaattctcccagcagcaccagccgctgctggtgagtctggagtctctcggtcgccacaccgtgcagatgctgcacgacgtgctggacgctttcgcgcgcatggatctggacgaagcggtccgtatctaccgtgaagacaagaaagttgaccaggaatacgaaggcatagtgcgtcagctgatgacctacatgatggaagattcccgtaccattccaagcgtactcaccgcgctgttctgcgcgcgctcaatcgagcgtattggcgaccgctgccagaacatttgcgaatacatcttctacttcgtgaaggggcaggatttccgacacgtgggcggcgacgagctggacaagctgctggcgggcaaagatccgaaagagtga

SEQ ID NO: 2720 - DNA, 399 bp, Enterobacter cloacae
  unsure (10)
ggagcgatgnaccttccattcgcctgggtcaagacgtctatggagcggggcgtatttatcctcattctgttctacagcatcaaaatgaaaggcgtaagcggctttgtgaaagagcttaccttgcagccgttcaaccactgggcgtttattccggtcaacctgatcctggaaggcgttagcctgctgtccaaacctgtttcactgggtctgcgactgttcggcaacatgtatgcgggtgagctgattttcattctgatcgcgggtcttctgccgtggtggtcacagtggattctgaatgtgccatgggccattttccacatcctgatcattacgctgcaagcctttatcttcatggttctgacgatcgtctatctgtcgatggcgtctgaagagcactga

SEQ ID NO: 2721 - DNA, 555 bp, Enterobacter cloacae
actgtaaggagggaggggctgatgtctgaatttgttacggtagctcgcccctacgccaaagcagcttttgactttgctgtcgaacaccaaaatgtcgatcgctggcagaatatgctggcgtttgccgctgaggtgacgaaaaacgaacaaatggccgagttgctttctggtgcgttagcgcctgaaaccctcgccgcgtcgtttatcgccgtgtgcggagagcaactggatgccaacggccagaacctgattaaggtgatggcggaaaatggtcgtctccgtgtgctcccggatgttctcgagcagtttgagcacttacgtgcccttagtgaagctaccgctgaagttgaagtaacttccgcgactgaactgagtgacgaacagcttgcgaaaatcaccgccgcgatggaaaaacgtctgtcacgcaaagttaagctgaattgcaaaatcgataagtctgtaatggcaggcgtaatcatccgctcgggtgatatggtcattgatggcagcgtacgcggccgtcttgagcgccttgcagacgtcttgcagtcttaa

SEQ ID NO: 2722 - DNA, 1554 bp, Enterobacter cloacae
ggggactggagcatgcaactgaattccaccgaaatcagcgaactgatcaagcagcgcattgctcagttcaatgttgtgagtgaagctcacaacgaaggtactattgtttctgtaagtgacggtgttatccgcatccacggcctggccgattgtatgcagggtgagatgatttccctgccgggtaaccgttacgctatcgcactgaacctggagcgcgactccgtaggtgccgttgtgatgggtccatacgctgacctcgccgaaggcatgaaggttaagtgtactggccgtattctggaagtgccggttggccgtggcctgctgggtcgcgttgttaacaccctgggtgcgccaatcgacggtaaaggtccggttgagcacgatggcttctcaccaatcgaagttatcgcaccaggcgttatcgaccgtcagtcagttgatcagccagtacagacgggttataagtccgttgatgccatgatcccaatcggtcgtggtcagcgtgaactgatcatcggtgaccgtcagaccggtaaaaccgcgatggcaatcgacgccatcatcaaccagcgtgactccggcatcaaatgtgtgtacgtggctatcggccagaaagcgtccaccatttccaacgtggttcgtaaactggaagagcacggcgcactgtctaacaccatcgttgtggtagcaaccgcgtctgaatctgctgcactgcaatacctggcaccatacgccggttgcgcaatgggcgaatacttccgtgaccgcggtgaagatgcgctgatcgtatacgatgacctgtctaaacaggctgttgcttatcgtcaggtttccctgctgctccgtcgtccaccaggacgtgaagcattcccaggcgacgtattctacctccactctcgtctgctggagcgtgcttcccgcgttaacgcggaatacgtcgagaacttcaccaaaggtgaagtgaagggtaaaacaggttctctgaccgctctgccgatcattgaaacccaggcgggtgacgtttctgcgttcgttccgaccaacgtaatctccattaccgatggtcagatcttcctggaaaccaacctgtttaactccggtattcgtccggcggttaacccgggtatctccgtatcccgtgtgggtggtgctgctcagaccaagatcatcaagaaactgtccggtggtatccgtaccgcgctggcacagtatcgtgaactggctgcgttctctcagttcgcatccgatctggacgaagcaacccgtaaacagctgagccacggtcagaaagtgaccgagctgctgaagcagaaacagtacgcgccaatgtctgttgctcagcagggcctggtactgttcgcggctgaacgcggttacctcgaagatgtggaactggcgaaaatcggtagcttcgaagccgctctgctggcttacgtcgaccgtgatcacgctccgctgatgcaagagatcaaccagaccggtggctataacgacgaaatcgaaggcaagctgaaagctatcctcgattccttcaaagcaacccaatcctggtaa

SEQ ID NO: 2723 - DNA, 915 bp, Enterobacter cloacae
tcgtccggcggcttgtctcaggacaagccgtctggcattgaggagaagctcatggccggcgcaaaagagatacgtagtaagatcgcaagcgtccagaacacgcaaaagatcactaaagcgatggagatggtcgccgcttccaaaatgcgtaaatcgcaggatcgcatggcggccagccgtccttatgcagagaccatgcgcaaagtgattggtcaccttgcaaacggtaatctggaatataagcacccttacctggaagaacgcgacgttaagcgcgtgggctacctggtggtgtcgactgaccgtggtctgtgtggcggcttgaacattaacctgttcaaaaaactgctggcggatatgaaaggctggtccgataaaggcgttcagtgcgatctggcactgattggctctaaaggcgtctctttctttaactccgttggtggcaacattgtcgctcaggtgaccggtatgggtgataacccgtccctgtccgaactgatcggcccggttaaagtgatgttgcaggcctacgatgaaggccgtctggacagactgtacgttgtcagcaacaaatttattaacaccatgtctcaggtgcctacgctcactcagatgctgccgttaccggcatcagaagatgacgagctgaaacagaaagcctgggattacctgtatgaacccgatccgaaaccgctgctggataccctgctgcgtcgttacgttgaatctcaggtttatcagggcgttgtagaaaacctggccagcgagcaggccgcacgaatggtggcgatgaaagccgcgaccgataatggcggcagcctgattaaagagctgcagttggtttacaacaaagctcgtcaggccagcattactcaggaactcaccgagatcgtctcgggggccgccgcggtttaa

SEQ ID NO: 2724 - DNA, 432 bp, Enterobacter cloacae
tcggagggtgatatggcaatgacttaccacctggacgtcgtcagcgcagagcaacaaatgttctctggtctggtcgagaaaatccaggtaacgggtagtgaaggtgaactgggtattttcccgggtcacgcaccgctgctcaccgccattaagcctggtatgatccgcatcgttaaacagttcggtcatgaagagtttatctatctgtccggcggcattcttgaagtgcagccaggcagtgtgaccgttctggccgataccgctattcgtggccaggatctcgacgaagcgcgagccctggaatcgaagcgtaaggctgaagagcacattaacagctctcatggtgacgtggattacgctcaggcgtctgcggagctggccaaagcgatcgcgaaactgcgcgttatcgagttgaccaaaaaagcgatgtaa

SEQ ID NO: 2725 - DNA, 1425 bp, Enterobacter cloacae
aattttaagcatcaaacgtttttacttctcacacaaactaccgtcaggatgcgtatgttaaacagtgcgatgagcgtggtgatccttgccgcaggcaaaggtacccgcatgtattccgatctgcctaaagtgctccacacgctggcaggaaagccaatggttcagcatgttattgatgcagcgaatgaattaggcgccagccaggtgcatctggtttatggacatggcggcgatctgctgaaaaaaacgctgcgtgacgacaatctcaactgggtgcttcaggcagaacagctgggtacgggtcatgcaatgcagcaggctgcacccttcttcgctgatgatgaagatatcctgatgctctacggcgacgtcccgctgatctccgttgaaacccttactcgcctgcgtgaagccaaaccgcagggtggcatcggtttgttgaccgtcgtgctggacgatccaaccggctatggccgcattacgcgtgaaaacggcaacgtgacggggattgttgagcataaagatgccactgacgaacagcgccagattcaggagatcaacaccggcatcctgattgcgaacggtgcggatatgaagcgctggctgtccagactcaacaataacaacgcgcagggtgaatactacatcaccgacatcattgcgatggcttaccaggaagggcgtgagattgctgccgttcatccggcgcgtatcagcgaaacggacggggtaaacaaccgtctccagctttcccgtcttgagcgtatttaccagtccgagcaggcagaaaagctgttgctcgcgggcgttatgctgcgcgatccggcgcgtttcgatctgcgtggcacgctgacccacgggcgcgacgttgaaatagatactaacgttatcctggaaggtaacgtcacgctgggcaaccgcgtcaaaatcggcaccggctgtgtgattaaaaacagcgcgatcggtgacgactgcgaaatcagcccgtacagcgtggtggaagatgcccatcttgaggcggcctgtacgattggcccatttgcgcgtctgcgcccgggcgctgagctgctggaaggtgctcacgtaggtaacttcgtggaaatgaaaaaagcgcgtctgggtaagggctctaaagcgggtcatctgacctatctgggcgatgcggaaattggcgacaacgtaaacattggtgcagggacgattacctgtaactatgacggcgccaataagtttaaaaccatcattggtgatgacgtgtttgtaggctccgatacccagctggtggcgcctgttaccgtgggcaaaggcgtgaccattgccgccgggacaaccgttacgcgcgatgtggccgagaacgagctggtgttaagccgcgttccgcaggtcagcaagcagggctggaaacgcccggtgaagcagaagtaa

SEQ ID NO: 2726 - DNA, 1845 bp, Enterobacter cloacae
tcaggaaatataactatgtgtggaattgttggcgcagttgcgcagcgtgatattgctgaaatccttctcgaaggtttacgtcgtctggaataccgtggttacgactcagccgggctggctgtcgttgatgcagaaggtcatatgacccgtctgcgccgtctcggtaaagtacagatgctggcccaggctgcggaagaacatccgctgcacggtggcaccggtattgcgcatacccgctgggcgacccacggtgagccatctgaaggcaacgcacacccgcatgtgtctgaacacatcgtggtcgtgcataacggcattatcgaaaaccacgaaccgctgcgtgaagaactgaaagcgcgcggctataccttcgtctctgaaaccgacaccgaagtgattgctcacctggtgcactgggagctggcaaagggcggtacactgcgtgatgcggtgctgcgcgctatccctcagctacgtggtgcttacggtacggtgatcatggattcccgcgacccgtccacgctgctggccgcgcgttccggtagtccgatggtgattggtctgggcatgggtgaaaactttatcgcttccgaccagctggcgctgctgccggttacccgtcgctttatcttcctggaagagggagacattgccgaggtgacacgtcgcagcgtgaccgtattcgacacaaaaggcgagcaggttaagcgtcaggagatcgaatcaaacctgcaatacgacgcgggcgacaaaggtgcttaccgtcactacatgcagaaagagatctacgaacagccaaacgccattaaaaacaccctgactggtcgcatcagccatggtgaagtggatctgagcgagctgggcgccaatgccaacgaactgctgagcaaagtcgagcacattcagatcgtggcctgcggcacctcctacaactccggtatggtctctcgctactggtttgaatctctggcgggcgtgccgtgcgacgtagaaattgcgtctgagttccgctatcgcaaatctgccgtacgtcgtaacagcctgatgatcaccctttcccagtcaggtgaaacggcagataccctggcggcgctgcgtctgtctaaagaactgggttacctcggctcgctggccatttgtaacgtgccgggctcttcgctggtacgtgaatccgatctggcgctgatgaccaaagcgggtaccgaaatcggcgtggcttccaccaaagcgtttactactcagctgaccgttctgctgatgctggtggcgaaactggcgcgtctgaaaggccaagatgcttccgttgagcatgatatcgttcacggtctccaggcgctgccaagccgtattgaacagatgctctctcaggacaaacgcattgaagccctggcggaggatttctccgacaagcatcacgctctgttcctggggcgcggcgatcagtatccgatcgcgctggaaggggcgctgaagctcaaagagatctcttatattcacgctgaagcctatgcggcaggcgagctgaagcatggcccgctggcgctgatcgatgcggatatgccagttatcgtggtggcacctaacaacgaactgctggaaaaactgaaatctaacatcgaagaagtgcgcgcccgtggtggtgttctgtacgtctttgcggataaagatgccggtttcgccagcagcgacaacatgcacatcatcgagatgccgcatgtggaagaggtgattgcgccgatcttctacaccgtaccgctgcaactgctggcttatcacgtcgcgctgatcaagggcaccgacgtagaccagccacgtaacctggcgaagtccgtcaccgtagaataa

SEQ ID NO: 2727 - DNA, 786 bp, Enterobacter cloacae
ggaaatgagtcaatgagtatggttgatactgccccgggtaagattcaggttcgtgatttgaacttctactacggcaaattccatgccctgaagaatatcaatctggatatcgcgaagaaccaggtaacggcattcatcggtccgtccggctgtggtaaatccacgctgctgcgcacctttaacaaaatgtattcgctctatccggagcagcgcgcagaaggtgaaattctgctggacggtgacaacatcctgaccaatacccaggatatcgccctgctgcgtgcgaaagtggggatggtattccagaaacccacgccgttcccgatgtcgatctatgacaacatcgcctttggtgtgcgtctgtttgagaagctctcccgtgcggatatggacgagcgcgtgcagtgggcattgaccaaggccgcattatggaacgaaaccaaagataaacttcaccagagcgggtactctctctccggtggtcagcagcagcgtctgtgcattgcgcgcggtatcgccattcgcccggaagtcttgctgctggatgagccgtgctcagccctggacccgatctcaaccgggcgtatcgaagagctgatcaccgagctgaagcaggattacaccgtggtgatcgtgacccacaacatgcagcaggctgcacgttgttctgaccacacggcgtttatgtacctgggcgagttgattgagttcagcgatacggatgcgctgttcacccgtccggcgaagaaacaaaccgaagattatattactggccgctacggttga

SEQ ID NO: 2728 - DNA, 1377 bp, Enterobacter cloacae
gatagcgacgaattttccctccttgttcggaaattgatgatgagtcaacaacacactacccagacgtctggtcaggggctgcttgagcgcgtgttcaaactgcgcgagcacggcacaacggcacgcaccgaagtgatcgccggttttactaccttcctgacgatggtctatatcgttttcgttaacccgcaaattctgggcgtggctggcatggacaccagcgccgtcttcgtgaccacctgtctgatcgcggcgcttggcagcatcctgatgggcgttttcgctaatctgcccgtggcgctggccccggcaatgggtctgaatgcgttctttgcgttcgtggtggttcaggcgatgggcctgccgtggcaggtcgggatgggcgctattttctggggcgcggtcggcctgctgctgctgaccatcttccgcgtgcgctactggatgattgcgaacattcccgtgagcctgcgcgtgggtatcaccagcggtatcggtctgtttatcggcatgatggggctgaaaaacgctggcgttatcgtggcgaacccggaaacgctggtgagcattggtaacctgacctctcacagcgtgctgctgggcgtgctgggcttctttatcatcgcgatcctggcgtcgcgcaacatccatgctgcggtgctggtctctatcattgtgaccacgctgctgggctggatgctgggtgacgtacattacaacggtatcgtctctgcgccaccaagcgtctctaccgtgattggccacgttgatctggcgggctcgctgaacctgggtctggccggggtgattttctccttcatgctggtcaacctgtttgactcctccggtacgctgattggcgtgaccgacaaagcgggtctggcggatgaaaaaggcaaattcccgcgcatgaagcaggcgctgtatgtggatagcatctcgtccgtcgctggctctttcatcggcacctcgtctgttaccgcttacattgaatcctcttccggtgtgtccgtgggcggtcgtactggcctgacggcggtagttgtgggtctgctgttcctgctagtgatcttcctctctccgctggcggggatggtgccaccatacgcggcagctggcgcgctgatttacgtcggcgtgctgatgacctcaagcctggcgcgcgtgaagtgggaagatttgacggaagccgttccggcgtttattaccgcggtgatgatgccgttcagcttctcgatcaccgaaggtatcgcgctgggctttatctcttactgcgtgatgaagatcggtaccggccgcttccgcgaactcagcccgtgcgtgattattgttgcgctgctgtttgtgctgaagattgtgtttattgattcacactaa

SEQ ID NO: 2729 - DNA, 480 bp, Enterobacter cloacae
ccattcacatcgctgatgcccagcgtttcgccggtaacgtcggccttgttgcgcaccacggtgatcggcagtttagccgggagacgggcgataaagtctggccagatttcagccgggtcaacggcgtcggttgtggtgccgtccaccataaacagcacgcggtcggcctgctcgatctcctgccaggcgcgttcgataccgatacgctcgacttcatcgctcgcatcgcgcaggccagcggtgtcgatgatgtgcagcggcattccgtcgatgtggatatgctcgcgcagcacgtcgcgggtggtgccggctatgtcggtgacgatcgccgcttcacggcccgccagggcgttcagcaggctcgatttcccggcgttggggcgtccggcaatgaccaccttcatgccttcacgcagcaggctgccctggcgcgcttcggcgcggacggcatcgagatcgttcatcacctggttgagctga

SEQ ID NO: 2730 - DNA, 258 bp, Enterobacter cloacae
aacaaactggagactgtcatggaaaacctgaatatggatctgctgtacatggctgccgctgtgatgatgggtctggcggctatcggtgctgcgatcggtatcggcatcctcgggggcaaattcctggaaggcgcagcgcgtcaacctgatctgattcctctgctgcgtactcagttctttatcgttatgggtctggtggatgcaatcccaatgatcgctgtaggtctgggtctgtacgtgatgtttgctgtcgcgtag

SEQ ID NO: 2731 - DNA, 507 bp, Enterobacter cloacae
aaccccaagccacagaaatttaagaggtattgtgctgtgaacatgaacgcaacaatcctcggccaggccatcgcgtttattctctttgtctggttctgcatgaagtatgtatggccgcctttaatggctgccatcgaaaaacgtcagaaagaaattgctgacggtctggcttccgcagaacgcgctaagaaagatttggaccttgcacaggccaacgcgacagaccagctgaaaaaagcgaaagctgaagctcaggtaatcattgaacaggctaacaaacgccgttctcagatcctggacgaagccaaagctgaagcagaacaggaacgtactaagatcgtgacacaggctcaggctgaaattgaagctgagcgtaaacgtgctcgtgaagaactgcgtaagcaggttgcgattctggctgttgctggcgccgagaagatcatcgaacgttccgtggatgaagctgctaacagcgacatcgtggacaaacttgtcgctgaactgtaa

SEQ ID NO: 2732 - DNA, 1506 bp, Enterobacter cloacae
ttaaagagctgcagttggtttacaacaaagctcgtcaggccagcattactcaggaactcaccgagatcgtctcgggggccgccgcggtttaaccaggtttacgaattacgtagaggattcaagatggctactggaaagattgtccaggtaatcggcgccgtggtggacgtcgagttccctcaggacgccgtaccacgcgtgtacgacgcgcttgaggtacagaatggtaacgagagcctggtgctggaagttcagcagcagctcggcggcggtatcgtgcgtaccatcgccatgggttcttccgacggtctgcgtcgtggtctggaagtaaaagaccttgagcacccgatcgaagtcccggtaggtaaagcaacactgggtcgtatcatgaacgtattgggtcaaccaatcgacatgaaaggcgacatcggtgaagaagagcgttgggctatccaccgcgcggcaccttcctacgaagagctgtccagctctcaggaactgctggaaaccggcatcaaagttatcgacctgatgtgcccgttcgcgaagggcggtaaagttggtctgttcggtggtgcgggtgtaggtaaaaccgtaaacatgatggagctgatccgtaacatcgcgatcgagcactccggttactccgtgtttgcgggtgttggtgaacgtactcgtgagggtaacgacttctaccatgaaatgaccgactccaacgttctggacaaagtttccctggtttacggccagatgaacgagccaccaggaaaccgtctgcgcgttgcgctgactggcctgacgatggctgagaagttccgtgacgaaggccgtgacgttctgctgttcgttgataacatctaccgttacaccctggccggtactgaagtatctgcactgctgggtcgtatgccttcagcggtaggttatcagcctacgcttgcggaagagatgggtgttcttcaggaacgtatcacctctaccaaaactggttctatcacctccgttcaggcggtatacgtacctgcggatgacttgactgacccatctccagccaccacctttgctcacttagatgcaaccgtggtactgagccgtcagatcgcgtctctgggtatctacccggccgttgacccgctggactccaccagccgtcagctggatccactggttgttggccaggagcactacgacaccgcgcgtggcgtacagtccctgctgcaacgttatcaggaactgaaagacatcatcgccatcctgggtatggatgaactgtctgaagaagacaaactggtggtagcacgtgcgcgtaagatccagcgcttcctgtcccagccgttcttcgttgcggaagtattcaccggttctccaggtaaatacgtttccctgaaagacaccatccgtggctttaaaggcatcatggaaggcgaatacgatcacctgccagagcaggcgttctacatggttggttccatcgaagaagccgtggaaaaagccaaaaaactttaa

SEQ ID NO: 2733 - DNA, 696 bp, Enterobacter cloacae
ggacattggattatgccagggcgtatagtgaatgtattattagcgtgttgtcttacgggtatttctacaatggcatcggcaggtgtggttatcggtggcacacgagtggtttattcgagtgataaatccgacgcaaccattactgtcaaaaataacgaagcggctatcccttatcttattcaaacatgggttgaccccttcagtaatacagggaccgcgaaaaaaccaccgtttaccgtcattccaccggtatctcgtctggaggctgggcaggaaaaaattctgcgcattatgaaaaccgagggcaatttaccgcaggatcgggagtcggtgttctggctgaacatcaaaaatattcccccggcgagcaataagccgaacgcgatggaaatcgccattaagacacgtatcaagctgatctggcgtccggcctcgttgaacattaccccggagcgcgccgccacgcaggtgaagtggcacagagaaaatcggcagctggtagttgaaaatcccacgccgctaaatatcaacgttatgaatgtgacagtggacggcaaagatgtgccgctcaatatcgtccatccctttgaaaccctgcgtttacccttaccggaaggcgtgaatggccatgcgctggtttggcggtatgtgaatgatttcggtgcgattagtcaggatttaaaagcagcgctttaa

SEQ ID NO: 2734 - DNA, 2538 bp, Enterobacter cloacae
gcaaaggatggtttatttatggagtgttaccgtattttcatcgcgcttgcttccgggatggtgcttggtttatccggcgaggtggccgcgagggatatgtttaaccctgcgctgcttgaaatcgatcatccggtggacgtggatatccaccagtttaatcgcgcgaacagtctgcctgccgggaactataaggtcagcatctatgtaaacggcgaatatgttgaccgccgggaggtgacctttgtcgaagatactgccaccagcaacctgcatccttgcttctcagacatcaaaaccgtgctcgctgagcttggggtcaaagtggcggctatcaaggcccttaacgacatagatgacaaagcctgtctggaccccgcgccgctcgttcctggctcaacctggacgtttgatacggataaactccagcttaacgtcacgttgccgcaaatctatattgatgtatcggcgcgcggctatatcaatccctcacgctgggatgagggcatcaatgcgctgatggtgaactacgatttttccggctccagcacggtgcattcgaacgaggatgataacaacgatttttattatctgaacctgcgcaacggtgccaacctgggggcatggcgtttacgtaactacagtacgctaaacgtgaccgatggcgagtcttcgtatcattcgatcaatacctatttacagcgcgatatcgccgctttacgcagccaaattatgctgggggatacatggaccgcaagcgacgtgtttgacagcacgcaactgcgagggatgcgtctctacacggatgatgacatgctgccttcgagcctgacggggtttgcgccagtggttcgcggcgtggcgaaaagcaatgcgaccgtgattgtgcggcaaaacggttacatcatttaccagtctgccgtaccgcagggagcgtttgcgctcaaggatttaaacaccaccaattcgggtggcgatctggatgttaccatcaaagaagaggatggcagcgagcaacattttacccagccttacgcctcactggcgatcctgaagcgtgaagaccaaaccgatgtcgatatcagcgcgggtgaactgcgcgatcaaaacgattttcagccgaccgtttttcaggcgcaggtgttacacggttttcctgcgggtattaccctctacgggggcgtgcagggaaccagcgattacacctccgccgcgcttggcgtggggaaagatatgggttcgctgggcgccctttcgctggacgtaacgcatgcccgctcgcggtttgaggacgatgacgaaagcgggcaatcttaccgttttctctattccaaacgttttgatgaaacgaacacaacgtttcggctggtgggctaccgctactccacagagggctactacaccctgaacgaatgggcgtcccggcagaataacgagagcgacttctggacgacaggtaaccgccgtagccgtctggagggaacatggacgcagacctttggcgacgggatgggaaatatttatcttacccttagccgccagcagtactggaagacggatgaagtcgagcggctggtgcagctgggctacagcaatagctggcgcgctatttcctggaacgtctcctggaactacaccgattcactcacctcggcccaaaatagcaccgacactgacgtcagcgacagtcagggcagcgaacagatttttatgctctccctctccataccgttgtcaggctggctgcatgacagctacgtcaactatgggtacacccaaaacaaccacggaaaagggatgcaccaggtggggctgagcggtaacgcgctggatgcgcacaacctctcctggaacgttcagcagtcttacgatgcggataacgaagattacaacaacagcgcaggggtgggctatgacggcacctatggttcggtaaacgccagttacgactatacccaggacaaccagcgcctcaactatggaatgaagggcgggattctggcccacagcgatggcataactttctctcaggaactgggggaaaccgtcgcgctggttaaagccccgggagcttccggcctggcgctggagaatggtacgggtaaggcgacggactggcgcggctatacggtacagacgcagctcaacgcctacgatgaaaacagagtggagatcgacagcgattactttgcgaaggccaacgtcgaaatcgacaacagtatcctcagcgttatcccgacgcgcggcgcggtggtacgggcggagtttgtcactcacgtgggctatcgcgtcctgttcaatgtgcggcagaagagtggcaaaccggtgccgtttggcgccatggcctcggctgatttaccccacggcagcgtaaccggcattgtgggcgaaaatggcgagctttatctgtccggcatgccggaagagggggcgtttgtcctgaagtggggcgcagataacacgatgacctgcccggttaactaccactttaccccgccagaaggcgtcgaactgatacaaatatcggcagtatgccaatag

SEQ ID NO: 2735 - DNA, 1086 bp, Enterobacter cloacae
ggaaataagatgaaattcaggacacctctgtttttaagcgcgttgataatatttatgacgccagtatgcaaagcgtacaccacgggcgacgggatttgtcactccgaaggtggcgcttatatctataaccttaatctgaacgggcagtcgatcccggcggataaaaataaagcaggtacagagatcagggatctggaaacgctcagttcatctgcgagttacaaagcgcaatgcaactgtcttacgcattactctacgggctttcgccaaatctactacaccgcacgatcgtcgttaagtgaagatgtggtaaagaacgggtatacctattttacccttaataacaacctcagcatcgccacgtcgatacttgtgctcggcagagattatataccggtacctttcagcgcagaaccaaacgtaatgtctcatagctcctattgttatgcgcctggtgaggaagggagcgaaccaacactcaataccggttcaaaaataaaaatatcattcttaattaacaagccgtttattggccgggtgagtgtgccaggtacgatagtcgccgatctttatggcgggctggatgcggcctcctcgacctccagcaccgaaaaaatggcagagatcaaaatcgctggcgatatcgtcgtgccgcaaaactgcgagatagcgcccgggcagacgcttgagatagattttggcaaaatcccggccccggaattttccgctaccaaaggcaccgccgtgacgagtcacaaggtaaaaaagacgattcaggtacagtgcacaggcatgctggatgagaatattgtctactccactttccatggagaccctgtcgacgccgatgccacgatgatgaaagtcaacggcaatgatgatgtaggcattgtggtatacgacaagtgggatcgtcaggtcagcgtcaacggcggcaggatggacatggataggggagaaaacaataacggcgccgaaaacaattcgcttaccttttccgctgcgcctgcaagcgcaacgggggcgcagccaaaacctggaacgtttgaagcgtacgcaacggtcacgctggaaattgaacattaa

SEQ ID NO: 2736 - DNA, 1074 bp, Enterobacter cloacae
acaatgatttacgaaatccttgcaggagacattatgaaagttatgcgtaccactgtcgcaactgttgtcgccgcgaccttatcgatgagcgctttctctgccttcgcagcagcaagcctgactggcgctggtgcaaccttccctgcgccggtgtatgccaaatgggcggatacctaccagaaagagaccggtaacaaggtcaactatcagggtatcggctcctccggtggcgtaaaacaaattaccgcgaataccgttgatttcggcgcatccgacgctccgctgtctgatgagaaactgaatcaggaaggcctgttccagttcccgaccgtgattggcggcgttgtgctggctgttaacatccctggcctgaaatcaggcgagctggtgctggacggcaaaaccctgggtgacatctacctgggcaaaatcaaaaaatgggatgacgaagccatcactaagctgaacccgggcgttaagctgccttcgcagaatatcgcggtggttcgtcgtgctgacggctctggcacctctttcgtgttcaccagctatctggcgaaagtgaacgaagagtggaaatctaaagtcggttccggctctaccgttaactggccaaccggtctgggcggtaaaggcaacgacggtatcgcagccttcgtacagcgtctgcctggctctatcggctacgtagagtacgcctacgctaagcagaacaatctggcctacaccaaactggtttctgccgacggcaaaccggttagcccgaccgaagagaacttcgccaacgccgccaaaggcgctgactggagcaaatccttcgctcaggacctgactaaccagaaaggtgaagacgcgtggccaatcacctctaccaccttcattctggttcacaaagagcagaagaaaccagagcagggcgcagaagtgctgaagttcttcgactgggcatacaaaaacggcggcaaacaggctaatgacctggattacgccagcctgccagacagcgtggttgagcagattcgtgctgcatggaaaaccaacgtgaaagacagcagcggtaaagcgctgtactaa

SEQ ID NO: 2737 - DNA, 909 bp, Enterobacter cloacae
aaacgagggggcacgctaatggcaactctcgatatgcaaaataccgctcagcttgcggaatcccgtcgcaaaatgcagtcaaagcgccggattaaaaaccgcattgcgctgacgctttccatggccacgatggcgttcggcctgttctggctgatctggatcctgatgtcaaccatcacccgcggcatcgatggaatgtccctggcgctgttcacggaaatgacgccgccgccgaacacggcgggcggtggtctggcaaacgccctggcgggtagcggcctgctgatcctgtgggcgaccgttttcggtacaccgttgggcatcatggcgggtatctatctggcggagtatgggcgcaagtcctggatcgctgaagtcatccgctttattaacgacattctgctttctgccccgtcgattgtcgtgggtctgtttgtttacaccatcgtggtggcgcaaatggaacacttctccggctgggcgggtgtgattgcgctggcgctgttgcaggtgcctatcgttattcgtactactgaaaacatgctgaaactggtgccggacagcctgcgtgaagcggcttacgcgctgggcacgccgaaatggaaaatgatttcggcgatcaccctgaaagcgtccgtctcggggatcatgaccggtatcctgctggctatcgcccgtatcgccggtgaaaccgcaccgctgctgtttaccgccctctccaaccagttctggagcacggacatgatgcagccgatcgccaacctgccggtgacgatctttaaatttgcgatgagcccattcgcggaatggcagcagctggcctgggccggggtgctgatcatcaccctttgcgtactgttgctgaacattctggcgcgcgtcattttcgcgaagaagaaacacggttaa

SEQ ID NO: 2738 - DNA, 303 bp, Enterobacter cloacae
tctttgccgttcagggtcaaggtaatcacatcgcccgcctgcgcgcccgtcaccttgccggtgacaatcagcgcctggccgtgctcggcaatattaacaatgtcgtcgcccgccacaatgtcgaaggtaatctgcggcacggtagtgtcgaccagcacggacgcccctgcactggccgggttgcccgctttatcggacacggtcaccgtgaccgccgcgctgccgtcggcgatccccgccagatccgccgccggtacgtccagcgtccagctgccgtttgcctgcacctgggcggtgtactga

SEQ ID NO: 2739 - DNA, 2181 bp, Enterobacter cloacae
acaggacgtagcattatgaagacacatccacagtacgaaccctggttgcagggcatgctcatcatcgcgaaatattatcggctggatttttcggcggagcatgttcgggtcacgattaaccatgaaagccagtcgccacgccagctggtgctggaggagatggcgcgccagcttgggctggggatgcggtgggtggcggcggaagccctatcgctcgatccctggcgtttaccgctgctggcggagtttaccggcgggcaaattgcggtcatcaaccgtatggacaacgatgggaacgtcagcgtgcagtttagcggcgacggcggcctggagacaacgctgacgcgggacgagctcggttcgcggttaaaggggctgatggtgctgcgtcccctggagtccacgccggatgcgcgcgtggatgattacatcaaaccctatgagaaaaactggttctggcagctggcgctgaaagactggcgtcgttacagcgatattatgctggtggcgctggtcgccaacgtgctggcgctttccggcatggtcttctccatgcaggtctacgacagggtggtaccgtcgcagtcagaagccacgctgtgggtgctgtttggcggcgtgatgattgccatcgtgttcgaattcatcatgcgcatgctgcgcgtgcacatttctgacgtggtggggaagcgcgccgatctgcgcatctctgaacgcgtctttgcccacgcgctgcggattaaaaacggcgcacgctcgaaatcaaccggatcgtttatcgcgcagatccgcgagctggaatcggtgcgggagctgatcacctccaccaccattgccgctatctccgatctgccgttcttcctgctgttcgtcttcatcctgtggatgataggcggcccgctggtgctggtggtgctgctggccgtaccgctgctgctcattcccggcctgctggtgcagcgcccgctggggaaactctcgagcgaagggatgcgtgaatcggcgattcgcaacgccacgctggtggaagcggtgcaggggcttgaggacatcaagctgatgcgcgctgagcagcggttccagaaccagtggaataacaccaatgacgttgccgccagcgtcggcatgaagcagcgctggctgacggggctgctgctaacctggacccaggaggtgcaatctatcgtctacgccgtggtgctgctggtggggtgttacctggtcatcagcggtgacatgaccaccggtgcgctggtgggcacctcgattctggcgtcccggaccattgcgccgctgtcgcaaatttctggcgtgctttcccgctggcagtcagcaaaggtggcccgcaagggactggatgacctgatgcagcgcccgattgacgatccccagcacggaaagaaggtgcataaagcccacctgcgcggtgattatctgctggacgacgtggggttttattacgacgaagaagagaagctcaccgtgctgaatatcagcaaactacgcattcgcgccggggagcgcgtggcggtgctcgggcggaatggttcggggaaaagcaccttgctgcacctcctcgcgggaatgcaggagccgcagcagggcagcattttgctggacgatattgctctcaatcatcttgacccggccgacgtgcgccgcgatatgcagttgctcagccagcaggcacggctgttcttcggctccgtacgcgacaacatcctgatgggtaatccgctggcgacagacgaggaaatccatcaggcgctggtcaacagcggcgcgctggagtatgtgcgcaagcagaaaatggggctaaacaccatcatcaacgagggcggaacggggctttccggcgggcaacgtcaggcgctgctgctggcgcgcgcgctgatcacctcgccgaatattctgctgctggatgaacccaccgcctggctggatgaggtcagcgagaagcagtttatccagcatctgcaccagtggctcggtaagcgccggacgctggtggtggcgacgcatcgcctgccgattctggacctggttgaccgcatcatcgtcctggaaaacggcaaagtggtgatggatggccctcgtgatgccattttacgccagcacggaatggccccgcatcaggcgccgcagcgtacggttaaactgaaaacggagggcgtggcatga

SEQ ID NO: 2740 - DNA, 18048 bp, Enterobacter cloacae
accgcaaaagttgttgatgtcatcattcgcaaaacggcagagaagacgaaattaaccggtgaagggaatctctcggtttctatttcctcaccgagcgtgattgaaattcagggttctgctcaggacgtggtgcgttatgtccgccaggggaatgacctcctcatttatatgaaagatggcagcgtgatccgctgcaataattattttgtcgaagacacggaaacccataatcattccgaactggtatttaacgataaccaggcgttgacgcatatttcatttgccgatgccggcgaagcatcaggcgttgccgccaccgaattaaccgcccaggctgcacccattagcagcattgaacctttcctggagcagggaagcgtattaagcgatgcgccgtggggctggattgccggtgcggcgttagggggcggtgcgatcggcgcactgctggctcacggcggcgatggcgaaaccaaaacgaaggttattgataatacgaaagaagtcgaaagcgctacgccgacatttttgctgacggacaacgcgggtgacaagcagggcgtgctgagtgcaaaagaggtcacggatgacaacacccccaccttcagcggtaccgggcagccgggcgcgaccattcaggttaaagacggcagcggcagcaccatcgccagcaccatggtcgcgaaggacggcacctggacggtaacactcccgacccaggcggacggggaacatacctggtccgtcgtacagatcgacggcagtaaaacgacctctgcgggcagtattaacgtaaccgtttctacagcggataccagcgtgacgctcgccaccacggcgggtgataacgtgatcaacgccagcgaacagtccgcgggctttacgctgtccggcaccagcaaaaacctggcgcagggaacggcgcttaccgtcacgctcaacggtagaacctataccgcagaagtgggggcaaacggcgcatggagcgtgaaggtccctgctgccgacgcacaggcgctgggcgatggtacctggacggtcaacgtcagcggaaaagacgcggcgggcaacaccgtgtccggcagccagacgattggcgtggataccgcctcgccagtgatctctgtcgacacgatcgcccaggacaacatcatcaacgcggctgaacataatcagccgctgacgctgacggggaaaaccgatgcggaagcgggccagattgtgacggtcacgctgaacggcaaaaatcacacggcgaccgtgggcagcgacggcagttggtccgttacgcttccggccagtgaagtacagacgctggctaacggcgagcacaccctgacggtaaacgtcagcgacaaagcgggtaatgggtcctccatcaccgccgatttcacggtcgataccgcagcgccagtggtcactatcaacaccgtcgcgggcgacgacattctgaacaccagcgagcaggggcaggcgcagattatttccggccaggcgaacggcgcggcggagggcgacgttgtcaccgtgaccgttggcggcaagacctttaccggtgtcgtccaggcggacggcagctggagcgtcggcgtgcctgcctccgtcattggcgcgctgggggaaggtagccacagcatttcggtcgccgtgaccgatgcggcgggcaacaccggcagcgcgacgcacggcattacgctgagcggcaacccgccggaatttacccttgatcccatcagccaggataacgtcctgaatgcgcaggaggccatgcagcccctgagcctgagcgggaccagtaatctgccgaacggcagcgctgtcaccgtgacgctgaacaacgttaactatcaggccaccgttgagaacggtcgctggtccgttcaggtgccggtttccgacgtgctggatctggcgaataccctttacaccgtcagcgtcagcggcaccgacagcgtgggtaacagcggctccgccgaggcgaatctgctggtagacaccgtgctgccgcaggtgatcgtcaacacctttgccggggataacctggtcaataacgccgaagcggcggttgaccaaaccctcagtggacgcgtcaccggcgcggcggcgggcgataccgtctcagtcaccgtgggcggcaagagctacaccgcgacggttggcagcgacctgaaatggagcgtgacgatcccatcggccgacctccaggcgtttggcgacggcgatttaaccttcagcgcctctgtcactaatgcgcacggcaataccggcaccggcgaacgtgatatcaacatcaacgccgaactgccgggcctgcgcgtgaacacgatctctggcgatgacgtgattaacgccatcgagcagcagcaggatctggccgtcaccggctccagcactcatctggccgaaggcacacagatcaccgttaccatcaataatgtcgaatacgtcaccacggttaacgccagcggcagctggcagattggcgtgccggcggcggaccttcaggcatggacggcgggaggcatcaccgtcagcgtcagcgcggaagatgcctggggcaacaccgtggcggctgaacacccgatcgagcttgacctgaatgcggtggctgtcaccatcgataccgtaaccactgacgatatgctcaacgcggcagaaaaaggcgcggatgtcacgctttctggtcagacgcagggcgtggaggccgggcagaccgtggtggtgaaattcgcggatcaaacctttactgcacaggtgcagcaggacggctcctggcacctgaccgttccggcgagcgcgatggaaacgctgatcgacgggcgtgcgcaggtgagcgtcagcgtgactaacgtcaacggcaacagcgcggacgcctcacgcgtggtgatcgtcgatacgcagccgccagccattacgcttgataacctgaccgacgacaacatcattaatgcggcagaagcgcagcaggatctggtgctcagcggcagcacaaccgctgaaacgggccagacggtcaccgtgacgctgaacggtaaatcttaccagaccacggtacaggcggacggtcgctggcagctgaacgtgcctgccgccgacgtgggcgcgctgaccgatggcaatgtcaccgtgacggccaccgtcagtgacgtggcgggcaacagcagcagcgcggaccgcgttgggctggtggatgctaccgtaccgcaggtgaccatcaacgatttcgtcaccgacaccaacaccgttaaccagctggcccatgctcaggcgcagatcctgagcggctccgtcaccggcgcggcggcgggcgatttggtcaccatcaccatcaataacgtggactacaccaccgtggtggatgcggcaggaaactggagtctcggcctgcctgcgtccgtcattcaggggctgacggacggcacctggactattaacgtctccgtgaccgatcggtccggcaacaccggcagcagttcagtggatgtggtggtcaatactgtgacgcccgttatcggtattaacacgctggcagcggatgacgtgatcaatgcggcagagaagggcgaagatctgctgctttccggtaccagcaaccagccggaaggaaccaccatcactgttaatctgaacggtatcaactactccgccaccaccgacgccagcggcaactggagcgttaccgtacccgcctctgcggtgagcgcgctgggtgaagccaattacaccgtaacggcgagcgtcaccgataatgtgggcaatagcgccgctgccacgcacgatgtgctggtggacagctcgctgccggttgttaccctcaacaactttgcgggcgacaatatcgtcaacgcggcggaagtggccgcagggcaaaccctgaccggaaaggtttctaacgcggcatcgggcgataccgtcacgattatcctcggcgggcagacatacacggctaccgtacaggacgatctcacctggagcctgccgttaacccagagtcagttaaccgcgctcggcaacggcgacctgaccgtatcggccagcgtgacgaacgcgcacggcaataccggatcgtcttccctggatgtcaccattgacgcccagctgcccggcctgcgcattgataccgtcgccggtgacgacgtcattaacgttattgaacacgcgcagaacctggttatctccggcaccagcaccgacctggcggcgggtagcaccgtcaccgtgaccatcaacggcaagagttattccgcatcggtacaggcggacggcacctggcaggctgcggttccggccgccgacgtctcccggtgggcggacgggtcgctcaccatcagcgccagcgcgcaggatacctccggcaacccggtgaacatcggtaccgttgtggatgtcgatctcgccccggtggcgataagcattaacaccgtgacggacgacaacgtgctgaacgcggcagaaaaaggccagaatctggtgctgtccggctcctcctcgaacgttgaagcggggcagaccgttaccattatctttgcgggtaaaacctggaccacgacggtcgatgccaacggtgactggacctgcaccgtaccggctgccgatctgagcggcctgaaggacggcgaagccagcgtacaggtcagcgtaaccaacgtgaacggcaacgcggcctcttcctcgcaggcattcagcgtcgctaccgccgcgccagcggtcaccatcaacaccatcagcggcaacaacatgctgaatgcggcagaggcggcgcaggagctgaccctgagcgggacgtctactgccgaagcaggccagacggtcaccgtgaccttcaacggcaatcagtacaccgcccaggtgcaggcaaacggcagctggacgctggacgtaccggcggcggatctggcggggatcgccgacggcagcgcggcggtcacggtgaccgtgtccgataaagcgggcaacccggccagtgcaggggcgtccgtgctggtcgacactaccgtgccgcagattaccttcgacattgtggcgggcgacgacattgttaatattgccgagcacggccaggcgctgattgtcaccggcaaggtgacgggcgcgcaggcgggcgatgtgattaccttgaccctgaacggcaaagactacacagcgatgctggacggtgccggtaactggagcgtgggcgttccggcggcagacgtgggcgcgctggctaacggcgatcagacgatctccgccacggtcaccgataaagcgggcaacagcaccagcgcgacgcacgcgtttgacgtctccctgaccgcgccggtgattgccatcaataccctggcggttgacgacgtgatcaacgcgaccgagaaaggccaggacctgttgatctccggtaccagcaaccagccggacgggacccgcatcaccgtaaccctgaacggtatcagttacgccgccaccaccgatgccagcggtaactggagcgtcaccgttccggcggcaaacgtctcggcattgggcgaagcgagctatagcgtgacggccagcgtgaccgatactgcgggtaatagtgcgaacaccagccatagcgtgctggtcgacagcgcgctgccgcaggtcaccattaatgcggttgccaccgacgacgtgattaacgcggcggaagtggcttccggacaaaccctgagcgggaaggtgagcggtgccgcgagtggtgacactgtcacaatttcggtgggtggcaatacctacacgacaatcgtgcaggacgatttaagctggtcggttaacgtcgcgtctgacgtgttaaccgccatcggcaacggcgacctgaccgtatccgccagcgtcactaacggccacggtaataccggctccggcgagcgcgacatcacgattgatgccaacctgcctggcctgcgggtcaataaggtggcgggtgacgacgtgatcaacagcatcgaacacggacaaaacctgattatcaccggctccagcgacggtctggcagcgggttcagcattgacggtgaccgttaacggtaaaacctacgcggccaccgtactggcagacggtacctggacggccgccgttccggcagcagacgtcggcgcgctgagcgaaggcaccgtcaccgtgaccgttgaaggccagagcgcagcgggcaacccggtttctatcagccacgacgtgaaggtcgacctggcgacggttgctatcagcattgacgctatcgctaccgacgacgtaatcaatgcggcagaaaaaggcgcagatctggtgctgtcgggtgccaccaccaacgtggaagaaaaccagaccgttaccatcactttcggcggtaagacctatagcgcgacggtggatgccagcggcaactggacggcgaccgtaccgtctgccgatttaggtagcctgaaagacggcgacgccagcgtgcaggtcagcgtcaccaacgtgaacggcaacagcgcctcggcgggccgcgagtacagcgtggacgccaccgcgccgacggtgtccatcgagatcgtcagcgacaacaacatcatcaacgcggccgaagcgcagcaggatctggtcgttaacggtgtctccaacgccgaagcgggccagaccgtcaccgtgacgctgaacggcgtggactacaccaccaccgtacaggcgaacggcagctggagcgtcaccgtaccgtctgcggatatcggcgcgattaccgacggcagttacaccatcacggcagccgtcgcggataaggcgggtaacccggccttggcggaccgcgatgtgctggtggataccacggtgccacagctgaccattaacaccgtttccgacgacgacgtgatcaacagcgccgagcatgcgcaggcgctgattgtcaccggttccgtgaccggtgcggcggcgggcgacgtggtgaccgtcaccatcaataacaaagattacacggcgaccctggacgcttccggcaggtggagcgtgggcgtgcctgcggcggacgtgagtgccctgaccgccggggatcacaccatcaccgcggcgctgaccgataaagccggaaacagcaacagcacaacgcacgaggttgaagtcaacctcactgcgccggtgctgaccattgacaccgtgtccggcgacgatgtgatcaacagcagtgagaaaacgcaggatctgaccatcacaggtacggcttccgggctggccgcgggcgcggtggtcaccgtgatgctcaacggcaaagcgtacagcgccacggtggataccaatggccaatggaccacaaccgttccggcgagcgaggtggggcaactgggtgaagcgctttacaccgtgtcggcctccgcaacggacagcgtcggcaacagcaccagcacctcgcacaccgtgaacgtggaatccgtgctgcctggcgtcatcattaacgccgtggcgggcgacgacgtgatcaacgcggcggagctggcaaccggccagaccattagcggcacagtggtgaatgccgaagcgggcaacaccgtgactgtgtctgttggcggccataactacaccgcaacggtgcagagcgatctgacctggtccgtcagcgtaccggaatctgtgctcaccgcgctgggcaatggcgatctgaccgtgaccgccagcgtcacgaacggcgtgggcaacagcggcagcggagagcgcgatatcactatcgacgcgaatctgccgggcctgcgcgtggacaccgtagcgggcgatgacgtgattaacagcatcgaacacgggcagaatctgattatcacgggttcaagcgacggcctgacggcgggcacagcgctgaccgtcaccgtaaacggtaaaacctatgcagccacggtgctggcagacggcacctggagcgcggcgatcccttctgcggacgtgagtgcccttgccgcaggcgcggtcaccgtgaacgttgaaggccagagcagcgcgggcaatccggtgactatcaaccatgatgtgacggtggatctggcaaacgtcgcgatcagcattgacgccatcgcttccgacgacgtgatcaacgccgccgagaggggtgcggatctggtgctctccggcaccaccgcgaatgtagaggaaaatcaaaccgtcaccatcaccttcggcggcaagagctacaccgccacggtggacgctgagggtaaatggaccgccacggtgccgtctgcggatctggctggcctgaaggacggtgacgccagcgtgcaggtaagcgtcaccaacgtgaacggcaacagcgcgtctgcgggccgcgagtacagcgtggatgctaccgcgccgtccgtgaccatcaacacgattgccaccgacgatatcctcaacgcctcagaagcacagtccgaccttgcaatctccggcaccagcaccgccgaagcaggccagacggtgaccgtatcgctgaacggcaaagattacaccacaaccgtcagcgcgaacggcagctggacgctgaacgtgccggcagctgaccttgcaggattaaccgacggcagcgtcaccgtaaccgcgagcgtgagcgacaaggcgggtaacccggcgtcggttgaccacgccctgacggtggacgtcaccgtacctgcggtgaccatccacaccgtggcaggcgacgacgtgattaacgtggctgaacacaatcaggcgcagattatcagcggctccgccaccggcgcggcggcgggcgataaggtcaccgtcacgatcggcggccagacttataccaccgtgctggatgcggcgggtaactggagcgtgggcgttccggcgaatgtgatttcaggcctcagcgacggcaccgtgaccgtctctgtgtcagtcaccgacgcggcgggcaataccggcagcggcatgcataatgtgaccgtcgataccggtctgccatcggtcagcttcaacgccatcagcgatgacaacgtcctgaacgccgttgaaaaaggccaggatctgagcgtcagcggcaccagcgccaacctggcggaaggcacccaggtcaccgtgaccctgaacggtaaaaactacacggcgacaactgcggcagacggcacctggagcctgacggttccggctgcggatctggccggtctcggtcaggccagttacaccctgaacgcgacggccaccaacggcgtgggcaacagcgtgagcaccaccgcgaacctgcttgtcgacaccgcgctgccaaccgtcaccatcaacaccgtggcgggcgacaacgtcatcaacgcggcggaagtggccgcgggtcagaccctgagcggcaccgtggcgaatgccgaagcgggcaacaccgtgaccgtcgctatcggcggccacagctacaccgcaacggtgcagaataatctgtcctggtccgtcaacgtgccgtctgacgtgctgaccgcactcggcaacggcagcctgagcgtaaccgcgaccgtcaccaacggccacggcaacaccggcaccggcgaacgcgagatcgctatcgacgctaacctgccggggctgcgcgtcgataccgtggcgggtgacgacgtggtcaacaccatcgagcacgcgcagaacctgattgtttcaggcaccagcgacgggctggcgccgggcacggcgctgacggttaccgtcaacggtaaagattacgcggcaacggtgctggcagacggcacctggcgcgcggcgatcccgtccaccgacgtgagcgcgtggccggaaggcaccgtgaaaatcagcgttaccggtgacagcgcggcgggtaatccgatcaccatcagccacgacgtgaccgtggatctggctaccgttgccatcagcatcaatgcgcttgccaccgacgacgtgattaacgcggcggagaagggcgcggatctggtgctgtccggtgtgaccaccaacgtggaagccgggcagaccgtgaccattagtctgaacggcaggatctacaccaccaccgtggacgacagcggcaactggacttacaccgtgccgtcagcggatctggctggcctgaaggatggtgacgccagcgtacaggtgagcgtcaccaacgtgaacggcaatagcgcctcggcgggccgtgagtacagcgtggatgctaccgcgccgtccgtgaccatcaacacgattgccaccgacgatatcctgaacgccacggaagcgcagtcagacctggcaatctccggcaccagcacagccgaagcgggccagacggtgaccgtatcgctgaacggcaaagatttcaccacaaccgtcagcgcgaacggcagctggacgctgaacgttccggcggcggatctggcaggattaaccgacggcagcgtcaccgtaaccgcgagcgtgagcgacaaggcgggtaacccggcgtcggttgaccacaccctgacggtggacgtcaccgtacctgcggtgaccatccataccgttgcaggcgacgatgtgattaacgtggctgaacacaatcaggcgcagatcgtcagcggctccgccaccggcgcggcggcgggcgataaggtcaccgtcacgatcggcggccagacttataccaccgtgctggacgcggcgggtaactggagcgtgggcgtcccggcaaatgtgatttcaggcctcagcgacggtaccgcgaccgtctctgtgtcagtcaccgacgcggcgggcaacaccggcagcggcacgcataatgtgaccgtcgataccggtctgccgtcggtcagcttcaacgccatcagcgatgataatgtgctgaacgcggtagagaagggtcaggatctgcgcgtcagcggcaccagcgccaacctggcagaaggcaccgtggtggccgtgaccctcaacggcaaaaactacacggccacgacggcggcagacggcacctggagcctgaccgttccggcagcggatctgaccggtctcggtcaggccagttacaccctgaacgcgacggccaccaacggcgtgggcaacagcgtgagcaacaccgcgaacctgcttgtagataccgcgctgccaaccgtcaccatcaacaccattgcgggcgataacgtcatcaacgcggcggaagtggccgcgggtcagaccctcagcggcaaggtagcgaacgcggaggcgggcaataccgtcaccgtgaccattggcggcaacacgtacaccgcgacagtgcagagcgatctgacctggtccgtgaacgtgccggaatccgtcctgacggcgctgggcaacggcgacctgacggtgtctgcgactgtgaccaacggccacggcaacacgggaacaggcgagcgcgatatcactatcgacgccagcctgccggggctgcgcgtgaataccgtggcgggcgatgacgtgatcaacagcattgagcatggtcaaaacctgatcgtctccggcaccagtgacgggctggcggcaggcacaacgctcaccgtgaccgtgaatggcaagacctatgccgcgtcggtactggcagacggctcctggaacgcggcgatcccggcggcagacgtcgcggccttcgcagcaggtaccgtcaccgtgaccgtggcaggccagagcgcggcgggcaacccggtgaccatcagccatgacgtgaccgtcgatctggcggcggtggctatcagcattgatgcgattgccaccgacgacgtgattaacgcggcggagaaaggcgtggatctggtgctctccggcagcacctcgaacgtggaggaaaaccagaccgttaccgttaccttcggcggcaagacgtacaccgcgaaggtggatgctgacggtaactggacggccaccgtgccttccgccgatctcgcgggcctgaaggacggtgacgccagcgtgcaggtgagcgtcaccaacgcgcacggcaacagcgcctcggcgggccgcgaatacagcgtggacgcgactgcgccaaccgtgaccattgatacggtagccggcgacaacgtgatcaacggcagcgaagcggctgcgggcgtggacatttccggcaccaccacggctgaagtcggtcagacggtcaccgtgacgctgggcggaaacagctataccgcacaggttcagcagggcggcgtctggagcgtgaacgtgccgggcacagacctgtccgcactggcggataacggttacaccgtgcaggccagcgtgagtgacgccgcgggtaatccgggcagcgcggggaaagcgattacgcttgataccacgccgccgaccgtcagctttaacgttgtggcgggtgatgacgtcatcaacagcgtggagcacgggcaggcgcagatcgtcagcggcaccgcaaccggcgccagcgtcggcgataaggtggtcatcaccatcggttcgaaccagtacaccaccaccgttgacgccagcggcaaatggagcgtgggcgttccggccagcgtgatttccgcgctgaccgacggcaccgtgacccttagcgcgactatcaccgacagtgcgggtaacagcagcacccagacccacgacgtggtggtaaataccgcatcggtcgcgctgaccgtcaacaccctcagcggtgatgacgtgatcaatgcggcagaagcgggcgcgtcgctggtcatcaacggctccagcgcgcagttcgccagcggtacgcaggtcactatcaccctgaatggtaagagctatacggccactatccagagcgatggctcctggacaaccaccgtaccggccgccgacgtgggcaccctggccgacggcgcgagctaccaggtttctgtttcggcgcaggacagcgccgggaacagcgcctcggcgacgcacaccatcagcgtggacaccaccgcgccggtgattagcgtgaacacgttgtcgggcgacgatgtgctgaatgcggcggaagcgcagcagccgctgaccgtgcacggatcttccagcgcggaggcgggtcagaccgttaccgtgacgctgggaggaaaaacctacactgcgcttgtcggcagcgacggcacctggacgctcgacgtgccggcagccgacctggccgccctgagccagggcgcgctgacggtcaccgcttcggtcaacgataaagccggtaacagcggccagacgacgcataccttaacggtcgataccatcgcgccagccgtcaccattagcaccgtggccgatgacgatatcgtcaacaacgccgagcagctggcggggcagaccatcagcgggaccaccaccgcggaacagggccagacggtgaccgtctccttcaacggccacagctatcaggcgaccgtggcggcgaacggctcctggtcggtcttcgtgccggggcgtgatttccttggcctgagcgacggggattacaccattacggctacggtgagcgataaggcaggtaacccgggcagcgcaacgcacgacgtgacgcttaacggcgacgtgccgaccatcgccattaacacctttgcgcatgacgatatcgtaaatgccgccgaacatggcacgccactggttatcagcggcaccaccgatgcgccagcgggccagacggtgacaattacgcttaacggtaaaacctacacggctaccgttcaaaatgacggcacctggagctatacggtcggcagcgcagacgtgaccgcgctggcggacggcggttcgtacgtgattaacgcgcaggtgagcaacgccatcggcaacagcgtcagcgataaccacaccgtaaccgtggatctcaccgcaccgtcgatggggatcagcattgattccctgcaaaacgataccggcctcagcgcgaatgacttcatcaccaacgacagccaggtggtggtgaatggttccctgaccgcgcagctcggcaataacgagaaggcgcagatcagccttgacggcggcgtcacctggatcgacctgaccgtcaccggcaccacctggcgctacactgatggtcgcaccctgacggacggtacgtatcagtaccaggtgcgcgtgattgataacgcgggcaacgttggggcaacggacagccaggacgtggtaatcgatctgacgaagcctgcggcggcgaccattaccgtggattccgtctcgcaggatacaggcctgtccgacagcgacttcattaccagcgacaaccagatcagcctgaaagggacgctcggcgcggtcctgggcagcggcgaccacgcccagatcagcctggacggtggcgcgacctggactgacgtgagcgttagcggcctgagctggacgtatattgatggccgtacgctgaccgacggggattacaactaccagctgcgcgtgattgacgaggcggggaatatcagcgccaccaccagccaggtggtgaccattgataccgtcgcgccggacgccagcaaaacgatcgctatcgacagcatcagcgacgataccggcctgagcagcagcgactttatcactcgcgacacgtccctgaccctgcacggctcactcggcgcgacgctggccgacggcgaatatgcccagatcagcatcgacggcggcgtcacctggcagaacgtgatcgtcaccggcaacagctggtactacgtggacggccgcacgctgggtaaccagacctatgattactacgttcgcgtagtggatgcggcgggcaacgtgggtgccagcgctcatcagcaggtgacggtcgatacggtcgcgccggatgcggcgattacggtgaccgtggataacatcaccgtcgataccggtttcgataacaatgacttcctgaccagttcgacctcgtacacgctcaacgggacgctcggggccgaactcggggcgggtgagtatgtgcaggtgagcatggatggcggcaccacctgggtttacgccacggtaagcggtacccagtggcgctataccgacgcgcgcaccctgaccgacggcgactaccgctatcaggtgcgggttgtcgatcaggcgggcaacgtcggggccaccaccacccaggacgtgacggtggatacccaggcgccgcagtacggcatcaccattgacagcatcagcgaagataccgggcagtccggaagtgatttcatcaccatggacacctcgctgacgatcaacggttcgttgggcagcgcgctggccagcgacgagcgcgtacagattagcctcgacggcggcaatacctggattgacgctaccgtcactaaccagcgctggagctatacggacacccgcgatctggcggacggggattacaactaccaggtgcggatcatcgaccaggcgggcaacgtcggctcaaccacttcgcaggtggtaacggttgataccacgccgcctgatacggtgggaacggtggtcagctataccgacggggaaggcgaacgtcagggcagcttcggcgcttcggtggcaacagatgacaactctccagtgattaacgggacgcttaaccgtgcgccggacaatggcgagatcgtgcaactgtatcgtgacggtgtgctgctgggacaggtgacgatgaacggcgccgccagctggtatttccaggacagtggtctgaatgacggtaatcacgtctatatgctgcgtgttaccgatctggcaggtaacttcaccgactcagatgatttcgtgctgaaagtggatacgagcatcccgaccaccaccgtgaccattaaccctcagacgacgacagatagcaccccgattctgagtggacttgtatcggcgggactgaccaacggtgagtacgtggttatcaccgtgaacgataaaacctacacctcagagactggcggtgcggtcgtggtcgatccggataacaacacatggtatttgcagctccctgacggcgatgcgctgagcgtgaagaattatgatgttacggcacaggtgaaaagcagcgccggcaacggtaataccgctgggttgaccaccggtagcctgattgtagggagtgaagaatcattgacgccggcctggtcatttaccgccgcgaactactcctattctgccagctatatgctggattcggatgggctgtggacgattatggccaaccagcaattcgcatccgccaataccagtagccgtaacgcttacaccgtttcaggcaatttctcaatgacggggagttacacaaccggtacttacgcggatatcaaccgcgacgggctggctgacgtgctggcggaagggacaagttactcgtacatggtgcagctgattaacaatggagacggtacatacacttccagtacgctgaccaatatgggggctgcggtgtggtatggcgcggtggtcgccattgacatcaagggcgatggttacactgactttgtcatcggcgatgctggcgggcctgattccagcaccgtcatgctcaataacaacggcacgctgacgggcagttcgaagtccggtacgtactccagtttcgtatcgggatcaacggtaggtaactacaacagtctgattgaaacgtccggtgtggatttgaacaacgacgggaaagtggatattgcccagcatacgaccaacgggggcaacaactatgccctgtcgaccatgtttaaccagggcaatggctcatttacgtgggggcaaaacttcaccaataccatgtacagcggctatggttccgccgcagcgtccaatgccgtgagtatgacctgggccgactttaacggtgatggttacatggacctgtatatgagcatgtcccgtacctccagcggaaccagtcagggcggggtgttaatgctgaacgacggtagcggcaaccttctggccggcaccgcggttggaacggcgaccacggataagtttgtgggtaacgtcagcgtggcggtggactggaacctcgacggtcacatggacatcatcaagctggcgaatagcgggcagtcttatctttacaccaatgatggactggcaggtactgcaagctttactgcttcgaaattcagtaccgctacgtcaactcaggtatccggcgcggctctgcttgattacgactgggatggcgcacaggatctgctcattttccgtcaaaacggtacggttttactggagcggaataccaatacggtcgcaccaggtacggccttgcatctgaagattgtcgacagcgaagggattaacgccttctttggcaacactgtccagctgtacaacgcggcaggccagctggtcgccagtgaaatcatcaatgcccagtccgggattggcattaacgattcctcgtcgctcatcagtttttacggcctggatcccagcgagacgtatcacgcggtgctggttcgtgccgttaacggtgtttcgagtaacgtaacctgggacgggctgacggcaggagacggtaaagaaagttacgccctgacggctgaagctgctacgggcggtcaccagggcaccctgacaggtaccggctacaacgatacctttatcgctgaagcagggacgtatacctacaacggttccggtggttggacgacgacctctgaacacgacacgtggagcagtacgggcggcatggatgtcgtggattatcgcaacgccacttccggcgtcaccatcgatttaggacgctctacggcgcagagtaccggattcgataccgcgacactggtgaatattgaaggcatcaacggctccgactatgacgacgtgatcaccggcaacagcggtgataaccagttcgaaggccggggcgggaacgacaccttcaacatcggcagcggcggtcacgatacgttgctctataagctgatcaacgcgtctgacgcgacgggcggcaacggcagcgatgtggtgaacggctttaccgtcggcacctgggaagggacggcggatacggaccgtatcgacctgcgcgacctgctttccgacagcggttataccggcaccggctcggcgagctacgtcaacggcgtggcgacgctggacagcagcgcgggcaacatcgccgactacatccgcgtggtgcagaacggcagcaacaccgagatccaggttgacctggacggcaccggcggtcagttctcgcccaccacgctggtgacgctgaacggggtgcagacagatctggcgacgctgctggcgaaccaccagctgttaattgcgtaa

SEQ ID NO: 2741 - DNA, 1197 bp, Enterobacter cloacae
actgaaaacggagggcgtggcatgaatgatttctcccgctttaatagccgactgaaggagccccgcctgccgcgttcgtcgctggtggcatggtcgctgtttgccctgctggtggtgtttattacctgggccagcctgttccagctggatgaggtcacgacgggcagtggcaaggtgatcccgtcctcccacgagcaggtgatccagtccctggaaggggggattattcacagtctgatggtgcgcgaaggcgacatcgtcgagcgtggtcaacagcttgcccaactggaccggacgaaaaccgagtccagcgtgctggagagcgagtctcgattaaacgctgcaatggcgacggccgcgcgtctgaatgctgaggtgaacgacaccgggctgacattcccggcagagctggatgacgacgttgagctggtcaaacaggaaacggcgctttatcagtcacgtcgcgaaagccttgaaaaagggctggcgggtttacgccagggagcggatctcgtgcagcgtgaactggcattaacgcgcccgctggtgacgcagggggcggccagtaaggtcgaagtcttacgccttgaacgccaaaaaaatgagctggagagcaaaatcaccgagatgaaaaaccagtactacgttcgcgcccgcgaagaactggcgaaagcgaacgcagaaatagaggcgcagcgttcggtcatgaaaggacgcgaagattcactcacccgcttaacgtttaatgcgccggtgcgtggcatcgtgaaggatattgacgtgacgacggtgggcggggtgatcccgccgaacggcaaactgatgagcctggtaccgcttgatgaccagatggtgatagaagcgaaaatctcgccgcgcgatgtcgcgtttatccatcccgggcaaaaagcgctggtgaaaatcaccgcctatgattactcgatctacggcgggctggaaggggaggtgacgatgatttccccggatacccttcaggacgaggtgaaacgggatgtttattattatcgcgtttatattcgtacagacagtaaccatctgaccaacaggcagggcaaggcgttcccggtgttcccgggcatgatagccacagttgatatcaaaaccggcagtaaatccgtcattgattatctgctgaaaccgttgaataaggcaaaagaggcgctgcgcgagcggtaa

SEQ ID NO: 2742 - DNA, 783 bp, Enterobacter cloacae
cgcaaaaatgttcctgtgcataacattgataacggtttattaaccaaacagggtgcggtaaaattattcaatgcgacaaagagtattggctttaattacagatgggaatactatttgcattctcaggagcaggttatgtctcaaaatttaccttttatacaaggtacgtgctacaagcaacggtttgttatttcagcctgcggtttcaccttcgaggggtatagcctgcttctgaagtcacgtggcgtaaacgccacgcggctccattttgaagaggatgaagtttgctcaggtgatgttcataaaatgatgcaaaatcaaccacctgaagttgctgtttttcttggtcgcgacgtcgctgcctttcttgaaagcctgaagcagttggtatcggttctgaatgcgctgccggttatttgtagcgtgacgctgtatggcgcaataccagagagatggctttatgccacgttgtgtagtctcgttaataataccaaatcgttatcgatgatcaggatagcgaatatttcagacgtaatggactgtgcagacaacatttatgacgtgcataccgattcgtcacgcatattgcgtgatggacccgagaaagaaggtaaagaaagtctgaatggtttaacaaagcgcgaattaaccgtattgctgaatttttatcggggtatttcgataaaagagcagtctgcgaggttagggttgtcagataaaaccatttatacccatagaaaaaagggggttggaaaaatatatcctaaccagggttttggttaa

SEQ ID NO: 2743 - DNA, 330 bp, Enterobacter cloacae
aacagagtgatattttcgggaggtcttatggcagactttacattgtcgaaaccgatttttggcggaaaacaaccaaaaacctccacggcggggaatattgcctatgccctgtttgttctgttttgtttctgggcaggaacccaactgctgaatatgctggtgcatgctcctggcgtgtatgagcatctgatgcaggtgcaggatacaggccgcccacgcgttgaattcggtttaggcgtgagcaccgtatttggactcattcccttcctcgcgggcagcatggttctgggcgtgattgccctcgtcctgcgctggcgcaatcgccactga

SEQ ID NO: 2744 - DNA, 1335 bp, Enterobacter cloacae
cgtctatcatacggtcgatgtcacaaaatgggagccacgctgcaagtaaattgttcaaatttacccacggttacgtttttctcgctatcgttatgcaaatcgggccattgcccgacgccgattagtagtataactacccgtaactttccttattcacttgatggatgcttttcgttgaaacgttgtctgctctctatcgccgcgctgtgtgcggtgagcctgtccaccgcccaggcagcacagcctctgacggccccggttctggcctctgacattgccgatcgctacgcgaaccttatttattacggcagcggtgcgacgggaatggcgctggtcgtgatcgacggtaaccagcgggtgtttcgcagcttcggtgaaacacgaccgggaaataacgttcgtccgcagctggattccgttatccgtgtcgcgtcgataaccaagctgatgaccagcgaaatgctggtgaaactgctcgatcagggcgtggtgaaactcgacgatccgctcagcaaatatgcgccgcccggcgctcgcgttccgacatatcagggaacgccgatcagactggtgaatctggcgacccataccagcgccctgccgcgagaacagcccggtggcgctgcgcatcgccctgtctttgtctggccaacccgtgagcaacgctggaactacctgagcacagcaaccctgaaatcggccccgggctcgcaggctggctattctaacctggcgtttgatctgctggccgacgctttagcgacggcctcgggtaagccctaccctcaactgtttgaagagcagatcacgcgtccgctcgggatgaaagataccacttacaccccctccccggaccagtgcaagcgtctgatggtggcggaaaaaggggccagcccgtgcaataacacgctggccgccattggcagcggtggagtttactctacgcctggcgacatgatgcgctggatgcaacagttcctctcatcggatttttacgcgcgcagcaatcaggccgaccgcatgcagacgctcatctaccagcgtgctcagttacgtcgcgtcattggcatggatgtacccggtaaagccgatgccctcggcatgggctgggtgtatatggcgccaaaagatggccgaccggggattattcaaaaaaccggtggaggtggcggattcatcacctatatggcgatgattccgcaatcaaacgtaggtgcttttgtggtggtcacccggtcgccaaatacacgcttcgtgaatatgagtgatggcgtaaataatctggtggccgagctgagcgccaataaagcgcaggtgcttacggcctctaactga

SEQ ID NO: 2745 - DNA, 1728 bp, Enterobacter cloacae
tcaatgtttagtctcgacagcgttcttgatgacctttggcctcaggcgaggcccgcaccctggcaaaaaagtctgttaaaaagactgcttcacgaagacgaatttcagcagtttgctgccagccaccgtcacctgaaagggctggatatggtggatcaggttctggaacaccttgatattcactgctccgtttccgcccgcgatctcgaacaaatccccgaacacggcccactcattgtgatagcgaaccaccccactggcacgctggatgggctggcgttgctgtacgccgtttcccgcgtgcgccgcgacgtcagggttgttaccaacaggatgctgtcccaccttgagcccctcagttcattgtttattcccgtggataatatgggcggcagaaccgcaaaagcttcgctgatacagatggagcagcacctgcaaaacgccggtgtgctgatcttctttccggcgggcgaagtttcccgcccaacgcgcaaaggcatacgcgataaaaaatggcatccgggctttatcaagctggctggcaaattacgggtgccgctacttccggtacatatccaggcgcacaacagcctgctgttttatgccagtaccctggtctcgccaacggtatccatgctgctgttgatgcaacagatgtttcgccgccgtcacagtcagttgccgatcaaaatcggccagcagattgcctggaatgaccggtttagttctaccctttcatcgcgtgagatggccgagcagtgtcgtcagcacgtgatacgtcttggcaagggattgcctggcgtctttaaaacccagtgcgccattgcccgcccggaagacagggccacgctgaagcgcgaactggcgcaggccgagtgtctgggaaaaacgagcgatggtaaggccatctatctttggcagcgcaacgggcaggaagaggcgcctctgctgcgcgagctggggcggctgcgcgagattgcctttcgtgccgtggaggaaggcagcgggaagcggcgggatacggacagctacgatgatgactatctgcacctcattttgtgggatgacgatgacctggagattgtcggcgcgtaccgctttatgccaacggccatgcaggtggaaaagcgcggcgtcgaggggttgtacagctacagcctgttccactacgacgaaaaaatgcaggacatactggagcacggcattgagctggggcgtagctttatacagccgcgctactgggggcgtcgcggtctggactatctgtggtcaggtattggcgcctatctggcacgctatcctcattaccgttacctgtttggcccggtctccatctccggggggttaccgcctgccgcgcgggatctgctggtcgccttttaccgcttgtggttcccggcgacgcatcctctagccgcctcgcgccagccctatcccgcatccctgccagacgtgctggcgcaatttggcggggtggattacgtggatgacctgacaaagctcaaatccctgctcggcaacctgggctgcggcatcccgccgctctacaaacagtattccgagctatgcgaacccggcggcgtgcagtttgtcgatttcggcagcgatccggcgttcaataactgtatcgacgggctggtgctggtggatttgtgttatctgaaggcgaaccgctatcagcggtatatagaggcgcacttaataccctcccccctgccctctccctaa

SEQ ID NO: 2746 - DNA, 876 bp, Enterobacter cloacae
cggcgacgaaacacaaagtgcgacgcgcagatgctgatccacactgccaccaccgcaaaaccggaaatggctgacagcgccacaaacaccgtatccggcgcgaccacgctggagaacagcgccagcacgccgcccagcatggaaacggagagcgccgtcagcggcacgccgtttttgttgacgcgggcaaagcagcgcggcagcgttttctcgttagacagagaccacagcatacggccagaggcgtacaggcccgagttcgccgccgagaggatcgccgtcaggatcacgaagttaaagatatccgccgcatacggaatgccgaccttttcaaacaccagcacaaacggacttttctccacgccagcctgctgcatggggatcagcgccgccagcacaaacacggtgccaataaagaagatgatgagccgggcgatggtggtgcgaatagcaaccggaataaccttgtgtgggttttccgtttcccctgccgcgatgccgataagctctgtacctgagaaggcaaagttgaccgccaccatggtcatcaggatcggcagaccgccgtgcgggaaccagccttcggcagtaatgttgctcaagcccggcgccggtgaaccatcctgcatcgggataaaaccgaagatcgccgctccgccgagaataatgaaggcgatgatggtgatgactttcaccagcgagaaccagaattccccttcggcgaagaaacgcgtggaaatcacgttaagagcaaaaatcaccacgcaaaagacgacgcaccacgtccagacgggaacctgcgggaaccagtactgcatacagaacccggctgcggtaaagctcgatccgagcgccaccgtccaggtcaaccagtag

SEQ ID NO: 2747 - DNA, 1155 bp, Enterobacter cloacae
atcagttctatagtcgacacagtttcttcttcaccaggactcactatgcgatttaacggactgaccaaaggtttctttattctcatcctggcccttgtaacctgggctttctttgacgtgctgtcaccctatttctcggcgattctgtgggccgcgatcctgaccatcattttcaacccggtgaaaaacaagctgcgtaccgcgctgggcgatcgcaacgggctggcttccctcctcacactcggcattatctgcctgatcgtgtttattccgttgatggtgatcctttcctcgctcgcggtggaactgaacatggtttacaccaagctgcaacagaacaacacgcagttcccggaagtcatcgccggtatcttcaaccgcctgccggactgggccagcggcttcctggcggatcacaacctgaccaacgccgcgcagatccagaaaaagctttccgatgtcgcgttacagggcggacagtatctggcgggtagcgcgttcctgattggtaaagggacgttcggctttgctattagcttcggcattatgctgtacctgctgtttttcctgctcaaagacgggccctatctggtgcgccagatcctcgactcgctgccgctgtctgacttcgtcaaacagcacctgttcgcgaagtttgtcggcgtctcgcgagctacggtaaaaggtacggcggtcgtggcggtggttcaaggtacgcttggcggtatcgcctttgccatcgtcggtattgacggtagcgtactgtggggagcgctgatggcgttcctctccctggtgcccgccgtcggctcggctatcgtctgggttcccgccgccatcttcctgtttgccactcaccagctgtggcagggtctgttcattgtgggcttctttgtcattatcgtcgggctggtggacaaccttttacgtccgctgctggtgggcaaagacaccaaaatgccggactacctgatactgatcaccacgctcggcggtatggagctgtacggcattaacggctttgtgattgggccgctgattgccgccctgtttatcgcctgctggaacctcttctccggccgcgaccacgcaggcaacgccgaggagctggacgcagattttatcgaagaaggaaaaaatcctccggatctctaa

SEQ ID NO: 2748 - DNA, 1821 bp, Enterobacter cloacae
acgctcttccacatttgtcgtagaaggatccaacaggtgcgaatcgccacgatcacaaactgggcctatggtgtcacggtgtgcctgaccattgcttccggtatcgtcatgctgatggcttcccatgccgacaacgtagaacgtcaggctgttaagcaacgacaaatttttgaccagcttacggaagagattgaagcagaaacctggatgctctccgacttagcgcgcctttacgccatcaaaaaagagcccgatgtgctgaaaacgtaccaggcgaaagaaggcgaactgaagaatatcgagcgcaagctgggccagttaaaagatacgggcgcaacgggcgaagagctggcgctgctgtacgaagggctgaagattgtcgatgacctacaggatgaacagcaggcagcaattgccagcgtcgccaggggtgaggaacaacaggccattgcgttactcttcggcaaaatctacgaacttgaaatggaacgcgcccaaagcaagattgaccattttcgtgtgcttctggataagcgcattatcgccgatgtccaggcagcgaccaacacgtcaaaaaccctgcgtaccgcctctgaaatgatggtcggcctgaccgccctgctcttcttattcgtgatgggttttattctcaagcaccgcgtgctgcgcccggtggtgcgcctcagtgatgtggttcaccggctggcctcacaggattacgccgtcgaaacgccaaatttcaaccaggtcgatgagataggcgatatggcgcaggccattcgcattttccgcgagaacgggctggcaaggcagcggcttgaaaaagaacgcgacgcagactgggccatccgcgagctgctcgcgcgaatgacccagcgcttgcagggctgcgagaacgttagcgacgtgattgaggtggcagagctgtttgctcccaacattgcgccgggtgtcgccgggcgtctgtatattctggatcgaaacccgtgggagatgcgctgtgcggcggaatggttatctccccagggagaaaaaaatgctttccaccccgatcaatgctgggccatacgccgtggtcagagccacccaccggtcaacggcgagccggatatcggttgccagcatctgcctgaatcacaaaaagacagttcactctgcgtgccgctcattgcgcagggggaagccattggtttgctgtcgtttcagaacatcacgcctgaaacggcaccgtcccgcgcctatctcgaattaatggcggaagccctgggtctggcgctggccaaccagcgtctgcgcgatgccctgctggaaaaagcgctattcgacccgctcaccggcttgcgtaaccgccaccaccttgaagataccctgcgcactcagatagctcaggcgatgcgcaatgatgaaccggtgagctgcatgatgatcgacatcgatcacttcaaaagcattaacgatcgcttcggccatgaggctggcgatcatgtgattaagagcgtggcgacaattgttcagcgtgccgtgcacgatgccggcctggccttccgctttggtggcgaagagtttctggtgctacttacgggtgcggatgaggaagcggctcacgcctgcgcaacggagatttataacggcgtccatacgctgtcgctacgttatgggcttgctgagattggcccggtagatgtgtcgatcgggatcgccagttacccgcagcacgcccaaagcgacgacctgctgcgcgcggcagacgttgcgctttaccgggcgaaagagctggggcgctcgcggatcgtcagtttcagtatgctggaggcgggttaa

SEQ ID NO: 2749 - DNA, 789 bp, Enterobacter cloacae
acaacgttcgcgctcagcctgataatcgttgaggagaggatgatggatatcccacgtatttttactgttagcgaaagcgaacaccgcattcataacccgttcaccgaagaaaagtacgccacgcttggccgtgtgctacgcatgaagccaggcacacgcattctcgatctcggcagcggctcgggagagatgctttgtacctgggcacgtgattacggtattaccggtaccggcatcgacatgagccagctcttcaccgcgcaggccacactgcgcgcagaggaacttggcgtcagcgaacgcgtccatttcattcataacgacgcggccggctacgtcgcgaatgaaaaatgtgacgtggcggcctgcgttggcgcaacctggattgcggggggcgtagccgggacaatggatctgctggcaaaaagcctcaagcccgggggaataatgctcatcggcgaaccgtactggcgtcaggtacctgcgacggaggagacagcccaggcctgcggcgtctcgtcgattacagactttctcactctgcccggtctggttgcgtctttcgatcaacagggctatgacctggttgaaatggtgctggctgaccaggaaggctgggacaggtacgaagccgcaaaatggatgaccatgcggcgctggctggaggaaaacccagacgatgacttcgcgcaggaggttcgggcggagctgacgatagcgcctgaacgtcatgtgacgtacacgcgggagtactttggctggggagtgtttgcgttaatggcgcgataa

SEQ ID NO: 2750 - DNA, 1221 bp, Enterobacter cloacae
acagaccttttcctttcacgcgccccccttcagcatccctcaaaatattatggcagaaggccgcgaaacccgccgggcatcgtggtatgttattggcttttcgtcagactggaagagagtgagatggcaaagcagcgcgtaggtattgtctttgggggaaaatcggcagagcacgaggtgtcattgcaatcggctaaaaatatcgttgatgcgattgataaaagccgttttgacgtggtgctgctgggcatagataaacagggccagtggcatgttaacgatgccagccagtatctgttacacgctgacgatccggcgcacatcgcccttaatccttctgatatcagcgtcgcaacggttccaggcgtggtacagggacagcttatcgatgccgggaacgcgcaggcgctggcacagattgacgtggtgtttcctatcgttcacggcacgctgggcgaagatggctccctgcaaggcatgctgcggatggcgaacctgccgtttgtcggttccgatgtgctgggctctgccgcctgcatggataaagacgtcacaaaacgtctcctgcgcgacgccggtctgaatattgcgccgttcgtggcgcttactcgtgccaaccgcgataaacatagcttcgcgcagatccaggcgcaactcggcctgccgctatttgtgaaaccagcaaatcagggctcgtccgttggcgtcagcaaagtcaccagcgaagcgcagtttaacgaagccgttcgtctggcctttgagtttgaccataaggtggtggttgagcagggaattaacggacgcgaaattgagtgcgccgtactgggcaacgacttcccgcaggcgagtacctgcggtgaagtagtgctgaacagcgacttctattcctacgacaccaaatatattgacgacaaaggtgcccaggttgtggtccccgccgcgctcgatcctgacgttaacgacaagatccgcgcgatcgccgttgaagcctatcaggcgctgggatgctgtgggatggcgcgcgtcgacgtgtttctgacgccggataacgaggtggtgattaacgaaatcaacaccctgccgggctttaccaatatcagcatgtacccgaaactgtggcaggccagcgggataagctatccggaactgatcacccgcctgattgaactggcgctggagcgtcacgccgctgacagcgccctgaaaagctccgttaactaa

SEQ ID NO: 2751 - DNA, 1095 bp, Enterobacter cloacae
actaaatacatgcagcgtatattagtcgatttcgaaaatctaaaagacaactttagtaaaacaccgctccctgctttcaggtacactatacctctttgttccacaaacatcaggcataccatgaccgatttaattgcacgtccccgtcgcctgcgcaagtcacccgcactgcgcgccatgtttgaagagacaacactgaccttaaacgatctggtgttgccgatttttgttgaagaagagatcgatgactacaaagccatcgacgcgatgccgggcgtgatgcgcattcctgaaaagcatctggcccgcgagatcgaacgcattgcgaatgcgggcatccgctcggtgatgacgttcggtatctcccaccacactgacgcgaccggcagcgatgcctggaaagaagacggcctcgtggcacgcatgtcgcgcatctgcaaagagagtgtgccggagatgatcgtcatgtccgatacctgcttctgcgaatacacctctcatggccactgtggtgtgctgtgcgatcacggcgtggacaacgatgcgaccctgctgaatctgggcaagcaggcggtggttgccgccgccgcgggtgcggatttcattgcgccttctgcggcaatggatgggcaggtacaggcgattcgccatgcgctggatgccgcgggcttcaccgacaccgccatcatgtcctactccaccaaattcgcctcctctttctacggtccgttccgtgaagcagcgggcacggcgctgaaaggcgatcgtaaaacctatcagatgaacccgctgaaccgccgcgaagcgattcgtgaatctctgcttgatgaagcccagggcgctgactgcctgatggtgaaaccggctggcgcgtacctggatatcctgcgcgacattcgcgaacgcaccgaactgccgctgggcgcataccaggtaagcggtgagtacgcgatgatcaaattcgccgcgcaggcgggtgccatcgacgaagagaaagtgatcctcgaaagcctgggggcaatcaaacgtgcgggcgcggatctgatcttcagctatttcgcgctggatctggccgagaagaaaattctgcgttaa

SEQ ID NO: 2752 - DNA, 1959 bp, Enterobacter cloacae
atagtagttcaggagaacataatgaacaggatactggttggtatcattttttctctttttatcactacgggatatatagcatttcttgtttacgatcgtcagcaagagttgcaaaaattgactcactacactgagtcctggtctgtagcccaactggtatctgaatattaccgatttgaatcatggattggactgtacgcaaccgagactgatgacgttacggtagaccaggttcgcatgcgcctggaaatcatgctgagccagaatgatttattgaaagaaggcggcctgggtcgttatataaacagcgaaaaagcgcatcaggcgctcgccttacgcctggaaaatatactgaactatctggatggtcatcttgagaaaatgagccgttcagagttaaagctctatctgaacaatatgcattcactggatgccccgctaagccagctttcatccacggctttaacaaaagatgttaatacaatcaatgaaaccaaccttaaaatacaggttctgtattatatttactcggcactttcgctgttgctggttattttaagcttcatactgggctttttgattatctatcaaaataaaaatatcctgaaagcccatatgcaggtgaaaacgctggctgaagaacttcagctatccaaagaaaccctgcaaatccagaatacaaaactggaatacgatgtttatcatgactcccttaccggaatgaaaaaccgtcttttcttttgggatgatctcaataaacttaatctacaggctgagaaaaaacatatttcggtcacggtgatgttattcgatttagaccgattcaaagaggtgaatgatacctacggtcatgataccggggatttactgttacgtgaggtatccacgcgccttaatgctttgggccgcttttcagagacattttatcgtttgggcggcgacgaatttgcgtttctctccagtggcttaaccgaaaccgcagccgtctcacgcgcgcgagaaatcagtgatagcatcagcaagccctatacaatcaataatcaactcataaaaatagccacctgtgtaggtattgttttatcggataacgaacgacgttcagattacctttataagtttgccgatctggcgctctatgaagccaagaaagaaggttctcagcaaatcaaagtcttccgccagcgaatgctacagaagttgcaggaaagcagaacccttgaaaatgatatggcaagagcaatagagaatgatgaatttgttgtttattaccagcctattgtgaattccgtcagcaaggaaatttacggctatgaagcgcttattcgctggatgcatcctgtaaagggaatgcttgccccggatagctttattttcgccgctgaaaaaacaggcatgatcaacgagataggtaaaaccgtacttaaactggcctgtagggaagcggtctcctggactgttccggccaggatctccgtcaacgtctcgcctgttcaattgggcagcaaatcatttattaatacggtgcagtccgttctggctgaaaccgggctcccggctaaccgtcttgagttagaggtcacggagtcctccctcttcagtgacagaaataaccccattgcgattctgaaaaaactccgcgcactgggcgtaagaatctccattgatgattttggcacgggctattcgtcgctctccagactcagcgaactgaattttgataaaatcaagatcgataaatcttttgtcaatccgatatctacgcaggaagatgcgcttaatattgtgaagctgattaccggtatggctaaaagccttaatatgggcgtcatagctgagggcgttgagaccgaagagcagcttgagcggcttcaggctctgggttgcgagcttgtgcagggatatcttttcagcaaaccacagcctcaggtcgacagcaaaatcaagagcggccaggaatga

SEQ ID NO: 2753 - DNA, 183 bp, Enterobacter cloacae
tcgaactcattcagcatgatgttcgataatagcggcgatataacaccgccctgtggtacaccttcactggccgcccgaaagagaccgacatcgatatgtcccgccttgatggttttccacagcagagtcatgaaacgtgcgtcactgatcctgcggcgtacagccttcatcagcagtcgatga

SEQ ID NO: 2754 - DNA, 444 bp, Enterobacter cloacae
atccgtagggacggatcggtggctgcccatgtggcaagcttgcgttgcatttcgctgattatcaaaggtcttcacctcgttaggtcagttaattcacgtcgcaaacacattcaaactgcttcccttcgccatgtaatgggctttccccatcgcggactactacggaagctccgccagccagcgcgtcatcggagccatgcccccttaacatccgtcgctgaccttccccggtttacctgcctggactcaggcatactgaggaggctgcccgtcgcactctttatccttgcttgccgcaagttggcagaagtcagcaacgcaagcgtgatagacgctgctgccccggtgtttcgcatacatgtcaaaacaccttcgaccggcagtgcttacgtatcactgccagttcctcctgcacggcctgtcagatcacgtaggccgtggtga

SEQ ID NO: 2755 - DNA, 423 bp, Enterobacter cloacae
acgctgctgccccggtgtttcgcatacatgtcaaaacaccttcgaccggcagtgcttacgtatcactgccagttcctcctgcacggcctgtcagatcacgtaggccgtggtgacgttttcaacccacagaggcggattaacgggttcatgttcttcagcctttcagtacttaaccttgaggatcatctcggcttagtgatctcgcctcaatccccgttgtcagcgggttacatcaccctgcgggcatgccgcaggtcactgccgctcaggttctccaccgtcacacccggtgggattgttgggtttctcatcgtgagttaccggttcaatattccagacagactcgcggttcatttaagcatccatgcccgccctgaactccgggcacactatacgtcacatcgccgcaccacacctgattag

SEQ ID NO: 2756 - DNA, 522 bp, Enterobacter cloacae
aatggaaaacgacatattaaaaaaggctaccgcgcttttgatgtcagactccctgaacagttctcgttaatcgaaaaactcagagcgcagtatcctgtggtcacactctgccaggtgttcggggttcatcgcagcagctacaaatactgggtgaaaagccccgaaaagccagacggcaagcgggctgtattacgtagccaggttctggagctgcataacattagccatggctctgctggcgcgaggagtatcgccattatggcaaccctgagaggtttcagaatgggacgctggcttgccggcagactcatgaaagaactgggactggttagttgtcagcaacccacccaccggtataaacgtggtggccatgaacacattgctatcccaaaccaccttgagcgacagttcgcagtgacagagtctaatcaggtgtggtgcggcgatgtgacgtatagtgtgcccggagttcagggcgggcatggatgcttaaatgaaccgcgagtctgtctggaatattga

SEQ ID NO: 2757 - DNA, 1530 bp, Enterobacter cloacae
agacctttgataatcagcgaaatgcaacgcaagcttgccacatgggcagccaccgatccgtccctacggattcaacggctgctgcgtctgataacacaaccagaatggctggctgaagcggcgcggatcacgctttcatcaaagggggcccatacccccggcgttgatggcgtgaacaaaacaatgctacaggccagactggctgttgagctgcaaatcctcagggatgaattactctcaggccactaccagcccttgcccgccagacgggtttacatccctaaaagcaacggcaaactgcgaccactgggtatccccgcgttgcgggatcgtattgttcagcgggccatgctgatggcgatggagccgatatgggagagtgattttcatacgctctcatatggcttccggcctgagcgcagtgtccaccacgcgatccgcacggtgaaattacagctcacagactgtggtgaaacccggggacgctgggtgattgaaggcgacctgtccagttacttcgacaccgtacatcatcgactgctgatgaaggctgtacgccgcaggatcagtgacgcacgtttcatgactctgctgtggaaaaccatcaaggcgggacatatcgatgtcggtctctttcgggcggccagtgaaggtgtaccacagggcggtgttatatcgccgctattatcgaacatcatgctgaatgagttcgatcaatacctgcatgagcgctacctgagcgggaaagccagaaaagatcggtggtactggaataacagtatccaacggggccgaagtacggcggtcagagaaaactggcagtggaaacccgcggtggcgtactgccgctatgccgatgattttgtcctcatcgtcaaaggcaccaaagcacaggcggaagccatcagggaggagtgtcggggtgtgctcgaaggcagtctgaaactcaggctgaacatggataagactaaaatcacccatgttaatgacggctttatctttctggggcacaggatcattcgcaaacgcagtcgttatggcgagatgcgagtggtctcaacgatcccgcaggagaaagccagaaacttcgccgcatcgctgacagcactgttatcaggcaactacagtgaaagcaaagtcgatatggctgaacaactcaaccgaaaactgaaaggctgggctatgttctatcagttcgttgattttaaggccaaagtcttcagttatatcgaccgtgtcgtgttctggaagctggctcactggctggcccgcaaataccgtacaggtatcgcttccctgatgaggtggtggtgtaaatcaccgaaaccgggtcagagcaaaacgtgggttttatttggtaaaaccaatcacggcaagctcagcggcgaaatactgtaccggttggtggggcaaggcaagaagctgttccgctggcggctacccgaaggtaatccctatctgaggacggagaccagaaacacgtatacatcgcgctttacagaagtggcaatggcgttcgccagcatttaa

SEQ ID NO: 2758 - DNA, 210 bp, Enterobacter cloacae
ggccgcatgactataacggtgggttacccccaaacgaatcggaaaaccgatactggaaaaactctaaagccgtggccagttttggttgaccacttcaaacaactcaacccatctatgctgcactttctggctgaatgcttaaccctgtctgttgaacggcggcataaccctaaaggctataccgccagcgttatgttatcgcgccattaa

SEQ ID NO: 2759 - DNA, 957 bp, Enterobacter cloacae
tgtggtactggcagggatcgcagtgatcgccgcgatcgcctttggattagaactgggactgcgcgcgctacagcgtcgcctgacgccctggcatggagaaatacaatgagtgaacgtctgacgattatcccgttggggccgtacattggcgcgcaagtgtcgggcctggacgtaacccgtccgctgagcgataaccagtttgagcagctgtaccacgcggtgctgcgtcatcaggtggtgttcctgcgtgaacaggccattaccccgcatcagcagcgcgcgctggccctgcgttttggcgacctgcatatccaccccgtctatccgcatgcggaaggggtggaggagattatcgtcctcgacacccacaacgataacccgccggataacgataactggcataccgatgtgacctttatcgacacaccgccagccggggcgattcttgcggcgaagctgttgcctgagacggggggcgatacgctgtgggccagcgggatcgcagcgtttgaggcgctctccgcgccgctccagaccctactgagcggcctgcgggcggagcatgacttcaaaaaatcattccaggaatataagtaccgtaaaacggaagaggagcaccagcgctggctggatgcggtcgaaaaacatcccccgctgctgcacccggtggtgcgtacgcatccggtgaccggaaagcaggcgctgtttgtgaatgaagggtttaccacgcgtatcgtggacgtagcggagaaagagagcgaggcgctgctcggcttcctgtttgcgcatatcacgaaacccgagtttcaggtgcgctggcgctggcaggagaacgatctggcgatctgggataaccgcgtcacgcagcattacgccaatgcggattatctgccgcagcgaaggattatgcagcgggcgacgattttgggggataagccgttctaccgtgcggtttga

SEQ ID NO: 2760 - DNA, 432 bp, Enterobacter cloacae
gggatgaaactgggctatgactggaaaccaaacctgtctggctacgtcacgccttacgcggcgatttctggcctgttccagtcccgtgatgaataccagttaagcaacgacatgcgtatcgatggtcagtcttacgacagtatgcgttatgaagtcggcgtggatgcaggttataccttcaatacgggcggcgagcaggcattaacgccttacttcaaactggcttacgtgtatgacgatgctgacaacaatgctgatatcaacaacgacagcattgataacggcgtagaaggctctgcggttcgcgtgggactgggtactcagttcagcttcacgaaaaacttcagtgcttacactgatgcgacttatctgggcggcggcgacgttgaccagaactggggagcaaacctgggtgtgaaatatacctggtaa

SEQ ID NO: 2761 - DNA, 1239 bp, Enterobacter cloacae
caacaagaaggaagcacaatgtttaagtcttttttcccaaagccggggccctttttcctgtcggcatttatttgggcactgctggctgtcattttctggcaggccggtggcggcgcgtggctgacccgtcttacgggggcaacgggcgatattcccattagcgcagcgcgcttctggtccatgagctatctgcttttctacgcttattacgtgctctgcgtagggctttttgccatgttctggtttgtctattctcctcaccgctggcaatactggtcgattctcggcacgtcgttaatcatctttgtcacctggttcctggttgaggtgggcgtagcggtcaacgcctggtatgcgccgttttacgatctgatccagacggcgctgagttcgccgcataaagtgaccattaaccagttctaccatgaggtggggatcttcctcggcatcgccctcatcgccgtggtgatcggcgtgatgaataactttttcgtcagccactatgtgttccgctggcgtaccgcgatgaacgaacactatatggcgcactggcagcacctgcgacatatcgaaggtgccgcacagcgtgtgcaggaagacaccatgcgttttgcctctactctggaagatatgggcgtgagctttatcaacgccatcatgacgctgatcgccttcctgccggtgctggtgacgctctcgtcgcacgttccggagctgccgattgtcggccatctgccctacggcctggtgattgccgcgattgtctggtcgctgatgggaacggggctgctggcggtggtagggatcaagttgccggggctggagtttaaaaaccagcgcgtggaagcggcctaccgtaaagagctggtgtatggtgaagacgatgccaaccgtgcgtcaccgcctaccgtgcgtgagctgtttggcgccgtacgtcgtaactacttccgcctctatttccattacatgtatttcaatatcgcgcgcattctttatcttcaggttgataacgttttcgggttgttcctgctgttcccgtccatcgttgcgggtacgattacgctcggtctgatgacccaaatcaccaacgtctttggtcaggttcgcggttcgttccagtatctgattagctcctggactacgcttgtggagctgatgtccatctacaaacgtttacgcagtttcgagcgtgagctggacgataaggacgtgcaggaagtcacccatacattaggttaa

SEQ ID NO: 2762 - DNA, 1110 bp, Enterobacter cloacae
aaaggaattgctatgccatttgccgtaccacgtgcattacctctgacgttactcgccgctttcgtgctggcgggctgtgccgaaaaaggggctgccccgctcaaagaaggggagaagcctgtggatgtggcgagcgtggtgcggcagaagatgcccgccagcgtgaaggatcgcagtgagtgggctgatgcgctggcaacgaccttcaaaagccagaagatcgcgcctaccgaagagaatatctgctcggtgctcgcggtggcgcagcaggaatcgatgtatcagtcagatcctgttgtgcctggcctgaacaaaatcgcctggaaagagatcgaccgccgggccgaatcgatgcatatcccggttttcctggtacataccgcccttaaaatcacctcgccaaacggtaaaagctatagcgaacggctggatacggtgaaaaccgagaagcagcttagcgccattttcgatgatttcatcaatatggtgccgatggggcagaagctgtttggatcgctgaatccggtgcataccggcggtccgatgcaggtgagtatcgcatttgcggaaaagcataccgacggctatccgtggggtatcgatggtacggtgcgtcaggaggtcttctctctgcgcggtgggctgtggtttgggacgtatcacctgctgaattatccggccaactacgataaaccgctgtatcgctttgccgactttaatgcgggctggtatgccagccgaaatgcagccttccagaatgcggtaagccgcgccagcggtgtgaagctcgctttggatggcgatctcattgcatacggcagcagtgaggctgggaccaccgaacgtgcggtgcgaaaactctcgacgaagctggagatgagcaacaacgacattcgccgacagctggagaagggcgacagcctggcgtttgagaaaacggatctctataagcaggtctttgcgctggccgagaagaaaagtggaaaggcattacccagagccattctgccagggattcaactggaaagcccgaagatcacgcgtaacctgacgaccgcctggttcgcgaaacgcgtgaacgatcgtcgggcacgctgtatgggactgtaa

SEQ ID NO: 2763 - DNA, 396 bp, Enterobacter cloacae
ccccatgcagcgcaacgctgtgtgaagtggtttactgaatttggccacctgaacagaggtgatatgctcatctcagaacaatacaggtgtcccaatgaaaaaagaaatttcagcgcagagtttaaacgcgaatccgctcaactggtccttgatcagaactacaccgttgcagctgcggccagtgctatggacgtggggctttctaccatgacgcgatgggtaaagcagttacgggatgaacgacagggtaaaatacctaaagcctcccctataaccccggaacagattgaaatacgtgagctaaagaaaaagctacaacgcattgaaatggaaaacgacatattaaaaaaggctaccgcgcttttgatgtcagactccctgaacagttctcgttaa

SEQ ID NO: 2764 - DNA, 1425 bp, Enterobacter cloacae
atgtccatacgtttagaaggtaatatgcaaacagaacaacaaaacgggcagcttaagcgcaccatgaaaacccgtcacctgattatgctctcgctgggtggcgttatcggcacagggttattcttcaataccggatacatcatttcgacaactggcgcggcgggcacgctgctggcgtatcttatcggtgcgctggtggtctggctggttatgcaatgcctgggggaactttccgtggcgatgccggaaaccggggcgtttcacgtctacgccgctcgctatcttggcccggcgacggggtataccgtggcctggctctactggttgacctggacggtggcgctcggatcgagctttaccgcagccgggttctgtatgcagtactggttcccgcaggttcccgtctggacgtggtgcgtcgtcttttgcgtggtgatttttgctcttaacgtgatttccacgcgtttcttcgccgaaggggaattctggttctcgctggtgaaagtcatcaccatcatcgccttcattattctcggcggagcggcgatcttcggttttatcccgatgcaggatggttcaccggcgccgggcttgagcaacattactgccgaaggctggttcccgcacggcggtctgccgatcctgatgaccatggtggcggtcaactttgccttctcaggtacagagcttatcggcatcgcggcaggggaaacggaaaacccacacaaggttattccggttgctattcgcaccaccatcgcccggctcatcatcttctttattggcaccgtgtttgtgctggcggcgctgatccccatgcagcaggctggcgtggagaaaagtccgtttgtgctggtgtttgaaaaggtcggcattccgtatgcggcggatatctttaacttcgtgatcctgacggcgatcctctcggcggcgaactcgggcctgtacgcctctggccgtatgctgtggtctctgtctaacgagaaaacgctgccgcgctgctttgcccgcgtcaacaaaaacggcgtgccgctgacggcgctctccgtttccatgctgggcggcgtgctggcgctgttctccagcgtggtcgcgccggatacggtgtttgtggcgctgtcagccatttccggttttgcggtggtggcagtgtggatcagcatctgcgcgtcgcactttgtgtttcgtcgccgtcacgtgcagtccgggcaaccgctttcggcgttgcagtatcgcgcgccatggtatccgctggtgcccgtgcttggctttatcctctgcctggtggcctgcgtcggcctgtggtttgaccccagccagcgtattgccctttattgcgggcttccgtttgtcgccctgtgttatggtgcgtactatctgacccgaaacctgaccacgcaggagcctgaacatgtcgcagaataa

SEQ ID NO: 2765 - DNA, 1038 bp, Enterobacter cloacae
cgattcttttttattcctttatcaaaattctcgcgccggaaatactgctctcataacaacaagggagcagacattatggcaatttcatcgcggatcacacttctcggcgcactggcgctgtgggcatttcaggcgcaggcggtggacgtcaccgtcgcgtatcagacttccgctgagccggcgaaagtcgcgcaggcggataacaccttcgccaaagcgagcggggcgaacgtcgactggcgcaagttcgacagcggcgcggcgattgtgcgggcgttagcctcgggcgacgtgcagattggcaacctgggctccagcccgctggcggtggccgccagccagcaggtgccgattgaagttttcctgctggcgtcgcagctcggaaattccgaagcgctggtggtgaagaaaagcatcacgaaacccgaagatttgatcggcaaacgcatcgcggtgccgtttatctccaccacgcattacagcctgctggcagcgctgaaacactggggcattaagcccggccaggtgcagatcatcaacctgcaacctccggccattattgccgcctggcagcgtggcgacatcgacggagcatacgtctgggcgcccgccgtcaacgaactggaaaaagagggcaccgtgctgaccgactccgaaaaagtggggcagtggggcgcgccaacccttgatgtctgggtggtacgtaaggactttgccgagaaacaccctgaagtggtgaaagccttcgccaaaagcgccatcgacgcacagcagccatacatcagcaacccggatgaatggctgaaacagcccaccaacctggagaaactctcacgtctgagcggcgtgccggaagctgacgtgccggggctggtaaaaggcaacacctatctgacgcctgctcagcaggtccagcagctgaacgggccggtaagcaaagcgattgttgacactgcgacgttcctgaaagagcagggcaaagtgcctgcggtggcggcggattacagccagttcgtgaccgatcgctttgtgaaataa

SEQ ID NO: 2766 - DNA, 846 bp, Enterobacter cloacae
gcaacgggaggcgttctcatgagcattgttttcagtgaaaaaacgcggcggacgcgccttgccttacgctggccgttctctcgccagatcactttaagcgtcagcacgctggtggtgttgctggcggtatggtgggcggttgccgcgcagcagtgggtaagcccgctgtttctgcccccgccaggccaggttctggaaaaactgattactatcgccgggccgcagggctttatggatgccactctctggcagcatttaggcgccagtctgacgcgtattctggtggcgctgctggcggcggtcattattggcgttccggtggggatcgcgatgggactgagcccgacggtacgcggcattctcgacccgctgatagagctttaccgtcccgtcccgccgctggcttacttgcccctgatggtgatctggtttggcatcggggagacgtcaaagatcttactgatatacctggcgatttttgcgccggtcgcgatgtcggccctggctggcgtaaagagtgcgcagcaggtacgcatacgtgcggcgcagtcgctcggcgccagccgcgcgcaggtcctgctgttcgtcattttaccgggcgcgctgccggagatattgaccgggctgcgcatcggccttggggtgggctggtctacgctggtggcggcagagctgatagccgccacgcgcggccttgggtttatggtgcagtcggcgggagagttcctggcgactgatgtggtactggcagggatcgcagtgatcgccgcgatcgcctttggattagaactgggactgcgcgcgctacagcgtcgcctgacgccctggcatggagaaatacaatga

SEQ ID NO: 2767 - DNA, 2391 bp, Enterobacter cloacae
tggacaaacttgcttacgtccctgaggagggatgacccaatgcaaacatggaaaaagaaactggttgtatcacaacttgcattagcctgcacactggctatcgcttctcaggccaatgcgaaagatatatccggcacgacatataatacttttggatatgacaatactgcgtccacgccctggtattatggttatgctgactggaattattcagatgccacacatgatggtgacatttatccggtcgtcaataaatcaaccgtaaacggagttatttcgacatactatctggatgatggtgtcaatggccgtgcgaacgcgttgagtatttctaacagcaccattaatggcatgatcacctcagagtgtatgaccacgacgtgtgcagatggcgtagatactgacggcaccgctcatacccagtatgatcgttttagcctgaccgttgataactccaccatcaacgatacctacgagcattacgcgtatgatgtcgtcaatggcgaaaccactgaaacgcattatctggacacctatgatctgggtaacgccatcacgctggacgttgaatctgatatcgttattcagaacaattcccacgttgcgggtatcacgctgacgcagggttaccaggatctggataacacgccatacgacggtgttgaaggcgttgctaacagcagcaatgtctttaccgatacgctggtggtgaaagactctgtgctgacctccggtgcgtacagcgatctgggtaccagcggcttctacggtcaaacggcgaagccgagcgactacggtgaaaccaacgccacggctgcggatgatgcggcgctgatcgttgtggctggcgcgtctgataacgctatgcagaccaccgctaccttcgatcactctaccattaccggcgacatccttttctccagcacctttgataacaacttctacgagaatggcgatccggcaacggataccaccgatgacggcatctataacccaactaccaacggctgggatgataccgacaagctggatgtcacgctgaccaacggcagtaaatgggtgggtgccgcgcagtccagcgttgaggccatcggcacggcgcagatgtatggtgaaggctacagcaatgtagactggcatgcactttctccaaacagcatctggcctgattctacctttgatagcaacggtcacgttgcaggtgaagaggtttatcagagcggcctgttcaacgtggcgctggataacggttccgagtgggatacccgtaagatctccaacatcgacgcgctgacggtgaacaaccagtctcaggtcaatgttgaaaactccggcctgctggcggattccatcaccctgaccaatgcgtctagcctgaacatcggcgacaacggcgcggtagcaaccgatagcctgtatctggatagctacagccgtgcggcactgactgaagagacagctgagctgtatgccaacaccattaccgtggacaacggtgcagagctggcgctgggtctgggtcaggttgatacgcacaatatggtgctgaccgatggcggtgtactcaacgttgccagccgcgattatgtgctgaacagcgacctgaacaacgcacggtatatcaccaacgatcgcaataaagcggactacgactatggtgttgtcgcgctgaactctgacggtcatctggcggtgaacggtgacgttgccggtaactataaagtgcgcatcgacgatgcgaccggcgcaggctccgtagctgactacaaaaacaaagagatcattcgcgtctctgacaataacgcggataccgctgcgagctttactgcggcaaataaagctgatttaggtgcatacacctatcaggcgcagcagaagggcgacaccgttgttctccagcaggaagagctgactgactacgccaacatggcgctgagcattccttctgctaataccaacatctggaatctgcaacaggataccgtgggtacccgtctgaccaacagccgtcatggcctggcagataacggcggcgcatgggtgagctatttcggcggcaactttgacgcggataatggcaccgttagctacgatcaggacgtaagcggcattatggtaggtctggatactcagatcgacggtaataacgcgaagtggattgtcggtggtgcggctggtttcgcgaagggtgatatcagcgatcgtacgggtcaggtcgatcaggacagccagactgcgatgatctacgcgtcggcgaagttcatgaacgatatcttcctcgacagctcactgagttacacccgcttcaacaacgacctctctgccaccatgagcaatggtcagtatgtggacggtaataccacgactgaacccgttggttttaggggatga

SEQ ID NO: 2768 - DNA, 639 bp, Enterobacter cloacae
cttgaggtatgcatgaacgttaatgcgaaaccactttctgaattaagccggctcattaagtgtctggaaatcgccggtaccccatttaagaccgaaccacaacaattaataactaccggcaataatgatgatgaaccattgaccgttgtcatacaatccggtctgactgccgtccaccgtaaatcagacgaattacttatgggtattgcgcgggcaccgtatatccacggtttaagcgcatggataaatgacaactatcttgaatattctctgattgcacaaacaccttgtaccggattttatttgcctgcctctactgcatgcgaacttattcaagaagcgcatgtttggcaagaagctttctgctggctgtcatggctaaaccatttactgggaaaacgtgatatacagctgattggaaataattcctatagccaaattcgggcgatgctgttgaatatggccgagtgggatgacgcgctacgttcaaaaattggtgttatgaatcatattcagcgtagcacgcgtatttctcgttcggtcgttgcggaggttctggcggcgctgcgtcaggggaactacatcaatatgagccggggcaaactggtcagtatcaaccgtttgcccacggactattga

SEQ ID NO: 2769 - DNA, 507 bp, Enterobacter cloacae
tccgactacgccctgcctcttactctactctggacaggcaggcgctgggcttacctcgccattgttctcgatttgttcgccaggaaaccggtaggctgggcaatgtcattctcaccggacagcaagctaaccatcaaagcgctggaaatggcgtgggaaacccgagataaaccagcgggagtgatgttccccagtgaccagggtagccactacacaagcaggcagatccggcagttattgtggcgttaccggatcaggcaaagtatgagccgacgcggaaactgctgggataacagcccgatggaacgcttcttcagaagtctgaaaaacgagtgggtgccagtgacaggctatataaactttagcgaagcagctcatgcgatcacagactatatcgtcgggtattacagttcggtaaggccgcatgactataacggtgggttacccccaaacgaatcggaaaaccgatactggaaaaactctaaagccgtggccagttttggttga

SEQ ID NO: 2770 - DNA, 276 bp, Enterobacter cloacae
aggctataccgccagcgttatgttatcgcgccattaacgcaaacactccccagccaaagtactcccgcgtgtacgtcacatgacgttcaggcgctatcgtcagctccgcccgaacctcctgcgcgaagtcatcgtctgggttttcctccagccagcgccgcatggtcatccattttgcggcttcgtacctgtcccagccttcctggtcagccagcaccatttcaaccaggtcatagccctgttgatcgaaagacgcaaccagaccgggcagagtga

SEQ ID NO: 2771 - DNA, 951 bp, Enterobacter cloacae
ccacgcaggagcctgaacatgtcgcagaataatccgcttaccgccctccttgaaaaccagccgtttgtcgtgctggatggggcaatggcaacggagctggaagcgcgcggttgtaaccttgccgacagcctctggtcggctaaagtgctgatggaaaacccggagctgatccgtgacgtacacctcgactactaccgcgcgggggcacaggtggcgatcaccgccagctatcaggcgacacccgcgggctttgccgctcgcgggctggacgagtcgcaatcccgggcgttgattggcaaaagcgtagagctggcacgcaaagcgcgggaagtgtacctggctgagaacgcaaatgcaggcacgctgctggtggcgggatctgtgggcccttacggcgcgtatctggccgatggttccgagtatcgcggcgattacgtgcgtagcgctgaagaattcaccgccttccaccgcccgcgtgtagaggcgctattggatgcgggcgcggatttgctggcctgtgaaacgctgccttcgttcactgagattaaggcgctggcggcgttgctgacggcgtatccccgcgcccgggcatggttctcatttaccctgcgtgacagcgagcacctgagtgacggaacgccgctgcgggatgtcgtttctgcgctggaaaactacccgcaggttgtcgcgctggggatcaactgtatcgcgctggaaaacaccacctcggcgctgacgcatctgcacagcctgacatcgctgccgctggtggtctatccgaactccggcgagcattatgatgcggtgagcaaaacctggcatcaccacggtgaagcgtgcgagacgctggcggggtatttaccgcagtggctggcggctggcgctaaattaatcgggggatgttgccggaccacgccgaaagatattgctgcgctgacggttcagcgctga

SEQ ID NO: 2772 - DNA, 783 bp, Enterobacter cloacae
aataagggggctgcaatgctgaacattacaaacctgtctgccgattacggcggcaaacccgccctggaagcgatcaacctgacgctggacagcggtgaactgctggtggtgctgggaccgtccggctgcgggaaaacgacgctgctgaacctgatcgccgggtttgtaccgtatcagcacggctcgatccaactggaagggaaacgggtcacggggccgggcgcagagcgcggcgtggttttccagaacgaagggttactcccgtggcgaaacgttcaggaaaacgttgcgtttggtctgcaactggccggtgtagcacgtgaacagcgcctgaatacggcgcgcgatatgctgaaaaaggtcgggctggagggggctgaaaaacgctttatctggcagctttcaggcgggcagcgtcagcgcgtcgggatcgcccgtgcgctggcggctaacccacagctgctgttgctggacgaacctttcggggcgctggatgccttcacccgcgagcagatgcaaaccctgctgctgcgcctgtggcacgaaaccggcaagcaggtgctgttaatcacccacgatatcgaagaggccgtgtttatggcgacggagctggtgctgctctcaccggggccgggacgcgtgctggagcgcctgccgcttgagtttgcccggcgctatgtggcgggagagccagtacgcagcatcaaatccgatccgctgtttattgaacagcgtgaatacgtcttaagccgcgtgtttgagcaacgggaggcgttctcatga

SEQ ID NO: 2773 - DNA, 252 bp, Enterobacter cloacae
gaggatagttttttttctgccggagttgtcatgaagctcacttccaaactacgccgtgactggcattactacgcctttgcgatcgggctgatctttattctcaacggtgttgtcgggctgctgggatttgaagcgaaaggctggcaaacctatgcggttgggctggtgacctgggtaatcagtttctggctggcgggattcattatccgccgtcgccccgatgagacgacgacggcagagaaaaccgactaa

SEQ ID NO: 2774 - DNA, 672 bp, Enterobacter cloacae
tcttccgccgaaatttggataaattgtgacttatttcacaaatatgatgactgggaagataaaacaccaaagtctgcaaggccgcatctctggcgctatgtcattgcgcgtaacttgctaatctgtcggcgaattcgcctaaaaatgaagactatttctgttatggaatcctggaaagttaacctcatttcagtctggttcggctgcttcttcaccggactggctatcagccagatattgcccttcctgccgctgtatgtgtcgcagctgggggtcacttcccatgaagcgctctccatgtggtccggcctgacgttcagcgtgacgtttctggtctccgccattgtgtcaccgatgtggggtagcctggcagatcgcaaggggcgcaagttgatgctgctccgcgcctcgctggggatggcgatagccattttgctccaggccttcgccaccaacgtctggcagctgtttattctgcgggcgataatggggctgacctccgggtacattccgaatgccatggcgctggtggcctcacaggtaccgcgtgagcgaagcggctgggcgctcagcacgctttccaccgcccagatcagcggggtcattggcggcccgctgctcggcggcttcctggcggaccatgtcgggctgcgtgcggtctttatcattact

SEQ ID NO: 2775 - DNA, 1167 bp, Enterobacter cloacae
ggtgaagacgaccgtgacatccgtgatccgatggagctgatggatgaagtggaaaacgagctgaagattgcctgcgcgccaatcacctggccgattggctgcggcaagctgttcaaaggggtttaccacctctataaagacgaaacctacctgtaccagaccggtaagggtcacaccattcaggaagtgcgcatcgtgaaaggtctggacaacccggatctggacgcagcggtcggtgaagaactggccgcgcagctgcacgatgagctggagctggttaaaggcgcgtcgcacgagttcgatcgagagctgttcctgagcggtgaaattaccccggtcttcttcggtaccgccctcggcaacttcggcgttgaccatatgctcgacggtctggtggagtgggccccgcagccaatgccgcgtaaaaccgacacccgcgaagtagaagcaaaggaagagaagttctccggcttcgtctttaaaattcaggccaacatggacccgaaacaccgcgaccgcgttgcctttatgcgcgtggtctccggtaagtacgagaagggcatgaagctgcgtcaggtccgtatcggtaaagacgtggtgatctccgacgcgctgaccttcatggcaggcgaccgttcgcatgtagaagaagcctatccgggtgacatcattggtttacacaaccacggtaccattcagattggcgataccttcacgcagggcgagatgatgaagttcaccggtatcccgaacttcgcgccggaactgttccgccgcattcgcctgcgcgatccgctgaagcagaagcaactgctgaaaggcctggtccagctttccgaagagggggctgtacaggtgttccgccctattgctaacaacgatctgatcgtgggcgcggtgggtgtgctccagtttgacgtggtggttgcccgtcttaagagcgagtacaacgtggaagcgatttacgaatcggtgaacgtggcgaccgcccgctgggttgaatgttcagacgtgaagaaattcgaagaatttaaacgtaagaacgaagttcagctggcgctggacggtggcgataacctgacctatatcgccccgaccatggttaacctgaacctgacgcaggaacgttatcctgatgttcagttccgcaaaacgcgcgagcattaa

SEQ ID NO: 2776 - DNA, 732 bp, Enterobacter cloacae
aaggaactgaagatggcaactcctcacattaatgcagaaatgggtgatttcgctgacgtcgtattgatgccgggcgacccgctgcgcgcgaagcacattgcagaaaccttcctcgaagacgtgcgtgaagtgaacaacgtgcgcggcatgctgggcttcaccggtacctataaaggccgcaaaatctccgtgatgggtcacggcatgggtatcccatcctgctccatctacaccaaagagctgatcaccgatttcggcgtgaagaaaatcatccgtgtcggctcctgcggcgcggttcgcatggacgttaagctgcgtgacgtggtgatcggcatgggcgcgtgcaccgactctaaagttaaccgcatccgctttaaagatcatgactttgcggccattgctgactttgacatggtgcgtaacgcggttgacgcggcaaaagcgctgggcgtagacgcgcgcgtgggcaacctgttctctgccgatctgttctactcgccagaaggcgacatgttcgacgtgatggaaaaatacggcattctgggtgtggaaatggaagcggccggtatctacggcgtggcggctgaattcggtgcgaaagcgctgactatttgcaccgtgtctgaccatatccgtactcacgagcagaccaccgctgccgagcgtcagaccaccttcaacgacatgatcaaaatcgcgctggaatccgttctgctgggcgataaagagtaa

SEQ ID NO: 2777 - DNA, 1389 bp, Enterobacter cloacae
accgtggcgaaagctccaaaacgcgcatttgtctgtaatgaatgtggtgcggattatccgcgctggcaggggcaatgcagcgcctgtcatgcctggaacaccatcaccgaagtgcgtggtgtggcggcttcgccgagcgtggcccgcaatgaacggctgagcggctatgcgggcaatgcaggcgtgtcgaaggtacaaaaactttcggatatcagccttgaggcgctgccgcgcttctcaaccggattcaaagaatttgaccgcgtgctcggcggtggcgtagtgccgggcagcgctatactcatcggcggtaacccgggcgcgggtaaatcgaccctgctgctgcaaacgctctgcaagctcgccgaacagatgaaaaccctgtacgtcacgggggaagaatcactccagcaggtggcgatgcgcgcgcaccgcctcggcctgccgaccggcaatctgaatatgctgtcggaaaccagcatcgagcagatctgcatgatcgccgaagaagagcagccgaagctgatggtgatcgactccattcaggtgatgcatatggctgacattcagtcgtcaccgggaagcgtggcgcaggtgcgtgaaaccgcggcctacctgacgcgctttgccaaaacgcgcggcgtggcgattgtgatggttggtcatgtgaccaaagacggctcgctggcgggaccgaaagtgcttgaacactgtatcgactgctcggtaatgctcgatggcgatgcggattcccgttttcgtaccctgcgcagccataaaaaccgcttcggcgcggtgaatgaacttggcgtctttgccatgaccgagcaggggcttcgcgaagtcagcaacccgtcggccatcttcctgagccgtggcgacgagatcacgtccgggagttcggtgatggtgctgtgggaaggaacgcgtccgctgctggttgaaattcaggcgctggtggatcactcaatgatgggcaacccgcggcgcgtggcggtcggtctggaacagaaccgcctggcgatcctgctggcggtgctgcaccgtcacggcggtctgcaaatggcggatcaggacgtgttcgtcaatgtggttggtggggtgaaggttacggaaaccagcgcggacctggcgctgctgctggcaatggtttccagcctgcgcgacagaccgttgccgcaggatctggtggtatttggtgaggtagggctggccggcgagatccgcccggtgccgagcggtcaggagcgtatctccgaagcggcaaaacatggcttccgccgcgcgattgttccggccgccaacgtgccgaaaaaaattccggaagggatgcaggtttttggcgttaaaaaactcgcagatgcgttaaatgtctttgacgacttataa

SEQ ID NO: 2778 - DNA, 906 bp, Enterobacter cloacae
acaatcatgtttaaacagcttcaggatatggcactgtttgcgctggtggccgagatgggcagctttaccgcggcggcgcagaaggcggaactgccaaaatccagcgtcagccagcgtattagccagctggagcagcaggtggggatccgtctgttgaatcgcacgacgcgcagaataagcctgacgtttgcgggcgagcactatctggtgcactgtcgcgagatgctggcggccagcgagcgcgcggagtatgccattcagcggctgcgagaaaaccccagcgggcggctgcggatcacctgtccggcaggaattggcgcgacgctgctggcgcatatgaatgccgagttccagcttcgctatccggacgtgtcactggatgtgtcgatctcagacgacgtggtggatctggtcgagtctggctttgacgtggcgctgcgcaccggcaaaccgcaggattcttccctgattggccgcatgattgggcactgtccgcgctacatgctggcctcgcccgactacctggcacgccgggagccgttaattcatcccagacagctggtggagcatcgctgcattacgcaccgggcatggtcggagtggcttctgcgaagcgagaatgaggattaccgctacctgccggataacgctcatatgacggataatctggtgtacgccagggaatgcgccattgccggggcggggatcacgctgttacccgcattcctgctggaagataagatcgaaaagggcgcgctggtgaaggtgttgtcggcgtggagcgttgagggaaacgatctctggctggcctacccgagtcgtaagctcaattcgcctgcgctgatgagctatatcgactttgcgatgcagtttgatgaggtgaagcggtattacgtgggcgggtga

SEQ ID NO: 2779 - DNA, 414 bp, Enterobacter cloacae
gcgatgccgagtggcagagacgttactgatcggcgcgggttgtgttatgctgtactcgctaatgagtacaagaggcagcataacatgacccagcattccccgtattcctcggccatggccgaacagcgtcatcaggagtggcttcgttttgtggagttgctccgccagtcttacgacaaagatctgcatttaccgttgctacagctgatgctgacgcccgatgaacgcgaagcgctgggcacgcgggtacgcattattgaggaactgctgcgcggcgaaatgagccagcgcgagctgaaaaacgagctgggcgcgggcatcgcgaccattacccgtggttcaaacagcctgaagtcggcgccggttgaactgcgtcagtggctggaagcggtattgctgaaaaacgccggatga

SEQ ID NO: 2780 - DNA, 432 bp, Enterobacter cloacae
cgccagaattacggcctggtggtaaacgctcgaacgggtgagcttgcccgcggtaaagacgccaatcgccccctctttacgaccaatatcatcaatgccggtgtagtgcgacattaccggacccagcgcctcacccgcgcggactttctccagtatgacctccggcagcggcagcgtggcagaacgcgcttcgccgcgctgctcgcggctttcgatgacaacccagctgaaggtcgctccttcgtcgataccagcatcaatcgcgacccagaagtcagcgtctggcgcggcggcttttgcattcgccacgcgatttcgtgcgccagcgcgtgtttcctcgctgccaaacggctgttccggcacaccgctctcgacgccgacggcgtcaatatggcaggatccttcgccaaagatctcttcaaatgcccttag

SEQ ID NO: 2781 - DNA, 571 bp, Enterobacter cloacae
cggaaaaaaagcatgttacaggtataccttgttcgccacggtgaaacgcagtggaacgccgagcgacgtattcaaggccagtcagacagtcctctcaccgacaaaggtgtgcagcaagcgtggcaggtggcggagcgcgccagaacgctgggcatcactcacgtcatctccagtgatttaggccgcacacagcagacggcacgcatcatcgccgatgcctgtggctgcgacgtgaccctcgaaccgcgtctgcgcgagctggatatgggcgtgctggaaaaacgtcctatcgatacgctgacggaaaccgaagaaggctggcgccgcacgctggtgaacggcactgaagatggtcgcatccctgagggtgaatccatgcaggagctgagcgtgcgcatgcatgccgcgctggccgagtgcctgaaactcccggcaggtagccgaccgctgctggtgagccacggtatcgcgctgggttgtctggtgagcaccattctgggactgccagcttacgccgaacgccgtttgcgtctgcgcaactgttccatttcccgtatcgactatcatgaga

SEQ ID NO: 2782 - DNA, 642 bp, Enterobacter cloacae
tgggcaaaacacaggaataaatcgatgaatatgacaagactgaagatttctaaaactctgctggctgtaacgttgggtagtgtcctggtaagcggttctgctctggcggaatccagcaccatggataaagcgcaaagttccgccaataccgcaggggaaaaaatcgatagctctatgaataaagtcggtaatttcatggatgacagctcaatcacagcaaaagtgaaagccgcactggtggatcacgactccattaagagcaccgatatttctgttaaaaccgacaacaaggttgtcaccctgagcggtttcgttgaaagccagacccaggctgaagaagccgttaaagtggcgaaaggtgttgagggcgtaagctccgtcagcgacaaactgcacgtacgtgacagcaaagaatcgtccgtgaagggctatgccggagatgcagcaactaccagcgaaatcaaagctaaactgttagccgacgacatcgtgccatcccgtatggtgaaagttgaaaccaccgatggtgtggtccagctgtccggtacggttgagaatcaggcacaaagcgatcgtgccgagtcaattgcaaaagctattgatggtgtgaaaagcgtcaaaaacgatctgaaaacgaagtaa

SEQ ID NO: 2783 - DNA, 327 bp, Enterobacter cloacae
cgaggatctggcatgacgcactgctttatcgatacccattgccactttgatttcccgccgtttagcggggaggaaacatccagtcttgcgcgtgcggctgaggccggtgtgagagccattattgtgcccgctattgaagcggcgagattcgacaaagttctggcgcttgcccgggggcacgatgcgctgtatgccgcgttgggtctgcatccgatcgttattgagcaccatcttgatgaccatctcgacaggctggatgccacgctgcaaaacgcggatacgaagctggttgccatcggtgagatcggcctcgatctctatcgttaa

SEQ ID NO: 2784 - DNA, 468 bp, Enterobacter cloacae
gatccgcagtttgaacgccagcagacgattctggacgcgcagctccggttggcaaagcgccacgatctgccggtgatcctccactccagacgtacccatgacaaactggcgatgcacctgaagcgcatcgacgtgccgcgcaggggcgtggtccatggtttcgctggaagccttcagcaggcgcagcgttttatcgagctgggctataaaattggcgtcggtggcaccattacctatccgcgtgccagcaaaacccgtgatgtgatggcacagctcccgctgacctcgctcctgctggaaacggatgcgcctgacatgccgctgaatggttttcagggccagcctaaccgcccggagcaggcggcgcgcgtttttgatgtgctgtgtgagttgcgtcaggagcctgaagatgtgattgccagcgcgctgctggaaaatacccgagcggtcttcggcatcacgctatag

SEQ ID NO: 2785 - DNA, 1239 bp, Enterobacter cloacae
gtacggagaacaattatgaaacgtgcatttattatggtgctggactcattcggcatcggcgcaaccgaagatgcagaacgatttggtgacgtgggttccgataccctgggtcacatcgcggaagcctgtgcaaaaggcgaagcggacaacggtcgtaaaggccctctgaacctgccaaacctgacccgtctggggctggtaaaagcgcatgaaggctctaccggtaagatcgcagccggtatggacggtaacgcggaagtggtgggcgcctacgcgtgggcgcacgagctctcttccggtaaagatactccgtccggccactgggaaatcgccggcgtgccggtgctgttcgactggggttacttctccgatcacgagaacagctttccgcaagagctgcttgataagctggtgaagcgcgccaacctgccgggctacctcggtaactgccactcttccggtaccgtgattctggaccagctcggcgaagagcacatgaaaaccggcaagccgattttctatacctctgctgactccgtgttccagatcgcctgccatgaagagacgtttggcctggataaactgtacgagttgtgcgaaatcgcccgtgaagagctgaccgaaggcggctacaacattggccgcgttatcgcgcgtccgtttatcggcgacaaagcgggtaacttccagcgtaccggcaaccgtcacgatctggctgtggagccaccggcgccgacagtgctgcaaaaactcgtcgacgagaaagacggtcacgtggtttccgtgggtaaaatcgcggacatttacgccaactgcggcattaccaaaaaggtcaaagcgaccggtctggatgcgctgttcgacgccaccatcaaagagatgaaagaagcgggcgataagaccattgtcttcaccaacttcgtggacttcgactcctcctggggccaccgtcgcgacgtcgccggttatgctgcgggtctggagctgtttgaccgccgtctgccagagctgatggagctggtgggagaagatgacattctgatcctgaccgctgaccatggctgtgacccgacctggaccggtaccgaccacacccgtgagcacattccggtgctggtgtacggcccgaaagtcaaaccgggctcgctgggtcaccgtgaaaccttcgcggacatcggccagacgattgcgaaatactttggtacgtctgacatggaatatggcaaggctatgttctaa

SEQ ID NO: 2786 - DNA, 1071 bp, Enterobacter cloacae
aatttacggcttaatgttgccagaagtgatggttacagggtagcctcatgcgttattttccctctggaaccttccggcgcgaacgaaattacaggagcttcaatgccgaacattacctggtgcgacctgccaacggatgtctctttatggccaggattgccgctctctttaagtggcgatgaggtgatgcctctcgattaccacgctggccgtagcggctggctgctgtacggacgcggcctggataagcaacgcctcacccagtatcaaaccaaactgggcgcagcgatggtcatcgttgcggcctggtgtgtggaagattatcaggtcattcgcctggcgggttccctgacgcagcgcgccacgcgtctggcgcacgacgccgggctggacgttgctcccctcggcaaaattccgcacctgaaaacgcccggcctgctggtaatggacatggactccaccgccattcagatcgagtgtattgacgagattgctaaactggcgggcagcggagagctggtggcggaagtcaccgagcgcgcgatgcgcggcgagctggatttcaccgccagcctgagacagcgcgtggcgaccctgaagggggccgatgctaacattttgcgtcaggtgcgcgatgaactgcccctgatgcctgggcttacgcagctggtactcaagctggagacgctcggctggaaagtggcgattgcctccggcgggttcactttctttgccgactacctgcgtgacaagctgcgtctgaccaccgtggtggcaaacgagctggagatcatggacggcaaactcaccggacaggtcatcggcgacatcgtggatgcgcagtacaaagccaatacgctgacgcgtctggcagagaaatatgccatcccggtcgagcagaccgtcgccatcggcgatggcgcgaacgatctgccgatgatcaaagttgccgggctgggtattgcctaccatgccaaaccgaaagtgaatgaaaagacggaagtcactatccgtcatgctgatctgatgggggtgttctgtattctctccggcagcattaatcaaaaataa

SEQ ID NO: 2787 - DNA, 1770 bp, Enterobacter cloacae
aaaacggcaaccgaagttgccgttttgcttttatttcgcaatacgcttgtacttaatacgcttcggctccagcgcgtctgcgcccagcgtgcgtttcttgtactcttcgtattcggtgaagttaccttcgaagaactccaccttaccttcgtcctggtagtccaggatgtgggtcgcgatacggtccaggaaccagcggtcgtgcgagataaccatcgcgcagcccgggaactccagcagggcgttttccagtgcgcgcagggtttcgatgtccaggtcgttggtgggttcatcgagcagcagaacgttgccgccaacctggagcagtttcgccaggtgcagacgaccgcgttcgccgccggacagttcgcccacgcgtttgccctggtcggtgcccttgaagttaaagcggccaacataggcgcggcttggcatctcggtgttgccgatacgcatgatatccagaccgccggagacttcttcccacacggttttgctgttgtccatcgcgtcgcggaactggtcaacggaggccagcttcacggtctcacccagggtgatagagccgctgtcaggctgttcctgaccagacatcatgcggaacagggtggatttacccgcgccgttcggaccgatgatgccgacgatagcgcctttcggaacggagaaggtcagatcgtcgatcagcacgcggtcgccgtaggacttacgcaggttagtcacttcaaccactttatcccccagacgagctccaggtggaataaacagttcgttggtttcgttacgtttctggtattcggtgttgttcagctcttcgaagcgtgccagacgggctttgcccttagactgacggcctttcgcgccctgacgcacccactccagctctttctcaatagacttacggcgggcggcttcctgagacgcttcctgcgccagacgctggtctttctgctccagccaggaggagtagttgccttcccacggaataccttcgccgcggtccagctccaggatccagcccgcaacgttgtcgaggaagtaacggtcgtgggtaatcgctaccacggtgccttcgaagtcatgcaggaagcgctccagccacgccacggattcggcatccaggtggttggtcggttcgtcgagcagcagcatgtctggtttttccagcagcaggcggcacagcgccacgcggcggcgttcaccaccggacaggttagcgattttcgcatcccagtctggcagacgcagggcatcagccgcgcgctccagctgcacgttcaggttgtgaccatcgtgcgcctggataatttcctcatatttgccctgctgagcggccagtttgtcgaagtccgcatccggctcggcgtatttggcatacacttcatccagacctttcagggcgttaaccacctcggataccgcttcttcaacggattcacgcacggtgtgctccgggttcagctgaggttcctgcggcaggtagccgatcttaatgccaggctgcggacgggcttcaccttcgatgtctgtatcgatgccggccatgatgcgcagcagggtggacttaccggcaccgttgagacccagaacaccgatttttgcgcccgggaagaagctcagcgagatatttttaagaatatgacgtttcggcgggacaactttgccgacacgatgcatggtataaacgaattgagccacgttggacttcgcctcttttatcgtgatgagaatgaatttcagcctcgaagtgtagcctttttcacgccctaa

SEQ ID NO: 2788 - DNA, 1113 bp, Enterobacter cloacae
gaaccaccggggaagtgcgttactgtgtctcatcacaataatgaaaacaggaaggcagaggtggggcaacgaattcccgttacgctcggcaatattgcgccgctgacgttaaaaccgtttcatgcagaccagcttgcgctggtctgtgaagggggcgggcagcgcggtatttttaccgccggcgtgctcgacgaatttatgcgcgcgcaattcaacccgttcgatctctatttcggtacctctgccggggcgcagaacctctccgcctatgtctgcaaccagcccggctatgcgcgcaaagtgattatgcgctataccacctcgaaagaattcttcaatccggtacgcttcgtgcgcggcgggaacctgatcgatctcgactggttactggatgccacctccagccagatgccgctggccatggataccgcgtcacgactgttcgataccggcaaagagttctggatgtgcgccagccgtggcgatgactattcgccgggttacttttcgccgcagaaagagaactggctggatatcatccgcgcatccagcgcgatcccgggattctaccgcaccggcgcgttgctggaggggataagctatcttgacggtggtatcagcgacgcggtgccggtacaggaggcggcgcggcgcggggcaaaaaccattgtggtgatccgcacggtgccttcgcagatgtattacaccccacagtggtttaagcggatggaacgctggctgggcgacagcagcctgcaaccgctggtgaatatcgcgaagcagcatgaaaccacctacggcgcgatgcagcgttttattgaaaaaccaccgggcaagctgcgcatctttgaaatttatccgccgaagccgctgttgagcatggcgctgggcagtcggctgcctgcgttgcgtatggattacaaaacggggcggctgtgcgggcgttacttcctggcgaccgtcgggaaaatgctggccgagcaaccgcctcttcatcggcataaaagcatcattttgccgcctgccgttgtggccaatgacgcggtggcgatgccgctggtggacgcgccgcaggccaacgatggcttactcgataacgaggatctggcatga

SEQ ID NO: 2789 - DNA, 948 bp, Enterobacter cloacae
tcagcaattaacgcactaaaatttgaagaagatctcattacagtaatgcaaatttgcacacagttttcattaactgtgatgaatgtcgaagtgtggatgcgggtgaatgttagaatactcacagacccgcaaggtaaaatttatacggcactgccgttggagaatgttatgaccgatttaactgcaagcagcctgcgcgcgttgaaactgatggacctgaccaccctgaacgatgacgacaccaatgaaaaagtcatcgccctgtgccatcaggcgaaaacgccagtgggtaacaccgccgccgtctgtatctatccgcgcttcatcccgattgcccgcaaaacgctgaaagagcagggcacgccggaagtgcgcattgccaccgtaactaacttcccgcacggcaatgacgatatcgagatcgctctggcagaaacccgcgcagcgattgcgtacggcgcagacgaagttgacgtggtattcccgtaccgcgcgctgatcgccggcaacgagcaggtcggttttgacctggtgaaagcctgtaaagacgcgtgtgcggcggcaaacgtgctgcttaaagtgatcatcgaaaccggcgagctgaaagaagaggcgctgattcgtaaggcgtctgaaatctccatcaaagcgggcgcggatttcattaaaacctctaccggtaaagtgccggtcaacgctaccccggaaagcgcacgcatcatgatggaagtcatccgtgatatgggcgtgtccaaaaccgttggcttcaaaccggcaggcggcgtgcgtaccgcagaagacgcgcagcagttcctggcgattgccgacgagctgttcggcgccgactgggcggactcccgccactaccgcttcggcgcgtccagcctgctggccagcctgctgaaagcgctgggtcacggcgacggtaagagcgcaagcagctactaa

SEQ ID NO: 2790 - DNA, 1422 bp, Enterobacter cloacae
gttgaattgccgggtggcgctacgctaacccggcctaaaggatcgtggggcgggtcaacatacccgccgccattcacccgattccgcatggaggttaccgtgtttctcgcacaagaaattattcgtaaaaaacgtgatggtcatgcattaagcgacgaagaaatccgcttctttatcaatggcattcgtgataacaccatctctgaagggcagattgcggctctggcgatgaccattttcttccacgatatgtcgatgcctgagcgcgtgtcgctgaccatggcgatgcgagattcaggaaccgttctggactggaaaagcctcaacctcaacggcccgattgtggacaaacactccaccggcggcgtgggcgacgtgacctccctgatgcttggcccgatggtggcagcctgcggcggttacatcccgatgatttccgggcgcggcctgggccacaccggcggtacgctcgacaaactggaagccattccgggcttcgatatcttcccggatgacaaccgcttccgcgacattattaaagacgttggcgtggcgattatcggccagaccagctctcttgctccggcagataagcgtttctacgcgacgcgtgacattaccgcgaccgtagactccatcccgctgatcaccgcctctatccttgccaaaaaactggcggaaggtctggatgcgctggtgatggatgtgaaagtgggcagcggcgcgtttatgccgacctatgaactctctgaggcgctggccgaagcgatcgttggcgtttccaacggcgcgggcgtgcgcaccaccgcactgctgacggacatgaaccaggtgctggcctccagcgccggtaacgcggttgaagtccgcgaggctgtgcagttcctcacaggcgaataccgtaacccgcgcctgttcgacgtcaccatggcgctgtgcgttgagatgttaatctccggcaagctggccaaagacgacgctgacgcgcgcgcgaagcttcaggcggtgctggacaacggcaaagcggcggagatctttggtcggatggtggcggcgcagaaaggcccgaccgacttcgtggaaaactacgcgaaatacctgcccaccgcgatgctcagcaaagcggtctatgcggatagcgaaggctttgtctcggctatggatacccgcgcgctcggcatggctgtcgtgtctatgggcggcggtcgtcgtcaggcatcggacaccattgattacagcgtcggctttaccgatatggcccgtctgggcgacagcgttgacggccaacgtccgctggcggtgatccacgcgaaagatgaagccagctggcaggacgcggcgaaagcggtgaaggcggcaatatctcttgacgataaagcaccggaaaccacaccgacggtctatcgtcgtatcactgaatag

SEQ ID NO: 2791 - DNA, 258 bp, Enterobacter cloacae
aattcaggcgctggtggatcactcaatgatgggcaacccgcggcgcgtggcggtcggtctggaacagaaccgcctggcgatcctgctggcggtgctgcaccgtcacggcggtctgcaaatggcggatcaggacgtgttcgtcaatgtggttggtggggtgaaggttacggaaaccagcgcggacctggcgctgctgctggcaatggtttccagcctgcgcgacagaccgttgccgcaggatctggtggtatttggtga

SEQ ID NO: 2792 - DNA, 1236 bp, Enterobacter cloacae
tttatgtcatcatttgactacatcaagaccgctatccgccagaagggctgcacgttgcagcaggtggcggacgccagcggcatgaccaagggctacctgagccaactgctgaacgccaaaatcaaaagccccagcgcgcagaagctggaagcgctgcaccgttttctggggcttgaatttccgcggatgcaaaagaacattggcgtggtgttcggtaagttctacccgctgcataccgggcatatctatctgatccagcgcgcctgtagccaggtcgacgagctgcatatcatcatgggttatgatgaaacccgcgatcgccagctgtttgaagacagcgccatgtcgcagcagcccaccgtgccggaccgcctgcgctggctgcttcagacctttaaatatcagaaaaatattcgtattcatgcctttaacgaagagggcatggagccgtatccgcacggctgggacgtgtggagcaacggcatcaaagcgtttatggaagagaagggcattgcgcctaactggatctacacctctgaagagtccgacgcgccgcagttccgcgagcatctgggcatcgagacggtgctgatcgatcctaaacgcaccttcatgaacatcagcggggcgcagatccgcgagaacccgttccgttactgggactacatcccgaccgaggtgaagccgttcttcgtgcgtacggtggcgatcctcggcggtgagtcgagcgggaaatcgacgctggtcaataagctggcgaacatcttcaacaccaccagcgcgtgggagtatggccgcgattatgtcttttcacaccttggcggcgacgagatggcgttgcagtattccgactacgataaaatcgcgctcggtcatgcccagtacattgatttcgcggtgaaatacgccaataaagtcgcctttattgataccgatttcgtcaccacgcaggcgttctgcaaaaagtacgaggggcgcgagcacccgtttgtgcaggcgctgattgacgaataccgctttgacctggtgatcctgctggaaaacaacaccccatgggtggccgacggcatgcgcagcctgggcagctccgtggacaggcgtgagttccagaccatgctggtagagatgcttaacgagaacaacgttgagtttgtccatgtggaagagtcggactacgacacccgtttcctgcgctgcgtcgagctggtgaaggagatgatgggggagcaggggtaa

SEQ ID NO: 2793 - DNA, 1983 bp, Enterobacter cloacae
cgtggcaagacgctgcaactgacgaaaaacaatgaggaagagcttgtggaaaaagccaaacgggtggtctggcgtctgctggctgccagcgtatgcgtaatggcggtaagccaggcggtgcatgccgattcactggatgaacaacgtagccgctatgcccagattaagcaggcatgggacaacaagcagatggataccgtgcaggcgctgatgccgacgctcaaggattatccgctgtatccgtatctggagtatcgccagatcacggacgatctcatgaatcaaccgaccgtcaccgtgaataatttcattcaggcgaacccgaccctgccgcctgcgcgtaccctgaagtcccggtttgtgaacgagctggcccgtcgcgaagactggcgcggcctgctggctttcagcccggataaaccgggcgcgacggaagcgcagtgtaattactattatgcgaaatgggcgaccggtcagcaggaggaagcctgggtcggtgcgaaaaagctgtggttgacgggtaaaagccagccaaacgcctgtgacccgctgttcagcgcctggcgcgcgtcggggcagcaggatccgctctcctacctcgaacgcatccgcctggctatgaaggccgggaacacgcggctggtcaccgtgctggcggggcaaatgccggcggattatcagaccattgcttctgccgttatcggcctggcaaacgatccgaacaccgtcctgacgtttgcgcgtaccaccggcgcgaccgattttacccgccagatggcggcggtggcctttgccagcgtggcgcgtgatgatgtggaaaacgccaggctgatgatcccgcagctggtgcaggcccagcagcttaatgacgatcaaactcaggagctgcgcgatatcgtggcatggcgactgatgggaacagatgtcaccgacgaacaggcgcgctggcgtgatgatgcggtgatgcgttcaaactctgtctcgctggtggagcgtcgcgtgcgcatggcgctgggaacgggcgatcgtcgtggcctcaatacctggctggcgcgtctgccgatggatgccaaagagaaagatgaatggcgttactggcaggcagacctgctgctggaacgtggtcgtgacgatgaagccaaagagatcctccactccctgatgcagcagcgcggattctacccgatggcggcggcgcagcgtctaggcgaggagtacaccctgaagatcgacaaagcgccagccaacgcgaacccggcgctgacgcaggggccggaaatggcgcgcgtgcgcgagctgatgtactggaatctggataataccgcgcgcagcgaatgggcgaatctggtcaccagccgtaccactgaagagaaagcgcagcttgcccgctatgcgtcagataatcgctggtgggatctgagcgtgcaggcgacgatcgccggcaaactgtgggatcatctcgaagagcgtttcccgctggcttataaggatctgttcgatcgctacaccagcggcaaagatattccgcaaagctacgcgatggccattgcccgtcaggagagcgcctggaacccgaaagtgcgttcaccagtgggtgccagcggcctgatgcagattatgccgggcaccgcgacgcacacggtgaagatgtttaatattccaggctacagcagcccgtcccagctgctggatccggagaccaacatcaacatcggtaccagctacttgcagtacgtctatcagcagttcggtaataaccgtatcttcgcgtcagcggcgtacaacgccgggccaggccgcgtgcggacatggcttggtaacagcgcagggcgtatcgacgccgtggcgtttgtcgagagcattccgttctcggaaacgcgcggctatgtgaagaacgtgctggcctatgacgcctactatcgctacttcatggggcagaaagataccctgatgagcgatgccgagtggcagagacgttactga

SEQ ID NO: 2794 - DNA, 567 bp, Enterobacter cloacae
catgctttttttccgttatactgcgatgaattttttaaatcgagcttaattatgcaccatgttgtctctgctaccaccaatcctgccaaaattcaggcaattctaagggcatttgaagagatctttggcgaaggatcctgccatattgacgccgtcggcgtcgagagcggtgtgccggaacagccgtttggcagcgaggaaacacgcgctggcgcacgaaatcgcgtggcgaatgcaaaagccgccgcgccagacgctgacttctgggtcgcgattgatgctggtatcgacgaaggagcgaccttcagctgggttgtcatcgaaagccgcgagcagcgcggcgaagcgcgttctgccacgctgccgctgccggaggtcatactggagaaagtccgcgcgggtgaggcgctgggtccggtaatgtcgcactacaccggcattgatgatattggtcgtaaagagggggcgattggcgtctttaccgcgggcaagctcacccgttcgagcgtttaccaccaggccgtaattctggcgttaagtccgttccataacgcgatttatcgttaa

SEQ ID NO: 2795 - DNA, 1041 bp, Enterobacter cloacae
actagcctcaacaaaacgaatgccattgaggagcacaccatgtcagtgaaagccattgccgttaacccagaaaatccctccaccttcgttgaaatcaccccgccgatgccgcagcccggcgaacacgatctgctggtggaggtgaaagccgtctccgtaaacccggtggacaccaaggtacatgcaggcattgctaaaagcgggctgaaggagccgcgcattctcgggtgggatgccagcgggatcgtaaaagccgttggggctggcgtcaccggattcaaaccgggtgacgaagtgtggtacgcgggggatatcacccgaccgggcagcaataccacacatcagctgatcgatgcgcgcattgtcgggcacaagcctgcaagccttgactgggccgccgcggctgcactgccgctgacggcgctcaccgcgtgggaaggcctgtttgaacggctgaagattcaggatgccgacgcagataaaacgctgctgattattggcggcgcgggtggagtcggatcgctggcgatcccgtttgcgaagcacaacagcaaggtgaagatcgtcgcaaccgcttcgcgagaagattccgcccagtggtgccgcgatcgcggggcggacatagtcgtaaattaccgcgacctgaagggggaaatggcgaaacaggggctcacctttgtggattacatttttatcctcaacgacaccgacgggcactgggatgcggtcagcgatctgattgcccctcagggacacatttgttccatcgttgaaaacgcgcatccgctgaatcaggacaagctgaagtccaaatctgccgccctgcactgggagtttatgtacacccgcagcatgtaccagactgcggatatggcgcgtcagggtgagattttaaatgaggtggcgaagctggtggataacggcgtagtggaaagttcgctcagcgaaacgctgcacgggctaagcgtggaaagcattaccgaagcgcaccgcaaggtgctggagggacatatgcgtggaaaggtggtggttgagtattga

SEQ ID NO: 2796 - DNA, 321 bp, Enterobacter cloacae
atatctctgattatcaacccgataaagtgtgaactatgcctcctcttaacagaggaggtattttgtcaggttaaaggattaatcttgatgtcagttgaatccacgatcgctcagtgcgccattgccgcaccgttattattctctgctctctttgctcaggcgtatgccgccggaatggtgccagaaaccacgctgctggttattgaagagtcgactcacagcggcaccatgaacgtaaaaaataccgacaccttcccggccctgatctataccatcattgtcgatcttcctgacgatacaggcgtgacgttaaacgcgtga

SEQ ID NO: 2797 - DNA, 1629 bp, Enterobacter cloacae
ctaaatcggcgatatcccctttctgatcaaagcgccaccaggctggcttcctacaattcgttcactatccgcagaacaaccaaggaagtgaacatgcccgacgccctgcaacaacgttgccagcacattgtgaccagcccggtgttaaccccggaacaaaaacgtcattttctggcgctggaagcggagaacaatctgccctatcccgctctgccagaggcggcccgcgccgcactggacgagggattcatctgcgacatgttcgaaggccatgcgccttacaaaccgcgctacgtgctgccggactacgctaaatttctggctaacggctcagaatggctggagctggaaggggcgaaagatctggatgatgccctctcgctgctcactatcctttatcaccatgttccgtccgtcacatcgatgccggtctatctgggccagctcgatgaaatactcagcccctatgttaaaattctaacacaggatgaaatcgatagccgaataaaacgtttctggcgttacctggacagaacgctgcccgatgcgtttatgcatgccaatatcggcccggcggatacgcctgtcacccgagccatccttcgcgcggatgcagaactaaagcaggttgcgccgaacctgacctttatctacgacccggatgtaacccccagcgatctgctgctgagcgtggcgaaaaacatttgtgaatgtagtaagccgcatatttctaatggcccggtgaatgataaaattttcacaaaaggtcgctatggcgtggtgagctgttacaactccctgccgctggcgggcggcggcagcacgctggtgcgcctaaacctgaaagcgattgcggaacacagccgctcaccggaagactttttcacccgtacccttccccactactgccagcaacaaatcgcgatcattaatgcgcgctgcgattttttatatgaacaatccggcttctttgagaatagcttcctggtaaaagaggggctgattgatgccgatcgctttgtgccgatgtttggcatgtacggtctggccgaagcggtgaacgtgctgtgccagaaagcaggcattacgggacgttacggtaagaacgaacaggccaatgcgctgggctaccgcatcagtgaacagcttgcggcgtttgtcgaaaacacgccggtgaaacacggctggaagcagcgcgcgatgcttcatgcgcagtcggggatcagctctgactcgggcaccacgccgggcgcgcgcctgccctacggcgacgagccggatcccatcagccacctgctggccgttgcgccgcaccacaagcactacgcttccgggatcagcgacattctgacgctggatgaaacggtaaaacgtaacccgcaggcagtggtccagctctgtctcggcgcgttcagggcggggatgcgcgagtttaccgccaacgttgcgggtaacgatctcgtgcgcgttaccggctatatggtgcggttatcggatctggagaagtaccgggaagccggatcgcgcaccaacaccacctggctcggcgaggaggccgcgcgcaatacccgtattctggaacgtcagccgcgcgtgataagtcatgaacagcagatgcgctttagttag

SEQ ID NO: 2798 - DNA, 1764 bp, Enterobacter cloacae
cactcccgacgttcctggctgggattagggcgtgaaaaaggctacacttcgaggctgaaattcattctcatcacgataaaagaggcgaagtccaacgtggctcaattcgtttataccatgcatcgtgtcggcaaagttgtcccgccgaaacgtcatattcttaaaaatatctcgctgagcttcttcccgggcgcaaaaatcggtgttctgggtctcaacggtgccggtaagtccaccctgctgcgcatcatggccggcatcgatacagacatcgaaggtgaagcccgtccgcagcctggcattaagatcggctacctgccgcaggaacctcagctgaacccggagcacaccgtgcgtgaatccgttgaagaagcggtatccgaggtggttaacgccctgaaaggtctggatgaagtgtatgccaaatacgccgagccggatgcggacttcgacaaactggccgctcagcagggcaaatatgaggaaattatccaggcgcacgatggtcacaacctgaacgtgcagctggagcgcgcggctgatgccctgcgtctgccagactgggatgcgaaaatcgctaacctgtccggtggtgaacgccgccgcgtggcgctgtgccgcctgctgctggaaaaaccagacatgctgctgctcgacgaaccgaccaaccacctggatgccgaatccgtggcgtggctggagcgcttcctgcatgacttcgaaggcaccgtggtagcgattacccacgaccgttacttcctcgacaacgttgcgggctggatcctggagctggaccgcggcgaaggtattccgtgggaaggcaactactcctcctggctggagcagaaagaccagcgtctggcgcaggaagcgtctcaggaagccgcccgccgtaagtctattgagaaagagctggagtgggtgcgtcagggcgcgaaaggccgtcagtctaagggcaaagcccgtctggcacgcttcgaagagctgaacaacaccgaataccagaaacgtaacgaaaccaacgaactgtttattccacctggagctcgtctgggggataaagtggttgaagtgactaacctgcgtaagtcctacggcgaccgcgtgctgatcgacgatctgaccttctccgttccgaaaggcgctatcgtcggcatcatcggtccgaacggcgcgggtaaatccaccctgttccgcatgatgtctggtcaggaacagcctgacagcggctctatcaccctgggtgagaccgtgaagctggcctccgttgaccagttccgcgacgcgatggacaacagcaaaaccgtgtgggaagaagtctccggcggtctggatatcatgcgtatcggcaacaccgagatgccaagccgcgcctatgttggccgctttaacttcaagggcaccgaccagggcaaacgcgtgggcgaactgtccggcggcgaacgcggtcgtctgcacctggcgaaactgctccaggttggcggcaacgttctgctgctcgatgaacccaccaacgacctggacatcgaaaccctgcgcgcactggaaaacgccctgctggagttcccgggctgcgcgatggttatctcgcacgaccgctggttcctggaccgtatcgcgacccacatcctggactaccaggacgaaggtaaggtggagttcttcgaaggtaacttcaccgaatacgaagagtacaagaaacgcacgctgggcgcagacgcgctggagccgaagcgtattaagtacaagcgtattgcgaaataa

SEQ ID NO: 2799 - DNA, 663 bp, Enterobacter cloacae
attttaagcaggtggaatatggctcgcgcaaaactgaaattccggcttcatcgcgccgtgattgtcctgatctgtctcgcactattagtggcgctgatgcagggggcatcctggtttagccagaatcaccaacgacagcgtaacccgcagtttgaggagctgggccggacgctggcgcgccaggtgacgctcaacgttgcgccgtctatgcgcaccgaaacgccggatgataagcgaatagccctggtattgcgccagcttacggaaaacagccgcattctggatgcgggcgtgtacgatgaacagggcgacctgattgcccgcgcgggtgagcatgtcgacgtgcgcgacaggctggcgctggacggcaaaaaagccggtggttatttcaaccaacaaatcgtcgaacccattcagggcaagaatggtccgctcggctatttacgtctgacactcgacacccacaccctgccaaccgaagccaaacaggtagataacaccaccaatattttgcgcctgatgctgctgctctcgctggcgattggcgtggtactggcacgtacgttgctccagggcaagcgcacccgctggcagcagtcgccgttcctgttaaccgccagcaagtcggttcccgaagaggaagagagcgagaagaaagaatag

SEQ ID NO: 2800 - DNA, 1050 bp, Enterobacter cloacae
agtaggcggatgattcggaaaaggaactctgccatgtcgacgttacgcctgctaatctctgactcttacgatccctggtttaacctggcggtagaagagtgcatcttccgccagatgcctgccacccagcgcgtcctgtttctctggcgcaacgctgatacggtcgttattggccgcgcgcaaaatccgtggaaagagtgtaacacccgccgtatggaagaggacaacgtccgcctggcgcgccgcagcagcggcggcggtgcggtattccacgatctgggcaatacctgctttacctttatggcaggcaagccggaatacgacaaaaccatctcgacctccattgtgcttaatgcgctcaattcgctcggcgtgacggctgaagcctcgggacgtaacgatctggtggtcaaaacgcccgatggcgaccgcaaggtatccggctctgcctatcgcgaaacgatggatcggggattccaccacggcacattattgctgaatgccgatctgagccgtctggctaactaccttaatccagataagaaaaagttacaggctaagggtattacctccgtgcgcggtcgcgtggcgaatctggtggaactgctgcccgggattactcatgagcagatttgcgatgcgatccgtgaagccttcttcgaacattacggtgagcgggtagaagctgaagtgatctcccctgacaaaacaccggacctgcccaacttcgcggaaacctttgcgcgccagagcagctgggagtggaacttcggccaggcaccggccttttcacacctgctggacgaacggtttacctggggcggagtggagctgcactttgacgtggagaagggccatattacccgcacgcaggtctttacggatagtctcaatcctgcaccgctggaggcgctggccgcacgtttacagggctgtctgtaccatgcagacagtctgcaacaggcgtgcgaagcgctgtgggtggatttcccggaccacgagcgggagctacgggatctctcccaatggatcgctggcgcggtgcgttaa

SEQ ID NO: 2801 - DNA, 696 bp, Enterobacter cloacae
ggattaacgatgaaaaaaatcattattgcaaccgctgttgcaatgaccctctctgcgactgcacatgccgactctactgcggtattaaaattaaaaggcgtattaaccaacaacgcctgtaccccaacgctgagcgatggcgctgtcgttgatttcggcactaaatatatcagctcgctctccgcaacggcagataaccagctgggttataaagatatttctctgactatcaactgctctgccgcaacgaaagtagcgtggtccattaccgatgatcacgcagattcaatgaagaaaatgaccatcgataacgccactttcgcgggcgatcaggcatggagttcaactaaccagtacggcgtaggtaaaacggctggcggcgtcaatatcggcgcttactccgtgggtatgaattcgaatgtaaccgtagatggaaacgtcaaagcattaggttattctgcgatagcagatgatccaatgtggttacttgcgaatacgggttcgcagctcgtcactcatagtgacggttctatccagtatagcgcactaaatagcagtgatcggacgttggttccctttatgaatgccgtattcccgctgcgcgttgcgctggcggtgcagaaaactgacaccctggcaattaccgacgataccccgatcgacggccaggccaccatcactttgcattatctgtaa

SEQ ID NO: 2802 - DNA, 699 bp, Enterobacter cloacae
ggaacaacaatgaaaaagattttagttgccactgccgttgcgctggccctctccgcgactgccgctaacgccgcctctaccgccgtactgaaagtgaccggtttactctccgttgccgcctgcaccccgcagttaagcggcggcggcgaggtagattatggtcttatccacctggcggatctctccgcgaccagcgttaaccagttgggtcagaaagatatctccctgaccatcacctgcccggtagccactaaagctggctggaccatcagcgatgaccgcgcagacacccatccgggtgcttctgtgatcaccattaacaccgcagacgcggcgggcggcaacgtttccgacaccacccagtcctacggcgtgggcaaaaccgcgggcggcgtgaaaattggcgcttactccatctttgctgatgtggcgaacgtcaccgccgacggcgtgaaatcagacgttatctccggtaccgtggacagcccgtcctggcagaaaaccgctaccggtatcatcaaaaacgccaacatggaaatgatgaccgtggccgcttccggcaccactgcgccgctgcctttcacgaccgcagtatttccgctgaaaacctccctggcgattcagaataccgcggccctcgcgattaccgatgataccaacctggatggtcaggccacgattaccgttaaatatctctga

SEQ ID NO: 2803 - DNA, 864 bp, Enterobacter cloacae
gtcatgaacagcagatgcgctttagttagtcaggtcatacccttctcctgcgtggacgggccgggcagccgcctggcgttgttcctccagggctgtaacctgcgctgcaaaacctgccacaacccgtggacgatagggcgctgcaacgactgcggcgactgtgtaccccactgtccgcatgatgcgctgacgattcaggccgggcgcgtctggtggcaggagagtcactgtcagcagtgcgacacctgtctgcacctgtgtcagcagcaggcgacgccgatggcgcagcgctatagcgtcgaggagatcctctcccgggtgctcacgtccgcgccgtttattgagggcgtgaccgtcagcgggggtgaggccaccacgcagctgccgtttttggttgcgcttttcaccgcgatcaaagccgatccgtccctgcgccatctgacgtgcctggtggacagcaacggcctgttaagcgaaaccggctggcaaaagctgtttccggtgtttgacggcgcgatggtggatctgaaagcctggggcaatgaacatcaccgttttctgaccgggcgcgaaaacacgctgatcaagcagagcatccgctggctggccgatcgtcatcgcctgacggagctgcgcctgctggtgatccccgatcggtgtgattatctgcaacatctgccatcgctgaccgcttttatccacacgttggagaacgttccggtgcggatcaacgcgtttcatgcccatggggtttacggggaggcggcgcgatggcggagcgccacgccggaggacatcgagccgctggcgcaggccctggaacggcagcagatcacggtgatccgcccggccctttatctatag

SEQ ID NO: 2804 - DNA, 315 bp, Enterobacter cloacae
cggcgtatcgatttaaacgagttattagtcgcccatccaagctccacttactttgtcaaagccgccggtgactcgatgatagaaggggggatcaataacggtgatttgctggtggtggacagttcccgcaagcctgagcatggcgatatcgtgattgcggcggtagagggcgaatttaccgtgaagcgcctccagctgcgtcccaatattcaactcaaccccatgaacagcgcctattcaccgattattgtcggcagcgacgatacgctcgatatctttggtgtagtgacgtatatcgtgaaatccgcgagctga

SEQ ID NO: 2805 - DNA, 570 bp, Enterobacter cloacae
tctcggcattacataagtccgtgcgcggcagcgccccggatgcggcgctctactggtatgcgcgtattatcaccgcaggtggcgatccgttatatgtcgcgcgtcgctgcctggcgattgcgtcggaagacgtcggcaatgccgatccgcgcgccatgcaggtcgcgctttccgcctgggattgctttacccgagtcgggcctgcggagggtgagcgcgccattgctcaggctattgtctatctggcctgcgcaccgaaaagcaatgcagtgtataccgccttcaaagcggcgatgtcggatgcacgtgaacgtccggattacgacgttccggtacaccttcgcaatgccccctacaaagctgatgaaagagatgggttacgggcaggagtatcgctacgcccatgatgaacccaatgcctacgccgccggggaggagtatttcccgcaggagatggcacaaacccgctattatcaccctacaaacagaggtcttgagggtaagattggcgaaaagctcgcctggcttgccggacaggatcaaaatagccctataaaacgctaccgttag

SEQ ID NO: 2806 - DNA, 2451 bp, Enterobacter cloacae
gtctttatgaaaatcaaagcgcctgaagcgttaatggctgccgaggtcactcgccgtgggttgatgaaaaccacggcaataggtggtctggcggttgccagcagcgcctttacgctcccctttacccgactggcgtcggcggcggaggctctgtctcccgcttcagccccggaaaaagtggtgtggagtgcctgtaccgttaactgcggtagccgctgcccactgcgtatgcacgtggtggacggtgaaatcaaatatgtcgaaaccgacaataccggcgatgataactacgaagggttacatcaggttcgtgcctgtctgcgtggtcgctcaatgcgccgtcgcgtatataacccggatcgtctgaaatacccaatgaagcgcgtcggtaagcgtggggaagggaagttcgagcgcattagctgggacgaagcctacgatattatcgcgaccaacatgcagcgcctgatcaaagagtacggcaacgaatctatctacctcaactacggcaccgggacgcttggcggcaccatgacccgttcctggccgccgggtaaaacgctggtggcgcgcctgatgaactgctgcggcggctatctcaatcattacggcgactactcttccgcacagattgccgcgggcctgaactatacctacggcggctgggcagacggcaacagcccgtcggatatcgagaacagtaaactggtggtgttgttcggcaacaacccaggcgaaacgcgcatgagcggcggcggggtaacctattaccttgagcaggcgcgcgccaaatccaacgcacgaatgatcatcgtcgatccgcgctacaccgataccggcgcagggcgtgaagacgagtggatccccatccgccctggtaccgacgcggcgctggtcaatgcgctggcgtatgtgatgattactgaaaacctcgtcgaccagccgttcctggataaatactgcgtcggttacgacgagaagacgctgccagccagcgcaccggctaacgggcactataaagcctatattcttggccagggcagcgacggcgtggcgaaaaccccggagtgggcatccactatcaccggcattcctgtcgaacgtattgttcagctggcacgtgaaattggttcaaccaaaccggcttatatcagccagggctggggacctcagcgccactcgaatggcgaaattgccacccgcgctatttctatgctctcgattctgactggcaacgtcggtattcacggcggtaatagcggggcgcgtgaaggctcgtatgaagtaccgtttgaacgtatgccaacgctggataacccggttcagaccagcatctccatgtttatgtggacagacgcgatcgagcgcggcccggaaatgactgcgctgcgcgacggtgttcggggcaaagataagctggacgtgccgatcaaaatgatctggaactatgccggtaactgcctgatcaaccagcactcagagatcaaccgcacccatgaaattttgcaggacgataagaagtgcgaaatgattgtggtgatcgactgccacatgacctcatcggcaaagtatgccgatattctgctcccagactgcaccgcgtctgagcagatggatttcgcgctggatgcctcctgcggcaatatgtcctatgtgatcttcactgaccaggccatcaaaccgcgcttcgagtgcaaaaccatctatgagatgacttccgagctggcgaaacgtcttggcgttgagcagcagttcactgaaggacgtactcaggaagggtggatgcgccatctgcacgagctctcacgcaaagccattcctgacctgccggacttcgataccttccgcaagcagggcatgtacaagcagcgcgatccggaagggcatcatgtggcgtataaagccttccgcgacgatccgcaggccaatccgctgaccacgccgtcgggcaaaatcgagatctactccgaagagctggcaaaaattgccgcaacgtgggaattgccggaaggggatgttatcgatccgctgccgatttatacgccaggcttcgaaaactacaacgatccgctgacggagaaattcccgcttcagttgactggtttccactacaaagcgcgtgttcactccacctacggcaacgttgacgtactgaaagcggcctgccgacaggagatgtggatcaacccgatggatgcgaaagcccgcggcatcagtaatggcgatcgcgtacgtatcttcaacggacgtggtgaagtgcatatcgaagctaaagtgactccgcgtatgatgcctggcgttgtcgcgctgggggaaggcgcctggtataacccggatgcgaaccgtatcgatcaggcgggctgcatcaacgttctcactacgcagcgtccatcgccgctggcgaagggcaacccatcccacacaaacctcgttcaggttgaaaaggcgtaa

SEQ ID NO: 2807 - DNA, 1152 bp, Enterobacter cloacae
tccatgaccacctatacccgcccggtgcttttgttgctctgtggcctgcttttgctgaccctggcgatcgcggtgttaaacacactcgtcccgctatggctcgcccatgaaaacttaccgacctggcaggtgggtatggttagctcgtccttttttacgggcaatctgctgggcaccttattaacgggcagccttattaagcgctttggttttaaccgcagttattatctggcatcgctgatctttgccgtcggctgcgccggtttaggccttatggtcggcttctggagctggatggtctggcgctttattgcgggcgtcggctgcgccatgatctgggtggtggttgaaagtgcgctgatgtgcagcggcacgtcccgtaatcgcgggcgtctgctggcggcctatatgatggtttactacgtcggtaccgttctgggacagctgatggtcagcaaactgccaaccgacctgatgagcgtgctgccgtgggtgacgggcatggtgctggcggcgatcctgccgctgctctttacccgtattgtgaatcaaaacagcgaacatcaggaagccacccacgtctggccgatgctgagactgcgccaggcgcgtctgggggttaacggctgcattatttccgggattgtgctgggctcgctctatggcctgatgccgctctatcttaaccatcagggcgtcagtgattccgggatcggtttctggatggcggtgatggtcagcgcggggattgtcggccagtggccgattggccgcctggcggaccgctttggtcgtctgctggtgctgcgcgttcaggtcttcgtggtcatcatgggctgtctcgccatgctcagcaacgccgcgatggcgcccgcgctgttcattctgggggctgcgggctttacgctctatccggtcgcgatggcgtgggcctgtgagaaagttgagcatcaccagctggtggcgatgaaccaggctttattgctgagttacactatcggcagtttactggggccgacttttaccgctatgctcatgcaaaattattctgataatctgctgtttattatgatcgccagcgtgtcgtttatttatctgctaatgctgctgcgcaaagtgggcgaacatccaacgccagtggcccatgcctga

SEQ ID NO: 2808 - DNA, 768 bp, Enterobacter cloacae
cgggtgctatctccggcgaaaataaatggctgggctatgcttataagcagtaacctactgttaaggcatagaaaaatgaaagcatttgatctccagcggatggcgtttgataaagtcccgcctgagtttttaggcgaagtggcgttgcgtagcctttacacctttgtactcgtcttcctgtttctgaaaatcaccggacgtcgcggcgtgcggcagatgtcgctgtttgaagtactgattatcctgacgctggggtcggcggcaggggacgttgccttttatgacgatgtgccgatggtgccggtctttatcgtctttgtgacgcttgcactgctgtaccggctggtcatgtggctgatgtcgaaaagtgagaaacttgaagatctgctcgaagggaagccggtggtgattgtcgaagatggtcaactggcctgggagaatgtgcaaagcgccaatatgacggagtttgagttctttatggaactccgtctgagcagtgttgagcaactggggcaggtgcgtctggcgattatggaaacgaatggtcaaatcagcgtttattactatcccgacgatgaggtgaagcccggtctgtgcatcctgccggatatgctcatcgagcgatacaaaactgtacctgaagcgggggagtatgcctgcataaaatgtagtcatgtggtggtcatgcaggcgggcgatcatcaattatgcccccgctgtacgaatccagaatggacgaaggttagccgggctaaacgcatcacctga

SEQ ID NO: 2809 - DNA, 1095 bp, Enterobacter cloacae
ggggaaatggctcaagtctttaatttcagttcaggtccggcaatgttaccgacagatgtgctcaaacaggctcaacaggagctgtgtgactggaacggtctgggtacgtcggtgatggaagtcagccaccggggtaaagcgtttattaaggtggcggaagaggcagaaaaggattttcgcgatctgctgaacattccctcgaactacaaagtattgttctgtcacggcggtggacgcggccagtttgcgggtatcccgctcaatctgctgggcgacaaaaccaccgctgattacgttgatgcgggctactgggcggccagtgcggtaaaagaagcgcataaatattgcacgccgaatgtcatcgatgccaaagtgaccgttgacggtctgcgcgccgtgaagccgatgagtgagtggcagctttctgacaacgccgcgtatcttcactactgcccgaacgaaaccatcgacggtattgccattcacgaagagccagactttggcgaaaatgtcattgtgacggcggacctctcttcaaccattctgtccaccccgctggatgtcagccgctacggcgtcatctacgcgggtgcccagaaaaacatcggtcctgcgggcctgacaatcgttatcgtgcgtgaagacctgctggggaaagcccataagtcttgcccgtcaattctggattacaccgtcctgaacgacaacgattccatgttcaacaccccaccaacgtttgcctggtatctctccggcctggtcttcaaatggctgaagctaaaaggcggtgtggcgcagatggataagatcaatcagcaaaaggctgaactgctgtacggcgtgatcgacaagagcgatttctaccgtaacgatgtcgccaaaactaaccgttcgcgcatgaacgtgccgttccagctggcggacagcaacctggataacgtgttccttgaagagtccttcgcggcgggtctgcatgcgctgaaaggccaccgtgtggtaggcgggatgcgcgcctctatctataacgccatgccgctggaaggcgttaaagccctgactgatttcatgatcgacttcgaacgtcgtcacggttaa

SEQ ID NO: 2810 - DNA, 468 bp, Enterobacter cloacae
tacgctttgcgccgatccttcgtctcctctgtggatgaagaccaaaaggatgggcgtatttccactgtcgagctttcaaaacgtgtgggactttccccgacgccgtgccttgagcgtgtgcgtcgactggaaagacagggttttatccagggctatacggctctgctgaacccgcattatctggatgcctcacttctggtatttgttgagattactctgaatcgtggtgcaccggatgtgtttgagcaatttaacgccgctgtacaaaaacttgaagaaattcaagagtgtcatctggtctccggtgatttcgactacctgttgaaaacccgtgtgcccgatatgtccgcctaccgtaagctgctgggtgaaaccctgctgcgtctgccaggcgtgaacgacacccgtacttatgtggtgatggaagaggtcaaacagagcaatcgtctggttattaagacgcgctaa

SEQ ID NO: 2811 - DNA, 3705 bp, Enterobacter cloacae
cacacaggcaggacatgcctgatacctggagagcctttcttgagccaggaatacactgaagacaaagaagtcacattatctaagctaagcagcggacgtcgtctccttgaggcgttactgattgttattgccctttttgccgtctggctgatggctgccttactcagtttcaacccctcagatcccagctggtcgcaaaccgcatggcatgagcctatccataatttgggtggcgttcccggtgcctggcttgcggacacgctcttcttcattttcggtgtgatggcctatacccttcctgtcatcattattggcggatgctggtttgcctggcgtcatcgacagaacgacgactacatcgattattttgccgtttcgctgcgcctgattggcgccctggcgctgatcctcacctcctgcggactggcggcgatcaatgccgatgacatctggtatttcgcctccggcggtgtgattggcagcctgttgagctccgcgctgcaaccgatgcttcacagcagcggcggcacgctggcgctgctctgcatctgggcggcgggcctgacgctgtttaccggctggtcctgggtgagcattgccgaaaaaatcggcagctttattctgactctgctgacgtttgccagcaatcgtacccgtcgtgatgatacgtgggtcgatgaagacgaatatgaagatgaatacgaagaggaagacgaggcacctgtgcagcgtcgtgaatcccgccgtgcccgtattctgcgcggtgctctggcacgccgccagcgcgttgctgaaaaattcgctaacccgttaggccgtaaaacggatgccgcgcttttctccggcaaacgtatggatgaagacgagcagattgagtatcgcggtgcggccgtcgatcctgatgatgtgttgttctctggtcatcgagctacgccgggtgagtatgacgaatacgatccgctgttgcatggtcattccgtgactgaaccggtagccgctgctgccgccgcaacgacggctgcgcaggcccatgttgcgcctgttgaagccgtgatgccgtcctcgcctgttccggcaccggagtccgcgatccagcaaccgcaggtggactggcagactgcgccaggcgtccatacgcctgaaccgaccattgcgccggagcctgaaagctatattcctgtgcagcaggaacagtgtcagcaatcgtatcagccgtctgagcctgccagcgagccgcaacagccgtatcaggcttatacgcccgaacccgctgtgcctgaacagccatatgttgcgccggtgtctgaacccgaagtggtggaggaagcgaagccatcacgtccgccattgtactattttgaagaagtggaagagcgccgtgcccgtgagcgcgagcagcttgccgcctggtatcagcccgtgcctgagccggtgcaggagcctgttgtaaaagcgccttctgcgagcgttgcacctgtagacccagcgccagccgttgcgtcaggagcagaaaccgtgaagcaggcaacggcagccgctgccgcgtccgctccgctattcagcccggcaaccgacagcgccccgcgccctcaggttaaagagggcattggtccacagctgccgcgccctaaccgcgtgcgcgtgccgactcgccgggagctggcctcttatggcattaaactgccttcccagcgtatggcggaagagaaagcgcgtggttctgactacgaagatgatgccgacgaactgcatcaggacgagctggcgcgtcagtttgccgcccagcagaatcagcgctacggcgacgagtatcagcacgacgtgccttcacaccaggaggatgatgatgcggctgaagcggagctggcgcgccagtttgccgctacgcagcagcagcgttattccggtgagcagccttcgggggcaaacccgttctcgctgtcggatttcgaattctcaccaatgaaagatctggtggatgatggcccaagcgaaccgctgttcacgccgagcgtgatgccagaagcggaaccggtgcgtcagtcgcctccgccacaggtttacgcgcagccgcaacaaccggcgccacaggcgtatgctcagccgcagacgcctgcccaaccgccgcagccgcagttccagcagccagcaccacagccgcaggaaagcctgattcacccgctgctgatgcgtaacggagacagccgtccgctgcaacgaccaagtacgccgctgccgtcgctggatctgttaacgccgccgccagcggaagtcgagccggtggatacctttgcccttgaacagatggcccgtctggtggaagcgcgtctggctgacttccgtattaaagcggacgtggtgaactactcacctggcccggtgatcacccgtttcgaactgaatctggcgccaggtgtaaaagcggcacgtatttctaacctgtcccgtgacctggcgcgttctctgtcgaccgtggcggtacgcgtggtggaggtgatcccaggtaagccttacgttggccttgagctgccaaacaagaaacgccagaccgtttatctgcgtgaagttctggataacaccaaattccgcgacaacccgtccccgctgaccgtggtgctgggtaaagatatcgccggcgatccggtggttgccgatctcgcgaagatgccgcatctgctggttgcgggtaccaccggctccggtaaatcagtcggggtgaacgccatgatcctcagtatgctctacaaagcgcagcctgaagatgtgcgtttcatcatgatcgacccgaaaatgcttgaactgtccgtctacgaaggcattccgcacctgttaacggaagtggtgaccgacatgaaggacgccgccaacgcattgcgctggagcgtcaatgaaatggagcgtcgctacaagctgatgtcggcgctgggcgtgcgtaacctggccggttataacgagaaaatcgccgaggcggcgcgtatgggccgtccgattccggacccatactggaagccgggtgacagcatggatgcccagcatccggtgctggaaaaactgccttacatcgtggtgctggtggatgaatttgccgacctgatgatgaccgttggtaagaaagtggaagagctgattgcgcgtctggcacagaaagcgcgtgcggcgggcatccacctggtactggcaacgcagcgtccgtccgtagacgttatcaccggtcttattaaggcaaacatcccgacccgtatcgcgtttaccgtgtcgagtaaaattgactcgcgtactatccttgaccagggcggtgcagagtcgctgctgggaatgggtgatatgctctattccggcccgaactccacctcgccggtgcgtgtccacggtgcgtttgttcgcgaccaggaagtgcatgcggtggtacaggactggaaagcgcgcgggcggccgcaatacgttgacggcatcacctccgacagtgaaagcgaaggtggcggcggtggttttgacggcggcgaagaactggatccgttatttgaccaggcggttaatttcgtcaccgaaaaacgtaaggcgtctatctccggcgtccagcgccagttccgtatcggctacaaccgcgcggcgcgtattatcgagcagatggaagcccagggtattgtgagcgaacaggggcataacggtaaccgagaggtgctggcaccaccgccttttgattaa

SEQ ID NO: 2812 - DNA, 621 bp, Enterobacter cloacae
ccgatgacaacccagtatggattttttattgattccagccgctgcaccgggtgcaaaacctgcgagctggcctgcaaggattacaaagacctgaccccggaggtcagcttccggcgtatttatgaatacgcgggcggcgactggcaggaggataacggcgtctggcatcagaatgtcttcgcctattacctgtcgattgcctgcaaccactgcgaagatccggcctgcaccaaggtctgcccgagcggggcaatgcacaagcgtgacgacggttttgtggtggtggacgaggatgtctgcatcggctgtcgctactgccacatggcctgcccgtacggcgcgccgcagtacaatgccgccaaaggccacatgaccaagtgcgacggctgccacagccgggtggcggacggcaaaaagcccatctgcgtcgaatcctgcccgctgcgcgcgctggactttggcccgattgaggagctgcgcaaaaaacacggccagcttgctgccgtcgcgccgctgccgtctgcgcacttcacaaagccgagtattgtgattaaacctaacgccaacagccgtccgacgggggacaccaccggctacctggcaaacccgaaggaggtgtga

SEQ ID NO: 2813 - DNA, 495 bp, Enterobacter cloacae
tgcggcatttccttacgctttctgacactcatcctctttcatttcttctacactctgcttcaatcattccgtaatttgcacgcaaaggtaacagttgcgcacgttggcgcgtataatgcgcggcgttcatgtaaacggtatgccttaattaaggagaaaaagatgacggcaattgccccggtaatcaccattgatgggccaagtggcgcagggaaaggtactctgtgcaaagcgatggcggaagcattgcaatggcatcttttagattcgggagcaatctatcgcgtgctggcgctggctgcgctgcatcatcatgtggatgttgcgtctgaagaagcgctggtaccgctggctgcgcatctggatgtgcgctttgtctcgaccgatggcaaccttgaagtgatcctggaaggggaagatgtcagcggtgaaatccgtacccaggaagtggccaatgcggcctctcaggtggcggctttccccacgcgttcgtga

SEQ ID NO: 2814 - DNA, 327 bp, Enterobacter cloacae
gctgttcagctaatgggtttgaaaggaaccggaggaatcatgaccaagtcagaattgattgaaagacttgccagtcagcaaccgcatatccctgccaaggctgtggaagatgccgttaaagagatgctggagcatatggctaccactcttgcccaaggcgagcgcattgaaatccgcggtttcggtagtttttccctgcactatcgtgcaccacgtaccgggcgtaacccgaagactggcgataaagtggagctggaaggaaagtatgttccgcactttaagccgggtaaagaactgcgcgatcgcgccaatatttacggtaactga

SEQ ID NO: 2815 - DNA, 993 bp, Enterobacter cloacae
aatgcagttcggtcaatgattgcacgcatctggtcgggtgaatcccctctgtgggtgctgcttctcccgctctcctggctgtatggcctggtgagcggtgctattcgtctgctttaccgccttgggatcaagcgcgcctggcgcgcaccggtaccggtagtggtggtcggcaacctgacggcgggtggaaacggcaaaaccccggtggtgatctggctggtagagcagctccagaggcgcggtatccgcccgggagttgtctcacgcggttacggtggtaaagcggcgcagtatccactggtgctgagcccagctacgacaaccgctgaagccggtgatgagccggtactgatttaccagcgtacaggcgcgccggttgcggtatcgccggtgcgcagtgatgccgtgaaggcactgcttgcggagcataatgtacaaatcatcattaccgatgatggtttgcagcattacgcgctggcgcgtgataaagagatcgtggtcattgacggtgtgcggcgttttggcaacggctggtggcttccagccggtccaatgcgcgagcgtgcgtcgcgcctgaaaaccgtcgatgccgtgattgtgaacggtggtgaagccagagcggtcgaaatcccaatgcttcttcgtcccggacaggccgtaaatatgctgaccggcgagcgtaaagatgtcgcgcaactggaacatctggttgcgatggccggtataggtcatccgccgcgtttcttcgcaacgctggagcagtgcggcgcgcggctggaaaaacgggtgccgctggccgatcaccaggcgttagttgccgaagaggttgaaaggctggcagcgccgggccagacgctgatcatgacggaaaaagacgcggtaaaatgccgggcctttgcgaaagaaaactggtggtatctgccggttgacgctgaactcagcggcgaacagccggaacatttgctcaaggaactgctcgcgttagtgcagtaa

SEQ ID NO: 2816 - DNA, 780 bp, Enterobacter cloacae
agcccgttcactggtggcagaagagatcaaaccatgagttttgttgtcattatccctgcgcgttatgcttcaacgcgcctgccaggtaaaccgctggtggatatcaatggcaaaccgatgattgtgcatgtccttgaaagggcacgcgaatcgggcgccggacgtgtcatcgtcgccaccgatcacccggatgtcgcgcgagcggttgaggccgcgggtggggaagtgtgcatgacccgtgccgatcatcagtcaggcaccgagcgcctggcggaagtcgtcgaaaaatgcggtttcagcgacgagacggtgattgtgaacgtgcagggcgatgagccgatgatcccggcggcgattatccgtcaggtggccgacaacctggctcggcgtcaggtcgggatggcaaccctcgcggtgccgattcaccacgctgaagaggcgttcaatccgaatgcggtgaaagtggtcatggacgcagagggctacgcgctctatttctcccgcgccaccattccgtgggatcgcgatcgtttcgcgcaatcgaaagagacaatcggcgaaaccttcctgcgccacatcggtatttacggctaccgcgccggctttattcgtcgctacgtcgcctgggcaccaagcccgctggagcatattgaaatgctcgaacagcttcgcgtgctgtggtacggcgagaaaattcacgttgcggttgcccaggaaatccccggcaccggcgtggatacccctgaagatctcgagcgcgtacgcgtcgaaatgcgttaa

SEQ ID NO: 2817 - DNA, 624 bp, Enterobacter cloacae
ggaataacaatgaaaaaaatcgccatcgcctgtgcattactctccagttttgttgccagcagcgtctgggctgatgcagccagcgaccttaaaagccgactggataaagtgagcagcttccacgccagcttcacgcaaaaagtgactgacggcagcggcaacgcggtgcaggaaggtcagggggatttgtgggtgaaacgcccgaatctcttcaactggcacatgacccagcctgatgaaagcgtgctggtgtccgacgggaaaaccttgtggttctacaacccgtttgttgagcaggcgaccgccacctggctgaaagacgcgaccagcaatacgccgtttatgctcattgcccgtaaccagtccagcgactggcagcagtacaacatcaaacaaaacggtgatgagttcgtcctgacgccaaaaggcagcaacggtaatctgaagcagttcacgattaacgtgagcagcaacggtaccatcaatcagttcggcgcggttgagcaggacgatcagcgcagtagctatcagcttaagtctcagcaaaacggcgctgtagatgcttcgaaattcacctttaccccgccgcagggcgtaacggtggacgaccaacgtaataagtaa

SEQ ID NO: 2818 - DNA, 1182 bp, Enterobacter cloacae
gtgagcaacctgtcgctcgatttttcagataatgcgtttcaacctctggccgcccgtatgcggccagaaaatttagcgcagtacatcggccagcaacacctgctggctgcggggaaacccttgccgcgcgctattgaggcggggcatctgcactccatgatcctctgggggccacccggcaccggcaaaaccaccctcgctgaagtgatcgcccgctatgctaacgcggacgttgagcgcatctcggcggttacctccggcgtgaaggagatccgcgaggcgatcgagcgcgcacggcaaaaccgtaatgccgggcgccgcaccattctgtttgttgatgaagtccaccgtttcaacaagagtcagcaggatgcgtttctgccgcacattgaagacggcacgattttcttcatcggcgcaaccacggaaaacccgtcgtttgaactcaactccgcgctgctttcccgcgcccgcgtttacctgcttaaatccctgaccacagaggatatcgaaaaggttctgacccaggcgatggaggacaaagcgcggggttacggcggacaggatatcgttctgccggacgagacgcgtcgtgcgatcgctgaactggtcaacggcgatgcgcgtcgggcaatgaatacgcttgaaatgatggccgatatggctgaagtggatgatgccggaaagcgggtgctaaagcaggagctgctgaccgaaatagccggcgagcgcagcgcacgtttcgataataaaggcgatcgtttttacgacctgatctcggcattacataagtccgtgcgcggcagcgccccggatgcggcgctctactggtatgcgcgtattatcaccgcaggtggcgatccgttatatgtcgcgcgtcgctgcctggcgattgcgtcggaagacgtcggcaatgccgatccgcgcgccatgcaggtcgcgctttccgcctgggattgctttacccgagtcgggcctgcggagggtgagcgcgccattgctcaggctattgtctatctggcctgcgcaccgaaaagcaatgcagtgtataccgccttcaaagcggcgatgtcggatgcacgtgaacgtccggattacgacgttccggtacaccttcgcaatgccccctacaaagctgatgaaagagatgggttacgggcaggagtatcgctacgcccatga

SEQ ID NO: 2819 - DNA, 1314 bp, Enterobacter cloacae
ttcgataagcacaggataagcatgctcgatcccaatctgctgcgtaatgagccagacgcagtcgctgaaaaactggcacgccggggctttaagctggatgtagataagctgcgcgctcttgaagagcgtcgtaaagttttgcaggtacaaactgaaaatctgcaagcagagcgtaattctcgatcgaaatccattggccaggcgaaagcgcgcggggaagatattgagccattacgcctggaagtgaacaaactgggtgaagagctggatcaggcgaaagctgaactggacgttcttcaggctgaaattcgcgatattgctctggcgatcccgaacattcctgacgacagcgtgcctgtcggcaaagacgaaaacgacaacgttgaagtgaaacgctggggtacgcctcgcgagtttgacttcgaagtgcgcgatcacgtgacgctgggcgaaatgcacgcgggcctggactttgcggcagcggttaagctgaccggttctcgcttcgtggtaatgaaagggcaaattgctcacctgcaccgcgcgctggcgcagttcatgctggatctgcacaccgagcagcacggctacagcgaaacctacgttccgtatctggttaaccacgatacgctgtacggtacaggccagctgccgaaatttgccggcgatctgttccatacccgtccgctggacgaggaagctgacagcagcaactacgcgctgatcccaactgcggaagtgccgctgaccaaccttgtgcgtgatgagatcatcgacgaagacgatctgccaatcaaactgactgcgcactctccatgtttccgttctgaagccggttcttacggtcgcgatacgcgcggtctgatccgtatgcaccagttcgataaagttgagatggtgcagatcgttcgtccggaagagtctatggacgcgctggaagagatgaccggccacgcggaaaaagtgctggagctgctgggtctaccataccgtcgtatggcgctgtgcaccggcgacatgggcttcggtgcctgcaaaaccttcgaccttgaagtctgggtgcctgcgcagaacacctaccgcgaaatctcctcctgctccaacgtctgggatttccaggcgcgtcgtatgcaggcgcgttgccgcagcaaatctgacaagaaaacccgtctggttcataccctgaacggttctggtctggcagtaggccgtacgctggttgctgtgctggaaaactaccagcaggctgacggacgcattgagatccctgaagtgctgcgcccttacatgaaaggccagcagttcatcggctaa

SEQ ID NO: 2820 - DNA, 936 bp, Enterobacter cloacae
ttaaacctaacgccaacagccgtccgacgggggacaccaccggctacctggcaaacccgaaggaggtgtgagatgggaagtggatggcatgaatggccgctgatgatcttcacggtctttgggcagtgcgtggcgggcgggtttatcgttcttgcgctggcgctgttaaaagggaacctcaatactgaacagcagcagcgtttagtgttaagcatgtttggcctgtgggtgttgatgggcattgggtttatcgcctctacgctgcacctgggctcaccgatgcgcgcgtttaactccctgaaccgcgtaggtgcctcttcgctgagtaacgagattgccagcggtgcaatcttctttgccgttggcgggctggggtggttactggcagcggtgaaaaagctgccgtcagggttacgcgcgttgtggctcatcgtcaccatggtactgggcgttgtcttcgtctggatgatggtcagggtgtacaacaccattgatacggttacaacctggtacagcgtctggacgccgatgagcttcttcctgaccatgtttattggcgggcccctgctgggttatctgctgctgcgcgtggctggcattaatggttgggcgatgcgcctgctgcccgcggtctcgctgctggcgctggtaatcagtaccgttgtcgcgctcatgcagggagcggagctggcgaccattcacagctctatccagcaggcttcggcgctggtgccggattacggttcgctgatggcctggcgtgtggtgctgctgacggctgcgctggtgtgctggattgcccctcagcttaaaggttactcgcctgcgctgccgttactgtccctggcctttgtactggtgctggcaggggagttaattggtcgcggcgtattttatggtctgcatatgacggtcggtctggctatcgccagctaa

SEQ ID NO: 2821 - DNA, 1296 bp, Enterobacter cloacae
gagttgagtttcatggaatccctgacgttacaacctatcgcgcgggtagatggcaccattaatctgcctggttcaaaaagtgtctcgaaccgcgctctgctgctggcagctttggcaaacggcaccaccgtcctcactaatctgctggacagcgatgacgtgcgccatatgctcaatgcactgaaagcgttgggcgttcagtacgcgctgtctgacgatcgtacccgttgtgaagtcaccggtaacggcggcgcgttacattctgctgaagcgctggagcttttcctgggtaacgccggtaccgcgatgcgtcctctggccgctgcgctgtgtctggggagtaacgatattgtgctgaccggtgagccgcgaatgaaagagcgtccgatcggccatctggtggatgccctgcgccagggcggcgcgcagattgattatcttgagcaggaaaattacccgcccctgcgtctgcgcgggggattcactggcggcaatgtagaggttgacggtagcgtttccagccagttcctgaccgcgctgctgatgaccgcaccgctggcaccacaggacaccgtcatcagcattaaaggcgacctggtttctaagccgtacattgatattaccctgcacctgatgaacacctttggtgttgaggtggaaaaccagtcttatcagcgcttcgtggtgcgcggagcgcagcagtatcagtccccgggccactacctggttgaaggcgatgcttcctccgcctcctatttccttgccgcaggtgcgattaaaggcggtacggtaaaagtgacgggcattggccgcaacagcgtgcagggcgatatccgttttgctgacgtgctggaaaaaatgggcgcggtggtgacctggggcgatgacttcatctcctgtacccacggtgagctgaacgccattgatatggatatgaaccatattccggatgcggcgatgaccattgctaccgctgcgctgtttgcgaaaggcaccaccacgctgcgaaacatttacaactggcgtgtgaaagagacggaccgcctgttcgcgatggcaaccgagctgcgtaaagtgggggccgaggtagaagagggcgaagactacattcgcgtcacgccgccggcaaaactgcaatttgcagaaattggcacctacaacgatcaccgcatggcgatgtgtttctcgctggtggcgttgtcagatacgccagtcactatccttgatccgaagtgtacggcaaaaacgttcccggactacttcgaacagctgacgcgcattagcaccctggcctga

SEQ ID NO: 2822 - DNA, 444 bp, Enterobacter cloacae
tcctggaaggggaagatgtcagcggtgaaatccgtacccaggaagtggccaatgcggcctctcaggtggcggctttccccacgcgttcgtgaagcgctgttacgtcgccagcgcggtttccgtgaagcgccggggctgatcgccgacggccgcgacatgggaaccgtggtattccctgatgcgccagtgaaaattttccttgacgcctcttcagaagaacgtgcccatcgccgcatgcttcagttgcaggaaaaggggtttagtgttaactttgatcgccttttatccgagataaaagagcgcgatgaccgcgatcgtaaccgcgccgtcgcaccacttgttcccgcgcaagacgcattagtgctggattcaaccagtttaactattgagcaagtgattgaaaaagcgctacaatatgcgcgccaaaaactggcactcgcgtaa

SEQ ID NO: 2823 - DNA, 1683 bp, Enterobacter cloacae
agattaaacatgactgaatcttttgctcaactgtttgaagaatccttaaaagaaatcgaaacccgtccgggttccatcgttcgtggcgttgttgttgctatcgacaaagacgttgtactggttgacgccggtctgaaatctgagtctgccatcccggctgagcagttcaaaaacgcccagggcgagctggaaatccaggtaggtgacgaagttgacgttgctctggacgcagtagaagacggcttcggcgaaaccctgctgtctcgtgagaaagctaaacgtcacgaagcatggatcacgctggaaaaagcttacgaagaagctgaaactgtggtcggtgttatcaacggcaaagttaaaggtggcttcactgttgagctgaatggtattcgtgcgttcctgccaggttctctggtagacgttcgtccagtccgtgacaccctgcacctcgaaggcaaagagcttgagttcaaagtaatcaagctggaccagaagcgtaacaacgttgttgtttcccgtcgtgccgttatcgaatccgaaaacagcgcagaacgcgatcagctgctggaaaacctgcaggaaggcatggaagtcaaaggtatcgttaagaacctcactgactacggcgcattcgttgacctgggcggcgttgatggcctgctgcacatcaccgacatggcgtggaaacgcgttaagcacccaagcgaaatcgtgaacgtgggcgacgaaatcactgttaaagtgctgaagttcgaccgcgagcgtactcgtgtatccctcggcctgaaacagctgggcgaagatccatgggtagctatcgctaagcgttacccagaaggtactaaactgactggtcgcgtaaccaacctgactgactacggctgcttcgttgaaatcgaagaaggcgttgaaggtctggtgcacgtttccgaaatggactggaccaacaaaaacatccacccatccaaagttgttaacgttggtgatgtagtggaagtgatggttctggatatcgacgaagaacgtcgtcgtatctccctgggcctgaagcagtgcaaaaacaacccatggcagcagttcgcggaaacccacaacaagggtgaccgtgttgaaggtaaaatcaagtctatcactgacttcggtatcttcatcggcctggacggcggcatcgatggcctggttcacctgtctgacatctcctggaacgttgcaggcgaagaagcagttcgtgaatacaaaaaaggcgacgaaatcgcagcagttgttctgcaagttgacgcagagcgtgagcgtatctccctgggcgttaaacagcttgcagaagatccgttcaacaactgggttgcactgaacaagaaaggcgcaatcgtaaacggtaaagtgactgctgttgacgctaaaggcgcaaccgtagaactggctgacggcgttgaaggttacctgcgcgcttccgaagcttcacgtgaccgcgttgaagatgcaactctggttctgagcgttggtgacgacgttgaagctaagttcaccggtgttgaccgtaagaaccgtgcaatcagcctgtctgttcgtgctaaagacgaagctgatgagaaagatgcaatcgcaactgtgaacaaacaggaagatgcaaatttctctaacaacgcaatggctgaagctttcaaagcagctaaaggcgagtaa

SEQ ID NO: 2824 - DNA, 2280 bp, Enterobacter cloacae
aacatggaggtgaagatggggatccacgttatcagcatgtgcgccattctggccataatcccgctctattggttacccgttttgccagatttgcatattgtctggttgctgattgccgcaggaattgcgttatcagtacagcagagaaaatggctcaggttttcaggcctcgcattgctttttatgtgctgggggatcctggccgctcaggaaagcgtgtggccgatgaaccatttaacgaaagttccgcagcaggccgaggtggtcattaccgcaacggacggcgcaacgatgcatcagggaaggattgtcagcctcaatggagaacgtgtgtgggctgccatgggcgtggcgctgtatggcaactatctgccgcaaaacgtctgcgtgggtcaacgctgggcaatgaccctgcggctcagggcggtacacggagaactcaacgatggcggctatgattcacagaaaaatgcctttgtccgacatcagacgctgagtggacggtttacccatgcggcgctcgttgacgaaggctgtagcctgcgtgcgcagtacctgacatcactacagagtacgctttcagcatatcagtggggacccgtgatactggggctgggaatgggggagcggctgtcggtctcgcgggagataaaaaacctgatgcgtgagaccggaacgatgcatctgatggcaatctcgggattgcatattgcgctggccgcttctgtcatctggtttctggcgcgaggcatccagttcttcctgccgggccgctggattatctggcaaatccccttgctggcagggctgatttttgccgcgttttacgcatggctaacaggcttacagccgcctgcgctgcgcacggttatcgcgcttgtggtactggcggtgttaaaaatgagcggtcgccagtggtcgccctggcaggtatggcttacctgcgtggcggcgatcttggttttcgatccactggcggtcctgtcacaaagcctggcgctatcagcgtttgcggtcgccgcgcttattttttggtatcagtggttgcctctcccgctctggcaacgtggccggtgcctgcggccgctggttacgctgttgtatttgcaggtcggtatgctgctgcttctgttgccgcttcaggtgctgattttccatggtttcagtctctcctcgctggcggcgaatctgtttgccgttcctctggtcacgtttatctcagttccgctgatcctgctcggcatgtttctgcatctgtttccggtggcgacgctggaaagtatcgtctggctggctgccgataaatctctggcagggcttttctggctattgatgcgtttaccgaatggctggcaggacgttgatgaacgctggcaatacctgacgttactgccatggctgctgatcattggctggcgattcagggccttcagcgcagtacccgcagtctgtctggcaggcagcgtggtgctggcatttcccctctggcacagggccaaaacagacagctggtccctgcatatgctggatgtagggcaggggctggcgatggtcattgagcgtcacgggaaggccattctgtatgacactgggttggcatggcccggtggggacagcgggcagcagctgattatcccctggctacgctggcatcatctgaggccggaaggggtgatcctgagccatgaacatctcgaccacgcggggggactggcatcgctaaaagctgcctggcccgcaatgtggatcagaagccccttatcctgggccgggcatcttccttgctttcgtggagagcgatggcagtggcagggtttaacgttctccgtgcactggccacccgaaaatacctcggcaaaaggtaacaaccgctcctgcgtggtaaaaatcgatgacggcgaacaaagcgttttactgaccggagatattgaaaggcaggcagaactggcaatgctgagccaccgctggcgtcaactagcgtctacactgattcaggtgccgcatcatggaagtaacacgtcatcttcaacaccgctgctacagcgcgtggagggacaggtttcgctggcctcgatggcccgctataacgcgtggcgtttcccttccatcaaagtagtcaggcgctatcgaactgagggatatctctggcttgatactccgcagtccggacagatatctgtgacgttttcgcaccaaagtcggcaaattcgccgcttacgtgaacactatttaccgcgttggtatcatcagtggtttggcgcgcccgtagataacgggtag

SEQ ID NO: 2825 - DNA, 1749 bp, Enterobacter cloacae
atgcataacgacaaagatctctccacgtggcaaacgttccgccggctctggccgatgattgctcctttcaaagcaggcttgatcgtggcgggcgtagcgttaatcctcaacgcagccagcgatacgtttatgttatcgcttctcaaaccgttactggatgacggtttcggtaaaacggatcgttcagtgctgctatggatgccgctggtggttattgggctgatgatcttacgcggaatctccagctatgtatccagctactgcatctcctgggtatccggtaaagtggtgatgaccatgcgccgtcggttattcagccatatgatggggatgccggtctcattctttgacaagcagtcaaccggtaccctgctgtcgcgtattacctacgattcagagcaggttgcgtcgtcctcttccagcgcactgattaccgttgtgcgtgaaggcgcatccatcatcggcctgttcgcgatgatgttctattacagctggcaactgtcgctgatccttattgtgctggcgccgattgtctccatcgcgatccgcgtggtatcaaagcgttttcgcaacatcagtaaaaatatgcagaatacgatggggcaggtgactaccagcgccgagcagatgctgaaaggccataaggaagtgttgatcttcggcggtcaggaagtcgaaaccaaacgctttgacaaggtcagcaacagaatgcgtctgcaagggatgaaaatggtatcggcctcgtcgatttccgatccgatcattcagctgattgcctctctggccctggccttcgtcctgtatgccgcaagcttcccgagcgtcatggaaaccctgactgcgggtaccattaccgtggtgttctcatccatgatcgcgctgatgcgtccgctgaaatcgctgactaacgtcaacgcccagttccagcgcgggatggcagcctgtcagacgctgttcagcatcctcgattccgaacaggaaaaagatgaaggtacacgcgtgatcgagcgcgctaaaggcgacctggaattccgtaacgtgacctttacctatccaggccgtgaagtgccggcgctgcgtgatatcagcctgtccatcccggcgggtaaaaccgtcgcgctggttggtcgttccggttcgggcaagtcgaccatagccagcctgattacccgtttctacgatatcgaccagggcgagatcctgcttgatggtcacgacctgcgggaatataccctccagtcgctgcgtaaccaggttgcgctggtctcgcagaacgtgcatctgttcaacgatacggtggcgaacaacattgcgtatgcccgtaccgaagagtacagccgtgaagagattgagaatgcggcgcgtatggcctatgcgatggacttcattaacaaaatggataacggtctggatacgatcattggcgaaaacggggtgctgctctccggtggtcagcgtcagcgtatcgcgattgcccgtgcgctgctgcgcaacagtccgattctgatcctcgatgaagcaacgtccgcactggatacggaatctgaacgcgctatccagtctgctctggatgaattacagaaaaaccgtacctcgctggttatcgcgcaccgtctgtcgaccatcgaacaggctgacgaaatcgtggtggtggaagatggcgtgatcgttgaacgcggcagccatgcggacctgctggaacagcgtggtgtttacgcgcagcttcataaaatgcagttcggtcaatga

SEQ ID NO: 2826 - DNA, 1245 bp, Enterobacter cloacae
ctgacaggaaaacgcatgtctctaccgcaactctcacttgcagccgcacgaaacctgcatcttgccgcccaggggcttctgaaaaagccccgccgccgcgcgcagccagctgatatcctctctaccgtgcaacgcatgtcgttgctgcaaatcgacaccattaacatcgtggcgcgtagcccgtatctggtcctgtttagccgcctgggaaactatcctccgcagtggctggataatgcgctgagtcagggcgaactgatggaatactgggcgcatgaagcctgttttctcccgcgcagcgattttgcactggtgcgtcaccgcatgctcgccccggacaaaatgggctggaaataccgccaggagtggatggtggaacacgcggatgaaatagaacaactgattgcccatattcagaaaaacggtccggtacgctccgcggattttgaacacccgcgaaaaggtgccagcggatggtgggagtggaaaccgcacaaacgccatcttgaagggctgtttacgtcgggcaaagtgatggtggtcgagcgccgcaactttcagcgcgtctatgacctcacgcaccgcgttatgcctcactgggacgatacgcatgacctgctgtctcaggacgtagccgaagccatcatgctcgggaacagcgcccgcagccttggcatcttccgcccgcagtggctggcggattattatcgtctgcgtcagccgcggctaaaaccactgctcgaaacgtggcagcgcgaacagcgcgtcatgccggtctcggtagagtcgttaggtgaaatgtggctgcatgcggatttgttccctctgctggcgcaggcgcaggagggcaaactccaggcgacccacagtgccgtgctgtcgccgttcgaccccgttgtctgggacagaaagcgggccgaacagctgtttgatttcagctaccgtctggaatgctacaccccggcgcccaggcgtcagtatggttattttgttttgccgctgctgcacaaaggacagcttgtcggacgcatggacgctaaaatgcaccgtaaaaccggcatgcttgaaattatcgcgctctggctggaagagggcataaaggtgacggctggcctggaaaaagggttaacgactgcgctcagtgaatttgcgcgctggcagggggcgcatgaaattgtactcggtcgcgtgcctgtggagctgtttgcgacctgtcgagatggctgggaaacagacactccctga

SEQ ID NO: 2827 - DNA, 228 bp, Enterobacter cloacae
aaagggaatgtgataagctttagcgattacccatacggaggaactatggatcaccgtttactagaaattattgcctgcccggtgtgcaacggcaaactgtattacagccaggataaacaagagctgatttgcaaactggacagcctggcgttcccgctgcgtgacggtattccggtcctgctggaaaatgaagcccgttcactggtggcagaagagatcaaaccatga

SEQ ID NO: 2828 - DNA, 900 bp, Enterobacter cloacae
tctcatatggaacagctgcgtgctgaactcagccatctccttggcgaaaagctaagccgggtggaatgcgtgaatgaaaaggccgattccgcactctggtcgttgtatgacagtcagggaaaccccatgccgctgatggccagaagttttacctcgccgggcgtcgccagacagctggcctggaaaatgtcgatgctggcgcgggaagggactgtccgtatgccgacggtctacggcgtgatgacccatgaggagcatcccgccccggatgttctgcttatcgagcgtttacgcggggtttctgttgaagccccgacgcgtacaccggagcgctgggaacagctgaaagatcagattgtcgaggctctgcttgcctggcatcggcaggacagccggggtcttgttggcgcggtagacagcacccaggaaaacctgtggccgctgtggtatcgccagcgtgtcgaagtgctgtggggcacgctgaaccagttcaacaacaccggcttaacgatgcaggacaaacgtattctgttccgcacccgggaatgtctgccgacgctgtttgagggttttaacgacaactgcgtgctggttcacggcaacttcacgctacgcagtatgcttaaagactcgcgcagcgaccaactgctggcgatggtcgggccggggatcatgctctgggcgccgcgcgagtacgaactgttcaggctgagcgagggcggggcggcggaagatttgctctggcactatcttcagcgcgcccccgttgcggaggcctttctctggcgacgctggctctatcttctctgggatgaggtggcgcaactggtcaacaccgggcgctttaatcgcgccagtttcgatctggccgcaaaatcactcctgccctggcttgcctga

SEQ ID NO: 2829 - DNA, 777 bp, Enterobacter cloacae
gcccccggatgggccaaattcggagatatcaccgcaatgtcaattattggtcgtattcactcctttgaatcctgtggcaccgtcgatggcccggggatccgctttatcactttcttccagggctgcctgatgcgctgcctgtactgccataaccgtgacacctgggacacccatggcggtaaagaagtcaccgtagaagatctgatgaaagaggtggtgacctatcgccactttatgaacgcgtccggcggtggcgtgacggcatccggcggtgaagccattcttcaggctgaatttgtgcgcgactggttccgcgcctgccacaaagaaggcattcatacctgcctcgacaccaacggctttgtgcgccgttacgatccagttattgatgaactgcttgaagtgaccgatctggtcatgctcgatctcaagcagatgaacgatgagatccaccagaatctggttggcgtctcgaaccaccgtaccctggaatttgccaaatacattgccaacaaaggcgtcaagacctggatccgctacgtggtggtgccgggctggtcagatgatgatgactctgcacatcgtctgggtgaatttacccgggatatgggtaacgtggagaaaatcgaacttctgccctatcacgagctgggtaaacataaatgggtggcgatgggtgaagagtacaagctcgatggcgtgaagccgccgaaaaaagagacgatggagcgcgtcaaaggtattcttgagcagtatggccacaaggtcatgtattaa

SEQ ID NO: 2830 - DNA, 302 bp, Enterobacter cloacae
  unsure (18)
ggggggggggtatggggngagcgacttcccttccagacgccgtgtgtgaagacgatgtaccgttcctgctggtgacctctgcttcacacctgccgcgcgcaatgattttctttgagaagcagggcctgcatccgcttcctgctccggcaaaccagatggctattgacgccccgctcaatccgtgggaacggataatcccatccccggtatggctgatgcacagcgaccgcgtcggctacgagacgcttggccgcttgtggcagtggcttaagggttcgtcaggcaagccagggcaggagtga

SEQ ID NO: 2831 - DNA, 1968 bp, Enterobacter cloacae
aggctacgcaacgccacttcgcctaaaaactcaggcgggactttatcaaacgccatccgctggagatcaaatgctttcatttttctatgccttaacagtaggttactgcttataagcatagcccagccatttattttcgccggagatagcacccgtcacgcaaaacccgtatcattgcgcgctttacgtacgataaaagtgaacgccatgactcaaacgtttatccccggcaaagacgccgctctggaagattccatcgctcgcttccagcagaaactgaccgacctgggctttaatatcgaagaagcctcctggctgaatccggtgcctcacgtctggtccgtgcatattcgcgacaaagactgtgcgctgtgctttaccaacggtaaaggcgcgaccaaaaaagcggcgctggcctctgcgctgggtgagtattttgagcgtctgtccaccaactacttcttcgccgacttctggctgggcgaaactatcgccaacggtccgttcgttcactacccgaacgaaaaatggttcccgctgaccgaaaacgatgaactgccggaaggcattctcgatgcccgcctgcgcgcgttctacgatccggaaaacgagctgaccggcagcatgctgatcgacctgcaatccggcaatgaggatcgtgggatctgcaccctgccgttcacccgtcagtctgacgagcagaccgtttatatcccgatgaacatcgtcggcaacctgtatgtgtccaacggcatgtctgccggtaatacccgcaacgaagcgcgcgtgcaggggttgtctgaagttttcgagcgtcacatcaaaaaccgcattattgctgaatccatcagcctgccggagatcccggctgacgtgctggcgcgctacccgggcgtggtggaatccatcgccaaactggaagcagaaggtttcccaatctttgcttatgacggctctctgggcggcaaatatccggttatctgcgtagtgctgttcaacccggccaacggcacctgcttcgcctccttcggcgcgcaccctgacttcggcgtggcgctggagcgtaccgttaccgagctgctccagggccgtagcctgaaagatctcgacgtgtttacgccgccgacctttgatgacgaagaggtcgccgagcacaccaacctcgaaacgcacttcatcgactccagcggtttgatctcctgggatatgttcaaacaggacgcggactatccgttcgtggactggagctttgccggtacgacggaagaagagttcgccaccctgatggcgatcttccacgcggaagatcaggaagtctacattgccgactatgaacatctcggcgtttacgcgtgccgtattattgtgccaggtatgtcggacatttatccggcagaagatctgtggctggcaaacaacagcatgggcgcgcatctgcgtgaaaccctgctggccctgccaggcagcgagtgggataaagaagattatctgaacctgatcgcccagctggacgaagaaggacacgatgatttcacccgcgtacgcgaactgctgggtctggcgaccggaaaagataacggctggtacaccctgcgcatcggcgagctgaaagcgatgctggcgctggcgggcggcgatctggatcaggctttggcctggaccgagtggacgatggagtttaaccagtccgtcttctccgccgagcgcactaattattaccgttgcctgcaaacgctgctcctgctttctcaggaagacgaccgccagccattgcagtatctgaacgcctttgtgcgtatgtacggtgcggatgccgttgaagctgccagcgcggcgctgagcggtgaagaaccattctacggcctgcaagcggttgacagcgatctgcaagccttcccggcgcatcagtcactgctgaatgcgtatgaaaaattgcagaaggcaaaagccgcttactggtcaaaataa

SEQ ID NO: 2832 - DNA, 969 bp, Enterobacter cloacae
aaccatacacactgcgggcctataagccaggcgagatatgatctatatcaatttctcttctataatgctttgttagtatctcgtcgccgacttaataaagagagagttagtgtgaaagctgacaacccttttgatctattactccccgctgcgatggcgaaagttgccgaagaagcgggtgtctacaaagccacgaaacatccgatgacgacgttctttctggccattacggctggggtgttcatctccatcgctttcgtcttctatatcacagccaccaccggcacggccgggatgcctttcggcatagcgaaactgattggtggtatttgcttctcactgggcctgattctctgcgtcatctgcggcgccgacctcttcacctcaacggtgctgattgttgtggcaaaagccagcggaagaattacctggggtcaactgggtcgcaactggctcaacgtttacgttggcaacctgattggctgtctgctctttgttctgttgatgtggctctctggcgagtatatgaccgccaacggcggctgggggcttaacgtcctgcaaaccgccgaccacaaaatgcaccatacatttatcgaagccgttgctctcggcatcctcgcaaacctgatggtctgcctggcggtctggatgagctactctggtcgtagcctgatggataaagccatgattatggttctgccggttgcgatgtttgttgccagcggctttgagcacagtattgcgaatatgttcatgatcccgatggggattgttatccgcaactttgcaagcccggagttctggactgctgtaggttcaaccccggaaagtttttcacacctgacgattatgaacttcattactgataacctgatccccgtcactatcgggaacattatcggtgggggtctgttagttgggttgacatactgggtcatttacctgcgtggcggcgatcatcattaa

SEQ ID NO: 2833 - DNA, 2298 bp, Enterobacter cloacae
gaaggtaggtgttacatgtccgagcttaatgaaaagttagccacagcctgggaaggttttacgaaaggtgactggcagaatgaagtcaacgtccgtgactttattcagaaaaactataccccgtatgaaggtgacgaatccttcctggctggtgcgactgacgcaaccaccaagctgtgggacagcgtaatggaaggcgttaaactggaaaaccgcactcacgcgccagttgattttgacacctccgttgcttctaccatcacttctcacgatgctggctacatcaataaagcccttgagaaaattgttggtctgcaaactgaagcaccactgaaacgcgcaatcatcccgttcggtggtatcaaaatggttgaaggttcctgcaaagcgtataatcgcgagctggacccaatgctgaaaaaaatcttcaccgaataccgcaaaacccataaccagggcgtattcgatgtttacaccaaagacattctgaactgccgtaaatctggcgttctgaccggtctgccagatgcctatggccgtggccgtatcatcggtgactaccgtcgcgttgcgctgtacggtatcgacttcctgatgaaagacaaatacgcgcagttcgtctctctccagtctgacctggaaaacggcgtaaacctggaagcgactatccgtctgcgtgaagagatcgctgaacagcaccgtgcgctgggtcagatcaaagagatggcggctaaatacggctgcgatatctctggtcctgctaccaacgctcaggaagctatccagtggacctacttcggctacctggccgcagttaagtctcagaacggtgcagcaatgtccttcggccgcgtatccaccttcctggatgcgtacatcgaacgtgacctgaaagcaggcaaaatcaccgaacaagacgctcaggaaatgattgaccacctggtcatgaaactgcgtatggttcgcttcctgcgtaccccagaatatgatgagctgttctctggtgacccaatctgggcaaccgaatctatcggcggtatgggcgtagatggccgtactctggtaaccaaaaacagcttccgcttcctgaacaccctgtacaccatgggtccttctccggagccgaacatcaccgttctgtggtctgaaaaactgcctctgaacttcaagaaattcgccgctaaagtgtccatcgacacctcttctctgcaatatgagaacgatgacctgatgcgtcctgacttcaacaacgatgactacgctatcgcttgctgcgtaagtccaatggttgttggtaagcaaatgcagttcttcggtgcgcgtgcaaacctggcgaaaaccatgctgtacgcaatcaacggcggcgttgatgaaaaactgaaaatgcaggttggtcctaagtctgaaccgatcaaaggcgacgtgctgaactatgacgaagtcatggaccgcatggatcacttcatggactggctggctaaacagtacgtgaccgcgctgaatgttatccactacatgcacgacaagtacagctacgaagcctctctgatggcgctgcatgaccgtgacgtcgttcgcaccatggcatgtggtatcgcaggtctgtccgttgcggctgactccctgtctgcaatcaaatatgcgaaagttaaaccaattcgtgacgaagatggtctggctatcgacttcgaaatcgaaggcgaatatccgcagtttggtaacaacgacgctcgcgttgatgacatggcggttgacctggtagaacgtttcatgaagaaaattcagaaactcactacctatcgtaacgctatcccgactcagtctgttctgaccatcacctctaacgttgtgtatggtaagaaaaccggtaacaccccagacggtcgtcgtgctggcgcgccattcggcccaggtgctaacccaatgcacggtcgtgaccagaaaggtgcggttgcctctctgacctccgttgctaaactgccgtttgcttacgcgaaagatggtatctcttacaccttctctatcgtgccaaacgcgctgggtaaagacgacgaagtgcgtaaaactaacctcgcgggtctgatggatggttacttccaccacgaagcgtccatcgaaggtggtcagcacctgaacgtgaacgtgatgaaccgtgaaatgctgctcgatgcgatggaacaccctgagaaatatcctcagctgaccatccgcgtatctggctacgcagtacgttttaactccctgacgaaagaacagcagcaggacgttattacccgtactttcactcagtccatgtaa

SEQ ID NO: 2834 - DNA, 318 bp, Enterobacter cloacae
cgtctacggacggacgctgcgttgccagtaccaggtggatgcccgccgcacgcgctttctgtgccagacgcgcaatcagctcttccactttcttaccaacggtcatcatcaggtcggcaaattcatccaccagcaccacgatgtaaggcagtttttccagcaccggatgctgggcatccatgctgtcacccggcttccagtatgggtccggaatcggacggcccatacgcgccgcctcggcgattttctcgttataaccggccaggttacgcacgcccagcgccgacatcagcttgtagcgacgctccatttcattga

SEQ ID NO: 2835 - DNA, 1689 bp, Enterobacter cloacae
cacaaaattctgtttctccagatttatgacggggaactaactatgaatggggcacaatgggtagtacatgcgttgcgcgcgcagggagtcgaaaccgtattcggttatccgggtggcgcaattatgccgatttacgatgcactgtatgacggcggcgtggagcacctgttgtgccgacacgagcagggcgcagcgatggccgccatcggttatgcccgtgcgaccggtaaaaccggtgtctgtatggccacctcaggtcccggcgcaacgaacctgatcaccggcctggctgacgcgctgctcgactccgtacccgtggtggcgatcaccggccaggtggcctctccgttcatcggcaccgatgccttccaggaagtggatgtgctcggtttatcgctggcctgcaccaaacacagcttcctcgttcagtctctcgaagagctgccgcgggtgatggccgaagcgttcgaggttgccagctctggccgtcctggcccggttctggttgatatcccgaaagatatccaggttgcactcggcgaactggagccgcatttctctaccgtggaaagcgataatgcgttcccgcatgcagaggtggaagaggcgcgtcagatgatagcgcaggccaaacaaccgatgctgtacgttggtggtggcgtaggtatggcgcaggcggttcctgcactgcgcgaatttatcgcggcaacgcaaatgcctgccacctgcacgctgaaagggttgggggcggtagatgctgattacccctactatctgggcatgctggggatgcatggtaccaaagcggcaaacctggcggtgcaggagtgtgacctgctcatcgccgtcggcgcccgttttgacgaccgcgtcaccggcaagctgaacaccttcgcgccaaacgccaaagtgatccatatggacatcgacccggcggagatgaacaaactgcgtcaggcgcatgtcgcgttgcagggcgatcttaacgcgctgttaccggccctggagcagccgctggatattaacccatggcgtcagcacaccgccgatatgcgcgctgaacacgcctggcgttacgaccaccccggcgaggccatctacgcgccgctgctgttgaaacagctgtcagaccgtaaacccgcagacagcgtggtaacgacggatgtcggccagcatcagatgtggtcagcccagcacatgacctacacccgcccggagaactttatcacctcgagcgggttagggacgatgggcttcggtctgcccgctgccgtgggcgcacaggttgcccgcccgaacgataccgttatctgtatctccggtgacggctccttcatgatgaacgttcaggagctcggcaccgtgaagcgcaagcagttaccgttgaagatcgtgttgctcgataaccagcgtttagggatggttcgccagtggcaacagctgttcttccaggaacgttacagtgaaaccaccctgaccgataaccccgatttcctcaccctggccagcgccttcggcattcctggccagcacatcacccgtaaagaccaggttgaagcggcactcgacaccatgctgtcaagcgaagggccatacctgcttcatgtctcaatcgatgagcttgagaacgtctggccgttggtaccgcccggtgccagtaactcacaaatgctggagaaattatcatga

SEQ ID NO: 2836 - DNA, 186 bp, Enterobacter cloacae
aaaacatgtatcgcgccggtccggcgggcatccgtaccacccaggcgttctcgcaggattgccgttgggacacgcttgatgacgatcgcgccgaaggctgcattcgctcgctggaacatgcctatagcaaagacggcggcctggccgtgctgtacggtaactttgcggaaaatggctgtatcgtga

SEQ ID NO: 2837 - DNA, 222 bp, Enterobacter cloacae; identical to SEQ ID NO: 376

SEQ ID NO: 2838 - DNA, 390 bp, Enterobacter cloacae
ctaatactccgcgccataaatagctcggccaaagaattaggagcgtgtaggatggcggaaagctttacgacgactaatcgttttttcgacaataaacattatccgcgcgggttctctcgtcacggcgatttcactatcaaagaagctcaacttcttgagcgccatggttatgcctttaacgagctggatctgggtaaacgtgaaccggcaaccgaagatgaaaaacagtttgtctctgtttgccgtggtgagcgtgagccgcaatctgatgcagaacgtgtatggattaagtatatggctcgcattaagcgtcctaagcgtttccatacgctgtctggcggcaagccgcagatggaaggtgcagaagactacaccgagtctgacgattaa

SEQ ID NO: 2839 - DNA, 1560 bp, Enterobacter cloacae
actggggggctaacgatggccgagtcacaacccttatccgccgcccctgagggggcggagtacctgagagcggtgctacgcgcgccggtctatgaagccgtgcaggtcacgcccctgcaaaaaatggaaaaactctcctcgcgcctcgacaacgtcattctggtgaagcgtgaagacaggcagccggtgcacagcttcaagctgcgcggagcctacgcgatgatggccgggctgacggacgagcagaaagcgcgcggggtgattaccgcgtcggcgggcaaccacgcgcagggcgtggcgttttcctcggcgcgtctggggctgaaggcgctgatcgtgatgccggttgctaccgcagacatcaaggtcgacgcggtgcgcggtttcggcggagaagtcttgctccacggggctaactttgacgaagccaaagccaaagcgattgagctggcgcagcagcaggggttcacctgggtgccgccgttcgaccacccgatggtgattgccgggcagggtacgctggcgctggagctgttgcagcaggacgcccatctcgaccgcgttttcgtcccggtgggcggcggcggcttagccgctggtgtggcggtgctgatcaaacagctcatgccgcagatcaaagtgattgcggttgaagcggaagactctgcctgcctgaaggcggcgctggatgccgggcatcctgtggatctgccgcgcgtcgggctgttcgccgagggcgtggcggtgaagcgcattggcgacgaaacgttccgtctgtgccaggagtatctcgacgatatcgtcacggttgatagcgacgctatctgcgcggcgatgaaagatctgttcgaagacgtgcgtgcggtggcggaaccctccggcgcgctggcgctggcggggatgaagaaatacatcgcccagcacaatatccgcggcgagcgtctggcgcacgtgctttccggtgccaacgtgaacttccacggtctgcgctacgtttccgagcgctgtgagctgggtgagcagcgtgaagcgctgctggcggtgaccattccggaagagaagggcagcttcctgaagttctgtcagctgctgggcggtcgttcggtaacggagttcaactaccgctttgccgatgccaaagatgcgtgcatttttgtcggcgtgcgtctgagccgtggcgtggaggagcgcaaagagatcctcagcctgctgcatgacggcggttacagcgtggtcgatctctccgacgacgagatggcgaagctgcacgtgcgttacatggtcggcggccgtccatccaagccgctgaaggaacgcctgttcagcttcgagttcccggaatcgccgggcgcgctgctcaagttcctgcacacgttgggcacgcactggaacatctctctgttccactaccgcagccacggcaccgactatggccgcgtactggcggcgttcgagctgggcgagcacgaaccggatttcgaaacgcgcctgaacgagctgggctatgagtgccatgacgaaacccacaacccggcgttccgtttcttcctggcgggttag

SEQ ID NO: 2840 - DNA, 1503 bp, Enterobacter cloacae
acaacacaacatcacgaggtatcacccatggctaactactttaatacactgaacttgcgccagcagctggcgcagctgggcaaatgccgcttcatggcgcgcgatgaatttgctgatggcgcgagctaccttcagggtaaaaaagtggtcattgtcggctgtggcgcacagggtctgaaccagggcctgaacatgcgtgactccgggctggatatctcctacgccctgcgcaaagaagcgattgccgagaagcgcgcttcatggcgtaaagcgaccgaaaacggcttcaaagtgggcacctacgaagagctgatcccgcaggcggatctggtggtgaacctgacgccggacaagcagcactctgacgttgtgcgttccgtacagccgctgatgaaagacggcgccgcgctgggttactcccacggcttcaacatcgttgaagtgggcgagcagatccgtaaagacatcaccgtagtgatggtggcaccgaagtgcccgggcaccgaagtgcgtgaagagtacaaacgtggcttcggcgtaccgacgctgatcgccgttcacccggaaaacgatccgaaaggcgaaggcatggcgattgccaaagcctgggcagcggccaccggcggccatcgtgcgggcgtactggaatcttccttcgttgcggaagtgaaatctgacctgatgggcgagcagactatcctgtgcggcatgctccaggctggctctctgctgtgcttcgacaagcttgtggaggaaggcaccgatccggcatacgcagaaaaactgattcagttcggctgggaaaccatcaccgaagcgctgaagcagggcggcattacgctgatgatggaccgtctgtccaacccggcaaaactgcgcgcgttcgcactctctgaacagctgaaaaccatcatggcgccgctgttccagaaacatatggacgacatcatctccggcgagttctcctccggcatgatggcagactgggcgaacgacgataagaaactgctgacctggcgtgaagagaccggtaaaaccgcgttcgaaaccgcaccacagtacgacggcaagatcaccgagcaggagtacttcgataaaggcgtcctgatgattgcgatggtgaaagcaggcgttgagctggcgttcgaaaccatggtggattccggcatcattgaagagtctgcgtactacgaatcgctgcacgagctgccgctgatcgcaaacaccatcgcccgtaagcgtctgtatgagatgaacgtggtgatctccgataccgccgagtacggtaactacctgttctcttacgcctgcgtaccgctgctgaaagagttcatgaccaccctgcaagcgggcgatctgggccaggcgattgcggaaggtgcggttgataacgcgcagctgcgtgacgttaacgaagcgattcgcagccacgaaatcgagaaagtgggccagaaactgcgtggctacatgaccgatatgaaacgtatcgcggtagcaggctaa

SEQ ID NO: 2841 - DNA, 432 bp, Enterobacter cloacae
gagcgtgtaggatggcggaaagctttacgacgactaatcgttttttcgacaataaacattatccgcgcgggttctctcgtcacggcgatttcactatcaaagaagctcaacttcttgagcgccatggttatgcctttaacgagctggatctgggtaaacgtgaaccggcaaccgaagatgaaaaacagtttgtctctgtttgccgtggtgagcgtgagccgcaatctgatgcagaacgtgtatggattaagtatatggctcgcattaagcgtcctaagcgtttccatacgctgtctggcggcaagccgcagatggaaggtgcagaagactacaccgagtctgacgattaagaagagaaggggctacggccccttttttttttacgccagcattttttgcagatgcaacagcagccgatcgatcgcacggtaa

SEQ ID NO: 2842 - DNA, 288 bp, Enterobacter cloacae
ctcacaaatgctggagaaattatcatgatgcaacatcaggtcgccgtgcaggctcgcttcaacccggaaacgttagaacgcgttttgcgcgtggttcgccaccgtggctttcagatttgctctgtgaatatggaaacggctaccgacgcacagaacatcagtatcgaattaaccgttgccagcccgcggccggtcgacttactgtttagtcagttatcaaaactggtagacgttgcccatgttgccatctgccagagcacaaccacatcacaacaaatccgcgcttaa

SEQ ID NO: 2843 - DNA, 942 bp, Enterobacter cloacae
caggacgaaaaaatgacgacaaaaaaagctgattacatttggttcaatggtgagatggttcgctgggaagacgcgaaagttcacgtgatgtcccacgcgctgcactacggcacctccgtgtttgaagggatccgttgctacgactctcacaaagggccagtggtgttccgccatcgcgaacacatgcagcgtctgcatgactcagccaaaatttatcgtttcccggtctcccaaagcgttgatgagctgatggaagcctgccgcgaggtgattcgccagaacaaactgaccagcgcctatattcgtccgctggtcttcgtgggtgatgtcggcatgggcgtcaacccgcccgccggctataacaccgatgtgatcattgccgcgttcccgtggggcgcctacctgggcgcggaagcgctggatcaggggatcgacgcaatggtttcttcctggaaccgcgtggcgccaaacactatcccgactgcggctaaagcgggcggtaactacctttcctcactgctggtcggcagcgaagcgcgccgtcacggctatcaggaaggtatcgcgctggatgtgaatggctacatctccgaaggtgcgggcgaaaacctgtttgaagtgaaagacggcattctgttcaccccgccgttcacttcgtccgcgctgccgggcatcacccgcgacgccatcatcaagctggcaaaagatctgggtatcgaagtgcgcgagcaggtactgtcccgcgaatccctgtacctggctgacgaagtgttcatgtccggtaccgcggctgaaattacgccggtgcgtagcgtagacggcattcaggtgggcgaaggccgctgtggcccggtcaccaaacgcattcagcaagccttcttcggcctgttcaccggcgaaacagaagacaaatacggctggttggatcaggttaatcactaa

SEQ ID NO: 2844 - DNA, 1854 bp, Enterobacter cloacae
agcatgcctaagtatcgttcagccaccaccacccacggccgtaatatggcgggtgcccgcgcactgtggcgcgccaccggaatgaccgacgccgatttcggcaagccaattatcgccgtggtgaactccttcacccagtttgtgccgggccacgtgcacctgcgcgatctcggtaagctggttgccgagcaaatcgaagcctccggcggcgtggcgaaagagttcaacaccattgcggtggatgacggtatcgcaatgggccacgggggaatgctctattcactgccgtcgcgcgagctgatcgccgactcggtggagtacatggttaatgcccactgcgccgatgcgatggtctgtatctccaactgcgacaaaatcaccccggggatgctgatggcttccctgcgcctgaacattccggtgatcttcgtctctggtggcccaatggaagcggggaaaaccaagctctccgacaaaatcatcaagctcgacctggtcgatgcgatgatccagggcgcggacccgaaagtctctgacgagcagagcgaccaggtggaacgctccgcgtgcccgacctgcggctcctgttccgggatgttcaccgctaactccatgaactgcctgaccgaagcgctgggcctttctcagccgggcaacggctcgctgctggcgacccacgccgaccgtaaacagctgttccttaacgcgggcaagcgcatcgttgagctgaccaaacgctactacgagcaggacgatgccagcgcgctgccgcgcaacatcgccagtaaagcggcgttcgaaaacgccatgacgctggatatcgccatgggcggctccaccaacaccgttctccacctgctggccgccgcgcaggaagctgaaatcgacttcaccatgagcgacatcgacaagctctcccgcaaagtgccgcagctgtgtaaagtcgcgccgagtacccagaagtaccacatggaagatgtccaccgtgcgggtggtgtgattggtattctcggcgagctggatcgcgccgggctgcttaaccgcgacgtgaaaaacgtgctcggcctgacgctgccggagtcgctggagcagtacgacgtgatgctgaccaaagacgacgcggtgaaaaacatgtatcgcgccggtccggcgggcatccgtaccacccaggcgttctcgcaggattgccgttgggacacgcttgatgacgatcgcgccgaaggctgcattcgctcgctggaacatgcctatagcaaagacggcggcctggccgtgctgtacggtaactttgcggaaaatggctgtatcgtgaaaaccgctggcgtggacgacagcatcctgaaattcaccggtccggcaaaagtgtatgaaagccaggacgaagcggtagacgccatcctcggtggcaaagtggtagaaggcgacgtggtggtcattcgctacgaaggaccgaaaggcggtcccggcatgcaggagatgctctacccgaccaccttcctgaaatcgatgggcctcggcaaagcctgcgcgctgatcaccgatggtcgtttctctggcggcacgtcaggcctctccattggtcacgtctccccggaagcggcaagcggaggcaacatcgcgatcatcgaagatggcgacctgatcgaaatcgacattccgaaccgcggcattcagctgaagctgagtgaccaggagattgcggcccgtcgtgaagcgcaggaagcccgcggcgacaaagcctggacgccgaaagatcgccagcgcgaagtctccttcgccctgcgcgcctacgcgagccttgcaaccagtgcagataaaggcgcggtgcgcgataaatctaaactggggggctaa

SEQ ID NO: 2845 - DNA, 426 bp, Enterobacter cloacae
cccggaagatgccccgcgacgcgtggcgttttggcgccgatgggatcgtgttttctaaccatgtgccccgccagcttgatggggtgtttttcctccgcccgcgccctgccggccattgccgatgcggtgaaaggcgatattgcgatcctggccgatagcggcatccgtaacgggctggacgtggtgcgcatgattgcgctcggcgccgacagcgtgctgctgggccgtgcttacctgtacgcgctggccaccagcggccaggcgggcgtggcgaatctgctgaacctgatcgagaaagagatgaaagtagcgatgaccctgaccggggcgaagtcgattagcgaaatcaacaaagactcgctggtgcaggagctcagtaagctgcctgcggcgctggcccctctttctcagggaaacgcggcctga

SEQ ID NO: 2846 - DNA, 1428 bp, Enterobacter cloacae
gaaaatttgacacaccccgcccctccgcaattgtatagacaagcaaatacaagaacacaaaaacaacatcacatcggaggggaacgtatgacgtattcaggtcgggtggatattcagcaggtgatcgatgaaagtcccttttcagggtttcactggcttcttattgtgctgggctttctggtgctggcgatcgatgggtttgataccgcagcgatgggttacattgcgcctacgctgtcgacggagtggggaatacataaacaggatctggggccggtgctgagtgcggcgctgctggggctgtcgctgggagccctgattgcaggtccggtatcggaccggatgggacgcaagcgcgtgctggtcttttcgtgtctcttcttcggcctggcgagcctgggcacggcctgggcgcaaagtctgaataccctgacgctatggcgatttctgaccggtctcgggctgggcgccgcgatgcctaacgccatcacgctgatctcagagtttgccccccagcgctgccgcgccatggcaattaacaccatgtactgcggctttccgctgggtgcggcgggcggcggggcgatctcgtcctggcttatccctcaccatggctggcgaagcgtgctgctgaccggcgcgattgcgccgctgattttaacggtgctgctggcgctgctgttgccggagtcggtgaagtttctggtgcagcgcgggaaagacatcgcccaggttcgccgcatcgccagccggttcgcccgcagcacgctggatagcgtcacgggctttttcctgacagaggagaaagtcgcgtcgaaaaaaggcagcgtgtcgcagctgttttccatgccctggctgcccggcaccctgatgctgtgggtcacctactttatgggactggtgatttattacgtcctgctgagctggatgccgacgctgatgcaggggatggggtatgcgctggcggaatctgcctggctcacctcgctgttcaccttcggcggcaccgctggcattttgctcgcgggctggatgatggatcgctgggaagcgcacaaggtggtcgcgtgtggtttcgtgctgacgatgggcctgattcttttactcggcattgagcataaccatatcgccctgtttggcgggttaattttcctgatggggatcgcgatgaacggcgcgcagtcgggcatgcagaccctggccgccaccttttaccctaccgagtgccgcgcgacgggtatcgcctggatgcaggggatcggccgcttcggcggcgtggcgggcaccatgaccagcgcccagcttctttccatgcagtggcaggcagacagtattttaatgatcctcagcgtgcctgctctcgtggccgcggcggcaaccgtctacaaaatgctgtatagccgcgcgcaggagccgggcgtcgcctag

SEQ ID NO: 2847 - DNA, 483 bp, Enterobacter cloacae
gggggcagcatgcttaacatcgtcttattcgaaccagaaattccgccgaacaccggcaatattatccgcctgtgcgccaacaccggttttcgtctgcacatcattgaaccgatgggctttacgtgggacgacaaacgtctgcgccgcgcggggctggactaccatgagtttactgccgtcgttcgtcatcacgattacgccgcgtttctggacgcagagaagccgcagcgcatgttcgccctgaccaccaaaggcacgccagcacacagcgccgtaagctatcaggacggggattatctgatgtttggtccggaaacccgcggcctgccggccaccattctggatgccctgccagccgagcagaaaattcgtattccgatgatgccggacagccgcagcatgaacctgtcgaatgcggtgtcggtggtggtgtatgaggcgtggcgccagctgggttatcccggcgcgatactgcgtagctaa

SEQ ID NO: 2848 - DNA, 855 bp, Enterobacter cloacae
atcataacgacaaataattttgcggagaaagatgtggatacggaattgctaaaaactttcctcgaagtgagcagaacgcgacactttgggcgagcagctgaagccctctacctgacgcagtcagcagtcagttttcgtattcgacagctggaaaatcaactgggtgtgaacctttttacccgccatcgcaacaatattcgtttaaccccggccggtgaaaagctattgccttatgcagaaaccctgatgaatacctggcaggcagcgcggaaggaggttgcgcacacctcccggcataatgaattctcgatcggtgccagcgcttcactatgggaatgcatgctcagccagtggcttatgcggctatatcgctcacacaaccatctgcaatttgaggcgaggattgcgcaacgccagtcgctggttaagcaactccacgagcggcagcttgatctcctgatcaccacagaagcgcccaagatggacgaatttagcagccagattgttggacagtttagcctggcgctctatgcatccgagcctgcaatgatgaaggccgacctgaattatttacgcctggaatgggggcctgattttcagcagcacgagacggggttaattgccagcgatgatatcccgcaactcacgacaagctctgcggagatcgcatgccagcatcttcccgcattgaaaggctgtacatggttacctgttcgctgggcggataataaacccgcactccatgttgtcaccgattcgacaactctctccaggccgctgtatgccatttggctgcaaaacagcgataagcagtcgcagataaaagatctgttaaaaaccagcatactggattaa

SEQ ID NO: 2849 - DNA, 909 bp, Enterobacter cloacae
aaagagggagtggaatcggtggatttacgcgatctgaaaatgttcctgcacctggcggaaagccgtcactttggccgtagcgcccgggcgatgcacgtcagcccctccacgctgtcgcgccagatccagcgccttgaggaagacctcggccagccgctgttcgtgcgcgataaccgcaccgtcaccctcacggaagcaggtgaagagctgcgcatctttgctcagcagacgttattacagtatcagcagctgcggcacaccatcgaccagcaggggccgtcgctttccggcgagctgcatattttctgttccgtgaccgctgcctacagccatcttccccccattctcgaccgcttccgcgcggaacatccgtcggttgaaattaagctcaccaccggcgatgccgccgacgcgatggaaaaagtggttacgggcgaagcggatctggcgattgccggaaaacctgaaacgctgccaggggcggtggcgttctcgatgctggagaatctggcggtagtgctgattgccccggcgctgccctgcccggtgcgcaaccaggtttcggtggagaaaccggactggtccacggtgccgtttatcatggccgatcaggggccggtgcgccgccgcattgagctgtggttccgccgccagaagatcagtaacccgtcgatttacgccacggtcggcggccatgaggcgatggtatcgatggtggcgctcggctgcggcgtagcgctgctaccggaagtggtgctggaaaacagcccggagccggtgcgcaatcgcgtgatgattttagaacgcagcgatgagaaaacgccgttcgagctcggcgtgtgcgcacaaaaaaagcggctgcatgagccgcttattgatgcgttctggacgatattgccgaaccactaa

SEQ ID NO: 2850 - DNA, 228 bp, Enterobacter cloacae
  unsure (34)
ttgaaaagaccttggagtgatatccgcgaattantgggacgccccggatgtgattcaaaggataccttgacccggaagatgccccgcgacgcgtggcgttttggcgccgatgggatcgtgttttctaaccatgtgccccgccagcttgatggggtgtttttcctccgcccgcgccctgccggccattgccgatgcggtgaaaggcgatattgcgatcctggccgatag

SEQ ID NO: 2851 - DNA, 1551 bp, Enterobacter cloacae
tgctggcatagtcaccgccaaggagggcttatgtcactgtcagttgtttatacacgcgcggccatcggcgtgaaggcaccgcttatttctgtagaggttcatttaagtaatggactgcccggactgacgctggtcggcttaccagaaacgaccgttaaagaggcgagggatcgcgtgcgcagcgcaattattaatagcggttatgcttttccggcgaagaagatcaccatcaaccttgcgcccgccgatttgccaaaggagggagggcgatatgatttacctattgctatagcgcttctcgcggcttctgaacagctcaatacgccagggctaagctcgtgcgagttcgtgggtgaattagcgcttacaggcgcgttaagaggcgttcccggagcaatctcgggtgcgcttgaagccatacgcgcgggaagacaaatcattgtggccaatgaaaatgcctctgaagtaagccttatcgccgaaaagggatgtcttgtcgcgggacatttgcaggaggtttgcgcctggctggaaggccgacacgagcttgccgagccgcaggagaatgacgaggtggcgccagattcgcccgaggatctcagcgatattatgggtcaggaacagggtaaacgggcgttagagataacggccgcgggtgggcataacctgttactgataggtccgccaggcacggggaaaacgatgctggcgagcagattgagcggcctgttgccacccctcaataatcacgaagcgctggaaagcgccgcgatatttagcctggtcagttctacgtcgctgcataaacagtggcgccgccgtcctttccgctctccacaccacagtgcgtctcttaccgcgatggtgggcgggggttcgatccccgggccgggtgaaatctcactggcgcacaacggcattctcttcctggatgaattgccagagtttgaacgccgcgtgctggatgcattgcgggagccgattgaatccggcgaaatccatttgtctcgtacacgggccaaaataagctaccctgcgcagtttcagctggtcgccgcgatgaaccctagccctacgggtcattatcagggcaatcataaccgctgtacgccggagcagacgctgcgctatctgagtaagctgtccggccccttcctcgaccgttttgatttatctctcgagatccccctgcccccgcccggtctgctgaggcaaaccggtattaagggcgaaagctcagcaacagtgcgtgaacgggttattgcggcacaggcgcggcagtatgttcgtcagaacaggctgaatgcccggctggataacagcgggatccgacagttttgttctctcaacgctgaagatgcgggctggctggaagagacactgacgcggtttgggctatccattcgcgcgtggcagcgtttgttgaaagttgcgcgcacggtcgccgacgtggagggctgccccggaatagagaggcggcatttgcaggaggcattaagttaccgtgcgatcgatcggctgctgttgcatctgcaaaaaatgctggcgtaa

SEQ ID NO: 2852 - DNA, 189 bp, Enterobacter cloacae; identical to SEQ ID NO: 377

SEQ ID NO: 2853 - DNA, 1488 bp, Enterobacter cloacae
cagttagcaaaatcttctctttttctcctgctgatatacactgtcagcaataaggagaatctgatgaaaaaataccagcgtctggcgcaacaaattatctcgcagattgagcttggcgtatggttgccgggcgataagttaccttctctgcgagagcaggtggcaggcagcggcatgagttttatgaccgtgggccacgcgtatcagatgctggaaagtcaggggcgcattgttgccagaccgcagtcaggctattacgttgccgcgcgcccgaccacacaccagcctgcaccgcccgcgcaggtgatgcgcgatgaagtggtcgacatcaacacctatatcttcgacgtgctacaggccagccgcgacccctccgttgtcccttttgcctcggcgtttcccgatccgcgccttttcccgcttcagcaactcaaccgatcgctggctaacgtcagcaaaacggctaccgccatgagcgtgattgaaaacctgccgccgggtaacgtcgacttacgtcatgccattgcccgtcgctacgctcagcagggaatgaatatctccccggatgaaattgtgatcaccgcgggtgcgcttgaggcgctcaacctcagtttgcaggctgtgactgaaccaggggactgggttatcgttgaaaatccctgtttttatggcgcactccaggcgcttgaacgtctgaaactgaaagcgctgtcggttgccactgacgtgcgtgagggcatcgatctcagtgcccttgagcaggcattaaatgattatccggtgaaagcctgctggctgatgaccaacagtcagaacccgctcggcttcacgctgagtgcagagaagaaagctcagctggtggcgttattaacccggcataacgtcacgctgattgaagacgatgtttacagcgaactctactttggccgcgaaaagccgcttccggcaaaggcctgggataagcaggatatgacgttgcactgctcctcattctccaagtgtctggtggctggttttcgtattggctgggtgacggcgggaaaacatgcgcgccgtattcagcagttgcagctgatgagtacgttatccaccagttctcccatgcagctggcgctggtggattacctggcgaccaaacgttacgacgcccaccttcgccgcctgcgacgcacgcttgctgaacgcaaacagcaggcctggcaatcgcttttgcgccatatgcctgccggcgtcaaaatccatcataacgacagcggctactttttatggctggaactgcctgaacagctggatgcggggcggttgagtgagaaggcgttaatccatcaaatcagcattgcgcccggcaagatgttttccacctccaatatctggacaccgtttttccgtttcaatacctcatggggatggggcgagcgggaagagcaggcggtcgtccagctggcggggctaatccgcgaaatgatgctgcacccagtcacaccttga

SEQ ID NO: 2854 - DNA, 267 bp, Enterobacter cloacae
tatttaagtggttatgatgtaacgaaaaaacttgatctgtgtcaacatatgacgcatattgcgtgcggttatttttcggctcaggtaaacagaatgacgttgtatcaaaagatgttggtgttctacgcaatcatggcctccatctgcgcattaatcacctggttcctgtctaaagatcgtaaacgtattcgcctgttgagcgcattcctggtgggatctacctggccgatgagctttcctgttgccctgttgatctctcttttctga

SEQ ID NO: 2855 - DNA, 834 bp, Enterobacter cloacae
ttgccctgccagcttgtaaagcgtggggatcatcaacagcagcccctgagacgacgtaaacgaggtcgacagggcaccggtctgcaacgcaccatgtacggtggcaatggccccggcttcggactgcatctcaacaacccgcgggacatcgccccagacgttttttatcccattaccagcccaggcgtcagcctgttcagccatcgtggagctgggagtgatggggtagatggcgatcacttcgctggtacgaaacgcaacagacgcgactgcaccattgccgtcaatagtttgcataggacaacacccttacattgcgcaaaaagaggggtctgtaaaacgacgacagaccctgaatattatctgtgtattttagcaaagctcaggttttacgattttcgcttttgtgtccttggtatgcgctgtatcaatgactcgaaggctattcgcgttaaaaaattgcgagaaattgttaccagggcgcataattacgcacatccgctctcgacgatgcggcgcgtgatgcctattatgcataggtttcgcgttaattatggggaggaaggtatgcgttcagcattttgggtcggatgtgccgcgttactgttgtcggcatgcagcaatgaacctgtacagcaggcgacagcggcacacgttacgccgggtatgcgagcggctatgtccagttcaggtcaggccaactgcgcaatgatcggcggttcactctccgttgcccgtcagctcgacggctcagccatcggcatgtgcgcgttgccaaatggcaaacgctgtagtgagcagtcgcttgccgttggttcgtgcggaagctactga

SEQ ID NO: 2856 - DNA, 1461 bp, Enterobacter cloacae
cagcgaaaacaatgtcgatttcaacaggacaatgctatgcaaaatcaattgctgattaatggtgaactggtggccggcgaaggtgagaagcaggcggtttataatcctgccacgggtgatgtgctgctggagattgctgaagcgtcggaagcacaggtggacgctgccgtccaggctgccgatcgcgcgtttacagagtggggacaaacgacgccgaaaacgcgcgccgaatgtctgttgaaactggctgatgtgatagaagccaacgctgacgcgttcgcaaatctggaatcccttaactgcgggaaaccgctgcactgtgtccagggggacgagatcccggccgtggtcgatgtgtttcgcttctttgccggggccgcccgctgcctgaacgggctggctgccggagaatacctcgaaggacatacttcgatgatccgccgcgacccggttggcgttgtcgcctctattgcgccctggaactatcctctgatgatggcggcgtggaagctggcgcccgcgctggcggcgggaaactgtgtcgtcatcaagccgtctgaaatcaccccgttgacggcgctgaagctggcggaactggcgaaagatatcttcccgccaggcgtgttgaacgtgctgtttggtcgcggcaaaaccgtaggagatccgctgaccggtcacgaaaaagtccgtatggtttctctcaccggctctattgctaccggagaacatattatcgggcataccgcatcttcagttaaacgtacccatatggaattgggcggaaaagcgccggtcattgtctttgacgatgcagatttggatgccgtggttgaaggcgtgcgtacgtttggtttctacaatgctggtcaggattgtaccgcagcctgtcgtatctatgcccagaaggggatttaccccgcgctggtcgaaaagctgggcgcagccgttgccagcctgaaaatgggcgcgccggacgatgcttcaaccgagctgggcccgctcagctccgcagcgcatctttcccgcgtttgtgctgccgtggacgaggccaaaacccttggacatatccgcgtcgtcaccggtggcagtaaaaaagagggggcaggatattacttccagccaacgctgctggccggggcgaagcaggaagatgcgatcgtccagcgagaagtgtttggcccggtggtcagcgtgacagaatttgaggatgaagcgcaggtgctgaactgggctaacgattcgcaatacggcctggcctcgtccgtctggacaaaagacgtcggacgcgcccatcgcctcagcgcacggttgcagtatggctgcacctgggtcaatacccattttatgctggtgagcgaaatgccgcacggcgggatgaagttatccggttacggaaaagatatgtcggtctacggacttgaggattacacggtagtccgacatgtcatgtttaaacactaa

SEQ ID NO: 2857 - DNA, 243 bp, Enterobacter cloacae
ggagtgacaatgtcacatttaaacaaagttatcgcccgcgtcgatgccaccatcgaagagagcgtgattacccacatgaacgaactgctgatcgaattaagcgacgatgcagagctcagccgtgaagatcgttatacccagcagcagcgcctgcgtaccgcgattgcgcatcatggcaagcaacataaagaagaggcggaggcacgccatgcccacctcacgcagggtgggactatcctgtaa

SEQ ID NO: 2858 - DNA, 585 bp, Enterobacter cloacae
tatgacgtcatgaatacaatgacagacaatatgaatcaacgcattagcgcccgcatacgccttgaacgcgagtcgcgtggctggtcattaagcgaactggccgaacgggcaggtatctcacgcgccatgatccataagattgaacggggtgacagtagcccaacggcgacgctgcttgcgcggttatccggtgccttcggtattagcatgtctacgctcattgcgcgcgcggaaatgcaggagggcaaactattacgtctggcgaaccagcccgtctggcgcgatccgcaaacccactatttgcgtcgccatgtgtcgccgcgcaccgatatgcctatcgacctcgtccaggtggagctacccgcaggcagcgatgtgccgatgcccgcttcctcttacgcgctggcgcgacagctgatttggttgcaggcaggtgaactggtctttctggagggggatacccgccatgaaatgaaggccggagattgtctggaactcgggccgccgaacgactgccggtttatcaacgaaacggatgaatcgtgcctctatctggtcgtgcggcttaatcagtccggctcataa

SEQ ID NO: 2859 - DNA, 1101 bp, Enterobacter cloacae
tgcaaaggcgatccgcaggataacgtgccagacttgaatgacattttcagcagtaaggagcgaagaatgaatcaatcaactacgcaaaaccgacgctgggtactggcttcccgtccacacggcgcgccggttgccgaaaatttccgcctggaagagcagccgatccccacgcccgcagagggacaggtattattacgcaccgtatggctctcgcttgatccgtacatgcggggccgtatgagcgatgcgccatcctattcacctcctgtcgagattggtgcggtgatggtgggcggcacggtaagccgcgtcgagacctcccgccatccggattataaagagggtgaatgggtgctgggttacagcggctggcaggagtatgaactgtccgacgggcaggggctggtgaagctgggtgaaaacccgtcgcatccttcatgggcactcggcgtgctcgggatgccgggcttcaccgcgtatatggggctgctcgatatcggccagcctcaggcaggagaaaccctcgtcgtggcggcggccacggggccggttggcgcaacggtggggcagatcggaaaaatcaaagggtgccgggtcatcggcgtggctggcggggaggagaaatgccgtcatgcggtcgacgtgctcggtttcgacgcctgtctggatcaccatgcggatgattttgccgaacagctggcgaaagcctgcccgcagggcattgacgtgtattatgaaaacgtcggcggtaaagtctttgacgccgtactgccgctcctgaatacctccgcgcgcgtgccggtttgcggactggtcagcggctacaacgcgaccaacctgccggaggggccggatcgcttgccgctgctgatggggaccatcctgaaaaaacgcatccgcatgcagggctttatcatcgctcaggactatggtcatcgtatcgtcgagttccagcaggaaatgggacgctgggtgaaggaaggcaaaatacactatcgcgagcaggtcaccgaagggctgaacgcggcgccggaggcgctgattgggctgctggaagggaaaaacttcggcaaggtcgtgatccgcgtggcggcggactaa

SEQ ID NO: 2860 - DNA, 798 bp, Enterobacter cloacae
ggctgtataaatatacagtctgtcatacatggagtgcttatgaacagtttctattcgcagcaagcaggctgcactgtgcgctggcaggatcttcccggtttcggtgacccggttgtgtttatccacgggttgggctgtgcatcgtcgtatgaatatcctcgtattgtctgtgatacccgtttcggggggcgcagagccattctgatcgatcttcccggtagcggttacagtgacaaacctgacaactaccgttatcgcacgagcgaacaggcgcaggtggtggttgaactgttaaaccatctcggcctggatagtctatggctctatggtcatagcatgggggggagtatcgcgatcgaaacggcaacgctgttaacgtcgcgcgttaagggcctgatagtgtctgaacccaattttcatgcgggtggcgggatgttcagccgggcaattgcggcccaaacggaacaacattttctggctcagggctatgatgacatgctgcgggcggaaacgtcgccgtgggctggaagccttcaaagtaatgccccctgggccgtctggcgcggcgcaacaagcctggtcgagggcgttaaacctgactgggaacacctgttcttgtcattgcgctgcccggtaatgttagtttttggtgagcgatccctgcctgatgacgattttaatcgtctgcaacaaaacggcgttgctgtaaaaattatccctgatgcgggccattcaatgtcctgggaaaacccgtcagcgttggctcaggctttgtctggcttcataaacggctcatga

SEQ ID NO: 2861 - DNA, 1689 bp, Enterobacter cloacae
aataacctgatagtgattcgttatttgtcaggccaatacgtctgtgctgttattactgttcactataataaaaccgaaagggtaataaccatgtctacagggaaaaccgtgctcgccctcgcgctgagcgcgctgctaccggcaagcgccgcatgggcggcaaataaagacaccattatctactgctccgaggcgtcgccggagtcgtttaacccgcagatcgccagctctggaccttcgtttgtcgccagctcgcaaacgctgtataaccgtctgattaacttcgacccggtaaaaaacacgccggtgccttccctggccgagtcgtggaccatttcgccagacggcaaaacatacacgtttaccctgcgtaaaggggtaaaattcaacagcaataaatacttcaaacctacccgtgattttaacgctgatgacgttattttctccgttatgcgtcagaaagaccctaagcatccctatcacaatgtttcccagggtaattacgaatactttaatgacgtgggcctcgacaagctcattcaggatgtgaaaaagatcgacgattatcacgtccagttcacgctgagcgaacccaacgcggcgttcctggccgactggggaatggacttcgcctcgatcctctctgccgagtacgcggacgcgatgctgaaaaaggggacacctgaaaatgtggacacctggccaatcggcaccggcccgtatgtgcttcagcagtacaaggtggattcgctgatccgctacgtcgccaatccgaactactgggacggtgaggtgccgaccaaacacctgatcttctccatcacgccaaacgttgagacgcgtctggcgaagctgcaaacgaacgagtgtcagatcattcctgcgccgtcgccggtgcagtttgaagcgatcaagaaaaacaaagacctgaccctgcactcggtggatgcgctgaacgtggggtacctggcgttcaacacggagaaaaaaccgtttgataacgtgctggtgcgccaggctctgaattacgcgacggacaaaaaggccattgtgaacgcggtctttatggggtctggtacggtcgctaaatcgccgatcccgccgaacatgctcggctttaataatgacctgaaggattacggctacgatccggaaaaagcgaaagcgctgctgaagcaggcgggtctggaaaagggcgcggaagtgaccctctggtccatgccggttcagcgtccgtacaacccgaactcgcgacgcattgcggagatgatccaggctgactgggcgaaagtgggtgtgaaggcgaaaatcgtctcttacgagtggggtgagtacctctccggcatgcgtaaaggcgagcatgattccgcgctgttcggctggatgtctgataacggcgatccggacaacttcgccgatgtgctgctgggttgtaacagcatcaaaaccggatctaacgccgcgcgctggtgtgataaggggtatgatgagctggtgcaaaaggccaaactgaccagcaacccggacgaacgtgcgaagctgtatggccaggcacaggagattttctatcagcaggcaccgtggattgcgttagctaacggcaaaacgttctacgcgacccgcagcaacgtgaccgggtacagcgtgagtctgatgggcagtgacttctcgaaagcgaagctgaactga

SEQ ID NO: 2862 - DNA, 714 bp, Enterobacter cloacae
acagtcgctgaaaatggcattttgttttggctacgggaattaaacatgcttgatttggaaaacctggaaaaagcacaaagaatcagtctgacgatgcaagttgagaacagtttaaagggagcgttaattacgggctcattaaaacctggggctcgactcatcacgaaagagattgcggataaattaggcaccagcatcacaccagtgcgcgaagccctgctgcgcctggtgtcggcaggcgcattacaggccacgcctgctcaggcgtttttggtgccagaggttacgctggagcgttataacgaaattaacgccatccgaaaacagcttgagccgatggccgttgcggcggcatgtcagaatatgaccgagaccaaactgggtgcattacgcgcgctgtcagataacttcagcaccgccatgcatcagggcgacgtgcagaaggcgatccatgccaaccgcgtgttccggtttacgctctatcagtatgccgaaatgccgaccctgaactcgctgattgagcagctatgggtacggattggtccgtgtatcaactacctgcacgaagagatgaaagatatccctgccacgacttaccattatgccgatctgctttctgcgcttgagcaaagggacgtgacggccagtcgggaagcgatcgaccgagccattgatgaagccaatatcctcctgcaacggcaatactacagttaa

SEQ ID NO: 2863 - DNA, 693 bp, Enterobacter cloacae
ttcatattgtctgtcattgtattcatgacgtcatactatagtgtacggatggtttttcgggggagttttgtgacaaaaaaacagggattttgtcgtagcgatggaatacatgaactgtgtaatattgtgacaaaaccatactactatagtgaacaacacagccagaggttaaccatgattgttcgtcatgcctgcaaagaagattgtgccgctatcggtgaaatttataaccatgcggtgctgcacaccgccgcaatatggaacgatacaactgtcgataccgataaccgtattgcatggtttgaggcgcgcacgctgttgggttatccggtgctggtcagtgaagaagaaggtgtagtgacgggatacgcctcatttggcgactggcgagcattcgacggttttcgccatacggtggagcactcggtttacgttcatcccgatcatcagggcaaaggcattggtcgactgctaatgacggaattaattaaggaagcccgccagataggtaaacatgtgatggttgccggtattgaggcgcagaaccaggcgtcgattcatctgcatgaaaccctgggctttattaccaccggaaatatgcagcaggtaggaaccaaattcggtcgctggctggatttaacctttatgcaactccagctcgatgagcgcagcgatccggatgctctgccatga

SEQ ID NO: 2864 - DNA, 351 bp, Enterobacter cloacae
cagcaggcttttaagggaggaaacatgctacgcattccgcagagttgcattcacacccgttccacgcctttctggaacaaagaaacggcccccgccggcatttttaaacgtcaccttgatacgggcacgcgtccgggcgtttaccctcgcctgtcggtgatgcgtggcgcagtgcgttatctgggctatgctgatgaatttacctctgagcctgacagcgagctcgtcattgaagcgggtcgtttcggcgttttcccgccagagagatggcaccacattgaggtgatgaccgacgacaccctgttcaatattgaattctttgttgaacctgaagtgcttaagtccctttaa

SEQ ID NO: 2865 - DNA, 381 bp, Enterobacter cloacae
gcacccgccaacatgaaggaaactatgatgttacgtattcctgaaaactttgttcatacccgctcgacgccgttctggaataaagagaccgccccaaaagcgctttttacccatcacaacaccaaagccggcgtgtacggtcggttgtccgtcatgcagggtgcggtgcgttactttggctttgccgatggcgacgccaccgagcccgatctggaagtggtcattgaggccggttcttttggcatctccccaccgcaaaaatggcaccgcattgagcttctgaccgacgacacctattttaatatcgactttttcgcggatcctgccgtcacgctcagcggtgcgggcatcggtaaagtggtcaacacgcataaggagtaa

SEQ ID NO: 2866 - DNA, 186 bp, Enterobacter cloacae
ataatgggtaaggctacctatactgtgaccgtcaccaacaacagcaacggcgtgtcagtggattatgaaacagaagcgccaatggagctgttgatcccggacgtcgcggcagatgtcgtgaaggatctggtgaacaccgttcgcgcctacgatacggaaaatgaacacgaggtatgtggctggtaa

SEQ ID NO: 2867 - DNA, 1023 bp, Enterobacter cloacae
ggagtaaccgtaatgggtatcgatctttccattatctggttcgtgattatcgttttcgccacgttgatgtatatcgtgatggacggttttgatctggggataggcatcctgtttccggcaacgccgaatgcggacgaccgcgacgtgatggtcaacagcgtggctcccgtctgggatggcaacgaaacctggctggtgcttggcggtgcggccctgtttggcgcctttcctctcgcctatgcggttatcatcgacgcgctaaccattccactgacaataatgctgatcgggcttatatttcgtggggtcgccttcgaatttcgcttcaaggccactccggcgcaccgcccgttctgggataaggcctttattggcgggtcaattgtggcgaccttcagccagggcatcaccgtcggtgcggtcatccaggggttcagcgtcaccggtcgagcttacagcggtggtccgtttgactggtttaccgcgttcaattttttctgcggagcgggtcttgtggtggcttacgcgctgttaggatcaacgtggctggtaatgaaaagcgaaaatgccctgcaaaagcggatgcgtcagctatcgaaagtgcttctgcccctgcttctggtattcattgcgataatcagtatctggacccctctcgcccaaccagccattgctgcgcgctggtttactctgccgaatctgttttatctgctgcctgttcctgcgctggttgcgatcctgagtctgtgccagtggcgctgcctgcacgatcctgcgagccataccctgccgtttatcatgacgttagggctggtttttcttggctttagcgggcttgggatcagcatctggccgcatatcatcccgccggacattaccctctggcaggccgctgcgccggcccaaagccagggctttatgttagtgggtgcactgttgatcattcccgtgattctggtctacaccttctggagttattacgtttttcgcggaaaagtacagcatggggagggttatcactga

SEQ ID NO: 2868 - DNA, 243 bp, Enterobacter cloacae
gctgtaagtgtagacaacccttcagtcttaaccaaacttctcctgtggggctcatttgtaaatcgtgctggcattcggcgctgcaatccgtaccatacacgacacactttcgcatgctggtttttaccggtagccgcaaacccgtcttttatcgctaaccagatggggcacgtaaatgcgcagatggtgtatgaaatctatgctacatggatagaagagatgaacacgaagctgacgctttga

SEQ ID NO: 2869 - DNA, 387 bp, Enterobacter cloacae
tgcgggaccttgccgcccctgtggatgaagacagattgtggcggcaaccgaatgccggggattgcccgtaatatggggtatgcgtcgtttggctgggagcctgaggaaggctggtacgcgggggcagatgcccgctacatgagcgacgtgatggcaaacgacaccaataccgccaaagcgccctcttataccgtggtcggtctgaataccgggtataaactcaattacggcaaatggggaatggacatctttggtcgcgtcgataacctgttcgataaagagtacgtcggttcagagattgtaaacgccggctacaatcgctattacgaacccgcccctggccgtaactatggcgtgggcctgtcggtctcttatcgctttgagtaa

SEQ ID NO: 2870 - DNA, 1452 bp, Enterobacter cloacae
tatctcattccccccctctttatcataacagtacaccgtttaacattgaggcaatgcatgtttggtccagatgcgtttcatcttgcgcgaatacagttcgcctttaccgtatcctttcatattatttttccggcgataaccattggcctggcgagctatctcgccgtgctggaagggctgtggctgagaacaaaaaatcccgtctggcgatcgctgtaccatttctggtcaaagatcttcgccgtcaactttgggatgggcgtggtctccggcctggtgatggcttatcagtttggcaccaactggagcgggttttcgcagttcgcgggcagtattaccggccccctgctgacctatgaagtgcttaccgcgttcttccttgaggcggggttcctcggggtgatgttgtttggctggaataaggtcgggccggggctgcacttcttttcgacctgcatggtcgccctggggaccctcatgtctacgttctggatcctctcgtcaaacagctggatgcagacaccgcaagggtatgaaatcatcaacggtcaggtcgttccggtggactggtttgccgtggtgtttaacccctccttcccttaccgcctgctgcacatgtcgatagcggcatttctcagcagcgcactgtttgttggtgcctccgcggcctggcatttgctgcgcggaaacaatacccccgctattcgcactatgttctccatggcgttgtggatgacgttaatcgtggccccagtccaggcgctggtgggggatatgcacgggcttaataccttaaaacaccagccagcgaaaatagccgccatcgaaggtcactgggagaatccgccgggtgagcctactccactgctgctgtttggctggccggatatggagcaggaacggacccgttttggcctggaaattcccgctctcggcagcctgatcctgacccacagtctcgataaacaggttccggcattgaaggagttcccaaaagaagatcgcccgaacgccaccattgtcttctggtctttccgcatcatggccggcctggggatgttgatgctgctcctgggcgtgacggcaatctggctgcgttacaaacagcgcctttatacatcacgttccttcctgtggtttgccctgctgatgggaccgtccgggctgatcgcgatcctcgccggatgggtaacaacggaggtcggccgccagccgtgggtcgtctatggactacagcgtacgaaggatgcggtttccgcgcatggcgatctgcacatgagcatcagtttgctggccttcttcgtggtttataccgcggtattcggcgtgggttacagctatatggtgcgtctgattaaaaaagggccgcagccccatgaatccttcgcgactgaatccgatggccgccctgctcgtccgctttctgccgtcaccactgaatttaaggagtaa

SEQ ID NO: 2871 - DNA, 441 bp, Enterobacter cloacae
aaaatgaaaaagctcgcggcagtaagtttaatcagccttgtactggctggatgcgttaatcctggtaaagcctccgttcagaccgatcagttagagaatcaccgtttcgttcttgaaaatgtggatggcaaagcagtcaaaggcgggaaaacgcagcctgaaattcgcttcagtgcgcaacccaatatcagcctgatcaacaacattgtcgtctccggcacaatgtgcaacggcttcaacggccagggtaaactgtccgaaggagagttgacggtcaaaacgctggcaatgacgcggaaactctgcaccgagccgcagctaaatgaactggatcagaccatcgccgatatgctacgcacaggcgcacaggtagacctgaccgaagaccagttaacgctggcgacagccaataagacattgatgtttaagcgagttgaataa

SEQ ID NO: 2872 - DNA, 474 bp, Enterobacter cloacae
gcgcagcgatccggatgctctgccatgaatcaatcgttgacgttagcatttctggtggccgccgggattgggctggtggtacaaaacacccttatggtgcgcattacgcaatcctcttccaccattcttatcgccatgctgctgaactcgctggtggggattgtgttgtttgtcagcatgttgctggtgaaaaatggcatggcggggtttaacgaactggcgtcaacggtgcgctggtggacactgatccccggcctgctggggtcattttttgtctttgccagtattagcggatatcagaatgtgggcgcggcaacaaccattgccgtactggtggcaagccagctgattggcggtctggtgatggacatcctcaagagcaacggcgttcccctgcgcgcgctggttggcccggtctgcggcgcagtgatgctggtggctggcgcctggctggtggcacggcgccagttttaa

SEQ ID NO: 2873 - DNA, 3537 bp, Enterobacter cloacae
gggtgttgtcctatgcaaactattgacggcaatggtgcagtcgcgtctgttgcgtttcgtaccagcgaagtgatcgccatctaccccatcactcccagctccacgatggctgaacaggctgacgcctgggctggtaatgggataaaaaacgtctggggcgatgtcccgcgggttgttgagatgcagtccgaagccggggccattgccaccgtacatggtgcgttgcagaccggtgccctgtcgacctcgtttacgtcgtctcaggggctgctgttgatgatccccacgctttacaagctggcagggcaattaacgccgtttgtgttgcacgttgccgcacgcaccgtagccactcacgctctctctatttttggcgaccactcagacgtgatggccgtgcgtcagaccggctgcgctatgctctgcgccagcagcgtacaggaagcacaggacttcgcgctgatatcgcatatcgctacgctgaaaagccgagtgccatttattcatttcttcgatggttttcgcacgtcccacgagatcaataaaatcgttccactgccggacgacaccattctgaatctgctgccgcaggctgacatcgatgcgcatcgcgctcgcgccctcaatccggaacatccggtgatccggggtacctctgcgaacccggatacctatttccagtcccgcgaggcgacaaacccatggtacaacgcggtgtatgagcacgttgaacaggcgatggacgattttgccgctgcgacgggccgcgaatataagccgtttgaatattatggtcatccgcaggccgagcgcgtgatcgtcctgatgggctctgccatcggcacctgcgaagaggtggtcgatgagctgctgacgcgtggtgaaaaagttggcgtgctcaaagttcgcctctaccgtcccttctcagcgaaacacctgctcgcagccctgccggacagcgcgcatgccgtggcagtactggaccgcaccaaagaacctggcgcacaggctgagccactttatctggatgtgatgaccgctctggctgagacgtttaaccgcggtgagcgcgaaacgctgccgcgcgtcattggcgggcgttatggattgtcttcaaaagagttcgggccggagtgcgtccttgcggtatttgctgaactgcgcgaggcaaaaccgaagccgcgctttacggtcggcatttatgatgacgtgactaacctttctctccctttgccggaaaacaccctgccctcgaatgcgaaactggaagcgcttttctacggtctgggcagcgacggcagcgtctcggcgaccaagaacaacatcaaaattatcggcaactctacgccgtggtatgcgcaaggatatttcgtctacgactccaaaaaagcgggcggactgaccgtctcccacctgcgcgtcagcgaacacccgatccgctcggcatacctgatttctcaggcggattttgttggctgtcaccagctccagttcattgataaatatcagatggccgagcgcctgaagcctggcggtattttcctgatcaacaccccttacagcgccgacgaggtctgggcacgcctgccccaggaagtgcaggcagtgcttaaccagaaacaggcgcgcctgtatgtcattaacgccgcgaagatcgcccgcgaatgcggcctggcggcgcgcatcaatacggttatgcagatggcgttcttccacctgaccaatattctgccgggcgacagcgcgctgatggaactccagggggcgatcgccaaaagctacagcagcaaaggtcaggaactggttgagcgcaactggcaggcgctggcgctggcccgcgaatcgctgttcgcggtgccgttgcagccggtcaatgccagcagtccgaaccggccgccagtggtgtctgacgccgccccggatttcgtcaaaaccgtcacggcggcgatgcttgccggactgggagacacccttcccgtctctgcgcttccgcctgacggcacctggccgatgggcacgacccgctgggaaaaacgcaacattgccgaagcgatccctatctggaaagaagagctgtgcacccagtgcaaccactgcgtggcggcctgcccgcactcggctattcgcgccaaagtggtgtcaccagaagcgttagatggcgcaccggaaagtttgcactcgctggatgtaaaatcccgcgatatgcgtggtcagaaatatgttcttcaggtggcgccggaagactgtaccggctgtaacctgtgcgtcgaggtgtgcccggcgaaagatcgtcaggacccgtcaatcaaagccatcaatatgatgtcgcgtcttgaacatgttgaagaagagaaagtgaattatgatttcttcctcgacctgcccgaaatcgatcgcaacaagctggaacgcattgacattcgtacctcgcagctcatcaccccgctcttcgagtactccggggcgtgctccggctgcggcgaaacaccgtatatcaaactgcttacccagctttacggcgaccggatgctgattgccaacgcgacgggctgctcgtcgatctacggaggtaacctgccgtccacgccgtacactaccgacgcaaacggtcgcggcccggcgtgggcaaactcgcttttcgaggacaacgcagaatttggtctgggattccgtctgacggtcgatcagcaccgcgcccgcataatgcgtctgctggcacagtttgccgataagatcccggcagaactgaatgatgccctgcatgcggaggccacacctgacgttcgtcgcgcgcaggttgctgaactgcgccacgcgcttcagggtgttgaaggggctgaacaactcctgactgatgctgacgcgttggttgaaaaatctatctggctgatcggcggcgacgggtgggcctacgatattggtttcggtggtcttgatcatgtcctgagcctgaccgaaaacgtcaatattctggtgctcgatactcagtgttattccaacactggcggacaggcctcgaaagcaacgccattgggggcggtcacgaaatttggtgagcacggcaagcgcaaggcgcgtaaagatttgggcgtcagcatgatgatgtatgggcacgtctacgtcgcgcaaatttcgcttggggcgcagctcaaccagacggtgaaagccattcaggaagcggaagcgtatccaggcccgtcgctgatcatcgcctacagtccgtgtgaggagcatggctacgatctggcactcagccacgaccagatgcgtcagctcaccgcaaccggcttctggccactgtaccgctttgacccgcgccgtgccgatgaagggaaattgccgctggcgctggattcgcgtccgccgtcagacgcccttgccgaaaccttacttcaggagcagcgtttccgcaggctgaacgcccagcagcctgaagtagcagagcagctatggaaggatgcggcagcggatcttcagaagcgttatgactttctggcgcaactggcaggaaaagccgaaaaatcgaccagtgaataa

SEQ ID NO: 2874 - DNA, 1155 bp, Enterobacter cloacae
aaaaataactgcaaaggaataatcaaaatgcaaagaaaagtactggcactgatgatccccgctttgttaatggctggagccgctcacgcagctgaaatttataataaagacggcaataaactggatctgtatggcaaagtagatggtctgcattatttctctgacgacgcgtctaaagacggcgatcaaacctatatgcgtctgggttttaaaggtgaaacccaaatcaacgacatgatgaccggcttcgcccaatgggaatacaacattcaggcaaacaacaccgaaggttctgacaatcagtcctggacgcgtctggccttcgcgggcgtgaaggttggcgattacggctccttcgattacggccgcaactatggcgtcctgtacgacgttgaaggctggaccgatatgctgccagaatttggtggcgactcttatacttatgccgataactttatgaccggtcgtgcaaacggcgtggcgacctaccgtaacaccgacttctttggtctggtgcagggtctgaacttcgcggtgcagtatcagggtaataatgaaggtaataactgcgacgagaatttctgctctaccaatgaagggaccaacaacggtcgtgatacacgtcatgaaaatggtgacggttacggtatatccgcaacctacgatttcggcatgggcttcagcgcaggtgcagcatatacttcatctgaccgtaccaacgatcaggtaaattacactactgcgggcggcgatactgcggatgcatggaccgcaggtctgaaatacgatgccaacaacatttatctggcggcaatgtattccgaaacccgcaatatgacgccgtacggcgacaatgcagatgcggtggcaaacaaaacccagaacttcgaagtcaccgcacaatatcagttcgatttcggtctgcgtccggccatttcctatttacagtctaaaggtaaagacctgggcaatggccaggacgataaagacctggtgaaatatgctgacgtcggtgctacctattatttcaacaaaaatatgtccacctatgttgattataaaatcaacctgctggatgaagatgattcattctacaaaaacaatggcatcggtacggatgacattgtagcgttaggtctggtttaccagttctaa

SEQ ID NO: 2875 - DNA, 567 bp, Enterobacter cloacae
aaacgaagatattcgggttcatgtggtgagtcgggagctggcttaccagtgggtagaagaggggaaaatcgacaacgcagcgtctgtcatcgctctgcaatggctacagctgcattatcagacattacgacacgagtggaaaaaatgaagcgttatacacctgacttcccagaaatgatgcgcctgtgcgaaacaaatttcgcccagctgcgccgcctgctgccgcgaaacgacgcgcccggcgaaacggtgagctatcaggtgagcaacgcgcagtatcggttaacgataacagaatcaacgcgctacactacgctggtggagattgagcaaacggcgccgagcatcagctactggagcctgccgtcgatgacggtacgtctttatcatgacgcgatggtcgctgaagtgtgttcaagccagcagatctttcgctttaaagcgcggtatgattatccgaataaaaagttgcatcaacgcgacgaaaagcatcaaattaaccagtttttagccgactggctaagatattgtttagcacatggagcaatggcgattccggtttgttag

SEQ ID NO: 2876 - DNA, 837 bp, Enterobacter cloacae
ggacaccatttggaaagcctgttgaacctgactgttgctggtggggcgccagtcaggatattacaaatcaccgacacccacctttttgccgaaaagcatgagacgcttctgggcgtgaacacctgggagagttatcaggcggttcttgacgcgatccatgctgaaaagcggccatgcgatctgatcgtcgcgacgggcgatctggcgcaggatcaatcctccgcagcctatcagcattttgctgaagggattgcgagctttagcgtgccttgcgtctggctgccgggcaatcacgattttcagcccgcgatgtacagttcgcttcaggatgcggggatttcaccggcaaaatgtgtctttgcgggggaccagtggcaaattctgctcctcgacagtcaggtgtttggcgttccgcacggtgagttgagcgactatcagcttgactggctggagacaaaactggccgccgaaccgaatcgcaatacgttgctgttactgcatcatcacccgctgccggcgggctgtagctggctcgatcagcacagcttacgcaactctgcggcgctggacggcgtgctggcgaaattcccgcgcgtaaaaaatttgctgtgcggtcatattcaccaggaacaggatctcgactggaacggtcgacgtctgctcgcgacgccctctacctgcgtgcagtttaagccgcactgcgccaactttacgctggataccatcgcaccgggctggcgctggctggagctgcatgccgatggctcgctgaccaccgaagtttgccgtctggccggggcacaattccgcccggataccgcttcggaaggctattga

SEQ ID NO: 2877 - DNA, 1896 bp, Enterobacter cloacae
atcatgacgcaaacctataacgctgatgccattgaggtactcaccgggcttgagccggttcgccgccgcccggggatgtacaccgatacgacgcgcccaaaccacctgggccaggaagtaattgataacagtgtggacgaagcgctggcaggccatgccaaacgcgtggacgttatcctgcacgccgatcagtcgctggaagtcatcgacgacggccgcggcatgccggtagatatccacccggaagagggtgttcccgccgttgagctgatcctctgtcgtctgcacgcgggcggtaagttctccaacaaaaactaccagttctccggcggcttgcacggcgtggggatctccgtggttaacgccctgtcaaagcgcgtggaagtgaacgtccgtcgcgacggccaggtgtataacatcgcgtttgaaaacggcgaaaaagtgcaggatttgcaggtcgtcgggacgtgcggtaaacgcaacaccggcaccagcgtccacttctggcctgacgaaagcttcttcgacagcccacgcttttctgtttcccgcctgacgcacctgctgaaagccaaagcggtgctgtgcccgggcgtggaaatcacctttaaagaccacgttaataataccgaacaaacctggtgctacgccgatggtctgaacgactacctgtgcgaagcggttaacggcctgccaaccctgccggaaaaaccgttcgtcgggaatttcgaaggcgatactgaagcggtggactgggcgctgctatggctgccggaaggcggcgagctgctgaccgaaagctacgttaacctgatccccactatgctcggcgggacccacgtcaacggcctgcgtcaggggctgctggatgcgatgcgcgagttctgcgaataccgcaacattctgccgcgcggcgtgaagctgtcggcggaagatatctgggatcgctgcgcctacgtgctttccgtgaaaatgcaggatccgcagtttgccggtcagactaaagagcgcctgtcgtcacgccagtgtgcggcgttcgtctccggcgtggtgaaagatgcctttaccctgtggctgaaccagaacgttcaggccgcggaaatgctggctgaaatggcgatctccagtgcccagcgtcgtctgcgcgcggcgaagaaagtggtgcgtaaaaagctgaccagcggccccgcgctgccgggcaagctggcggactgtaccgcgcaggatctcaaccgcaccgagctgttcctggtggaaggagactcggcaggcggatcggccaagcaggcgcgggatcgtgaatatcaggcgatcatgccgctcaagggtaagatcctcaacacctgggaggtctcgtctgatgaagtgctggcctcgcaggaagtacacgacatctcggttgcgatcggtatcgatccggacagcgacgatctgagccagttgcgctacggcaagatctgcattctcgcggatgcggactccgatggcctgcacatcgccacgctgctctgtgcgctgtttgtgaagcatttccgcgcgctggtgaaaaacggtcacgtccacgtggcgctgccgccgctgtaccgaatcgacctcggcaaagaagtttactatgcactgacggaagaagagaaagcgggcgtgctggaacagcttaagcgcaagaagggcaaaccgaacgttcagcgctttaaggggctgggtgagatgaacccgatgcagctgcgtgaaaccacgctggatccgaatacccgccgtctggtgcagctgaccatcagcgatgaagatgaacagcaaactaacgccgtgatggacatgctgctggccaagaaacgttctgaagatcgacgtaactggctacaggagaaaggcgacatggcggatatagaggcctga

SEQ ID NO: 2878 - DNA, 2277 bp, Enterobacter cloacae
gttgaggaatcacacgtaatgagcgatatggcagagcgcctcgcgctacatgaattcacggaaaatgcctacctgaactactccatgtacgtcatcatggacagggcgttgccgtttatcggggatggcctgaagcccgttcagcgccgcatcgtctatgcgatgtccgaactggggctgaatgctaccgccaagtttaagaaatccgcccgtaccgtcggcgacgtgctgggtaaataccatccgcacggcgacatcgcctgctatgaagcgatggtgctgatggcccagccgttttcttatcgctatccgctggtggatggccaggggaactggggggcgccggacgatccgaaatccttcgcggcaatgcgttataccgaatctcgcctgtctaaatatgccgaagtgctgttgggcgagctggggcagggcacggttgactgggtgccaaacttcgacggtacgatgcaggagccgaaaatgctgcctgcgcgtctgccgaacatcctgctgaacggcacgaccggtatcgccgtgggcatggcgacggacattccgccgcacaacctgcgtgaagtggcaaaagcggccatcaccctgattgagcagccaaaaacctcgctggacgatttgctggatatcgtgcaggggccggactatccgaccgaagccgagatcatcacctcgcgtgcggaaatccgcaaaatctaccagaacggtcgcggctccgtgcgcatgcgcgcggtgtggaataaagaggatggtgccgtggtgatcaccgcgctgccgcaccaggtgtccggtgcgaaggtgctggagcagatcgcctcccagatgcgcaataaaaagctgccgatggtggacgacctgcgtgatgaatcggaccacgaaaacccgacccgtctggtgattgtgccgcgttctaaccgcgtggacatggagcaggtgatgaaccacctgttcgccactaccgatctggaaaaaagctaccgcatcaacctgaacatgattggtctggacggtcgtccggcggtgaaaaacctgctggagatccttaccgaatggctggccttccgccgcgatacggtgcgccgtcgtctgaaccatcgcctggaaaaagtgcttaagcgcctgcatatcctcgaaggtttgctggtggcgttcctcaacattgacgaagtgatcgagatcattcgtaccgaggacgaacctaagcctgccctgatgtcgcgctttggcatcagcgaaacccaggccgaagcgatcctcgaactgaaattgcgccatctcgccagactggaagagatgaagatccgaggcgagcagaacgagctggaaaaagagcgcgatcagcttcaggcgattctggcgtccgagcgcaagatgaacaccctgctgaagaaagagttgcaggccgatgccgacgcctttggcgacgaccgacgttctccgctgcacgagcgcgaagaggcgaaggcgatgaacgagcacgacatgctgccgtccgagccggtgaccattgtgctttcccagagcggctgggtgcgtagcgccaaaggccacgatatcgacgcgccgggtctgagctacaaatccggtgacagcttcaaggcggcggtgaagggcaagagtaaccagccggtggcgttcatcgactccacgggccgcagctacgccatcgacccgatcacgctgccgtctgcgcgcggccagggcgaaccgctcaccggtaagctgacgctgccgccgggtgccacggttgagcatatgctgatggaagccgacgatcaaaaactgctgatggcgtctgatgcgggctacggctttatctgtaccttcaacgatctggtgtcgcgtaaccgtgccggtaaagcgctgattagcctgccggataacgcacacgtcatgccgccgctgatcatcgagaacgaaagcgacatgctgctggcgatcaccgctgccggacgtatgctgatgttcccggtcagcgatttgccggagctgtcgaaaggcaagggcaacaagatcatcagtatcccgtcagcggaagcggcaaaaggcgaagatagcctcgcgcatctcttcctgctgccaccgcagagcacgctgaccattcatgtcggcaagcgtaaaatcaaactgcgtccggaagagttgcagaaggtggtgggtgagcgcggacgtcgcggctcactgatgcgcggcctccagcgaatcgaccgcgtggagattgactcgccggcgcgcagcaaagcggacgacagcgaagagtaa

SEQ ID NO: 2879 - DNA, 768 bp, Enterobacter cloacae
ttgtcagctgtcagggcttcagaggtcgctatgctatacattgttcgtctcattcttaccgttatttattgcattctggtctgtattttcggatcgatttattgcctgttcagcccgcgtaacccaaagcatgtcgcgacgtttggccacatgtttggtcgtcttgcgccgctgtttggcctgaaggttgaaaagcgtctgcctgaaggggcggagaatttcggtaacgccatctatatcgctaaccatcagaacaactacgatatggtgacggcctcaaatattgttcttccgccgaccgtaaccgtgggcaaaaaaagcctgctgtggatcccctttttcggccagctgtactggctcaccggtaacttgctgattgaccgcaacaaccgcgccaaagcgcatggcaccattgcggaagtggtggatcagtttaaaaagcgccggatttccatctggatgttcccggaagggacgcgcagccgtggtcgcggcctgctgccgttcaagaccggcgcgtttcatgctgcaattgcggctggcgttccaattattcccgtgtgtgtttccaatacatcgaataagattaatcttaaccgtctgaataacggactggtcattgtcgaaatgctgccgccggtagatacctctaaatacggtaaagaccaggtgcgcgagctggccacgcactgccgcgagctgatggctcagcatattgcgcagctcgataaagaagttgcagagcgagaagccgccggtaagatttaa

SEQ ID NO: 2880 - DNA, 235 bp, Enterobacter cloacae
gttgattgtatggcaatgcgtcttaatgaaaatctggacgataacggtgaaatgcatgagatcaacgtgacgccgtttatcgacgtcatgctggttctgctgattatctttatggttgccgcaccgctggcgacggtggacgtgaaggtgaatctgcctgcgtcctccagccagccgcagccgcgtccggaaaagcctatctacctgtccgtgaaggccgataagtccatgttcc

SEQ ID NO: 2881 - DNA, 702 bp, Enterobacter cloacae
ccatacaaacggcagccaaacagccttgaaattcacaatttcatcaccattgctaccaggactcgaccgatgcaaaaaccagaaaacgtgcctgtcaccttcgccaaaaacgatgtagaaattattgcacgagaaacgctttatagcggttttttttcaatggaactttaccgtttcaggcatcgtctgtttaacggtgagatgagcggtgaaatcaaacgcgaaatttttgagcgcgggcatgcggctgtgttgctaccctatgacccagtgcgtgacgaagttgtgctggtcgagcaggtgcgtattgcggcttatgataccagcgaaacgccgtggttgctggagatggtggccgggatgatcgaagaaggtgagtcggtcgaagacgtcgctcgccgcgaggcgctggaagaggcgggcctggtggttggccggacgaagccggtgttgagctacctggcaagcccgggtgggacaacggaacgttcatctattatggtgggcgaagtggacgccacgacagcggaagggatccatggtctggcagatgaaaacgaagatattcgggttcatgtggtgagtcgggagctggcttaccagtgggtagaagaggggaaaatcgacaacgcagcgtctgtcatcgctctgcaatggctacagctgcattatcagacattacgacacgagtggaaaaaatga

SEQ ID NO: 2882 - DNA, 1359 bp, Enterobacter cloacae
cccatagccgggtcgtcattagcgaacccggaagcgaacgtaagctgtcgttcacattataaaaatctggccctacacgtcggcgaggatgatatgaaaagcacatcgacaaccaacagaactgaatattacaaaatcagtagctttatctttctctatttctttacctggtctgccagtattggactgctggcgatctggcttggccagaaagccaacctgagcggatcggtgattggaaccgtttttgcggtgaacgggatattctccgtaattcttaaaccgatctacggctatattctcgataagatcggcatgagcaaatacctgctctattttgtggtgatcatgtcggccctgatggcgccattctttatttatgtttaccagccgctgttaatgtctaataccctgctcgggattattatcggcgcgctctatttaagctttgcctggtacgcgggcgtggcggcgtgtgaatcctattccgaccgctttagccgcttaaacggcatggagttcgggcaaattcgcatgtggggttcgctcggctgggcggtggcatcgtctttctccggcctgctgtttaacctctcaccggcgtataactttattctcggcagcgtggcgtcagtggtgatgctgattgtcctgctgagcctgaaagtgaacactaactccgctcacgcaggcgaggtgctgacgaaagagaaaatcgccccgtcagacgtttacgccctgctgcgaaaccgcaaattctgggccttctgcctgtacgtggcgggcgtggcgtggatgatgtttatcgccgagcagcagttctcgcgctatttcgtcaccttcttcgacgatattcaccagggcaacgcggtattcggttatctcgggaccgtgcagtcgggcatggagttcgtcatgtatatggtgatcccgctgtttgtgaactttattggcgccaaacgcgggctattaattgtcgggctggtggttggggcgcgtctgattatttccggcatgtgtgattcacacctgttaatttcagtgcttaagccgctgtacggtctggaaatttgtctcctgctggtgtcggtatttaaatatatcgccgagcatttcgacaagcgcgtcaatgccaccatgtatttactcggctatcaggcgatgctctacgttggcaacgtggtggtctcttcccctgccggctatatgtatgaccgtattggctttgagcacacctatatcatcatgggcgcaacggcgctgacctttacccttatttctgcttttacgttatccgcctgtcagagcaaatggcgcggggctcgtgcgctgaacgtagcagaaacgtcaacacgataa

SEQ ID NO: 2883 - DNA, 303 bp, Enterobacter cloacae
ctccttctaattccaggctaccagttaagcaaaaatttccgcgagatgcttgcgatattctgcgatatagcgcgggacgtccggcattttaattacgtcgttgacgataaaggtcggcagcggctccattcccaggaactgattcgccttgtggaacggcagatacgcgccgtctacgcccacgccttcgaagaactgatctttctcggtgaaggcttccagcggcgcgttccaggtcagggagagcatatattttttgccctgaatcagaccgccagaaccgtattttttagacgcatctga

SEQ ID NO: 2884 - DNA, 417 bp, Enterobacter cloacae
acgggtgcggccgtcgctggcatacagcgaaccgtgaccttcggtaaacacatcgtccatgtattttttcacggtccacggtgcgcccatccaccagcccggcatctgccagatcaccacgtcggcccacaggaagttctgcacttcggccttcacgtcgtaatcgctgtccgcgcgcacgaccttaacatcatgtccggcgtcgcgcaggaaaccatccgcgacctcggtcagggtgtcattgagctggcctttagagtgcgcaaattctttcgcgccgttgataatcagaatgttgctcattatttgtcctcgatgatgagagtatgccgggtattctacgcgcgaggacggagcggaaaaataagcaaaatgtgcaaagtcttttgcgctcagcgcaataatcttaccagctga

SEQ ID NO: 2885 - DNA, 1539 bp, Enterobacter cloacae
tggctcagcatattgcgcagctcgataaagaagttgcagagcgagaagccgccggtaagatttaacccggtgtcgtgtaagggaaaacgaattcccgcgttgttagtcgtttcagatggagcttatatgtcactcagtcggcgtcagtttattcaggcttcgggtatcgccctttgtgcgggtgcgataccgcggacagccagcgccgccgggcagcaacagccgctgcctattccgccgttgattgaatcccgtcgcgggcagccgctattcctcacgcttcagcgtagccactggtcctttacccagggaacgcgcgcgcaggtatggggcattaacggacgctacctcgggccgaccattcgcgtgtggaatggcgatgacgttaagctcatctacagtaaccgtacgacggaaaatgtcgcgatgaccgtcagtggtttgcaggtgccggggccgctgattggcggcgcggcacgcatgatgtcgccgaatgccgactgggcgcccgtcctcccgattcgtcagagcgcggcgacattgtggtatcacgccaacaccccgaaccgcaccgcccagcaggtctacaacggcctggccggaatgtggctgattgaagatgaggtcagtaaaacgctgccgatcccgaatcactacggcgtcgatgatttcccgatcattattcaggacaagcggctggataacttcggcacgccggagtacagcgagccgggcagcggtggttttgtcggcgatacgctgctggttaacggcgcgcaaagcccgtatgttgaagtgtctcgtggctgggtgcgcctgcgtctgctgaatgcttctaactcgcgtcgctatcagttgcagatgagcgacggccgcgcgctgcacgtgatttcaggcgatcaggggttattacctgcgccggtgtcggtaaaacagctggcgctggcaccgggcgaacgtcgtgagatcctcgtggatatgaccaacggggatgaagtgtccgtgacctgcggcgaagcggcaagcattgttgaccgtattcgtggcttctttgaaccgtcgagcgttctggtctccacgctggtgctgacgctgcgcccgaccggcctgttgccgctggtgaccgacagcctgccgatgcgcctgctgccgcaggagattgtgaccggcccggcagtacgcagtcgcgatatcagccttggcgacgatccgggcatcaacggtgcgctgtgggacgtaaaccgcattgatatcaccgcccaacagggaacatgggagcgctggaccgtccgctcggagatgccgcagtcgttccatattgaaggggtgtcattcctgatccgcaacgtcaacggggcgatgccgttcccggaagacaggggctggaaagataccgtctgggtggatggccaggtcgaactgctcgtctactacggccagccttcctggccgcacttcccgttcctgttccacagccagacgctggagatgatggacaggggatcggtagggcagatgctggtgaatccggcaccgtaa

SEQ ID NO: 2886 - DNA, 618 bp, Enterobacter cloacae
tccggtggccggcagcgtcagcacggagcccatcgggatcgcactgctgatgtcgctgccgcccgtttccagaatatgccacgggtcgatgccgtcagcgtaatgggccgccgccgcgatgaatttggtgccgtccagcacggaaccgccgcccaccgccagcaggaaggtgatctgctcctcgcgggcgatttttaccgcgttcatcagcgtttcataagacgggttaggctcgataccgccgaactcgcgcacgtccagaccttccagagcgctgtacacctgatccagtacgccggtttttttcacgctgccgccgccgtaggtaatcaggacgcgggcgtccgtcgggatttgcgcgcgcaggtcagcgatagcgtttttaccaaacagaatgcgggttggggtatgaagattaaagttgttcatggcttgttccctgtagtgggtaaaaaatcgtggtggcgcagaaggcaacctgatgctgctcattgtggcgggcaggcgctatcctctcaatgcacattcctgccgatgtcttgcccatttctacagcgcgctggagaaacggtaagaaaatgcgcacactgtcagcgtcggaaaccgtacccggagtaa

SEQ ID NO: 2887 - DNA, 906 bp, Enterobacter cloacae
ctgaaaatgaaccgtgatgccatctgccgccagctaacgtcgcagattaaaacactgattgataacggaaatgattcggctgagctgttgccggatattcgattgctgtacggtacccagcccggaacgcgcaccccggtgatgtatcagcccggcatcgtgtttctcttttctggccataagattggctatatcaatgagcgcgtgttccgttacgacaccaatgaatatctgcttctgacagtacctttacccttcgaatgtgaaactttcgcgacagaggaggtgccgctggccgggatccgcgtcaacgtcgacatcctccagttgcaggagctgctgatggatattggggaggacgaacttttccggccgtcgatggcggcaagcggtatcaactccgcgaccctatcggaggaaattctctgcgcgattgaacgcctgttagacgtgatggaaaggccgctggatgcgcgtattctcgggaagcagattatccgcgaaattctttaccatgtgctgctcgggccgggcggcggggcgctgctggcgctggtaagccgccagacgcactttagcctgattagccgcgtgctcaagcgcattgagagccagtacacggaaaacctcagcgttgaccagctggcggcggaagccaatatgagcgtctcggcgtttcaccataactttaaatccgtcaccagcacgtcgccgttgcagtacctcaaaacctaccgtctacataaggcgcgcatgctgatgatccacgatggcatgaaggccagcgccgcggcgatgcgggttgggtatgaaagcgcgtcgcagtttagtcgggagtttaagcgctacttcggcgtcacgccgggggaagatgcgtcgcgcatcagaacgatgcagggcgcttag

SEQ ID NO: 2888 - DNA, 726 bp, Enterobacter cloacae
gccgcactgcgccaactttacgctggataccatcgcaccgggctggcgctggctggagctgcatgccgatggctcgctgaccaccgaagtttgccgtctggccggggcacaattccgcccggataccgcttcggaaggctattgatgtcgacgcttctctatctgcatgggtttaacagctcaccgcgttcggcgaaagcgacgcagcttcgccagtggctgagcgcgcatcatccccacgtggagatgattattccgcagttgcccccttatccggcggatgcggcagagatgctggaatcgctagtgctggaacacggcggcgaatcgtttggcgttgtcgggtcgtcgctcggcggctactacgccacctggctgtcgcagtgctttatgttgcccgctgtcgtcgtcaacccggcggtccggccatttgagctgttaagggactttcttggcgaaaacgagaacccctacaccggccaacaatatgtgctagagtcacgccatatttacgatctcaaagttatgcaggtcgacccgcttgaagcgcccgatcttatctggctgctgcaacagacgggagatgaagtgctggattaccgccaggcagtggcgtattacgcatcctgccgccagactgtagaagagggcggtaaccatgctttcacgggctttgaagatcatttcacccagattgtcgattttcttggactgcacagccactga

SEQ ID NO: 2889 - DNA, 453 bp, Enterobacter cloacae
ggtttaccctgtttaatggattgtgaaacgacattaaagggagagataaagatgaaaaaattcgctgcaattgctgccatcatgatgatgaccacggcccctgtctttgctgcacagggtggcttctctggcccatctgcgacacagaatcagacgcaaacccagcagggtggctttgtcgataacaacgccaacctcaccaccgcggctaaagtgaaagacctgaaggacgatgcctgggtgaagctgcgcgggaacattaccgagcgcctgtccgatgaccgttacaccttccgcgatgaaagcggcacggtggtggtggagatcgaccacaagcgctggaacggcgtgacggtgacgccgcaggataaagtcgaactccagggtaaaatcgataaagactggaacgagtttgaaatcgacgtgaagcaggttatcaagctgaacaaataa

SEQ ID NO: 2890 - DNA, 2265 bp, Enterobacter cloacae
gggcaacagcccgcacaataccccttcatttcccccggtaaaccagcgtataatcccgctccttttgtctattttttcttcggaagcattatgagcgctatttccctgatccagccggatcgcgacctcttctcctggccccagtactgggcagcctgctttggaccggcgccgttcctgccgatgtcccgggaagagatggatcaactgggctgggacagctgcgatatcattctggtgacgggcgatgcgtatgtcgatcacccgagctttggcatggcgatctgcggccgtatgcttgaagcccagggcttccgcgtggggatcatctcccagcctgactggaacagcaaagacgactttatgcgtctgggcaagccgaacctgttcttcggcgtgaccgcaggcaacatggactccatgatcaaccgctacaccgccgaccgtaagctgcgccatgacgacgcttatacggctgacaacgtggcgggtaaacgtcccgaccgcgcgaccctcgtctacacccagcgatgcaaagaagcatggaaagacgtgccggtgatcctgggcggcatcgaagcgagcctgcgccgtaccgcacactatgactactggtccgacaccgtgcgccgttcggtgctggtggattcgaaagccgacatgctgatcttcggtaacggtgagcgtccgctggtagaggtggcacaccgtctggcgcagggcgaagcggtcagcgagatccgcgacgtgcgcaacaccgcgatcatggtgaaagaggcgctgccgggctggagcggggtggattcccgcattatcgatatgccgggcaaaatcgatcctatcccgcatccgtacggtgacgatctgccgtgcgcggataacaaaccggttgagccgaagaaagcggaagcaaaagccgtggtggtgcagccgccgcgtccgaagccgtgggaaaaaacctatgtgctgctgccgtcctacgaaaaagtaaaaagcgataaagtactctacgcccacgcgtcgcgcatcttacaccatgaaaccaaccccggctgcgcgcgagcgctgatgcaaaagcacggcgagcgctatatctgggttaacccgccggcgatcccgctctctaccgaagagatggacagcgtgtttgctctgccgtacaagcgtgtaccgcatccgtcatatggcagcagccgcattccggcgtacgagatgattcgtttctcgatcaacatcatgcgcggctgcttcggcgggtgctccttctgttcgatcaccgaacacgaaggccgtattattcagagccgttccgaagagtcgattgttaacgagatcgaagccattcgcgacacggtgccgggctttaccggtgtgatctccgatctgggtggtccaacggccaacatgtacatgctgcgctgtaaatcgccgcgcgccgagcagacctgccgtcgtctctcctgcgtctatccgagcatttgcgagcatatggacaccaaccacgagccgacgatcaacctttaccgtcgcgcccgtgacctgaaaggcatcaagaagatcctgatcgcctccggcgtgcgttacgacattgcggtggaagatccgcgctacatcaaagagctggcgacgcaccacgttggcggttatctgaagatcgccccggagcacaccgaagaaggcccgctatccaaaatgatgaagccgggcatgggcagctatgaccgctttaaacagctgtttgatacctattcaaaacaggcggggaaagagcagtatctgatcccatacttcatctccgcacaccccggcacccgtgatgaagacatggtgaacctggcgctgtggctgaagcagcgtcgattccgtctggatcaggtgcagaacttctacccgtcgccgctcgccaactcgacgaccatgtattacaccggcaaaaacccgctgagtaagattggttataagagcgaagacgtggtggtgccgaaaggggataaacagcgccgtctgcataaagcgctgctgcgctatcacgatccgaaaaactggccgctgatccgtcaggcgctggaagagatggggaaaaagcacctgatcggctcgcgtcgtgattgcctggtgcctgcgccaacgctggaagagatgcgcgaagcgcgccgccagaaccgcaacacgcgcccggcgctgaccaaacataccccgattgcgcatcagcgttcgaatggtgttgcgggaacgaagaagaacgtaaaacgtaagaccggttaa

SEQ ID NO: 2891 - DNA, 753 bp, Enterobacter cloacae
tttgcgtcctggagatacagagtgggtaataatttgatgcagacggatctctccgtttggggcatgtatcaacatgctgacatcgtagttaagattgtgatgatcggcctgattctggcgtccgtgatcacctgggctatcttcttcagcaagagcgccgaacttctttcacaaaaacgccgcctcaagcgtgagcagaagcagctggcggaagcccgttctctggatcaggcttctgatatcacctcatccttccatgcgaaaagcctgactaccctgttagtgaacgaagcgcagaacgagctggaactctccgcaggcagtgaagataacgaaggcattaaagagcgtaccggcttccgtctggagcgtcgcgttgcggccgtgggtcgtcatatgggccgcggtaacggctacctggcgactatcggcgctatctccccgttcgtcggcctgttcggtaccgtctggggcatcatgaacagctttatcggtatcgcccagacgcagaccactaaccttgcggtcgtcgcgccgggtatcgcagaaacgctgctggcaacggctatcggtctggttgccgctatcccggcggttgttatctataacatcttcgcgcgcatgattggcagttacaaagccacactgggtgacgttgccgcgcaggttctgctgctgcaaagccgcgatctggacctgaacgccagcgccgttaaaccggttcatgcggcgtccaaactgcgcgtaggttga

SEQ ID NO: 2892 - DNA, 1347 bp, Enterobacter cloacae
tgccgtaattttcgctcactttccttgcgcttacgcagtaaaaatttcttatgcgaatttttgataatattttctgcttattcgataagcatccggatgcacattctgacaatcgtggtagtctggacgtccagacgtataaaaatagggttagcgaacatgactaaaaagcagcttgagaccacgctggtgcaggcaggacgcagtaagaaatacactcagggctcggtcaacagcgtgatccagcgcgcctcctcgctggtgtttgataccgttgaagataaaaaaatcgctacgcgtaatcgcgcgaagggcgggctgttttacggtcgtcgtggcacgttaacccatttctcgttgcaggaagccatgtgcgaactggagggcggcgcgggctgcgcgctgttcccgtgcggcgcggcggcggtcgccaataccattctggcgtttgtggaacagggtgaccacgtcctgatgaccaataccgcttacgagccaagccaggacttctgcaccaaaatactcagcaagctcggcgtcaccaccagctggttcgatccgctgattggggccggtattgccgggcttattcagcccaacacgcgcgttgtgttcctggaatctcccggttccatcaccatggaagtgcatgacgtcccggccatcgtgaaggcggtgcgcagcatagcgccggaagcgatcatcatgatcgacaacacctgggcggcaggtgtgctgtttaaagccctggaatttgacatcgatatctcgattcaggcggcgaccaaatacctgattggccattccgacggcatgatcggtacggcggtgtctaacgcccgctgctgggatcaattgcgtgaaaacgcctacctgatgggccagatggtggatgccgataccgcctacatgaccagccggggcatccgtacgctcggcgtgcgtcttcgtcagcatcacgaaagcagcctgcaaattgcacagtggctggcgctgcatccgcaggtggagcgcgttaaccatccggcgctgccgggcagcaaaggccatgaatactggcaacgtgactttacgggcagcagcgggttgttctcatttgtacttaaaaagcgcctgaatgacgccgaactggcaagctatctggataactttaccctcttcagcatggcctattcatggggtgggtttgaatcgctgatcctgcccaaccagccggagcagattgcggccctgcgcccgggcggcgaggtggacttcgaagggaccttaatccgcctgcatatcgggctggaaaatgtggacgatttaattgcggatttatcggcaggatttgagcgcatcgtgtaa

SEQ ID NO: 2893 - DNA, 840 bp, Enterobacter cloacae
ccagttacgtcgatcttcagaacgtttcttggccagcagcatgtccatcacggcgttagtttgctgttcatcttcatcgctgatggtcagctgcaccagacggcgggtattcggatccagcgtggtttcacgcagctgcatcgggttcatctcacccagccccttaaagcgctgaacgttcggtttgcccttcttgcgcttaagctgttccagcacgcccgctttctcttcttccgtcagtgcatagtaaacttctttgccgaggtcgattcggtacagcggcggcagcgccacgtggacgtgaccgtttttcaccagcgcgcggaaatgcttcacaaacagcgcacagagcagcgtggcgatgtgcaggccatcggagtccgcatccgcgagaatgcagatcttgccgtagcgcaactggctcagatcgtcgctgtccggatcgataccgatcgcaaccgagatgtcgtgtacttcctgcgaggccagcacttcatcagacgagacctcccaggtgttgaggatcttacccttgagcggcatgatcgcctgatattcacgatcccgcgcctgcttggccgatccgcctgccgagtctccttccaccaggaacagctcggtgcggttgagatcctgcgcggtacagtccgccagcttgcccggcagcgcggggccgctggtcagctttttacgcaccactttcttcgccgcgcgcagacgacgctgggcactggagatcgccatttcagccagcatttccgcggcctgaacgttctggttcagccacagggtaaaggcatctttcaccacgccggagacgaacgccgcacactggcgtga

SEQ ID NO: 2894 - DNA, 378 bp, Enterobacter cloacae
cagggcgttaaccacggagatccccacgccgtgcaagccgccggagaactggtagtttttgttggagaacttaccgcccgcgtgcagacgacagaggatcagctcaacggcgggaacaccctcttccgggtggatatctaccggcatgccgcggccgtcgtcgatgacttccagcgactgatcggcgtgcaggataacgtccacgcgtttggcatggcctgccagcgcttcgtccacactgttatcaattacttcctggcccaggtggtttgggcgcgtcgtatcggtgtacatccccgggcggcggcgaaccggctcaagcccggtgagtacctcaatggcatcagcgttataggtttgcgtcatgatttaagctag

SEQ ID NO: 2895 - DNA, 669 bp, Enterobacter cloacae
ataggcttttccggacgcggctgcggctggctggaggacgcaggcagattcaccttcacgtccaccgtcgccagcggtgcggcaaccataaagataatcagcagaaccagcatgacgtcgataaacggcgtcacgttgatctcatgcatttcaccgttatcgtccagattttcattaagacgcattgccatacaatcaacctacgcgcagtttggacgccgcatgaaccggtttaacggcgctggcgttcaggtccagatcgcggctttgcagcagcagaacctgcgcggcaacgtcacccagtgtggctttgtaactgccaatcatgcgcgcgaagatgttatagataacaaccgccgggatagcggcaaccagaccgatagccgttgccagcagcgtttctgcgatacccggcgcgacgaccgcaaggttagtggtctgcgtctgggcgataccgataaagctgttcatgatgccccagacggtaccgaacaggccgacgaacggggagatagcgccgatagtcgccaggtagccgttaccgcggcccatatgacgacccacggccgcaacgcgacgctccagacggaagccggtacgctctttaatgccttcgttatcttcactgcctgcggagagttccagctcgttctgcgcttcgttcactaa

SEQ ID NO: 2896 - DNA, 690 bp, Enterobacter cloacae
cgttatatctgctgttccacaggaaagtccatggctgttattcaaaatatcatcacggcgctctggcaacacgattttgccgcgctggcggacccgcatgtcgtcgggattgtctatttcgtgatgttcgcgacgctgtttctggaaaatggattactgccagcctcatttttacccggtgacagcctgctcctgctcgcaggggcgttaatcggcaagggcgtgatggacttcgcaccgacaatggtgatcctcacctctgcggccagtctcggctgttggctgagctacctgcaagggcgctggcttggaaacacccgcgtggtgaaaggctggctggcacagctgccgcataaatatcaccagcgcgccacctgcatgtttgaccgccacggcctgctggcgctgctcgccgggcgttttctggcgtttgttcgcaccctgttgcctaccatggcgggcatatcgggcctgtccaaccgccgcttccagttcttcaactggctgagcgccctgctctgggtgggcgtggtcaccacgctcggctacgcgctgaacatgatcccgtttgttaagcgccatgaagaccaggtgatgacgttcctgatggtgctgccgatattcctgctggttgcgggcctggtcggcacaatcgcggtggtgattaagaagaagtattgcagcgcctga

SEQ ID NO: 2897 - DNA, 1353 bp, Enterobacter cloacae
cgcatgaaactgacccaacgcctgagcctgaagctgcgcctgacgctcctctttttgctgctgtccctggcggcctggtttgccgcaagcgtggtggcctggcaccagacgaccgacaagctcgataagctgttcgatacccagcagatgctgtttgccaaacggctgctgacgatggacgtggacgaacttcgcgccccggaacgcatgcgcgaggtgccgaaaaaagccaaacacggccatcttgacgacgatgcgctggccttcgcaatcttcaccgccgacggcagcatggtgcttaacgacggcgaaaacgggcgcgacataccttacctctaccgccgggacgggtttgatgacggtcggttgcaggatgacaacgacgaatggcgtttcctgtggctgacttctccggacgggaaataccgcgtggtggttggccaggagtgggagtaccgacaggatatggcgctggacgtggtcagctcgcagctgacgccgtggctggtggcgctgcccataatgctgctgttgctgattgttctgctgagccgggagctgaaaccgctgaaaaagctggcgcagaccctgcgctcgcgctccccggatgcgaccgatacgctgcccacccacggcgtgccgacggaggttcgcccgctgcttgatgcgcttaaccatcttttcgcccgtacgcaggagatgatggcccgcgagcgtcgcttcacctcggatgccgcccatgagttgcgcagcccgctggccgcgctgaaggtgcaaaccgacgtggcgcagctttcccttgacgatcccggggcgcagtctaaagcgctggggcaattgcacgcaggcatcgaccgcgcctcccggctggtggatcagcttctcaccctgtcgcgcctggattcactggataatcttgatgacgtcgaacccgtgatgatggccgatttgctgcaatctgcggtgctggatatctggcatccggcgcagcaggcgggcattgatgttcggctcaacgttaatgcgcccgaggtgatgcgtcacggacagccgctactgctgagtctgctggcgcgaaacctgctggacaacgccgttcgttacagcccgcgcggcagcgtggtggacgtgacgctgaatacccaaagctttaccgtgcgcgacaacggcccgggcatttcaaccgatgcgctgacgcgtctcggcgagcgcttttatcgtccaccgggccaggacgccactggcagcggtctggggttgtctatcgtcaagcgtatcgcggcgttgcacgggatgcacgtctcgctgggcaatgcgccggaagggggctttgcagtgaccgtcagctggtaa

SEQ ID NO: 2898 - DNA, 453 bp, Enterobacter cloacae
cagaaggatggaatgggtctttttaacttcgtgaaagaagcaggcgaaaagctttgggacaacctgaccgatcataagggtcagagcgacaaaatcaccgagcacctcaagaaactcaacattcccggttccgataaagttcaggttaacgtcaccgacggcaaagccagcgtaacgggcgacgggctaacgcaggagcagaaagaaaaaatccaggtcgccgtcggcaacatcgcgggcgtcagcgaggtggagaacaatatcaccgcgacagacgccaaagatgaagcaacctactatacggtgaaatccggcgataccctgagcgccatctctaaaaccgtgtacggcgatgccaatcagtacaacaagatctttgaggcgaaccgcccgatgctctccagcccggataaaatttatcccggccagacgctgcgtattcctaaggcataa

SEQ ID NO: 2899 - DNA, 900 bp, Enterobacter cloacae
gaaaatttaaaaaggtggtttataaagacgatcagacaggaaaaagttgagttttattgcactatgcgcgacacgccgacaaccgaccttctggaactgatcgccctgaacgataccgtggcctcgttcagccgcctgtttgccaatacggtgcgctaccatcactggcatcagtgtctggagatcctctatgtggaagagggctttggcgtggcgattgtcgataatcgtcactacaccatgcgccccggacgactgtttttcttcccgccttttacgctgcacaaggtcatggtggacgaacaggcggaggcaatttaccgccgcaccattattcatctcgaccagcacgcggtgctgaagatcctgcgggattttccccagacccggcagcgcctggagcggctgtcacgccgtggcggcgaagcgtgggtcgccgatttagcccactgtcaccaccatatcgaccatctgtttagctgctataaaccgccgatgaacggcgagagcatcgccagcctgctgatcggcctgttcgcgatgctgcccgacgatcgcgacggcgagccgggcaacagccaggggatcgccagccaggtcatgatctggctcgacgagcattatcaggagaaatttcgtctggatgcgctggctgcagagctgggtaaatcgcgcagttacgtatcgcgaagattccatgcggaaacaggcgaaaaaattcacgactacctgaacacgctaaggttgcgtaaggcgtgcgagtgtttactccacactgattcgagcgtgcgtgacattgccgcacaggcgggattttccgacgtgacgtggtttatcagcgcgtttaaaaaggggattggcgagacgccgttgcagtaccggaaaaaccattcatcgtga

SEQ ID NO: 2900 - DNA, 1242 bp, Enterobacter cloacae
cgcctgcccgccacaatgagcagcatcaggttgccttctgcgccaccacgattttttacccactacagggaacaagccatgaacaactttaatcttcataccccaacccgcattctgtttggtaaaaacgctatcgctgacctgcgcgcgcaaatcccgacggacgcccgcgtcctgattacctacggcggcggcagcgtgaaaaaaaccggcgtactggatcaggtgtacagcgctctggaaggtctggacgtgcgcgagttcggcggtatcgagcctaacccgtcttatgaaacgctgatgaacgcggtaaaaatcgcccgcgaggagcagatcaccttcctgctggcggtgggcggcggttccgtgctggacggcaccaaattcatcgcggcggcggcccattacgctgacggcatcgacccgtggcatattctggaaacgggcggcagcgacatcagcagtgcgatcccgatgggctccgtgctgacgctgccggccaccggatcagagtccaacaaaggcgcggtcatctcccgtaaaaccaccggtgacaagcaggcctttatgaacgaacacgttcagcccgtgttcgcgatcctcgatccggtttacacctataccctgcctgcgcgtcaggtggcgaacggcgtggtcgacgcctttgttcacaccgttgagcagtacgttacttacccggtaaacgccaaaattcaggatcgtttcgcggaaggcattctgctgacgctgattgaagaaggtccgaaagcgctgaaagagcctgataactacgacgtgcgtgccaacgtgatgtgggcagccacccaggcgctgaacggcctgatcggcgcaggcgtgccgcaggactgggctacccacatgctcggccacgagctgacggcgatgcacggcctggatcacgcccagacgctggcggtggttctgcctgcgctgtggaacgaaaaacgtgacgctaaacgcgccaaactgctccagtacgccgaacgcgtgtggaacatcaccgacggttccgacgatgcgcgtatcgatgccgcgattgaagccacccgtcacttctttgaaagcctgggcgtgccaacgcgtctctctggctacggcctggacggcagctccatccctgccctgctggcgaaactggaagcacacggtatgacgcagatcggcgagcatggcgacatcacccttgacgtcagccgtcgtatttacgaagcggcacgctaa

SEQ ID NO: 2901 - DNA, 846 bp, Enterobacter cloacae
gcacctgaaggaggaaaaatggcaaaccaaaccgtaatcaagctacaggacggcaacgtgatgccccagctggggctaggtgtatggaaagccggtaacgacgaggtcgtctccgccattcataaagccctggaagtcggctatcggtccatcgataccgccgccgcctataaaaacgaggacggcgtgggaaaagcgcttgccagcgccggcgttccccgggatgagcttttcatcaccaccaagctgtggaacgacgatcaaaagcgtccccgcgaagcgttgcaggagagtctggagaaactccagctcgatttcgtcgatctttatctcatgcactggccggtaccggctatcgaccattacgttgatgcctggaaagggatgattgaactgcaaaaagaggggctgataaaaagcatcggcgtctgtaatttccaggttcatcatctgcaacgcctgattgatgaaacgggcgtcgcgccggtgattaaccagattgagctgcacccgctgatgcagcagcgccagcttcattcatggaacgccacgcacaagatccagaccgaatcctggagcccgctggcccagggcggcgaaggggtgtttgaccagaaaatcatccgtgaactggcggataagtacggtaaaaccccggcgcagatcgtcattcgctggcatctggatagcggtctggtggtgatcccgaaatcggtcacgccatcgcgtatcgccgagaacttcgacgtctgggatttccgcctggataaagacgagctgggtgaaattgcgaagctggatcagggcaagcggcttgggccggacccggatcagtttggcgggtaa

SEQ ID NO: 2902 - DNA, 678 bp, Enterobacter cloacae
cggcatcaaggaggaaatatgcgcattttactggtagaagacgacaagctcattggcgacggcatcaaagcgggcttaagcaaaatgggctttaacgtggactggtttaccgacgggaaaaccgggcaggcggccctgtacaccgcgccgtatgatgccgtggtgcttgatctgacgctgccggaaatcgacgggcttgagatcctgcgcgcctggcgcgaaagcggaaagagcgaaccggtgctgatcctgaccgcgcgggatgcgctgaatcagcgcgtcgaaggtttacgcctgggggcggatgattacctgtgtaagccgttcgcgctgattgaagtggcggcccgcctcgaagcgctggtacgccgcagccacggtcaggcgcgcagcgagttgcgtcacggcaaggtcacgctcgatccggcaagccttgtcgccacgctggagggcgaaacgctggtgctcaaacccaaagagttcgccctgctggaactgctgatgcgcaacgcgggccgcgtgctgccgcgcaaggccatcgaggagaagctctacaactgggatgatgacgtctccagcaacgctgtcgaagtccacgttcatcatttacgccgcaagctcggcagcgactttatccgcaccgtgcacggcatcggttataccctgggtgacgcatga

SEQ ID NO: 2903 - DNA, 699 bp, Enterobacter cloacae
ccgtcagctggtaagattattgcgctgagcgcaaaagactttgcacattttgcttatttttccgctccgtcctcgcgcgtagaatacccggcatactctcatcatcgaggacaaataatgagcaacattctgattatcaacggcgcgaaagaatttgcgcactctaaaggccagctcaatgacaccctgaccgaggtcgcggatggtttcctgcgcgacgccggacatgatgttaaggtcgtgcgcgcggacagcgattacgacgtgaaggccgaagtgcagaacttcctgtgggccgacgtggtgatctggcagatgccgggctggtggatgggcgcaccgtggaccgtgaaaaaatacatggacgatgtgtttaccgaaggtcacggttcgctgtatgccagcgacggccgcacccgttcagatgcgtctaaaaaatacggttctggcggtctgattcagggcaaaaaatatatgctctccctgacctggaacgcgccgctggaagccttcaccgagaaagatcagttcttcgaaggcgtgggcgtagacggcgcgtatctgccgttccacaaggcgaatcagttcctgggaatggagccgctgccgacctttatcgtcaacgacgtaattaaaatgccggacgtcccgcgctatatcgcagaatatcgcaagcatctcgcggaaatttttgcttaa

SEQ ID NO: 2904 - DNA, 327 bp, Enterobacter cloacae
aaggagttaattatgcttaccgttattgctgaaatccgtacgcgtcctggccaacatcaccgccaggcagtactggatgagttcgcgaagatcatcccgaccgttctgaaagaagaaggctgccacggctacgcgccgatggtagacgccgccaccagcgcaagcttccaggcgaccgcgccagactccatcatcatggtggagcagtgggaaaccgtcgcacatcttgaagcccatttgcagaccgcgcatatgaaagcgtggagcgacgcagtgaaaggggacgttctggaaacccacatccgtattctggagcaaggggtttaa

SEQ ID NO: 2905 - DNA, 1239 bp, Enterobacter cloacae
ccgcacacgacgaatgaggaacatcttatgaacacaactaccacccgggccgtaagccgctgggtaatcttaatgctggcgctcggtgcgggctttagcgtggcatccatctattatgcccagcctctgctgccgctgatgggctcagacctgaacctgagtatcgaaggcatgggcatggtcccgacgcttacccaggcgggttatgccttaggtatcctgtttctgctgccgctcggcgatcgtcatgatcgcagaacgctgatcctgataaaaagtgcggctctggcgctgttcctgctgggttgtagcctgaccggacaactgcactccctgctgctcaccagcctgctgattggcatggccgccaccatggcgcaggatattgtcccggccgcagcgatcctcgcgccggaaggcaaacagggaaaaacggtcggcacggtgatgaccggcctgctgctggggattttgctctccagaaccgtgagcggcgtggtgggtgaagcctttggctggcgggtgatgtatcagctggccgccgcaagtattgcctttgtcggcgtggtcatgtgggccgtgcttccccgcttcgccgttcactccacgctgagctacccggcgctgatgcgctccatggaacacctctggcgccgctacccggcgctgcgtcgggccgcgctggcccagggttttctgtcgattgcctttagcgcattctggtcaacgctggcggtcatgctgctggaacggtatcaccttggcagcgccgtggctggtggatttggtattgccggagccgctggcgcgctggccgcaccgctggcaggtggtctggcagataagctgggcgccggtaaagtcacccaactgggtgccgcgctggtgaccctctcgtttgccctgatgttcctgatgccggcactgggtatacacggtcagttgatcctgattgccctctccgctgtcggtttcgatctcggcttgcagtccagcctcgtggcccaccagaatctggtctacagccttgagccgcaggcccgcggacgcctgaacgccctgctgtttaccgtcattttcatcggaatggcgctgggttcggcattaggcagcaatatctacacgctggcaggctggtctggcgtggtggctctggcaaccctgtgtggtgccattgcgctggctatcagagtgattgaaagcgcccgggtgctgtccgcacaggcagaaagtgtgtaa

SEQ ID NO: 2906 - DNA, 714 bp, Enterobacter cloacae
tggaaaaccactgcgggtagaatttgcttaattctggatatggtggaacgtgcgatgcggacttttaaacgtggcctggcggcgaccctactgcttttgagccctctggtgcaggctgaggggttagaggaccagctcaatgcattctttgcgcagaagctggccggtttcagcgatgacgtacgcgtgaccgtgcgcaccccgcctaacctttacccttcctgcgaagccccgtcatttagcgtgaccggcagcacaaagttatggggtaacgtgaacgtgctggcgcgttgcgccaatgaaaaacggtatttacaggttgcggtacaggcgacgggcaattatgttgtcgccgccgttccgattccgcgaggcagcctgctgcaacctgacagcgtaacgctgaagcgaggccgtctggatcagcttccaccgcggacgatgctggacattaaccaggctcaggaggcggtcagcctgcgcgatgtcgcccctggacaggcgatacagctatccatgctgcgccaggcatggcgggtgaaagcgggacaacaggtgatggtggtcgccaatggcgaaggctttagtatcaacagcgaaggaaaagcgctgaataatgccgcagtggcgcaaaatgcccgggtcagaatgtcctcaggccaggtggtcagcggcacggtcggtcctgatgggaatattctgattaacctgtaa

SEQ ID NO: 2907 - DNA, 336 bp, Enterobacter cloacae
tgtcaggcgcaaacgccgcgaaccctcgatgaggacaacactatgagcattgatcgtacatcagccctgaagccggttagcactgtacaacctcgcgaaacgaatgaggctgccccgcaaaaaacgcgtctggaaaaaacgtcgacggctaacagcaccagcgtcacgctgagcgatgcgcagtcgaagctgatgcagccaggcagcagcgatatcaacatggaacgtgttgaagcgctgaaaacggctatccgtaacggcgaactgaaaatggataccagcaaaatcgctgatgcgctgattcaggacgcacagagtttcctccagagtaactaa

SEQ ID NO: 2908 - DNA, 621 bp, Enterobacter cloacae
gatcaccctgacatactggcgtatcaggacagatgcgccgattttatgttgaggaacgccatgaaaaagatcgttattgccgctgcgttaattgtcagtggtctgctggtgggatgtaaccagcttacgcagtacaccgtcagtgagcaggaaattaatcaggcgctggaaaaacataataacttttcaaaagatatcggcgtgcccggccttgcggatgcgcatatcgtcctgacgaatctcgccagccagattggtcgcgaggagcctaacaaagtcaccctttccggcgatgccagcctcgatatgacctcgctcttcggcaatcagaaagcggatatcaagctgaagctcaaggcgctgccggtctttaataaagataaaggggcaattttcctgcaagagatggaaatcgtcgatgcggttgtgacgccggataaaatgaaaccggtgctgcaaacgctgatgccgtatctcaaccagtcgttgcagaactactttaaccaacagcctgcctatgttctgagcgaagacaaaagcaaaggtgaatctctggcgaaaaaatatgccaaagggatagaggtgaaaccgggtgaaatcatcatccctttcaccgactaa

SEQ ID NO: 2909 - DNA, 360 bp, Enterobacter cloacae
ctgcggtcagcgcgtcatgggaacgacgcatgccacgtttggaacgggttggtttattctgttgtacggccatggaccttactcctcaattacttacgctttaagctggctaatacggcaaatgggtttggtttttgcgcttcatcaggcagttccccaaagaccatgtccgcctcggacacttcacagtgttcagaatcatgcaccggaacgactggcagggagaggatgacttcatcttcaaccagcgccagaagatcgatttcaccgaattcgttaacctcaatcggctcgtacgcttccgggagtgcttcagcctgttcgtcagaacgaaccggactaaaacaatacgttgtgtga

SEQ ID NO: 2910 - DNA, 3123 bp, Enterobacter cloacae
gttacgatgaaaagaatgttaatcaacgcaactcagcaagaagagttgcgtgtcgcccttgtggatgggcagcgcctgtacgatctggatatcgaaagtcctggacacgaacagaaaaaagcgaacatttacaaaggcaaaatcacccgcattgaaccaagccttgaagctgcatttgtcgattacggtgctgagcgtcacggtttccttcctctcaaagaaatcgcccgcgaatattttcctgcaaactacaactcccatggccgtccgaacattaaagatgttctgcgtgaaggtcaggaagttatcgtccagatcgataaagaagagcgtggcaacaaaggtgccgcactgaccacctttatcagtctggcaggaagctatctggtgttgatgccaaacaacccgcgtgcgggtggcatctctcgccgtatcgaaggcgatgaccgtaccgagctgaaagaagcgctggcaagtcttgagctgccagacggcatgggccttatcgtgcgcaccgcaggcgtcggcaaatctgccgaagcattgcagtgggacctgagcttccgtctgaagcactgggaagccatcaagaaagcggctgaaagccgtcctgctccgttcctgatccaccaggaaagcaacgtcattgtgcgtgccttccgtgattatctgcgtcaggacatcggtgaaattctgattgataacccgaaagtgcttgagctggctcgccagcacatcgccgcgctgggtcgcccggatttcaccagcaaaattaaactgtacaccggtgaaatcccgctgttcagccactatcagattgaatcccagatcgagtctgccttccagcgtgaagtgcgtctgccgtccggcggttctatcgttatcgataccaccgaagcgctgaccgctatcgacatcaactccgcgcgtgcaacccgcggcggcgacatcgaagagaccgccttcaacaccaacctagaagccgctgatgaaatcgcccgccagctccgcctgcgcgacctgggtggtctgattgttatcgacttcatcgacatgaccccggttcgccaccagcgtgcggttgaaaaccgtctgcgtgaagcggtgcgccaggatcgcgcgcgtatccagattagtcatatctcgcgcttcggcctgctggaaatgtcccgtcagcgtctgagcccgtcactcggcgagtccagccatcacgtctgcccgcgctgttccgggacaggtaccgtgcgtgacaatgaatcgctctccctctctattctgcgtctgattgaagaagaagcgctgaaagagaacaccaaagaggttcacgccattgttccggtgccgattgcctcctacctgctgaacgaaaaacgtgcagcggtgagcgcaatcgaagcgcgtcagggcggcgttcgctgcatcatcgtgccaaacgacgagatgcaaaccccgcactatcacgtgctgcgcgtgcgtaaaggtgaagagacaagcaccctcagctacctgctgccgaagcttcatgaagaagaaatggcgctgccatcggatgaagagcctgccgagcgtaaactgcctgagcagcctgcattagcaaccttcatcatgccggaagccccgccggaagcgacgctggaaaaaccagcggcaaaacctgccgtgcaaaaggcggcccctgccgcggcaaaagcgcagcctgagcagccgggtctcctgagccgcatcttcggcgcgctgaaaaaaatgttcgctggcgaagaagttcagcctgagcagccgaaagaagcgccaaaagaagcgaaaccagagcgtcagcaggaccgtcgtaagcgtcagaacaatcgtcgcgatcgtaatgaccgcaacgaccgtagcgatcgtaacgagcgccgtgataatcgttccgagaacaacgaaggtcgtgaacaacgcgaggacaaccgtcgcaaccgtcgcgagaagcaacagcagaacgttgaagatcgtgagattcgccagcaggcgggcgatgagtccgagaagagcaaacagcgtgacgagcagcaacctcgccgtgagcgtaaccgtcgtcgtaacgacgagaaacgccaggcccagcaggaagtcaaaaacctgaaccgcgaagcgcctgttgaacagcaggacacggagcaggaagagcgtactcaggttatgccgcgtcgtaagcagcgtcagctgacccagaaagtgcgtgtgggtgctgttcaggcggaagaaaacgacgttatcgcggttgaagcagcagaaagcacaacgggtacacaggttgcgaaagttgacctgccagccgtagtagaaaatcaggttgagcaggacgaaagcagcgaaaaccgtgacaacgcaggtatgccgcgtcgctcccgtcgttctccgcgtcatctgcgcgtgagcggtcagcgtcgtcgtcgttaccgtgacgagcgttacccaactcagtcgccaatgccattgaccgtggcgtgtgcgtcaccagagatggcatccggtaaagtctggatccgttatccggttgctcgcccggagcaggctattgaagaacaggctgtgacccaagaggtgattgcaccggtagcagcggtggaagacgtcgtgagtgaagcggcaaccgtggttgaaccgcaggttgttgacacggcggcaccgcaggctgtggaagtggaaacgactcatcctgaagtcattgctgcgccggttgatgccgctccgcagatcattgccgaagaagataccgtggtggctgaagaagtcgcggaagacgctgagccagtctccgcagcagaagagaccgcagacgttgccgtcgaaacggtgactgaagaggttgttcaggacgtcgagattcaggttgaacctgttgtcgaagaggtcaaagcgcctgaagtgaaatcagagccgattgaggtcgttgcagctgtagcgcctgctcacgttgctaccgcgccgatgactcgcgccccggcacctgagtatgtacctgaagcgccacgccatagcgactgggttcgtccggcattcaacttcgaaggcaaaggtgctgccggtggtcacagtgcaacgcacatggctactgcgccagctactcgtcctcagcctgttgaataa

SEQ ID NO: 2911 - DNA, 465 bp, Enterobacter cloacae
ttcaggacgcacagagtttcctccagagtaactaaccgtatgagtcgactgtcagaaatactggatcagatgacggtggtcctgaacgacctgaaaacggtgatggatgccgaacagcaccacctctcttctggtcaaatcaacggcagcgcgttgcaacgcataactgaagataaaagctcgctgctggcgaccctggattatctggaaaaacagcgacgcgctgagcaagacgcgaaacgcagcgccaatgatgagatcaacgaacgctggcagaccattacagaaaaaacccagcatcttcgcgatctcaaccagcataacggctggctgctggaaggtcagattatccgtaatcagcaggcgcttgaggtgttaaagccctataaagagccggggctgtacggtgcggatggtcagacggccacggcacgtatcacgggcgggaaaaagatttcgatttga

SEQ ID NO: 2912 - DNA, 1632 bp, Enterobacter cloacae
ggcgcgcctgccagccagaggggtagcagtggctctcgtcccgaacgggttcccagggttttaaaaactggcgattctcggcgtaataatccgccagacgccaggcatcacgctcatgcaccagacgaacgaccagcctgtccgtcgtcagacgcacttttggcacattactgcgatagccaaacatcgttaccactccttcccgtcgcttctgctctgcctgttagctttactatacctgtgcctgcgccttctgtgaaaacagtgacataccattttgatcgcttttcacatttttcgatgagaactctctatcaaagcacctttttgataaaaaaatattgtcgccagcgggtatgggaaaaagagcggcgacaccgcagaatgttagcgtgctcaccttttattttccctggagggaaaatgtcccgcgtatcacaggccaggagcctgggtaaatatttcctgctcgtcgataacatgctggtcgtgctcggcttttttgtcgtttttccgcttatatcaattcgttttgtcgatcaaatgggctgggcggcattgatggtcgggatcgcgctgggtctacgccagtttgtacaacagggtctgggcgtgtttggcggcgcaatagctgaccgcttcggcgcgaaaccgatgatcgtcaccggcatgctgttacgtgcggcgggattcgccaccatggcaatcgctcatgaaccctggctgctgtggttctcctgtttcctttccgggattggcggcacccttttcgacccaccgcgtaccgcgctggtggttaagcttatccgtccgcaacatcgggggcgcttcttctcgattttgatgatgcaggacagcgcaggcgcggtggtgggcgccctgctgggaagctggctgctgcaatacgatttccgcctggtttgcgccaccggtgcggtgttgtttattctctgcgcgctgtttaacggtctgtttctgcccgcatggaagctgtcgacggtgaaagcgcctgtgcgggaagggcttgaccgtgtgctaagcgataaacgcttcgtcacctatgtgttaaccctgaccggctactacatgctcgccgtgcaggtcatgctgatgctgcccattatggttaacgatattgccggcacgccggcagcggtgaaatggatgtatgccattgaggcctgcctctcactgactctgctctatccaattgcccgctggagcgagcgccgtttccggcttgagcaccgtctgatggccgggctgttgctgatgacgctgagcatgatgcccatcggtctggtaagttcgcttcagcaactgtttatgctgatctgcaccttctatattggctcaatcattgccgagccagcccgtgaaacgctgagcgcgtcacttgccgacgcccgggcccggggcagctacatgggcttcagccgtctcgggctggcgcttggcggcgcgctgggttacaccggtggcggctggctgtttgatgccggaaaagcgctccatcagccggagctgccgtgggtcatgctcggcatggtcggctttatgacgctgattgccctctggtggcagttcagtgataaacgcagcacccgcgggatgctggagcctggcgcctga

SEQ ID NO: 2913 - DNA, 357 bp, Enterobacter cloacae
  unsure (341)
aaccgtaaactggacggtaaaacgctaaaaaactgtcgccccctgttgtcaaaccgacaatataactgtataaataaacagtatattacacagggggcatttatgcgtattgaagtcaccattgccaaatccaccgtcctgcctgctggcgcactcgacgctctggcgggtgaactatcccgacgtattaacagcacttttcctgaaaacgatggcgccgtaacggtacgttatgcgacagcaaaccatctttccgtcatcggcggtgcgaaagaagacaaagaacgcatcagcgaaattttgcaggaaacatgggaaagcgccgacgactggttcatgtnttcacaaaccgactga

SEQ ID NO: 2914 - DNA, 624 bp, Enterobacter cloacae
aatggctggcatcgatacgctatatctggtgataaaaatatgccaaatctcgtccttgcttccacttcaccttatcgccgaatgctgctggaaaagctcgggatcccgtttgaatgcgctgcgccggaggtggatgaaacgccacagccgggcgagtcaccgcgtcatctggtgacccgtctcgcgaaagagaaagcacagtcgctggccgtacgttaccccgctcatctgattataggctccgatcaggtttgtgtgctggacggcgaaatcaccggcaaaccgtatacggaagaaatcgcctgccagcagcttttgcgtgcgcgaggcagtatcgtgaccttttataccggcctggcgctttataattcggcttccggtcatctgcaaaccgagtgcgagccgtttgatgtgcacttccgtcatcttagcgaacaggagattatggattatgtgcgtcgggaacgtccgctgaactgtgcagggagctttaaaagtgaaggactagggattgcgttgttcgacaagctcgatggccgcgattccaatacgctggtggggttgccgctgattgcgctgtgccagatgttaaggcgagaagagtgtaatccgctgacgatgtga

SEQ ID NO: 2915 - DNA, 1104 bp, Enterobacter cloacae
tttgtgtccggcaaaaacagccatcttatgactgatctctttcaagccggagcttccatgactgtacaatcccaggttctcaaaatccgccgcccagacgactggcatatccatcttcgtgatggcgacatgctgaaaaccgtcgtgccgtataccagcgaaatttatggccgtgcgattgttatgcctaacctggttccgccagtcactaccgtcgaggccgcgattgcctatcgccagcgtatccttgacgccgttccggccgggcacgattttaccccgttgatgacctgctacctgacggactcgctggatcccaatgaggttgagcgcgggtttaacgaaggtgtgttcaccgccgcgaagctctacccggcgaatgccaccaccaactccagccatggggtgaccagtatcgacgccatcatgcccgttctggagcgtatgcaaaaactgggcatgccgctgctggtgcacggggaagtgacccacgctgacattgatattttcgatcgcgaagcacgttttatcgaaacggtcatggagccgctgcgccagcgtcttccggggctgaaagtggtgtttgaacacattacgactaaagatgccgcagagtatgtccgggatggaaacgagctgattgccgccaccatcaccccgcagcacctgatgtttaaccgtaaccacatgctggtgggcggcgttcgcccacatctgtattgtctgccgatcctcaagcgcaacatccaccagcaggcgctacgtgagctggtcgccagcggcttcccgcgcgcgttcctcggcacggattccgccccgcatgcccgtcaccgtaaagaggcgagttgcggctgtgcaggctgctttaacgccccgaccgccctggcaagttacgcaaccgtgtttgaagagatgaatgcgttagaccatttcgaagccttctgctcccttaacggcccgcgtttctacggtctgccgatcaatgacacgttcattgagctggagcgcaaagaaagccaggttgaagcgtcgattgcgctcaccgacgatacgctgatccccttcctggccggtgaaaccgtaaactggacggtaaaacgctaa

SEQ ID NO: 2916 - DNA, 1068 bp, Enterobacter cloacae
cgtggagccctctgcgctggccgtcgtatccgacacgccagcatcaaacgaaagcctgaccgcgcgcgtggcagccctggaagacgaggttgccgggctgaagcagcgtctggatgcgttactcgcacatctgggagattaatcgtgacaacattacgcattggtgtcgtggggctgggagggattgcgcaaaaagcctggctgcccgttttaggcgccgcgtcagactggacgctgcaaggggcgtggtcgcccacccgcgagaaagcagagcgtatctgcaaaacctggcgcatcccttatgccggttcgctacaggatttagcccgtgaatgtgatgcggtatttgtgcatacctcaaccgcgacgcactaccaggtggtgagcgagttgctgaatgcaggcgttcacgtctgcgtggataaacccctggcggaaaatgtacaggatgctgagcgactgattgagctggccgcgcgtaaaaagctgacgctgatggtcggcttcaaccgccgttttgcgccgctctatcagcagcttaaagcgcagcccggctcgttcgcctctctgcgtatggataagcaccgtaccgacagcgtggggccgaacgatctgcgcttcacgctgctggatgattatctccacgtcgtggatacggccctgtggctgagtaacggaaaagcccagctgcaaagcggcacgctgttgaccaacgagcagggtgagatggtttacgccgaacatcattttgccgttgagcatatgcaggtgacgaccagcatgcatcgtcgggcgggcagccagcgcgagtccgtgcaggccgttatggatggcgcgctgtatgacgtcaccgatatgcgagagtggcgggaagagaagggcaatggcgtggttgcgttacccgttcccggctggcagagcaccctggaacagcgtggctttgtgggctgcgcgcgtcacttcatcacctgcgtgcagaatcagacggttcctgaaacgtccggggagcaggccattctggcgcagcgcatcgtggaacgactctggcgcgaagccatgtcggaataa

SEQ ID NO: 2917 - DNA, 1620 bp, Enterobacter cloacae
actaagcgccgcttgttggctttgccgggtggcgctttcgcttatccgtcctggaaatccgtagggttgtggaacttcacgttaatgaacttattaaaatcgctggcggccgtcagctcgatgaccatgttttcccgcgtgcttggctttgcgcgcgatgccattgtggcaagggtttttggcgcagggatggcgactgacgcctttttcgttgcgttcaagctgccgaacctgctgcgccgtatttttgccgaaggggctttctcacaggcatttgtcccgatccttgcggaatataaaagcaagcagggcgaagatgccacccgcgtctttgtggcttacgtttccggtttactgacgctggcgctggcgatcgtgaccgtcctgggcatgctggcagcgccctgggtaatcatggtaacggcaccgggctttgccgacacggcggataaatttgccctgacgacgcaactgctgcggataaccttcccctatattctgctgatttcgctggcgtcgctggtgggtgccatcctgaatacctggaaccgcttctccgtgccggcctttgcccccacgttccttaatgtcagcatgattggctttgcgctgttcgccgcgccgcattttaacccaccggtgctggcgctggcctgggccgtgaccgtcggcggggtgttacagcttgcttaccagcttccgcacctgaaaaagatcggcatgctggttctgccgcgcattagtttcaaagatgcgggcgcaatgcgcgttattaaacagatgggaccggcgatactcggcgtgtccgtcagccagatctcactgatcatcaataccattttcgcctctttcctggtgtcgggctcggtgtcctggatgtactacgccgatcgtctgatggagtttccatcaggggtgctgggcgtggcgctggggactattctgctgccgtcgctgtcgaaaagtttcgccagcggaaaccacgatgaatactgccgcctgatggactggggactgcgtctctgttttctgctggcattgccaagcgcggtggcgctggggatcctggcaaaaccgctgacggtgtcgttgttccagtatggaaaattcaccgcctttgatgccgccatgacccagcgtgcactggtagcctactcggtggggctgatggggctgatcgtcgtgaaggtgcttgcgcccggtttctattcacgtcaggacatcaaaacgccggttaagattgccattgtgacgctgattatgacgcagctgatgaacctcgcgtttattggaccgctgaaacacgcggggctgtcattgtcgattggtctggcggcctgtctgaacgccgggctgctgtactggcagctgcgcaagcaggatatcttcacaccgcagccgggctgggcaagcttcctgctgcgtctggcgatcgcggtagtggtgatggcggctgcgctggttggcatgttgtatgtcatgcctgaatgggcgcagggcaccatgccttaccgcctgatgcgtctgatggccgtggtggcggtcggggtggtggcgtactttgccacgctggcggtgcttggcttcaaggtgaaagaattcgcccgccgcacggtataa

SEQ ID NO: 2918 - DNA, 768 bp, Enterobacter cloacae
taccgtgaagagcatgatgctcaaaacactcactctcggccagtaaaggagacacgcatgtccatcgccgtaaacgtgaatgacccgacaaataccggcgtcaatagcaccagcagtgcgaccggttccagctctctcaccggcagcaatgcctccgatttacagagcagcttcctgaccctgctggtggcgcagctgaaaaatcaggacccgaccaatccgatgcagaacaacgaactgaccacgcagcttgcgcagatcagtaccgtcagcggcattgagaaactgaacaccacgctcggctcggtctccggtcaaatcgataatagccagtccttgcaggccgccaacctgatcggtcacggggtgatgatcccggggaccacgattctggcgggcaccagcactaccgatggcacgtccaccaccaccacgacgccgtttggcgttgagttgcagcagccggccgacaaagtcaccgccacaatcaaagacgccagcggcaacgtggtgcgcacgattgagattggcgagcttaaagcgggcgttcatacctttacctgggatggcagcctgaccgacggcactaaagcgcctaacggctcgtatcaggttgcgattagcgccagcaacggcaccactcagctggtggctcagccgctacagtttgccctggttcagggcgtcatcaaaggtagcgatggtaacaaactggatttgggtacctccggtaccaccacactcgacgaagttcggcagattatctaa

SEQ ID NO: 2919 - DNA, 816 bp, Enterobacter cloacae
ccaacttctggctatgagttaacaggactccctatgatcagttctttatggatcgcgaaaaccggtctggacgcacagcaaaccaatatggatgtgattgccaacaacctggcaaacgtcagcaccaatggtttcaagcgccagcgtgcggttttcgaagatttgctttatcaaacgattcgtcagccaggggcgcagtcttctgagcaaaccacgctgccgtccggtctgcaaattggtaccggcgtgcgcccggttgccaccgagcgtctgcacagccagggcaacctgtcccagaccaacaacagtaaagacgttgccatcaaaggtcagggtttcttccaggtgcagctgcctgacgggacctccgcctatacccgcgatggttcgttccaggtggatcagaatggtcaactggtgacagcgggcggcttccaggttcagcctgcgatcaccatcccggcgaacgcgctgagtatcaccattggtcgtgacggtatcgtcagcgtcactcagcaaggtcaggccgcgccggtccaggttggacagctcaatctgacgaccttcatgaacgataccggactggaaagcatcggtgagaacctctacaccgaaacgcagtcttccggcacgccaaatgaaagtaccccgggcctgaacggggcggggctgctgtatcaggggtatgtggaaacctcgaacgttaacgtggcggaagagctggtgaatatgatccaggtccagcgcgcctatgaaattaacagtaaagcagtgtcgacgaccgaccagatgctgcaaaaactgacgcaactctaa

SEQ ID NO: 2920 - DNA, 756 bp, Enterobacter cloacae
ggtgtagcccggtgcggtaaacgtcgcaccggctccctgttttcgaagatgaaggcaatgcaaaaaaacgcggcgtttcgttatccgatcctgactgttctggccgtcaccctcagcgggtgtgcctggatcccgtctaaaccattggtacagggtgcgactaccgcccaacccgttcccggccccgcgccggtggtgaacggttctattttccagaccgcgcagccgattaactacggttatcagccgctgtttgaagaccgtcgtccgcgtaacgtcggcgatacgctgaccattgtgttgcaggaaaacgtcagcgcgagcaagagctcgtcggcgaacgccagccgcgacggcaaaaccaattttggcttcgacaccgtaccgcgctatctgcaagggctgttcggcaacgcccgtgcggatgtggaagcctccggcggcaacacctttaacggtaaaggtggcgcgaacgccagcaataccttcagcggaacgctgacggtaacggttgaccaggttctggtgaacggcaacctgcacgtggtgggcgaaaaacagatcgccattaaccagggtacggaattcattcgtttctccggtgtggttaaccctcgcactatcagcggcaccaacaccgtaccgtccacccaggtggcggatgcgcgcattgagtacgtcggcaacggctacatcaacgaagcgcaaaatatgggctggctgcaacgcttcttccttaacctatcgccgatgtaa

SEQ ID NO: 2921 - DNA, 1101 bp, Enterobacter cloacae
cctatgtataaatttctcttcgccgtggcgctgtcgttggtcgctaccgttgcgcaggccgatcgcatacgcgatctcaccagcgtgcagggcgtgcgcgaaaactccctgattggctatggcctggtggtggggctggatgggacgggtgaccagacgacccagacgccgttcaccacccagagcctgaacaacatgctctcgcagctcggtattaccgtaccggccgggaccaacatgcagctgaaaaacgtggcggccgtgatggtgaccgcgtcttatccggcctttgcgcgtcaggggcagaccatcgacgtggttgtctcgtcgatgggtaatgccaaaagcctgcgtggcggtacgttgctgatgacgccgctgaaaggcgtcgacagccaggtgtatgctctggcgcagggcaacattctggttggcggagcaggtgcgtcggcgggcggcagcagcgtgcaggtgaaccagctgaacgggggacgtattaccaacggcgcgatcatcgaacgtgagctgccgacccagttcggcaccggcaacaccattaacctgcaactgaataacgaagactttacgatggcgcagcagattgctgacaccatcaaccgcagccggggctacggcagcgccaccgcgctggatgcccgcaccgtgcagatccgcacgtcaaccggcagcagcaaccaggtgcgaatgctggccgatatccagaatatggaagtgaacgtgccggttcaggatgcgaaagtcattatcaactcccgtaccggctcggtggtgatgaaccgcgaagtgacgctggacagctgcgccgtggcgcagggcaatctctccgtcacggttaaccgctcggccaacgtcagccagccggataccccgtttggtggcggtcagacggtagtgaccccgcaaacgcagattgatttacgacagagcggcggttcgttgcagagcgtgcgctccagcgccaacctgaacagcgtggtgcgtgccttgaatgcgctgggtgcaacgccaatggatctgatgtccattctgcaatccatgcaaagtgcaggctgcctgcgcgctaaactggaaatcatctaa

SEQ ID NO: 2922 - DNA, 954 bp, Enterobacter cloacae
atgctgaccgatagcaaactgttgaccagtgccgcctgggatgcccagtcgctcaacgagctgaaaaccaaagcgggcaaggatccggcggcgaatatccgcccggttgcccgtcaggtggaaggcatgttcgtgcagatgatgttgaaaagcatgcgtgaaactctgccgaaagacggcatgttcagcagtgattccacgcggctttacaccagcatgtacgatcagcagattgcccagcaaatgaccgccggaaagggactcggcctggcggacatgatcgtgaagcagaccgcagccgctcagggactcccgcctgaagaggccccgcagcaggtgccgctgaagtttgatctggaaaaggtgaccagttatcaaaatcaggcgctaacgcagatggtgcgtaaggcgatgccgaagccggcagaaacgcgtgacgagccgctctccggcgacagcaaagacttcctggcgcagctctccctgccggcgcgtcttgccagtgaagagagcggcgtgccgcaccatttgattctggcgcaggcggcgctggagtcgggctgggggcaacgtcagatccgcagggagaacggcgagccgagcttcaacatctttggcgtgaaggccacctccagctggaaagggccgaccacggaaatcaccactaccgaatatgaaaacggtgcggcagtgaaggtgaaagccaaattccgcgtctacagctcgtatctggaagcgttgtcggattatgtcgggctgttgagccggaatccgcgctacaccgcggtgacccaggccgccacgccagagcagggcgctcaggcattgcagaatgccggctacgcgaccgatccaaactatgcacgcaagctgaccagcatgatccagcagctgaaatccatgtctgagaaggtcagtaaagcgtatagcacagatctcgaaaatctgttctga

SEQ ID NO: 2923 - DNA, 1683 bp, Enterobacter cloacae
ccttcatcaggactcgtgtctgaacgtataaaaggaacccccatgtccagtttgattaacagcgccatgagtggcctcagtgctgcgcagtcggcactcaataccgtcagtaataatatttcaagctacaacgtggcaggttatacccgccagaccaccattttgggggcatcaaacagcaccctgaccggtggtggctgggtgggtaacggggtctatgtctccggcgttcagcgtgaatatgatgcgtttatcaccaaccagctgcgtgcggcgcagaaccagagcagtgggctgaccacgcgctaccagcagatgtcaaaaattgacgacgtgctgtcggataccacgaactcgctttctgccaacctccaggatttctttaaaagcctgcaaacgctggtgagtaacgcagaagatccggctgcacgccagacggtgctcggtaaggcggatggtctggtaaaccagtttaaaaccaacgatcaatatctccgcgatcaggatgcgcaggtcaatacggcgatttctaccagcgttgatcagatcaataactatgcgaagcagattgctaaccttaacgatcagatctcccggctgactggcgtaggggcgggcgcatccccgaacgaactgctcgatcagcgcgatcagctggtgagtgaactgaacaagattgtcggtgtggacgttaccgtacaggacagcggcacgtataacatctctatcgccaacggttacaccctggtacagggcagcaacgcaagtcagctggcggcggtgaaatccagtgcggacccagcgcgtacaacgattgcgtatgtggatgccgcagcaggcaacgtggagatctcagaaaaacagatcaccacggggtcgcttggagggctgttaacgttccgttctcaggatctggatcaggcgcgaaacaccctcaaccagatggcgctggcgtttgcggatgccatgaatacccagcaccaggcgggctttgatgccaacggggataaaggcggcaagctgtttgattttggctccccggcagtgctgagtaacggcaaaaacaccggaagcgcgtccgttacggccacgatgacggacagtaccaaggtccaggcgacaaactacaaagttgagtataacggtactgactggacaatcacgcgtctgtcggacaacaccagcttcacggccaagcctgacgccagcggtaatctgtcgtttgatggtcttaacgttaagattagcggctcagccaataataaagacagtttcatcgtcaaaccggtgaatgacgtcattgtgaatatggacgttgcgatcagcgacgaatccaaactggcgatggcctccgcgcaaggaagcggcgaaagcgacaataccaatggccagaagctgctggatttacagagcgctaagctggtgggggggaacaaaacctttaacgatgcttatgccgcgctggtcagtacggtgggcagcaccacggcgtcgctgaaaaccagcagcgaaaccaaagttaacgtggtgacgcagctgaccaaacaacagcagtcaatctccggggttaacctggatgaagagtatggcaacctgcaacgctatcagcagtactatctggcgaatgcgcaggtgctgcaaacggcgagcacgctgtttgatgcattgatcaatatccgctaa

SEQ ID NO: 2924 - DNA, 195 bp, Enterobacter cloacae
aagatcaatacgtcttacgccattgctgcgtggatgatcggtcagacaaaattggtcattccgtcgacatccttacaaaacccggatttaacgcggaaaacggattcattattccactgctcgccgggttatagcaagatgacttttaccaattatcacccggttactcacagtttcttcacttcaacggggtga

SEQ ID NO: 2925 - DNA, 534 bp, Enterobacter cloacae
tatgcgcgccctatgcaaaaggtaaaattacccctgactcttgatccggttcgtacggctcaaaaacgcctcgattacgaaggaatctattcttccgatcaggctgagcgtattgccgaatctgtagtcagtgtggacagtgatgtagaatgctccatgtcgttcgctatcgacaaccagcgtctcgccgtgttaaccggtgatgcaaaggtgacggtaacgctcgaatgtcagcgttgcgggaaaccgtttgtacagcatgttcacacaacgtattgttttagtccggttcgttctgacgaacaggctgaagcactcccggaagcgtacgagccgattgaggttaacgaattcggtgaaatcgatcttctggcgctggttgaagatgaagtcatcctctccctgccagtcgttccggtgcatgattctgaacactgtgaagtgtccgaggcggacatggtctttggggaactgcctgatgaagcgcaaaaaccaaacccatttgccgtattagccagcttaaagcgtaagtaa

SEQ ID NO: 2926 - DNA, 621 bp, Enterobacter cloacae
caggcagagcagaagcgacgggaaggagtggtaacgatgtttggctatcgcagtaatgtgccaaaagtgcgtctgacgacggacaggctggtcgttcgtctggtgcatgagcgtgatgcctggcgtctggcggattattacgccgagaatcgccagtttttaaaaccctgggaacccgttcgggacgagagccactgctacccctctggctggcaggcgcgcctcagtatgattgcggaatttcataaacagggaagtgcgttttatttcgcgcttctcgatccggaagagaaagagatcgttggcattgccaatttttcaaacgtggtacgcgggtcgtttcacgcctgctatctcgggtattccatcggccagaaatggcagggacaggggctcatgtttgaggcgctgacggcggcgattcgctacatgcagcgcacgcaacatatccatcgcattatggctaactacatgccgcacaataagcgcagcggcgatctgctggcccgcctggggtttgagaaagaaggctatgccaaagattatctgctgattgacggcgagtggcgggaccatgtgctcaccgcgctcaccacgcaggagtggaccgcgggtcgttaa

SEQ ID NO: 2927 - DNA, 660 bp, Enterobacter cloacae
ggagaaaagatgaaatatcagttaaatggcgccgaagcgcgcgtgatcggctgccttctggaaaagcaggtcaccacgccggaacagtatcctctgtccgtgaatgccgtcacgatggcctgcaaccagaagacgaaccgtgagccggtgatgaaccttggcgagcacgaggtgcaggatatccttgatgagctggtgaagcgccactacctgcgcaccgtcagcggcttcggtaaccgcgtcactaaatatgaacagcgcttttgtaattctgaatttggcgatttaaaactcagcgctgcggaagtggctgttatcaccacgttgctgctgcgcggggcgcagacgccgggggaactgcgcgcacgcgcctcccgcatgcatgagtttcaggatatgcaggacgttgaacagacgctggagggattagcctcacgcgaggacggtccctacgtggtgcgtctgccccgcgaaccgggcaagcgtgaaagccgctacatgcacctgtttagcggtgacgtggagccctctgcgctggccgtcgtatccgacacgccagcatcaaacgaaagcctgaccgcgcgcgtggcagccctggaagacgaggttgccgggctgaagcagcgtctggatgcgttactcgcacatctgggagattaa

SEQ ID NO: 2928 - DNA, 441 bp, Enterobacter cloacae
aattttctcatcagcggaggagacatgctcgataaactcgacgccgcgttacgttttcagcaggaagcgctcaatttacgcgcccagcggcaggagattttagccgccaatatcgccaacgcggatacccccgggtatcaggcgcgcgatattgatttttccagtgaactcaaaaaagtgatggagcgtggacgtgccgaaggaacgggtgtctcactggccctgacatcctcacgtcatattcccgctcaggcgatgaccgcgccaacgaccgacctgctttaccgtattcccgatcagccctcgcttgatggtaacaccgtcgacatggaccgggagcgcacacagtttgccgataacagcctgcaataccagacaggcctgacgctactcggcgggcaaattaaaggcatgatgaccgtcctacaggggggcaattag

SEQ ID NO: 2929 - DNA, 405 bp, Enterobacter cloacae
atggccttgctgaatatttttgatatcgccggttcggcattaacggcgcagtctaaacgactgaacgtggccgccagtaacctggccaacgccgacagcgtgaccggccctgacgggcaaccgtatcgcgctaaacaggttgtcttccaggttgatgctgcaccgggtgcggcaacgggcggcgtaaaagtggcggacgtggttgagagccaggcacccgacaagctggtttacgagccaggcaacccgctcgcggatgccagcggctacgtgaaaatgccgaacgtggatgtggtcggggagatggtgaactccatgtccgcgtcgcgcagctaccaggcaaacgtcgaagtgcttaataccgtgaagagcatgatgctcaaaacactcactctcggccagtaa

SEQ ID NO: 2930 - DNA, 768 bp, Enterobacter cloacae
cgggaaagcgcaatggatcacgcaatatatacagcgatgggcgcagcaagccagacgctcaaccagcaggctgttaccgccagcaacctggcgaacgcctccacgccaggttttcgtgcgcagctcaacgcgctgcgtgcggtgccggtagaagggctgtcattgcccacgcgtacgctggtcaccgcttccacgccgggcgccgacatgacgccaggccagatggattacaccgcgcgtccgctggacgttgcccttcagcaggacggctggctggcggtgcaaacggctgacggcggggaagggtatacccgcaacggtaatatccaggtgagcgccaccgggcagctgacgattcaggggcatccggtgatgggcgaagccggtccgttgacggtgccggaagggtcagagctgaccattgcggcagacgggacgatttcggcgttaaacccgggcgacccggctaacaccgttgcgcctgtcggtcgtctgaagctggtgaaagcggaaggcaacgaagtgcagcgtggcgatgacgggatgttccgtctgacccaggcggcgcaggccacgcgtggcgccacgttacaggccgacccgaccatccgcgtgatgtccggcgtgctggaaggcagtaacgtcaaaccggtagaagccatgaccgacatgatcgccagcgcccgccgcttcgaaatgcagatgaaaattatcagcagcgtcgatgaaaacgcaggcaaggctaaccaacttctggctatgagttaa

SEQ ID NO: 2931 - DNA, 957 bp, Enterobacter cloacae
aaaatgcgtattagtactcaaatgatgtatgagcaaagcatgcgcggcgtgacgaactcccaaagtctctggctcagctacggcgagcagatgtctacggggaagcgcatcaatcgtccatctgacgatccgattgccgcttcgcaggccgttgtgctctctcaggcacaaacgcaaaacagccagtatgcgctggcgcgctccttcgctacgacgaaagtctcgctggaagagaacgtgttatcgcaagtgacaaccgctatccaggctgctcaggaaaagattgtcaatgcgggcaacggtacgttaagtgacgatgaccgcgcttcgctggccacgaacctgcaaggtattcgcgatcagctcatgaacctggctaacagcacggacggtaacggccgctatattttttccggttacaagaccgaagcggcggctttcgaccagactacgggtgattataagggcggcggaacgccaatcagccagcaggttgactccgcgcgcacgatgcaaatcagccatacgggcactgaagttttcgatagcttcaccagcaatgcgaagccagagccagatggtagtaaaccggaaacgaatttgttcaagatcctcgactccgcaattgaagcgctgaatacgccgattggggaggatgaaacgaaagccgaggcgtttacggcggctattgataaagccaaccgtggcctgagcaactccctcaacaacgtgctgaccgtgcgcgccgacctcggcatcaagctggatgagctgggcaagctggacgctctgggtgaagaccgcgcgctgggtcagacccagcagatgagtaacctggttgacgtggactggaactcggtgatttcgtcctacaccatgcagcaggcggcgttgcaggcctcgtataaagcctttagcgatatgcagggtatgtctttgttccagatgaacagataa

SEQ ID NO: 2932 - DNA, 957 bp, Enterobacter cloacae
cgtatggatggaaatggtatgaaaaggcctgagcgtatagatcgggtagaactgatgcgaacgtttgttcgcattgtggaggcggggtctctttctgcggcagcacgtcagctggcaacaacccaggcaacggtgagccgacggttgcagtcgcttgagaccatgctgggagtacgcctgatgctgcgcacaacccatacgacccggctgaccgatgacggcgaacgctgctatcagcatgcccgacgggtgattgacagctggctggcgctggaagacgaggtagggcagacggaagatgaaccggttggggtgctgagggtgcgcgccccgcacgcgtttggccaggatcagcttcttaaaccgttaaccgaatttttgcagcgctatccccagctttctgttgagtggatgctcaacgatcgctcggttgatttcctcggcgacaaccttgactgtgctattcgggtgggtgtggaagtcgatccggcaaccgtgtccgtgctgctggctgaagtgccgcgctcggtggtggcttcaccggaattactggcccgttatcccgcggttaaaacgccggaagatttgcaacagcttccctggattgccatcagctctttttatcaacgccatgtggagcttttccacgatgcatcatctgccccgacgcgggttaccattacgccacgcctgagtaccgacagcctgtatgtggcgcgcaatacggcactcaccgggctaggcgttgcggtggtatccagctggacagtacaggatgatattcaggaaggacgactggtgcatctactgccagagtggcagccggcagcgctaccggtacatctggtttacccctggtctcgttattatccggcgcgcttgcggcgttttctggagctgatgcggcagataatgccggaggttaccggaatgagaaagcccctgcaacagccataa

SEQ ID NO: 2933 - DNA, 186 bp, Enterobacter cloacae
ggagtaaggtccatggccgtacaacagaataaaccaacccgttccaaacgtggcatgcgtcgttcccatgacgcgctgaccgcagttaccagcctgtctgtagacaagacttctggtgagaaacacctgcgtcaccacatcaccgctgacggtttctaccgcggccgcaaggttatcactaagtaa

SEQ ID NO: 2934 - DNA, 321 bp, Enterobacter cloacae
tcacgcgtcagcgtgattaggcttagtgaggaacttccccgtgcaaacggggagtttaccgaaccaggctgcgacgataccttgacacgtctaaccctggcgttagatgtcatggggggagattttggccctaccgtgacagtggctgcagcattgcaggcactgaattctaattcgcaactcaaacttcttttattcggtaatcccgacaccatcacgccattacttggcaaaactgacttggatcaacgttcgcgtccgcagattatccctgggcaatcacgtatgccaatgatgcccggcctcgcatgctttccctaa

SEQ ID NO: 2935 - DNA, 1212 bp, Enterobacter cloacae
gtcatggccttttctcaagcggtcagcggcctgaatgctgcggccaccaacctggacgtcattggcaacaacatcgccaactccgcgacctatggttttaaatccggttctgcgtcttttgcagatatgtttgcaggctctaaagtgggcctgggcgtgaaggtggcgggtatcacccaggacttcaccgacgggacgaccaccaacaccggtcgcggtctggacgtcgccatcagccagaacggtttcttccgtatggtggatgccaacggttccgtattctacagccgcaacggccagttcaagctggatgaaaaccgtaacctggtgaacatgcaggggcttcagttaaccggttatccggttgccggcacgccgcctacggtgcaaaccggtgcgaatccgcaggcgatctccatcccaacgacgctgatggcggcgaagtccaccaccacggcctctcagcagatcaacctgaactccaccgatactgcaccaaccgtcgccttcgacccggccaaccctgactcttacaacaagaaaggcaccgtgacggtgtttgacagccagggtaatgcgcacaacatgaacctgttctatgtcaaaaacgcgacgccagctaactcctggaaggtgtattcccaggacggcagcgtagcgggagatgcagcgaaactggcaaccacgctgacctttaatgcgagcggcgtgctgacgggtggcgatgatatcaagatcacaacgggcaccgttccgggcgcgacgccagccacgtttgacatgagtttcgccaactccatgcaacagaataccggtgcgaacaacatcgtggcgacgagccagaacggttataagccgggcgatctggtgagctaccagatcaacgatgacggtaccgttgtcggtaactattcgaacgaacagacccaggtgctgggccagatcgtgctggcaaacttcgccaacaacgaaggcctgaaatccgaaggggacaacgtctggtctgccacgcagtcttccggtgttgccctgctgggtactgcgggttccggtaacttcggcacgctgaccaacggcgcgctggaagcctctaacgtcgatctgagtaaagagctggtgaacatgatcgtcgcgcaacgtaactaccagtccaacgcgcagaccatcaaaacccaggatcagatccttaacacgctggttaacctgcgttaa

SEQ ID NO: 2936 - DNA, 270 bp, Enterobacter cloacae
gaggcgcagagtgtcggttgcctgtgtttcatacggaaacacagcgcaattatcaggggaattgcctgggaaaactctccagagaacaatccttataccgggaagtactgcaacccgcagcccgctaactgcctgaaagatcaatacgtcttacgccattgctgcgtggatgatcggtcagacaaaattggtcattccgtcgacatccttacaaaacccggatttaacgcggaaaacggattcattattccactgctcgccgggttatag

SEQ ID NO: 2937 - DNA, 969 bp, Enterobacter cloacae
cgctatttagaatcgccaaccatgaaaacagagactccagccgtaaaaatggttgccatcgccgacgacgaggcggggcaacgtatcgataattttttgcgcacccagttgaagggtgtgccaaaaagcatgatttatcgcatcttgcgtaagggcgaggtgcgggtgaacaaaaaacgcgtgaagccagagtataagctcgaggcgggcgatgaagtccgcattccaccggtacgtgttgcagagcgtgaagaagaggtcgtttctccgaagctgcaaaaagtcgcggccctgagcgacgttatcctttatgaggacgaccacattctggtgctgaataaaccgtccggaacggcggtacacggggggagcggcctaagctttggcgtgattgaagggttacgcgcgctgcgcccggaagcgcgtttcctcgaactggttcaccgtcttgaccgtgatacctctggcgtgctgctagtggcgaaaaaacgttctgcgctgcgttcactgcatgaacagctgcgcgaaaaagggatgcagaaagattatctggcgctggtgcgcggccagtggcagtcccacgtgaaagtggtgcaggcgccgctgctgaaaaatattctgcaaagcggcgagcgcattgttcgtgttaatcaggaagggaaaccgtctgagacgcgctttaaagttgaagagcgctacgaattcgccacgctggtgcgctgtagtccggtgacggggcgtactcaccagattcgcgtccatacccagtttgcgggccatccgattgcgtttgatgaccgctatggcgatcgcgaatttgataagcagctggcggggacggggctatcgcgtctgttcctgcatgcggcagcgcttaagttcacccatcctaataccggtgaagttatccgtattgaagcgccgctggatgagcagctcaaacgctgtctgaaagttctgcgcggctga

SEQ ID NO: 2938 - DNA, 1218 bp, Enterobacter cloacae
cattatcttcacaattttatgcgcacccgtaccgagaatctcactgacgttgtggcccccaaagctaactggtccctggcactgggcgccggtttattaggtattggacaaaacggtttgctggtcatgctgccgcagctggtctccctgaccggattgtcgctctccgtctgggccgggctgttgatgttcggctcgatgctctttttacccgcatcgccctggtggggacgccagagcgagcggcacggctgtaagatcgttatgctggcctcgctgggcggctacctggcgagcttcgtcgtgatggcgctggtagtctgggcgatggcgaacggcgcgctgaatgccctctggggaatggcgggcctggttctgtcgcgcatgctgtatggcctgacggtatcagggctggtgcctgcggcccagacgtgggccattcaacgcgcggggttggataaaaggatggcggcgctggcgacgataagctctggcctgagctgcgggcgtctgctgggaccgcctcttgccgcgctgatgctcggcgtcagcccggtcgcaccgctctggctgatggcgctggcgccgttgatcgcgctgctgctggtgctgcgcgaagccgccgatcccccgctgccgccggtggcgcaccagtcgacgcggttacaggcctccatgctgcctttcctggtgctggcgctgctgctggcagcgctggtcagcctgatgcagcttggcttatcgccgcatcttcatccgttattcaatggcgatgtcgtgcaaatcagccatcatgtcgcgctattgctgagtctggccgccctggcgaccctggcggcgcagtttctggtggtacgcccgcagcattttaccccgagagttttactcttaattgccgcagtgctgatggtggcgggtcttgggctgatgtctctcgccagtttagccctgttctacgtgggcattgtcatcacttcgctgggggccgccatggcaacgccgggataccagcttttgctcaacgatcggctgacgacgggcaaaggcgcaggggtgatcgccaccagccatacgctgggctacggggccagcgcgctgctggtacccgtggtgacgcgcttttacggtgagcagtttttgattactgccgcatggggaatggcgctgctgtttctcgcggtgagcgtgtgggtacgatcgaccgatcgtaccccttaa

SEQ ID NO: 2939 - DNA, 1206 bp, Enterobacter cloacae
ccatcaataccgatacctgcgtgctggacagcaaccacaacgtattgccgggagcgtttgctgcgggtgaggttgtcgggggcatccacggcggtaaccgcatcggcggtaatgcggtggcagatatcattatttttggtacgcttgcaggacatcaggcggctatgcgttcgaaaacacggtaaggctcctgtttccccggcggcgcggtgcctgccggggctacacctgaggactcatgcaatgcctgatagccatcgcgtttacagctactccgccgttctgatgggctcgcccatcctcctgaaactcttttcccatgacgaagcgcttgcctcccgcgtgtttcgcctgatcaaacagtacgaagatctgctcaccgttaaccgtgcgcactcccaggtaatggacatcaaccatgcggccggccagcatccggttgccgtcagtcgtccggtgtttgagctgatccgctgcgcgaaagcggcaagcctgcttaaagacagcgcctttaacctggcgatcggcccgctggtgaaatgctggaaaattggctttaagggggacgcggtaccgcccgcggacgagatcgccgccttgatgggcatcacggatcctgcggacgtggtactggatgaagccaatagcagcgtgtttcttactcgccagggaatggagatcgatctgggtgctattgctaaaggctatatcgccgacagggtgcgggattacctgcataaagagggcgccgaactcgggttgatcaaccttggcggcaacgtccagacgttaggttcgccggagggcggctggcgcgtcggcctgaaaaaaccgttcgccggtgacgcgctgattggcgctatgacggtagagaaccggtcggtggtgacgtcaggtacctatgagcgctatttcgagcagaacggcaaacgttatcaccacatacttgacccgcgcaccggctacccgctggataacgaactggacagcgtgacgattatttcgccagactctctcgacggcgatatctggaccacgctgatctacggcatgggtgtggaaaagggctgcgccgcgctgcgttcgcgccccgatattgaagccatttttgtcaccaaaacaaaagaagtggtgatctcctcgatgcaccacttccgttttacccttctggacgacagctaccgaattactggcagtactgcttga

SEQ ID NO: 2940 - DNA, 1014 bp, Enterobacter cloacae
cactccgcgatgaaaaagaaagggctaattatcgctgatgacgggcgtttcataaagccatgtaaagagaggcgtttcgtgagcctcctctcaggtgacctatataaaacactttatagtgtgtgggtactcataataaggaggcagtttatgagcattatgcttaccggtacggccagggaaagacggcacgccagcacgatgaacatcgacagattatcgacgctggatatgcttaacgtcatacaccaggatgacgcacaaatcacttctgcacttacccctcacttaagtatgctggctcgcgtggtggataacgcggcggcgacgcttagccacggcggacgtctggtgctgaccggcgcgggcgcgtccggacgcatggctgagcaggcggcagaagcgtttgcgccgggcaaacaccccgtcattgcgatgacagcaggcgataacgccggaagctacgcgagcggcgttgccgaccttcagacgatagaatttggcgagcatgacatgatgctggcgctgtccgtcagcggcaaaaccccatgggtatggggcgcgatgcgtcatgcgtggtctctgggctcaacggttgcgctcattacggaggatgcgcaaagtgaagcggcgcagctggcgagtatggtcattgctcccgatctgggcgcggatgtggtggccgggtataccaacgctaaagcaggcattgcgcaaagcatgatcctgcatatgatcaccaccggtctggcggtacggacaggacgggtgtacagcaacctgcgcgttgatctggaggcaagcaacaccagatgggccgaacgacaaattgccattgtgatggaagcggggggatgtagccgggcgcaggcgaaggccgcgctggaaagctgtaaccaccagtgcaaaacggcggtactgatggtgctgacgggtctgaatgcctggaaagcgcatgaattgctggcgcagaataacgggtttgttcgcctggccttgcaggaagcgccataa

SEQ ID NO: 2941 - DNA, 1506 bp, Enterobacter cloacae
cccatttccgtcgcagtgtgcgatcctgaactgtggtactctgttttctgtctttattgtccggttaagagaatgcaggaaaatcgatcagtgactgtgcccgcgcctgagcgggttgagaaatcaacggcagccgtgcaggcactcctgcgtcagctgctggaaatgtatgatgctaaaacgctggcaaaccagctggtggcccatggcgagagtcactggagcccggcgatactcaagcggttgctgataagcgacagggcagggcaccgcctgagcgacggcgagttccgttatctgcgcaacctgctgccgcgtcctcctgctgcgcatccgaattatgcctttcgctttatcgatctctttgccggtatcggcggcattcgccatggctttgaagctattggcgggcagtgtgtcttcaccagtgaatggaataaacatgccgtccgtacctataaagccaactggtattgcgaccccgacgcgcaccagttcaacgcggatattcgtgatgtcacgctgagccacaaaactggcgtcagcgatgaagaggccgccgaacacattcgcaataccattccggcgcacgatgtgctgctggcaggctttccgtgtcagccgttctcgctggctggcgtgtcgaaaaagaacgcgctgggacgcgcacacggctttgcctgtgatacgcagggcacactgttttttgacgttgcccggattattgatgcccgccgcccggcaatttttgtgctggagaacgtcaagaatttaaagagtcatgacggcggcaaaaccttccgcattatcatgcaaacgctggatgaactgggttacgacgtggcggatgcagaggatatggggccggacgatccgaaaattatcgacggcaaacacttcctgccacagcaccgcgaacgtattgtgctggtgggcttccgccgcgatctcaacctgaaaggcgattttacgctgcgtgatttgccttcgctgtatccggcgcgccgcccgacggtggccgatctgctggagcccgccgtcgatgcgaaattcattctgaccccggtgctgtggaaatacctctatcgctatgccaaaaagcatcaggccaaaggcaatggctttgggtttggcatggtcaatccgcttaatcctgacagcgtgacgcgtacgctgtcggcgcgctattacaaagatggcgcggaaattcttatcgatcggggctgggataaggcgctgggcgaaaaagatttcgacgatccacagaaccaacagcaccgaccgcggcgcttaacgccgcgcgagtgcgctcgcttaatgggctttgagacgccgcagggctacagttttcgcatccccgtgtcggacacccaggcctatcgtcagtttggcaactcggtggtagtgcccgcctttgccgccgtagctaaactgctggcctcacgtatcagcaaggccgttcagcttcgtcagagtgaggccgtcaatggcggacgttcacaataa

SEQ ID NO: 2942 - DNA, 963 bp, Enterobacter cloacae
gttttgttccatactattcacttaattagcaaaaaaagaaggatagagattttggcaggaagtagcttattaacattgctggatgatatcgccaccttgctggatgacatttcggttatgggaaaactggcggcgaaaaaaaccgccggggtactgggagatgatttgtcgttgaacgcgcagcaggtcagcggcgtgcgggcgaaccgtgagttgccggtggtgtggggcgtagcgaaagggtcctttattaacaaggtgatcctcgttccgctggcgttgctgattagcgcctttataccctgggccattacgcccctgctgatgattggcggggcgttcctgtgcttcgagggtgccgaaaaagtgttgcatatgttcgctgcacgcaaagagaaagacaccccggaaatgcgccagcagcgtctggaagcgctggccgcgcaggatccaaaaacgttcgagcgcgataaggtcaaaggcgcgatccgtactgacttcatcctctcggccgaaattgtggcgattacgctggggatcgtctcagaagcccctctgatgaaccaggtgctgatcctgtccggcattgcgatcctcgtgacgataggggtttatggtctggtcgggctgatcgtcaagctggacgatatcggcttctggctggaaaaaaaatccagcgcaattgcgcgcggcatcgggaaaagcctgctggtggtagcgccgtggctgatgaaaaccttatcggtggtgggaaccctggcaatgttcctggtcggcggtggaattatcgtgcacggtgttgcttcgctgcatcacatgattgaacattttgcgtcaggccagggagcggtagtcgctgcgatcctgcccacactgcttaacctcgtgctgggctttatcgtcggtctgattgtggtagccgttgttaagctggttgaaaaagtacgcgggaaatcgcattaa

SEQ ID NO: 2943 - DNA, 1008 bp, Enterobacter cloacae
ttttcatatttatcacgtttggctcaggaaggacttcagtttaagaacctgaggcctataataaaaaacgcgttatgggggaaaatcccccggaaaaatcgcgtggagaatgacgtggcatcactgatctattcctttgcccagcttgaggcgttcaccgccgtcgctgagcacggcagcctgatgaaggcggccagtaaactcggcaaagatcgtacaaccctgcgggatctgatcgatttccttgaggatgggctgggctacgcgctgttcctgcgggaggggcgtagcctgcgcctgacgccggagggggagcagcttcagcggcaggcgcacctgctgatgcggcaggtcaaagcgtttgaggcgtttgcccgtacggtgccggacagcgcgacgcaggacattgccctcgtttacgatccgttcacccccagagcctttttgcaggcgctgatcgctacgctggcgacgaaaaagacccgcctgagcctgaccagcgcatcgcgcgatgaggcggaagccatgctggcgaacggtcaggccgatctggggatctgccaggcgcgcaaccgcagcgtgggcaatgagatggagtggcgggcgctgggggcgatcgaaatggatttttacgccgcaacggcgctttttgcggaggttgcgtcgccagtgtcgctgctcgatctctctctggttccacaggtggttatgcatgccgcgtcagacgagccggttgcccgtcgcctgcaaatttcagggcacacgcttttcactaacgaactggagatgctgcgcggcctgctggagcagggctgcggctggggatttttgccgacccatcttcacgcaacgcagtggaaaaacgtaaaaaggctgcccaccgaagtgggcagccaggggataagccagacgatggtcaccatctggaagccgggcagcgacaagcgcgggttgatcaacgatacgctgtcgcagcttccggcgttatggaaacgctcagcgctgtga

SEQ ID NO: 2944 - DNA, 552 bp, Enterobacter cloacae
ctaaactgctggcctcacgtatcagcaaggccgttcagcttcgtcagagtgaggccgtcaatggcggacgttcacaataaggccacgcgcagtaaaaacatgcgtgccatcggcacgcgtgataccgcgatcgaaaaacggatcgcgggcctcctgaccgccgtcgggtttgaattcagggttcaggatgccacgcttgccgggcgtcctgatttcgtcatcgacgcgtaccagtgcatcatctttacccacggctgtttctggcatcatcatgactgctatctgtttaaagtcccggcgacacgcaccgacttctggctggacaaaattggcaggaacgtcgagcgtgataaacgcgatgtttcgcagctttacgctcagggctggcgggtgctgattgtctgggagtgcgcgctgcgcggaagaatgaagctgaatgacgtggaactgacggagcggctggaagagtggatctgcggcggcggtcaggccgcgcagatcgatacccagggcattcacccgatcacggtttctccacctcacacctcgtaa

SEQ ID NO: 2945 - DNA, 1182 bp, Enterobacter cloacae
cctctgttttatcgttgtcctgattttttccactctcctgacctggcgcgaagttgtggtactggaagatgcttatatctccagcccagcgtaaccatctggaaacggttgccagtgcgctggacagacagcttcagttcagcgtcgataaaatgctgttttttcgccacagcaggcatgatgcgctgggacacgccgctggcgtttggcgcgctgcatgatgcggtaaagcgttttgcgcagttgcgcacgtctcccacctggcaaattgcggttgataaacggcgcacattaccgatcaacggtgtttcggatgccttcgttgaaaagaccactcttctgaaccgtgatgatgagtaccttgataatgaattgtccgcggcgcttgaagtggggtatttactgcgtctggcatccagcccttcccgcaacgaagagcgcgtgatttatgtctctcgcgccggattctttctggaaacggatacgccgggaaattccagcgatatcgtgcagcgctattatcatctggtcactcagccctggtttacccaacagtccgagcgtgaaaaccgtgcgcgtgccgtgcgctggtttatctcgccgccttcctcttttgtgggcaaaaagccgctgattaccgccagcgtgccggtttattaccatcacgtctggtatggcgtggtggcgatggatttcacctttgccaccctgcgtcgcctgctggtggaagccgtgggcgataacccggaaggggaataccagctgtatgacagccggcttaccctgcttgcgacatcagagtcacctgctgtggacgttaatcattttgacgcgcgcgaattagcccagatagcgcacgcgatagaatcggattccgaaggcggcattcgtctggggagtcgttttgtcagctgggagcgtcttgaccattttgatggcgtcatcctgcgcgtgcacaccctggatgaaggggtgcgcggcgatttcggtagcatcagcattgtgctggcattgctttgggcgctgttcaccgcgatgctgctcatctcatggctggtgatccggcgcatggtcagtaatatgtattcgatgcagaactcgctgcaatggcaggcctggcatgaccctctgacccggctgcataatcttcaccacgaggccggcgccatccgcaattacaac

SEQ ID NO: 2946 - DNA, 942 bp, Enterobacter cloacae
atctcttcttaccctaccatgcttaaggatcccgtcagtatgcccgtcaattttgacctcaacgatctctatgccttccgcgctttactggaatacggcaatttccgtcttgcggcagaatctatctgcctttcccagtcggcgttgagtcgcagaattgaaaagctggaggcggcactggggacaaaactgttcgacagaaccacccggcgcgtcacgctgaccctgtatggacagacctttgccgaccggtgcgggcaactgcttgctgacgtggagtccatgctttcggatatcgataaggccagcgaagagcgcacggggctgatcaccgtggcgacggtgccgtcagccgcctgttactttatgccggatgtgatccgccgctttcagtcccgttacccccgcgtgcgcataaaactgatcgacagcagcgccggaaatgttatcgaggccgtcacccgcggacaggcggattttggtatctgctttgcccggagtttgcagcccgacatcgagtttgtcccgctggtggaggatgtctacgtggccgcctgccgacgcgacagcccgcttgcaaaaagaaaaagcctgacgtggcaggctttttatcagcaggattatatcggtctggataagacctccggcaaccgcaatcttctcgaccagcgggtcgggcatattcggcctgagcgccccagcatctgcgaaacgcggcacgtgacgaccatgctggggatggttgaagccgggatcggcattgcggccgttcccgccatgtcaatgccccgcgcagagcattcgctgctgacgtcggtacctttaaccgagcctgaagtcaggcgaaccgtggggctgatccgccgccgcggtcggatccagtcctatattgctgccgaactcgaaacgctgattaccgagcagtatcgcgaggtgcactga

SEQ ID NO: 2947 - DNA, 2805 bp, Enterobacter cloacae
tttttaaagtttggagtttctattatgagcactaacgaacgtattttaagccccttcacattaccgaatggtactgaactgaaaaaccgtttgttaatggccccgatgacaacctgtaccggttattacgatggcaccgtgaccagcgagctggtggagtactaccgcgcccgcgcgggcagcatcggcaccatcatcgttgagtgctgttttgttgacgatctcggcctggcgttcccgggcgcaattggcattgataacgacgagaaaatcgccgggctggcaaaaatcgctgacgtcatcaagtcaaaaggctccaaagccctgctgcaaatctaccacggcggccgtatggtcgacccaaaactgatcggcggtcgcacgccggttggcccaagcgccgttgccgcgccgcgtgacggtgccgccacgccggttgccctgaccgcggaagaggtggaaggcatgatcggcaagtttggcgaagccgtgcgccgcgcaattcaggccgggttcgacggcgtcgaaatccacggggcgaatacctatctgatccagcagttcttctccccgaactccaaccagcgcgacgacgagtggggcggcagccgcgaaaaccgcgcgaaattcccgctggcggtgctggacattacccacaagatggtgcgccagtacgcggacgacgcgtttatcattggctaccgtttctctccggaagagctggaagtcccgggcattcgcttcgaagataccctgtatctgctggaaaaactggccgcgcgcggggtggattatctccacttttcccttggcgacgccctgcgtccttctatcgtcgatactcaggacccgacgccacttatcgaaaaatactgcgccatgcgctcagacacgctggctcaggtaccggtgatgggcgttggcggcgtggtgaatgccacggatgtgaatgaagcgctggatcacggttacgacctgattgccgttggtcgtgccaccatcgcctatccggactggaccgatcgcatcgcggcgggcgaaagcctggagctgtttatggacagtacccgacgcgaagaactgagcatcccggaaccgctgtggcgcttctcgctggtggaagcgatgatccgcgacatgagcatgggcgaatctaaattcaaaccgggcacctttattgaaaaagtgcaggacgatgctaacgaactggtgattaacgtcagcctcgaaaccgatcgtattgccgatatcgaactggcctccggcccgagtgaagacgtcgagtttgtcaccagcttcgaagagatccgctcccgtattcttgatgccaacactccgcacgtggatgctatcaccggcgcgaccagccaaagcgaggcggtgaaaaaagcggtctcgaaggcgatgctgaaatccagcaaagcgctggcagcggaagagggcgctgacccgaatgagactaaaagcgtggatgttgtagtggtcggcagcggcggcgccggtcttgcggcggcgattcaggcgcatgacgaaggcgcgagcgtgctgatcgtcgagaaaatgccaaccatcggcgggaacaccattaaagcctcggccgggatgaacgcggcggagacccgcttccagcgcgtgaaaggtattcaggacagcaaagagctgttctaccaggaaagcctgaaaggcggtggcaacaagaacaaccctgaactgctgcgtcgctttgtcgagaacgcgccgcaggccatcgaatggctggcaacgcgcggcattatgctgaacgacatcaccaccaccggcgggatgagcatcgaccgtacgcaccgtcctaaagacggttccgcagtgggcgggtatctgatcagcggcctggtgcgtaacgtcaacaagcgcaacatcgaggtgatgctggatacctccgtgagcgacatcatcttcgaaaacggcgaagtgaccggcgtgcgtctgaccaccgaagagaacgaaaccctcaccgtggcaaccaaaagcgtgattgtcgcaacgggcggcttcagcgccaacagcgagatggtggtgaaataccgtccggatctggcagggttcgttaccactaaccacaaaggggcgaccgggggcggtatcgcgctgctggagcgtatcggtgcaggcacagtggatatgggcgaaattcagatccacccaaccgttgagcagaaaacgtcgtatctgatttccgaatccatccgcggcggcggggcgattctggtaaaccagcagggcaaccgcttctataacgaaatgtcgacccgcgataaagtctcggcgtcaatcatcgcgctgccggagaaatacgcttacatcgtctttgacgagcatgttcgcgtcaaaaataaagccgcggatgagtacatcgcgaaagggtttgttaccagcgccagctcgccaaaagccctggcggaagcgctggggatggatcaccaccagttcctggcaacgctggaacgctacaacggctttgtggagaaacagcacgatgacgactttggacgtaccaccgcgctgcgtgcgccaatcaacgaagggccgttctacgccattcagattgcaccaggggttcaccacaccatgggcggcgtgaccatcaataccgatacctgcgtgctggacagcaaccacaacgtattgccgggagcgtttgctgcgggtgaggttgtcgggggcatccacggcggtaaccgcatcggcggtaatgcggtggcagatatcattatttttggtacgcttgcaggacatcaggcggctatgcgttcgaaaacacggtaa

SEQ ID NO: 2948 - DNA, 771 bp, Enterobacter cloacae
ttctatttattaaagattttgattcggatgtattataattcactctcttttgagcaacaggatgggatgatggaacttgcgcagtggcagcaccgttatgagcgctggctcgacgaaaatcattttactgatgatgcggcgcacgatatcgcccattttcgccgcgtctggatgacggcgcagggtattatggctgacgaggatagcgatccgctggttgtgttgaccgcatgctacttccatgacattgtcagcctgccgaaaaatcacccggaacgtagccactcctcgcggctggcagcgcgaaaaacgcgcgagatcctcagtcgcgactttcctgattttccgccggatcgttatgcagccgttgagcatgctattgaagcgcacagcttcagtgccggtatcgcgccgcaaagcctggaggccaaaattgtgcaggatgccgaccggctggaggcgttaggcgctatcggcctggcgcgcgtctttgccgtgtccggtgcgctgggcgccgcgctgtttgatgccgacgacccgttcgccggaacacgagcgctggatgataaagccttcgcgctcgaccactttcagaccaaactcctgcgcctgccggacactatgcaaaccgcgcgggggcgcaaacttgcgcgtcacaatgccgattttctgatccagtttatggcgaagctgagtgccgaattacagggcgattacctcggaaccgacagccagatattgacccatttccgtcgcagtgtgcgatcctga

SEQ ID NO: 2949 - DNA, 213 bp, Enterobacter cloacae
aaacgtttcaccctgatacaggaggcaggtatggtctttttgatcagtgatgaagttaagcctaaaaatggtggtccaggcatgatcgtcaccgggtattccagcggaatggtggagtgtcggtggcatgatggatacggcattaagcgggaggcttttcgtgaagacgagcttcagcctgctaataaaaggcaaaaacgcgacaaggcttaa

SEQ ID NO: 2950 - DNA, 258 bp, Enterobacter cloacae
tcacacaacgcccggccttgccgggcgtttttactggcagaagacttatcatatcggatggtgagcgacaatcagggagtgtgtgtgcagcacgatacctttgttgtaaaacaatcttttttgcagtggctgcataagcgtagcaatcccagtttgattgttaacctctgttttatcgttgtcctgattttttccactctcctgacctggcgcgaagttgtggtactggaagatgcttatatctccagcccagcgtaa

SEQ ID NO: 2951 - DNA, 519 bp, Enterobacter cloacae
gcgccgcggtcggtgctgttggttctgtggatcgtcgaaatctttttcgcccagcgccttatcccagccccgatcgataagaatttccgcgccatctttgtaatagcgcgccgacagcgtacgcgtcacgctgtcaggattaagcggattgaccatgccaaacccaaagccattgcctttggcctgatgctttttggcatagcgatagaggtatttccacagcaccggggtcagaatgaatttcgcatcgacggcgggctccagcagatcggccaccgtcgggcggcgcgccggatacagcgaaggcaaatcacgcagcgtaaaatcgcctttcaggttgagatcgcggcggaagcccaccagcacaatacgttcgcggtgctgtggcaggaagtgtttgccgtcgataattttcggatcgtccggccccatatcctctgcatccgccacgtcgtaacccagttcatccagcgtttgcatgataatgcggaaggttttgccgccgtcatgactctttaa

SEQ ID NO: 2952 - DNA, 648 bp, Enterobacter cloacae
attcttgacgttctccagcacaaaaattgccgggcggcgggcatcaataatccgggcaacgtcaaaaaacagtgtgccctgcgtatcacaggcaaagccgtgtgcgcgtcccagcgcgttctttttcgacacgccagccagcgagaacggctgacacggaaagcctgccagcagcacatcgtgcgccggaatggtattgcgaatgtgttcggcggcctcttcatcgctgacgccagttttgtggctcagcgtgacatcacgaatatccgcgttgaactggtgcgcgtcggggtcgcaataccagttggctttataggtacggacggcatgtttattccattcactggtgaagacacactgcccgccaatagcttcaaagccatggcgaatgccgccgataccggcaaagagatcgataaagcgaaaggcataattcggatgcgcagcaggaggacgcggcagcaggttgcgcagataacggaactcgccgtcgctcaggcggtgccctgccctgtcgcttatcagcaaccgcttgagtatcgccgggctccagtgactctcgccatgggccaccagctggtttgccagcgttttagcatcatacatttccagcagctgacgcaggagtgcctgcacggctgccgttga

SEQ ID NO: 2953 - DNA, 1179 bp, Enterobacter cloacae
agggaatatataatgaaaagaaaagttctggcaattctcgtacccgcgttattaatggctggcgcagcaaatgcagcggaaatgtataacaaaaacggcaacaaagttgacctgtacggtaaggttgatgcgcgtcataccttctccgacaacccaggcgacgacggcgatgaaacctatgtacaggtgggtttcaaaggcgaaacgcagatcacgaacgacctgacaggttacggccagtgggaatataaaacctacgctaacgataccgaaggcgcaggcgacacctcttttaaccgtctggcctttgctggcctgaaatacggcgaatatggctcattcgattatggccgtaattacggcgtcgtgtatgacgttgaagcctggacagatatgctgccggtatttggtggcgactcctatacctggaccgacaactatatggttggccgtactaacggtgtggcgacctaccgtaataatgacttcttcggtctggtcgacggcctgaactttgcgctgcaataccagggtgctaacgaaggtgctaacgcaaacgaaaatcaggaaggcaccaaaaacggtcatgatgatgttcgtttccagaacggcgacggcttcggtatgtctaccacctatgacttcgatttcggcctgacgctgggtgcggcttattcttcctctgaccgtactaacgaccaggtcgcttacggcgctggcacctataaccgcttcagcaaatatgctggcggtgaacgtgcggaagcgtggacaatcggcgctaaatacgatgctaatgatgtctacctggccatgatgtatgcggaaacccgtaacatgactccgtacggcaacggtggcatcgccaacaaaacccagaactttgaagccgtagcacagtaccagtttgacttcggtctgcgtccatccctggcgtgggtctattctaaaggcatcgatttgggtggtaacgattatcatccaggcaatggttatgactatgtagaccaggatctggttaactatatcgacgtgggcatgacctacagcttcaacaagaacttctccacctacgttgattataaaatcaacctgctggacgaagatgatgccttctacaatgacaacggtattgctaccgatgacatcgttggcatcggtatgatctaccagttctga

SEQ ID NO: 2954 - DNA, 1644 bp, Enterobacter cloacae
ccctttctttttcatcgcggagtgttaatgagcgatttgcagcctttccccccgacgcgcaagcgccctatgaagctgaatacgctggttacgctgatggtgtgcgcgattatcggctcggtgctgctggtggtcttcgcgctctactctgtgcagatcacccgcgccacgcgcgatgacgtgaaagataccgcgctgggtatcgcccggacgctggccgacagcccggagatcaagcgtggcctaatggaatcgccgcaggctggcatcatccagccgattgccgaggcggtgacgaagcgcaacgacctgctgtttaccgtggtcaccgacctgcgtgggatccgctattcccatccaaacgaagcgctgttaggtttgcattttattggcgacgatctgacgcccgccctggaagggaaagagaacgtctccgttaaccgcggtgcgctcgcggaagcgctgcgcgtctttacccccgtgtatgacgaccagcacgaccagatcggcgtggtggtggtgggtatttcgctgaataaagttgaagatcagattgcccgcgggcggctcaacgccgtgtggaccatcttattcagcgttctgatgagctcagtggcgatctggggtctggtccgggttctgaaacgtatcctctttgggctggagccttacgagatctcagccctctttgagcagcgccaggccatgttgcagtccctgcgcgaaggcgtgatggccgtggatatgcacgggcgcgtgacgatgattaaccacaccgccagagagattttgctcctgagctcgggtgagcactccgagagcagcggcgaaccactgctggccagcctgcgggaagtggcgaaaaccggcattgctcgccaggatcaggagatcggctgtaacggacggctactgctgtgcaacatggtccccgtgaaaagccagaatcaggtgatcggggcaatcagcaccttccgcgataagaccgaaatcagccagttaatgcagcgtatcgatggcatggtcaactatgttgatgccctgcgctcccatacgcatgagtttatgaacaagctgcacgtgatcctcggcctgctgcacatgaagcgctacgataagctggaggagtacatcatccagaccgcgcagaattatcagacggatatcggcgcgatacagcgcaaagttaaatcgccggtcattgcgggtttcctgctgggtaaaattaaccgcgccaaagaggccggagtgaccctgacgctggcggaggagagtcagcttcctgacaccgccaatgaagagcaggttgcggtgctgatcaccgtgctgggcaatttaatcgaaaatgccctggatgcgatggaaggccagccggaaggcgagatcggcctgctgctgcattatcagaacggctggctgagcggtgaggtcagcgatgacggtcccggtattgatcccgagcggctggaggctatttttacaaagggctactcaacaaaaggtgaaaaccgcggcgttgggctgttccttgcgcgtcagcagatccagaatctgggcggagatattaccgtcgagtctgaacctggcgtatttacccaattttttgttcagatcccctgggatagcgagaggaatatcgcgtga

SEQ ID NO: 2955 - DNA, 1455 bp, Enterobacter cloacae
gttattgttgaatatgtaaatactggtcaacgcattgtcattaatgcaccacacgcatcggtttatgcgctatttgcgcttattaatttccacttcctgatccagttttcagaaacagacgagcataacgtcgctataaaactggagataatcatggtttcctcaacctcacctgcaacggttcgtgcgaaagcgggcgcgattttccgcgtcacgtcgggcaactttcttgagcaattcgacttctttctgttcggcttttatgccacctacatcgcccatacttttttcccggcaagcagtgaatttgcgtcactgatgatgaccttcgccgtctttggcgcgggcttcctgatgcgtccgatcggggccattgtgctgggggcttacattgataaagtgggccgccgtaaagggctgatcgtcaccctgtcgattatggccgccggaacctttctgattgtgctgatcccttcttatcagagcattggcctgtgggcaccgctgctggtgctgaccggccgcctgttgcagggtttttcggcaggtgccgagctgggcggggtttcggtttatctggcggagatcgccacgccgggccgcaagggtttctataccagctggcagtcaggtagccagcaggtcgccattatgatcgcggcggcgatgggtttcgccctgaatgtggtgctggaagagagtgccattcgcgaatgggggtggcgtattccgttcctgtttggctgtctgattgtgccgttcatctttttcctgcgccgcaagctcgaagagaccgaggaattcagcgcccgtcgccaccatctggcgatgcgtcaggtcttcacaacgctgctcgccaactggccggtcgtcgtcgcgggcatgctgatggtggcgatgaccaccaccgcgttttacctgatcaccgtttacgcgccgaccttcggtaaaaaagtcctgatgctcagcgcgtcggacagtcttctggtcacgctgctggtggcggtgtccaacttcatctggctgccggtgggcggcgcgctgtcggatcgcttcgggcgtaaaccggtgctgatcgccatgacgctgctggcgctggcaaccagctatccggcgctgacgatgctggcggcagctccgagcttctcaatgatgctgaccgtgctgctgtggctctctttcctctacggtctgtataacggcgcgatgatcccggccctgactgagatcatgccagcagaggtgcgcgtggcgggcttctcgctggcttacagcctggcaacggcggtctttggcggtttcacgccggtgatttcgaccgccttaattgagtacaccggcgacaaagcctccccgggctactggatgagctttgccgccgtttgcgccctgctggcaacgctctatctctatcgtcgtcgcacgttaatcctgcaaactgccgttaaggagtga

SEQ ID NO: 2956 - DNA, 795 bp, Enterobacter cloacae
tccctcatgcttacattcagaacggtgattgccgccctgaccttcgccaccctcagcgcgggcgcgcttgcgcaggatgtgacggtgatgatttctggcggcttcaaagcggcgctggagaagctgacgccgcagtacgaagcgcaaagcggcgacaggctcattgtgatctccggcccgtcgatgggcaaaacgccgcaggccattccggcccggctcgcccggggcgaaaaagcggacgtggtgattatggtgggcgatgcgctggcgaaactggaacaggatcgcaggacggcggcgggctcccgcgtggagctggcggattcgcccgtcgggatggtcgtcaaagcgggcgcgccggtgccggatatcagtacggtgcctgccctgcggcaaacgctgctgaaggcgcattccatggcttattccgacagcgccagcggccggtatgttgagagccagctgttccgtaagctgggcatagacggccaggtccacgataaagcgcaccgggttgagcgtatcccggtggcgtctgaagtggcaaaagggaaatacgacctcggctttcagcaggtgagcgagcttctgccggtcccgggggtgacgtttgtcggtaagttgcctgacgacattcaatacattacccgtttcgccggagccgtaacgcagaaggccgaccatcctgaacagggaaaagcgctgctgacttttctcgcctcgccacaggccgccagcgtcattacggcaacgggcttaacgcccgtcagtgcacctcgcgatactgctcggtaa

SEQ ID NO: 2957 - DNA, 837 bp, Enterobacter cloacae
cctttccattttgttcacgtgcgagtaacgagcaaagcgatgattaagtggccctggaaaacgaacgacgctggtcgaaatatggcgctcccctgggatgaggctctggcgatccccgtgctggcgaatctcttgcctgaagagcaatcaaagctgattcagctggccgagcgttttttacagcaaaaacggctggtaccgctacagggcttcgaactggatccgcttaaaaattcgcgcatcgccctgctcttctgcttgccggtgctggagctgggtatcgaatggctggatggcttccacgaagtgctgatctacccggcaccgttcatcgtcgatgatgagtgggaggatgacatcgggctggtgcacaaccagcgtatggtgcagtccgggcagagctggcagcaagggccaatcatcctcaactggctggatattcaagactcgttcgatgcctcgggcttcaacctgatcattcacgaagtggcgcataagctggatacccgtaacggcgatcgcgccagcggcgtgccgctgatcccgctgcgtgaagtcgcgggatgggagcacgacctgcacgcggcgatggaaaacattcaggatgagatcgacctggtgggtgaaagcgcggccagcattgatgcctacgccgcgaccgatcccgccgagtgctttgcggtgctgtccgagtatttctttagcgcacctgagctttttgccccgcgcttcccggcgctatggcagcgtttttgccagttttatcagcaggatccactccagcgtctgcggcaaagtgaggacgcagccagcacatcctctcatccgttccactaa

SEQ ID NO: 2958 - DNA, 1752 bp, Enterobacter cloacae
ggtacaactatgcgtactctgctccgctccgccggtacagatgttgcggcccagtgttttttgaacgcgctgctgcgcgaaacgaaggactggcactatcttcccgcaacccgtgcggatgagttatcactgattcatatcccgctctccccaacccaggccattcgggttccggtacgctatttctcccccacacagcatcaccagtatcttttcccggcaacgctgattcaggccgacagcgacggcggtgacacggtcacattccatcaactgattgatttaattattgaaaaagagacggttaaaggcgctctggatgccgatacgctggctcgctttaagcagcgcgtcctggaaagccatacacacacctggcaggccattgatttacgccacaactgggcaaacctgcgcgataagccgctgacctttgccgaagcggaacaggcgctgctggtcggccatgcttttcatcctgccccaaagtcgcacgagccgtttaacgaggccgaggcgcgtcgctatctgccggatttcgcctcccgcttcccgctgcgctggtttgcggttgagcatgagctgattaccggcgacagcctgaatgtctccctgcgggaacgtctgctgcgctttgcagcgcagagcgcgccggctcttctcggtcacttcaccgacacctgctggctactgccgatgcacccgtggcaggccgactatctgctggagcaggactggtgccagcgtctggtagaaaaaggcgccctgcgcgatctgggcgaagccggtgcgccatggctacccaccagctcttcccgctcgctgtacagtgaaaccaacagcgacatgattaagttttccctgagcgtgcgcctaaccaactccgtgcgcacgctgtcggtgaaagaggttaagcgcggcatgcgcctggcgcggctggcgaaaacggcacgctggcaagggctccaggcgcgctacccgaccatgcgcgtgatgcaggaggacggctgggcggggctgcgcgatgagcacggcgtcattcaggaagagagcctgatggccctgcgcgtcaatctgctgttcgatacccctgaaacgcaaaccaacgtgctggtgagcctgacccaggccgcgccggacggcggcgacagtctgctcgccgcggcggtgcgtcgtctgagccagcgtctggacttacccctcgcccaggccgcgcgctgctggctggatgcctactgcgaccgcgtattgcttccgctgttcagcgccgaggcggactacggtctggtcctgctggcgcaccagcaaaatatcctcgttgagatgcagcaggatttccccgttggactgatctaccgtgactgccagggcagcgcctggaccgaaggggccgacgcgtggctgaatgaggcaggtgaaaccgaagttgaaaaccgcttcggtgagagccagctgctgcgctacttcccttattacctgctgctgaactctacccttgccgtcaccgccgcgctcgccgctgccggtttcgacagcgaagagaacctgatgtcccgcgtgcgtgacgcgctggccgaactgcgcacgacggcgaagcagacccgctgccttgattatgtgctcgacagcccgacctggaactgtaaaggcaacttcttctgctatctgcacgatcgcaacgaaaacaccatcgtcgatccggcggtgatctatttcgacttcagcaacccgttttataaggagaaggcgtga

SEQ ID NO: 2959 - DNA, 705 bp, Enterobacter cloacae
ccctctttttctggcctcccgggagtcagcgcaatgaaaacctatgatttcatcggcattggtatcggtccgttcaacctcagtattgccgcgctggcggaggggctggacggttttagctcgctgtttcttgaacgcaagccgcacttctcctggcacccggggatgatggtgccggactgccatatgcagaccagcttcctgaaggatctggtcagcgccgtagagccaaccaaccgccacagcttcctgaactacctggtacagcgcaaaaagttctaccgtttcctcaccaccgagcagcgcaccgtgtcgcgcgaggagtttgccgactacctgtgctgggcggcggataacctcaccaacctggccttcagccagcaggtacagcaggtcagctttgatgagcaaaacggcctgtttgagattgtgacccagcgggatcgcttcctggcgcggcacgtctgcgtggggattgggaagcagatcaatctgccagactgcgtcaccgcgcaggacgatacctgcttccacgccagcgaaatgatgctgcgcacgccggatttagcgggcaagcgcgtcaccgtcgtcggcggcggccagagcggtgcggatctgttcctgaatatcttccgtggggaatggggccagccgctgagcctcaactgggtgtcgcgccgccaacaactacaacgcgttggatga

SEQ ID NO: 2960 - DNA, 555 bp, Enterobacter cloacae
cctccgaaggggatcaccaccgagtccttgctggggatataccgcgccatgtaccaccgtttcgaagtgctgcgtgaaaaaccctgggcgcacctgatgccgtcccgctcggtgacggcgctgacgcgccaggaaaccggacctcgcctcagcatccagcatcacctggacggcgggcgcgaacagcttgaaagcgacgtggtgattttcgccaccggctaccgcgccgtgcagcctgcttttctcgccccgctctcttcccgactgcgtctggatgaggatgaagccttctgcatcaacaacgattttacccttgaatgggacggcccgcagagcaaccgcctgtttgccgtgaatgccgggatgcaccgtctcggtattgccgaaccccagctcagcctgatggcctggcgcgcggcgcgaattttgaatcgcgctcacgatgacgagccgtttgagctggcaaccacccccggcgtgatccactggcggagcaccaccagcccggagagcagccaggtttttaaatcattaataaagaccaccgagtactga

SEQ ID NO: 2961 - DNA, 921 bp, Enterobacter cloacae
gggactatgcgttttcggcatttattaccgctcattggagcactcttttctctttatatcatctggggatccacctattttgtcattcgtataggcgtggaaagctggcccccgctgatgatggccggtattcgtttccttacggccggcgtgctgctgatggcatttttattgctgcgcggccacaggctaccgccgctgcgtcccttgcttaacgccgccctgattggcctgctgctgctggcggtgggcaatggcgcggtaaccgtcgccgagcaccagaacgtaccgtcgggcatcgccgccgtggtcgtcgcgaccgtgccgctgtttacgctctgctttagtcgtctcttcgggatccgcacccgtaagctcgaatggctgggcatcgcgattgggcttgtgggtatcatcctgctgaacagcggcggtaacctgagcgggaacccctgggctgccgttctgatcatgatcggctccatgagctgggccttcggctcggtctacggttcccgcatcgagctgccttccgggatgatggcgggtgccattgagatgctcgcggcaggcattgtgctgctgatggcctccgcgttgacgggtgaaaaactgacggcgatgccagacctttcaggtttcctggccgtcgggtatctggcgctgtttggctccattatcgctatcaatgcctatatgtacctgattcgcaacgtctcaccggcggttgccaccagctacgcctacgttaacccggtggtggccgtgctgctgggtaccggttttgcgggcgaagtgctgtcgacgattgaatggctggcgctgggcgtgattgtctttgccgtggtgctggtcacgctgggtaaatatttgctgcccgcgaaaccgattgttacgaggtgtgaggtggagaaaccgtga

SEQ ID NO: 2962 - DNA, 1569 bp, Enterobacter cloacae
agcaatcgaatttgtgttttcgctgtacgacgaatttttgacaacttaagacgtgaaactatgaaaacaaaaactgctgtaacgcctcctgcggcgaatctggcatcaaatggaacagcaaaacgcctgctgatgatggccctgcccgtcattgttgccgtcctgctgttgtttgttcccgttccggacgggctgccgccttatgcgtggcactacttcgccatctttgtcggcgtcatcgtcgggttaattttcgaaccgctgccgggcgccgtgatcggcctcaccggcgtggtggcgattgcgctgtgcagccagtgggtgctctttagcccggaacagctggctgacccaaaattcaagctggcgggcgcctcctttaaatgggcggtcagcgggtttggtaactccaccgtgtggctgatcttcggtgcctttatgtttgctgcgggctacgacaaaacccgcttcggtcgccgcctggcgctgatactggtgaaatatctgggccgtcgcagcctgacgctcggttacgccattacgtttgcggacctgcttctggccccgtttaccccgtccaataccgcgcgcagcggtgggaccatctacccgatcatcgccaacctgccgccgctgtacggttcaaaacccaacgacccaagcgcgcgtaaaatcggttcgtatctgatgtgggtggcaattaccgcggcctgtatcaccagctcgatgttcctttccgctctggcgcctaacctgctggcgctggcgctggtaaaaagtacggtcggaattgatatctcatgggggacctggttcctcgccttcctgccgctgggtattctgctgatcctgaccatgccgctgctggcttactggttctacccgccggaagtgaaggtaaacaacgaagtaccgttgtgggcgacccgtgaactggaaaaactgggcaaactgtcgcgcaatgagatcctgctgctggtgttcgtgtgctgtgcgctgctgatgtggatcttcgccgcggcgtggattgaaccggccatggctgccctgctgatcgttggcctgatgctgtggaccggcgtgctggagtggaacgatatcaccggtaacaaagccgcgtggaacaccttcgtctggttcgccaccctggtggcgctggcggacggcctctcctccaccggctttatcagctggctgggtaaagaaggcggcctgctgatgagcggtatctctccgggtgtcgccaccatcgtgctgctgctggcgttctacctgctgcactacctgtttgccagcaccaccgcgcacaccacggcgctgctgccggcgatgctgaccatcgcctccaccattccgggcatgaatatggaagtgttcgtcctgctgatggtgacctctctgggcgtgatggggatcatcaccccctacggtacgggtccaagcccgatttactacggtagcggttacctgccaaccaaagactactggcgcctcggcaccatcttcggcgccatcttcctggcggccctgctgctgattggctacccgtggatgtccatgatgttctga

SEQ ID NO: 2963 - DNA, 1329 bp, Enterobacter cloacae
actgaagtccttcctgagccaaacgtgataaatatgaaaatcaaaacaaaccgcacactgctcgcggcgctggttatcagcagcctgctctcgcccgccgtcatggcggcctgcaacggtaccgacctcacgacctgtccggcgcctttcgatgccagactcccagacgcacataccatgctcacctggagccaggccgatcgcgtggtgggctttcgcaatgactaccgcaactacgcgggcgatgtgttccgccacggcaacgctacgccactgctgcccgcagaaaaaccgctcaccgatgcccgctatcaggtgaagggtaagatttacaatcttcaggattacctgaaacgccagaacgtcagcggcatgctggtgctgaaaaatggcaaagtggcctataaatatctgggagaaggcaataccgactctacgctctggacgtcgcgttccgtgggcaaatccgtggtctccgcgctggtgggtgttgcgattaaagaagggaaaatccactccctggacgaccttgtcacccaatacgaaccggatttaaaaggcaccgcctgggagggcgtaacgctgaaacagctcatcacccacacctcgggcgtggcgtggactgaagattacaccaacgcgcaatctgacttcgcccggcttaccgaatgcgaagcgaaaccgggcacctacgactgtgtgcgcaccctggtgaaggggttacaccgtgaacacccggcgggcgaaaactggtcctattcctcgggtggtgcctggctgttaggcgatgtgcttgagcgcgccaccggcatgacgctcgcggcgtatctggagaaaagcatctggcagccgtacggtatggcgagcgacggcgtgtggcatgcctacagcaaaggccagcacgacgtgggtgcgcatgggttcaacgccacgctggaagactgggggcgtttcggggagtttatcctgcataacggtaccctgccggacggaaagcagatcctccccgagggctgggtgaaacagtcctcagcctggacacaggccaaaggatcggtgtccgaggcgcatccgaaggggttgtacggctaccagtggtggaacaatgaagtgccagccaccgccacaaatgtggagccgaaagtcgaaaattcgctgaaggattccctgtgggcgctgggtatttttgggcagatgatcatggttaatcataaagaaaatctggttatcgtccagtggtccacctggccgcaggcagagccgtcattcagcgcccagccgctggaagcgtcgctgatgtttagcgcgattgcgaacgcgctgcgctga

SEQ ID NO: 2964 - DNA, 1908 bp, Enterobacter cloacae
accgcgcacggcgcgcattgtggcggaaccgcgcttcgacaaccagcgtctgttccgccatctggcgtccgccggtttcgacacggtgaaagagttcgacttcccgcacaaacgctcccgcctcatcatgagcgagcgtcatcgcttcttccacgaggtggaactgtgaacgcactctggcagaaagtgaaccgcgagatggtggcgaagatcctcgccgaactggaatatgaacgcaccctgcgcgccgagccggattcggcggactactggcgcattagtatgggcaacgcgtgctggcagtttcgcgccacgcgtgggatctggggctggctgcatattgaccctgataccctgaccaccaccagcggcgcggcggtcgaagcggaaaacgcgctgctgcaactggccaccgtactggagatgagcgacgcgcaaacagcggagcacatggaagatctctacgccacgctgcggggcgacatgcagctgttgcaggcgcgtgaaacgctggatgccgatgcgctgatccaccttgacccggacgagctacagtgcctgatgcgcggtcacccgaagtttattttcaataagggacgccgcggctgggggctggatgccctgcgcctgtacgcgccggaatatcgcgggcgttttcgcctgcactgggtcgccgtgcagcgcgatcgtctggtctggagcagcgacgccgattgcgatattaacgccctgctctccagcgccatggacgatgccgagcgcgagcggttcgacgcccgctggcaggagctggatctggatgatagctggctgccggtgccgctgcacccgtggcaatggcagcaaaaaattgccattcatttcctggcgcagctcgcacgcggtgaaatggtggagctgggtgagttcggcgatgagtatctggcgcagcagtccctgcgcacgctgaccaacgccagccgtcgcacgccgtatgacatcaagctgccgctgaccatctacaacacctcctgctatcgcggtattccgggcaagtatattgccgccggtccgctggcctcgcgctggctacagcagcagtttgccagcgatgccacgctgattcgctccggggcgcaggtgcttggcgaacccgctgccggatatctgtcgcatccgggttatgccgcattgcctgaggcgccgtaccgctatcaggagatgctgggggtgatctggcgcgagaacccatcctgctatttacaggatggtgaacaggcggtgctgatggcggcgctgatggaaaccgataatcaggggcgcccgctgattgacgcatggatcaaacgctcggggttaaccgctgacgcatggctggaaaagctgtttgaggcgacggtgatccccttctatcacctgctctgtcgctacggggtggcgctcatcgcccacggccagaacgtcacgctggtgatgaaagattacgttccgcagcgcattttgctgaaggatttccagggcgatatgcgcctggtggatgaagatttcccgcaggcgcagagcctgccggagcaggtaaaagcggtgacggcgcgcctcagcgcggattacatcatccacgacctgcaaaccggcaactttgtcacggtgctgcgctttatatcccgcctcaccctgcaatgcggcgtgaatgaaacccgcttctatcagatcctggcgctggtgttacatcgttatatggccgcccatccggatcttgcggcgcgcttcgcgaagttcgacctgtttaagccgcagattattcgcgtgatcctcaacccggtcaaactgaccttctctgaacacgacggcggcagccgcatgctgccgaactacgtctgcgatcttgataaccctctttttctggcctcccgggagtcagcgcaatga

SEQ ID NO: 2965 - DNA, 282 bp, Enterobacter cloacae
aatgttatggcgcttcctgcaaggccaggcgaacaaacccgttattctgcgccagcaattcatgcgctttccaggcattcagacccgtcagcaccatcagtaccgccgttttgcactggtggttacagctttccagcgcggccttcgcctgcgcccggctacatccccccgcttccatcacaatggcaatttgtcgttcggcccatctggtgttgcttgcctccagatcaacgcgcaggttgctgtacacccgtcctgtccgtaccgccagaccggtggtga

SEQ ID NO: 2966 - DNA, 735 bp, Enterobacter cloacae
cgagaggaatatcgcgtgataaatgtgttaattgtcgatgatgacgccatggtagccgacctcaaccgtctgtatgttaaccgcgttgagggttttagctgctgcggcgtcgcttccacgctcaaccaggccgaggcgttgatcgccaacccaggccagccgatcgatctggtgctgctggatgtctatatgcagcaggataacgggctggatctgctccccatcattcgcgcgtcgggtcgcccgattgacgtcatcatgatctcgtcggcctccgacgccgcaacaatccagacgtccatgcactatggcgtggtggattacctgattaaaccgttccagttcccgcgttttgaagaggcgctgaacggctggaaggcaaagcgcagcctgatgggatcgcatcagtattatgaacaggccgacgtcgacaggctgatccacggcggcgcgccggagctggctgacagcaaaaaattacctaaaggcctaacgccgcagacgctgcgcaccatttgccagtggatcgacagccatccggagatagaattttccaccgacgatctggcgaatgcggtcaacatttcccgcgtctcctgccgcaaatacctgatctggctggcgcaaattaatatcctgttcaccagcattcattacggcgctaccggccgaccggtatatcgctaccgtttgcagccggaacaggtcggactgctcaagcagtactgccagtaa

SEQ ID NO: 2967 - DNA, 1695 bp, Enterobacter cloacae
ccgccggacatatcctccggcggttttatttttgtggagcaagctatgtcaaacaaaccctttatttaccagaaccccttccctctcgcgcatgacgacaccgaatactatctgctgaccaaagagcatgtctccgttgccgagttcgatggtcaggaagtgctgaaagtggagccggaagccctgaccctgctggcgcagcaggctttccatgacgccgcgtttatgctgcgtccgtctcatcagaagcaggttgccgccattcttaacgatccggaagccagccagaacgataagtacgttgccctgcaattcctgcgcaactccgaaattgcggcgaaaggcgtgctgcccacctgtcaggataccggtacggcaatcattatgggtaagaaaggccagcgcgtctggaccggcggcggcgacgaagcggcgctgagtcagggcgtgtataacacctatattgaagacaacctgcgctactcacagaacgcggcgctggatatgtataaagaggtgaataccggcaccaacctgcccgcgcagatcgacctctacagcgttgatggtgacgagtataaattcctgtgcatggcgaaaggcggcggttccgccaacaaaacttatctgtatcaggaaaccaaagcgctgatcaccccggcgaagctgaaaaaatatctggttgagaagatgcggaccctgggcaccgcggcctgcccgccttaccatatcgccttcgttatcggcggcacctctgcggaagccacgctgaaaaccgtcaagctcgcctctgcgcgctactacgatggcctgccaaccgaaggcaacgcgcacggccaggcgttccgcgacgtccagctcgagcaggaactgcttcaggaagcgcaaaacctcggcctgggcgcgcagtttggcgggaaatacttcgcgcacgatattcgcgtaatccgtctgccgcgccacggcgcctcctgcccgatcggcatgggcgtctcctgctccgctgaccgcaacatcaaggcgaagattaaccgcgaggggatctggattgagaagctggagcacaatccgggccagtatattcctgaatccctgcgccagcagggagaaggcgacgtggtaagcattgatctgaacaagccgatgcccgacattctggcgcagctttccgcgcaccctgtctccacccgcctgtcgctgaacggcaccattattgtggcgcgcgacatcgcccatgcgaagctgaaagagctgctcgacaacggggaagaactgccgcagtacgttaaagatcacccgatttactatgcaggcccggcgaaaacgccagaaggttacgcgtctggctccttaggcccgaccaccgccgggcgtatggactcctatgtagacttactgcaatccaacggtgcgagcatgatcatgctggccaaaggtaaccgcagccagcaggtcaccgacgcctgccataagcacggcggcttctacctcggcagcattggcggcccggcggcggtactggcgcaaaacagcatcaagagtctggagtgcgtggcgtatcctgaactgggaatggaagccatctggaaaattgaagtggagaacttcccggcgtttatcctggtggatgacaaaggcaacgacttcttccaggagatccagaataaacagtgcaaagggtgctcacagcgctga

SEQ ID NO: 2968 - DNA, 960 bp, Enterobacter cloacae
ggagaaggcgtgatggcaaacgcgaatatcgtccattccggctacggctttcgctgcacggtcacggaacaaaacctgccgctgacgctgggtctcgacggcagcgcggtgatggagcggctgatcgggctcccggacggctggctggtggacgccctcgaccagctgtttgttgccgcgcccgccctgaccggcattaccctgccgtgggcagcctggcaggatgaacctcaggcgcaggcgctgtttagcctcgttcacggagattatctggcgcgtgaaattttctggcagctgccgctgtggctgaaaggcgaacgcccgcaggcgagcggcggaatgcagtttgacgaaagccgtcagctgtacttcccgctgcgccctcaccgcccacagggcgaggtgtatcgccgttacgatccgcagattaagcgcaccctgagcttccgcgtggcggacgtggcgctggacggcgagcgttttacccgctggatgaacaccccacgcgtgaacgctttctgggagatggccggcccgcaggccgagcaggagaactacctgcgtcgccagctcgactcgacctattgctatccggtgctcggctgctttgacgatcagccattcggctattttgaactctactgggcggcggaagaccgcattggccgccactatcgctggcagccctttgaccgcgggctgcatatgctggtgggcgaagagaactggcgcggagcgcagtatatccgcagctggctgcgcggcctgagccactatctgtatctcgatgaaccgcgcacggcgcgcattgtggcggaaccgcgcttcgacaaccagcgtctgttccgccatctggcgtccgccggtttcgacacggtgaaagagttcgacttcccgcacaaacgctcccgcctcatcatgagcgagcgtcatcgcttcttccacgaggtggaactgtga

SEQ ID NO: 2969 - DNA, 459 bp, Enterobacter cloacae
gattgtgacccagcgggatcgcttcctggcgcggcacgtctgcgtggggattgggaagcagatcaatctgccagactgcgtcaccgcgcaggacgatacctgcttccacgccagcgaaatgatgctgcgcacgccggatttagcgggcaagcgcgtcaccgtcgtcggcggcggccagagcggtgcggatctgttcctgaatatcttccgtggggaatggggccagccgctgagcctcaactgggtgtcgcgccgccaacaactacaacgcgttggatgaagccgggtttgctaacgattattttcacgccagagtatgtggacagtttctcgaccttcggtgacgacgccggaagtcagatgttgcaggagcagaaaatgacctccgaaggggatcaccaccgagtccttgctggggatataccgcgccatgtaccaccgtttcgaagtgctgcgtga

SEQ ID NO: 2970 - DNA, 1221 bp, Enterobacter cloacae
atcattaataaagaccaccgagtactgacacacacattcaggatcaacataacaatgaaacgttctcatctttgggttttaaatccgtgcttgcttgccatgctttctacctctgcgtgggcggaagaacaaaaggaagaagatattgtggtctccgccagccgggcacatcgcagcgtggcagagatggcgcaaaccacctgggttattgagcgggcggaaattgagcagcaggttcagggcgggaaagagattaaagacgtgctggcccagctgatccccggcatggacgtcagcagccagggacgtaccaactacggcatgaacctgcgcggtcgctccatgatggtgatggtggacggcgtacgtctgaactcgtcccgcagcgacagccgccagctcgactctatcgatccgttcaacattgaccgcatcgaagtgatctccggcgccacctcgctgtacggcggcggcagtaccggcgggctggtgaacatcgtcaccaaaaaaggccagccggagaccgaagtggagttccagaccggggcaaaaagcgggtttaacagccataacgaccatgatgagaacgtctccgcagccgtgagcggcggcaatgacaacgcctctggccgtctgtcggtctcctatcagcgctacggcggctggtatgacggcaacggcgacgaggtgattatcgataacacccagaccggcttgcagtattccgaccgtatcgacgtgatggggacaggcaccatcaacatcgacgatcatcagcagctccagttaaccacgcagtactacaagagcgaatctgacggcaagcacggcctgttccttggggagaatttcgctgcggtcacgggcgatgccaaagcctataacaaagacaacctgaactctgaccgtatcccgggcacagagcgtcacctgatcaacctgcaatactcgaacaccgatttctggggtcaggatctggttgcgcagatttactaccgtgatgagagtctgacctactacccgttcccgacgctgagcaaaggcgcggtgaccagcattggcgcgtcccagcagaaaaccgatttttacggcggcaagctgacgctgaacagcaagccgatggacgacctgaccctcacctggggcgtggatgccgaccatgaaacgttcgatgccaaccagcagtttttcgacttaagcaaagcggcggcgagccgcggg

SEQ ID NO: 2971 - DNA, 714 bp, Enterobacter cloacae
atactgaggctgtatttatctctggagaaggtggaaaagaagagcgacactatagagagtacagtctctttccaggttaacgctatgtcttctgacaaaccatcgcatcgcggatctccctatgctcaggaactgatttctcatttacagccgcactgcaccacgcataaaaccgatcccggcgagcaacttaatctccaggtaaacgggcagagcatgtgttatttaattcttgacggcacggtcgccatatacagaagaagcgacgacatgatgctttcgacggcgcgcagtcccgccctgtttggcctcgctaacctgacggacatctattttaccgactaccttcgaacggtaacgccttgcctgattggtgtgctcacgaccgatcgggtggctgaaattatcaaagagaaggcgctgtgggggctgctttctaatcatctgatgtttgtctataaccggctttatcacaacgtcatgccgaaaggcgcgccaaccgcgtacgagatgattcgccagcagctcgtgctgctgatgcaggaagatgacagctaccgacgtagcgtgacggcggaaaggtatatcagggataaaacccagctttcccgcagcggcgtaatgcggatcctggctgacctgaaaacgggcgggttcatcgaaatggaagaaggccggctgattaaaattaataaactgcctgccagatactga

SEQ ID NO: 2972 - DNA, 207 bp, Enterobacter cloacae
ttgttatttataaacattatgtcaccgaccgataacagcgcggcaacgccaacaaaaacacacacagcgccgtcccctgctcccaccgatcgccgaatcgacagtaaaagcctgttgggtgaggagggacgggtcattatcgagcatgacggccagcactacctgctgcgccagaccaatgccggaaaactgatcctgactaaataa

SEQ ID NO: 2973 - DNA, 1197 bp, Enterobacter cloacae
aggtcagcagcagttcaaaggcatcaccaccaccctcgtgctggggaacgccttcgacaaagcctactggtcaccgcagggcatcccgcaggatggccgcaacggcaagatcttcgtcagttatcaatggtaattcccttcggggcaacgattcagaaggataagattatgggtcactacacacgctggcttgagcttaaagaagaacatccgggtaagtacgcccgtgatatcgccggattaatgcacatcagcgaagcagagctggcatttgcgcgtgttggacacgacgcctggcggctgcgcggtgaaatccgtgagattctggcggcgctggagtcggtgggggaaaccaaatgcatctgccgtaacgaatacgccgttcatgaacagatcggagcgtttactaaccagcacctcggcggccacgccgggctggtgctaaatccgcgtgcgctggatctgcgtttgttcctcaaccagtgggcgagcgcgtttcacataagtgaaacgacctcccgcggcgaacgtcagagcattcagttcttcgatcatcagggcgacgctttacttaaggtctacaccacggatcacaccgacgttgccgcctggggcgacgtgctgacccgttttatcattgccgataaccccgctctggcgctaaaggctgtcgaggcccctgcgcattccgacggtgctgatgcaggctcggtggagaaagagtggcgcgccatgaccgacgtgcatcagttctttagcttactgaagcgccataacctgagccgccagcaggcgtttcgtctggtgagtgacgatctggcctgtaaggtggataacagcgcgctggcacagctgctggagacggcgcgacaggacagaaacgaaatcatgatcttcgtcggcaaccgcggctgcgtgcagattttcaccggtgtggtggaaaaactgacgcccatgaaaggctggctgaacatcttcaacccaacctttaccctgcatctgctggaggagactatcgccgagacgtgggtaacgcgtaaacctacggcggacggacacgttaccagcctggagctgtttgctgcggatggcactcagatcgcccagctctatgggcagcgtaccgaaggcgagcctgagcagagccggtggcgtcgccagattgacgccctgacgccggaagggctggcggcatga

SEQ ID NO: 2974 - DNA, 684 bp, Enterobacter cloacae
tcgcatcagtcagtgaggtctcaaatgaatacccgattcgcgcctgagtcagaaattgataaatcaacagtgctcggcgctaagccttttaagcacattgaaaaaataatcgataatgttttgccgcatgcggagagaggcattattgccagaggagaaattatccattattgctccggcgatacccgtcaatgctttttactgttgcatggcagcgtggcgttgcaccgtcgcggggacggtatcgtcttaaattctgaatctgcgccatttatactcggcgtgagcagccagttatcgtctgagcacctgtacgtcagagcgctggaaacctcagaggtggccagcgtttcgctggcgcgtttcaatcatgttgtcgcacaacagaatttatgggagcacttctcaaacctgctgatctataccgcatcgcgcgtttacgaacattgcgcccagatatcgcaaatgtcggcttatgacattatccgctttcagctggttgagttgatgcaggagcctgaagccattatacaaaacattaccgccgcagcctatatcaaaagccgcacctatctttcacgcagcggcattatgcggatcctcgcggagttgcggacggggaaatacatcaccatggagcgtggcgttctagtagagatccatcacttaccccgtaaatactga

SEQ ID NO: 2975 - DNA, 2067 bp, Enterobacter cloacae
ctaaataaaccagacaacacattcgccagccacccaggtgatccccaggcagccagcgcttttcaattcttatggagagttgctatgccacacctgcaatccgcgtctttacgcccgtctcttctggcgctggcgattgtcagcaccctgccgggcgttacgtttgccgctgcagacgagatcaccgtcaccgccaccggcaatgcccgcagcgcctttgaagcccccatgatggtgagcgtgattgacgccaccgcgccggaaaaccagaccgccagctccgctgccgacctgctgcgcaaggtgcccggtctgacgctggacggcaccgggcgcaccaacggtcaggacgttaacctccgtggctatgaccgccgtggcgtgctggtgctggtggatggcgtgcgccagggcaccgataccggacacctgaacagcacgttcctcgatccggcgctgatcaaacgtatcgaagtggtgcgcggcccttccgccttgctgtacggcagcggcgcgctgggcggcgtaatttcgtatgacaccgtcgacgccagcgatctgctggatgcaggtaaaaacagcggctatcgcgtatttgctaccggtgcaacgggcgatcacagcatcgggatgggcgccagcgcctatggccgcaccgataccctggacggcctggtctcatggtccagccgcgatcgcggcgacattcgccagagtgacggcgcgagggcgccaaacgacgaatccatcaacaatatgctggcgaaaggcagctggaaaatcgatccggcgcagacgctgagcggctccctgcgctactacaacaacgacgcgcaggagccgaaaaatccgcagaccacggatgccagcagcagtaacccgatgaccgatcgttccaccattcagcgcgatgcccagcttggctaccgcattgcgccagccggaaacaactggctcaacgccgatgcgaaaatttactggtccgaagcgaggatcaacgcccagaacatcgacgccagcggcgagttccttaagcagaccaccaaaggcggaaaagtcgaaaaccgcacccgcctgttcagcgactccttcgcctcgcacctgctgacctacggcggggaatactatcgtcaggagcaacaccctggcggcgcgaccaccggcttcccggacgctaaaatcgacttcagctccggctggttgcaggatgagattaccctgcgcgacctgccggtaacgcttctcggcgggacgcgttacgacaactaccgcggcagcagcagcggttacgatgacgtggatgcggataagtggtcatcacgcgccgggttaaccgtgagtccagccgactggctgatgctgttcggctcttacgcccaggccttccgcgcgccaacgatgggcgagatgtataacgactcgaagcacttctctatcggcagcttctacaccaactactgggtgccgaacccgaacctgcgtccggaaactaacgaaacccaggagttcggttttgggctacgttttgacgatctgctgctcgccaacgacgcgctggagttcaaagccagctacttcgacaccaaagcgaaagattacatctccactaccgtcgattttgcggcggccaccaccatgtcctataacgtaccaaatgccaaaatctggggctgggacatgatggcaacctacgcgaccagcctgttcaacctggacgtggcctacaaccgcacgcgcgggaaagataccgacacgggcgaatacatctccagcatcaacccggacaccgtcaccagcaagctggatatcccggtggcgcaaagcggattctccgtgggctggatcggcaccttcgtcgaacgttcaacgcacatcagcagcagctacagcgagcagcctggctacgcagtgaatgatttctacgtcagctataaaggtcagcagcagttcaaaggcatcaccaccaccctcgtgctggggaacgccttcgacaaagcctactggtcaccgcagggcatcccgcaggatggccgcaacggcaagatcttcgtcagttatcaatggtaa

SEQ ID NO: 2976 - DNA, 1071 bp, Enterobacter cloacae
catggccctgctgggcttcagcgtccgcacgccgaaagccatacaacagctgcgtgccagagcggagcaactgccctgatgtcccggcgcatcacgttatcgttatggcttctggcggggtcgcttaccgtcatgacgatcatggctaccggttttggggcgttacgcctgccggtgaacgtgctgtggagcggcagcgatgagacgctacgccatatctggctcaccatccgtctgccccgcgtgctgctggcgctggtgattggcgggtcgctggcgctcgccggctgcgtcatgcaggggctgttccgcaatccgcttgccgacccgggcctgctcgggatcagcagcggtgcggcgctggccgtcgccctgtgggttgtgctcccgctcgcgctgcccgcgctggtgatgctttacgcccctatgctggcggcatttcttggggcgctggcagccacaggcgtgatcttcctgctcagcaagcagcatgacacctctctgtcacgtctgttgctggtgggtatcgccatcaatgccctgtgcggtgcggcagtgggtgtgctttcgtgggtcagcaatgacgcccagctgcgtcagctttcactctggggaatgggaagtcttggtcaggcacagtggtccacgctgctcgccgtgacctcgctgatggtgcctgccgctctggcgatctggcgctgtgccagtacgttaaatttactgcaactgggtgaagaggaagcgcattaccttggcgtggacgttgctcttgtacagcgaatattactgttatgcagcgccctgctggtcgctgcggctgtcgccgtcagcggcgtgattggctttgtcggactcgtggtgccgcacctgatgcgcatgtggttgggcgccgatcaccgggcaaccctccccggcacggtactcgcgggcgctttactgctgctggtggcggatacggtcgcgcgcaccatggtcgccccggcagaaatgccggtcggcctgctcaccagtatccttggcgctccctggttcttatggctcatttttcgtcgtggagaacagcatggctga

SEQ ID NO: 2977 - DNA, 1176 bp, Enterobacter cloacae
agagatgcggtttatattcccatcagccttgctggtgttcatttaaggaaagtttcgtttatggtcaatcttcgtcagcccagggatgtcgcgcagatactgctgtcggtgctgttcttagccattatgattattgcgtgtctgtggatcgttcgtcctttcgtgctcggatttgcctgggccgcgaccgtcgtcgtcgccacctggcctttactcttgcgtttgcagaaactgctgtttggtcgccgcggcctggccgtgctggtgatgacgttgctgttgttcctgctgtttattattcccattgcactactggttaacagcctggttgacagtagcggcccggttattcgcgcggtcaccagcggtgatatgacgctgccggatctcgcgtggctgaacagtattcctgttgtgggcgcaaaactgtacagcggctggcacagcctgctggagatgggcggtagcgccctgatggccaaagtgcgtccgtacatcggcacaaccaccacctggtttgtggggcaggctgcgcacatcggtcgcttcatgatgcactgtacgttgatgctggtcttcagcgccctgctgtactggcgcggcgagcaggttgcgctgggggtacgtcatttcgccacccgactggcaggtaaacgcggcgatgcggccgtgctgctggcagcccatgccgtccgcgcggtggcgctcggtgtggtggtcacagcgctggtgcaggctgtacttggcggaatcgggctggcgatttccggcgtaccttatgccaccattttcaccgtcgtcatgctgatgacctgtctggcgcagctcggtccgctgctggtgctggttccctgcattatctggctttactggacgggggatacgacctggggcacggtgctgctggtctggagttgcgtggtgggcaccatggataacgtgatccgtcccctcctcatccgcatgggcgctgacctgccgctgattctgatcctgtccggggtaatcggggggttaattgccttcggcatgattggcctgttcatcggtccggttctgctagcggtgacctggcgtctcttctccgcctgggtgcatgaagtaccgccgccgggaaccgatccagacgtcatcttaagcgaacttgaagagctggaagataagaacgcgcagtaa

SEQ ID NO: 2978 - DNA, 1059 bp, Enterobacter cloacae
attttcaacttttcggacagtttccccgcactcgataacccgatgattcctatagattccggcaaaaaccttagaaataaagccgctaatcgaaaaatgaaatctacttttcaggaaaatcaaaaacaccatttcattttaaattcagataagttctttgctgtgaaattaacttttttaatttatgctttcaggcaattacgtacgctattcagggtggataaaatggataatgctgtcgatcgccacgttttttatatttctgatgggacggcgattaccgccgaggtgctgggacacgcggtgatgtcgcagtttccggtatcgataaacagcatcacgctgccgttcgtggaaaatgagagccgggccaaagcggtcaaggaccagatcgacgctatttaccagcagaccggcgttcgtccgctggtgttctattccattgtgatccctgagatccgcaatatcattctgcaaagcgagggcttctgtcaggacatcgtgcaggcgctggttgcccccttgcaaagcgagctgaagctcgacccgacgccgatcgcccaccgtacccacgggctgaaccccggtaacctgaccaaatacgatgcgcgtattgccgctattgactacaccctggcgcacgacgacgggatctcgctgcgcaatctcgaccaggcgcaggtgattttgctcggcgtgtcgcgctgcggtaaaactcccaccagcctatacctggcaatgcagtttggcatccgcgccgccaactacccctttattgccgatgatatggataacctggtgctgcccgccgcgctcaagccgctccagcataagctgtttgggctgaccatcaacccggaacgactggcggcgatccgcgaagaacgtcgcgagaacagccgctacgcctcgatgcgccagtgccgaatggaagtctctgaagtcgaagcgctgtaccggaaaaatcaaattccctggctgaacagtaccaactattcagtagaagaaattgccaccaagatcctcgatatcatggggctaaatcgccgcatgtactaa

SEQ ID NO: 2979 - DNA, 1071 bp, Enterobacter cloacae
agcaaaaaatttctgagacattccatgaacaaaaccgacgaactgcgcaccgcgcgcattgatagcctggtcacaccggctgaactggcccggctgcatcccgtttccgccgaggtggcggaccatgtgacggcctcccgtcgccgcatcgaaaaaattctcaatggtgaagacaaacgtcttctggtggtgattggcccctgctccatccacgacctggacgcggcaatggattatgcacaacgccttcagacgctgcgcggcacgtatcaggatcgcctggagatcgtgatgcgtacctactttgaaaagccgcgtaccgtcgtgggctggaaaggattgatttccgatccggatctgaacggtagctaccgggtgaatcacggtattgcgctggcgcgcaagctgctgttacaggttaacaagctgggcgtgccgactgccaccgaatttctggatatggtgaccggacagtttattgccgacctcataagctggggcgcgattggcgcgcgtaccaccgaaagtcagatccaccgtgaaatggcgtcggcgctctcctgtccggtgggcttcaaaaacggaacggacggcaatacccgaattgccgtagatgccatccgcgcgtcacgcgccagccatatgttcctctccccggataaaaacggccagatgaccatctaccagaccagcggcaacccgttcggacatatcattatgcgtggcggtaaaaaaccgaattaccatgcagaagatattgccgccgcttgcgaaacgctggcggaatttgacctgcccgagcatctggtggtggatttcagccacggcaattgtcagaaacagcaccgccgccagctggacgtctgcgaggaagtttgccagcagatccgcagcggctcgaccgccattgcaggaattatggcggagagctttatcaaagaaggcacgcagaagatcgtcgccggacagcaaatggtctacggccagtcaatcaccgacccgtgcctgagctgggaagacagcgaacggctgctggagatgctggcgtctgcggtagattcgcgcttctaa

SEQ ID NO: 2980 - DNA, 846 bp, Enterobacter cloacae
cgccctgacgccggaagggctggcggcatgaaaaactggtttgccctgctctgtgccctgccgctggttgccgtcgccgcgccggagagaattgtcgccctcggcggcgacgtgacggagatcgtctacgccctcggcgcggagtcttctctggttgcgcgcgacagtaccagccagtggccgcaggcgacaaacgcgctgcctgacgtggggtatcttcgccagctgaatgcggaggggattttgtccgtacgcccgacgctggtgctggcaagcgaccaggcgcagccctctctggcgctgaagcaggttgaacagagccacgtccgggtggttaccgttcccggcacgcctgacctgcgcgcgattgacgaaaaagtacgggtgatagctcaggcgacgcatcatgaggcgcaaggggaaaccctgcgcagctcgctgcgtcaggcgctggcggcactgccctcaatgccgctcaacaagcgggtgctgtttatcctcagccacggcggaatgaccgcaatggcggccgggcaacagaccggcgcggatgcggcaatacgcgccgccgggttgcagaacgccatgcagggctttacccgctatcagccgctttcccaggagggggtgatggccagccagccggatctggtggtgatttcgcaggagggccttaacgcgctgggcggcgaagaaaatctgtggaaactgcccggtctggcgcaaacgccagcgggacgaagcaagcaggtgctggctattgatgacatggccctgctgggcttcagcgtccgcacgccgaaagccatacaacagctgcgtgccagagcggagcaactgccctga

SEQ ID NO: 2981 - DNA, 972 bp, Enterobacter cloacae
tgcgcatgtggttgggcgccgatcaccgggcaaccctccccggcacggtactcgcgggcgctttactgctgctggtggcggatacggtcgcgcgcaccatggtcgccccggcagaaatgccggtcggcctgctcaccagtatccttggcgctccctggttcttatggctcatttttcgtcgtggagaacagcatggctgaacgttatacggctgaaaatctgacttttacccggtctggccgcacgctgacagataacgtttcgctgtcactgtcgcagggagagctggttacattgatcggccccaacggcgcggggaaatccacgctgctgcggctgctgaccggctatctgaaacccgacagcggaggctgttcgctggcgggaaaagcgctggatgaatggcatccgcaggtgctgtcgcgctatcgggcggtgatgcgccagcaatctcagcctgaatttgactggcaggtggaggagatcgttggaatggggcgtgcgccctggacgcgtcacccggaaccgtcaattgtgcgtgaggtattgcagctgaccggttgcctgccgctggccggcaggcgctatcatgccctctcggggggcgagcagcagcgcgtccagctcgcccgcgcgctggcgcagctgtggcgtgacggaacgccacgcggctggctgtttctcgacgaacccacttccgcgctggatctctaccaccagcagcatctgctgcgcctgttgaaatcgctgacccgtcagggccatcttcacgcctgcgtggtgctgcacgatctcaatcttgccgcattatggtcggaccggatcctactgttacacaacggcaggattgtttctcagggcataccggagacggttttgcaggccgacgcgctggcacgctggtacggtgcgcaggtgcacgtcggcagacatccggcgcacgccgcgccgcaggtttttctcgccccttag

SEQ ID NO: 2982 - DNA, 1071 bp, Enterobacter cloacae
gcctcccgatggaggctttttttgtgcctgaagttaagagaatacgtccaacaattcggtgtctgcaccgacataatgaggaaaaccatgtcacatctcgcagagctggttgccagtgcaacggccgccattaaccaggcctcagatgttgccgcgttagacaatgtccgcgtcgaatatctgggcaagaaagggcatttgacccttcagatgactaccctgcgtgaactgccagcagaggagcgcccggcagccggtgcagtgattaacgaagccaaagagcaggtacagcaagcgctgaacgcgcgtaaagccgagctggaaagcgcagtactgaatgcgcgtctggcggcagaaacgattgacgtttctctgccgggtcgtcgtattgaaaacggcggtctgcatccggttacccgtactatcgatcgtattgaaagtttcttcggtgagctcggctttaccgtggcgactggcccggaaattgaagatgattaccataacttcgatgccctcaacattcctggccatcatccggcacgtgctgaccacgacactttctggtttgacgctacccgtctgctgcgtacccagacttccggcgttcagatccgtaccatgaaggaacaggaaccgcctatccgcatcatcgcgccgggtcgcgtataccgtaacgactacgatcagacccacaccccaatgttccaccagatggaaggtctgattgttgataaaaacatcagcttcaccaacctgaaaggcacgctgcacgatttcctgaacaacttttttgaggaagatttgcaggttcgcttccgtccgtcctacttcccgttcaccgaaccgtctgcggaagttgacgtgatgggtaaaaacggtaaatggctggaagtgctgggctgcggcatggtgcatccaaacgtgctgcgcaacgtgggtatcgatccagaagtgtattccggctttgcgttcggtatgggcatggagcgtctgaccatgctgcgctacggcgtaaccgatttacgtgcgttcttcgaaaacgatctgcgtttcctcaaacagtttaaataa

SEQ ID NO: 2983 - DNA, 1074 bp, Enterobacter cloacae
ctaaaaaggccgctcacgcggccttttttctttgcgctatttgctaaacccgccgtaaaatcaatgatatctcaaccggataacctatcgtttatgcttgatcttgcccgtcttcagcaccgctccgatctccgccgcctgtgtctgctcggggtgctattgattgtctccaccaccgtcagcctgtgcgcgggcgatcggtggctggggccggaaagctggtttacgcctgaagggcagctctttgtctggcagatccgcctgccgcggacgctggctgtccttttagtcggcgctgcgctggcgctgtgcggtacgatcatgcaggcattatttgaaaaccctctggcggaacccgggcttctcggggtctcgaatggtgcaggcgtcgggcttatcgccgccgtgatgttggggggaggcgagctctccggctgggggattagcctcagcgccatccttggcgcgctgttgataacccttatccttctgcgctttgctcgtcgccatttatccaccagccggctgctacttgccggggtagcgttggggatcatctgtagtgcgctgatgacctgggccgtctacttttctacctccttcgatctgcgccagttaatgtactggatgatggggggatttgggggtgttgactggcgtcaggggtggctgatggtgctcctgatcccggttatcctgtggatggtgttccaggcgcagccgctgaatattctcgcgctgggcgaaacgtctgctcgccagctcgggatgccgattggattctggcgcaacgtgctggttatcgccatcggctggatggtgggcgtaagcgtggcgcttgcgggggcgattggctttattgggctggtgatcccgcatatgctgcgtctgtgcggcattacggaccaccgaaccctgctcccggcctcggcggttgccggggcggcaacgctgctggttgccgatatcatcgcccgactcgccctgacggccgctgagttgcccataggcgtggtgaccgcaacgctgggcgcgccggtctttatctggctactattaaaagctggacgttaa

SEQ ID NO: 2984 - DNA, 561 bp, Enterobacter cloacae
gggaatgctatgcagtctgatattctgaataccgaagtgacgaccattgacggcgagaaaaccacgctggtaggctacaagggcaaggtgctgctcatcgtgaacgtggcgtcaaaatgtggccttacgccgcagtatgaacagctggaaaacattcataaagcctgggaaaaagacggctttaccgtactcggcttcccgtgcaaccagttcctgggccaggagccgggcagcgaagaggaaattaagaccttttgcagcacaacctatggcgtgacgttcccgatgttcagcaaaattgacgtgaacggggaaaatcgtcatccgctgtatgccaaactggtggccgcggcgccgaccgccgttgcgcctgaagagagtggtttctatgagcgtatggcgagtaaaggccgcgcgccgctctatccggacgatattctgtggaacttcgaaaaattcctgattggacgtgacggtcaggtcgtgcagcgtttttcgcctgacatgacgccggaagatcctatcgtgatggaatcaatcaagctggcgctggcgaaataa

SEQ ID NO: 2985 - DNA, 2433 bp, Enterobacter cloacae
atacgtagtcaggtgtttcttactccgatcaaatatcacaaaaggattgtttcgatgtccaacaatggctcgtcaccgctggtgctttggtataaccaactcggcatgaatgatgtagacagagttgggggcaaaaatgcctccctgggtgaaatgattacaaatctgtccggtatgggtgtctccgtacctaacggatttgccacaaccgccgatgcgtttaacctgtttttagaccagagcggtgtaaaccagcgcatttacgacctgctggataaaacggatattgatgatgtcaccgagcttgccaaagccggcgcgcaaatccgccagtggattatcgacacacctttccagccggaactggaaaaagccatccatgacgcctacaaccagctctccgctgacgacgcgcaggcctcctttgccgtgcgctcttccgctaccgcagaagatatgccggatgcctctttcgccgggcagcaggaaaccttcctcaacgtccagggttacgaggcggtactggtggcggtgaagcatgtgtttgcttccctgttcaacgaccgcgccatctcctatcgcgtccatcagggctatgaccaccgcggcgtcgcgctctccgcaggcgtacagcgcatggtgcgctccgacgtgggctcttccggcgtgatgttctctatcgacactgaatccggcttcgaccaggtggtgtttatcacctccgcatggggtctgggcgagatggtggtgcagggggcggtgaaccctgacgaattctatgtgcacaagcctacgctggcggctaaccgtccggcagtggtacgccgcaccatgggctcgaaaaaaatccgcatgatctatgccccgacgcaagaacatggcaagcaggtcaccattgaagatgtgccgcaggagcagcgggatcgcttctccctgaccgacgccgaagtggaagagctggcgaagcaggcggtgcagattgaaaaacactatggccgtccgatggacatcgagtgggccaaagacggacacaccggcaagctgtttatcgtgcaggcgcgtccggaaaccgtccgttcacgcggtcaggtcatggagcgctacaccctgcacgcgcagggcaaaattgtcgcggaaggccgcgcaatcggccaccgcatcggtgccggtccggtgaaagtgatccacgacattagcgagatgaaccgcattcagcccggcgacgtgctggtgaccgacatgaccgacccggactgggaaccgatcatgaaaaaagcggctgccatcgtcaccaaccgcggcggccgtacctgtcacgcggcaatcattgcccgtgagctggggatcccggcggtagtcggctgtggtgacgcgaccgaacgcatgaaggacgaccagaacgtgacggtctcctgtgccgaaggcgataccggttacgtgtatgctgatatcctcgacttcagcgtgaaaagctccagcgtggataccatgccggatctgccgctgaagatcatgatgaacgtcggcaacccggaccgcgcgtttgacttcgcctgcctgccgaacgaaggcgtgggcctggcgcgtctggaatttatcattaaccgtatgatcggggtgcacccgcgtgcgctgctggagttcgacgaccaggacgcaaaactgcaaaacgaaatccgcgagatgatgaagggttacgactcgccgagagagttctatgttggtcgtctgacggaagggatcgccacgctcggcgcggccttctacccgaaacgcgtgatcgtgcgtctgtcggactttaagtccaacgaatacgccaacctggtgggcggcgaacgctacgagccggaagaagagaacccgatgctgggcttccgcggcgccggacgctacgtgtcggaaagcttccgcgactgcttcgcgctggagtgcgaggcggtaaaacgcgtgcgcaacgacatggggctgaccaacgtggaaatcatgatcccgttcgtccgtaccgtggatcaggcgaaggcagtggtagatgagctggcgcgtcaggggctgaagcgcggcgagaacgggctgaagatcatcatgatgtgtgaaattccgtccaatgccctgctggccgagcagttcctggagcacttcgacggcttctccattggctcgaatgacatgacgcagctggcgctcggcctggaccgcgactccggcgttgtctctgagctgttcgatgagcgtaacgaggcggtgaaagcgctgctctccatggccatccgcgcggcgaagaaacagggtaaatatgtcgggatttgcggccagggtccttctgaccatgaagactttgcggcctggctgatggacgagggaattgatagcctctccctgaacccggacaccgtggtgcagacctggctgagcctggcagagctgaacaagtaa

SEQ ID NO: 2986 - DNA, 1485 bp, Enterobacter cloacae
tacttgagccttaccgcgtacatccgtcgggatgatgcgcgactggttgaaatacgttttaacctgataaaaaggcaaataacaatgacaatctcctctgtattacgtaccaaagataaaataggttatggcctcggcgatatggccagcgcgctggtctggcaaacggcaacgttatttctcgcttatttctatacggacgtattcggtttgcctgccgccattatgggcaccatgtttttagtggtgcgcgtggtcgatgcgtttgtcgacccgtgcattggcgcgctggtggaccgcactcagacccgccacggtcgttttcgtccctggctgctctggtttgccattccgtttggcgtgagctgcctgattaccttctacgtaccggatgccgggcagacggcaaaaattgtctatgcctgcgtaacctatgccatcctgagcctgatctattccgcgattaatgtcccttactgtgccatgcccggcgcgctgacgctcgacccgcgcgaacgccactcgctgcaatcctggcgctttggcctgtcgtttatcggcgggttgattgtaacggtcatcgcgctgccgctggtctcattattaggccaggggaatgtgcaaaaaggctatttctatgccatgagcctgatggggctgctgggtattgttttattcttctgctgcttctttatgacccgggagcgttactcgccgcgcaatgacacctccggttcgatgctgacggatttaaaactgctggccgccaatagccagtggcgaattgtttttctgtttaatattttactgttaaccgccgtcgtgacgcgtggctctgcgaccatgtattacgttaactatgttctgttacgtccggaactggtttttgcctttattgtttccggcatggtggcctccttaagtggcgcattattatctgaacgcctgctggggaaatttgaccgggtgcgtgcctatcagtggaccattatttctttcgttatttttggcgcgctgattttcttcattccgccttcgcaggtgtggctgatattcggtctgaatattgtgtttagctttattcagaacctgaccacgccgctgcaatggaccatgttctccgatgtggtggactacgaagaacaccgtagcggccgccgcctggacgggctggtcttttcaaccgccctgtttgccatcaagtttgggctggcgctgggtggggcggtggtcggttgggtgcttggcatggtggattacgctccgggtcaggcaaaccaggcgcctcacgttcttgcaaccatcaatgccctgttcaccctgatcccctgcgtgctgttcctctgcatggtggcgctccttgccatctacaaacttaacagccggctggtggacagcatcgcccgcgagctggccagcaaacgcgatagtcgaaacgatgcggggcagctcagcccggcaacccaatccgcactacaggagtaa

SEQ ID NO: 2987 - DNA, 2379 bp, Enterobacter cloacae
accatgactgcgatctacaaggacgcgggacgtcccgtacacgagcgtgtcgctgatttactggcgcgtatgacgccggaagagaaatttgcccagatgcacgcgtactggctgatcctcgatgaacacggcaaccaccgcgagcgcagcgatctgagcgatgaattcgctggcgtgagcgaacaggcgtccctcaacgaaaggctgaagctcggcgtcgggcagatcacccgtccgctcggcacgcacattgttaatgcaaaaaccggcgtgtgtgccgccaaccgcctgcaacgcatgatgatggaggagacccggctcggcattccggcgctgtttcatgaggagtgtctggtggggctgctgtgcaaagatgcaaccttgttcccgtcgtcgctgaactacggttccacctgggacccggcgctggtgcagcgcgcggcggagcagattggtaaagaggcccgatccgtcggttgccagcaggggctggccccggtgctggatgtctcgcgcgatgtgcgctggggacggacggaagagacatttggggaagatccgtggctggtaggggtgatggcgacggcgtacgtgaaggggttgcagggcgataagcgcgatctgctggcgaccctgaaacattacgtcggccactccttcagcgaaggggcgcgcaaccatgcgccggtccatctcggtttcagcgagctaaacgataccttcctgctgccgtttgagatggcggtgaagctggccaacgccggttcggtgatgccagcctatcacgacattgataatcagccagggcacagcgaccatttcctgctcactaccgtgctgcgtgaacagtggggcttcgacggcattatcgtggcggattacggcggcgtcagcctgctgcaccagcaccacggaatttctcacgatccagcggaatcggcggcgctggcgtttaacgccgggctggacgtggaattgccgaaggatgactgcgcgcgtcatctggcggaagcggtagagcgtgggcttatctcaatggcgaaagtggatgagattgtggcgcgcgtgctaagtgaaaaattccgtctcgggctgtttgaaaaaccgtacgccgccgaagacggtatcgatttgcagaatgaggcgacccggcaggtggcgcgcgaggtggcaacaaaatcgatcacgctgctggaaaataacggcatattacctctcggcggaaaaccccgtgtagcggtggtggggccgacggctgacgatccgctggcgctgctgagcggctacagcttcccggttcacctgatcatcagcgatatggttgaagagacctcacaggtaacgacgccgcgcgcggcgctggaacagtaccttggcgcatcgcaggttcgttacgcgaaagggtgccacattatcgaaaaacggatggcgggggcgccggtatttccgggcgacagcggcggtaaaccgatgcagcaatcgccggtttcacaacgtatggatctgatccccgacgccgtgagcgcggcaaaagagagtgacgtggtgatagcctgcgtcggcgatctcgccgggctattccagagcggcacagtgggggaaggctcggatacggattcgctaaacctgccgggcgtgcagcaacagctgctggaggcgctggtggcaaccggtaagccggtgattgtcgtcatgacgggcgggcgtccttataaccttcaggggctggaagagaaggtggccgcgctgatgatggtctgggcgccggggcaggaagggggctgggcgattgccgatgtcttaaccggccgcgcggagccgcagggcaggctggtagtgagcgtgccgaaaaacgccggggcgatgccgtactactataaccacaagctgaaaagcggcggcacgccgtttgcgttccatttcggcgcactttacccgttcggttacggtctcggctggacgcagtttcgctggggcgcggcccgcctggctgaaagccgcgtcccgatcgacggagaggtggcgttaagcgtcgatatcaccaacaccggcgagcgcagcggcagcgaagtggtacaggtgtacgtacgcgataaggtcgccacgcaggtgcgtccgcttcaggagctgaaagcgttccagcgcgttacgctttcaccgggagaaaccgccacgctgacctttaccctgccggtggagatgtttaatttcacccgccgggacggaaagcgaattgtcgagccaggggagtttgagctacaggttggcgcgtcctcggcggatattcgcgcggtggtgaacgtgcaggtaagcggaaagacgcgtgtactggcgggggattggcggatgcttagtcgctgtgacattacactggcgtaa

SEQ ID NO: 2988 - DNA, 2280 bp, Enterobacter cloacae
ccggtttctggcgccttcaccggcgtggtcgtgggcgaagtggttgaatgcggtcagcaccctaacgctgacaaactgcgcgtaacaaaagtcaatgtgggcggtgatcgtctgctggatatcgtctgcggtgcgccaaactgccgtcagggcctgaaagtggccgtggcgaccgtcggtgcggtactgccgggcgatttcaaaatcaaagcggctaagctgcgcggtgagccgtctgaaggtatgctgtgctccttctccgaactgggtatttccgacgatcactccggcattattgaactgccgcaggatgcgccagtcggtaccgatatccgcgaatacctgaagcttgatgacaacaccatcgaaatcagcgtaacgccaaaccgtgccgactgcttaggcatcatcggtgtggcccgcgacgtggccgtgctaaaccagaccgaactgaacgtgccggagatcgcgccggttgaggcaaccatcagtgacgtgctgccgattcaggtagacgcgcctgaggcctgcccacgctacctcggtcgtgtggtgaaaggtattaacgttaaagcgccaaccccgctgtggatgaaagagaaactgcgtcgctgcggtatccgttctatcgacgccgtggttgacgtcaccaactatgttctgctggagctgggccagccaatgcacgcctttgataaagatcgtatcgaaggtgggatcgtcgtgcgcatggcgaaagagggcgaaaccctggttctgctggacggcagcgaagcgaaactgaacgccgacaccctggtgattgccgatcacaacaaagcgctggcgatgggcggtatcttcggcggcgagcactctggcgttaacgacgagacgcaaaacgtcctgctggaatgcgcgttcttcagcccgctctccatcaccggccgcgcacgccgtcacggtctgcacactgatgcttctcatcgctacgagcgtggcgtggatcctgcgctgcaatacaaagcgatggagcgtgcaactcgcctgctgatcgatatctgcggcggtgaagcgggtccggtaattgatgtgaccaacgaagcgacactgccgaagcgtgcgaccattaccctgcgccgcagcaagctggatcgcctgattggtcaccacgttgccgatgcgcaggtgaccgacattttgacgcgtctgggctgcgaagtcactgaaggtcaggacgagtggaaagccgttgcgccatcctggcgtttcgacatggagatcgaagaagatctggtggaagaagtggcccgcgtttacggctacaacaacatccctgacgagccggtgcaggcgggtctggtgatgggcagccatcgcgaggccgatctgtctctgaagcgtgtgaaaaccatgctgaacgacaaaggctaccaggaagtgatcacctacagcttcgttgatcctaagctgcaacagctgatccacccgggtcaggaagcgctgatcctgccaagtccgatttccagcgagatgtcagcgatgcgtctgtccctgtggacgggactgctgggcactatcgtttataaccagaaccgtcagcaaaaccgcgtgcgtattttcgaaagcggtttgcgctttgtaccggatactcaggcgaatttaggcatccgtcaggatctcatgctggccggcgccatcagcggtaaccgctatgaagagcattgggacctggcaaaagggacagttgatttctacgatatgaagggcgatctggaagcaattctcgatctgaccggtaaattatccgaaattgaattccgcgcagaagcgattccagccctgcatccgggtcagagtgcggcgatctatttagacggcaaacgtgttggtttcattggggttgttcacccggaactggaacgtaagctggatctgaatggccgtaccatcgtattcgaactggagtggaacccggttgcagaccgcgtcattcctcaggcgcaggacgtctcacgcttcccggcaaaccgccgtgatatcgcggttgtggtcgctgaaaatgtgcccgcagcagatattttggccgaatgtaagaaagttggcgtaaatcaggtagttggcgtaaacttatttgacgtgtaccgcggcaagggcgtagcagaaggtttcaagagcctcgctattagccttatccttcaggataccagccgtacactcgaagaagaggagattgccgctaccgtcgccaaatgtgtagaggcattaaaagagcgattccaggcatcattgagggattga

SEQ ID NO: 2989 - DNA, 729 bp, Enterobacter cloacae
tgcaggacaagcgcgatgattattacgctagataatgcttaccagtctgaacttttactccttccggcgcgtgatagtgcaggtttgcttaaaggtttagagattttggttaactttactggcgtgggtgcggacgtacggatcccgactgaactggttatcccccatctttctcaggaagatgaattagcgctgtttcaggagaaactacaattactcgatacctgtaagctattttttattcagcatcagttaattgcatggatcaatattacacctgcaattgttgagtttttattaactaatgagaacgctgtttcaatccttgaacgatatccgtttcttgagtttactgttaatgagaactatccaggtttaaataacgggaaagacgatccctgtctggcaagaatggcgatccatttccccttagtgctggctaacttcggtgcaggggctgcgtcccttaagccggtttatgatggtctgttcaaacgggtggttctggataaaaactttatccagcagcgtgtctcggcactctcgtttgagccttttatgcgcgctattctctggcagatcgcgccgcactgtcagtcggtcatggtctcgggaattgacgatcacggcatcttacaacgcgtgctgacattcaattttggtgcaatgcagggaagcctgtggcctgccgtcccggcagagcgggtcacgactctcgtacagcaataa

SEQ ID NO: 2990 - DNA, 453 bp, Enterobacter cloacae
cggcgtccgccatccattgcaggctttactggagattatcggatgatctggaaacgtgcggtcacgctggaggccttaaatgccatgggcgcggagaacatggtcggtttgctggacatccagttcacgcgcattggcgacaacgaactggaagcgacgatgccggtagactgccgtactcatcaaccgtttggcctgttacacggcggcgcgtccgtcgtgctggccgaaacgctgggatcggtggcgggctacctgtgtacggaaggagagcagaaggtggtgggtctggaggtcaatgccaaccacatccgctccgttcgcagcgggcgcgtgcgcggcgtctgccgggcgctgcatgctggaagccgccatcaggtgtggcagattgatatcctggacgagcaggatcgcctgtgttgttcatcaaggctgacgacggccgttgtgtaa

SEQ ID NO: 2991 - DNA, 312 bp, Enterobacter cloacae
gggattgaacctatggcgcttacaaaagctgaaatgtcagaatatctgtttgataagcttgggcttagcaaacgggatgccaaagagctggtagagctgtttttcgaagagatccgtcgtgctctggaaaatggtgagcaggttaaactctccggctttggcaattttgatttgcgagacaaaaaccaacgtccgggccgtaacccgaagacgggggaagatattcccattacagcccgccgcgtggtgaccttcagacccggacagaagttaaaaagccgtgtcgaaaacgcaacgcccaaagcagagtaa

SEQ ID NO: 2992 - DNA, 813 bp, Enterobacter cloacae
catgacgccggaagatcctatcgtgatggaatcaatcaagctggcgctggcgaaataatgacgctgctgatgcagctcacggacgttgccgggaagggacgtcttgagcctgtgactgccgcagtcaacgcaggtgaaatccttcacctggttgggccaaacggcgccggaaaaagcacgctgctggcgcgtatggcggggctgaccaccggggaaggagagataacctttctcgggcaatcgctcgtcgactggctacccgctacacttgcctcccgtcgaggctacctggttcagcagcaggttccgccctttgcgatgcccgtctggcactacctgacgctgcatctgtctgataaaaatcaggtgggcttgctcaacgaggttgctgcggcgctcgggttagacgataagctcacccggcaggcaaatcagctttccggcggcgagtggcagcgcgtgcgtctggccgccgttatccttcagatccatccggcgggaaatcctcacgggcggatgctgctgctggacgagccgatgagcgggctggacgttgcccaacaggcagcgctggataccctgctcagcgcgctatgtcgcaaggggatcgccattgtgatgagcagccatgatttaaaccatacgttgcgccacgcgcatcgggtgtggttgctggcgcgtggcaaactgattgccagcggaacgcgcgacaacgtgctgacggccgccaatcttgcgagcgcttaccacatgtcgttccggaggctggatattgaaggccacaagatgctcatttccacggcgcaggaataa

SEQ ID NO: 2993 - DNA, 504 bp, Enterobacter cloacae
attaccgaaagaacaaaaaaagcagaggattcgtctgaaatgcgattctggtttctccttgttgcggcgctatttcttgcaggatgcagcagccatcatgcacctccgcccaacccacggctttccgattccattacggtcattgccagcctgaacgatcagctcagcaactggcgcggcaccccttatcgctacggcggcatgagccggggcggggtggattgctcaggattcgtgctgatgaccttccgcgataaatttgacctccagcttccgcgagaaacgcgtatgcaggcgaaaatcggtactgaaattgataaagacgaactcctgcccggcgatctggtcttttttaaaacgggctccggtgaaagcggccttcatgtcggcatttatgacaccgataatcagttcattcatgcctcgaccagccgtggcgtgatgcgctcctctctggataatgtttactggcgtaaaaacttctggcaggccagacgtatttaa

SEQ ID NO: 2994 - DNA, 1584 bp, Enterobacter cloacae
cattcaattttggtgcaatgcagggaagcctgtggcctgccgtcccggcagagcgggtcacgactctcgtacagcaataacccctttcttcgcccgtgtttacgtccagggaaaccctctacacttaaagcaggaggacttatgaccctgtcttttactgctcactggcacgatgaattacccggcttttacaccgcgcttaagccaacgcctttacaaaacgcgcgtcttatctggcataacgatgcattagcggattcgcttggcatcccttcgacgctttttcagccagaaaaaggcgccggcgtctggggcggcgaaacgctgcttccgggcatgaagccgctggctcaggtctacagcggacatcagtttggcgtctgggcgggacagctcggcgatggccgcggtatcctgctgggtgaacaagttctgccgaatggcgaaacgctcgactggcacctgaaaggggcagggctaaccccatactcacgcatgggagatggccgcgcggtgttgcgttcaaccatacgtgaaggtctggcttccgaggcgatgcacgctctggggatccctacctcacgtgcgctgtccattgtcaccagcgacacgccggtggcccgcgaaacgatggagcagggagcgatgctggtccgcgtggcggaaagccatctgcgtttcggtcattttgaacacttctactatcgccgcgagccggataaagtccgccagcttgccgattacgctcttcgtcgtcactggccgcacctgcaaaacgagccggaccgctatgttctctggttccgtgatattgctgcgcgcaccgccgcaatgattgcccgctggcaggccgtcggctttgcccacggggtgatgaacaccgacaacatgtccctgttagggctgacgtttgactacggtccgtacggcttccttgatgactatcagccgggttacatctgtaaccattcggactatcaggggcgttaccgtttcgacaaccagcctgcggtggggctgtggaaccttcagcggcttgcacaaagcctgtcgccgtttatcgacgtcgatgccctgaacgatgcgctggacagctatcaggaggtcctgctgcgggaatacggtgtgttaatgcgcaccaggctggggctgatgacgcagcaaaaaggcgataacgcgctgctgaatgggctgtttgccatcatggcgcgtgaaggcagcgactatacccgaaccttccgtatgctgagccagaccgcgcagcagagcgccgcgtcaccgctgcgcgacgagttcgtcgatcgacaggcgtttgatgactggtttgccgcttaccgggcgcgtttacagcaggaacaaattgatgacgatacccgccaggcgcggatgaaggcggttaacccggcgatggtattgcgcaactggctggcgcagcgggccattgagcaggcagagcagggggactataccgagttgcatcggctacatatcgccctgcgcacgccgtttgccgaccgggaggatgactatgtcagccgcccgccggactggggcaagcggctggaagtgagctgctcaagctaa

SEQ ID NO: 2995 - DNA, 3129 bp, Enterobacter cloacae
gaaaaaaatgtgataaaactttccagacacaacgcaaacgatttcacactattctcattagggtcgacagcaatgatcccacagatttctcaggcaccgggcgtcgttcagctggtgcttaattttttgcaggcactggagcaacagggttttacaggtgacaccgctaccgattatgccgacaggctgacgatggcgaccgataacagtatttaccagcttcttcccgatgccgtcgttttcccgcgctctaccgccgatgtggcgctcatcgcccgtctggcatcgcaggagcgtttcagctccctggtcttcaccccgcgtggcggcgggacgggtaccaatgggcaggcgctgaaccagggcatcatcattgatatgtcccgctatatgaaccgcatcattgagatcaacccggaagaggggtgggtgcgtgtggaagcgggggtgatcaaagatcagttgaatcagtttttgaaaccttacggctatttttttgcgccggagctttccaccagtaaccgcgcgaccattggcgggatgatcaacaccgatgcctcggggcagggctcactggtgtacggcaaaacctccgaccacgttatgggtgtgcgggcggtgctgctggggggcgatatcctcgatacccaaccgatgccgatcgagctggccgaaacgctggcagcagagagcaccaccagcggacggatttatcgcaccgtgctggagcgctgccgcgaaaatcgcgagctgatccttgacaaattcccgaagctaaaccgcttcctgacgggctacgatctgcgacatgtcttcaatgacgatatgagccagtttgatcttacccgcgtactgaccgggtcagaagggacgctggccttcatcaccgaagcgcgtctggatatcacccggttgccaaaggtgcgccgtctggtgaacgtcaaatacaactcctttgactccgcgctgcgtaatgcaccgtttatggtggaggcgcgggcgctgtcggtggaaaccgtcgattcaaaagtcctgaacctggcccgggaggatattgtctggcattcggtgagcgaactgattaccgacgtgccggataaagagatgctcggcctgaacatcgtcgagttcgccggggatgacgcagagctgattgagagccaggtaaacacgctctgccagcgtctggacgagctgattgcgcagggggaaggcggcgtcattggctggcagctgtgtaacgatctctccggcatcgagcgaatctacgcgatgcgtaaaaaggcggtggggctgctcggcaacgcgaaaggggcggcgaagccgattccgtttgcggaagatacctgcgtgccaccggaacatctggcggattatatcgtggagtttcgcgcgctgctcgacagccatggtctgagttatggcatgttcgggcacgttgacgcgggcgtgctgcacgtgcgcccggcgctggatatgtgcgatccgcagcaggagatcctgatgaaggcgatctccgacgaggttgtggccctgacggccaaatacggcggtttactgtggggcgagcacggtaaggggttccgcgccgagtacagcccggccttttttggcgaacagctctacgccgagctgcgtaaggtgaaggccgcgttcgatcctgataaccgcctcaatccgggaaaaatctgcccgccagagggcgttgatgcgccgatgttgcaggtggatgccgttaagcgcggcacctatgaccgccaaattccgattgcgatacgcgcttcctggcgcggcgcgatggagtgtaacggcaacgggctgtgctttaacttcgatgtgaaaagcccgatgtgtccgtcgatgaaaatcaccagcaaccgcatccactccccaaaagggcgtgccacgctggtgcgcgaatggctgcgcctgctggccgaccgcggcgttgacccgctcaagctggaacaggagctgccggaaaaacgcgccagcctgcgcgggcttatcgaacgcacccgcaacagctggcatgcgaacaaaggcgaatacgatttctcgcatgaggtgaaagaggcgatgtccggctgcctggcgtgtaaggcgtgttcaacccagtgcccaattaaaattgacgtaccggaattccgttcccgcttcctccagctgtaccacacgcgttatctgcgcccgatgcgcgatcatctggtagcgacggtggagagttacgcgccgctgatggcccgtgcgccaaaaacctttaacttctttatcaaccagccactggtgcgaaaactgtctgaaaaacatatcggcatggtggatctgccgctgctgtcggtgccatcgctccagcgtcggctggtggggcaccgctcggcgaatatgaccctggaacaactggaagcattaagccctgagcagaaagcgaaggtggtgctggtggtgcaggatccgtttaccagctattacgatgcgcaggtggtggccgattttgtccgactggccgagaaaatcggttaccagccggtggtgctgccgttctcgccgaacggcaaggcgcagcacattaaaggcttcctcacccgctttgcgaaaaccgcgcagaaaacttcagattttctgaatcgcgtggcgcagctcggcatgccgatggtgggcgtcgatccggcgctggtgctctgttaccgggacgaatataagcagacgctcggcgataagcgcggtgattttcaggtcttactggtacacgagtggttgcctgcggtgctgacgcaaacgccccctcaggaggtcagtggagaatcctggtacctgtttgggcactgcaccgaagtgacggcgctgccgacggcgcctgcccagtgggcttctatcttctcccggtttggcgcgaagctggaaagcgtcaacgtgggctgctgcggtatggccggaacctacggccatgaagtcaaaaaccacgctaattcgctcggcatttacgagctgtcatggcatcaggcgatgcagcgcctgccacgcaaccgctgtctggcgacgggctactcctgccgcagccaggtgaaacgggtggaaggtaacggcgtccgccatccattgcaggctttactggagattatcggatga

SEQ ID NO: 2996 - DNA, 231 bp, Enterobacter cloacae
tatactggtcacgttttgaacataagcgaggacatcatggatactgaaataaccccaatacagctggcaattgaatatttacgtcgcgataaaagcaatctgtctcccgcgcagtacctgaaaaagctgaaacagcttgagctggaatttacggatttgctggcgctctcttcaaacgaactgaaagaagagatctactttgcctggcggttgggcgttcacgtccattaa

SEQ ID NO: 2997 - DNA, 546 bp, Enterobacter cloacae
agtaatacgggatataaaattatgaataaaaaattgatgatggcaatgttagcggcaggttctgtactcactatgaccaatgcattggcagcggccggtaccgttaattttaacggaaatattctggattctgcctgcgacgttgatgtggcatcccagaatcaggtggtggtattgggcgattattataaaacggaattcccgacaaccggggcgagaacggctgcgacgcagtttaatattattttgaaaaactgtccggtaacggtcaccaatgcaaaagtccgttttgatggcacgccggatttaaccaacgccagcctgctggcgattgatacgtccgtggcgggagcggctaccggggtggcgattaacctgatgacggcagataaagccgatctgccgctgcacggcagcaacagctatacctacgcactcagcagtacggctgataatacgttgagcttctacgcgcagtatatttccaccgcggcatccgttaccgcgggcccggctaactcggtcgcgaacttctctgtggtgtac

SEQ ID NO: 2998 - DNA, 1884 bp, Enterobacter cloacae
tcctttattggtatgggtatactccagggtatgcaccagaatagcgccattcctgcaatcaggtcacgtcaggagcccggcaactctatgttaaaaagatgtttatctccgctgacgctggttaaccagctggcgcttattgttctgctgtccaccgctatcggtgtgaccggcatggctatttctggctggctggtacagggtgtacagggtaacgcgcatgccatcaacgaggcaggctcgctacgtatgcagagttaccggctactggcgtcggtgccgctgacgcaggctgaccaaccgcttatcgacgaaatggagcgtaccgcattcagccctgaactggaaagagccgccatccgtgacggtcagcaatctcagcttaaggcgcttcagggctactggcatacccagctggagcccggcttaaagcgggcggaagaccgggaaacggtcgcccaggatgtcgccgggtttgtgtcacgcatcgatcatcttgtctcctcattcgatcgcaccacagagttacgcattgaccgtgtggtgatggttcaccgcgcaatggcgctgtttatgggtttgctgctgattttcacggttatctggctgcgcgcgcggttgcttaacccctggaaacagctcctggcgatggcccgcgccgtcacacagcgcgattttacccagcgcacgcacatcagcgggcgcaacgaaatggcgatgctcggcgaggcgctcaacaccatgtcggcagagctatcagaaagctacgcggtactggaacaacgcgtccaggagaaaaccgccgggcttgagcagaaaaacgagatcctctctttcctctggcaggcgaaccgtcgcctgcatatgcaggtcccgctttgcgaacgtctctcgccagtactgaacggcctgcaaaacctgactctgctccgcgatcttgagcttcgggtttacgacgttgaagatgaggaaaaccatcaggaatttacctgtcagtcggacatctcctgcgacgataaagggtgtcatctgtgcccgcgcggcttgccgccgcttaccaccagcggcacgaccctcaagtggcggctgatggacagccatacccagtacggtattttgctggccaccttgcccgccggacgtcacctgagccacgaccagcagcagctggtcgatacgcttgttgagcagctcacggccacgctggcgctcgaccgccaccaggagaaacagcagcagctgatcgtgatggaggagcgtgccaccatcgcccgcgagctgcacgactccatcgcccagtccctctcctgcatgaagatgcaggtgagctgcctgcaaatgcaggacgaaggcatgcccgagagcagcaaacagctgctcagccagatccgcaacgagcttaacacctcgtgggttcagcttcgcgagctgctgaccaccttccgtttgcagctcaccgagccggggctgcgccctgcgctggagtccagctgtcaggagtttagtgcccggctgggcttcccggtgaagctggattaccagctgccaccgcgttttgtcccctctcaccaggcgatccatttgctgcaaattgcccgtgaagccctgagcaacgtgctcaagcatgccgaggcgacggccgttacggtcaccgtcagctgccaggataatcaggtgaagctcagggttcaggataacggccgcggcgtgccggaaaatgccgaacgaacgaaccattatggtttaattatcatgcgagaccgcgcgcaaagcctgcgcggtgattgccaggttcgccggggagagtcaggtggcaccgaagtagtggtcacctttatacccgaaaagcccctcataactgctcaaggagaaaaccatgactaa

SEQ ID NO: 2999 - DNA, 678 bp, Enterobacter cloacae
aggtgcaatgcggcgaggttttcatccaccagggccctgctggccttgcattcaggcgcgtacaatttgccctgcgagcagagccagacatttgacgcaccgcgctcgcactgtagcatatgcaccagtcgactgatgccattcaccagtgcgcccagctgcgccagtctgccgagctgttcctcgcgcaacattctcgcacgctggaaccattcggttgcgccaggggaactgccagccactatcgtcatcgtttctctccccgatacgtattcttcggtacgagaagcaatattcgtgccttttcaaagaacaggagtcaacatgcagaagattgtgatcgtcgccaacggtgcggcctacggcagtgaatccctttttaacagcctgcgcctggcaatcgcgctgcgcgataaggagagtgagctggagctgcgcctctttttgatgtccgacgccgtcacggccgggctgaaggggcaaaaacccgcagagggctacaacattcaacaaatgctggagatcctgaccgcgcaaaacgttccggtcaaactgtgcaaaacctgtaccgacgggcgcggcattaccgggctgccgctgattgatggcgtggaaattggtacgctggtggagctggctgaatggacgctttccgccgataaagtattaactttttaa

SEQ ID NO: 3000 - DNA, 1131 bp, Enterobacter cloacae
ttacaagcacctgcattgttggagaaacacatgacagcaacacacgaggcggtgaaaacccgccacaaggagacctctctcattttcccggttctggcactggctgtgctgctcttctggggaagcagtcagtcattgccagtggttgtggggatcaatattctggctctggtgggtattttaaccagtgcatttagcgtggtacgccatgcggatgttttagcccaccgtcttggagagccgtatgggtcattaattttaagcctttcggttgtgattcttgaagtcagtctcatttccgcattaatggccaccggcgacgccgcgccaacgctaatgcgcgatacgctctattccatcattatgattgttaccggcggcctggtcggtttttcacttttattaggtggtcgcaaatttgccacccagtacatgaacctttttggcattaaacagtacctgatcgccctgttcccgctggcgattattgtgctggtattcccgatggcgctgccgggtgcaaatttcaccaccggccaggcgctgctggtggcgctgatttccgcggcgatgtacggcgtgttcctgctgatccagaccaaaacgcaccagagcctgtttgtttacgagcatgaagacgacggtgacgacgatgacccgcatcacggtaagccgtcggctcacagcagcgcgtggcacacggtttggctgatcgtgcatctgattgccgttattgcggtcaccaagatgaatgcgaacccgctggaggcgctgttaactgaactgaacgcgccggtcgcctttaccggtttcctggtggccctgttgatcctgtcgccagaaggcctgggagcgctgaaagcggtgctcaataatcaggtgcagcgtgcgatgaatctgttcttcggctcggttctggcgaccatctcccttaccgttccggtggtgacgttgattgcctttatgacgggaaatgaattgcagtttgcgctgggtgcgccagagatgattgtgatggtggcatccttgctgctgtgccagatttccttctccaccggccgcaccaatgtgctgaacggcgcggcgcatatggcgctgtttattgcgtatctgatgacaatatttgcgtaa

SEQ ID NO: 3001 - DNA, 870 bp, Enterobacter cloacae
atgatgacccactggccttttcccgcaaaactgaacctgtttctctacattaccggacagcgcgctgacggctatcacaccctgcaaacgctgtttcagtttgtcgattacggcgacacgatctccatcgaaccgcgtcaggacgggcagattcacctgctgacgccggtcgacggcgtggcgcatgaggataacctgatcgtgcgcgctgctcgccttctgatgaaaacggcgtcgtcgtcgggtcgtctgccagcgggaagcggtgcggatatccgtatcgacaaacgcctgccaatgggcggcggtcttggtggcggttcatcgaacgccgcgaccgtactggtggcgcttaaccacctctgggactgcggtctgacgacggacgaactggcagcgttaggattgacgctgggcgccgatgtaccggtgtttgtgcgcggccacgcggcgttcgctgaaggtgtcggtgaaatcctcacgccggtcgatccgccggaaaaatggtatctgatcgttcaccctggcgtgagcattcctaccccggtcatctttaaagatcctgacctgaaaagaaataccccggtacggtcaataaaaacgttattaaattgtgaattcagcaacgattgcgaggatatcgcaagaaaacgttttcgcgaggttgatgcggtgctttcctggctgttagaatacgcgccgtcgcgcctgaccggtacaggggcctgtgtctttgctgaatttgacaccgaaaccgccgcccgtcaggtgcttgagcaagcgccggtttggctgcatggttttgtagcgcgcgggatgaacatctcccccctacagcagaccattctggcgcagactgagtttcggtga

SEQ ID NO: 3002 - DNA, 1686 bp, Enterobacter cloacae
ataattgtgaaaaaagtaacctcctcacatgttctgccctttcgcgccctcatcgacgcctgctggaaagagaaatacacgtcgtcacgctttgttcgtgacctgatagccgggatcaccgtcgggattattgccatcccgctggcgatggcgctggcgattggtagcggcgtcgcgccgcagtacgggctgtacacctcggccgttgcggggattgtgattgcgctgacgggcgggtcccgcttcagcgtctccggcccgacggccgcctttgtggtgatcctctacccggtttcccaacagtttggtctggcaggcctgctggttgccaccctgatgtccggcatctttttaattctgtttggtctggcccgctttggtcgcctgattgaatatattcccctttccgtaacgctggggttcacctcggggatagggattaccatcgggaccatgcagatcaaggatttcctcggcctgcaaatggcccatgttccggagcactatttacagaaagtgggcgcgctgtttatggcgttgccgacggccaacctgggcgatgcggccattggcatcgttaccctcggcacacttatcgtctggcctcgcttaggcattcgtctcccggggcatctgcccgctctgctgctgggctgcgcggtgatgggcgtcgtcaacctgctcggtggacaggtcgccaccattggctcccagttccactatgttctggcggacggctcacagggcagcggcattccgcagctgctgccgcagctggttctgccgtgggacatgccgggctccagcttcaccctgagctgggattcccttcgcgctctgctgcccgccgcattctccatggcaatgctgggcgcgatcgaatccctgctctgcgccgtcgtgctcgacggcatgaccggcactaagcacaaagccaacagcgagctggtcggccagggcttggggaacatcgttgtaccgttcttcggcggtattaccgctacggctgcgattgcccgttccgccgcgaacgtacgtgcgggcgcgacatcaccggtttcggcggtcattcactccctgctggtgatcatggcgttgctgatcctcgccccgctgctttcatggcttccgctctctgccatggctgcgctgctgctgatggtggcctggaacatgagtgaggcgcataaggtggttaacctgctgcgccgcgcgccgaaagacgacattatcgtgatgctgatctgcatgtcgctgaccgtgctgttcgatatggttatcgctatcagcgtcggcatagtgctggcctcgctgctgtttatgcgccgcatcgcgcagatgacgcgtctctccccggttaacgttgaggtgcctgacgatgtgctggtgctgcgcgtgattggtccgctgttcttcgccgcagcggaaggtttgttcagcgatctggaataccgcatcgcgggcaaacggattgtggtgctgaagtgggatgccgtcccggtgctggatgccggcggtctggatgccttccagcgctttgttgcccgcctgccggaaggctgcgagctgcggataagtaacctcgaattccagcccctgcgcaccatggcgcgcgcaggcgtgcagccgatccctggccgattgtccttctaccctaaccgtgaagctgcattagcggatctgtga

SEQ ID NO: 3003 - DNA, 669 bp, Enterobacter cloacae
ctgctcaaggagaaaaccatgactaatcaggaaccggcatctatcctgttgattgacgatcatccgatgctgcgcactggcgttaaacagcttgtcagcatggcgccagatatcaccgtcgtcggggaagccagcaacggcgaacagggtattgaacttgccgaatcgctcgatcctgatttgatcttgctcgatctcaacatgccgggcatgaatggcctggaaaccctcgacaagctgcgggagaaatccctctctggccgggtggtggtcttcagcgtctcaaaccatgaagaagacgtggtcaccgccctcaagcgaggggcagacggctatctgctgaaagatatggagccggaagatctgctcaaggcgctgcaacaggctgccgcaggcgagatggtgctgagtgaagcgttaacgccggtactggccgccagcctgcgtgcgaaccgcgccacgtctgaccgcgacgttagccagttgaccccgcgcgagcgtgacattctgaagctgattgcccaggggctgccgaacaaaatgatcgcccgccgtctggacatcaccgagagcacggtcaaagtgcatgtcaaacacatgctgaaaaaaatgaagttaaaatcccgcgtcgaagccgccgtctgggtgcatcaggagcgcattttttaa

SEQ ID NO: 3004 - DNA, 246 bp, Enterobacter cloacae
tccaccagtccggtctggcctcgcccggcgcaggcagaaacgcgcgctggcgggagatacggcgttcagaattggtcaccgtgccgtttttctcgccccagcccagggcgggaaaacggatatgggcaaaccggctggtgtccgtctcctgcatcacctcagataccacgaccagcgggcaggccgccagagcctggcacaccgcgtggctgtcgggaagcgacacggcagggttggtgcccatga

SEQ ID NO: 3005 - DNA, 1899 bp, Enterobacter cloacae
ctttttaataataacccgctaaaaatattattttcttatggacgcggtttcagcatcaagtttacctgcaccgttgccgataggcatggaaacaacacagcaggtattacacttatgttcagatccattcgcgcccgcatcattgccgcgacgacaggctgtctggtcgtcgcccttcttcttaataccattattaactttcaggtcacgcgccaggataatcagcagtcgcagcgcgatattctgaccagcaccagcgccagccacaacatggcgattgccgactgggtgaacagcaaaataaccgtcatcacttcggcgcagtcggtcgcgctcagcgacgatccggttccggtgtttaaacagcttgcactggcgggtggatttaccaacgtctacgtgggttatgccagcaaaacggctaaattttctgacccaaccggggtgcccgctgattacgatcccacccttcgcccgtggtatcagcaggtcgtcagcgctgatggcccggtagtgactgcaccctatgtggatgcgggcaccgggaaactggtggtgacgttcgcggtacccgttaaagagcaaggcgccctgaaagcggtggtggcgggcgatgtggcaatggacagcgtggtggctaacgtgcgcggtattcacccgactccggccagcagtggactgcttttggacagcaacggcaccgtaattgccggcagcgatcctgcgctgacgcttaagccgtttactgaaacgatcaaagggaccgattttgccactctgaaaagcggcaacctggttgacggaacgtcaaacggacgcgaaaaaacgttcctggccaccgccgtgccggggacgcactggctgctggttgtggcgcttgataacggcgatgccaccgccgggatgcgctcattgcttaaagcatctgcactgtcgctggcaatcctcgccctgctgagcggagccctcatgcacctcctgattgcccgcctgcttaagcggctgtttggtatccgtgacgcgatgaacaacattgccaacggtactaacgatctgtcgcagcgtctgccggataaggggggcgatgaagtggcgcaaatcgcgcaggcgtttaacgccttcagcgataagctttctgtggtgatggtccagctgcgtgatgccagcgcctcagtgaaaaacgccgcgcatgagattgcggcgggtaatcaggatctttccgggcgtaccgagcaggcggcatcaagccttcgcgaaaccgccagcgccgtggaagagatcacggcctccgtcacgcagtcaaacgagtcggcagcagaagcgaatgaacaggcgagcaaggcctctgccgccgcatcccgcggaggtgacgtcgtcgctcaggccatcagcaccatgcagtccatcgaactggcttccgcgaaaatcggcgatatcaccagtgtcattgacggcatcgccttccagaccaatattctggcgcttaacgcctcggtggaagcggcacgtgccggggagcaaggccgtgggttcgcggtcgttgcgggggaagtacgtaacctggccagccgcagcgctcaggcggcgaaagagatcaaatcccttattgattccaccaccgaaagcgttgcaaccggctcccggtttgtgcaccttgcgggcgacagcatggatgagatccgcgccagcgtcgggagcgtgtcaggcataatgcgtgaaatatctattgccacccgcgagcagatgaaagggatccatgaaattaaccacgcggtgactcatctggatcgcatggtgcagcagaacgccgagcttgttgtacagtctgctgcggcggccagcgcgctgcaaagccaggcgggcgaccttgctgagaccgcaggccatttccgcatataa

SEQ ID NO: 3006 - DNA, 522 bp, Enterobacter cloacae
acggtggcacccttcaacgctagcattaacagttataactgcaacgtatctcaaggatttgtcatcattatgacccgaatgattcgcctgctgcctctggcggccctggttctgaccgcctgttccgttcatcagccgaaaggcccgggcaaaagccctgactcaccgcagtggcgccagcaccagcaggacgtgctgaaattaagccagtatcagacccgcggtgcatttgcttatctctctgacgagcaaaaagtttacgctcgcttcttctggcagcaaacgggtcaggacaactatcgcctgctgctgctgaacccgctgggcagcaccgaactggagctgaacgcgaagcctggcgaagcgcagattaccgataacaaaggccagcactacacggcaaccgacgccgaagagatgattggcaagctgaacgggatgccgattccgctcaatagtctgcaccagtggatccttggcctgccgggtgacgcaaccgactacacgctcgacgatcaataa

SEQ ID NO: 3007 - DNA, 588 bp, Enterobacter cloacae
atcgtgacgattaaactgattgtcggcctcgccaatccgggcgcagagtatgctgctacccgccataacgccggtgcctggtatgttgatctgctggcggagcgtttgcgcgctcccctgcgtgaagaacccaagttttacgggtatacctcacgcatcaatcttgcgggtgctgacgtgcggttgctggtgccaaccacctttatgaacctgagcggcaaagccgtggcagctatggcaacgttttatcgcatcaatccggatgagatcctggtggcccacgacgaactggacctgccgccaggcgtggcgaagttcaaactgggcggcggtcatggcggccacaacggccttaaagacatcatcagcaaactgggtaataaccctaatttccaccgtttgcgcgtgggaatcggccatccgggcgataaaaacaaagttgttggtttcgtactgggtaagcccccggtttctgagcagaagttgattgacgaagcggtggacgaagcggcccgctgcaccgagatttggcttcaggacggcctgacgaaagccaccaatcgactgcacgctttcaaagcgcaataa

SEQ ID NO: 3008 - DNA, 1107 bp, Enterobacter cloacae
ggtgatttagaaatgggattcaaatgcggtatcgtcggtctgccaaacgtgggcaaatccaccctgttcaacgcgctcaccaaagcaggtattgaagcggcgaacttcccgttctgtaccatcgagccgaacaccggtgttgttcctatgcccgatccgcgtctggaccagctcgcggaaatcgtgaagccgcagcgcattctgccaaccaccatggagttcgtggacatcgcgggcctggtaaaaggcgcatccaaaggtgaaggcctgggcaaccagttccttaccaacatccgtgaaaccgaagcgatcggccacgttgtgcgctgcttcgagaacgacaacattatccacgttaacaacaaagtggatccggctgacgacatcgacgtcatcaacaccgagctggcgctctctgacctcgacacctgcgagcgcgcaattcaccgcgtgcagaagaaagccaaaggcggcgacaaagacgcgaaagcggaactggctgcgctggaaaaatgtctgccacagctggaaaacgcgggcatgctgcgcgcgctgaaaaacctgactgacgaagacaaagcggcgatcaaatacctgagcttcctgaccctgaagccaaccatgtacatcgccaacgttaacgaagacggtttcgagaacaacccgtatctggacaaagtgcgtgaaatcgctgcggctgaaggttctgtagtggttgcggtttgcgctgccgttgaatctgatattgcagagctggacgacgccgatcgtgaagagttcatggccgagctgggtctggaagagccgggcctgaaccgcgtgatccgcgcgggctatgagctgctgaacctgcaaacctacttcaccgctggcgtaaaagaagtgcgtgcgtggaccatccctgtgggtgcgaccgcgcctcaggcggctggtaagatccacaccgacttcgagaaaggcttcattcgtgcgcagactatcgcgtttgaagacttcatcacctacaagggtgagcaaggcgcgaaagaagcaggcaagatgcgtgcggaagggaaagattacatcgttaaagatggcgacgtgatgaacttcttgtttaacgtttga

SEQ ID NO: 3009 - DNA, 1017 bp, Enterobacter cloacae
cgtttgcttaggccccgcagtttgcggcgaacgctatccaccactggacgcatgcctgaggttcttctcgtgcctgatatgaagctttttgctggtaacgccaccccggaactagcacaacgtattgccaaccgcctgtacacttccctcggcgacgccgctgtaggtcgctttagcgacggcgaagtcagcgtacaaattaatgaaaatgtacgcggtggtgatattttcatcatccagtccacctgtgctccaacgaatgacaacctgatggaattggttgttatggtcgacgcgctgcgtcgtgcttctgctggccgtatcactgctgttattccttactttggctatgcacgtcaggaccgtcgcgtccgttccgcgcgtgtgccaatcaccgctaaagttgtcgctgacttcctgtccagcgtcggcgttgaccgcgtactgacggttgacctgcacgcagagcagatccagggcttcttcgacgtgccggttgataacgtattcggcagcccaatcctgctggaagacatgctgcaactgaatctggacaacccgattgtggtttctccggacatcggcggcgtggtacgtgcgcgtgctatcgcgaagctgctgaacgataccgacatggcgatcatcgacaaacgccgtccgcgcgctaacgtttctcaggtgatgcacatcatcggtgacgtggctggccgtgactgcgtgttggtggacgacatgatcgataccggcggtacgctgtgtaaagccgctgaagcgctgaaagagcgtggtgcgaaacgcgtattcgcttacgccactcacccgatcttctccggcaatgcagtaaacaacctccgtaactccgtcattgacgaagttgtggtgtgcgataccattccactgagcgacgagatcaaagcgctgccaaacgtgcgtacgttgactctgtccgggatgctggccgaagcgattcgtcgtatcagcaacgaagaatccatctctgcaatgttcgaacactga

SEQ ID NO: 3010 - DNA, 279 bp, Enterobacter cloacae
catatgaaacgcaaaaacgcttcaatgctcggtaacgtgctaatggggttgggactgttcgtgatggtcgccggtgtcggttattcaatcttaaaccaattaccgcagcttgacctcccacaatactttgcgcatggcgcggtgctgagtatcttcctcggtgcggtactgtggctcgccggggcgcgcgtgagcggacatgaggaagtctgcgataaatactggtgggtgcgtcattacgataaacgatgccgccgcgaccagcgcaagcatagctag

SEQ ID NO: 3011 - DNA, 1116 bp, Enterobacter cloacae
ccctcacgtaacgtaaggcttcagagtaacgacactggcagaacaaaaggagccgttatgttgatacaggtgggagaactggcgaaacgtgccgggatcaccgtgcggactttgcatcactacgagcaaacagggctgttgttaccttctgccagaagcgcggcaggctaccggctttataacctggcggatgtgcagcgtctgcatatgatccagacgctggcaaaagccgggctggagcttgccgaaatcagggattttctgaaacagcgttcgctgtcattagccgaattactcgacgggcaaatcactctgctggacaagcaactgcgtagtatccatacgctgcgcaaccggctggtggaattgcgtaccgggctgaccgacgatgcgacgccggatctggaatcctggctacagactctggagttaatgaatatgtacgatcgctggtttagcaaagaagagttgcagcaactgccgtttgcggtagagaaagaggcgctggcggatatctggtcggggctggtgagggaggttaaacacttgctggaacagaacgtcagcgtcacggacgcgcgggcgaccgatttggcttcacggtggatggaacgcctggagcaggataccgcaggcaaaccggaatttttgacccgcctgaacgagatgcacagcgtggagccgcagatgcaggagcaaaccggcattacgccggagataactgattacatcacgcgggcgtttgccgaatcaaagctcagcatctgggagaaatatctcactgccgaagagatggcctttacccgggcgcactactttgaccggatgatggagtggccgccgctggtggcgaagctgcatcaggcacagcgagataatctcagtcccgcttctgacgatgcgcaaaagctggcagaaaagtggctggttttattccagtcctatgcaggaacaaacccgcagacccagcaaaaatttcgcctcgccatgcagcaggagccgcatctgatgaaaggcacgtggatgacgcctgccgtgcttgaatggctccagcaggcgatcggggtgatgatgcaaagacgcgtctctgcatcagatgactcacagatccgctaa

SEQ ID NO: 3012 - DNA, 888 bp, Enterobacter cloacae
gcctatcgtgcaggaataccaggccgaccagctggcggcactgtccgagcaggattaatggattttcagcgctggttacgccatgccgccagtgagctttctgcaagtgaaagcccgaagcgcgacgccgaaattctgcttgagcatgtgacgggtaaagcccgcacgtatctgctggctttcggcgaaaccgcgctgaccgctgaacagcaatcgcagctggagacgctgcttgcccgccgtaaaaccggcgagccggtggcgcatctggttggcgagcgcgagttctggtcccttccactgtacgtctcagcggccacgctgatcccgcgcccggacaccgagtgtctggtggagcaggcgctggcgcggttaccggcgcagccgtgtcagatcctcgatctcggcaccggcaccggggcgattgcgctggcgcttgccagcgagcggccagactgcaccgtgacggcggtagacgtgatgcctgatgcggtcgccctcgcgcggcgcaacgttgaacggctggggctgaacaatgtttccgttctgcaaagcagctggtttgccgcgcttgaaagccgcatgtttgaaatgattgtcagcaatccgccttacatcgacgaagacgatccgcatctcgcgcagggggacgtgcgttttgaaccgttgaccgcgctggtcgctgcgaatcagggacttgcggatctcgatcacattgtgacaacgtcacgacaacatttgcttcccggtggctggctgctggtggaacatggctggacgcagggagaggcggtgcgagcgctgtttacgcatgccggatacgctgccgtggaaacctgccgggattacggcggcaatgaacgtctgacgctggggcagcggtcatga

SEQ ID NO: 3013 - DNA, 843 bp, Enterobacter cloacae
catttcaggcggttgacctgccgctgtattgcatctggcccgcgaattgcttatcgttgctcaactgctgttaaaatgaacagcacagaatgccaggaaggcgaattacagatgtcgcaaggaagcatgcagtggcggaggtggaatgtgttaacgcgtgatttcttgatgaaggctgattgtaagacggcatttggtgctattgaggaatcgcttctgtggtcggctgaacaacgtgcggcgtcgcttgcggcaacgcttgcctgccgcccggatgatggcccggtctggatttttggttacggctcgctgatgtggaacccggcgctcgaatttgttgaatcggcaaccggaacgctgcctggctggcaccgcgccttctgtttgcgcctgaccgccggacgcggcagcgcgtgtcagccaggacgcatgcttgcactaaaagagggcgggcgcaccacgggcgtggcataccggctgccggataccacgctggaagatgagctgacgctgctgtggaagcgcgagatgatcaccggctgctatatgcccagctggtgcaagctggaactggatgacggccgcaccgtcaacgcgctggtgttcattatggatccgcgccacccgctgtatgaagccgacacccgaacccaggtgattgccccgctgattgccgccgccagtggaccgctgggtactaacgcccagtaccttttctcgctcgatcaggagctgacgcgtctcggtatgcaggacgactgtctgagtgagctggtggtgaaggtgaaagcgctgctggaagggaacccgctcagcaatacgctgcggccaggttttgcctga

SEQ ID NO: 3014 - DNA, 1365 bp, Enterobacter cloacae
cagattaaccattttcgacgatgcgccaacggcggtgcatgcgtcttcaggataaaggcgtccagcggtgcttcagcaccgtcgggcgcttttttttgccttttttcaggagcaattatggcggatttgtcgagacggcggttattgcaggccagcatgctggcgagtggtgcgatgctgttgccgggtgtcatgcaggccgcatgggcggcggggtcagataagcctgagcaggataccgtgcgtatcgggtttatccccctgaccgactgcgcgcccgtggttatcgcggccctgaaagggttcgataaaaaacacggcattaccattgtaccgaccaaagaggcgagctgggcggcggtgcgcgacaagctggtggcgggtgaactggacgccgcacacattctttacggcctgctgtacggtctggaactgggtattgcgggcaagccgcagcagatggcgaacctgatgaccctcaaccagaacggtcaggccattacgctctccagcgatctggcggagaagggcgttcgtcacctcgacgggctgaaaaagctgattgcgcagcaggcgccgggaacttacaccttcgcgcataccttcccgacgggaacgcacgccatgtggctctactactggctggccagcgcggggattaacccgtttgacgacgtgcgcaccgtggtggtgccgccgccgcagatggtgatgaacatgcgcattggcaacatggtcgggttttgcgttggcgagccgtggaacgcgcgggcgattaacgaccgcatcgggtttaccgccgccacgtcacagtccatctgggccgatcatccggaaaagatcctcggcacccgacgcgactgggtggcgaaaaatccgcacaccgcacgggcgctggtgagcgccgtgatggaagccgcgcgctggatcgaggcgtcagcggaaaacaaacgcgaaaccgcgcagatcctctcgcgccgcgcctggctcaactgcaaggaacagtatctcaccggacgcatgctcggcgagtacgacaacggggtcggtcagcgctggcaggatgcgcacccgatccgtttcttcaacgagggtgccgtgagctacccgtatctctccgacggcatgtggttcttaacccagttccgccgctggggcttgctcaacgccgcgccggattacgcgggcattgcacagcgcattaaccagaccgcggtctggcaggatgccgcgaccgccgtgggcggcatgtccacaccgtcatcaccgtatcgcagcagcaccttgatggacggcaccgtctggaacggcaccgatccggaagggtacgccaaccgcttcgccattcaccgtaaaggggcctga

SEQ ID NO: 3015 - DNA, 1440 bp, Enterobacter cloacae
agccctaatgtttgcagcatcattcgagaatcagaggtgtctatgagtcactcttccgctcccgaaagggaaactggtgccgttattacagactggcgtccagaggatccggcgttctggcaacagcgcggccaccgtgtagcaagtcgtaatctgtggatttccgttccatgtctgttactggcgttttgcgtctggatgttgttcagtgcggttgcggttaacctgccaaaagtgggctttacctttaccaccgaccagctgtttatgttgaccgcgttgccgtcgctttcaggcgcactgctgcgcgttccttatgcgtttatggtgccggtctttggtggtcgtcgctggacggctttcagtaccgggatcatgatcataccgtgcgtgtggctcggttttgcggtgcaggatacctccacaccgtttagcgtgttcgtgattatctctctgctgtgcggttttgcgggggcgaactttgcgtccagtatggcaaacatcagcttcttcttcccgaaagcgaagcagggtggcgcgctgggcattaacggcggtctgggtaacatgggcgtgagcgtgatgcagctgattgccccgctggcgatctctgtctccatctttgcggcctttggcggcggcggtgtgacgcagcccgacggttccgtgctgttcctgcaaaacgcctcctggatttgggtaccgttcctggtggtctttaccctggcggcgtgttttttcatgaacgatctgtccgcgtccaaagcgtcattgagcgagcagctgccggttttgaagcgtggccacctgtgggtgatggcgctgctgtatctggcgaccttcggctcgttcatcggtttctccgcaggctttgccatgctgtctaaaacccagttcccggacgtgcagatccttcagtttgctttcttcggtccgtttatcggcgcgctggcacgttcgctgggcgggatgatctccgaccgtctgggcgggacgcgcgttacgctggtgaactttgttgtaatggccatcttctgtgcgctgctgttcctgacgctgcctgcgggtggtgaggggggtaacttctttgccttcttcggcgtcttcatggtgctgttcctgaccgccgggctgggcagtgcgtctactttccagatgatctctgtcatcttccgcaagctgaccatggaccgcgtgaaagcgcagggtgggagcgacgagcaggcaatgcgtgaagccgccaccgataccgctgcggcgcttgggtttatctctgcgataggcgcgattggcggcttctttattccaaaagcgttcggtatctcactggatctgaccggctcaccggcgggtgcgatgaaagtattcctcgtcttctatatcgcctgcgtggtcatcacctggctggtatatggccgtaataccaagaaaaacaagtaa

SEQ ID NO: 3016 - DNA, 1164 bp, Enterobacter cloacae
acgcctgacaattctgcgcaacagcctcgggctggaatagcgccctatacccattttctaagacaaggtgcatttacgcctatgaagccttctatcgtcgctaaactggaagctctgcacgagcgccatgaagaagtccaggcgctgctcggcgatgccgggaccattgccgaccaggaacgttttcgcgcgctgtcgcgtgaatacgcgcagttaagtgatgtttcaaaatgctttaccgactggcgacaggtccaggaagatatcgaaaccgcgcagatgatgctcgacgatcctgagatgcgcgagatggcgcaggaagagttacaggatgcgaaagcgcgttcagaagagatggagcagcagcttcaggtgcttctgctgccgaaagatccggacgatgagcgtaacgcctttgtggaagtccgcgccggtaccggcggcgacgaagcggcgctgttcgccggggatctgttccgtatgtacagccgttatgccgaatcccgtcgctggcgcgtggagatcatgagcgccaacgaaggcgagcatggcggctacaaagaggttatcgccaaaatcagcggtgacggcgtgtacggtcgactgaaatttgaatccggcggtcaccgcgtgcagcgcgtgcctgcgacggaatcgcaggggcgcattcatacctcggcctgtacggtggcggtgatgccggagctgccggaagcggaactgccggatatcaacccggcggatctgcgcatcgacaccttccgctcttcaggggcaggtggtcagcacgtttacaccacagactccgctatccgtattactcacctgcccaccgggattgtggttgagtgtcaggatgaacgttcccagcacaagaacaaagctaaggcgttatccgtgctgggcgcccgtatccacgcggcggaaatggcgaaacgccagcaggcggaagcctctacccgccgtaacctgctgggcagcggcgaccgtagcgatcgtaaccgcacctataacttcccgcaggggcgcgtaaccgaccaccgcatcaacctgacgctgtaccgtctggatgaggcaatggaaggcaagctcgatatgctgattgagcctatcgtgcaggaataccaggccgaccagctggcggcactgtccgagcaggattaa

SEQ ID NO: 3017 - DNA, 249 bp, Enterobacter cloacae
ccaaaagagaggttaacgatgccatacaaatcgaaaagcgaattaccagataacgtgcaaaacgtattgcctgcccacgcccaggatatctacaaagaagcctttaacagcgcctgggatcagtacaaagataaaaaagatcgccgggacgatgccagccgcgaagagacggcccataaggtggcctgggccgccgtaaaaaatgactatgagaaaggggacgatgataaatggcacaaaaagaaatag

SEQ ID NO: 3018 - DNA, 1227 bp, Enterobacter cloacae
aaaggcacgaatattgcttctcgtaccgaagaatacgtatcggggagagaaacgatgacgatagtggctggcagttcccctggcgcaaccgaatggttccagcgtgcgagaatgttgcgcgaggaacagctcggcagactggcgcagctgggcgcactggtgaatggcatcagtcgactggtgcatatgctacagtgcgagcgcggtgcgtcaaatgtctggctctgctcgcagggcaaattgtacgcgcctgaatgcaaggccagcagggccctggtggatgaaaacctcgccgcattgcaccttcagtttaacgaaccgctgccgggcagcgccctgtgcgaacgtattgccagcgcactgcacggccttgagacgctaacggcgctgcgtgatggcgttacaggtcaatgcgtcaccgcgccgcaggcgatggaacattacagccgcatactgcgtcatttgctcagtatcgtaccccaactcagcgacagcattgacgatccgcacatcgcgggccgatttgtggccctttacagcctgatgcagggcaaagaacttgtgggacaagagcgggcgctgggggctattggtttcacccagggattctttgacgatgaaacccgccagcggctggtggatcgcattgatggccagcaggcctgctttgaggtttttatctcccattgcactccagacgtgcaggagtcatttaccctcaactgcctgccgggtctggagactgaaaaactcaggcgtgaagcgtgcacccgccagcctccggcagataacggtgataccgccctcaaatggtttgccctgcaaaccgcgcgccttgagcacctgcgcacgctggaggaggtggcaattgccgatctgatgacggcagttgaggagcgccgctatagcgaaaacctgcacgcagacgatgaacacgacgatatcctggcgcgatttccggataaaccgctgctgccgctggtgcgccagcaggcgcgtgaaattgagcaactctcccgtcagcttgcttccctgcgcgacacgctggaggagcgtaagaccatcgacaaagccaaaagcgtgctgatgacgcaccagaacatgagcgaggagcaggcgtggaccgccctgcgcaaaatggcgatggataaaaaccaacgcatggtggatatcgcccgtgcgctgcttacggtgaaaaatttgtggaagataccccctggggagtag

SEQ ID NO: 3019 - DNA, 2505 bp, Enterobacter cloacae
agagctggtgatgcgtgcggaggcctcatgaccgaaacccggacaacgtgcccttactgcggggtgggctgcggcgtggtcgccagcgcagacggtgaaaaggtgagcattcggggggatgaaactcatccggcgaatttcggtcgtctgtgtgtaaaaggatctgccctcggggaaaccacggggttgcagggacgcctgctgcgcccggtggtcgatggccgggaggtggcatggccgcaggcgctgggcgaagcgggcgagcggctacggaacatcatcaacgaatgggggccgcaggcggtggcgttttatgcctccggccagctgttgaccgaggattactatgccgccaacaagctgatgaaaggctttatcggggcggcgaacattgataccaactcgcggctgtgcatgtcatcggcggtggtgggctacaaacgcgccttcggtgaagacgtggtgccgtgcagctacgaggacgtggaaaacagcgatctggtggtactcgttggctcaaacgcggcctggacgcatccggtgctgtatcagcggctggtgcaggcaaagcacaacaatccgcagatgaaagtggtcgtgatcgatccgcgtaaaaccgccacctgcgatatcgccgatctccacctcgcgctcagacccggcagcgacgccgggctgtttgtggggttgctcaatctgattcaggggcggggcgagtggccgatccctcgcgtggcggcgttttgcgatctgccttcagacgagattagcaccttctacgactggtttatcaccgcgccacgcgcgatcacgctctacaccatggggatcaaccagtcctccaccggcagcgacaagtgtaacgccatcattaacgtgcatcttgccagcgggaagttcaaccgtcctggctgcggcccgttctcgctgaccggacagccaaatgccatgggcgggcgggaagtgggcgggctggcgaatcagctggcggcgcacatgaacttcgagccggacgatctttcgcgcgtggcgcgtttctggggaacggaacggctggcgcagaccccgggcctgatggcggtggaattgtttgacgccattgcgcgcggcgaggtgaaggcggtgtggatcatgggcaccaaccctgccgtgtcgcttcccgacagccacgcggtgtgccaggctctggcggcctgcccgctggtcgtggtatctgaggtgatgcaggagacggacaccagccggtttgcccatatccgttttcccgccctgggctggggcgagaaaaacggcacggtgaccaattctgaacgccgtatctcccgccagcgcgcgtttctgcctgcgccgggcgaggccagaccggactggtggatcatcgcccggatggcagaccagctcggttatggcgatgccttcgcctggaaacaccctcaggagatattttgtgaacatgcggcgctgacggcgtttgaaaataacggcgaacgggcgctaaacctgcgcgaactggcgtcgctgtcgcgagaggcgtgggacgcgctggcgccttatcagtggcatgccggtgatttcccgcaaagaaatcttgtaccggttgatccttcctcgcatggggcaggcgtcgacgaattgtaccccttgatactgaataccgggcggatccgcgatcagtggcacaccatgacgcgcacggggtatgttccgcgcctgatgcagcatatcgatgaaccttttgttgagatgaacgcgaccgatgcggcgcgcgccgggctgactgacggccagctggcgcgggtaagctccccgcgcggggtgatggttgccagagtacgtatctccaccgcgcagcgtgcgggcgagctgtttacgccgatgcactggaacgcgcaatttgcacggcaggggaaggtcaatgcgctggtggaagggcgggttgatgccgggtccggccagccggagagtaaacaaaccgcggtgaagatcctgccctggctacccgcctggcagggtgaactgtatgcccgcgacctaccagcgctgccgccgtcggtctgctggtggcgtaaagcctcacgtctgacggtggcgggggagcagccgttgctgtcgtgggtcatggcgtacgccagcggtcggggctggcagttacaggtggcacagacgggagaacgcaacagcgtgctcgcctggcatcacggcgagctgatgctgggctactgggagggccatacgctgccggcgctggcgcatgcgtttattgaagaagcctttgctgctgcacccgtacaactcgctgaacgccatgcgctgctgcacggacaacggccgggcgaagatgccgatcacgggcgaattatctgtagctgcttcagcgtgggtgaaaatacgatacgtaaggcgatagccggaggctgtgattctgccgtagcgctgggcgtgaagctgcgctgcggcacgaactgtggctcctgtgtgccggagctgaaagcgctgttgggataa

SEQ ID NO: 3020 - DNA, 1419 bp, Enterobacter cloacae
ttgacgacgttgaaggctgtatcgtcccgcatccgttttttgctgttactccccctttttacggctggagccgttcacggtgcgccgaaatccttcgtgcagcaggcgcagaatccgtttgataataacggcgatagcctgccggatctcggtatggcgcaaccgaccaccgaaggcgaaaagcatctggctgaaatggcaaaggccttcggtgaagccagtatgaccgataacggcctgacggccgggcagcaggcgcgacagttcgcgtttggcaaagtgcgggatgccgtcagcggggaagtcaacgagcagattgaatcctggctttcaccctggggaaacgccagcgtcaatgtactggtggatgacgacggcaactttaacggcagcagcggtagctggtttatcccctggaacgacaacacccgttatctgagctggagccagcttggcctgacgcagcagacagatgggctggtgagcaatgtcgggatcgggcagcgctgggttgccggaaactggctgctgggctacaacaccttttacgacaacctgctggaagacaacctgcaacgtgccgggctgggcgcagaggcgtggggtgaaaacctgcgcctgtcggccaattactaccagccgttcgctggctggcagccgcgttccgacatccgcgagcagcgcatggcgcgcgggtacgacgtaacggccaaagcctggcttccctggtttcatcacctgaacaccagcgtcagctttgaacagtattttggcgataatgtcgatctgtttaacagcggtacggggtatcacaacccggttgcggtcaacctggggctgaactatacccccgttccgctggtcaccctgacggctgcccataagcagggcgagagcggcgttagccagaataacctcgggctgaagctcaactatcgttttggcgtgccgctggcgaaacagctttccgccggggaagtggcggcgacgcgatcgttgcgggggagccgctatgattcacccgatcgcgataatctgcccgtgatggaattccgtcagcgcaaaaccctctcggtatatctggccacgccgccgtgggatcttaagccaggcgaaacggtgatgctgaagctgcaaattcgcagcacgcacggtatccggcagatccactggctgggtgatacccaggcgctcagcctgacctcaccggcaaacggcaacagcagcgatggctggagtgtgatcatgcctgcatgggatgattcggaaggggcgaaaaatacatggcggcttacggccgtggtggaagataaggatgggcagcgtgtctcctccaatgagatcacgctttccgtggtgcaaccgctcgtcgcaatgcctgccgacgatccacggtggaagttgctgccggatgagtaa

SEQ ID NO: 3021 - DNA, 1302 bp, Enterobacter cloacae
tgcgtcctgctaaccttattaacgctggtactactcccgctcaacatgaccctattagcactcggtattaaccacaaaacggccccggtttcactgcgagaacgcgttacgttttcgccggatacgctcgacctggcgctggacagcctgcttgcacagccgatggtgcagggtggcgtggtgctgtcgacgtgcaaccgtaccgagctctatttaagcgtggaggagcaggacaaccttcacgaggcgctgatccgctggctatgtgactaccacaacctcaacgaagaagagctgcgcaacagcctgtactggcatcaggataacgatgcggtcagccatctgatgcgcgtggccagcggtctggattcgctggtgctgggcgagccgcagatcctcggccaggtgaaaaaagccttcgcggattcccagaaagggcatctgaaagccagcgaacttgaacgaatgttccagaagtcattctccgtggcgaagcgtgtgcgaaccgaaaccgacattggcgccagtgcggtttcggttgctttcgcggcctgtacccttgcccgtcaaatcttcgaatcgctgtcgaccgtcaccgtactgctggtgggggcgggcgaaaccatcgagctggtggcgcgccatcttcgcgaacacaaggtgaagaagatgatcatcgccaaccgcacccgcgaacgtgcacaggtgctggcagatgaagtgggcgctgaggtgattgcgttgagcgacatcgatgaacgtctgaaagaggcggacattattatcagctctaccgccagcccgctgccgattatcgggaaagggatggtcgagcgtgcgctgaaatcccgccgcaatcagccgatgctgctggtggatatcgccgttccgcgtgatgtcgaaccggaagtgggcaaactggcgaacgcctacctgtacagcgtggatgacctgcaaagcatcatttcgcacaaccttgcccagcgtaaggcggcggctgtgcaggcggaaactatcgttgagcaggaaaccagcgaatttatggcctggctgcgcgcgcaaagcgtcagcgagaccatccgcgaataccgcggtcaggcggagcaggtgcgtgatgacctgacggccaaagcgttagcggcccttgaacagggcggcgacgcgcaggcgattatgcaggatctggcctggaaactgaccaaccgcctgatccatgccccaaccaaatctcttcaacaggctgcccgtgacggggacgatgaacgcctgacaattctgcgcaacagcctcgggctggaatag

SEQ ID NO: 3022 - DNA, 417 bp, Enterobacter cloacae
acgtctgacgctggggcagcggtcatgagcctgtttacgctgctgatctccgttcacctggtttccgttgccctgaccattggcttttttattgcccgctactggtggcgctacaacaacaatccgctgattaacgcccgctgggtacgcatcgccccgcactgtatcgacacggtgctgttcctttccggagccgggttaatgtggaagaccggctatctgccatttactgataaaggcgcatggctgactgaaaagctgtttggcgttatcatctacatcgttttgggttttatcgcgcttgggcgtcatcgtccgcgcagccagcagacagggtttatcgcctttttgctgggtctggtggtgctgtacatcatcattaaactcgccaccacaagaataccgttactggggtaa

SEQ ID NO: 3023 - DNA, 813 bp, Enterobacter cloacae
gtcatgaggtccttagccgatttcgaatttaacaaagtgccgctctgcgatggtatgatcctgatttcagagatgatccgcgacgattttacgtcacagtacgtttacgctgaactggagaatctggtcagcctggcgcgcgaagagatcaatcaggcacgtccgcaggactggcaattagagaagctgattgagcttttctacggcgaatggggtttctgcgacacgcgaggcgtgtaccgcctgtctgacgcactgtggctggaccaggtgttgaaaaatcgtcagggcagcgccgtcgcgttgggcgccattttactgtgggttgcgcacgagctggagattccactggtgccggtcattttcccgacgcagatgattttgcgggcggagtggctggacggtgagatgtggttaatcaatccgtttaacggcgacacgctggatgagcatacgctggacgtctggctgaaaggcaacatcagcccgatagctgagctgttcaatgaagatctcgatgaagccgataacgccgaagtgatccgcaagctcctggatacgctgaagtctgcgctgatggaagagcgtcagatggagctggccctgcgcgcaagcgaagtgctgttgcagttcaatccggaagatccgtacgaaatccgcgaccgcggcctgatttatgcgcagctcgactgcgagcacgtggcgctgaatgatttaaattatttcgtcgaacaatgtccggaagacccgatcagcgagatgatccgcgcgcagatcaacgcgatcgcgcataaacacattacactgcattaa

SEQ ID NO: 3024 - DNA, 864 bp, Enterobacter cloacae
ggcgatcctatgaaacaaaaagtggttagcattggtgatatcaacgtggcaaacgacctgccgttcgtgctgtttggcggtatgaacgtgctggaatcccgcgatctcgctatgcgcatctgcgaacactacgtgaccgtgacccaaaaactgggcatcccgtacgtgtttaaagcctcttttgacaaagccaaccgctcctccattcactcataccgtggcccgggcctggaagaggggatgaagattttccaggagctgaaacagacgtttggcgtgaaagtgatcaccgacgtgcacgaggcgtctcaggcacagccggtggctgatgtggtagacgtgattcagcttccggcgttcctcgctcgccagactgacctggtagaagcgatggcgaaaaccggtgccgtgattaacgtgaaaaaaccgcagttcgtgagcccaggccagatgggtaacatcgtcgacaagtttatcgaaggcggtaacgaccaggtgatcctctgcgaccgtggttcaaacttcggttatgacaacctggttgtggatatgctgggcttcagcgtgatgaagaacgtctctaaccagtccccggtgattttcgacgtgacccactccctgcaatgccgcgacccgtttggcgccgcgtctggcgggcgtcgtgcgcaggtgaccgaactggcgcgcgccggtatggcaaccggcctggcgggtctgttcattgaagcgcacccggatccggctaacgcgaaatgcgacggtccatccgcgctgccgctggataagctggagccgttcctgaaacagatcaaagcgattgacgatctggtgaagagcttcgacgagctggataccagcaactaa

SEQ ID NO: 3025 - DNA, 891 bp, Enterobacter cloacae
aggggcctgagtatgcagcatctgcaaaatacaaaaccacaagagacgtcagagagcggggaagtgatagtcctgcctccgttacaggttcgccgtcgtgcgcccgcgtttacgcgtcggatgaatgattttttacagcgcgtcatcccggcgctgctcggtctcggcctgctggtggtgctctggcagctggcggcgataaacagtaaaggctttccgacgccgctcagcacgctcgattcggccatgaccctgtttgccgatccgttttatcgcgacgggccaaacgatatgggcattggctggaacgtgctggcgtcgttgcagcgcgtcgccatcggcttcggtctggcggcgctggcgggcattccgctgggctttttgattggccgcttcacctttttctcccgcatgttcaacccgctgatcgcgctactgcgtccggtcagcccgctggcctggctgcctatcggcctgctgctgttccagaaagcggagcctgcatcgagctggactatttttatctgctccatctggccgatggtcattaacaccgccgaaggggtgcgctgtattccgcaggactacctcaacgtggcccgggtgctgcaactctcagagtggaccatcatgcgccgcattcttttcccggccgtgctgcctgcggtgctgaccggggtacgtctttccattggcattgcctggctggtgattgtcgccgccgagatgctcaccggaggtttaggcattggcttctggatctggaatgagtggaacaacctcaacgtcgaaaacattctcatcgccatcgtcatcattggcgtggtcgggttgctgctggagcaggggctgatgctgatcgcccgtcgctttagctggcaggaaaaataa

SEQ ID NO: 3026 - DNA, 798 bp, Enterobacter cloacae
ggagtgaagatgaaaccgttaattcaggtccaggccgtgagccagcgtttttccaccgccagcggcgagtttctggcgctgcaaaacgtctcttttgatatccacgagggcgaaaccgtcagtctgattggtcactccggctgcggcaagtcgacgctgttaaacctgatcgccgggatcacgctgccgacggaaggcgggctgatttgcgacaaccgcgaaatcgccgggccggggccagagcgcgcggtggtgtttcagaatcattcgctgctgccgtggctgacctgcttcgacaacgtggcgctggcggtagatcaggtcttccgtcacaccatgagtaaggccgagcgcaaagcgtggattgagcacaatctcgaccgggtgcagatgggccacgcgctgcacaagcatcccggggagatctccggcggcatgaagcagcgcgtcgggattgcccgcgcgctggcgatgaagccgaaagtgctgctgatggatgagccgtttggcgcgctcgatgcgctgacgcgtgcccatcttcaggattcggtgatgcagatccagcaggcgctgaataccaccatcgtgctcatcacccacgacgtggacgaggcggtactgctctctgaccgcgtactgatgatgaccaacggcccggcggccaccgtgggtgagatcctgcgcgtcgatctgccgcgcccgcgcaaccgggtgcagctggcggacgacagccgctatcaccacatgcgccagcagatcctccatttcctctacgaaaaacagccgaaagcggcgtaa

SEQ ID NO: 3027 - DNA, 3996 bp, Enterobacter cloacae
gggggcacgatgcgactggtcattatcggtaatggtatggcggcaacccggctgattgcgtcgctcaccgggcgtgttcccggtcgtttcgctgtcaccgtcatcggtgacgagccggagcaggcatacaaccgcatccagctttcgccagtgctgggtggcgaaaagcaggcggagcacatctgtctgcacgatgaagactggtacacggcacgaggcgtgacggtgctgcgaggagaaacggcgctcgcagtagacgtcaacgcgcgtgaagtgcatacctctgcttgcacgctgggctgggatgcgctggtgtttgctaccggttctacccctgttgtgccgccgatccccggcggcgatgcgccgcatgtgttcacctttcgcaccctggcagaaacccgcgccatccagaatatctccgggccggcggtagtgctgggcggcggagtactcggcgtggaggcagcggcagcgctggcgcgcaagggtgacaacgtcacgctcgtgcatcgcggtccgtggctgatggaacagcagctggatcagcaggcgggactgttgctggaagaggcgctggcggcgcggggcgttagctgtgaactcgcctccggcatcaccgccatcgctgacgatgccgtgacgtcgctcgacggacgccgcattgccgccacgcgcgtggtgctggcaaccggcgtgcagcccaacgttgcgctggcaaatgccagcggcattcgctgcgcgcgcggcatcgtggtggatcagcagatgcaaacctccgtgccgggtatctacgccatcggcgagtgctgcgaaattgacggccagacgtttggcctggtggccccctgtctggcgcaggcggatattcttgccgcgcggctggccggggaggtcaccgcgccgtttaccctgaccgacaacggcgtgcgccttaaggtgaccggcgtggagctgttcagcctcgggcgcgcgacggcgcaggcggacgatgtggtctggagttcatgggacccgctgacccgtcactatcgacgtttactgatccatcagggggcgctggctggcgtgctgctgctgggtgactgccgcagcgcggcaacctttaccgatttactggcaacggctgcgcccgcccacgcggactggctgttcgatcgtttcacaacgcaaccgcaggttgcaggacagaacgctatgacaaaacctactctggtggtggttgggcacggtatggtcggccatcatttcctcgaagactgcgttaaccgcaatttgcatcagcagtatcagattattgtttttggcgaagagcgctatgccgcctatgaccgcgtgcatctgtcggaatattttggcggacgcagcgcggactcgctctcgctggtggcgggggagttctttgccgataacggcattgagctgcgcctctcccagcagatcgttgctatcgatcgtgatgcacacgtagtgcgtaccgccagtgggcatgagacccactgggacaagctggtgctggcgaccggctcgtacccgttcgtaccacccgttccgggcaacgatctgccggggtgttttgtctaccgcaccctcgacgatctggacaacattacggcccatgcggcaggttctcgccgcggcgtggtaattggcggcggcctgctgggtctggaggcggcgaatgcgcttaagcagctcgggctggaaactcacgtggtggagtttgcgccgaacctgatggcggtgcagctcgacagcgacggcgcggcaatgctgcgcaagaaaattgaggcgctgggcgtaggggtgcacaccagtaaatcgacgacggagattgccaccgcagacgacgggctggtgctgcgctttgccgatggtgaacagctggaaacggacatggtggtcttctctgccggtattcgtccgcaggacgcgctggcgcgcagcagcgggctggttatcggcgagcgcggcggtatctgtattgacgacggctgccggacttccgatccggacgtgcttgctatcggcgaatgcgcgctgtgggagggaaaaatctttggcctggtggccccgggctaccagatggcgcgcgtggccgccgctgtgctggcgggtgaggagaagcgcttcaccggcgcggatatgagtaccaaactcaagttgctgggcgtggatgtggcgtcgtttggcgatgcccatgggcgcacgccgggcgcgctgagctaccagtggacgcacgggccgcagcaaatctacaaaaaaattgtggtcagccacgacagcaaaaccctgctgggtggcgtgctggtgggcgatgccagcgaatacgccacgctggtgcagatgatgctcaacggcatcagcctgccaaaagaaccggaaacgctgatcttacccgtatcgtcaggcagcgcgccgaaagcgctgggcgtggcggcgctgccggaaagcgcgcagatctgttcgtgtcataacgtcagcaaaggggatatctgccaggcggtaagcgcgggcgcaacggatatcggcgccattaagcagtgcaccaaagcggcgaccggctgcggaggctgtagcgcgctggtgaagcaggtgatggagttccagcttgcggagcagggcgtggaggtgaagaaagatatctgcgaacacttcccgtactcgcgtcaggagatttaccacctggtgcgcgtcaaccatatccgcaccttcgaccagcttatcagccgctacggtcaggggcacgggtgcgagatctgtaagccgctggtgggatcggtattggcttcctgctggaacgagtatctgctgaaaccggcgcatctgccgttgcaggacaccaacgaccgctttttcgccaatattcagaaggacggaacgtactccatcgtcccgcggatgcctgcgggtgaagtgaccgccgacgggctgatcgccatcggccagatcgcgaaacgctatagcctttacagcaaaattaccggcgggcagcgtattgacctgtttggcgccacgctcgagcagttgccggaaatctggcaggcgctggtggaggccgggtttgagaccggacatgcctacgggaaatctctgcgcacggtgaaatcctgcgtcgggtcgacctggtgccgctacggcgtgcaggattccaccggcctcgcggtcaggctggagcaccgctacaagggcctgcgcgcgccgcacaaaatcaaaatggcggtctccggctgtacccgtgagtgcgcagaggcgcagagcaaagacgtgggggtgattgccacggacaaaggctggaacctctatctgtgcggcaacggcgggatgaagccgcgccacgcggacctcttcgccagcgatctggacgacgaaacgctgatccgcaccattgaccgtttcctgatgttctacattcgcacggcagatcgtctgcaacgtaccagtacctggatggataacctggaaggcggcctcgactatctgcgcgaggtgatcctcaacgacagcctggggatcgcccacgagctggagcaggagatggctcgggtgatggaaacttaccagtgcgaatggcaaaccacccttaacgatcctgaccgcctggcgctgttccgcactgcggtgaacgtccccgccgcggaggagaacaagcgctggcaggaaatttgtaatatcgatgagatcccggagcaggcgggcatcggtgcgcatcttgggcgcaaaccgattgcgctgttccgctttggcaaaaacgtttatgccctcgacgatcgggagccgggtagccgcgcgaacgtgctttcacgcggcatcctcggcgatgcggcgggggaaccggtggtgatctcgccgctctacaagcaacgtattcgtctgcgcgacggctgtcaggtggagaatggcgaacccgtggtgcgcgcctggccggtaaaaattgaaaacggcaaggtatgggttggaaatgaagagctggtgatgcgtgcggaggcctcatga

SEQ ID NO: 3028 - DNA, 582 bp, Enterobacter cloacae
gaaattatgcgttatctgagcaaggacgagcggcgggaagagatcctccaggccgcgatgcgcgtggcgctgaccgaaggattcgctgcaatgaccgtgcgccgcatcgccaccgaagcgggcgtcgctaccgggcagttgcatcaccactttgcgtcggcgggcgagcttaagtcgctggcgtttgtccggctaatccgcgatttgctggatgctgaaatcgttggcgaaaacgctggctggcgcgagcgcctgcatgccatgctcggcagcgatgacggcgggtttgagccctacattcggctgtggcgagaggcgcaaattctcgccagccgggatagcgatattaaaggcgcctacgttttgactatggagatgtggcaccaggaaacggttgcgattatcagggccggggcggaggccaacgcctttacgcttgctgaccagccggaaaatatcgcctggcgtttaattggtctggtatgtggcctggatggcatatacgtattaaatatgcctgaaatggacgacgcggcctttaataagcatctggataaacttatctccctcgaattgttttaa

SEQ ID NO: 3029 - DNA, 918 bp, Enterobacter cloacae
agagatgtaccgctatctggcgattgccaactacgaagaccgcttcgtgatccccaccagccaccgcgaaatggcacgcgacgctttcccggagaaaaacggctgcggcttcaccttcggcgacggctgtcacggctccgacacaaaattcaacctcttcaacagcagccgcatcgacgcgatcaacatcaccgaagtgcgcgatcacggggagggagagtaatgcaaatcctcaaaatcatcgcgctgctcattgagtatcccgatgagctgctgtgggaaaaccgtgacgaagcgctttccctggtggaacaggatgcgcccatgctgctgccgtttgcgcagcagcacctgagcgccccgctgctggataagcaggccgaatggtgtgaagtcttcgagcggggacgcgcaacgtcgctgctgctgttcgagcacgttcacgccgagtcgcgcgatcgcggtcaggcgatggtcgacctgatgagccagtatgagaaagccgggctggagctggattgccgcgagctgccggactatctgccgctctatctggaatatctcagtatcgtcagcgacgacgaggcacgtgaagggctgcaaaacgtcgcgcctatactggcgctgattggaggccgcctgaaacagcgcgaggtcgcgcattaccagctgtttgacgccctgctgtcgctggcggaaacacggctttccagcgacagcgtggcgaaacaggtatccggtgaaaaacgggatgatacccgtcaggcgctggacgccgtgtgggaagaggaacaggtcaagtttatcgaagacaacgccacatcgtgcgacagttcgccgatgcagcaatatcaacgacgctttagccaggacgtcgcgccgcagtacgtggacgtcagcgccggaggcccaaaatga

SEQ ID NO: 3030 - DNA, 765 bp, Enterobacter cloacae
atgcagcccccgcagggtatcgatattaacctgtacgggctgctgccagcccgtgcgggcaaaataagcactcagaaatggggacatgatttgctccaggaggtgatatcccctgtttataaactattttcccttttgcatatgcgtaaaagtgctttttcgtcatactcatcgtgtacacgaggagatcctatgagccactttcgccctgttgaattacgtcacgccagccgccttctgaatcacggtccaaccgtgctcatcaccagccgggatgagaccatcgatcgtcgcaatgtcatggccgccgcatggtctatgccggtggaatttgaacccccgcgtatcgcgattgtggtagacaaaagcgcgtggtcacgggagttgatcgaacgcagcgggaaattcggcattgtgatccccggcgtggcggcagccaactggacctgggcggtcggcagcgtcagcgggcgcgacgaggataaatttaactgctacgggatcccggttatttatggccctgagcttgacctgccggttatagaagagaaatgtctggcttggatggagtgcaggttattacctgtcacctctgcggcagagaaatatgacactctgtttggcgaagtggtttccgccgcggcggatgaacgcgcatttgtcgccggacgctggcagtttgacggggataagctgaatacgttgcatcacatgggagcgggtacgtttgtcgcgagcgggaaaatggtgaaggcgctggaatga

SEQ ID NO: 3031 - DNA, 285 bp, Enterobacter cloacae; identical to SEQ ID NO: 1479

SEQ ID NO: 3032 - DNA, 219 bp, Enterobacter cloacae
tttcgaggtctactggcagcggctggtcgagacatctgttcttatggcgaccaggatctggttgaatacgttgacgttggcgcgagctactacttcaacaaaaacatgtccacctacgttgattacaaaatcaacctcgtggatgacagccagttcaccaaagatgccaaagtggctaccgacaacatcgtggctgtaggtctgacctaccagttctaa

SEQ ID NO: 3033 - DNA, 1473 bp, Enterobacter cloacae
catccaataattcccacaagccatcgaaaggtatctttctgtttttatttaattttttctctccacttgggtaagcaagagggtgatatgtcacatcaaagcgagaagagtaaccagcatctgttgagtaactggaaaccggaaaatgcgcaattttgggagaataaagggaaacatatcgcacgaagaaacctgtggatttccgtggcgtgtttgctcctcgcgttttgtgtctggatgttgtttagcgctattgcggtaaaccttaataaggtcggatttaatttcagcaccgatcagctttttatgctaacggcattaccttctctctccggcgcgatattgcgtgtcccctactcttttatggtgccgatatttggcgggcgttactggaccgtgttaagcaccgttatcctggtcgtaccctgtgtctggcttgggatcgccatccagaataccgccacgccttactgggtctttatcatcattgcactgctgtgcggttttgccggcgccaacttcgcttccagcatgggaaacatcagcttcttcttcccgaaagccagacagggcagcgcgctgggcattaacggcgggctgggtaacctgggtgtgagcgtgatgcagctggttgcgccgctggtgattttcctgccgatgtttacctttctcggcgttcatggcgtcccccaggaggatggctcgacgatgtggctggcgaacgcggcgtggatctgggcgccgctgctgattctggccacccttgcggcgttttttggcatgaacgacatcgccagctcgaaagcatccattgccagccagcttccggtacttaagcgctttcacctttggctgctgagcctgctttatctggcaaccttcggctcgtttatcggtttctcggcaggctttgccatgctgtcgaaaacccagtttccggacgtaaatatcctccacctcgccttctttggtccgctgattggcgccctggcgcgttcggctggcgggatgatttcagacaggctgggcggcgtacgggtgacgctgatcaacttcgtctttatggccatctttagcgccctgattttcctgacactccccgggtctggttcaggcagttttatcgccttctatctggtctttatgggtctgtttctgaccgcaggcctgggcagcggctcgaccttccagatgatcgcgattatctttcgccaaatcaccctcgaccgcgtaaaaaaacagggcgggagcgacgaacaggcacagcatgaagcggtgaccgaaacggctgccgcgctgggctttatctctgccatcggtgcggtaggcgggttctttattcccaaagcctttggcacatccctggcgatgaccggatccccggtgggcgccatgaaagtcttcctcgtgttttacatcgtctgcgtgctcgtcacctggctggtgtacggccgcaaatcctcacaaaaataa

SEQ ID NO: 3034 - DNA, 1590 bp, Enterobacter cloacae
ctggctggacggcgaaggtcgggatcaggtacaggaggcgaaaaaatgaaaatacgctcacaggttggcatggtactgaatctcgataaatgtattggctgccacacctgctcggtcacctgtaagaacgtctggaccgggcgcgaagggatggagtacgcgtggtttaataacgtcgaaaccaaacccggcatcggctatccgaaaaactgggaagatcaggatgagtggcaaggcggctggatccgcggtattcacggcaagctgaccccacgcctcggcggaaaaatgggcgtcctgtcgaaaattttcgccaaccccgtgttgccgcagattgacgattactatgaacctttcaccttcgattaccaggatctgcaccgcgccccggagggggatcacctccctaccgcccgcccacgttcgctgatcgacggtaagcggatggataagatcgtctggggaccaaactgggaggagctgctgggcggcgagttcgaaaaacgcgcccgcgatcgaaactttcagaagatccagaaagagatgtacggccagttcgaaaacaccttcatgatgtacctgccgcgcctgtgcgagcactgcctgaacccgagctgcgtcgccacctgcccgagcggtgcaatttacaagcgcgaagaggacggcattgtgctgatcgaccaggacaaatgccgcggctggcgtctgtgcattagcggctgtccgtacaaaaaaatctacttcaactggaaaagcggcaagtcagagaagtgcatcttctgctatccgcgcatcgagtccggccagccgactgtctgctcggaaacctgcgtcggacgcatccgctatctcggggtgctgctgtatgacgcagaccgcattgaagaggcggccagcaccgagcatgaaaccgatctgtatgagcgccagtgcgacgtgttccttaacccgaacgatccggcggtgattgaagaagccctgaagcagggcatcccgcagaacgtcatcgacgcagcgcagcgttccccggtttacaaaatggcgatggactggaagctcgccctgccgctacacccggaataccgcaccctgccgatggtctggtatgtgccgccgctgtcaccgattcagtcctacgcggacgcgggtggtctgccgcagagcgacggcgtactgcctgcggtagaaagcctgcgcatcccggtgcagtacctggcaaacatgctcagcgcgggcgataccggcccggtgctgcgcgccctgaagcgcatgatggcaatgcgtcactacaagcgctcccagaccgtggaaggcgtgaccgatacccgcgccattgaagaggtcggcctgaccgaagcgcaggttgaagagatgtaccgctatctggcgattgccaactacgaagaccgcttcgtgatccccaccagccaccgcgaaatggcacgcgacgctttcccggagaaaaacggctgcggcttcaccttcggcgacggctgtcacggctccgacacaaaattcaacctcttcaacagcagccgcatcgacgcgatcaacatcaccgaagtgcgcgatcacggggagggagagtaa

SEQ ID NO: 3035 - DNA, 234 bp, Enterobacter cloacae; identical to SEQ ID NO: 1481

SEQ ID NO: 3036 - DNA, 345 bp, Enterobacter cloacae
cctattgttgatatagctcaatctcacgcgagacgcaggaaaacgatgatcccaaaccacccggaacctgaacaaatagtgttggaaaatgtgctgttcgccctcggcaacccgctgcgattagcgattattcgcaggctggccgacggcagcgaactgagctgtaacgcgctgcgcccggaagaggtggtgaaatccactatgactcaccactggcgcgtgctgcgcgacagcggcgtgatctggcagcgcccgcaggggcgcgagaatatgatttcactgagaagagaggatctggacacccgctttccgggactgctggcgatcctgctccaggctaagtag

SEQ ID NO: 3037 - DNA, 897 bp, Enterobacter cloacae
gccgccatgttaaaagacaacttcaacgatctgctttcctttatggtcgtcgcccgggagcgcagctttacccgcgccgcggcgcagcttggggtatctcagtcggcactcagccacgcaatgcgcaatctggaggcgaggctggaagtccgtctgttaacccgcaccacccgtagcgtagcccctaccgaggccggtgagcaactcttcatgcgcttaagcccccatctgctggagatcgagcaggaactcaccgcgttgcgtgatacccgcgacagacctgccgggaatattcgccttaacgccggggaacacgccatgtctacagtgctgtggcctgtgcttaaaccctttatggcgcagtatcctgacatcaacgttgaagtcacggtggacaatgggctgactgatattgttgatggccgctttgacgcgggggtgcgtctgggtgagcaggtggcgaaagatatgattgcggtacgtattgcgccggacatgcgcatggcggttgtcgggtcagcagagtatttgcaacgtttcggcataccgaaaacgccggagcagctcgatcagcaccgctgcattaatatgcgcctgcccacacgcggcggattatatgcctgggaatttgaacgggacggacgtgagctgcgcgtgcgggttgacggccagctgatcctcaacagcctgccgcagcgcatcgatgccgccgaaaacggtctggggctagcgtatgttccgcaagatgcggttcaggacgcccttgctaagggccggttagtgggtgtgcttgaagcctggtgtccggcttttacgggataccatctgtattatccgagccgccgccagcacactaccgcctttgcattacttattgcagccctgcggcatacatag

SEQ ID NO: 3038 - DNA, 1599 bp, Enterobacter cloacae
ctggaaaggcagcatgtgtctgcgcagaagcaatcgtttgtttcggcatctgccaggcaggactatcacgttaatggttcagacaggcaaacaggtaactcaatgaaaacaagcaataaaagcgcagccgatcatcatgctgcgaaacgtcgctggttgaactctcatgaagagggctatcacaaggcgatgggcaaccgtcaggtgcagatgatcgccatcggcggcgctatcggtacaggtctgtttttaggtgcaggcgcacgtctgcaaatggctggccccgctctcgccctggtctatctggtgtgcgggatcttctctttcttcatccttcgtgccctcggcgaactggtactccaccgcccttccagcggcagctttgtctcttacgcccgcgagtttcttggtgaaaaagccgcgtatgtcgcgggctggatgtacttcgttaactgggcaatgaccggtattgtcgatatcaccgccgttgcgctgtatatgcactactggggcgcgtttggcgatgtgccgcagtgggtgttcgccctcggagcgctggcaattgtcgggaccatgaacatgatcggcgtgaaatggttcgccgaaatggagttctggttcgcgctggttaaggtgctggccattgtgatcttcctggtggtcggtaccgtattcctcggcaccggtaaaccgctggacggtaacgcaaccggcttccacctgattaccgataacggtggtttcttcccgcacggcctgctgccagcgctggttctagtgcagggggtggtgttcgcctttgcctccatcgaactggtcggtacggcggcaggtgaatgcaaagatccgcagacgatggtgccaaaagccatcaacagcgtgatctggcgtatcggcctgttctatgtgggctccgtggtgctactggttctgctgctgccgtggaacgcataccaggcgggccaaagcccgtttgtaaccttcttctctaagctgggcgtgccgtacgtgggcagcatcatgaacatcgtggtactgaccgccgcgctctccagcctgaactccggactctattcgacgggccgtatcctgcgctccatgtcgatggggggctctgcgccgaagtttatgtcgaagatgagcaagcagcaggtgccttacgcgggtattctggccactctggtggtgtatatctttggcgtgttcctgaactatctggtgccgtctcaggtgtttgagatcgtgctgaacgtcgctgcactgggcattattgcctcctgggcctttattgtggtgtgtcagatgcgcctgcgcaaagcgatcaaagaaggaaaagcggctgacgtcagcttcaagctgcccggcgcaccggtgacctcctggcttaccctgctgttcctgctgagcgtgctggtgctgatggccttcgactacccgaacggtacctacaccatcgccacaataccgctgctggcggtgctgttgattgctggctggtttggcgttcgtaaacgcgtgaatgaaatccacagtaccgcaccggttcatcctggagatgacaaacaggacggtccgctggtggaagagacgtcgcgttaa

SEQ ID NO: 3039 - DNA, 996 bp, Enterobacter cloacae
ccggtttactccatgaaaattattactgcccgcaaggcatcactacccctgctgttcgctcccgtcatttttggcccgctgagtgcgatggccgcggatgaacagaccctgatcgtcagcgccacgccgcaaactgtctccgaactggacaccccggccgcagtcagcgtggtgagcggcgaggatatgcgacatgccacaccgcgcatcaacctttctgaatcccttgggagcgtgcctggcctgcaaatccagaaccgccagaactatgctcaggatctgcaactttccgttcgcggattcggcgcgcgttcaaccttcggcgtacgcgggatccgcatgtacgtggacggcattccggcaaccatgcccgacggccaggggcagacgtcaaacatagacctcaacagcattgagagcgtcgacgtgctgcgcggccccttctctgccctgtacggcaatgcctccggcggcgtaatcaacatcaacacccagaccggacaacagccagccacaattgaagccagcagctattacggcagttacggcacctggcgttacggcatgaaggccaccggtgcggtgggcgacgggactcaggcgggggatgtggactatgcggtatccaccacccgcttcaccacccatggctatcgcgaccacagcggcgcacggaaaaacctcgccaatgcgaaactgggcgtacgcattgatgatgtcagcaagctaacgctgatttttaacagcgtcgacatgaaagccaacgatccgggcggactgagttatcaggagtggcagaacaacccacgccagtcaccccgtggcgatcagtacaacacgcgtaaaaccattaagcagacccaggccgggatccgctacgactgtcagttgagcgaacaggacgacctcagcgtgatgatgtacgccggtgagcgtgaaatgacccagtaccagtccattccggataccgcgcagactgaaaatcctgcgcactag

SEQ ID NO: 3040 - DNA, 3783 bp, Enterobacter cloacae
tgcctcaccctccggccatgctatcgaagcaggagaaatgtcatgagcaaactgttggaccgcttccgttacttcaaaacaaaaggcgacagtttcgccgatgggcacgggcaggtgtaccacaccaaccgcgactgggaggacagctaccgtcaacgctggcagttcgataaaattgtgcgatccacccacggcgttaactgcaccggctcctgtagctggaagatttatgtcaaaaatggcctggtgacctgggaaacccagcagaccgactacccgcgtacccgccctgacctgcctaaccacgaaccacgcggctgcccgcgcggcgcaagctactcctggtatctctacagcgccaaccgcctgaaatacccgctggtgcgccgtcggctgatcgaactctggcgcgaggcgctggcgcagcataccgatccggtgctggcctgggacgccattcagaacgataagcagaaagcgcagagctacaggaaggcgcgcggtaaaggcggttttatccgctcaaactggaaagagcttaaccagctgattgctgccgccaacgtctggaccatcaaaaactacggcccggatcgggtagccggtttttcccccatcccggccatgtcgatggtctcttatgccgccggtacgcgctatctctccctgctcggcggcacctgcctgagcttctatgactggtattgcgatctgcctccggcgtcgccgatgacctggggcgaacagaccgacgtgccggaatcggcggactggtacaactccagctatatcattgcctggggctcgaacgtgccgcagacgcgcaccccggacgcccacttctttaccgaagtgcgttacaaaggcaccaagaccgtcgccattacgccggacttctcggaggtggcaaagctcagcgaccaatggctggcccccaaacagggtaccgacagcgcccttgccatggcgatggggcatgtgatcctcaaagagttccatcttgataacccgagcgattacttcctcaactattgccgccgctacaccgacatgccgatgctggttctgctggatgaacaggctgacggtcgcgtggtgccgggccgcatgctgcgtgcatcggatctggccgacgggctgggtgaaaccaataatccggagtggaaaaccatcgcctttgacgtggccggaaatctggtggcgccgaatggttccatcggcttccgctggggtgaaaaaggcaaatggaacctggagtcgctggccgcgggacaggaaaccgagctgacgctttccctgctcatcacccacgacagcgtggcagacgtggccttcccttactacgggggcaacgagaacccgcatttccgcagcgtgaagcaggagccggtgctgactcgccgagtaccgagtaaaaccctgacgctggccgacggcagccagagacgcgtggttagcgtgtacgatctggtgctcgcaaactacggcctcgatcgcggtctggaagacagtaacgcggcgacaaactacgccgagataaaagcctacaccccggcctggggcgaacaaattaccggcgtccccgcttatctgatagaaaaaatcgcccgtgaatttgccgacacggcgcataagacccacggacggtcgatgatcattctcggggccggtgtgaaccactggtaccacatggacatgaactaccgcgggatgatcaacatgctggtcttctgcggctgcgtcgggcagagcggcggcggctggtcgcactatgtcggccaggaaaagctgcgcccgcaaaccggctggctgccgctggccttcgcgctggactggaaccgtccgccgcgccagatgaacagcacatcgtacttttacaaccacgccagccagtggcgctatgagaagctcaccgcaagggaattgctttctccccttgcagacgcatcgaagtttaccggtcatctgattgatttcaacgtccgcgccgagcgtatgggctggctcccttccgcgccgcagctcaacctcaacccgctgcacgttaaagctcgcgccaacgccgccgggatgtcgccgcaggattacaccgtgcaggcgttaaaatcgggtgatattcgcttcgcctgcgaacagccggacaacggcaagaaccacccgcgcaacctgttcgtctggcgttctaacctgctcggttcgtccgggaaaggccatgaatacatgctgaaatacctgcttggcaccgagagcggtattcagggtgaggatttaggctcaacggacgatgtgaagcctgaggaagtggaatggcaaaccgccgccattgagggcaagctggatctgctggtgacgcttgatttccgtatgtccagcacctgcctgttctcggatatcgtcctgcccaccgccacctggtatgaaaaagacgatatgaatacctcggacatgcatccgtttattcacccgctctccgccgccgttgacccggcgtgggagtcccgcagcgactgggagatttacaagggcatcgccaaagtcttctctgaagtgtgcgtcggacatctcggcaccgaaactgacgtggtgctacagccgctacagcatgactccccgggggagctgtcgcagccttttgatattctggactggcgcaaaggggagtgcgatctgatccccggcaaaaccgcgccaaacattgcagtcgtcgagcgcaactatccggaaacctacgagcgctttacggcgcttggcccgctgctggacacgctcggcaacggcggaaaaggcatatcgtggaacacccagaatgaggtcgatttcctcggcaagctcaactacgtcaagctcgacggcccggccaaaggccgtccgcgcatcgagaccgccattgatgcttcagaggtgatcctcgcccttgccccggaaactaacggtcaggtcgcggtcaaagcctgggaagccctcggcgaactgaccgggcgcgatcacacccatctggcgctgaacaaagaagacgagaaaatccgcttccgcgatattcaggcgcagccgcgcaaaattatctccagcccaacgtggtccggccttgagagcgagcacgtgtcgtataacgcaggctataccaacgttcacgagctgatcccgtggcgcacgatttccggccgccagcagctgtatcaggatcatgcctggatgcgcgccttcggtgaaagtctggtggcctatcgtccaccgattgatacccgcagcgtaacccatatgcgcgagatcccgccgaacggctaccctgaaaaagcgcttaactttctgacgccgcaccagaaatggggcattcactccacctacagcgaaaacctgctgatgcagaccctgtcgcgcggcgggcccatcgtctggatcagcgaaaccgacgcgcgcgagctgggcattgaggacaatgactggattgaagccttcaacgccaacggcgccctcaccgcccgcgcggtggtcagccagcgcgtgccgccgggcatgaccatgatgtaccacgctcaggagcgaatcctgaacattccgggttcagaagtaaccggacggcgcggcgggatccacaactcggttacccgcgtctgcccgaaaccgacccacatgatcggcggctacgcgcagctggcgtacagtttcaactattacggcaccgtcggctcgaaccgcgacgagttcatcatgatccgcaaaatgaaaaacattaactggctggacggcgaaggtcgggatcaggtacaggaggcgaaaaaatga

SEQ ID NO: 3041 - DNA, 729 bp, Enterobacter cloacae
ccaggacgtcgcgccgcagtacgtggacgtcagcgccggaggcccaaaatgactcattacctgaacgtgtttttctatgacatttatccgtacatctgcgccaccgtctttttccttggcagctggctgcgctacgactacgggcagtacacctggcgcgcctcgtcgagccagatgctcagcaagcgcgggatgaactgggcttcgaacctgtttcatatcggcattctggggatcttcttcgggcacctgttcggcatgttaaccccgcactggatgtacgcctggtttttacccatcgcggttaaacagcagttagccatgattgcggggggcatttgcggggtgctaacgctgattggcggctctatgctgctgatccgccgcctgttcaaccagcgggtacgtgccacgtccaccacgccggatattatcatcatgagtatcctgctgcttcagtgcatccttgggctgtcgaccattcctttctccgcccagtatcctgacggaagcgagatgatgaagctggtcggctgggcgcaggggatcgtgacgttcaagggaggctcgtcggaaatgctgagcggcgtcgcgccgatcttccgcgtgcatctggtgctggggatgacgatcttccttatcttcccgttcacccgcctggtgcacgtgtggagcgcgccgtttgagtattttacccgtcgctatcaggttgtgagatcgcgccgttaa

SEQ ID NO: 3042 - DNA, 525 bp, Enterobacter cloacae; identical to SEQ ID NO: 2161

SEQ ID NO: 3043 - DNA, 537 bp, Enterobacter cloacae
ttaactcttcacacgcttcgcaatgatctcttccgccacattccgcggagcttccgcaaaatgatggaattccatcgtatacgtcgcgcgcccctgggacatcgagcgcagcgtggtggcataaccaaacatctcagccagcgggacgtcagcgcgaataatctggctgccgtactgctctgccatcccctgcaccaggccgcgacgggaggagagatcgcccataatgttcccggcatactcttccggcgtttccacctcaacgtgcatgaccggctcaagaataaccgggtccgcccgccgtgcgccctctttgaagccgaggatcgccgccatgcggaaggccatctccgaggagtcaacgtcatggtaagaaccaaacgtcagggtcgctttcacatccaccaccggatagcccgccagcacacccgtattcatggcttctcgcaaccctttttccaccgacgggatgtactcccgcggcaccaccccgcctttggtggcatcttcaaacacaaaaccactcccggctgctaa

SEQ ID NO: 3044 - DNA, 270 bp, Enterobacter cloacae
cggctcaaggctcaggaccacatgaccgtactgccctttcccgccggactgtcggacaaatttaccttctatatctttcaccgctttacgcagggtttcacggtaggtgacctgcggacgaccaatgttcgcctcaacgccaaactcgcgcttcatgcggtcgacgatgatctccagatgcagctcgcccatcccggagataatcgtctgaccggactcttcgtccgtgtgcaggcggaacgacggatcttccgccgccaggcgctgtag

SEQ ID NO: 3045 - DNA, 954 bp, Enterobacter cloacae
agcgatccccattttctcctgatcggccttggttttcggctcaatcgccaacgaaataaccggatccgggaactccatccgttcaagggtgatcaccgcattcgggtcggtcagcgtgtcaccggtggtgacgtctttcagcccgacacaggctgcgatatcccctgcgcgcagctcgtccacctcatggcgatcgttggcatgcatcagcacgatgcgcccgatacgctctttcttgcccttcaccgggttgtacaccgcgtcgcctttacgcagtatgccggaatagacgcggatgaaggtcagctggccgacgtacggatcgctcatcagcttgaaggccagcgccgagaacggttcatcatcgcttgggtggcgctcggcgtgctgtccgtcttcgtctaccccatcaatagcgggcacgtccagtggagacggcatcaattcaatcaccgcgtcgagcatgcgctgcacgcccttgttcttgaaagcgctgccgcacagcatgggctgtatttcaccggagatagtccggatccgcagtcctttgatgatttccgcttcatccagttcgcccgtctcaaggtacttatccataagctcatcgctggcttctgccgcagacgagaccattttttctcgccacgtctgggcggtactcagcagatcgtcaggcaccggcgcgtagctaaatgccatgccctgcgtcgcatcgtcccacagaatggtgcgcatcttgatgagatccaccacgccggtgaagtgttcttctgcccccacggggatcacaatcgggacaggattggctttcagccgctcctgcatcatccgcaccacgcggaagaaatctgcgcccgggcggtccattttgttgacgaatgccagacgcggaacatggtatttattcgcctgacgccagacggtttccgactgcggttgcacgccaccgactga

SEQ ID NO: 3046 - DNA, 402 bp, Enterobacter cloacae
atcatgaaaattatccgtagcggttcgttaccttccgttcagggtccagaggcctggtttaccggcagcgtgcgcattgacgcgcctttccaggcgactgaaccggcaaaagtcggtggcgcgaccgtcacctttgaacccggcgcacgtaccgcctggcatacgcatcctcttggacaaacgctgatcgtgacgcaggggcgcggctggttacaggagtgggggaaagaggcggaaccgctgaatcagggggatatcgcctggatcccacccggcgtgaagcactggcacggcgcaagcgcgcagacggcgatgacccatatcgccatcgcagaagcggtcgaagggagtccggtggcgtggctggagaaggtcaccgacgagcagtatccgaacgagtag

SEQ ID NO: 3047 - DNA, 1020 bp, Enterobacter cloacae
gtcaaacgagaacgcaacatgtcatggcgaatcagcattctggataaaagccccgtcgcagaacacgaaacagccgccgatgcgctggcgcgaaccttagcactggcgcagcaggcagaaacgctgggttatcaccgcttctggattgccgaacaccacaataccccgcagcttgccagcccctcgccggagctgctgattgcctggatcctcgggcaaacaaagcgtattcgcgtgggctcaggcggcgtcatgctgcaacattacagcccctacaaagtcgccgaaaattttaacgtactggccgccattgcgccgggccgggttgatctgggcgttggcaaagcgcccggcggtctgccgctctctacccgcgccttgcagtacggcctaaatccgcaggagaaaggcagctttgcggaccaactgacgcagcttgatcgctggatccgccctgaaaatcagtcagcggaggaggacgttcgcgccacgccgctgccaccggcgcctgcccggggattcctgctgggcgccagtaccgaaagcgtgctgctggcggcctccctcgactggcattttgtctttgccgcccatctgaatggtgaccctgagctgctgcgcgacgtcgtcacagcctggcgtcaacacagcgtccgggaggtgattgtggccgtgcaggccattgttgccccaacccaggctgaggccgatgcgctggcgcagaaggttgaagtgtggggcgtggagctggcaaacggacagcgcgtcaccgtcgccagcgaagaacaggcctacgcctttgcgcggcaggcggggagtgaaccggtgcgcatcgcgcgtcgggcgcagtctctgctggccggaacggcggcgtcggtgcatgaacagctcaacgcgctgcatcagcagtgggggattgacgaatttatcatcgacacgccggtcgctgatggcgcaacgcgcgtgcagtccctgcgactgctggccgaggcgcgtcttaacagggaggttaccgtatga

SEQ ID NO: 3048 - DNA, 1329 bp, Enterobacter cloacae
tttgaggtgaatatgactgcacatcgtcaattgcggctggggaccattttgcatggtgcatccggtaatatgtctgcctggcgccatcccgcggcggtcgcggatgccagcattaattttgatttcgttaaagaaacggctttaaaagcagaagagggcaagctcgactttatatttgtggccgacggcctttatattaacgagaaatccattccgcattttttaaaccgctttgagccgctgacggtgttgtccgcgctggcgagtatcacctcgcgcctggggctggtcggcacgttgtccacctcctacagcgagcccttcaccgttgcacgccagttcgccagcctcgatcacctgagcaacggacgcgcgggctggaacgtggtgacctcaccgctggaagggtcagccaggaacttctcacgtgaaaaacacccggagcatgcgctgcgctaccgcattgccgatgagtatctcgacgtggtgaaaggactgtgggattcctgggaaggggatgcctttatccgcaataaagagagcggacagttctttgatgcgtcgaaactgcatactctggatcaccacggtgatttcttccaggtttccggcccgctgaatattggccgcacgccgcagggacgtccgattgtctttcaggctggcgcgtccgacgacggtaaaaagctggcggcaaaacacgctgacgccatctttacccaccatgacacgcgggaagaagcccaggctttttaccgcgatgttaaacagcagctggaaagtcacggccgtcgcgcaggggatttacatatattccagggcgtcagcgtgattgttggaaacgacgccgatgatgtagaaaaccagtatcaaactacggcggcactggtctccattaatgatgcgctgaattacctcggacgatatttcgagcatcacgacttcagccagtatcccctcgacgcgccgttcccggatattggcgatttgggcaaaaacagctttcgcagcaccaccgatgaaatcaagcgtaacgcccgtgagcgcaacttaactctgcgtcaggtcgcgctggaagccgcatcgccgcgcccgcgtttttccggcacaccggagcaggtggccgatggtttacaggcctggttcgaagagaaggcggcggatggcttcatcattcagggcggcacgccggacaccttcccgcgctttgttgaccaggtggtgcccgttttacaggcgcgtggcctgttccgcaccgactatcccggcaccacgctgcgcgaaagtctgggcttagacgagcccaaaaatcagttcacacaacaataa

SEQ ID NO: 3049 - DNA, 837 bp, Enterobacter cloacae
accagaaccgggcggcgagtcgctcgcgttcggtcaccacttcgccagcacaggagcctgttcatgcaagcctctcctgaaggacacatttccattaccggcgtcagtaagttttttggccgacataaagcgctcgataacgtcacgcttgagatcccgccgggctccgtgacggtgatcctcggcccctctggatcgggaaaatcgacgctgctgcgcgccattaaccatctggagcgcgtagacgaaggctttattcagattgacggggattacatcggctatcgccgtcagggtgacaaactctacgaactaaaagagagagagatcctcaaacagcgcgtcaacgttgggtacgtgtttcagaacttcaatctttttccgcatctcacggtgctggaaaacctgattgaagcacccatcgcgcataaaaagttcagtaaaaaagaggctgttgaaaacgcctacagcctgctggatgtggttggactgcgcgataaagccgatgcctggtcgcgtcacctctccggcggccagcagcagcgtatcgccattgcccgcgcgctggcgctgcgcccgcgcgtgatgctgtttgatgaaccaacctcggcgctggatccggaactggttggcgaagtgctggacgtgattaaaaaactcgcccgttccggcactacgctggtggtggtcacccatgagatcggctttgcccgggaagtggcggaccaggtggtatttatggtcgacggtaaaattgtggagcagggcagcagcgatgacgttttaaaccgaccgtctcatccgcgaacgcgccagttcctctcaaaagtgctgtaa

SEQ ID NO: 3050 - DNA, 897 bp, Enterobacter cloacae
ggagcgcagatgaaatatggactcctggcggggctggtcttcacgacggcgagccacgccagcattgatttaaaggccaacgaacagccgctgccggtgacggttgatcaacaggcagtggcgaaaatcccggcgaactataaatttgttgagccgggtaccctcacggtggcgatttcagccctgaattctccgccgcttgcgctgctggccagtgataaccgcacccgtattggcagcgacccggatatcgcccggttgctggcgggcagtctggggctgaagctgaagctggtgccaacggcgtgggaagactggccgctggggatcacttccgggcgctatgacgtggcgttggtgaatatcgccgtcaccgagcaacgtaaggagaagttcgattttgcgacctatcgcgtcgattccctggccttctcggtgaaatccaccagcaacgtacagtcgatcaccagtgcgaaagatctggccgggaaaaaggtgattgtcgggtctggcaccaatcaggagcgtattctgctgggctggaacgaagagaataaaaaggccgggcgcgagcctgcgttgccggtttacctgaccgacgacgcctcaggcaatctttatattcagtccggcagggcggatgtgttctttggaccgcagtccgtttcggcctataaagccgcgttaaccggcaaaacccgcgtcgtgggtttaggcccgaagaaagcctatgtcgccaccacaaccaaaaaaggtaatgggctggtgtatgcgttgcaggctgcgctggacggtgcgattaagcgcggggagtatcaaaaggtgctggcgcgctggggggaagcgggcgaagcggtgacgtcttcagacgttaatccgcccgggataacctactaa

SEQ ID NO: 3051 - DNA, 273 bp, Enterobacter cloacae
tctgataacgtggaacgctcacctataaaaggagccctgcccatgccacacgttgatatcaaatgttttccacgcgatctgactgacgaacaaaaaacggccctggcggcggatatcgccgaagcgatcgcccgccacttgaacagcaaagatcgctcaatctccgtggcgcttcaggaggttcaggaagctgactggaaggcgcaggtctgggataccgagatcggcccgaaactggatgaactgattaagaagcccggctattcgatgtaa

SEQ ID NO: 3052 - DNA, 1017 bp, Enterobacter cloacae
aaggataatttttccatgacaaaattacctcagttttcactcgcctttattcatcctcgttactggctcagctgggcaggcattgccgcgctctggtgcacggttcagcttccgtacccgctgctgttgaaaacaggtcacaggcttgggcgtctggctatgcgcctgcttccacgccgcgtggagatcgccagacgaaatcttgagctttgctttcctgatatgaaagaggacgagcgcgagcgtttacttgagcgtaattttgaatcggttggaatgggcgtcatcgaaaccgggatagcgtggttctggcctaactggcgcgtgcggagacacttcagcgtgaccggctacgaacatatggaacaggcgcgggcgcaaggtaggggcgtggtgctcattggcatgcattttctcacgctggaattaggcgcacgcatctttggcatgctcaacgcgggtattggtgtgtatcgtcccaacaataatgcgttgctcgactggctgcaaacgcgcggtcgtctgcgttccaataaaaccatgcttgaccgctatgacctgaagggcatgatccgcgcactgaagcaaaacgagatcctgtggtatgccccggaccacgactatggcaaaacgaatagcgtgtttgtgccgttttttgccgtcccggacgccgcgacaactgccgggagctacatgctggtgaaaagtgccagaccggccgtgatcccgtttgtaccgcgccgaaaagcagatggcacagggtatgagctgcttattctggaagatatcagcgataccttgcagggaggcgataaagcgtcggtggccacgcaaatgaacagagcgattgagcgcgccgtgatgatggcgcctgagcaatatatgtggctgcatcgccggttcaaaacccgccctgaaggccagccggaccggtataaacgcaaaaaacaggtcgcgtctactgcaagaaccttatctgccagcgatatttcggaccggtcgagtatccagcagtag

SEQ ID NO: 3053 - DNA, 882 bp, Enterobacter cloacae
tttataaacaggggatatcacctcctggagcaaatcatgtccccatttctgagtgcttattttgcccgcacgggctggcagcagcccgtacaggttaatatcgataccctgcgggggctgcatttacaccataactgcgcgatccccttcgaaaatatcgacgtcgttttgccgcgggaaatccatctggacgacgggtgtctggtggataaactggtcaccgcacgtcgaggggggtattgcttcgagcaaaacggcttgtttgagcgggtattgcgcgaagtcgggtttacggtgcgcagcgtgctggggcgggttgtgctggctaatccgtcgcagatgccgccgcgtacgcaccggttgctgctggttgagctgaacggcgagcgctggatcgccgatgtgggatttggcggacaaacgctgacggcgccgattcgtttgatcgccaacgaggaacaggaaaccccgcacgggcgttatcgtttgctgagcgagggtaacgactggatactgcaattccgccatcacgaccactggcagtcgatgtatcattttgacctggcgacccagtacttcaacgattacgtgatgggaaacttctggtcggcgcactggccgcagtcccatttccgtcatcacctgctgatgtgtcgccacctgccggacgggggcaagctaacgctgaccaactttaattttacccactggcagaacggtcatgtggaagagcagatccatttgccggatgcggaggcgctgtatcagctgatgcaggcgcggtttggcctgggcgttgatgacccgaagcacggctttaccctggcagagctgacggccgtgatggcggggtttgatacgcatccgcaggcgggggaatag

SEQ ID NO: 3054 - DNA, 2112 bp, Enterobacter cloacae
ggaaatatcatgccccgacccattccactcgaacgttatcgcaacatcggtatctccgcgcatatcgatgccggcaaaacaactaccactgagcgcatcctgttttacaccgggatgagccacaagctgggtgaagtacacgatggcgcggcaaccaccgactggatggcgcaggagcaggagcgcgggattaccattacgtcggcggcggtaagctgtttctggcctggtatggacagaggctttgaaccgcaccgcatcaatattatcgacacccccgggcacgtggatttcaccattgaggtggaacgttccatgcgtgtgctcgacggcgcggtaatggtctatgactcagtcggtggcgtgcaaccgcagtcggaaaccgtctggcgtcaggcgaataaataccatgttccgcgtctggcattcgtcaacaaaatggaccgcccgggcgcagatttcttccgcgtggtgcggatgatgcaggagcggctgaaagccaatcctgtcccgattgtgatccccgtgggggcagaagaacacttcaccggcgtggtggatctcatcaagatgcgcaccattctgtgggacgatgcgacgcagggcatggcatttagctacgcgccggtgcctgacgatctgctgagtaccgcccagacgtggcgagaaaaaatggtctcgtctgcggcagaagccagcgatgagcttatggataagtaccttgagacgggcgaactggatgaagcggaaatcatcaaaggactgcggatccggactatctccggtgaaatacagcccatgctgtgcggcagcgctttcaagaacaagggcgtgcagcgcatgctcgacgcggtgattgaattgatgccgtctccactggacgtgcccgctattgatggggtagacgaagacggacagcacgccgagcgccacccaagcgatgatgaaccgttctcggcgctggccttcaagctgatgagcgatccgtacgtcggccagctgaccttcatccgcgtctattccggcatactgcgtaaaggcgacgcggtgtacaacccggtgaagggcaagaaagagcgtatcgggcgcatcgtgctgatgcatgccaacgatcgccatgaggtggacgagctgcgcgcaggggatatcgcagcctgtgtcgggctgaaagacgtcaccaccggtgacacgctgaccgacccgaatgcggtgatcacccttgaacggatggagttcccggatccggttatttcgttggcgattgagccgaaaaccaaggccgatcaggagaaaatggggatcgctctacagcgcctggcggcggaagatccgtcgttccgcctgcacacggacgaagagtccggtcagacgattatctccgggatgggcgagctgcatctggagatcatcgtcgaccgcatgaagcgcgagtttggcgttgaggcgaacattggtcgtccgcaggtcacctaccgtgaaaccctgcgtaaagcggtgaaagatatagaaggtaaatttgtccgacagtccggcgggaaagggcagtacggtcatgtggtcctgagccttgagccgttagcagccgggagtggttttgtgtttgaagatgccaccaaaggcggggtggtgccgcgggagtacatcccgtcggtggaaaaagggttgcgagaagccatgaatacgggtgtgctggcgggctatccggtggtggatgtgaaagcgaccctgacgtttggttcttaccatgacgttgactcctcggagatggccttccgcatggcggcgatcctcggcttcaaagagggcgcacggcgggcggacccggttattcttgagccggtcatgcacgttgaggtggaaacgccggaagagtatgccgggaacattatgggcgatctctcctcccgtcgcggcctggtgcaggggatggcagagcagtacggcagccagattattcgcgctgacgtcccgctggctgagatgtttggttatgccaccacgctgcgctcgatgtcccaggggcgcgcgacgtatacgatggaattccatcattttgcggaagctccgcggaatgtggcggaagagatcattgcgaagcgtgtgaagagttaa

SEQ ID NO: 3055 - DNA, 1074 bp, Enterobacter cloacae
aaaggaattgttatgtctttacgtcatctgtgctcgccgcgcctgcgtgggtctctgctgttgggctctttactgtttgccggtacgttccaggttcatgccgctgaagagatgttgcgcaaagcggtcggcaagggcgcgtatgaaatggccgtcagccagcaggaaaacgcgctgtgggttgcgacgtcacaaagccgcaaaaccgataagggcggcgtggtttatcgtctggatccggtcacgctggaagtgacgcaggcgattcataacgatctcaagccgtttggcgccacgatcgataacgccacccagacgctgtggttcggtaacaccgtcaacagcgccgtgacggcgattgacgccaaaacgagcgaggttaaagggcgcctggtgctggacgatcgcaagcgtagcgacacggtgaagccgcttcagccgcgccagctggtggccgatgacacgaccaatacggtgtacattaccggcatcggcaaggagagcgtgatctgggttgttgatggcgcaacgctgaagctgaaggacactatcacgaacaccggcacgttcagcaccggactggcgctggatgcgaaggcaaaacgcctgtataccaccaatgcggacggcgagctggtgaccattgatacggcaaccaacaaaatcctcagccgtaaaaaagtgcaggatgacggaaaagagcacttctacctgaacctgagcctggacactgtcggccagcgtgcgtttgtgacggattcaaaacagccagaagtgctggtggtgaatctgaaagatggcagcgtgatgcagaaaatcgccgcgccagaatcgctggccgtactgtttaacccggcgcgtaacgaagcctatgtgacgcaccgcgaggcgggcaaggtgagcgtgattgacgccaaaacctacaaagtgaccaagacctacgataccccggtttacccgaacagcctggcgctgtctgcggacggtaaaacgctgtacgtaacggtgaaacagaaatcaacccgtcagcaggaagcgacccagcctgacgatgtgattcgtatcgcgctctga

SEQ ID NO: 3056 - DNA, 576 bp, Enterobacter cloacae
ttcgatccgttttcttcagcatttgcaggcggaacggtgaaaatcaatatcataggtaccagcggaagtgggaaaagcacgtttggcaggcgaatcgcggaggcgctggctatcccttacattgagatggacaggctttactggcgagcgaactggcagggaacaccggacgatgagtttcttgcaaccctggaaaaagcgctcgccgcctcgcctgactgggtcctggacgggaattacaaccgcacacgcgacgttaagtggcgcgacgtcgatctggtggtgtggatagatcgtgggtttatccgcacgctctggcaagcggtgacgcgggcctccagacgcgcctggcacaaacaggagctctggcccggcacggggaaccgcgaaagctttcgtcggtcgttccttagcaaggactctattatcatctggacgatcaaaacctggcgcagcaaccgcaaacgctatcaagcggatatgcaaaacccgcagtacaaacacattcgctttctccgcattacccgacggcaggatgccgaaagactcattgcctcgcttaaatcacgccgatga

SEQ ID NO: 3057 - DNA, 1137 bp, Enterobacter cloacae
cagggaggttaccgtatgagctttagcgaacaactgattgcctggcgccgtgagctgcaccagaaccctgaactctccggtcaggaggtcgaaacaacggcccgcctgcgcgagtggctgacggcagccgggattgcaccgctgccttacgatctccagaccgggctggttgcggagatcggcacgggcaacgcactggttgcgctgcgcgccgatatcgacgcgttacccatcgacgagcgcagcggggtgccgtttagctcccggcgtgccggggtgatgcatgcctgcggacacgacattcacaccagcgtgatcctcggcgccgcgctaaagctgaaagagcgggaagcctcgcttaacggtcgcgtgcggatcctgttccagcctgcggaagaaaatttcggtggagcgaaaagcatggtgcgggccggggcgttacgcgacgtacgcgcgattttcggaatgcataacgagccttcactgccggtcggcgagtttgccacgcgcggcggcccgttctatgccaacgtcgatcgcttcgttattcacgtgaccggcaaaggcgcgcatgccgcacgtccccatgaaggcaacgacgccatcgtgctggcaagccagctggtaaccgcgctgcaaagcgtagccagccgtaacgtcaatacgctggattcggttgttctgagcgtgacgcgcatcgccggggggaatacctggaatgtgctgccggaaagcgttgagctggagggcacgctgcgcacgcaccgcacggaagtgcagcagaacgtgaaagcgcgcgtcggtgaaatcgccgccggatttgccagcgcctttagcgcgcagatcaacatcacctggtacgccgggcccaccgcgctggtgaacgatgagcactgggccgtgtttgccacctcggtcgcgcgcgaagcgggatatgaaacccggcatgcggaactgcacatgggcggggaggatttcgcggtctatctgcaaaacatacccggcgcgtttgtcagcattggcagcaacagtccgtttgggttacatcacccggcatttaacccggacgaagcattaatcgaacccgctgcccgctattttgctcagctcgcggaaaaagccctgcaacacttttaa

SEQ ID NO: 3058 - DNA, 1062 bp, Enterobacter cloacae
ccaggtggtgcccgttttacaggcgcgtggcctgttccgcaccgactatcccggcaccacgctgcgcgaaagtctgggcttagacgagcccaaaaatcagttcacacaacaataaaagagaaaaacgctatgcagaaatcatcgcttattctggcgcttgcgctggcctttacccctgccgtctgggcagagaacgtcaatattaacggcaccggcgtgagcattgaggccaataaaacgccgatcaataccgccaaaaacagcgatgcgatcgcgcaactgccgaaagactatcgttttgccgtgccggggaaatttaccgtggcggtggcgggactgaatcaaccgccactgacggtcttttccgacgacaacaaaactctgctgggaagtgaggtcgacatcgcgcgtctggtagcggacagcctcggactggagctgaacgtggtgcccacctcttgggaggactggccgttgggggttgcctccgggaaatacgacgcggctatcagcaacatcaccgtcactaaagcgcgcaaagagaagttcgacttcgccacctaccgcaaggattcacttggcttctacgtgaaatccaccagtccgatcaactcgcttgtgaaggcagaggatatcgccgggctgcgcatcatcgtgggttccggcaccaaccaggaggccatcctgctggcatggaacgaagagaacctcaaaaaagggcttaaaccctttacgccgatctacaccaaagacgacgcggcccaaacactggcgcttcagtccggacgcgcggacgcctactttggcccgaacgtgatcggtgcctggaaagcggcgcttaacggtaaaaccaaactggtcggcagcgtcgatggcggctggccgaaggcagcgcatatcgcggtgacgctgaaaaaaggcagcggcctggccgaaccggttcaaaccgcgctgaatggcgcgatcaagaacggagattacgacaaggtgctgaaccgctggggggaaggcgtggagcgtatccccagttccgaagttaacccggcgggtctgggcgattaa

SEQ ID NO: 3059 - DNA, 519 bp, Enterobacter cloacae
ggaggcgctatgcgcgaacaatttcgtgacgtttcgccagaagataccgatcttcagcctattatcgaggggctttttggtgaatacgctgctcgttacggcgactacttttcaaaggatgcggaagtcgagctgacagagtggtacctggcgccgcaggggctgtttatcgtactggagcgcgatggcgagatcatcgccaccggggcgtataagcccttcgacgaacataccgcagagatcaaacgtatctggacgaataaaacgctgcgccagcaggggctggccgcgcgcgtggtacaggagctggagcgccgggcggtgctggcgggctacagccacatctacctgaccacggggtttcgtcagccggaggcggtgcggctctatctcagccaggggtatcagccgcagttcgatctcaaccgcgacccggaagagtacagccagccgccgttcgacggtcggctgcgtttcaccaagacgctgatccgcgaagcgctcagcaaaaccgcataa

SEQ ID NO: 3060 - DNA, 936 bp, Enterobacter cloacae
ggagcgacgatgagcaacgttgaaaccataaaagtggtcccggcacgttatccgctgcgcgctgctggcgccgtggtggcgctgtttgtgctggcggtcgtgatccagtccgtggcctttaatccgcgctgggagtgggcggtatttgcccgctggttcttcgacccggtgatcctcgaaggcgtcggccagacgctgctgctgacgttgataagcactgtactgagcgtggtgattggcggcatgctggcgctggcgcggctctcgtcatcatggctgttgagcagcctggcgtggggttacatctggctgttccgatcgctgccgctgatcgtggtgctgattatcctctataacttctcctatctctacgacacgctctctctcggcgtgccttttaccggcattacctggggcagctttgaaaccatcaacgttctcgggcagttttctaccgccatcgtggggctgactctggtgcagagcgcctatactgcggagatcattcgcgggggcttccttggggtcgaccacggtcagtatgaggcggccgctgcgctaggtctgccggcgtggcgtcgcaccgtgcgcataattctcccgcaggcgctgcgcaccatcctgccgtccgggtttaacgaaattatcagcctcgcaaaagggacggcgatggtgtacgtgctggcgatgccggaactgttctacacgatccagatgatctacaaccgcacccaggatgtgatcccgctgttgatggtgggggccgtctggtatctggtgatcaccaccgtactgtctgccatccagcatgttattgagcgtggactcgcccgcagcgagcgccgctccgccgtaaaccagaaccgggcggcgagtcgctcgcgttcggtcaccacttcgccagcacaggagcctgttcatgcaagcctctcctga

SEQ ID NO: 3061 - DNA, 627 bp, Enterobacter cloacae
gggggcaacatgatcaaactctatggcgtacctggctggggatcggcaatcagtgaagtgatgctgactctggcagacatcccgtatcagttcgtcaacgtggacgggtttgaccagcccggcccgcagcgcgaattgctgttgaaactgaacccgctgtgccaggtgccgacgctggagctggaaaacggggcgatcgtgacggaaaccgcggcgatcgccctgatggtgctcgacagacgtcccgacctcgcgccgcccgttgggcaggccgagcgccagcagtttcagcgcctgctcatctggtttgtggcgaacgtctatcccacctttacgtatgcagattacccggaacgctgggttcctgatgccccggaacagttgaagaaaaactgcattgagtaccgaaaatcgctttatctgtggttcgacagccagctcagcgcctcgccgtttgcgtttggcaaacagctgacgctgcttgacgtctatattgccgttgcgcgtacctggggtccacgccatgagtggtttgccaccaacacgcctaattttaccgccgtcgcggatgccgtctgcgcgctgccggaactgcacaaggtgctaaaagctaacgatataatctga

SEQ ID NO: 3062 - DNA, 297 bp, Enterobacter cloacae; identical to SEQ ID NO: 1488

SEQ ID NO: 3063 - DNA, 1395 bp, Enterobacter cloacae
agcatgacgttgggtgccagcggcaaagaattgttgtggattattgatatttactcgctggtgatggcggggatggtgctgccgatgggcgcgatgggcgatcgcataggttttaagcgcctgctgatgatcggcagcgtgctgtttggcctgtcatcgttagcggcggcttttgcgccgtccgcgggctggctgattgccgcccgcgcgtcgctggcgattggcgcggcgatgattattccggctacgcttgcagggatccgcacgctgtttattgatgcgcggcaccgtaatatcgccctcggcgtctgggctgccgttgggtcgggcggcgcggcgtttggcccgctgattggcggcatgctgctggagcacttttactggggttcggtcttcctgattaatgtgccgatcgtgctgatggtggtttcgcttgctgcgcgctttgtgcctgctcagcaggggcggcccgagcagccgctcaatatcagccatgccattatgctaattgtggcgattttactgctggtctatagcgccaaaaccgccttgaaaggggtgctgtcgccgtggatggtgaccattacgctgcttaccggggcggtgatgctgtttatcttcgtccgtatccagctgcgcgcgcgcgtaccgatgatcgacatgcgtctgttttgccatcgcattattttaagcggcgtggtcatggcgatgaccgccatgattgcgctggtgggctttgaactgctgatggcgcaggagttgcagtttgtgcatggttttacgccgtttgaagcagggatatttatgctgccggtgatggtggcgagcggatttagcgggccgatcgcgggtgtgctggtcgggcgtctggggctgcgcattgtcgcggccggaggcatggggctaagcgcagtcagttttatcggcctgtcgatgcttgatttcagcacccaacagtggcaggcgtggagcctgatggtgctgttgggcttcagtgccgccagcgcactgctgacatcgacgtcagcgatcatggctgccgcgccgaaagagaaagcggccgccgcaggcgcgatcgaaaccatgtcctacgagctgggcgctggtctggggatcgccattttcggtttgctgttaacccgcagcttttcggcgtctattgtactgccgcaggggctgagcgcgtcgctgaccgataaagcctcgtcgtccatcggtgaagcgatgaaggtggcgcaggagctgacgccgtcactggccgagccggtgatgacggcggcgaaaactgcgttcatcacctcgcacagcgtggccctgggcagtgcgggaggcatgctgctgattctggcggtcgggatctggtttagtctggcgaaggtcggagggcagcagtaa

SEQ ID NO: 3064 - DNA, 216 bp, Enterobacter cloacae
cagatcttagaactggtaggtcagacctacagccacgatgttgtcggtagccactttggcatctttggtgaactggctgtcatccacgaggttgattttgtaatcaacgtaggtggacatgtttttgttgaagtagtagctcgcgccaacgtcaacgtattcaaccagatcctggtcgccataagaacagatgtctcgaccagccgctgccagtag

SEQ ID NO: 3065 - DNA, 786 bp, Enterobacter cloacae
cagcgccagagcattattaaaatcagtaagttagttaataacgcccgacatgttaactgcgtggagggcaataccacgctgtacgccctgccccgcgcggagatcgtcgaacgctggcgtgagcaaaccaccgacgacttccgcttttgctttaaattcccggcgaccatctcccacaacgccgcgctgcgcaactgcgatgatttaacccacgagtttttcacccggatgtcgcctctggccaaccgtattggccagtactggctccagcttcccgccgcgtttggcccacgcgacctgcccgccctctggcagtttctcgaggccctgccacttgatttcacctacggcgtagaagtgaggcatccggaattctttgccaaaggcgacgcggagaaagcgctcaatcgcggcctgcatgaacgatcggtcaaccgcgtgatcctcgacagccgccccgtgcacagcgcaatcccgcacagcgaagccgttgttgatgcccagcgcaaaaaaccgaaagtgcccgtccatgcgatcgtaacggcgcagaacccgatggtccggtttatcggcagcgataacatgcagcaaaatgaggagatgttcgccgtctggctgcaaacgctggcgaaatgggagcacaccaccacgccgtacctttttttacatacgccggatatcgcacaggcgcctgaactggtcgatgctctctggcaggccttgcagcaggcggttccgtcggttggccccgcgccgtccatcccacaacaatcttctcttttctga

SEQ ID NO: 3066 - DNA, 429 bp, Enterobacter cloacae
agacgtgccatctgccaaaaacagggagttagtatggtcagcgcgctgtatgcggtgttaggtgcattactgctgattaagttttcatttgatgttgtgcgcctgagaatgcagtaccgcgtctcgtacggtgacgggggcttttctgagctgcaaagcgcaatccggatccacggcaacgccgtcgagtacattcccgtcgcgttaattttactgctgttaatggagatggatggcgctgaaacctggatggtgcacgtctgcgggctgctgctgatagcagggcgtttgatgcattattatggttttcaccaccgcctgatccgctggcgtcgttccggcatgagcgcgacctggtgctcgcttttgctgatggtgctggctaacctttggtatatgccgtgggagttggttttctccttccattag

SEQ ID NO: 3067 - DNA, 1011 bp, Enterobacter cloacae
ctttggttctctggtggcgctgaaagccggagacgcagcatgatcgagttcggtaatttctatcagctgattgccaaaaaccatctttcccactggctggaaaccctgcctgcgcaaattgccacctggcagcgcgatcagcagcatggtctgttgaagcagtggtccaacgccgtggagtttctgcctgaactgacgcctcatcgtctggatttactgcacagcgtgacggcggagagcgaagagccgctcccggccgggcagatcaaccgcatcgaaacgctgatgcgcaacctgatgccgtggcgcaaagggccgttttcactttacggcgtaaacatcaacaccgagtggcgctctgactggaagtgggatcgcgttctgccgcatttatccgacctgaccgggcgcaccattctggacgtgggctgcggtagcggctatcacatgtggcgcatgatcggcgcaggcgcgcatctggtcgtcggtatcgatccgatgcagctgttcctgtgccagtttgaagcggtgcgtaagctgttgggtaacgaccagcgtgcgcacctgttgccgctgggtatcgagcaactccctgccctgaaagcctttgataccgttttctcgatgggcgtgctgtaccaccgtcgttccccgctggagcatctctggcaattgaaagatcagctggtcagcggcggcgaactggtgctcgaaacgttggttatcgaaggcgatgaacatgccgttctggtgccgggcgatcgctatgcgcagatgcgcaacgtttacttcatcccttccgcgctggcgctgaagaactggctggagaaatgtgggtttgtcgatgtacgcatcgccgatgtgtgcgtgacgtcgattgaagaacagcgtcgcaccgactggatgatcaccgaatcgctggagcaattcctcgacccggacgatcacagtaaaaccatcgaaggctatccggccccgatgcgtgcggtattgattgcgacgaagccgtag

SEQ ID NO: 3068 - DNA, 1743 bp, Enterobacter cloacae
ggtatccaggtgaatattcaggctcttctctcagaaaaagtcagtcaggcactgattgccgcaggtgcgcctgcggattgcgaaccacaggttcgtcagtcagcgaaagtacagtttggcgactatcaggctaatggcgtgatggcagtggctaaaaaactgggcatgccgccgcgacagctcgctgagcaggtactgacgcatctggatctcaccggcatcgccagcaaaaccgaaatcgccggtccaggctttatcaacattttccttgagcctgcattcctggcaagccacgttgacgcggcgctgaaatctgaccgtctgggcgtggctcagccagaagcgcagaccgtggtggttgactactccgcgccaaacgtggcgaaagagatgcacgtcggtcacctgcgctccaccatcatcggtgacgcggcagtgcgtaccctggagttccttggtcacaaggtgatccgcgctaaccacgtaggcgactggggcacgcagttcggcatgctgatcgcgtatctggaaaaacagcagcaggaaaacgcaggcgaaatggcgctggcagacctggaaggtttctaccgtgaagccaaaaagcactatgacgaagacgaagccttcgccgagcgcgcgcgcagctacgtggtgaaacttcaaggtggcgacccgtacttcctcgagatgtggcgcaagctggtggacattaccatgtcccagaaccagcttacctataatcgtctgaacgtgaccctgacccgtgacgacgtgatgggtgaaagcctgtataacccgatgctgccaggcattgtggcggacctgaaagctaaaaatctggcggtggaaagcgaaggcgcaacggtggtgttccttgatgagtataaaaacaaggaaggcgaaccgatgggcgtgatcgtccagaaaaaggatggcggctatctttacaccaccaccgacatcgcctgtgcgaaataccgttacgaaaccctgcatgcggaccgcgtgctgtattacatcgactcccgtcagcatcagcatctgatgcaggcgtggactatcgtgcgtaaagcgggttatgtgccggattccgtgccgctggaacatcacatgttcggcatgatgctgggtaaagacggtaagccgttcaaaacccgtgcgggcggcaccgtgaagctttccgatctgctggatgaagcgctggaacgcgcgcgtcgcctggtggccgagaagaacccggacatgcctgctgacgagctggagaaacttgctaacgcggtgggaattggcgcggtgaaatacgcggatctctccaaaaaccgtaccaccgactatatcttcgactgggacaacatgctggcgtttgaaggcaacacggcgccatacatgcagtacgcttatacccgcgtactctccgtcttccgtaaagccaatatcgacgaaagcgtgctggcgaatgctacggtgtctattaccgaagaccgtgaagcacagctggctgcccgcctgcttcagttcgaagagacgctctccgtggtcgcgcgtgacggtacgccgcacgttatgtgtgcttacctgtacgatctggccggtctgttctctggcttctacgaacactgccctatcctctctgccgagagcgaagcggtgcgccacagccgcctgaagctcgcgcagctgacggcgaagaccctgaagctcggtctggatactctgggtatcgaaaccgtagagcgtatgtaa

SEQ ID NO: 3069 - DNA, 1347 bp, Enterobacter cloacae
tctcatatcgctcttgggcgtctggaggaatcaatggatagagttacatatccaacaggcgtcgaaaaccacggtggcacattgcgcatctggtttaatttcaaaggtaagcgtgtcagggagagcctcggtgtccctgacaccgctaagaacaggaagatcgccggggaactgcggacatcggtatgttttgccatcagaacaggcacatttgagtacgcggcacagtttccggactcccctaacctcaagacttttggggtggggaagaaagaaattacagtgtcagagcttgccgaaaagtggctggatctgaagagaatggaaatctgcgcgaacgcactcaaccgttatgagtcggtcacaaggaatatggtgccaaggatcgggggtaatcggctggtgtcggcggtgacgaaagaagaattactgtatatcaggaaagatttactgaccggtcaccagatgccaatgaaggggaaggtcccggcaaagggaataagtgttgtcaccgtaaattattacatgacaactattgccggaatgtttcagtttgccgcagatcacggttacttagaggcgaacccattcgacgggatcaagcctctcaaaaaagccagggcagagccagatccgctaactcgtgacgaatttattcgcctgattgatgcatgccggcatcagcagacgaaaaacctgtggtcactagcagtatacacaggggtccgtcatggggagctgacctccctggcctgggaggatatcgatcttgaagctggaacaataacaatcaggcgcaattatacaaaactgggtgaattcactctaccgaaaactgaggccagtaccaacagagtgatacacctcattcagcctgcgatcagcgtcctgaggaatcaggcggaaatgaccaggtttggaaaaaagcatcaaatcgatgttcagctgcgcgaatacggcagaactgagagccacgagtgtacatttgttttcaaccctcaactggtcagaagatgtcagcaggtggggatcatctacaaagtcgactcgataggtgatttatgggacgcagcgatgaagcgagcagggataaggcacaggaaagcatatcagtcgcgtcacacgtatgcatgctggtcactgtcagctggtgctaaccccagcttcattgccagtcagatgggccatgcgagcgcccagatggtcttcaacgtatacggtgcgtggatggcagacagcagtagcgagcagatcgcaatgctgaatcagaggctcgcggattttgccccacagatgccccaaagcatacatagcagcgccagagcattattaaaatcagtaagttag

SEQ ID NO: 3070 - DNA, 840 bp, Enterobacter cloacae
tggtgctggctaacctttggtatatgccgtgggagttggttttctccttccattagcgcacaatatgcccctttatttttcccggatttttacgttatgtcagatcgcgacacgcttttttccgcgcctatcgccagcctgggcgactggacctttgatgaacgggtagccgaagtcttcccggatatgatccagcgctctgttcccggttattccaatattatctccatgatcggcatgctggcggagcgttttgttcaacccggcacgcaggtctatgacctgggctgttcgctgggagcggcaacgctgtccattcgtcgtaacgttcatcacgaaggctgcaagattgtggctgtcgataactcaccggccatggtcgaacgctgccgtcgccacattgacgcgtataaagcccctacgcctgtggaggtggtagaaggcgatatccgcgatatcgacatccagaacgcctcgatggtggtcctgaactttacccttcagttcctggtgccggacgatcgtcagcggttgctggataaaatttatcaaggcctgaacccgggcggcgcgctggtgttatctgagaaattcagctttgaagatgccagcgtgggcgaactgctgttcaacatgcaccatgatttcaagcgtgcaaatggctacagcgagctggagatcagccagaagcgcagcatgcttgaaaacgtcatgctgacggattccgtagaaacccacaaagcgcgcctgcgcaaagccggatttgaacacagcgaactgtggttccagtgctttaactttggttctctggtggcgctgaaagccggagacgcagcatga

SEQ ID NO: 3071 - DNA, 1317 bp, Enterobacter cloacae
ataaaaattttgtatgcatcgacgcaggaaactcttttagcgcatagaggattttttgtggcaagtgcaaacaaactcacgctcttcatcgtgattttcatgctggcgggtattctttcaggtgcggcgatccatgagtatgcttcgtccgacgcgatacaggcctggtcggagaacattacgctactgaccgatattttcctgcggctgattaagatggtgattgccccgctggtgttcagtaccctgacggtgggcattatgaagctgggtgaaacgtcgacgattgggcgcgtcgggggtaaagcgatggtgtggtttatcagctcatctgtgctttccattctggtggggctgtttattgttacccttgaacaacccggcagcggtctgaacctgagcattcccacagagacggttgataccggcctggccgttagtgggatgtcgctgaaagccttcctgtcacataccattccaaccagcattgccggcgcgatggcgaacaatgagatcctgcaaattgtggtcttctcgatgttcttcggcattggcggcgcgtcactgggccaaaaattcaacgccccgctggtcgcggcgctggatgtggtctcccacattatgctgaaggtgacgggctacgtgatgtacgttgcgccgctggccatttttgccgcaatttcgtccgtcattgccacccaggggctgggcattttgctgaactatgcctcgtttattggcggttactatgtggcgatccttctgacctgtctggtattgctggcggtaggttacatggtgctgaaaaaagagatttttcgtctggtggcgatgctgaaagatccggtgctggtcgcgtttaccaccagcagctctgaagctgcatacccgaaaacgctggagcagttagcgcgcttcggctgttcacggaatatcgcctctttcgtcctgccgatcggctactcgtttaacctggtcggctccatggtgtactgctcgttcgcctcaatgtttatcgcccaggcgtacaacattcacctgagtttcaccgaggtgacggtgctgatgttaacgctgatgctggcctcgaaaggcattgcgggtgtaccgcgctcgtcgctggtggtgctggcggcaaccattccgagctttaacattccggtggccgggatcctgctgctgatggggattgatcatttcctggatatgggacggtccgccattaacgtgctggggaacgggattgcgacagcgatgctgtcgcagaatgaaggggcgcgggaagcggaggcagagctggtggagcaggaggcgtaa

SEQ ID NO: 3072 - DNA, 441 bp, Enterobacter cloacae
aaggagtgtgtgatgagttactcccatcttcttgtttctgttgcggtttccccagaaagtcatcaactcgtcgcccgtgccgtttccattgcccgcccgaacaacgcccgcataagtctgatcaccctggcagctgaacccgaaatgtataaccaactggcagcgcctatgctggaagatattcgtgaggttcttcaggaagaaacgcagcaatttctgcgcgagctggttgagcgggcaaactatcctgtccatcagacggtgattgccaccggggaattaagtgaacatattctcgacatttgtcggaaacagaatattgatttggtcatttgcggaaatcataaccagagctttttttcccgggcggcatgctcggcaaaatccatcgtttcgtcaagccaggtggatgtcctgctggtgcctctcgggggcaattaa

SEQ ID NO: 3073 - DNA, 936 bp, Enterobacter cloacae
ggacgcatgaaaaaccagtcccatccgatcgtcatcgtaaaaaagcgcaagcataaggcgcacgggcacggttctcacggctcctggaagatcgcgtacgccgactttatgaccgccatgatggcgttcttcctggtgatgtggctgatctccatctccagcccgaaagagcttatccagattgcggaatatttcaggacgccgctggcgacggcggtcaccggcgggccgcgcatttcgaacagcgacagcccgatccccggcggcggtgacgattacacccagcagcagggcgaagtgaaaaaacagcctaacatcgacgagctgaaaaaacggatggagcaggcgcgcctgaaaaaactgcgcggtgacctggatcagctgattgaagcggaccccaagctgcgtgcgctgcgtccgcatctgaaaattgacctggtacaggaagggctgcgtattcagatcatcgacagccagaaccggccgatgtttaaaaccggcagcgccgatgtcgagccctacatgcgcgatattctgcgtgcgattgcaccggtactgaacggtattcctaaccgcattagcctgtccggacacacggatgatttcccgtacgccacgggagagaaaggatacagcaactgggagctttctgccgatcgcgccaacgcctcgcgtcgcgagctggtggcgggtgggcttgatgatggcaaggtcctgcgcgtggtcggcatggctgcaaccatgcgccttaccgaccgcggaccggatgacgccatcaaccgtcgtatcagtcttttagtgctgaaccagcaggcggagcaggccatcctgcatgaaaacgccgaaagtcagaatgagtcactggacgatttaaaacagcctggggccgtcccttcggctgccgttccaacatcgccaccagccaatccgaggtga

SEQ ID NO: 3074 - DNA, 792 bp, Enterobacter cloacae
ccttgtcatggtaggaaagggagaacatcgatgaagccatttttcaggcgatcaggcctggtgggtctgttgggggcaacggctctggcagcgggccaggcgcaggcagcggcaaccattcttttgtggcccatcgatccgtggctttcggcagaggccagagcaactgaattgtggatccagaatcagggcaacagcgccacgacaatgcagatacgcattgtgcgctggaaacaggagggcggatatgagcgttacaccgcccagcaggatgtggtcgccagcccgccgatcgtgactatcgctaaaggcagtaaacagcttattcgcctgatcaagcaggggacgatcccgtcgggggttgagcaggcctaccgcattattgtggatgaaattccccagccggatgccaaagcggaaccgtccatgggcctcaaactgcaaatgcgctattcgattcctttatttgtttatgggcaggggatccccaccctcaacgaaggggcacaccacgcgctggcgaacacccaacagctgagctggcgggtcgttcaggagggggggaaacccgcgcttcaggtccgtaatcagggggatgttcacgtccggctcagccaggttgcggttgagcagggcgggcaaaaacgcacggttgccgaggggctgctgggttatgtgctgccaggcagcacccgaagctggccgcttccggcagggatttatcagccgaaccggatgagcgcgcaaattaatgccagggatacgcaatggcaatcgacgcccgtcaactga

SEQ ID NO: 3075 - DNA, 465 bp, Enterobacter cloacae
ccaggtaagccagcagatgctggcgaaaatcagtgccggacaggcaatacgtatttgactcaggagtattattttatggcggataaagagcttaagtttttggttgtggatgacttttccaccatgcgtcgcattgtgcgcaacctgctgaaagagctgggcttcaacaatgttgaagaagcagaagacggggtggatgcgctgaacaagctccaggctggcgggtttggttttgtgatttccgactggaacatgccgaacatggacggtctcgaactgctgaaaaccatccgcgcggatgcaggcatggcctctctgccggtgctgatggtgaccgcagaagcgaagaaagagaacattattgccgctgcacaggcgggcgcaagcggctacgtggtgaagccattcaccgcggcgactctggaagagaagctcgggaagatcttcgagaaactcggcatgtga

SEQ ID NO: 3076 - DNA, 1431 bp, Enterobacter cloacae
aaagctattggtcacttactcgtcgtctctaatcgcatcgcaccgccggatgataaaaaagccagtgccggtggcctggcggtcggggtattaggtgccctcaaagccgcggggggtctctggtttggctggagcggggaaatcagtaatgaagagaaaccgctaaaaaaggtgtcacggggcaatatcacgtgggcctccttcgcccttagcgagaaggactatgatgaatattattccgagttctcaaacgccgtgctgtggccagcgtttcactatcgtctggatctggtgaaattccagcgtgaatcctatgaaggctacatgcgcgtcaacgcgctgctggcagataaactactgccgctgatcgaagaagacgatatcttatggatccacgattatcatctgctgcccttcgccagggagttgcggaaacggggtgtgaataaccgaatcggtttcttcctgcatataccgttcccgaccccggagatctttacggcgctgccgcagcacgaggagatcctggaggcgctgtcagattacgacctgctcggtttccagacggaaaatgacaggctggccttcctcgacagcgtgtcgggcaaaacccggctggtcactcacggcggtaaatctcataccgcgtggggacgaaatttccataccgaagtctacccgatcggtattgagccagacgaaattgccgagcaggcctccggtccgctgccgccgaagcttgcccagctcaaggacgaactcaagcacgttaagaatatcttttcggttgaacgactggattattccaaagggttgccggagcgattcctcgcctatgaaaccctgctggataaattcccgcagcatcatggcaagatccgctacacccagatagcgccgacctcgcgcggtgaggttcaggcctaccaggatattcgtcaccagcttgagaccgaagcagggcgcatcaacgggcgctatggccagctcggctggactccacttttctatctgaatcagcattttgagcgcaaaatcctgatgaaagtgttccgctatgcggacgtcgggctggtcacgccgctgcgcgacgggatgaatctggtggcaaaagagtatgtcgcagcacaagatcctgctgacccgggcgtgctggtgctgtcccaatttgccggtgcggcaaacgagttaacctcagcgctggttgtgaacccttacgatcgcgatgacgtggcaaatgccctgaatcgcgcgttaaccatgccgcttgcggaacgcatttcacgtcattcggaaatgatggagaccatcgtcaagaatgatatcaaccgctggcaggcgcgttttattgacgatttacgcgcgatccagccgcaaagtcaggaaggtgatctgcaaaaaaagatcgcgaccttccctaaactcgcctga

SEQ ID NO: 3077 - DNA, 606 bp, Enterobacter cloacae
cgtagcccggaagaaaagggcttaacaatgagcgaaaaaagcattgttcaggaagcccgtgatatccagctggcaatggaactcatcacgctgggcgcgcgtttacaaatgctggaaagcgagacgcagttgagccgtggtcgtctgatcaagctgtacaaagaactgcgtggtagcccgccgccaaaaggcatgctgccgttttccactgactggttcatgacctgggagcagaacattcatgcttccatgttctgtaacgcctggcagtacctgcttaaaacgggtttatgcagcggcgttgatgccgtgatcaaagcctacaaactttaccttgagcaatgcccgcagcatgaagaaggacctctgctggcgctgacccgcgcctggacgctggtgcgttttgttgaaagcggcatgcttgaattgtcgcgctgcaactgctgtgacggcaattttattacccacgcgcatcagcctgcgggcagcttcgcctgtagtttgtgccagcctccatcccgagccgtaaaaagacgtaaactttcccgggatgctgccgatattattccacaactgctggatgaacagatcgaacacgctgtttaa

SEQ ID NO: 3078 - DNA, 903 bp, Enterobacter cloacae
cggaaggatgatgtcgtgcttatcttattaggttacctggtagttctcggtacagttttcggcggttacatgatgaccggcgggcaccttggagcactctatcaaccggctgaacttgtcatcatcggcggtgcaggggtaggggcttttatcgttggtaacaacggtaaatcgatcaagggcacgctgaaggcgattccgctgctgtttcgtcgctcgaaatacaccaaaagcatgtatatggatctgctggcgctgctctatcgcctgatggcgaagtcacgtcagcaggggatgttctcgctggagcgggacatcgaaaacccgaaagagagcgaaattttcgccagctacccgcgtattctggccgacgcgatgatgctcgattttatcgtcgattacctgcgcctgatcatcagcggcaacatgaacaccttcgaaattgaagccctgatggacgaagagattgaaacccatgagagcgaatccgaagtgccggccaacagcctggcgctggtgggcgactcgcttccggcgtttggcatcgtggcggcggtaatgggcgtggtacatgccctggcctcggcggatcgcccggcggctgaactgggcgcgctgattgcccacgcgatggtggggacgttcctcggtattttactggcctacggctttatctccccgctggcgagcgtgctgcgccagaagagcgccgaaaccaccaaaatgatgcagtgcgtgaaaattacgctgctctcaaacctcaatggttatgccccgccgatcgccgtcgaatttggtcgtaagacgctctactccagcgaacgtccgtcgtttatcgaactggaagagcacgtgcgcgcggtgaaaaaccccaaccaacagacgacaactgaggacgcatga

SEQ ID NO: 3079 - DNA, 2076 bp, Enterobacter cloacae
aacagcctggggccgtcccttcggctgccgttccaacatcgccaccagccaatccgaggtgatagcgtgagcatggatattaccgatttttaccagacattttttgatgaagccgacgaattgttggccgatatggagcaacatttgctggatctggtgcccgaggcgccggactcagaacagctcaatgccatcttccgtgcggcgcattccattaaaggcggagccggaacgtttggatttaccattttgcaggaaaccacccatttaatggaaaacctgctggatgaagcacgacgcggtgagatgcagctcaataccgacattatcaacctgtttttggaaacgaaagatattatgcaggaacagctcgacgcctataaaagttcggcagagcctgatgccgccagctttgaatacatctgcaacgcgctgcgtcagttagcgctggaagccaaaggtgaggcgtctgcgcccgctgtccctgcggcaaaactgagcgttgttgacgccgtggccgaacccgctacggcgcctgacgcgcccgcaggaaaactgcgcgtggtgctgtcacgtctgaaggagaacgaggtcaacctgctggaagaggagctggggaacctggcgacgctcagcaacgtggtgaagggcaaagacagcctggccgcgacgcttgacggcgggatcggtcaggatgacatcgtggcagtgctctgcttcgtcattgaagcggatcagattgcgtttgaaaccgaggcgggggccgttgaagcgccagctccggcagagaatacccctgcggtagttgccgctgccccggcactgaaagccgtgccaaaagagacggctgccccggcccgcggtgaaaaaccggcggcgcgttccagcgagtccacgagcattcgcgtggcggtggagaaagtggatcagctaatcaacctggtgggtgaactggtgatcacccagtcgatgctggcccagcgttccaacgagctggacccggtgactcacggcgatctcatcaccagcatgggccagttacaacgtaacgcccgcgatttgcaggaatcagtgatgtccatccgcatgatgccgatggaatatgtcttcagccgcttcccgcgcctggtgcgcgacctggccggcaagctcaacaaacagatcgaactcacgctgatgggcagctccaccgagctggacaagagcctgatcgaacgcattatcgacccgttaacgcacctggtgcgtaacagcctcgaccacggcatcgagctgccggaaaatcgcgtggcagccggaaaatcgcccgtgggcaacctgatcctgtcagcggaacatcagggcggcaacatctgcatcgaagtgaccgatgacggcgcgggcctgaaccgcgagcgcattctggcgaaggcgatctcgcagggaatggcggtcaacgaaaacatgacggacgaagaagtgggcatgctgatttttgccccgggcttctcaaccgcagagcaggtcaccgacgtttccggccgtggcgtgggcatggacgtggtgaaacgtaacattcaggagatgggcggtcacgttgagatccagtctaagcagggtgcaggcaccacgattcgtatcctgctgccgctgacgctggccattcttgacggcatgtccgttaaagtggcggacgaagtctttattctgccgctgaacgcggtgatggagtccctccagccgcgtgaagaagatctgcatccgctggcgggcggggagcgcgtgctcgaagtacgcggcgagtatctgccgctggtggaactgtggaaagtgttcgaagtggacggggcaaaaaccgaggccacgcagggtatcgttgtgatcctgcaaagcgccggacgccgctacgcgctgctggttgatcagctgattggtcagcatcaggtggtggttaagaacctggaaagtaactaccgcaaagtgccggggatctctgctgccaccatcctgggtgatggtagcgtcgcactgatcgtcgatgtatcggcacttcagggattaaatcgtgaacaacgtgtggcgaacacagccgcctga

SEQ ID NO: 3080 - DNA, 573 bp, Enterobacter cloacae
atgaaaagaaaacttctttttatctgcgcgggtacagtgctgacggcggcgactgtcggtcaggcgctggcagtcaccagtagcggtactatcggggcgacgctgacgttgacgaacggttgtttgatcaacggctcgccaacgcaaaacggcattaacttcgggacactcgatttcgggacccatcctgcgacattctccaccctgacaacccagttaaccggggccagcggcggaaatacctttaccattcaatgtaccactgccagttacacggtggcgatcaccggcaacaccaacgcgaccgcacccggaaccgttgtcggcacccccggcacacccgcccgatatctggtgaacaccgccaatgcggcacagggcgtggcatacagcctctatagcgacagcgggtacaacaacgtgattgctaacaacgccgcgttgcccgtagcttccacagcgggcggggtgaacagctataccctctacgggcgcataacgggcggcggcaatagcgtaacggttgtaccgggaacctataccgacacgattaacgtcagcgtcacctactga

SEQ ID NO: 3081 - DNA, 1635 bp, Enterobacter cloacae
accgcggctgcttgccgcttgatgggagcgtggatgttaaatcgtattcgtatctcgaccacactgtttttgattctgatcctgtgtggggttttgcaggttggcagtaacgggttgtctttctgggcgtttcgcgatggctatcagaatttgcaggaagttgagacgagtaatcagcagcgctccgcactggcacaaacgcgtgccgtgctgttgcaggcaagcactgcgctgaacaaagcagggacgttaaccgcgctgagctatccgccggaggatattaaggcgctgatggttgtggcccgcagcagcctgaagcaggccgacgcgcagtttaaggcttttacggcgcaggaggcggtcagtgagaaagagaaagcgctcaaagtcgccatgaaaaagacctttgatgtgtggtacggcgatctcgaccatcaggcgacgtggctggagaacaaccagctttctgacttcctgaccgcgccggtgcaggcgtctcaggcggcgtttgacgacagctttaacgcatggcagcaggatattaaccagtttgtggcgcgtgccggtgcggacagccgtaccagttaccgcatgtcaggggtgatattcctgactatggtaatcctggcggccctgctgaccggcggctcgctgtggtggtcgcgcaaaatgatcgtccagccgctggccatcgtcagcagtcacttcgacagtattgcgaagggcgacctggcgcgtccggtggccgtgtatggcaggaatgaaatatcagcgattttcgccagcctgaaggcgatgcagagttcgctgcgggaaacggtaagcaacgttcgccagggcagttacgccatgcataccgggatctccgagattgcggcaggcaataacgacctctcttcccgcactgaacagcaggcggcatcgctggcgcagacggcggccagcatggagcagctgaccgcgacggtaagccagaacgccgataacgcgcgtcaggcgtccgacttgtcaaaacaggcagcgatgacggcgaaacgtgggggcgatcaggcttctcacgttgccagcacgatgcaggagattgccgccagctcgcagaaaattggcgacattatcagcgttatcgacggtatcgcgttccagaccaatattctggcgctgaacgcggcggtggaagcggcgcgtgccggcgagcaggggcgcgggttcgcggtggttgccggtgaagtccgaaacctcgccagccgcagcgccaatgcggcgaaagagatcaaagggctgatagaagagtcggtctcccgcgttcagcagggctccgcgctggtggataccgccgcgcagaccatgcacgagatagtcacctccgtgacgcgggttaacgacattatgggcgagattgcctcggcgtctgatgaacaacgccgtggtattgagcaggtggcgcaggccgttacacagatggatcaggttacacagcagaacgcctcactggtggaagaggcggcggctgcgaccgatcagctggcaaaccaggcggatcaccttaccgggttagtcgccgtatttaatgtaaaagagcacgttgaagcagtaacagaagtcggacggtcacaggccgtgcccgttgtatcctga

SEQ ID NO: 3082 - DNA, 1059 bp, Enterobacter cloacae
ggaaaaagcatgagtaaaatcagggtattgtctgtcgatgattcggcgctgatgcgtcagatcatgaccgaaatcatcaatagccacagcgatatggagatggtggcgacagcgcccgatccgctggtcgcgcgggatttaatcaaaaaatataaccccgacgtgctgacgctggatgttgaaatgccgcgcatggatggcatcgatttcctggaaaaattaatgcgcctgcgcccgatgccggtggtgatggtgtcatctctgaccggtaagggttcagaaatcaccctgcgcgcgctggagctgggggcggtggattttgtcaccaagccgcagctcggcattcgcgaggggatgctggcgtacagcgagatgatcgccgagaagatccgcaccgcgtcccgggcgaagcttgccgcgcataaaccgacggcagccccggcaaccctgaaggcggggccgttactcagctcggaaaagttgctggtgattggcgcgtcaaccggaggaacagaggcaattcgccatgtactccagccattgccgctctcaagcccgggtattctgattacgcaacatatgccgccgggctttacccgctcgttcgcggagcgcctgaataagctgtgccagatcagcgtgaaagaggcggaagacggcgagcgcgtgctgccgggtcacgcctatatcgccccgggtgacaagcacatggagctggcgcgcagcggggcgaactatcaaatcaaaattcatgacgggccgccggttaaccggcaccgtccgtcggtggatgtgctgtttcattcggtggcgaaacatgcggggcgcaacgccgttggggtgatcctgacggggatgggtaacgacggcgccgccggaatgcttgcgatgcaccaggctggcgcctggacgattgcgcagaatgaagcaagttgtgtggtgttcggcatgccgcgcgaggccatcaatatgagtggcgtaagcgaagtggtcgatcttagccaggtaagccagcagatgctggcgaaaatcagtgccggacaggcaatacgtatttga

SEQ ID NO: 3083 - DNA, 720 bp, Enterobacter cloacae
agccattcaccgcggcgactctggaagagaagctcgggaagatcttcgagaaactcggcatgtgaggtgatggatatgttgcaacctgctatgaaacccgttgaagaacattcgccgagcgacattattgcccgcattggtagcctgacccgcatgctgcgcgacagcctgcgtgagctggggctggaccaggcgatcgccgaagcggcggaagccatccctgacgcgcgcgaccgtctggactacgtcgtgcagatgaccgcgcaggcggccgagcgtgcgctgaacagcgttgaagcctcgcagccgcaccaggatgccatggagaagggtgcgaaagcgctgagcaaacgctgggatgagtggtttgagaaccctattgagctggcggatgcccgcgaactggtaacggatacccgtcagtacctgggtgacgtgccgggccacaccagcttcactaacgcccagctgctggacatcatgatggcgcaggatttccaggaccttaccggccaggtgatcaagcgcatgatggatgtgattcaggagattgaacgtcagctgctgatggtgctgctggagaacattccggaaccggctgcccgtccgaaacgcgagaacgaaagcctgctcaatggtccacagcttgacaccagcaaagcgggcgtggtggcaagccaggatcaggtggacgatctgctggatagccttggtttctga

SEQ ID NO: 3084 - DNA, 1173 bp, Enterobacter cloacae
attaatgggctgcgagcaggcacagtggcagaagagaacgacgacaaaacagaagcccccacaccccaccgacttgaaaaagcccgtgaggatgggcagatcccccgatcccgagagctgacatccctgctgatcctggtggtgggcgtctgcataatctggtggggcggggagatgctcgcccgcagactggcgggaatgctctctgctggcttacgttttgatcacagcatggtcaatgaccccaatctgatcctcattcaaatcatcaaccttgtgaaaagcgcgatgatcgccttgctgccgctgatcgcgggcgtggtcatcgtggcccttgtttcgccggtcatgctcggtggcctggtgttcagcggtaaatcgctgcaaccgaaattctccaagctcaacccgctacccggtattgcgaaaatgttctccgcgcaaaccggggctgagcttcttaaagcgatcctgaaatcgcttcttatgggcagtacagccgggttttttctgtggcaccactggccggagatgatgcgcctgatcagcgagtccccgatgacggcgatgaaaaatgccctgaacctggtcgggttatgctcgctgctggtggtactcagcattattccgatggtggcgttcgacgttatcttccagatctattcccatatcaaaaagctgcgaatgtcgcgtcaggacatccgcgatgaatataaacagatggaaggcgacccccacgttaagggccgtatccggcagatgcagcgtgccgccgcgcgtcggcgcatgatggaagatgtgccgaaagccgacgtcatcgtcaccaacccgacccactactccgtggcgcttcagtacgacgaaaacaaaatgagcgcgccgaaagtggtggcgaaaggggccgggctgattgcgctgcgcattcgtgaaatcgcgacggaaaaccgcgtaccgatcctggaagcaccgccgctggcccgtgcgctgtatcgccacgcggaaattggacaacagatcccgggccagctctacgccgctgtcgcagaggtgctggcctgggtgtggcaactgaaacgctggcgtttagcgggcggtcaacgacctgtaaaacctgagaaccttccggtgcctgaagcactggattttttgaacgagaaggacactgatggctaa

SEQ ID NO: 3085 - DNA, 432 bp, Enterobacter cloacae
ccgcaatattcgcatgacggcgaccataggagggaaataatgcggaagtggctgtggatcttacttttcccgctggcggcgcaggccgcaggcgagggggcatggcaggccagcagtataggcttaacgctcaaccatcgcggggagtcgatctcctcccgtccgttgtccgcctctgagcccgtgtccgggcagatgacgctggtggcctggaattacaccctgacgggacccacaccagccgggttgcgggtgcgtctgtgctcgctgacccgctgcgcggaaatcgagggacaaagtggcaccacccaggccttcaacggggtgtctgctcaggagcctttacgctttatctgggaagtgccaggcggtggacgtctgatcccggcgctgaaagttcagcgcaacgaggtgctcgtcaactaccgctaa

SEQ ID NO: 3086 - DNA, 1599 bp, Enterobacter cloacae
ttagggttgacggcaatgaaaacacgtaaaattggactcgcaaattatcttgcttacgggtcaggggacttcctcggggcgggaaccaccgccctgacggccgcctggcttttgtatttttataccaccttctgtggactcacaccgattgaagcaacctttatcttcgccgccgcaagggtgctggatgcggttgtcagcccgttaatgggctttttaaccgataactttggcaccacctggctgggcaagcgttttggccgtcgtaagttcttcatcctgctcggtattccctgcgttttcagctactcgctgatgtgggtaggggacatgagtttctggtactacctgctgacctatctgatctttgatatcgtctacaccatgatcctggtgccatacgaaacgctggtgccggagatgacggacgatttcaaacagaaaaccaaattctccggggcgcgtatctctatggcgcagatgtccgctattctggcttccttcctcccggggatcctgctcacgcatttcggcaaagacaacgcgatctccttcttctatgcaagcctggtcttctccgtactctgcgcactgatgcttacgttcgtctggttctttacctgggagcgcccgcgggaagagtggtctgaagcggccctgcgtgccgaagaagagaagaaaaagctgacccttgggcagagcctgaatcgcctttttgttgaattaagttcgacgctgcgtatcaagattttccgccagcatctggggatgtaccttggcggctacatcgcacaggacgtctttaatgccgtgtttacctattacgtggtatttgtgctgatgcaggaggcgtcaatggcgtccaacctgctgggcacgatggccatcttccagttcctcgccgtgatcggcatgatcccgctgtgcattcgcttcggacctgcgccgtcttaccgcatggtggtcgtgctgtttggtctggcttcgctctcttacgcggtactttattacgcgggcctgagcgacgtttacgctctgctgctgctgatctctgcggttgccggtcttggtcgcggggggatcaactacgtaccgtggaatacctacacctacattgcggacgtggacgaagtgatcaccggtcagcgtcgcgaagggatcttcgcgggcatcatgacgctgacccgtaaagcgtcccaggccggtgcggtgatgctggtggggatcgtgatgcagatgtcgggctttgtcagcgggcaaaaagtgcagcctgcggaagtgagccacactatcctgatgatcctgagcgtcggcaccattctggtactgttctgcggcttcctggtctccctgcgcttcaaactcaatttgcagacccacagcaccctgcgtgaagagaccgcgaaaatgcgcgagtccggccatgcgatgccagaggcggtgaccccgcaggcccgcgccaccgtggagatgctggccggtatgccgtatgaatccctgtggggcaacaacaatatcggttatctgaatcgcaataagccggcggccccttcgctgaaggatcgcgcggtactgaattcgacatacaacagaggttaa

SEQ ID NO: 3087 - DNA, 564 bp, Enterobacter cloacae
cctatggcgaactggcacaccattgacgaactgcatgatatttccgcagatttaccgcgcttcacccaggcgttcacagaacttgccacccgtctcgggctggatatcgcgccgcttgaggccgatcacatctctttgcgctgccaccagaatgccaccgccgaacgctggcggcgtggctttgaacagtgcggagaactgctgtcggagaatatcattaacggtcgcccgatctgcctgttcaaacttcatgcgccggtaacggtggcgcactggcaattcaccgttgtggaactgccctggccaggagagaagcgttatccgcacgaaggctgggagcatatcgaaattgttctgcctggggagcccgagacgctgaacgcccgtgcgctgacgctgctttccgacgaggggttaagccagccgggtattttcgtcaaaaccagctcgccaaaaggggagcgcgaacgcttaccgaaccctacgcttgccgtaacggacggcaacgtgacggtgaaattccatccctggactatcgagcagatcgtcgccagcgaagcgtaa

SEQ ID NO: 3088 - DNA, 765 bp, Enterobacter cloacae
gtgaaatttaaggaggatgacatggcgctgctggaaatttgttgttacagcgtggagtgtgccgtcactgcgcaacggcacggggccgatcgcatcgagctttgcgcggcaccgaaagaaggaggattaaccccgtcctctggcgtgctgaaatcagcccgtcaggccatcactattccggtgcacccgattattcgcccgcgcggcggtgatttttgttatacggcgggtgagttcagtgccatgcttgaggatatcgccctcgtccgtgatttaggttttccggggctggtgatcggtgtactggacgaagacggcaacatcgatcttccgcgtatgcgtcaggtcatgcgcgccgcccgggggatggcggtcacttttcatcgtgcgttcgatatgtgtcaagatccgatacaagcctttgatacgctggcagaactgggcgtggcgcgcgttctgacgtcgggccagcagtcctcggctgaaaaaggactgaaattaattacggaactaaaagcacattccggtgttccaataatcatggcgggcgcaggagtacgcgccagcaatctggaactgtttttaaacgcaggggtggaagagctgcacagctcagcgggtaaatggataccttcacccatgcgttatcgcaatacagggttgtcaatgtcgacggatgctgaagcggatgagtactcgcgctacggtgtggatggagagtcggttgcggtaatgaaatcgttgattgaacgtcatcacgtgtag

SEQ ID NO: 3089 - DNA, 462 bp, Enterobacter cloacae
attcaactatgcatttggccttttctttttataccgggtgatttcccggcgacatcacggggtgcggtctttccgcataaaaataatagttggttattcgggatgggaaaaatgcatacatccgagttgctaaaacatatttatgacatcaatttgtcgtatttattgctcgcgcagcgtttgattagtcaggacaaaccgtcagcgatgtttcgtctgggtgttaacgaagagatggcaaccatgctgggtggattaaccctcccgcaaatggtcaagctggctgaaaccaatcaacttgtctgccagttccgttttgataacccgcagaccattacgcgtctgactcaggaatctcgcgtggacgatctgcaacaaatccacaccggtattcttctctccacccgtctgctcaacgaaatcagccagcctgatgacgtagcccggaagaaaagggcttaa

SEQ ID NO: 3090 - DNA, 519 bp, Enterobacter cloacae
gtaaaaggtaataacatgaccggtatgagtaacgtaacgaaactggcgggcgagccatcggggcaggaattcctggttttcactttaggtgatgaagagtacggtatcgacatcctgaaagtgcaggaaattcgtggttacgaccaggtaacgcgcattgcgaacacgccagcgtttatcaagggtgtgaccaacctgcgcggtgtgattgtgcctatcgtggacctgcgcgtgaagttcagccagggcgatgtggagtacaacgataacacggtggtgatcgtcctgaatctggggcagcgcgtggtggggatcgtggtggatggcgtgtctgatgtactgtcgctgaccgcagatcaaatccgtcctgcgccggagtttgcggtcacgctgtcgacggaatacctgacggggttgggtgcgctcggcgagcgtatgctaattctggtgaatattgagaagctgctgaacagtgaagagatggcgctgctggatattgcggcgaatcatgtagcataa

SEQ ID NO: 3091 - DNA, 609 bp, Enterobacter cloacae
cggttgtaccgggaacctataccgacacgattaacgtcagcgtcacctactgattcagccatgaaggcattgtgtttatgtctgcgcgaaagcgcagagggcgtcgtgcacccttttttggccctgatcgtcgggctgatgatgatctgcgacgccagggcggtgacatcccagtccttcagggtgagcgcgacggtagtaccaggatgctcggtgagtaccggcacgggcgggcgctttgggacgctggattttggaacccgcaatggcgtggacaacacgccggtcagcaccagctttgtcgccgacggcgcgttgtccatcgcctgcacaccgggtgtggcgctaagtatgagcattaacggcggtcagaattatagctctgtgaggcggatgacgcgttcaggcgggacagaggtggtcggttaccggctctacagcagcagctcactggccgcgaacagtgaaattggcgttaaccaggccataccgattacctataccaacagcaataacatcgcgctgcctctttttggcgtcgcgctcctgacggggtttagcctgccgggaacatattcagatcaactcaccgtgaccttgtcatggtag

SEQ ID NO: 3092 - DNA, 2400 bp, Enterobacter cloacae
tgccagggatacgcaatggcaatcgacgcccgtcaactgaaaccggcgatgatgatcctgctttgcgtcagtaccagcgcctttgccgaaaccggtgacgacagtttaccgccgccgccggatgcacggacgatgaacggcgaagcagtattccagctcgccctggtgctgaaccactatgacacgggtctggtggtgccggtgacgcagcgcgagggtgcctggtttatttcgggcgcggatttgctccgcgccgggctgccgcccgcgcatgtgcctgccggagaggtgaatctctcgacgcttacgtcggtacgcgcagagtacgacagcacggcccagcgtctgttgctgacggtcccccgggactgggtcgccgcgcggatcacgccgttcagcgaacagaacacgcatagcaagccgcactatggccgcggcgcgttgctcaattacgacgtttataccaaccattccgagcacacgggcggccaggcgtcggtctggcacgagttccgctatttcaatgaggattattcgttttcatcgacgggttacgcccggcagaatttcaccggtaacagcgggcagcaggaagggtacgtgcgctacgactcaacgtttctgatcaccaacgaggaagatgccaccacctggaccgtcggggacgtcatcagcgatgcgctgagctggagcaccaacgtgcgcatgggcgggatcagctacgggcgcgacttctccctgcgtcctgatctggtgacctggccgctgccggcgttttccggcgaggcggctgtcccgacctcggtcgatctctttattaatggctaccgttccggctccacccgccttcagccggggccgttcactctcaccaatctgccgtatatcaacggtgccggggatgcggtgctggttaccactgatgcgctgggtcgtcaggtgagtaccacgctgccgttttatgtcagcagcgatctgcttaagcaggggttaagcgacggcgccgtgacgctgggcagcctgcggcgtaactacggtattgagaattttgactatggcccggcggcgggcagcggatcgtatcgctacggggtgaccgactggctgacgctggaggggcatgcggaaggggcggagtcgctggcgctcggcggagcgggcacggtgctgaagctcgggcgttttggcgtggtaaatacctcgtggacccaaagccgcatgcgcggcgatagcggcggccagataaactggggctatcagtacaacaccagcgagtttagcgtagcgacccagcatacccggcgcgaccgtggcttcggcaacctcgccctgtacgatcagcccaccgtttatgatgaaaatgataaccccgttgccagcctgagccgcaataccgaccagtattccttaaccttcaacctcggcggttacggcaatatcggcgcggcgtggatcggggttgaaagttttgacagcaaaaaaactgagctgctcaacctctcctggagccgtaatttgtggggctcaagcagtatttatctggctgccagccgtgaccagcagcggggcgactggacggttgcgctgtcgttgcaggttcccctcggcgaacgtgacagcgccgccgtcacctttgaaaacacccctgacgcaggcagcactcaacgcattaactacaaccactcgatgccttcagacggcggctttagctggaacatggcctgggccaaccagtcgcggtcgagtaactatcagcaggctacgctcggctggcggaataacaacgtggagctacagggcggcggctacggtgagaagggcatgatgacctggtggggcgaggcgatgggttctgttgtgctgatggacggtgagctgtttgcggcgaacaaaatcaacgatgcgtttgtggtgatcagcaccgacggacatccggacgtacccgtcagctacgaaaaccagccggttggtaaaaccaataacaaaggttatctgttggtcagcggcgtttccgcctattacccggcaagctaccgcattgataccctgaacttacctgcggatacccggctgaaagagaccgagcgtcgggtggcgattcgtcggcataacggttatctggtggatttcccgatggagcaggagcgggttgccagcgtcattctgcacgatgcgcagggcaatgcgatcccggtgggaagccaggtcagacgcgcatcccgcagcagcgcggttgtcggctatgacggcctcgcctggctggaaaacctcaacgatgtgaatccgcttgaggtcatcaccccggagggtaaacgctgtacggcaacgctgaccgttggtgcaaaccctgagcataagctgcaaacctacggtccgctgacctgtcgggaggcgccgtga

SEQ ID NO: 3093 - DNA, 1773 bp, Enterobacter cloacae
ttgtcgacgtcgcattctgactcccgcgcttttccctttcgcaaatgtaaagttcctgtggcctgtgccgataacaccgttaataaatctatgagaaggtgttgtatgttgaaccgtatccgcgttgtcacaatgcttatgatggtgctggtcattttcgcacttcttcagcttacttctggcggcctctttttctcgtcgttaaaacagaaccaggacagcttcgcggcctcgaacgatttgcgaatgcagcaaagcgaactgaccacgacctgggatctgatgttgcagacgcgtatcaacctgagccgctcgtctgcccgcatgatgatggacccaaataaccagcagagcagcgcaaaaacggaactgctgaagaatgcgcgcgccacgctggcagacgcggcgaaacattacgacgccttcaaaaaaatcgcccctcagccggcaatggcgcaggcgagcgcgaacatagatgaaaaatatcaggcctacttcgccggcctcacggagctggtgcagttcctggagaagggcaatatggacgcctatttcgcgcagccgacccagggaatgcagaacgccctcggcgcggcgctcggcgagtacgctaaagccagcggcgagctttatcactccgcgttcacgcaaagccagaacgactaccgtttcgcgaaatggcagatggcggttctcgccctcgcgctggtcatagtgctggtggccgtgtggtacggcattcgtcatatccttcttaacccgcttggccgcgtcattgcccatatccgtgatattggccggggcgatctcacgaaaacgctgtccgtttctggccgcaatgagatcaccgagctggcaaccagcgtcgaccatatgcagcgttcgctgattgataccgtcgccaacgtgcgcgagggggcggatgccatctataccggcacgagtgaaatcgcgatgggcaacaacgatctttcgtcccgtaccgaacagcaggcgtccgctctggaagagacggcggccagcatggagcagctcaccgcgaccgtgaagcagaatgccgacaacgcccgtcaggcgtcgcagcttgcagaaagcgcgtccgataccgcccagcgcgggggtcgggtggtcgacggcgtggtgaaaaccatgcatgacattgccgacagctcgaagaaaatcgccgacatcatcagcgttatcgacggcatcgccttccagaccaacatcctggcgctgaacgcggccgttgaagcggcgcgtgcgggcgagcagggccgcgggtttgccgtagtcgccggcgaagtgcgtaacctcgccagccgcagcgccaatgcggcgaaagagatcaaagctctgattgaagactctgtttcacgcgtggataccggctcggtgctggtggaaagtgcgggtgaaaccatgaatgacatcgtgaatgccgtgacgcgcgtgacggacatcatgggtgaaatcgcctctgcatcggatgagcagagtcgtggtattgaccaggtcgccctggcggtatcggaaatggatcgtgtgacgcagcaaaacgccgccctggtgcaggagtccgctgccgcggccgctgcgctggaggaccaggcgagccgcctgaaaatggccgtctcggcgttccgtcttacttcaaaaacaacaaatacggtcagctcgcggtcggtgtacggcgaagcagccccggcgcccgtgacagcacgtacgcgcgcagcggtgaccggacaagatgaaaactgggaaacattttga

SEQ ID NO: 3094 - DNA, 876 bp, Enterobacter cloacae
gaaggcgctatgacatcacccatgccctcagggcaaacgtcattattgttgcagatgacacagcgcctcgcgctgtccgacgcgcattttcgtcggatatgtcagttaatctaccagcgtgcggggatcgtgcttgcggaccataagcgagacatggtctacaaccggctggtgcggcgcttgcgcacgctggggctgtacgattttggccgctatctgagcatgctcgaagcgaaccagaacagcgccgaatggcaggcatttatcaactcattaaccaccaacctgaccgcgtttttccgcgaggcgcatcacttcccggtgctggcggaacacgcccgccgccgtggcggagagtatcgcgtctggagcgcggcggcctctaccggggaagagccgtactcgctggccatcaccctggcggacaccctgggcatggcgccgggtcgctggaaagtatacgccagcgacatcgacacggaagtgctggaaaaagcccgtaacggcgtttatcgccaggatgagctgaaaacgctgtctccccagcagctacagcgttacttcatgcgcggtaccggcccgcatgaaggactggtgcgcgtacgccaggagctggcgaactgcgtggaatttgcccccgttaatttactggataagcagtacaacgtgccggggccattcgacgccattttttgccgtaacgtgatgatctattttgataaaacgacgcagcaggacattttgcgtcgctttgttccgttgctcaagcctgacggtttactgtttgccgggcactcggaaaacttcagcaacctcgtgcgtgagtttagcctgcgtgggcaaacggtatatgcgctgagtaaggaaaaagcatga

SEQ ID NO: 3095 - DNA, 2094 bp, Enterobacter cloacae
acgagaaggacactgatggctaatctggtggcaatgttgcgcctgcccggcaacctgaaatcgacgcaatggcagatccttgccggaccgattctgatcctgctaattctgtcgatgatggtgctgccgttaccggcatttattctcgacctgcttttcaccttcaacattgcgttgtccatcatggtgttgctggtggcgatgttcacccagcgcacgctggagttcgccgcgtttccaacgatcctgctgttcaccacgctgctgcgtctggcgctgaacgttgcctccacgcgtatcatcctgatggaagggcacaccggcgcggcggcggcgggcaaggtggttgaagccttcggtcacttcctggtgggcggcaacttcgccatcggtatcgtggtgttcgtcattctggtgattatcaacttcatggttatcactaaaggtgcggggcgtatcgcagaagtaggcgcgcgcttcgtgctcgacgggatgccgggtaagcagatggccatcgacgccgacctgaatgccgggctgatcgcggaagatgaagcaaaaaaacgccgtgccgaagtgacccaggaggcagatttctacggctccatggacggtgcgagtaagtttgtgcgcggtgacgccatcgcgggcattctgatcatggtgattaacgtcgtcggcggcctgctcgtcggcgtgctgcaacacggcatggacatgggccacgcagcggaaagctatacgctgctgaccattggtgatggtctggtggcgcagatcccggcgctggtgatctccaccgcggcgggtgtgattgtgacccgcgtcagcaccgatcaggatgtaggcgagcagatggtggggcagttgttcagcaacccgcgcgttatgctgctctccgcggcggtactgggcctgctcggtatggtgcctggcatgccaaacctggtattcctgctgtttactgccgcgctgctgggccttgcctggtggatgcgtggccgtgaaacgcagcctaaggcagagccagcgccggtcaaaatgcctgagaacacccaggcggtggaggccacctggaacgacgttcagctcgaagattcgctggggatggaagtggggtaccgcctgatcccgatggtggatttccagcaggatggtgaactgcttggccgtatccgcagcattcgtaaaaaattcgcccaggatatgggcttcctgccgccggtggtccacatccgggacaacatggatctcccgcccgcgcgctatcgcatcctgatgaaaggggtagaaatcggcagcggtgatgcgtaccccggccgctggctggcaattaacccgggcacggccgcaggcacgttgccgggtgagcagacgaccgacccggcctttggtctggcggcaatctggattgagagcgctctgaaagagcaggcgcagatccagggttacacggttgttgaggccagtaccgtggtggcgacgcacctcaaccatctgattggccagttctctgcggaactgtttggtcgtcaggaggcgcagcagctgctcgaccgcgtaacgcaggagatgccgaaactgaccgaagatttagtgccgggcgtgctgaccttaaccaccctgcataaagtgctgcaaaacctgctcgacgagaaggtgcccattcgcgatatgcgtaccatccttgagacgctggccgaacatgcgccgctgcaaagcgatccgcacgaactgacggcggtggtacgcgtggcgctcggacgcgccattacccagcaatggttcccgggaaccggcgaagtgcaggtcattggcctggatacgccgctggaacggctgctgcttcaggcgttgcagggcggtggcgggctggagccgggtctggcggacagattactggcgcaaacccaggaggcgctggcgcgtcaggagatgctgggcgcgccgccggtgctgctggtgaatcatgcgctgcgtccgctgctgtcgcgcttcctgcgccggagcctgaaccagctggtggtgctgtcgaatatggagctgtccgataaccgcaatattcgcatgacggcgaccataggagggaaataa

SEQ ID NO: 3096 - DNA, 1167 bp, Enterobacter cloacae
attcgacatacaacagaggttaagatgatgaaagtttggcctgtcaaacatagcccgttactgcgtcagcctgagcgctttatcgccagggatgagctgaaatcgctgattcaaaaggtgacgcataacctggtcaatatccacgacaaaacgggtgagtttttgctgcggctggacgacgggcgcgtgatcgacaccaaaggctgggccggatgggaatggacccacggcgtcggtttatacggtatctggcagtattactgccagaccggtgacgaaggcatgcgcgaggttatcgacagctggtttactgaccgtttcgctgaaggcgcaaccaccaaaaacgtgaataccatgtcgccgttcctgacgctggcgtatcgctacgaagagaccaaaaacccggcctggctgccgtggctggaaagctgggcggaatgggcgatgaatgatatgccgcgcaccgaacatggtggcatgcagcacatcaccctggcggaagagaaccatcagcaaatgtgggatgacacgctgatgatgacggtgctgccgctggcgaaaatcggcaagctgctgaacaagccggagtacgtcgaggaggcgatctatcagttcctgctccacgtacagaacctgatggatcgggagacggggctgtggttccacggctggaattacgacggcaatcacaactttgtccgggcccgctgggcgcgcggcaacagctggctgaccatcgtgatcccggatttcctcgagctggtggatctgccggaaaacaacgccgttcgtcgctatctagtgcaggtactgaacgcgcagaccgccgcactggcaaaatttcaggacgagagtggcttgtggcatacgctgctggacgatcctgaatcttatctggaggcgtcggccacggcagggtttgcctacggcattctgaaagccgtgcgcaagcgttatgtcggcgcagagtacgcagaggtggcggagaaagcgattcgcggtatcgtgaaaaacatctcgccggaaggggagctgctgcaaacctcgttcgggaccgggatgggaagcgatctggcgttttaccgccagataccgctcacgtcgatgccgtacgggcaggcgatggcgatactgtgcctgacggagtatttgcggaagtatttctga

SEQ ID NO: 3097 - DNA, 333 bp, Enterobacter cloacae
cagaaatatgtgcaaaaaaatctatttcctctagatgatgtaatagataatgttcaagaggagacaaaagatttagacattggagatctccaggttgctcaaaaagttgtaatggaaaaaatcacacaatctgtggaaagtgtttgtgaaaaaacttattccacaaaatgggaaacaagtgatcttattacttttgataacaaagataagtatgcaagaatcagtaaaaacaatactggtagaaaaattcgctctgaattcaataggataaatgcgggttttattaaggaactagaggagttcataaaagaaacattaaaagtatcagaataa

SEQ ID NO: 3098 - DNA, 621 bp, Enterobacter cloacae
tatctacaggagaatcatatggttctggtaactcgtccggctccggattttacagctgccgccgttctgggcaatggtgaaatcgttgaaaacttcaacttcaaacagcataccaacggtaaagcgaccgttctgttcttctggccaatggacttcactttcgtttgcccgtctgagctgatcgcgttcgacaaacgttacgaagaattccagaagcgtggcgtggaagtggttggcgtctccttcgactctgaatttgtacacaacgcatggcgtaacacccctgtcgaaaacggcggcatcggtgcggtgaaatacgcgatggttgcggacatcaaacgcgaaatccagcaggcttacggtatcgaacatccggacgctggcgttgcactgcgtggttctttcctgatcgatgcaaacggcatcgttcgtcaccaggttgtgaacgatctgccgctgggtcgtaacatcgacgaaatgctgcgcatggttgacgcgctccagttccacgaagagcacggtgaagtgtgcccggcgcagtgggaaaaaggtaaagaaggtatggcggcttccccagacggcgtagctaaatacctgtctgagaacgtatccagcctgtaa

SEQ ID NO: 3099 - DNA, 3147 bp, Enterobacter cloacae
cgaggacgaaaacgcatgaaaattctgagcctgcgtctgaaaaatctgaattcgctaaagggtgagtggaaaattgatttcaccgcggagccgttcgccagcaacgggctgtttgccatcaccggcgcaaccggcgctggtaaaaccacgctgctggatgccatctgcctggcgctgtaccacgaaacgccgcgtcttaataaggtctctcaggcgcaaaacgacctgatgacgcgcgataccgccgaatgccttgcggaagtggaatttgaggtcaaaggcgttgcttatcgcgctttctggagccagaaccgcgcccgcaaccagccggacgggaacttacaggcaccgcgcgtagagctggcccgctgcgaagacggcaaaattctggccgacaaagtcacggataagctggaacaaaccgccgcactcaccgggctggactatggtcgctttacccgctcgatgttgctctcgcaggggcagtttgccgccttcctgaatgctaaaccgagcgatcgcgctgagctgctggaggaactgaccggcacggaaatttacggccagatttccgccatggtttttgaaaaacacaaagcggcacgtaacgcgctggagatgtgcgaagcgcaggccgcaggggttgtgctgttgagcgaggaacagcagcagcacttgcagcaaagtttgcaggcgctcactgacgaagagaaaatcctgctggcacagcagcagagccaacagaaagattttcagtggcttacgcgtaacgacgagctgatacgtgagcagcagcgcgcagccgcttcgcagcagcaggcgcaacaggctctgacggacgccgcgccgcaactggcgaagctccagctggcgcaacccgccgcccagctacgtccgctatgggagcaccagcaggagcagaccgcccgcctgtcgcaaaccgcagagcgaattgtcgaagtaaatactcgcttactcgacagagcggcacagcgcgcgtgtatccgcaacggtgcgcagcgcaaccgtgaacagttgcagacagagcacacggcgctgacgcagtggctaaccgaacacgatcgtttccgtcagtggggacaggaaattgccggctggcgggcgcattttacgcagctgaatcgcgataaaaatcagcttgttgccaaggcagcgcgcatggctgagcttcgtcagaagctggctgagatgccggagagtacgctgacgctgacggctgaggatctcgcgacggcaatggagcaacaggcacaatcgcgggcgctccgccagcgtctgactgcacttcacgctcgctatcagccgctgcaaaaacgactgcgccagaatgcggaaagcgtgcagaaagcgcaggctgagcagggtaagctcaatgaaacgctgatcctgcggcgtcagcagttcaaagaaaaaaatcagcactatgccgacctgaaagcgctctgtgagcgtgaggcgacaatcaaggatcttgagaattatcgtgctcagctggaagcgggtaagccttgcccgctctgcggttcacgcgaacacccggcagttgtgcagtatcaggcgcttgaactgactgacaatcagcgccgccgcgacgcgctggagaaagaggttgccgcgctaaaagaggaaggattgctggtgctcgggcaggtgaatgcgctgacccaacagatccagcgcgagactgaggaagcacaggctctctctcaggaagaacaagcactcactaaagagtggctggaggtctgcacctccctgaacatagcgctgaatattcaggatgatatagcactctggatgagcgcacaggagcagtatgaacgccagctgtatcagctcagccagcgtctgacgctgcaaaaccagctcattgaacaggaaggtcaggcgcgccagtaccagcagcagctgacggcgacgcgtcaggcgctggcggcctcgctagagtcgctgtcgcttagcgtgcccgatgaaggggccgaaagcgcctggctgagcgcgcgcgaaagcgaatataccctgtggcaggaaaaacaggcccagcacggtacgattcaggaacgtattaacgccctgatgccaatcctggagacgctgccggttaccgatgatacagaagccgacgcggttatacctgagaagtggcgcggcatccacgacgaatgcgtgtcgctgcaaagccagctcaccaccctccagcagcaggagacgcttgagcgtgaacggctccagcaatcacaggctcagttcaacgccgcgctgaccgcgagctgctttgccgatcgggaggcatttctctccgccctgctggatgaagcgtcgatccgccagcttgaacagcaaaagcagacgctggaaaaccagctccagcagaccacggcgctttcggtgcaggcaagccagcagcttcaggcgcatcaggcacagcgccccgaggggctggaaaccgatgccgcaacgcttcaggcgcagttacatcagctggcgcaacagcttcgggacaacaccacgcatcagggggagatccgccagcagctcaaacaggacgccgataaccgtctgcaccagcaggcgcttatgcagcagattgaggaggcggcgcgtcaggccgacgactggggctatctcaatgcgctgataggctccagcaccggcgataaattccgtaaattcgcccaggggctaacgctggataatctggtgtggcttgccaaccagcagctcaaccgtctgcatggccgctatctgcttcagcgtaaagccagcgacgcgctggagctggaagtggtcgatacctggcaggccgatgcgatacgcgatacccgtaccctttccggcggggagagtttcctggtcagtctggcgctggctttagcgctttccgatctggtcagtcacaaaacgcgcattgattcgctgttcctggatgaagggttcggcacgctcgacagtgaaacgctggacaccgcgctggatgcgctcgacgcactgaacgccaccgggaaaaccatcggcgtgatcagccacgttgaggcgatgaaagagcgtattccggtgcagatcaaggtgaagaagatcaacgggctggggtatagcaggctggacagggagtttgcggtgaattga

SEQ ID NO: 3100 - DNA, 942 bp, Enterobacter cloacae
tttaacgacaaggccgtggaaattatcatgctgtggttcaaaaatttgatggtttaccgtctcagccgcgacgtttcgctgcatgcagaagagatggaaaaacagttagccgcttactcctttaccccttgcggtagccaagatatggcaaaaaccggctgggttccgccaatgggttctcaaagcgatgcgctgacccacgccagcagcacggggcaaatcatcgtttgcgcccgcaaagaagagaagatcctgccgacgcccgtggttaagcaggcactcgaagcgaagatcttcaaactggaagctgaacagggccgtaagcttaaaaaaaccgaaaaagattcgctgaaggatgaagtgctgcactcgctgctgccgcgcgcctttagccgctttagccagaccatgatgtggatcgacaccgttaacgggctgattatggtggactgcgccagcgccaaaaaagccgaagatacgctggcgctgctgcgtaagagtcttggctcattaccggtggtaccgctggcgctggaaacgccgattgagctgaccctgaccgagtgggtgcgcagcgggactgccgcgcagggcttccagatccttgatgaagcagagctgaaagcgttgctggaagatggcggcgtgatccgagcgaagaaacaggaactggtgagcgacgaaatcgccgtgcacattgaagcgggcaaagtggtgaccaaactggctctcgactggcagcagcgcattcagtttgtgatgtgtgatgacggctccgtgaagcgcctgaaattctgcgatgaactgcgcgatcagaacgaagatatcgaccgcgaagattatgctcagcgctttgacgcagactttatcctgatgaccggcgagctggcggcgctaattcagaacctggtggaaggtctcggcggcgaagcgcagcgctga

SEQ ID NO: 3101 - DNA, 822 bp, Enterobacter cloacae
cggagagacgtgatggataagaaaatcgggtttatcggctgcggaaacatgggcaaagctatcctcggcggactgattgccagtgggcaggtgctgccggggcagatttgggtctataccccatccccggataaagtcgcggcgctgcgtgatgagtatggtgtcaacgctgccgaaagcgcgcaggaagtggctcaggtggcggatattgtctttggcgccgttaagccgaatatcatgattaaagtcctgagcgagatcacctccagccttaacaaagagaccctggtggtgtcgattgccgcaggcgtgaccctcgatcagctcgcccgcgcgctgggtcacgaccgtaagattgttcgcgccatgccaaacaccccgtcgctggtgaatgccggtatgacctccgttaccccgaacgcgctggtcacatctgaagacgtggcagatgtactgaatatcttccgctgcttcggcgaagcggaagtgattgccgaaccgatgatccacccggtggtcggcgtgagcggctctgccccggcgtatgtatttatgtttatcgaagccatggccgatgccgccgtattgggcggaatgccgcgcgcgcaggcctacaaatttgcagcgcaggcggtgatgggctcggccaaaatggtgctggaaacgggtaagcatccgggcgaattgaaagatatggtgtgctcgccggggggcacaaccattgaagccgtgcgcgtgctggaagatcgcggattccgctccgccgtgatcgaggcgatggaaaaatgcatggaaaaatcagagaagctcagtaagtcctga

SEQ ID NO: 3102 - DNA, 900 bp, Enterobacter cloacae
accagtggcatgattatgaaaaaaacattactcgcagccggtgcagttctggcactgtcctcctctttcactgttaacgcagcggaaaacgacaaaccacaatacctctccgactggtggcaccagagcgttaacgtggtaggcagctaccatacccgtttcggaccgcagatccgtaacgatacttacctcgagtacgaagcattcgctaaaaaagactggtttgatttctatggctacatggacgcaccggtattcttcggcggtaacaccgacgcgaaaggtatctggaaccacggttccccactgttcatggagatcgaaccacgcttctccattgataaactgactggtaccagcctggcgtttggtccgttcaaagagtggtatttcgcaaacaactacatctacgacatgggccgcaacaagtccggtcgccagagcacctggtatatgggtctgggtacagacattgagactggcctgccgatgagcctgtccatgaacgtctacgcaaaataccagtggcagaactacggcgctgcgaacgagaacgagtgggatggctaccgtttcaaagtgaaatactttgtgccaattacccaactgtggggcggcaacctgagctatatcggcttcaccaactttgactggggttcagacctgggcgataacgatttccgcgacctgaacggcagaaaagcgcgcactaacgactccatcgcgtccagccacatcctggcgctgaactacgatcactggcactactctgttgttgcgcgttactggcacaacggtggtcagtggaacgacgacgccagcctgaacttcggcaacggcgacttcagcgttcgttctaccggttggggcggttacctggtcgtgggttacaacttctaa

SEQ ID NO: 3103 - DNA, 1323 bp, Enterobacter cloacae
cagatttatgaaaaacattaccactataaatggcaaactgttgttttattacagcggttattttccgttccacgaaagtttataatcctgctttcttattattgccacggatcttttatgcgcatacttcacacctcagactggcacctgggtcaaaatttttacagcaaaagccgcgccgcggaacatgaagcgttcctgaactggctgctggagacggctcaggctcacgaggtggacgcgattattgtggcgggcgacatttttgataccggatcgccgccgagctatgcgcgtgagctatacaaccgttttgtggtcaacctccagcaaaccggttgtcacctggtgattgtcgccggaaatcatgactcggtggcgacgctgaatgaatcccgcgatattctggcgttcctcaataccaccgtggtggccagcgccgggcacgcgccgcagatcctgaaaaaacgcgacggcacgccgggcgcggtgctgtgcccaatcccgtttttacacccgcgcgatatcgtgcaaagccaggcgggtctgtccggcagcgaaaaacagcagcatctgttgcaggccatcacccgctattatcaccagcagcatacggaagcctgcgcgctgcgcggcgatcaggccattccgatcattgccaccggacacctcaccaccgtcggagccagtaagagtgacgcggtgcgcgagatctatatcggtacgctggacgcgtttccagcgcaaaacttcccccccgccgactacattgccctcgggcatattcaccgggcgcagatcatcggcggctgcgagcatatccgctactgcggctcgcccatttcgctcagttttgacgaaacgggcaaagccaaatccgtccatctggtgagcttcaccgggggcaaactcagcgccgttgagacgcttgaggtgccggtcacccagccgctggcggtgctgaaaggcgatctggccgccattaccgctcagcttgatcagtggcgcggcacagcgcttaatccccccgtctggctcgatatcgaaatcaccaccgacgactacctgtacgatatgcagcgtaaaattcagacgctgacggaagaccttcccgtggaagtactgctggtacgccgcagccgcgagcagcgcgagaaaatactgctcaacgcccagcgtgaaacgcttagcgaacttcgggttgaagaggtgttcgcgcggcggcttgcgcatgaagaggtggacgaggccagacgcaccaggcttaacgagctgtttgcccagaccctgcactccctccatgacgaggacgaaaacgcatga

SEQ ID NO: 3104 - DNA, 639 bp, Enterobacter cloacae
tctagtgctcacacccttttgctgcaacaactagccgccaccggacaacgaaaacgcatgaattttctcgctcacctgcatctcgctcacctcgcggacagctccctctccggcaatttgctggccgattttgtacgcggcaacccggcggaagcgtattcccctgaggttgtcgacggaatttttatgcaccgccgcatcgacgtgctgaccgataacctgccggaagtgacggaagccaaaacctggttccgccccgaaacgcgacgggtggcgccgatcacgctcgacgtcatgtgggatcatttcctgtcgcgccactggccgcagctgtcgcctgatatgtcgctgcctgagtttgtgcgctacgcccacgcgcaggtgtcgatcattttgccggactccccgccgcgctttgtgaatctgaataactatctctggtctgaacgctggctggagcgataccgcgagatggatttcattcagaacgtcctgaacggcatggcgagccgtcgaccgcgtctggacgcgctgcgcgactcatggcatgacctggatgaacattacgatgcgctggaaacccgcttctggcagttctacccgcgtatgatgacgcaggcgaaaaataaagaactgtga

SEQ ID NO: 3105 - DNA, 273 bp, Enterobacter cloacae
ggaaatagcaccatgaaaaatctcattgctgagttgttggttaagcttgcccaaaaggaagaagagtcgaaagagctggttgcccaggtcgaggcgctggaaatcgttgtgacggcgctgctgcgacagatggcaaaaccagagcaggaggcgttgatcgacaacgttgaaggcgcgctggaaaaagctcgccctgattcacaggttcccgcagaggatgcggagctgcttcagcaatacgtaaaaaagcttttgaggcatcctcgcagttaa

SEQ ID NO: 3106 - DNA, 195 bp, Enterobacter cloacae
gctatgccaaccagacctccctatccacgtgaagcccgcatcgttaccgttgaaaaaggtaatggtgatcaaaccgtaacctggtaccagctgcgtgccgatcaccctaaacctgattcgctgatcagcgaacatgaaaccgaacaggaagcgctggatgcgaaacggcgctatgaggatcctgagaagtcctga

SEQ ID NO: 3107 - DNA, 1107 bp, Enterobacter cloacae
ctgtttttccatctcttctgcatgcagcgaaacgtcgcggctgagacggtaaaccatcaaatttttgaaccacagcatgataatttccacggccttgtcgttaaatcagcgggcatgataacgaattgtcgcatcgcttgcattgctaatcgggaagcgggcttctactctgttgataatcaaaataatgaggagtgtcttgtgcgtattgggattgatttgggcggcaccaaaacagaagtcattgcgttgagcgagcagggggagcaactgtttcgccaccgtctgcctacgccgcgcgatgattatcaccagaccatagagacgattgcccgcctggtcgatatggcagagcaggcaacgggcgagacgggcacagtcgggatggggatccctggctccatttcgccgtataccggcgtggtgaaaaacgccaactccacctggctcaacggtcagccgtttgataaagacttaagccaacgcctgaaccgggaagtgcgtctggcgaatgacgcaaactgcctggcggtgtctgaggccgtggatggcgcagcggctggcgcgcagaccgtatttgccgtaattatcggcaccggctgcggggcgggcgtggccttcggagggcgctcgcatattggcggcaacggcaccgcgggcgagtgggggcacaacccgctgccgtggatggatgaagatgaactcaaataccgcgccgaagtgccgtgctactgtggcaagcagggctgtatagagacctttatctccggtacggggtttgccaccgattatcatcgtctgagcggccagccgctgaaaggtaacgagattatgcgtctggttgaggagcaggatccggtggctgaactggcgctcagccgctacgaaatgcggctggctaagtcactggcgcatgtgatcaatatcctcgatccggacgtgattgtgctgggcggcggcatgagcaacgtcgaccgactttacgccacggtgccaacgctggtgaaacagtgggtatttggcggcgagtgcgaaacaccgatccgcaaagccgtccacggtgactccagcggcgtgcgaggcgcggcgtggctgtggccggaataa

SEQ ID NO: 3108 - DNA, 717 bp, Enterobacter cloacae
cttaaatacgataagacagggcaaagtatggcgagacgtattctggtcgtagaagatgaagctccgatccgtgaaatggtgtgcttcgtgcttgaacaaaatggcttccagccggttgaagcggaagattatgacagcgcggtgaaccagctgaatgaaccctggcccgatctgatcctgctggactggatgctgcctggcggttccggattgcagtttatcaagcatatcaaacgcgaggcgatgacccgtgatatcccggtggtgatgctgacggcgcgcggcgaggaagaggatcgcgtgcgcggtctggaaaccggcgcggacgattacatcaccaaaccgttctccccgaaagagctggtggcgcgtatcaaagccgtgatgcgccgtatttcaccgatggcggtggaagaggtgattgagatgcaggggctgagcctggatcctacctcgcaccgggtcatgaccggtgaaaatcccctcgatatgggccccaccgaatttaaactcctgcacttctttatgacacacccggagcgcgtttacagccgcgaacagttgctgaataacgtctggggaactaacgtctatgtcgaagaccgaacggttgacgtccatattcgccgcctgcgtaaagcactggaactgagcggccacgatcgcatggtacagacggtccgcggcacgggttatcgcttctcgacccgtttctga

SEQ ID NO: 3109 - DNA, 1299 bp, Enterobacter cloacae
cgcgtgctggaacgtctgtcatggaaaaggctcgtctttgaactgatcttatgctgtattccggccctcattctgggggctatctttggctatctgccgtggtttttactggtggccgtgacgggattgctcgtctggcatttctggaatttactgcgtctttcctggtggctgtgggtcgacagaagtatgacacctccgccgggaagcgggagctgggaaccgcttctctacggcctgcaccagatgcagatgcgtaataaaaagcgccgtcgtgagctgggaagcctgatcaaacgctttcgtagcggtgcggagtcgctgccggacgcggtgatcctgacgacggaagaagggaccatcttctggtgcaatggcctcgcacagcagctgctgggcctgcgctggccggatgataatggtcagaacatcctgaaccttctgcgttatcccgagttcacgctgtatctgaaaaagcgggatttttcgcgcccgcacaatctgaagctcaataacggtcgccatctggaaatccgcgtgatgccctacagcgatcggcagtggctgatggtggcgcgggacgttacccagatgcaccagcttgagggcgcgagacgtaacttctttgccaacgtcagccacgagctgcgtacgcccttgacggtgcttcagggctacctggagatgatgcaggagcaaacgcttgagggggcgccgcgtgagaaagcgctgcataccatgcgggagcagacgttccgcatggaagggctggtcaaacagctgctgacgctttcaaaaattgaggctgccccgtcgctggcgctaaatgacatcattgatgtgccgatgatgttgcgggtggtggagcgcgaagcccaaacgctgagtcataatcagcacaccctgagttttgacgttgataacacgctgaaagtgctcggcagtgaagatgagctgcgaagcgctatctcaaacctgatctataacgccgtgaatcacaccccgaaagggacgcatatcgcggtgcgctggcagcataccccggcgggcgctgagtttagcgtcgaggacaacgggccggggattgggcctgaacacctcccgcgtctcactgaacggttctaccgggtggataaggcgcgctcgcggcagaccggcggaagcggactggggctggcaattgtgaagcatgccgtcagccaccacgaaagccggctcaatatcgaaagcaccctcggtaagggcacgcgctttagcttcgtgattccggaacgattaattgccaaaaaaagcgcctga

SEQ ID NO: 3110 - DNA, 1326 bp, Enterobacter cloacae
ggttttatgacccatcacttgaaatcgcgtgacattatcgcgctgggctttatgacatttgcgctgttcgttggcgcaggtaacatcatttttcctccaatggttggcttacaggcgggtgaacacgtctggacggctgcgtttggcttcctgcttactgccgtgggcctgccggtactgaccgttatcgcgctggcgaaagtcggtggcggtgtggacagcctcagcaccccgattggcaaagtggctggcgttctgctggcaaccgtctgctatctggccgttggcccgctgttcgcgaccccgcgcacggcgaccgtctcctttgaagtgggtatcgccccgctgaccggtgacggcgcgatgccactgtttatttacagcctcatttacttcgccatcgtgattctggtttctctctatcccggcaaactgctggataccgtgggtaacttcctggcaccgctgaaaattgtggcgctgattgtgctggcggttgcggccattgtctggcctgcggggcccatcagctccgcgatggacgcctaccagaacgcggcgttctcaaacggtttcgtgaacggctatctgacgatggatacgcttggcgcgatggtgtttggtattgttatcgttaacgccgcgcgttcccgtggggtgaccgaagcgcgcctgctgactcgttacactatctgggctggcctgatggccggtgtcggcctgacgctgctgtatctggcgctgttccgtctgggttcagatagcgcaacgctggtcgatcagagcgcaaacggcgcggcgatcctgcatgcttacgtgcagcacacctttggtggtgcaggcagtatgctgctggcggcgctgattttcctggcctgtctggtgacggcggtgggtctgacctgcgcctgcgcggagttcttcgctcagtatctgccgctctcttaccgcacgctggtgtttatcctcggcatcttctccatggcggtgtcaaacctcggtctgagccacctgatccaggtgtcaattccggtgctgacggctatctatccgccatgtatcgtgctggtggtgctgagcttcacccgcccgtggtggcataactcgacgcgaattattgcgccggccatgtttatcagcctgatttttggtatccttgacgggatcaaagcatcagcatttgcagaaatcctgccagcctggacacagcgtctgccgctgtccgagcagggcctggcctggctgatgccttccgttgtagcgctggttcttgcgattatctgggaccgtgcggccgggcgtcaggtgacatccaacgcccattaa

SEQ ID NO: 3111 - DNA, 1455 bp, Enterobacter cloacae
tcaacggcaacaaattgtttaaccacggggcttaaggccccgtggttttttgtttttttcgtgttgaatggcaagattttaatggaaagcactaacaaacttaaacgtggattgagcacccgccacatccgctttatggcgctgggctcggctatcggcaccggtcttttttatggctcggcagatgccatcaaaatggccggtccaagcgttctgctggcctacatcatcggcggtgccgcggcctatatcatcatgcgtgcgctgggggagatgtcggttcacaacccgtctgccagctcgttttcacgctatgcacaagagaacttaggcccgctggccgggtttatcactggctggacttattgctttgaaatcctgattgtcgccattgccgatgtgacggcgtttggcatctatatgggggtctggttccctgccgtgccgcactggatctgggtgctgagcgtggtgctgattatctgcgccgttaacctgatgagcgtgaaggtgtttggcgagctggagttctggttctccttcttcaaggtcgcgaccattatcatcatgatcctcgccggtttcggcatcatcatctggggtatcggcaacggtgggcagccaaccggcatccataacctgtggagcaacggcggcttctttagcaacggctggctcgggatggtcatgtcgctccagatggtcatgttcgcctatggcggaatcgagattatcggcatcaccgccggggaagcgaaagatccggagaagtctattccgcgcgccatcaactcggtgccgatgcgtatcctggtgttctacgtgggcacgctgtttgtgattatgtccatctacccgtggaaccaggtgggcaccaacggcagcccgtttgtcctgactttccagcatatgggcattgcgtttgccgccagcattctcaactttgtggtgctgaccgcctcgctgtcggccatcaacagtgacgtgttcggcgtgggccgtatgctgcacggcatggcggagcagggcagtgcgccgaaggtgtttgccaaaacgtcgcgtcgcggcaccccgtgggtaacggtgctggtcatgaccgtggcgctgctgttctcggtttacctgaactacatcatgccggagaacgtcttcctggtgattgcgtcactggcgaccttcgccaccgtgtgggtgtggatcatgatcctgctgtcgcagattgcgttccgtcgccgcctgtcgccagaagaggccaaagcgctgaagtttaaagtgccgggcggcgtgccaacgaccattgtcggtctgatcttcctggtcttcatcattggcctgattggttatcacccggatacccgtatttccctgtacgtgggcttcgcgtggatcgtcctgctgctggtgggctggatgtttaaatgtcgccgcgatcgtcagctggcggaagcacagtaa

SEQ ID NO: 3112 - DNA, 1845 bp, Enterobacter cloacae
cgtcaatttcatcaaaggggattcgtgatgttaaacgcctggcaccttccggttgccccatttgttaaccaaaacaaagacaaccttgtgattacgctctggctggcaggggacaatcagcctgaacgtgtgaccctgcgcgccgaagtggataacgaagaaacgtcgttgaaaatgcacaaagtgcgcagccagccgcagccgggcgtcacggcgtggcgggcaaatatcgatttgcgcagcgggcaaccgcgtcgccgctacggcttcaagctgctgtggaacaaccgccagctgtggtttaccccgcagggtttcagccgtttccctccggccaggctggagcagtttgccgtggatcacccggataacggcccgcagtgggttaacgatcaggtcttttaccagattttcccggaccgctttgcgcgcagtgaaaagcgcaccgtcgatcaggacaaggtttattaccatcatgcggtcggtcacgacatcattctgaaaaaatgggacgagccgctgaccgcccaggcggggggatcgaccttttacggcggcgatctcgacggtatcagcgaaaaactgccgtacctgaaaaagctcggcgtgacggcgctgtacctgaacccggtgtttaaagcgccaagcgtgcacaaatacgatacgcaggactaccgccacgttgacgagcagtttggcggtgacgaagcgctgctgcggctgcggcacaacacgcaaaaagagggtatgcgcctgatccttgatggcgtgttcaatcacagcggtgattctcacgcgtggtttgaccgtcacaatcagtcgatgggcggcgcatgccataatccggactcaccgcagcgtgactggtacagttttgacgagaatggccgcgccctggactggctgggctacccgagcctgccgaagctcgatttccagtcgccatcgctggtgaatgagatctacggcggcgacgacagcatcgtgcgccactggctgaaagcgccgtggaacatggacggctggcggctggacgtggtgcatatgctgggtgaagcaggcggggcgcggaataaccttcagcatgtcgccgccattacccggtcggcaaaagcggcccggtcggaagcattcgtcttcggggagcactttggcgacgcgcgtcagtggttgcaggctgatgcagaagacgcggcgatgaactatcgcggcttcaccttcccgctgtggggtttcctcgctaacaccgatatctcttacgatccgcagcatattgacgccgaaacctgcatggcgtggatggaaaactatcgcgctggcctgtcgcatcagcagcagctgcggatgtttaaccagctcgacagccacgataccgcacgctttaaatcgttgctgggtaaggatgtggcgcgtctgccgctggcggtgacctggctctttacctggccgggcgtaccctgcatctactatggcgatgaagtcgggctggacggcaacaacgatccgttctgccgtaaaaccttcccgtgggagcctgaaaagcaggatcaggatctgttcagcctctaccagcgcatggcgacgctgcgcaagcagagccaggccctgcgatacgggggctgtcaggtgatgtacgcccacgataacgtggtggtgtttgtccgcgtctataaccagcagcgcgtgctggtggcgatcaaccggggcgaggcgtgtgaagtcgtgctggaagattcaccgctgctggctggtaaaatgtggaagagcaaagagggtaaagcgacgttccaggggagcgtgctcacgctgccagcgatctccgctgcggtctggttcggcagctaa

SEQ ID NO: 3113 - DNA, 474 bp, Enterobacter cloacae
cgggacggcgttgctggtgctggcgctcggcagcgcgatatgggcgcaaatggacggcgtcacttcgctgagcctcctgcttattttcgcagtgctcagtctttgctggctggctgcggcctggctgtggcagaaaatcgcgctgccgggcagctgggcattgctggccggtgggttgctgttctggttagtggcgttgctgggcgcgtcgcagttgttcctgaagcaggagttatcgcttctggcaggcgtgctggcgctgacggcggcgtcgacctggggatggcggcaggctgccgctcgtctggcatggtgggagctggatgccagcaaatggctgctgtggccggtgatgctgctgatggtgctgtatcaggtctcgcaccagcagattctggcggccggctgggcaaatctggcctgggctatcgcgctgcctgccgccctgatgctgctgcggcgcgacgaagataa

SEQ ID NO: 3114 - DNA, 1107 bp, Enterobacter cloacae
actatgccgcctgtttttaagtcacgagtatacgtcatgcgcgtcgccgatttctcctttgaactacctgaatccctgattgctcactaccccatgcctgagcgtagcagctgtcgcttgctgtcactggacgggccaacgggcgcgctgacgcacggtactttcaccgatctgctcgacaagctcaaccctggcgatctgctggtctttaacaatacccgcgtgatcccggcgcgtctgtttggccgtaaagccagcggcggcaagattgaggtgctggtcgaacgtatgctcgatgataaacgtattctggcacatattcgcgcctccaaagcgccgaagccgggcgcggagctgctgctgggggatgacgagagcatcaaagcgaccatgaccgcgcgtcacgacgcgctgttcgaggtggagttcaacgacgaacgcacggtgcttgatatcctcaacgccatcggccacatgccgctgccgccgtacattgaacgcccggacgaagaggccgaccgcgagctgtatcagaccgtctacagccagaagccgggtgcggtggcggcgccaacggcgggcctgcactttgatgaaccgctgctggaaaagctgcgcgccaagggcattgagatggccttcgtgacgctgcacgtcggcgcggggaccttccagccggtgcgcgtggacagcatcgaagatcacatcatgcactctgagtatgccgaagtgccgcaggaggttgtggatgcggtgctggcggcgaaagcgcgcggtagccgcgtcgtggccgtcggtacaacgtcggtacgttcccttgagagcgctgcgcaggccgcgaaaagcgagctgattgaaccgttctttggcgatacgcagatttttatctacccgggctatcagtacaaagtcattgatgcgctggtgaccaacttccatctgcctgaatcgacgctgattatgctggtttccgcgtttgcggggtatcagcatacgatgaacgcctacaagtctgcggtagaacaaaaatatcgcttttttagctacggtgacgcgatgtttatcacgtacaatccgcaggctttgaatgagcgtgtcggggaataa

SEQ ID NO: 3115 - DNA, 333 bp, Enterobacter cloacae
atgagcttttttatttctgatgcggtagcagcaacgggtgcaccagcgcagggcagcccgatgtctctgattctgatgctggttgtgttcggtctgatcttctacttcatgatcctgcgtccacagcagaagcgtactaaagagcacaaaaacctgatgaactccatcgcgaagggcgatgaagtcctgaccaatggtggcctggtgggtcgcgtaaccaaagtagcggaaaacggctacattgctatcgccctcaacgacaccactgaagtggttatcaaacgtgacttcgtagctgccgttctgccgaaaggcaccatgaaggcgctgtaa

SEQ ID NO: 3116 - DNA, 1875 bp, Enterobacter cloacae
tcccaacttttcccaaagggaactgccgtgttaaaccgttatcctttgtggaagtacatcatgctggtcgtcgtgattatcgtcggcctgctgtacgcgcttcccaacctgtatggtgaggatccggccgttcaaatcactggcgcgcgcggtgtcgccgccagtgagcaaacgctgatccaggtccagaaaacgttacaagaagaaaaaattaccgctaagtctgtggcactggaagagggcgcaattcttgctcgcttcgacaccaccgacacgcagctccgcgcacgtgaagcgctgatgggcgtgctgggtgataaatatgtcgtggcgcttaaccttgctcctgcaaccccacgctggctggctgcgctgaacgcagagccaatgaaactgggtcttgacctgcgtggcggcgttcacttcctgatggaagtggatatggataccgcgctcggcaagctacaggaacagaatatcgacagcctgcgcagcgatctgcgcgataagggcattccgtacaccaccgtacgtaaagaagataactacggcatgagcatcacgttccgcgacagcgcggcacgcgatcaggctgtgacctatctgtctcagcgtcaccgcgatctggttatcacctctcagggcagcaatcagctgcgtgcggtaatgaccgacgcgcgtctgagtgaagcacgtgaatacgccgttcagcagaacattaacattctgcgtaaccgtgtaaaccagctgggcgtggctgagccactggtacagcgtcagggtgcagaccgtatcgtggtcgaactgccgggtatccaggataccgcccgtgcgaaagagattctgggcgcgacggcgaccctggagttccgtctggttaactccagcgttgaccaggctgctgcggcttcaggccgtgtgccgggcgattccgaagtgaagcagacccgcgaaggccagccggttgtgctgtacaaacgcgtgatcctgaccggtgaccatatcaccgactccacttcaagccaggatgagtacaaccagccgcaggttaacatctcgctggatagcgcaggtggcaacatcatgtctaacttcaccaaggacaacatcggcaagccgatggcgaccctgttcgtggagtacaaagacagcggtaagaaagacgccaatggccgtgccgtgctggtgaaagaggaagaggtgattaacatcgccaacatccagtctcgtctgggtaacagcttccgtattaccggtatcagcaacccgaacgaagcgcgtcagctctctctgctgctgcgtgccggtgcgctgattgcgccaattcagattgttgaagaacgtaccatcggtccaaccctgggtatgcagaacatcaaacagggtctggaagcgtgtctggccggtctggcggtgtccatcatcttcatgatcttcttctataagaagttcggcctgattgcgacctccgcgctgattgccaacctggtgctgatcatcggtatcatgtccctgctgccaggggcgacgctaaccatgccaggtatcgcgggtatcgttctaacccttgcggtggcggtcgacgccaacgtactgataaacgaacgtatcaaagaagagctgagcaacggtcgttctgtacagcaggcgattgaagaaggctacaaaggggcgttcagctccatcttcgatgcgaacgtaacaacactgattaaggttcttatcctgtatgcagtgggtactggcgcgatcaaaggctttgcgattactaccggtatcggtgtcgcaacgtcgatgtttaccgctattgtcggcacccgtgccatcgtgaacctgctgtacggcggcaagcgcgtcaaaaagctgtctatctga

SEQ ID NO: 3117 - DNA, 384 bp, Enterobacter cloacae
caacaggcaggaggacgtatgaaaagtgtcattaactggtttgaaattccggtcgccgatatggatcgcgccatcaaattttatgagtcggtgatgcaggtcgcgctgcggcgcgagaagatggacgtggctgagctggcggttttcccgcacgaggatccggccaccggcggcgcgctggcgaaatttgacggcgttacaccctcttcgcagggcgctattatttacctgcatactgacaatctggcggccacgctcgatcgtattgcttctgcgggcggtgagtgcgtgtttggcccgctggaactgccgcaaggcattggcactatagccctgtttaccgacagcgaaggtaatcgcgtcggcctccatcaaccggtatga

SEQ ID NO: 3118 - DNA, 471 bp, Enterobacter cloacae
tggggagagacgatggcgatttgggttgatgcggacgcgtgtccgaatgtgattaaagagattttatttcgtgctgccgagcgcgtgcagatgccgctaacgctggtggcgaaccagaatatccgcgtgccgccctccagatacatccgatctctgcgcgttccggccgggtttgacgtggcggataacgagatagtacgcctgtgtgacgcaggagatctggtgatcacggcggatatcccgctggctgccgacgtgctggcgaagggggccgcggcgcttaacccgcgcggcgagcggtactctccggcaacgatccgggagaagctcaccatgcgtgattttatggatacgttgcgttccagcggcgtgcaaaccggtgggccggacagcctgtcgcagcgcgatcgccagcagtttgccgccgagctggataaatggctgctggaagtgaagcgccgcccggcgtag

SEQ ID NO: 3119 - DNA, 669 bp, Enterobacter cloacae
cccacctccgggcggttttgtggtacagtgtggcttccacaggcttgtcattccgtaccgctttgcagtaaagttagcgcaacatctactgcaatcatttctttacagccttcagttatccggcagcaaggggaacacctggttatgaacccacccatctttttagttggccctcgcggctgtgggaaaaccaccgttggtctggagctggcgcgtttgtgccagagtcagtttgtcgatactgaccactggcttcaggagaatgcgggtaagactatcgccgatatcgttgaagatgagggttgggagagctttcgtgcgcgtgaaacggccacgctggaagcggtgaccgcgccgtcaaccgtgattgcgaccggtgggggcattatcctggcgtcgtataaccgccagtttatgcgcgaaaagggtgtcgtgatctacctctgtgccccggtctctacgctggtggggcggctggaggcgtttccggaagaggggcagcgcccggcgctgaccgcgaaaccgctgagtgaagaggtcagcgaggtcctcgccgaacgcgatgcactgtaccgcgaggcggcacaccacgttgtggatgcgtcggcgtcacccgaaaaagttgcgattcagattattaccgccctgcgtttggcttgcgccagctaa

SEQ ID NO: 3120 - DNA, 321 bp, Enterobacter cloacae
tggatttttctctataaatataagggccagttcatgcttcaaagtaacgaatacttttccggtaaagtgaaatccattggttttaccagcagcagcactggccgcgccagtgtcggcgtaatggcggaaggggaatacacctttggcaccgcagaagcggaagagatgacggtggtcagcggcgcgctgaacgtcctgctgccgggtgaaacggagtggaaagtatatagtgccgggcaggtcttcaacgtgccgggccacagcgagttccatttacaggttgcagagccaacctcttatctgtgccgctatctgaaataa

SEQ ID NO: 3121 - DNA, 1026 bp, Enterobacter cloacae
acctgctgtacggcggcaagcgcgtcaaaaagctgtctatctgaggagtgcgttgtggcacaggaatatactgttgaacaattgaaccacggccgtaaagtctgggactttatgcgctgggactactgggccttcggcatttcaggttttctgctgatcttgtccatcgtcattatgggcgtgaaaggctttaactggggcctggatttcaccggtggtacggtgatcgaaattaccctggaaaaaccggtcgatatggaccagatgcgtgagtctctgcaaaaagcgggctttgaagagccgctgctacagaacttcggcagcagccgcgacatcatggtgcgtatgccgccggtacacgatgccaacggcagccaggagttgggcagcaaggtcgttcaggttattaacgaaacgaccagccaggacgcaacggttaagcgtattgagtttgtcggcccgagcgttggtgctgacctggcgcagaccggtgcgatggcgctgcttgtggcgctgatctcgatcctgatttacgtcggtttccgctttgagtggcgactggcggcaggcgtggttatcgccctggcgcacgacgtggtgatcaccatgggcatactgtccctcttccacattgagattgacctgacgattgtggcatccctgatgtccgttatcggttactcactgaacgacagtatcgtggtatctgaccgtattcgtgaaaacttccgtaagatccgtcgcggcacgccgtacgaaatctttaacgtgtcgttgacccagacgctgcaccgtacgttgatcacctccggcaccaccctgatggtgatcctgatgctgttcctgttcggtggcccggtgctggaaggcttctcgctgaccatgctgatcggtgtgtctatcggtacggcctcgtctatctacgtcgcgtccgcgctggcgctgaagctgggcatgaagcgcgagcatctgatccagcagaaagtcgagaaagaaggggcggatcagccgtccattctgccgtaa

SEQ ID NO: 3122 - DNA, 744 bp, Enterobacter cloacae
ccctgtttaccgacagcgaaggtaatcgcgtcggcctccatcaaccggtatgagagtaaaccgatgacccgacgcgctgaccgtttgttccagattgtgcagatcctgcggggcaggcgtctgacaacggcagcgcatctggcggaaaggcttggcgtgtccgagcgcacggtgtaccgcgatatccgcgacctgtcgctttccggcgtgccggtggaaggcgaggcgggaagcggatatcggctaatgtcgggttttgatttacccccgttgatgctgaccaacaaggagtccgaggcgctgatggtggcgatccgtctgctcaaaacctggggcggggaatcgctgtcgcgcgagctggagtcggcccaggaaaaagtgctggcgatcctgccagaagagagccgccgcaaagctgaacagacgcgaatttacgcaccggatattgcccttcagccacactcccgtagtggttttgacgtaatccaccaggcaatttctgccctgcgtgtgctggcgctgcactatcgcgatgaagccgggcagttaacctggcgtgaggttcagccgctggggctgttcttctggggtgagcactggctgctggcggcatggtgtgaacggcgcgatgactaccgctgcttccgtctcgaccggtgtttgcatattacgctgacggaaagacgctttagcgaaagcgcggacaggtctttggcggattttttgcgcaaggtgaagcagtaa

SEQ ID NO: 3123 - DNA, 591 bp, Enterobacter cloacae
agatatcctggcctgatgattagcctctttgtgacgacgatggtgatccagctctgtaacggctcggtggggccgattctggcgctgtttatcaagtcgatggcgccggacagcagcaacattgcgtttctgagcgggatgattgccgccgtgccgggcgtgtcggcgctgatgtctgctccgcgcctggggaaactgggcgacaggatcggtacggcacgtattctgatggcaacgctcatcattgcggtgatccttttctttgccatgtcattcgtcaccacacctcttcagttgggcatcctgcgcttcctgcttggcttcgcggatggcgccatgctgcccgctgttcagacgctgctggtgaaatattccagtgaccaggtaaccggccgcatttttggctacaaccagtcgttcatgtatttaggcaacgtagcgggcccgcttattggcgcctcggtctcggcgatggcgggtttccgctgggtatttgccgcgacggcggtggtggtactgctgaatattattcaactggcctttgccttacgccgtcgcaggcgaatcgctgaggcaaagtcggcccggtaa

SEQ ID NO: 3124 - DNA, 363 bp, Enterobacter cloacae
cgaaccagacttaacgtggaacttcacataaaggatggtgcaatgaaaacaacaatactgattaccctgctctctggcctgtgtctgatggcatcagcacatgcggaagagaaaacgttgacgccccagcagcaacgcatgacgacctgtaaccaacaggcgacatcgcaaagcctgaaaggggatgcccgtaaaacgtacatgagcgactgcctaaaaaatggtgcgacaaaacccggtgaaaaaagcctgaccccgcagcagcaaaaaatgcgcgagtgcaatgcccaggcgacacagcagatgctgaaaggcgacgatcgcagcaagttcatgagcgcgtgcctgaaaaaacaggcgtag

SEQ ID NO: 3125 - DNA, 1200 bp, Enterobacter cloacae
cgggtgagtcacggctgtggctcacccaaaatttcatactttccccgctatccccctctctataatttgggaaaatgtttcagaatattcccaaagatgatgaatgatgagttttatgacagtcacgggaacattcgggaagcgtggcaccagcagctttctcaggatgattcataccgttccggtctgcgatttgcccggcgaatacggctggcacgcatcgttggtctggcggcgctatttgttccgcttgccagcgttctggtgagccagtttctttccggcgtctggtggttattgctggtgggctgggtctttgtctggccccatctggcctggcagctggcttttcgttcggctgaaccccacagaagtgaaattgttaatctgaaaatcgatgccattcttgccggtgtctggatggggctaacagggttcaatgcactaccaacggcggcgctgatcatgatgatcggcatgaatatgatgggatcggggggatgtcgcttatttctgacaggactggcgctgcttgccctgtctgctctgctcaccgtgcaatccacgggtactcctgtgctattgacctctgaaccgctggcgttgtggctgacgctccccgtgctggtggtctaccccatgctgtttgcatggctcagccaccgcacggcgatccggctggcagagcataagcgtcggcttgagctgatgagtacccgcgacggaatgaccggcgtgttcaatcgccgtcactgggaaacgctgctgcgttacgaatttgaggcctgccgtcgcagccatcgacatgcgacgatactgctcattgatatcgatcacttcaagacgatcaacgacacctgggggcatgacgtgggagatgaagcgattgttgccattacgcgccagcttcagctgactctgcgctcaggcgattatattggccgctttggtggggatgagttcgcggtgatcatgtccggcacgcctgccgacagcgcgattgcagcgatgtcgcgcgtccatgaacggctggtcaacatgccgctgcacggagcaccaacggcgaggttgtgtatcagcgttggggttgccccctggggagcgcagttcacccactatcgtgaatggctaaaggcggcggacgtggccctctataaagccaaaaatgccggacggggccgcaccgaagtggccgcctga

SEQ ID NO: 3126 - DNA, 693 bp, Enterobacter cloacae
cggaaggcgatcaaaatgaaggcgacgttggcgatcctcacgattggtgtggtgcctgtaagcgaagtattaccgctcttaaccgagcatgtctctgaacaacaaattacgcatctcagtctgttagggaagctcagtcgggaagaggtcatggaagactacgcggtcggagagggggaagatcccctggcaacgttactcagtgacggtaaactggcgcatgtgtcgcgccagaaaatcgagcgcgcgctacagggcgtgatcgaagtgctcgacaatcaggactatgacgtcattttgctgatgagcacggcacccgttaaaggactcagcgcgcgtaatgccattctgctcgaaccgatgcggattatccccccgctggtggcctctattgttgatggtcatcaggttggggtcatcgttcccgttgaggaactgctggataaccagacggtgaagtgggctgcgctggagcacaccccgctgtacgcgctggctaacccgttctgggacagcgaagcgaagctgattgcggctgggcaggaattgatcgacagaggggcggatgtcctgatgctcgactgcctgggcttccatcagcggcatcgtgatttattgcaaaaggcgctggatgttccggtgctgctctctaacgtcctgatggcgcgtctggcgtcagaattactggtgtaa

SEQ ID NO: 3127 - DNA, 1197 bp, Enterobacter cloacae
gcgtgtcggggaataagtccgcggcactgtgttacaacgttggactgtttttctgacgtcggagaaaaaatgaaatttgaactcgataccaccgatggtcgcgcgcgtcgcggtcgtctggtgtttgatcgcggcgtggtagaaacccccgcgtttatgcctgtgggcacgtacggcaccgtaaaaggaatgacgccggaagaagttgaagccactggcgcacagattatcctcggcaacaccttccacctgtggctgcgtccaggccaggagatcatgaagctccacggcgatctgcacgacttcatgcagtggaaaggccccatcctcaccgactccggcggtttccaggtcttcagcctgggcgatatccgtaagatcactgagcagggcgtacacttccgtaacccgatcaacggcgatccaatcttcctcgatccagaaaaatccatggagattcagtacgatctcggctccgatatcgtaatgatcttcgacgaatgtacgccatatccagcggactgggactacgccaagcgttctatggagatgtccctgcgttgggcgaagcgtagccgcgaccgttttgactccctgcaaaacaaaaatgcgctgttcggcattatccagggcagcgtttacgaagatttacgcgatatctcggttaaaggtctggtagagataggctttgatggctacgctgtcggcggtttggctgtgggtgagccgaaggaagatatgcaccgcattctggagcatgtctgcccgcaaatcccggcggataaaccacgatacctgatgggtgtgggtaaaccagaagatctggtggaaggcgtacgtcgcggcattgatatgttcgactgcgttatgccaacccgaaacgcgcgtaacggtcatctgttcgttaccgatggcgtggtgaaaatccgtaacgcgaagcataagagtgacaccagcccgctcgattccgagtgcgattgctatacctgtcgcaattattctcgcgcgtacctgcatcatctcgatcgttgcaacgagattttgggggcgcgtctcaataccattcataatcttcgttattatcagcgcttaatggctggtttacgtaaggctatcgaagagggtaaattagagagcttcgtgaccgatttctaccaacgtcaggggcgggatgttccaccgttgaacgttgattaa

SEQ ID NO: 3128 - DNA, 1419 bp, Enterobacter cloacae
gaacaggtaagccttgccatgccacattcctacgattacgacgcaatagttattggttccggccccggcggcgaaggtgctgctatgggtctggtaaaacagggagccagagtagcggttattgagcgctaccataatgtcggcggcggttgcacccactggggcaccatcccttcgaaagccctccgccacgccgttagccgcattatcgaatttaaccagaaccctctttacagcgaccactcccgacttcttcgctcctcctttgccgatatcctgaatcacgcagacacggtcattaaccagcagacgcgcatgcgtcagggtttctatgagcgcaaccactgtgaaattctgcaagggaacgcgcattttgtggatgaacacaccctggcgctggagtgccacgacggttcggttgagacgctcaccgctgaaaaatttgtgatcgcctgcggctcccgtccttaccatccggcagacgtggatttctcgcacccgcgcatttacgacagcgactccatcctcagcctgcaccacgagccacgccatgtgatcatttatggtgcgggggtgattggctgtgaatatgcgtcgatcttccgaggaatggaggtcaaagttgatttgatcaacacccgcgaccggcttctggcgttcctcgatcaggagatgtcagattccctctcctaccacttctggaacagtggcgtggtgattcgccacaacgaagagtacgagaaaatcgaaggctgcgatgacggtgtgatcatgcacctgaaatccggtaagaagctgaaagccgactgcctgctgtatgccaacggccgtaccggcaacacggattcattgcagctggagaatatcgggcttgaaaccgacagccgcggtcagctcaaggtcaacagcatgtaccagactgcgctgccgcacgtttacgcggtgggcgacgtgattggttacccaagcctggcctccgccgcttacgatcagggccgcatcgccgcacaggcgctggtgaaaggtgaagcgacggcgcatctgattgaagatatcccgacggggatctacaccattccggaaatcagttctgtcggcaaaaccgagcagcagcttacggccatgaaggtgccttacgaggtgggtcgtgcccagtttaaacatctggcgcgggcgcaaatcgtgggaatgagcgtgggtacactgaagatcctgttccatcgcgagacgaaagagatcctcggtattcactgcttcggtgaacgcgcggcggaaatcattcatatcggccaggcgatcatggagcaaaaaggtggtggcaacaccattgagtacttcgttaacaccacctttaactacccgaccatggcggaagcttatcgggtcgctgcgctgaacggcttaaaccgcctgttttaa

SEQ ID NO: 3129 - DNA, 1164 bp, Enterobacter cloacae
ggtgtgtcaacaatgaaaatgaacttaccgccatttatcgagatttaccgcgccctgatcgccacaccctccatcagcgcgacggaagaagccctggatcagagcaatgagtctttaatcaatctgctggcgggttggtttagcgatcttgggtttaacgttgaggttcagcccgtccccggaacacgccacaaatttaacctgctcgccagtaccggacatggcgcgggcggcctgctgctggctgggcacactgacaccgtgccgtttgatgatggccgctggacgcgcgatccgttcacgctgtccgagcatgacaacaagctttatggtctgggcaccgccgacatgaaaggcttcttcgcctttatcctcgacgcgctgcgtgacgtggacgtgacgaagctgaaaaaaccgctctacattctggcgaccgccgatgaagagaccagcatggcgggcgcacgttatttctctgaaaacacatcgattcgtcctgactgcgcgatcatcggcgaaccaacctctctgcaaccgattcgggcgcacaaaggccatatttctaccgcggtgcgcgtactgggccagtctggccactccagcgatccggcgcgcggcgtgaacgccattgagctgatgcatgacgcgattggccgcatcatgaccctgcgcgacgatctgaaagagcgctatcactacgaggcgttcaccgtgccttacccaacgcttaacctcggcagcctgcacggcggtgatgcgtccaaccgtatctgcgcctgctgcgaactgcatatggatatccgtcctctgccgggtatgacgctgagcgatctggatggcttactgaacgaagctctggcaccggtcagcgagcgctggccgggccgtctgacggtctccgaactgcatccgccgattccaggctacgaatgcccgcctgaccatcagctggttcaggtagtggaaaaactgctcggcgagaaaaccgacgtggtgaactactgcaccgaagcgccgtttattcagacgctgtgcccgacgctggttctgggccctggctccatcaaccaggcacaccagccggacgaatatctcgaaacccgcttcatcaagcccacccgcgaactcattacccaggttgtgcatcacttctgctggcattaa

SEQ ID NO: 3130 - DNA, 2523 bp, Enterobacter cloacae
ggattgatttcaggagtgtgtatggctctcgtagtggaatttacctgtgaattacccaacggtgttcacgcgcgtccggcaagtcatgtggaaacgctgtgcaatacgtttatctcgcaaatcgaatggcacaacctgcgcacagaccgtaaagggaatgccaagagcgcactggcagtcattggcaccgatacgctggcaggcgatgcctgtcgtctggtgatccaaggtgaagatgagcagaacgcctatcagcaactggaacaatggctccgggaagagttcccacactgtgatgcgccgctcgcagaagccattaataatgagcgcgatccgctgccagaatccctcgcgcgccttaacccaacacttttccgcgccctgcccgtttgcagcggtagcgcccagggcgtgttgaccttgctggcctcgctggatctcaacgcactgtcagatttagccgaagcgaaagacgaagaagatgagcagttagcactggataatggtctcaccctgctggtgaaaaacattgagctgcgcgcgctggacagcgacagcaccgccagcgccattcttgaagcccatcgttcgctggctacagatacctcgctgcgccagcacctcctgtcaggggtcaaccggggcttaagctgcgcccaggccatcatcgccacggcgaaccatttctgcgaaacgttctctcgttccagcagcacgtatttgcaggagcgtgtgctggacgttcgcgacgtctgctatcagcttttacagcatatctacggtgaagcgcgtttcccgtctccggggcaactgacgcagccgagcgtctgccttgctgacgacctcacgcccggccagttcctggaactggataaaactctgctcaaagggctgctgttaaaaagcggtggaacaacctcgcacacggttattcttgcacgttcctttaatattccgacgctggtgggcgtcgacggtgaaagcctgttgcagtggcgcaatcaatccgtatttatcgatggcaatgctggtgccgtcgtggtcgatgcaagcgatgcggtggcgcgctactaccgacaggaagcacgggtacaacaggcactacgcgagcagcagggcatctggctggaccgggaagccagaaccgccgacggcctgcgggttgagattgccgcgaacatcgcccatgcggtggaagcgcaggcagcctttgagaacggcgccgagggcgttggcctgtttcgcaccgaaatgctttatatggaccgcagcagcgcgcccggtgaaaacgagctctacaacattttctgtcaggcactggaaagtgcaaacgggcgcagcatcatcgtgcggaccatggatatcggcggcgataagccggtagagtacctgaagatcccggccgaaaataacccgttcctcggttaccgcgccgtacgtatttacgaagagtatgcagtgcttttcaccacccagcttcgggcgatcctgcgcgcctctgctcacggcagcctgaagatcatgatcccgatgatctcttccatggaagagatcctgtgggtgaaagagaaacttgccgaagcgaaacaacagctccgcgctgagcatattccgtttgatgagaaaatcccgcttggcatcatgctggaagtcccttcggtgatgtttatcatcgaccagtgttgcgaagagattgatttctttagcatcggtagcaatgacctgacgcagtatctgctggctgttgatcgcgataacgccaaagtcacacgccattacaacagcctgaacccggccttcctgagggcgctggattacgcggtacaagccgtccatcgccaggggaaatggattggcctgtgcggcgaactgggtgcaaaaggctcggtgttgccattgctggtgggtctgggtttggacgagctgagcatggggtcgcctgctatcccggcaaccaaagcgcgtctggctcagcttgatagccgcgcctgccgccagttgctgaatcaggccatggcgtgtcgcacctcacttgaagtggagcacctgctggcgcagttccgcatgaatcagcaggacacacctctggttacacctcgctgcatttcactggacaatgactggaacagcaaagaagaggtcatgaaaggaatgaccgataacctgctgctcgcaggacgttgccgctacccacgcaagctggaggccgatctgtgggcacgcgaagcggtcttctccaccgggctcggctttagctttgctatcccgcacagcaaatcggagcacattgagcaatccaccatcagcgttgcacgcctgaaagcccccgtcatgtggggagatgaagaagcacaattcatcatcatgctaacgctgaataaacacgccgcgggcgatcagcatatgcgtattttctcccgactggcacgccgcatcatgcatgaggatttccgcaatgcgctggttaacgccagctcaggggaggcgattgcttccctgctacaacacgaattagaactgtaa

SEQ ID NO: 3131 - DNA, 2670 bp, Enterobacter cloacae
tggggtgactgggtttttatgaacgaacaatattccgcgttgcgtagtaatgtcagtatgctcggcaaagtgcttggagataccatcaaagacgcactgggggagaacatcctcgaccgcgttgaaaccatccgcaagctgtccaaatcttcccgcgccggtaatgaggccaaccgtcaggagctgcttaccaccttgcagaacctctccaacgatgagctgctgcccgttgcccgcgccttcagccagttcctgaacctggcaaacaccgctgagcaataccacagcatttcgccaaaaggcgaagcggccagcaacccggaagtcattgcccgcacccttcgtaaactcaaagaccagcccgacctcaacgaagcgaccatcaaaaaagcggtggaatccctttcgctggagctggtgctgaccgcacacccaaccgaaatcacccgtcgtacgctgatccacaaaatggtggaagtgaacaactgtctgaagcagttggataacaaagacatcgccgactacgaacgtaaccagcttatgcgccgcctgcgccagctgattgcccagtcctggcacaccgatgaaattcgtaagcatcgcccaagcccggtcgacgaagccaagtggggctttgcggtggtggaaaacagcctgtgggaaggggtacccaactacctgcgcgagctgaacgaacagctggaagaaaatctgggctatcgcctgccggtcgactttgtgccggttcgcttcacctcctggatgggcggcgaccgcgacggcaacccgaacgtgacggcggaaatcacccgtcacgtcctgctgctgagccgctggaaagcaaccgacctgttcctgaaagatattcaggtgctgatctccgagctgtcgatggtggaagcgacgccggaactgcgcgcgctggccggtgaagaaggcgccagcgagccgtaccgcttcctgatgaaaaagctgcgcggtcagctgatggccactcaggcctggctggaagcgcgcctgaaaggccagcgcctgccgaagccggaaggtctgctgagccagaacgaacagctctgggagcctctatacgcctgctataaatcgctccaggcttgtgggatgggcatcattgccaacggcgaactgctcgacaccctgcgccgcgtgaagtgtttcggcgtgccgctggtgcgtatcgacgttcgtcaggaaagtacccgtcataccgaagcgctgggcgagctgacccgctacctcggcattggcgactacgaaagctggtcagaagccgacaaacaggcgttcctgatccgcgagctgaactccaagcgcccgctgctgccgcgcaactgggagccaagcaatgacacccgcgaagtgctcaacacctgtaaagcgattgtagatgcgccgaaaggatctgtggccgcctacgtgatctccatggcgaagaccccgtccgacgtgctgggcgttcaccttctgctgaaagaagcgggcattgactatgctctgccggtagcaccgctatttgagactctcgacgacctgaacaacgctaacgacgtgatgacccagctgctgaacatcgactggtatcgcggctttattcagggcaaacagatggtgatgatcggctattccgactccgcgaaagatgcgggggtgatggcagcctcctgggcgcagtatcaggcacaggatgcactgatcaaaacctgtgagaaagccggtatcgagctgaccctgttccacggacgcggtggctcaattggtcgtggcggtgcgcctgcacacgcggcgctgctctctcaaccaccaggaagcctgaaaggcggcctgcgcgtgaccgagcagggcgagatgatccgcttcaagtacggcctgccggaagtgaccatcagcagcctgtcgctttataccagcgcgatcctcgaagccaacctgctgccgccgccggagccaaaagaatcctggtgccggattatggacgaactgtctgacatctcctgcgatctgtaccgcggctacgtgcgtgaaaacaaagactttgtcccttacttccgctcggccacgcctgaacaggagctgggtaaactgccgctgggttcgcgcccggccaagcgtcgtccgaccggcggtgttgaatccctgcgcgccattccatggatcttcgcctggacgcaaaaccgcttaatgctgccagcctggctgggtgccggtgcggcgctgcaaaaagtggtggaagacggcaagcagagcgaactggaaaccatgtgccgcgactggccattcttctctacccgtctgggaatgctggagatggtcttctcgaaggccgacctgtggctggcggaatactacgatcagcgcctggtgaagccggagctgtgggcgctgggcaaagagctgcgcgaactgctggaaggcgacatcaaagtggtgctggatatcgccaatgactcccacctgatggaagacctgccgtggatcgccgagtctatccagctgcgtaacatctacaccgacccgctgaacgttttacaggctgaactgctgcaccgttcgcgtctggcggaagaggaaggtaaagagccggatccacgcgttgaacaggcgctgatggtaacgatagcaggcgttgcggcaggtatgcgtaacaccggttga

SEQ ID NO: 3132 - DNA, 912 bp, Enterobacter cloacae
aataggcttttcgtaggcccggcaagcaccagcgccgccgggcaataccctggtatccacaccatgcaccacgacattacccagatcctgactaacctgatcaacggcacaacgccgctgcgtcaggtgcattttgcaaactccgctacctccgcccccgaacttgccttgcaggtcgattttccacgtctggagatcgcgatcgaaggttcgatgaaagaccaggctggctgcgttttacagcagggtgatgttttatacgtcccggctggcggctggaataatccacaatggcaagcacccgcaacaacgctgagcatcctgtttggcaaacagcagcttgggtttagccttttgcactggaatggtatagacgttcgaaacctgacaaagcagcacgttgcccgccgcggtccccgtattggatcgctactcttacagacgcttcatgaaatgcagatgcaaccgcatgagcaacaaaccgcgcggctgattattgccagcctgcttagccactgcgtcgacctgctgggtagtcagatccaaaccgcctcccgcagccaggctttgtttgaagcaattcgggtctatattgacgaacactacgccactccccttacccgggaatccgtcgcgcaggcgttttatatctccccaaactacctgtcgcatctgttccagaaaacgggcgcagtgggtttcaatgagtacctgacgcacacccgactggaacacgcgcgccagttactgaaaggatatgatttgaaagtgaaagaggtggcgcatgcctgcggatttgtcgacagcaactatttctgccggttgtttcgtaaaaacaccgagcgttcgccgtcagaataccgtcgccagtatcacagccagctcaccgggaaggtcattagtccagaatga

SEQ ID NO: 3133 - DNA, 1179 bp, Enterobacter cloacae
ctattagccattaaatctggacatccactgcacaatccctacaatccccgcgtaattctttatcactcaggacgcatcatgacccccgaacacctcccgacagaacagtacgacgcacagctggcagaaaaagttgtccgcctgcaaagtatgatgacgcctttcaacgcgcccgttcccgaggtgtttcgttctccggtcagccactaccgtatgcgcgctgagttccgcatctggcacgatggcgatgacctgtaccacatcattttcgatcagcagacgaaatcccgtattcgcgtagacagttttccggcggcgagtgagcttatcaaccagctgatgacgctgatgatcgacggtgtgcgcaacaatccggtactgcgcaacaagctgttccagattgactacctgaccacccaaagcaatcaggccattgtttctctgctctatcacaaagcactgactgacgagtggcgcgagcaggcagaagccctgcgcgatgcgctgcgcgcgcagaatatcaacgtgcacctgattggccgcgcgaccaaaaccaaaatcatgctggaccaggattacatcgacgagcgtctgccggtggcaggaaaagagatggtttaccgtcaggtggagaacagcttcacccagccgaatgccgccatgaacgtgcagatgctggagtgggcgttgaaggcgacggaagggtctaagggcgatctgctggaactctactgcggtaacggcaacttctcgctggcgctggcgcgtaacttcgaacgcgtgctggcgacggaaatcgccaaaccgtcggtggcagccgcgcagtacaacatcgccgctaaccatattgataacgtacaaattattcgtatggcggcagaagagtttacccaggcgatgaacggcgtacgcgagtttaaccgcctgcaaggcattgatttgaagagctaccagtgtgagacgatttttgtcgatccgccacgcagcgggctggacagcgaaaccgagaagatggtgcaggcgtacccgcgtattttgtacatctcctgtaacccggagacgctgtgcaagaatctggaaacattgagccagacgcacaaggttgaacgtctggcgctgttcgatcagttcccgtatacgcaccatatggagtgcggcgtactgcttactgcacgataa

SEQ ID NO: 3134 - DNA, 732 bp, Enterobacter cloacae
cgccagctcaggggaggcgattgcttccctgctacaacacgaattagaactgtaaaacgaggaagagtgatggaactgtacctggataccgccaacgtagcggaagttgaacgcctggcgcgcatttttcccattgcgggcgttaccaccaacccgagcatcattgccgccagccgtgaatccatctgggacgtgctgccgcgcctgcaaaaagccattgggccggaaggcatgctgtttgctcaaaccatgagccgcgatgccgaagaaatggtggcggaagcaaaacggctgaacaatgccctgccggacatcgtggtaaaaattcccgtcactgcacaggggctcatcgcgattaaggcgctgaagaaagagggaattaccacgctgggcaccgccgtttacagcgccgctcagggtttactggccgcgctggcaggcgcgaaatacgttgcgccgtacgtcaaccgcgtcgacgcacagggcggcgacggtattggcatggtacaggagctgcagtccctgctggaactgcatgcgccggaaagcatggtgctggctgccagctttaaaacgccgcgccaggcgctggattgcctgttggcaggatgtgaggcaatcacgcttcccttagacgtagcgcaacaaatgctcgacacaccagcggtagagtcagccatagagaagttcgagcaggactggaaaaacgcgtttggtaacctcaacctctaa

SEQ ID NO: 3135 - DNA, 1116 bp, Enterobacter cloacae
gggagaactgttatggaccgtattattcaatcgccggggaaatacatccagggtgcagatgttcttactcgcctcggcgactacctgaagccgctggcgaatcgctggctggtggtgggcgataaatttgtgctgggttttgctgaagaaaccctgcgtcagagttttaaaaaagccggactccatgccgaaatcgcaccgtttggtggcgaatgttcgcaaaatgaaatcgatcgcctgaaaaagctggccgacagcgccgactgcctggcggtgctgggtatcggcggcggaaaaacgctggataccgccaaagcgctggcgcactttatggacgtgccggtggctattgccccgaccattgcctccaccgatgcgccgtgcagcgccctctccgtgatttataccgacagcggtgagttcgatcgctacctgatgctgccgcacaacccgaacatggtgattgtcgataccaaagtggtggcaggcgcacctgcgcgcctgctggccgccgggattggcgatgcactggcaacctggtttgaagcgcgcgcctgttcgcgcagcggcgccacgaccatggcgggtggcaagtgcacgcaggcagcgttagcgctggcagagctgtgctacaacacgctggttgaagagggcgagaaagcgatgctggcggcagagcagcatgtcgtcacaccggcgctggaacgcattatcgaagccaacacctatctcagcggggtgggctttgaaagcggcgggctggcggcggcgcacgccattcacaacggcatgacggcggtgccggatgcgcatcatttttaccatggtgaaaaggtcgcgttcggcacgctgacacagctggtactggagaacgcgccggttgaagaaattgagaccgtcgccgcgctttgccacagcgttgggctgccgatcaccctggcgcagctgaacatcaaagaggatattccggccaaaatgcggctgatcgcggaagcgtcctgcgccgaaggtgaaaccattcacaacatgcctggcggcgtcacgccggatcaggtctatgcggcgctgctggtggccgaccagtatggacagcgattcttgcaggagtgggagtaa

SEQ ID NO: 3136 - DNA, 921 bp, Enterobacter cloacae
ataatgaatattcgtgatcttgaatacctggtagcgttagctgagcatcgccattttcgccgcgcggcagactcctgccatgtcagccagccaacgctgagcggtcagatccgcaagctggaagatgagctgggcgtgatgctgctggagcgcaccagtcgtaaagtactgttcacgcaggcaggtctgctgctggtggatcaggcgcgcaccgtactgcgcgaggtcaaagtgctcaaggaaatggcaagccagcagggggaagcgatgtccggcccgctgcatattggcctgatcccaaccgttggcccgtacctgttgccgcaaatcattccgatgctgcaccagacgttcccgaaactcgaaatgtacctgcatgaagcgcaaacccatcagctgctggcgcagttagacagcggtaagctcgactgtgcgattctggcgctcgttaaagagagtgaagcgtttattgaagtaccgctgttcgatgagccgatgatgctggcgatctatgaagatcacccgtgggcgaaccgcgatcgcgtaccgatggccgatctggccggtgaaaaactgctgatgctggaagacggccactgtctgcgcgatcaggcgatgggcttctgcttcgaagcgggtgccgatgaagatacccattttcgcgcaaccagcctggaaacgctgcgtaatatggtggcggcgggaagcggtattacgctgttgccggcactggcggtgccgcacgagcgtaaacgtgatggcgtggtctatctgccgtgtattaagccggagccgcgtcgcaccattggtctggtttatcgtccggggtcaccgctgcgcagccgctatgagcagctggcagaggccatccgcggtgcgatggatggccattttgacagcgcgttaaaacaggcggtttaa

SEQ ID NO: 3137 - DNA, 885 bp, Enterobacter cloacae
ccaacctgttcgataaagattacgagacagtttatggctaccaaactgcaggacgggaatacaccttgtctggcagctacaccttctgatccgcgtcccaccgtgctgctgtttgattccggcgtcggtgggctttcggtctatgatgagattcggcagctcctgccggatctccattacatctacgccttcgataacgtcgcgttcccgtatggggaaaagagtgaagactttattgttgagcgtgtggttgaaatcgtcaccgcggtacaaaagcgctaccccctggcgctggcggtcattgcctgtaatacggcaagcacggtctctcttcctgccctgcgcgaaaaattcccgttcccggttgtgggcgttgttccggcaatcaaacctgcggcgcgtctgacggcgaacggcattgtggggttgctggctacgcgtggtacggtaaaacgtccttatacgcgtgagcttattgagcgctttgccaatgaatgccagatcgccatgctcggctccgcggagctggtggaaatggcggaagcgaaactgcacggcgagacggtatcgcttgaagagctgcgtcgtattctgcgtccatggctgcggatgcaggaaccaccggatacggttgttctcggctgtacccatttcccgctattacaggaagagctgttaaaggttctgcctgaagggacccggctggtggattccggtgctgcgattgcgcgtcggacggcctggttgctggaacacgaggcgccggatgcgaaatccgctgatgcgaacatcgctttttgtatggcgataacaaaagaaactgaacaacttttgcccgttttacgtcgttatggctttgaaacgctcgaaaaactggcgctgtag

SEQ ID NO: 3138 - DNA, 2487 bp, Enterobacter cloacae
agatttaattgccgatctggaaaatggcttccgggtcgcagccaaggggtaatcatgagtgtgatagcgcaggcaggggcgaagggtcgtcagctgcacaagtttggtggtagtagtcttgctgatgtgaaatgttacctgcgtgtcgcagggatcatgaccgagtattcacagccgggggacatgatggttgtctctgcggcaggcagcaccaccaaccagttgattagctggctgaaactgagccagaccgatcgcctctctgcgcatcaggtgcaacagtccttacgtcgttaccagagcgaactgattgccggtttgctgcctgcggacgtggcggacgggctgattagcgcttttacgcacgaccttgagcgtctggccgctctgctggacagcggcattaccgatgcggtgtatgccgaagtggttggccacggtgaagtgtggtctgcgcgcctgatggccgccgtgctgcaacacctgggtgtggaagccgcctggctcgacgcgcgtgatttcctgcgtgccgaacgtgccgcgcagccgcaggtggacgaagggttgtcctacccgctgctgcaacagctgctggtgcaacatcccggtaaacgtattgtcgtcaccggctttatcagccgcagcaatgccggcgaaaccgttctgctgggccgtaacggctctgactactcggcaacacagattggtgccctggcgggcgtgtcccgcgtcaccatctggagcgacgtggccggtgtgtacagcgcggacccgcgcaaagtgaaagatgcctgcctgctgccgctgctgcgtctcgacgaagcgagcgagctggcgcgtctggcggccccggtgctgcacgcgcgcacgctacagccggtttccggcagcgacatcgacctgcaactacgctgtagttacacgccggatcagggttccacccgcatcgagcgcgtgctggcatccggtacgggcgcgcgcattgtcaccagccacgatgacatctgcctgattgagttccaggtgcctgcgggccaggatttcaaactggcgcacaaagatatcgacaccatcctgaaacgtgctcaggtgcgtccgctggccgttggcgtgcataacgatcgccagctgttgcagttctgctataccgccgaagtggtggacagcgccctgaaaattctggatgaagcgggcctgccgggcgagcttcgcctgcgtcaggggctggcgctggtggcgatggtgggcgcgggcgtcacccgtaacccgctccactgccaccgcttctggcagcagctgaaaggccagccggttgagtttacctggcagtcggaagagggcatcagcctggttgccgttctgcgtaaagggccaaccgaaagcctgattcagggcctgcatacctccctgttccgtgcggaaaaacgcatcggcctggtgctgtttggtaaaggcaacatcggttcccgctggctggagctgttcgcccgcgaacaggtcacgctctcggcgcgtaccgggttcgaattcattctcgcaggcgtggtggacagccgccgcagcctgctgaactacgaagggctggatgccagccgcgcgctggccttctttaatgatgaagccgtcgagcaagatgaagagtcgctgttcctgtggatgcgtgcgcacccgtatgacgatctggtagtgctggatgtgaccgccagcgagcagctggccgatcagtatctggatttcgccagccacgggttccacgtcatcagcgccaacaagctggcgggcgcgagcagcactgataaatatcgccagatccacgacgcgttcgaaaaaacgggtcgtcactggctgtataacgccaccgttggcgcaggtctgccggttaaccataccgtgcgcgatctgattgaaagcggcgacagcattctggcgctgagcgggatcttctccggcacgctctcctggctgttcctgcaatttgacggcaccgtgccgttcaccgacctggtggatcaggcgtggcagcagggtttaaccgagccggatccgcgcgttgaccttgccggtaaagacgtgatgcgcaagctggtgatcctggcgcgtgaagccggctacgacattgagccgggtcaggtacgcgttgagtcgctggtgcctgcgggctgcgaggaaggatccgtcgatcacttcttcgagaacggcgacgagctgaacgagcagatggtgcaacgtctggaagcggctaacgagatggggctggtgctgcgttacgtggcgcgcttcgaggcgaacggtaaagcgcgcgtgggcgtggaggcggtgcgtcctgaacatccgctggcggcgcttctgccatgcgacaacgtcttcgccatcgaaagccgctggtaccgcgataacccgctggtgatccgtggcccgggcgcggggcgcgatgtcaccgccggagccattcagtccgacattaatcgtctggctaagctgctgtaa

SEQ ID NO: 3139 - DNA, 339 bp, Enterobacter cloacae
ctgattgaggaaaagaacatggcccgaattatcgcagtaacagcttgtccgtcaggcgttgcccatacctacatggcggccgaagcgctggaaagtgccgccaaatctaaaggttgggaagtgaaggttgaaacgcaggggtcaattggcctggagaacgaactgacggcagaagacgttgccgccgccgatatggtgatcctgaccaaagatatcggcattaaattcgaagagcgctttgccgggaaaaccattgtacgcgtcaatatcagcgacgcggtaaaacgcgccgacgccatcatgaacaaaattgatgcccacctggcgcaaatcgcctga

SEQ ID NO: 3140 - DNA, 2349 bp, Enterobacter cloacae
cgctctcccgcccttcggggcgggttcgttttccgttacaggagttccctcatgacgaatcgtatccagcgtttgaaagacgcactttttgccagtccacgtgaaatctcgcttgagcgtgctttgctctataccgccagccatcaacagacggagggcgagccggttatcctcaggcgagcaaaagccacggcgtacattcttgaccatgtgaatatcgcgattcgtgatgaggaactgattgccggaaaccgcaccgttaaaccgcgcgcgggcattatgtcccctgagatggatccgtactggctacttaaggagctggaccagttttccacacgtccgcaggaccgcttcgagatcggcgaagcggataagcagatctaccgcgacgtgctgtatccctattgggaaaaacggtcgatgaaagatttcatcaacagccagatgacggatgaggtgaaagccgctgtagggacgcaaattttcagcgtcaaccagacggacaaagggcaggggcatatcattattgattatccgcacctgctgaataacgggctgggtgcgctggtggagcaaatgcgagaatattgtgcccgcgatgctcagaacacgttctatgccgccgcgctgattctgcttgaagcctcccagcgccatattctgcgctatgctgcgctggctgaaacgcttgcaaccgtctgtgatgacgcttcacggcgtgaagagctacgaaagattgccgaaatctcgcggcacaacgcggagcataagccgcaaacgttctggcaggcgtgtcagctgttctggtatatgaacgtcattttgcaatacgaatctaacgccagctcgctttctattgggcgcttcgaccagtatatgctgccgttttatcaggcctcgttaacgcagggagacgacccggcatttctgaaagagctgctggaatcgctgtgggtgaagtgtaacgacgtggtgctcttgcgctcgaccagcagcgcccgttattttgccggcttcccgaccgggtataccgcgttattgggcggactgacggaaagcgggcgtaacgcggtgaatgtgctttccttcctgtgcctggatgcttaccaaagcgttcagcttcctcaaccgaaccttggcgtacgggttaatgaacttatcgaccgacctttcctgcttaaaacggcagagacgatccgcctgggcactggtattccgcagattttcaatgatgaagtggtggtacccgctttcctgaatcggggtgtgtcgctggaggatgcgcgcgactacgcggtggtaggctgtgtagaactgtcaattccgggtaaaacctacggtctgcacgatatcgcgatgtttaacctgctgaaagtaatggaaatcgcgatgctggagaacgaaggcaattcaacgctgagttatgaaggcttgctggaccatattcgggccaaaattaaccactacattgcgctgatggttgaggggagcaacatttgcgatatcggccatcgagactgggcaccggtaccgttgctctcttcatttatcagcgattgccttgaatcagggaaagatattaccgacggcggggcgcgatataacttttctggcgttcaggggatcgggatagccaacctgagtgattcactgcacgccctgaaagggctggtctttgaacagcatcgcttaagttttgatgagctcttagccgtgttaaaagcgaactttgccacccctgagggagaaaaggtgcgtgcaaggttgatcaatcgcttcgaaaaatacggcaatgatatcgatgatgtcgacaatatcagcgctgaactgttgcgccattactgtaaagaggtcgaaaaataccggaacccgcgcggcggacagttcacgccaggctcttataccgtatcggcacacgtgccgctgggggcagtggtgggagctacaccggatggccgctttgccggagagcaactggctgacggtgggctctcgccgatgcttgggcaagatatgcagggcccaacggcggtacttaaatcggtaagcaagctggataactatctgttatctaacggtacgctgttaaacgttaaatttacccctgcgacgctggaaggcgatgccgggctgcaaaagctggcggatttccttcgtgctttcacccagcttaagttgcagcatatccagttcaacgtggtgaacgcggaaacattgcgtgaagcgcaacagcgtccacaggattttgccgggctggtggtgcgcgttgctggctacagcgccttctttgttgagttatcgaaggagatccaggatgacattatccgccgcacagcgcatcagctgtga

SEQ ID NO: 3141 - DNA, 420 bp, Enterobacter cloacae
ggtgtcagcgatgcgtcaactggcagagcgcgaaggtttcaatgttaccgtgggaggctgaacatgacagtgataacgggacgtcatctggtggcggtgaccgcgtgtgtcagtggcgtcgcacatacctatatggctgccgaacgtctggaaaagctctgccagcaggagaagtggagcgttaacattgagacgcagggagcgctgggtgttgagtgcgagcttacggaagacgacatacggcgagccgatgtcgtattgctcattaccgatatcgaactggcgggcagcgaacgtttcgagcatgcgcgctacgtgaagtgcggtattagcgcctttttacgcgacccacaaaaggtgatgggggcggtgcgtaaaatgttagccgctccgcagcatactcaggtcattctggactaa

SEQ ID NO: 3142 - DNA, 1014 bp, Enterobacter cloacae
aggaacccgatgttgaatacgctgattgtaggcgctagcggttatgcgggcgcagagcttgtaagctacgtaaatcgccaccctcatatgaccataaccgctttgaccgtgtcagcgcaaagcaatgatgccggaaagttaatttccgatttgcatccacaacttaagggcgtggttgatttgcctttgcagcccatgtctgacatcagcgagtttaccgacggcgttgacgtggtgtttttagccaccgcacacgaggtcagtcacgacctggcgccgcagttcctggcagccggatgcgtggtgttcgatctctccggcgcgttccgcgttaacgacggcgcgttctacgaaaaatattacggtttcacccaccagcatccggatctgcttgaaaaagcggtgtacggcctggcggagtggagcgcagataaactgaaagaagcgaacctgattgccgttccgggatgctacccgacggcggcgcagctttccctgaagccgctgatcgacgccgggttgctggatctgaaccagtggccggtgatcaacgccaccagtggcgtgagcggcgccgggcgcaaagcggcaatctccaacagtttttgcgaagtgagccttcaggcgtatggcgtgtttaaccaccgtcatcatcctgaaatcacgacgcatctgggcgcggacgtcattttcaccccgcatctgggcagcttcccgcgcgggatcctcgaaaccattacctgccgcctgaagccgggtgtgaccaaagaacaggtgaacgaggtcttcacgcaggcgtatgcggataaaccgctggtgcgcctgtacgacaaaggcgtgccggcgctgaaaaatgtggtcggcctgccgttctgcgatattggctttgccgtgcagggtgagcatctcatcgtggtggccgcagaagataacctactgaaaggcgctgccgcacaggcaatgcagtgtgcaaatattcgtttcggctttcctgaaacgcaggctcttatttaa

SEQ ID NO: 3143 - DNA, 783 bp, Enterobacter cloacae
ggtgtgatgatgaatccattaattatcaaactcggtggtgtactgctggacagcgaagaagcgctggagcgcctgtttaacgcactggtgaactatcgtgaatcacaccaacgtccgctggtgattgtgcacggcggcggctgtgtggtggatgagctgatgaaagggctcaacctgccggtgaaaaagaaaaatggcctgcgcgtgacgcctgccgaccagattgacatcattaccggcgcgctggcgggcacggcgaacaaaacgctgctggcctgggcgaagaagcaccatatcgcctccgttggcctctatctgggcgatggcgatagcgtgaaagtgacccagctcgacgaagagcttggccatgttggactggcgcagccgggttcgcctaagctgattaacaccctgctggaaggcggtttcctgccggtggtgagctctatcggcgtgaccgaagagggcgagctgatgaacgttaacgctgaccaggcggcaaccgcgctggcggccacgctgggcgcagacctgatcctgctctccgacgtgagcggcatactggacggcaaaggccagcgtattgcggaaatgaccgccgcaaaagccgagcagctgatcgatcaaggcattatcaccgacggcatgattgttaaagtgaatgcggcgctggatgcggcccgcacgttgggtcgcccggtggatatcgcctcctggcggcacgcggagcaactcccggcgctgtttaacggtacgccgattggtacgcgtattctggcttaa

SEQ ID NO: 3144 - DNA, 1419 bp, Enterobacter cloacae
gcgcagcgccaccgggcaaaaatatcatcattaaggaaattcgttatggcactttggggtgggcgttttacacaggcagcggatcagcggttcaaacagttcaacgactctttgcgcttcgactaccgcctggccgaacaggatattgtcggctctgtggcctggtccaaagcgctggtgaccgttggcgtgctgaccgcagacgaacagcagcagctggaagaggcgctgaacaatctgctggaagaggtgcgtctggatccgcagcaaatcctccagagcgatgctgaagatattcacagctgggtggaaggcaaactgatcgacaaagtcggccagttgggtaaaaagctccataccgggcgtagccgtaatgaccaggtggcgaccgacctgaagctgtggtgcaaagagaccgtcggcgaactgctggcggcgaatcgtcagttgcagggcgcgctggtggacaccgcgcagaacaatcaggacgcggtgatgccgggttatacccacctgcaacgcgcgcagccggtgacgttcgcgcactggtgtctggcctatgttgagatgctggcgcgtgatgagagccgtttacaggataccttaaagcgtctggacgtgagcccgctgggcagcggcgcgcttgccggcacggcttatgaaattgaccgtgagcagctggcaggctggctgggctttgcctccgccacccgcaatagtctggacagcgtctctgaccgtgaccacgtgctggaactgctctcaaatgcgtctatcgggatggtgcacctgtcgcgctttgctgaagacctgatcttctttaactctggcgaagccgggtttgtggagctgtccgaccgtgtgacgtccggctcctccctgatgccgcagaagaaaaacccggacgcgctggagctgatccgcgggaaatgtggccgcgtgcagggtgcgctgaccggtatgatgatgaccctgaaagggctgccgctggcgtacaacaaagacatgcaggaagacaaagaggggctgttcgacgcgctcgacacctggctggactgtctgcatatgggcgcgctggtgctggacggcattcaggtgaaacgtccgcgctgccaggaagcggcgcagcaggggtatgctaactctaccgaactggcggactacctggtggcgaaaggcgtaccgttccgcgaggcgcaccatattgtgggtgaagcggtagtggaagcgattcgtcagggtaaagcccttgaagagctggcgcttgccgacctgcaaaaattcagcgcggttatcggggatgatgtctacccgattctggccctgcaatcctgcctggataagcgtgcagcgaaaggcggcgtgtcaccgaagcaggtagcgcaggcgattgcggatgcgaaaaaccggttggtttaa

SEQ ID NO: 3145 - DNA, 807 bp, Enterobacter cloacae
aagcaacagaatcataacataattgccagggtaacccaattatcgttgtgcttttttcgggcagtggagcacaaaccgcgcgtaaacaatcattcacaaagtcaggtaaacagattaattttattctctggtatagtgccaacgggcctttggaaggattcaactatcgtgatgggcgtaagagcacaacaaaaagagaaaacccggcgttcgctggtggaagccgcattcagtcaactgagtgctgagcggagttttgccagtttgagcctgcgtgaagtggcgcgcgaggccgggattgcgccaacgtccttctatcgtcatttccgtgatgtggatgaactgggcctgaccatggtcgacgagagcggtttgatgctgcgccagcttatgcgtcaggcgcgtcagcgtatcgccaagggcggcagcgtgatccgcacttccgtgtcgacatttatggaatttatcggcaataaccctaacgcgtttcgcctgctgttgcgtgagcgttccggaacgtcagccgcgtttcgtgccgccgtcgcgcgtgaaattcagcatttcatcgcggaacttgccgactatcttgaactcgaaaaccatatgccgcgtgcgtttactgaagcacaggctgaggcgatggtgacgattgtattcagcgcgggtgctgaagcgctggatgtcagcattgaacaacgtaagcaactcgaagagcgactggtattgcagctgcggatgatttctaaaggcgcgtactactggtatcgccgtgaacaagagaagttggcacatcaaaacgatgagtga

SEQ ID NO: 3146 - DNA, 378 bp, Enterobacter cloacae
gtaatgaaacagtcaggtcaggataaaggaacgctgttgctggcattgatcgctggcttatccattaatggtacgtttgcggcggttttcagctcaattgtaccgttctcgattttcccgattatcgcgctggtgctgacggtgtactgcctgcatcaacgttatctgaaccgcacgatgccagttgggttaccgggactggctgcagcctgttttattctgggtgtattgctttatagcacggtggtgcgcgcggagtatccggatattggctctaacttcctgcctgcggtactgtctgtggcgctggtgttctggattggctctcgcatgcgtagccgcaagagcgagttgccggagtacagaagggttttgtag

SEQ ID NO: 3147 - DNA, 624 bp, Enterobacter cloacae
cgcggatccttgcgctctggtgaagacgccgatctggtgttgcattcatgcacgaaatatctgaacggccattctgacgtggtggcgggcgtggtgattgccaaagatcccgacgttgtcaccgaactggcatggtgggccaataacattggcgtcaccgcgggcgcgttcgacagctatttgctgctgcgcggtattcgcacgctatcaccgcgtatggacgtggcgcagcgtaatgcccaggcgatcgtggatttcctgaaaacccagccgctggtgaaaaagctttatcacccgtcgctgccggaaaaccaggggcacgagattgccgcgcgccaacagaaaggatttggcgcgatgttaagttttgaactggacggtgacgagcaaacgctgcgtcgcttcctgagcgggttgtcattgtttacgctggcggaatccttagggggagtagaaagcttgatctcccacgccgcaactatgacgcacgcaggtatggcacccgaagcacgtgccgccgccgggatttccgagacgctgctgcgtatctcgaccggtattgaagattctgaagatttaattgccgatctggaaaatggcttccgggtcgcagccaaggggtaa

SEQ ID NO: 3148 - DNA, 894 bp, Enterobacter cloacae
ggtatgagcttttttcacgccaaccagcgggaagcactgaaccagagcctggccgaagtaaacggccagattaacgtctcttttgaatttttcccgccgcgcaccagtgaaatggagcaaaccctgtggagctctatcgatcgcctgagcagcctcaagccgaagttcgtctccgtgacctacggcgccaactccggtgagcgtgaccgcacgcacagcatcattaagggcattaaagaccgaaccggtctggaagcggcgccgcacctgacctgtatcgacgccacccgtgatgaactgcgcgccattgcccaggactactggaataacggcattcgccacattgtggccctgcgcggcgacctcccgccaggcagcggtaagccagagatgtttgccgccgatctggtcggcctgctgaaagacgttgccgactttgatatctccgtggccgcctaccctgaagttcacccggaagccaaaagtgcccaggcggatctgctcaacctgaagcgtaaagtggaggctggtgctaaccgtgcgattactcagttcttctttgacgttgaaagctacctgcgctttcgtgaccgctgcgtctcggcaggtattgatgtcgaaatcatccctggtattctgccggtctcgaacttcaaacaggcgaagaaattcgcggatatgaccaacgtgcgcattccgctgtggatgtccaaaatgtatgaagggctggacgacgacccggaaacccgcaagctggtgggggccaatatcgcgatggacatggtgaagattttaagccgcgaaggggtgaaagatttccatttctataccctgaatcgcgcggaaatgagctatgccatttgccatacgctcggtgttcgcccggcgctgtaa

SEQ ID NO: 3149 - DNA, 2202 bp, Enterobacter cloacae
cactgtaaagggagcatagcgatgagcatgtcagacgagaccaataacgcggcatccgccggcaaatgtccgttccaccagggcggcgtcgatcacagcgcgggtgcaggtaccggcagcaaagattggtggcctaaacaactccgcatcgatcttctaaaccaacattccaaccgttcgaacccgctgggtgaagacttcgactaccgcaaagaattcagcaagctcgactattccgcccttaagggcgatctcaaagcccttttaaccgactcacaaccgtggtggcctgccgactggggaagctatgcgggcctgtttattcgtatggcctggcacggtgcgggtacctatcgctccgttgacggtcgcggcggcgcggggcgcggccagcaacgttttgcgccgctgaactcctggcctgataacgtcagcctggataaggctcgccgtctgctgtggccagttaagcaaaaatacggacaaaaaatctcctgggccgacctgtttatcctcgcgggtaacgtggcgctggagaactccggcttccgcacttttggtttcggtgccgggcgtgaagacgtctgggaaccggatctggacgtgaactggggcgatgaaaaagcctggctgacccaccgtgacccggaagcgctggcgaagcgcccgcttgcggccactgaaatgggcctgatttacgttaaccccgaagggccaaacgccagcggtgaaccgctgtctgcggcggcggcgatccgcgctacctttggcaacatgggcatgaacgacgaagagaccgtcgcgctgattgcaggcggccatacgctcggtaaaacgcacggcgcaggcgaagccacgcatgtgggcactgacccggaagcgtcaccgattgaagcgcagggcctgggctgggccagcacgcacggcaccggtattggcgctgacgccatcacctccgggctggaagttatctggtctcaaaccccgacccagtggagcaactacttcttcgagaacctgttcaaatacgaatgggtgcagacgcgtagcccggcgggcgccattcagtttgaagccgtggatgcgccggaaattatgcctgacccgtttgacccgtcgaaaaaacgcaagccaaccatgctggtcaccgacctgacgctgcgttttgatccggaattcgagaaaatttcccgtcgcttcctgaacgatccgcaggccttcaacgaagcctttgcgcgcgcgtggttcaagctgacccatcgcgatatggggccaaaagcgcggtacattggcccggaagtgccgaaagaagatttgatttggcaggatccgctgcctcagccggtgttccatccgacgcaggaagatattgaaagtctgaaagcggaaatcgcggcctctggtctctccgtgagcgagctggtttccgtggcctgggcgtcggcatcgaccttccgcggcggcgacaagcgtggcggcgctaacggcgcgcgtctggcgctggcgcctcagcgcgactgggatgtgaacgccgcggcggtacgggcgttaccggctctggaagctattcagcgcaccactaataaagcctcactggccgatatcatcgtgctggcaggtgttgtgggcgttgagcaggcggcgaaagcggcaggcgtttacgtcaacgtaccgtttaccccaggccgcgtagatgcgcgtcaggaccagacggacatcgagatgtttaacctgctcgaaccggttgccgacggtttccgcaactaccgtgcgcaggtggatgtgtccaccaccgagtcgctgctgatcgacaaagcccagcagctgaccctgaccgcgccggaactgacggtgctaatcggcggtctgcgcgtactgggtgcaaacttcgatggcagcaagaatggcgtgtttaccaaccgcgagggcgtgctgagcaacgacttcttcgttaatctgctggatatgaacacccagtggaaagcgaccgatgactcaaacgagctgtttgccggtagcgatcgcgccagcggagaagtgaaatacaccgccacccgcgccgatctggtcttcggttcaaacgccgtcctgcgtgcgctggccgaagtttacgccagcagtgatgcacacgagaagttcgtccgtgattttgttgccgcgtgggcgcgagtgatggatttggaccggtttgacgtgaagtaa

SEQ ID NO: 3150 - DNA, 1131 bp, Enterobacter cloacae
ttgcctattgtttgccacaacatctttatggttttaggccaggagcgacatatgaaagagttggtgcatattctcaagaacacgcggcagcatctgatgactggggtgtcgcacatgatcccgtttgtggtctcgggcggcattttgctggcggtttcggtcatgttgtatggcaaaggcgcggtgcccgatgccgcaactgatcccaacctgaaaaagctctttgatatcggcgtggcggggttaacgctgatggtgccattcctcgccgcctatatcggctactccattgcagaacgtgccgcgctggctccctgtgcaattgccgcctgggtgggcaacagcttcggtgccgggttctttggcgcgattatcgccgggattttcggtgggattgtcgtttggtacttgaaaaaactgccggtcccgaaagtgctgcgctccgtcatgcctatcttcatcatcccgattatcggcacgtttatcacagcaggcatcatgatgtgggggctgggcgagcctgtaggcgcactgaccaccggccttacccagtggctgcaaggaatgcagcagggcagcattgtggtactcgccattattatcggtctcatgctggcgttcgatatgggcggcccggtcaacaaagtggcgtatgccttcatgctgatttgcgttgcgcagggcgtctataccgtcgttgcaattgccgccgtggctatttgcataccaccgctaggattaggcctggcgacgctgattaatcgcaagagttttaccggtgaagagcgtgaagcgggtaaggctgcattagtgatgggctgcgtgggggtcaccgaaggggccattccgttcgctgctgctgatcctctgcgcgttattccctccatcatgctgggatccgcatgtggcgcagtgacggccgccgtgatgggcgcacaatgctatgccggttggggcgggctcatcgttctccctgtggtggagggcaagctgggctacatcgtggcggttgccgtgggggctgttgtgacggccattagcgttaacgtgctgaagagttttgcccgcaagaatgcaaaacaggtcgaggaaaaagaggacgacctggatctggatttcgaaattaactga

SEQ ID NO: 3151 - DNA, 987 bp, Enterobacter cloacae
acgcggaaacattgcgtgaagcgcaacagcgtccacaggattttgccgggctggtggtgcgcgttgctggctacagcgccttctttgttgagttatcgaaggagatccaggatgacattatccgccgcacagcgcatcagctgtgacgtggttgaaacgcacgccgaggtggcgcgtattttcaatatccagcgctactcattgaatgacggtcgcggcatccgtacggtggtcttttttaaaggttgtcctcaccgttgtccgtggtgtgcgaatccggagtcaatttcaccgaaaatcgaaacggtgcgcagagaaagcaaatgtcttcactgtgcaccctgtttgcgggacgtcgatgagtgcccctccggcgcatttgagcctattgggcgggatgttacgctggaggagctggtaagcgaggtaatgaaagacgatgttttctttcgttcctcgggaggtggggtgacgctctcgggtggcgaagtgttgctgcatgcgcctttcgcgacaaaatttctacagggtttacgccgtttcggcgtgcatacggccatcgaaacggcaggcgatgcccctttgtcccgattaatgccgctggctcgccagtgtgatgaagtgttgtttgatttaaagatcatggacgcggatctggcccaatcgattgtggcaatgaatcttcccagagtgctggataatttccgccagctggtggctgacgggataaacgtgattcctcgtgtgccgcttattcctggctatacgcttaacgaaacgaacatggcgcgcgtgctggctttcctgctaccttcaggaatacggcaactgcatttattgccctttcatcagtatggggagccaaaataccgtctgctgggacaggagtggggaatgcggcaagcgacccctccgacagaagatgaggtgtcagcgatgcgtcaactggcagagcgcgaaggtttcaatgttaccgtgggaggctga

SEQ ID NO: 3152 - DNA, 1890 bp, Enterobacter cloacae
ggcctgcggcatccttcttatattgtggatgctttaacaatgattaaaaaagtatcgctgttgacggtgttttccgtcacggcattttcgggctgggcgcaggaaagcgccgactcgttggtggtgacagcaaaccgtttcgaacaaccagcaaaaaccgttctggctccgacctccgtcgtgacccgtgaggatattgaacgctggcaggcaacgagtgttgtggaaatcatgtcacgcctgccgggtgtggacatcgcacaaagcggcgggatggggtcgacctcttcaacgtttattcgcggtacggaatcccgccatgttctggtactgattgatggtatccctctgaataatgccgggatcagcaacgttcccgatttaagccaaattccgacgtcgctgattcagcgtattgagtacattcgcggcccacgttcggcgctgtatggctccgacgcgattggcggtgtgattaacatcattaccgggcgcgacaagccgggtgcggaaatttctgcgggtgtcggttcaaaggggtatcaaaactataacggtgccttccagcaggtgttcgataaaaccaaaatcaccatggccggtgattatacctatacccgtggttttgatattgccgcaaaagatgccccgcgccagccagaccgcgatggttttatgagtaaatcgctgtttggctcggtggagcagcagtttaccgacagcgtcagcggattcgtccgtggctttggctacgataaccgctccgcgtatgacggttacgatcactatggcgcgaccggcattgatgggcggccggacacgcgtcaggtttacagccagaactgggacaccgggttgcgctataaccagggtattttccagtcacagctggtggcagggtatggccgtagcaaagatcagaactatgatccgaaaaaaggccgctacgctgactccgcaaccatggatgacgtgaagcagtacaccacccagtggctgaatacggttgaagtggggcacggcaatatcggcgcgggtctggactggcagaagcagaaaacccaggcgggtacgggctatctggaaaaaggttacgaacaacgtaataccggcgtgttcctttcggcgatgcagcagttcaacagcgtgacgctggaagcggcggcgcgtaatgacgataactctaactttggcaatcatgccacctggcagaccagcgccgcatgggagttcatcgacgggtatcgcatcatcggttcttacggcacagcgtataaagcgccgaccatgagccagatccacagtaaggattacggcaatccggacctgaagccagaagagagtaagcagtgggaaggcggctttgaaggtctgacggggccggtaaactggcgtgtgacgggctatcgtaatgatatcgataacctcattaatagcgacccgcggacttaccgttattacaacgtcgatgaagcccgtattaaaggaatcgaggcgacggcccagttcgataccggaccggtagggcaccaaatttcctatgactacgtcgacccgcgcaatgcgaaaaccaacgaagtcctggcacgtcgctcaaagcagcaggttaagtatcagcttgactggcaggtgtgggatctcgactggaatctggcgtaccgttatctgggcactcgctatgacgttgccgttgatccgaatacctatgcaacagaacgcgtgaaaatgggcggcgtcagcctgtgggacgtcgcggtttcatatcccgtcacctctcatctcacagttcgtggtaaaatagccaacctgttcgataaagattacgagacagtttatggctaccaaactgcaggacgggaatacaccttgtctggcagctacaccttctga

SEQ ID NO: 3153 - DNA, 984 bp, Enterobacter cloacae
cggcaaatatttctctcgcgggtcaacctcatgacgacacaacgacttcaacgtgactggcgtctcccaactgccgggctcgccgtgctggtgttacttatggcaggttttgcactgcatgagcactggaatgcttttattcagtggtgcctcgccacccagatcaccctgcaccgttatctggtgatgtatttgctgcaacttaataatcatcagtacaggggtgggctgtggttgttaaccggtgcgtttctttatggtgtactccatgccgttggaccgggacacggcaaattcatcgtcaccacgtatctcaccaccaataaagagagccagctcgcggcgcgcgtcgtaccgtttatcggtagcctgatgcagggcgtcagcgcaatcgcctttgtctttatcctggcggttggattgaacctcgcgtcaggggatatcagcaccagccgttggtacgtcgagaaaatcagcgccctactgattgccgccttcggtgcatttatcatttatcaggcgctcagcagcctgcgtccgcgcaaaatggcgattagcgccatcaagccgcttcaccagcataatgaacattgtggctgcggccatcacggcgtaggggtggatctggctaaaagcgactggaaaacccgtctgggcgtggtgctggccataggcgcacgcccgtgcagcggggcaattatgatcctgatgttctcgaatgcgctcggcattattagctgggggattgctgctgtgatgacaatgtcgctgggcacggcgctgtcgattatggggctgtcgctggcagtacgttacgcacgtgaacgcacagtagcctggtttggtggcggcacgtccctgaactggataatgccgatggtcaaaattgccggaggggttgttctgatactgttcgcgacggtcctgttcctgacggtgatccccgtcagcgctggcggcgactacatcgccgcaggatgctaa

SEQ ID NO: 3154 - DNA, 1002 bp, Enterobacter cloacae
gggttaatgatgaacattaaagcaactatagaacgcatcccgggcgggatgatgctggtcccgctggtacttggcgcgatattaaatacgctggccccgaataccggtgcttattttggcggttttacaaaaggtatgatcaccggaacggtaccgattctggcagtctggttcttttgcatcggcgcatctattaacttgcgtgcaacaggtacggtattacgtaaatcagggacgttggtcattactaaaattgcggtcgcctgggttgttgccatgatctgtgcgatgttcattccggagaatggaattcagactggcttcttcgccggattatccgttctggccattgtctcagcaatggatatgaccaacggcggtctctatgccagcctgatgaatcaatatggcaccaaagaagaatcgggcgcgttcgtgctgatgtccctggagtcgggtccactgatgacgatgttgattctgggttctgctggccttgcctcctttgaactacaccattttgtcggggcgatcctgccgttcctgattggttttgcgctgggtaacctcgatcacgatctgcgcgatttcttcagcaaagccaccccggtactgatcccgttcttcggcttcgcgttgggcaataccatcaacctgaacgtaattctggaaaccggcctgctgggtattgtgctgggtgttgccgtcatcgtcatcacgggtattccgctgattattgcagaccgcgtcatcgggggcggcaacggaaccgcgggtgtggccgcctcttcggccgcaggcgctgcggtagccaacccggtgattatcgcccagattaacccggcctttgaacccgtagccgcttccgccacggctctggttgccgccagcgtgattgtgacggcaattctggtccctatcatcacggcactgtacgccagacgctttgggcatgtgcctgagtcccggacagaacatgaagcggtagaaatgcaccactaa

SEQ ID NO: 3155 - DNA, 531 bp, Enterobacter cloacae
gttcgtgaaaaagaactgattgtcccgcccggtgacgcttcgcttaccgggcgttcgggaactacacttaacgggcttttcttacgtgaggtaaagattatgccgttaagtccctacatctctttcgccggcaactgtgcggaggcgacggccttctatcagcaggccgtcggcgcagaactcctctacaaaatcaccttcggcgaaatgcccaaagacgaaaacagcgaagaaggctgtccgtcaggcatgaacttcccggataccgccatcgcccactctaatgtccgcattgccggcagcgatatcatgatgagcgatggtctgccacccggtagcagcacgcagtacgccggatttacgctggtgctcgacacgcaggacgtggatgaaggcaaacgctggttcgacaacctctctgatggcggcaatgtcgaaatggcctggcaggagactttctgggcgcacggattcgggaaagtcaccgataaatacggcgtgccgtggatgattaacgtcgttaaatcgtag

SEQ ID NO: 3156 - DNA, 1029 bp, Enterobacter cloacae
cgaggaatggaaatgagctataaaacggttgccgcgctggccttcaccagcatgttcagcatcagcaccctgttaagcccggcccacgccgaggagcaggaaaaagcactgaactttggcatcatttcgacagaatcacagcaaaacctgaaaccccagtgggaaccgttcctgaaagatatggaaaccaaactggggatcaaagtgaacgcgttcttcgccccggattacgcgggcatcattcagggaatgcgcttcaacaaagtcgacatcgcctggtatggcaacctctctgctatggaagcggtagatcgcgcgaacggccaggtgttcgcccagaccgttgcggcagacggctctccgggctactggagcgtgctgatcgttaacaaagacagcccgatcaacaacctcaacgacatgctcgccaaacgcaaagagctgacctttggtaacggcgacccgaactctacctccggcttcctcgtccctggctactacgtcttcgcgaaaaacaacgtctccgccagcgactttaagcgcacggttaacgccagccacgaaaccaatgccctggccgtggcgaataagcaggttgacgttgctaccaacaacactgaaaacctcgacaagctgaagacctccgcgccggacaagctgaaggaaatcaaggttatctggaaatcaccgctgatcccgggcgacccgatcgtgtggcgcaaaaacctctccgagaacaccaaggacaaggtctacgacttctttatgaactacggcaaaacgccggaagagaaagcggttctggcacgtctgggctgggcaccgttccgcgcgtccagcgatttgcaactggtgccgattcgccagctggcgctgttcaagcagatgcagggcgtgaaggacaacaaaggcctgaaggacgaagagaagaccagcaaagtgtcggaaattcaggcgcagctggacgatctcgaccgcctgaccgccgcgctcggcgccatgaccagcgtgaataaagcggtgcagtaa

SEQ ID NO: 3157 - DNA, 669 bp, Enterobacter cloacae
ccgcgccgcacgccttgccgcgcgtcaggccgaagtaaataccagccgggtcgacttctttacgctcgttcgcggagacaacgcatgacgcttcaacctgcttttaccctggccgtccaggatgcccaacagagtttccgtcgactgctgaaagccatgagcgagccgggcgtcattgtctcgctgcaccagctctcccagggctggctgccgctgaacctcgcctctaccagcgtgctgctgacgctggcggacaacgacaccccggtatggctgtcaggggcattgctgaacgatatcgccagccagaacctgcgctttcacaccaacgcgccgctggtcgagcagccccagcaggcggtcttcgccgtggccgacgagcaaatcagccatgaacaacttaatgccctgagcgaaggcagcgccgtcgcaccggaaaccagcgctacgctgattttgcaggtctccagcctgagcggtggccgcatgctgcgcctgacgggggcagggatcgccgacgagcggatggtcgccccccagctgccggagtgcatcattcatgagctgaccgagcgcccgcatccgttcccgctcggtatcgacctgatcctgacctgcggcgagcgcctgctggcgatcccgagaaccactcacgtggaggtgtgctga

SEQ ID NO: 3158 - DNA, 870 bp, Enterobacter cloacae
aacgcctgcaacgggagcgcgccaatggctaacttaagcggctacaactttgcctatctggacgagcaaactaaacgcatgatccgccgcgccatccttaaggctgtggcgatccccggctaccaggtgccgttcggcggccgcgaaatgccgatgccctacggctggggcaccggcggtattcagatcaccgccagcgtgatcggcgaagcggacgtgctgaaggtcatcgaccagggggcagacgacaccaccaacgccgtgtcgatccgcaacttctttaagcgcgtaacgggcgttaacaccactgaaaaaaccgaagacgcgacgctgatccagacccgtcaccgcattccggagaccccgctgactgaagatcagattttgattttccaggtgccgatcccggagccactgcgttttatcgagccgcgggaaaccgaaacccgcaccatgcacgccctggaagagtacgggatcatgcaggtcaaactgtatgaggacatcgcccgcttcggccatatcgccaccacctacgcctatccggtgaaggtgaacggccgctacgtgatggacccgtcgccgatcccgaaattcgataacccgaagatggacatgatgcccgccctgcaactttttggtgccggacgggaaaaacgcatctacgccgtaccgccgtacacccgtgtggagagcctggattttgacgatcacccgtttacggtgcaggagtgggacgagccgtgcgccatctgcggttcgaagcatagctatctggatgaagtggtgctggacgacacgggcaaacggatgtttgtctgctccgacaccgattactgccgccaacagagcgaggcgaacagccaatga

SEQ ID NO: 3159 - DNA, 648 bp, Enterobacter cloacae
gattgccgaaggcaaacgggcagacctggtgctggcgcaccgcaagggcgagcacgttcatatcgaccacgtctggcgtcagggaaaaagggtgttctgatgggaagactcatctggttaatgggcccgtccggctccgggaaggacagcctgctgtcggcgttacggcagcgggaacattcacagctgctggtagcgcaccgctacattacccgcgcggcaaacgccgggagtgaaaaccatatcgccctgagcgagcaggagttttttacccgcaccgggcaaaacctgctggcgctgagctggcatgccaacggttactactatggcgtcggcatcgagatcgacctctggctgcacgcgggctttgacgtgctggtcaacggctcgcgggcgcatctcccgcaggctcgcgcccggtacgaagcggcgctgctcccggtctgtttgcaggtttccccggacgttctgcgtagccggctgcaaaagcgggggcgcgaaaacgcgcgcgagatcgaccagcggctggaacgggcggcgcgttacaccccgtcgggttgccatctcctcaataacgacggaagtttgctacagtcagtcgagacctttctatcccttatccgccagaaggagaaacagcatgcctga

SEQ ID NO: 3160 - DNA, 1080 bp, Enterobacter cloacae
actgcacgggcgcgacatctctcaggaaaacatcatgacgctggcaaccggcgtgaacgacacacatcatcaggcggtgtaattatgacaactccaacccatccgcagcaggtggcgaaatccgcctctgccaaaaaaatgctgatgagcgatctgatgcaaacgatcggcattttgccgattttaatcctgattgtggcggtatttggctttatcgctccgaactttttcacagaaagtaacctgctcaatattacccggcaggcgtcgatcaacattgttctggcggccgggatgaccttcatcatcctgaccggcgggattgacctctccgtgggctcgattctgggcaccacggcggtggcggcgatggtggtctcgcttatccctgaatttgcgatgctctccattccggcggcgctaatgctcggtatggtactggggctgttcaacggcgcgctggtggccttcgccggacttccgccatttatcgtcacgctcggcacctacacggcgctgcgcggcgcggcctacctgctggcggacggcacgacggtcattaactccaacatcaacttcgagtggatcggcaataactacctcggcccgatcccctggctggttgtgatcgccctggcggtgattgtggtgtgctggtttattctgcgtcgcacaaccctcggcgttcacatctatgcggtcggcggcaatatgcaggcggcgcgcttaacgggcattaaggtctggctggtgctgctgtttgtatacggcatgagcggcctgctctccggtctcggcggcgtcatgagcgcttcacgtctctacagcgccaacggcaacctcggcacggggtatgagctggatgcaattgcggcggtgatcctcggcggcaccagcttcgtcggcgggatcggcacgatcaccggcacgctggtcggtgccttgatcatcgccaccctcaacaacggcatgacgctgatgggcgtctcctacttctggcagctggtgatcaaaggggcggtgatcatcattgcggtgctgatcgacaaataccgtacccgacaccatcaaagtgcataa

SEQ ID NO: 3161 - DNA, 864 bp, Enterobacter cloacae
atgatgccattgatttctcttgccgatggtctggcccacgccagggaacaccgctacgccctgggcgcgttcaacgtgctcgactcccacttcctgcgcgcgctgtttgccgccgcgaaacaggaacgctcgccgttcatcatcaacatcgccgaagtgcattttaagtacgtgtctctggagtcgcttgtcgaagcagtgaagttcgaagccgcccgtcacgatattcccgtggtgcttaacctcgaccacgggctgcattttgaggccgtcgtgcgcgccctgcgcttagggttcagctcggtgatgttcgacggctcgacgctgagctatgaggaaaatatccgccagacgcgggaagtggtgaagatgtgccatgcggtgggcgtctcggtagaggcggagctgggcgcggtcgggggtgatgaagggggtgcgctttacgggcatgcggatgaagccttcttcaccgatccgcagctggcgcgcgagtttgtcgatttaaccggtatcgacgcgctggcggtcgccattggcaacgcgcacggcaaatacaagggcgagccgaagcttgatttcccgcgtctggacgccattcgacagcagacgggcctgccgctggttttacacggcggctctggcataagcgatactgatttccgccgcgccatcgagctgggcattcataaaatcaacttttataccggcatgtcgcaggccgcgctcgccgccgttgagcagcgcatggcaaaccgccagccgctgtacgatgagtttgccgaactgctgctgggcattgaagaggccattaccgatacggttgcggaacagatgcgcatcttcggcagcgcggggcaggcataa

SEQ ID NO: 3162 - DNA, 492 bp, Enterobacter cloacae
gaatccatgaaaatcctttttctgatgttgttatttttaaccgcgtttgcccatgccgatgagataggcagccagtataaaaagcaggctgaagcgggcgatgcgcgcgcgcagtattatctcgccgatacctggttcagttccggcgacagcgcgcaggcggcgctgtgggcggaaaaagcggcaaaaggcggtgatgtcgacgccatggcgctgctgtcgcaaatccacttttcgcagggtgactatgcgcaggctaaagccctggcccaacaggcaaacattgcgggcagcaaacgcggcgcgatcatgctggcgcgtgtgctggtgaacacgcaggcgggcaaaaccgactacccgcaggccatcgcattgctgcaatcggcgaccgaagacatcgatagcgactcggcggtagacgcgcaacagctgttggggctgatttatgccaacggcgttgaagttcctcaggatgacgtgcaggccgcatag

SEQ ID NO: 3163 - DNA, 189 bp, Enterobacter cloacae
tggttcaagcggagttcggctctgtcccggacgggctatgcggagtactgggcaggaatgctgttcaggcagggtgaaaaaggctttatcacaccgaataagcagaaagcgctttactggttaaacctgagctgtaccgaagggtttgataccgggtgtgaagagtttgatgcgttgagcggggagtaa

SEQ ID NO: 3164 - DNA, 492 bp, Enterobacter cloacae
cagttcgtgtcatcgcttgcgcatttatgcgctatttttataaaacaatatcaccgacaaaagtggggatttgcgttatactcgctgcctttttcggcacactgccgtcatttagctggcgttttccagcgtgttaacacttttgaggatacccacatgcaacttccacactgcccgaaatgcaattctgaatacacctatgaagacaatggcatgttcgtttgcccggaatgcgcccatgaatggaacgatgcggagcctgcgcaggacagcgatgcgctgatcgtgaaagacgcgaatggcaacctgctggcgaacggcgacagcgttaccgttgtgaaagatcttaaggtaaaaggcagctcctccatgctgaagatcggcactaaagttaaaaatatccgtctggttgaaggcgatcataatatcgactgcaaaattgacggcttcggtccgatgaaactgaaatctgagttcgtgaaaaagaactga

SEQ ID NO: 3165 - DNA, 759 bp, Enterobacter cloacae
gcacttcatctgagaagcgaggctttgattggtatgcacttatccagacatccgaccagttaccccacccgctggcaagagattgcggcaaagctcgaagtggagctgcgcacgcactatcgctgcggagactacctgcctgccgagcagcagcttgccgaccgctacgaagtgaatcgtcacaccctgcgtcgtgccatcgatcaactggtggagcgcggctgggtccagcgtcgtcagggcgtcggcgtgctggtgctgatgcgtccgtttgactacccgcttaatgcccaggcgcgttttagccagaaccttctcgatcagggcagccaccccaccagcgaaaagctgctgtctgtcctgcgcccggcctcccgccacgtggcggacgcgctggggattcaggagggcgacaacgtcgttcacctgcgcacgttgcgccgggtgaacggcgtggcggtctgtcagatcgaccactacttcgcggacctcaccctctggcccgttctgcaacatttcgccagcggttccctgcatgattttcttcaggacgcgacgggtatcgtgctcaaacgcacccagacgcgcatcagcgcccgccgcgcgcaggcgaaagagagcaaggtgctggagatccccaacatggccccgctgctctgcgtgcgcaccctcaaccaccgtgacggcgacgtcaacgcaacggaatactccgtcagcctgacccgcgccgacatgattgaatttaccatggagcactga

SEQ ID NO: 3166 - DNA, 453 bp, Enterobacter cloacae
atgcacttcgacacctccactcgtcagcgctggatgcgcgtgctggcccacagccagcctgctgcgctggctgcccgcatgaacgcgctcggcctgacgccggattacgacacgatccgcgcgccggagatcggcctggtgcagatccaggcacgcatgggcggcaccggcgagcgcttcttcgccggcgatgccaccctcacccgcgcggtgatccgcctgaaaagcggcacgctgggctacggctacgtacttggccgcgacaaaacgcacgccgagcgctgcgcagcgatcgacgcgcttttacaggaacagccgcattttcagacgttaatggaaacccttattgccccgctggaagctgaccgcgccgcacgccttgccgcgcgtcaggccgaagtaaataccagccgggtcgacttctttacgctcgttcgcggagacaacgcatga

SEQ ID NO: 3167 - DNA, 1266 bp, Enterobacter cloacae
aaacagcgcagcggtgatagaactgatcgaacaggccaaagcgcgcggcgcggcgatcgtcgggatcttccacgacgacgccgtacgccatcgcgtggcggacagactgcacccgatggggacaaacgtatgattatcaataatgtcaggctggtgctggaaaatgaggtcgtgaacggctcggttgaggtgcgggacggtgtcatccgcgcctttgccgaaacccagagccgctcaccggacgcgatggacggcgaaggcggctggctgctaccggggctgattgagctgcataccgataatctcgataaattcttcaccccgcgcccgaaggtggactggcctgcgcattcagcgatgagcagccacgacgcgctgatggtcgccagcggcatcaccacggtgctggacgcggtggcgatcggcgacgtgcgcgacggcggcgatcgcctggagaacctggagaagatgatcaaagccgtggaggagacgcaaaagcgcggcctcaaccgcgccgagcaccgcctgcacctgcgctgcgagctgccgcaccacaccaccctgccgctgtttgagaagctggtgggccgcgagccggtctcgctggtttccctgatggatcactcgccgggacagcgccagttcgccaacattgaaaagtatcgcgaatactatcagggcaaatattctctcagcgacgcggagatggcccgttacgaagaagagcagctggcgctggcggcccagtggtcgcagccgaatcgcctctccattgccgctatgtgccgggaccgtaatattgccctggccagccatgatgacgccacgcacgatcacgtgcgcgaatcccaccagcttgggagcgtgatcgccgaatttcccaccacgttcgaggcggcagaagcatcacgtaagcatggcatgaacgtcctgatgggcgcgccgaacatcgtacgcggcgggtcgcactccggcaacgtggcggcaagcaagctcgcctcgctcggcctgctggatatcctctcctctgactattaccccgccagcctgctggacgcggcgttccgggtggcggacgatgagggcaacagcttcacgctgccacaggcgattcgcctggtgacaaaaaacccggccagcgcgctcaaccttcacgatcgcggtgagattgccgaaggcaaacgggcagacctggtgctggcgcaccgcaagggcgagcacgttcatatcgaccacgtctggcgtcagggaaaaagggtgttctga

SEQ ID NO: 3168 - DNA, 774 bp, Enterobacter cloacae
gctggcatgccaacggttactactatggcgtcggcatcgagatcgacctctggctgcacgcgggctttgacgtgctggtcaacggctcgcgggcgcatctcccgcaggctcgcgcccggtacgaagcggcgctgctcccggtctgtttgcaggtttccccggacgttctgcgtagccggctgcaaaagcgggggcgcgaaaacgcgcgcgagatcgaccagcggctggaacgggcggcgcgttacaccccgtcgggttgccatctcctcaataacgacggaagtttgctacagtcagtcgagacctttctatcccttatccgccagaaggagaaacagcatgcctgactgccagcttcgccccgccaccgccgacgatgcgccgatcgtttacgcgctgatctgcgaacttaagcaggccgagttcgatcatcaggcgtttcacgccgggtatctggccaacttgcaggatcacaatatgcgctaccagctggccgagctggacgggcagatcatcgggatgatcggcctgcatatgcagtttcacctgcaccacgcccgctggatcggcgagatccaggagctggtagtgatgccgcaggcgcgcggattaaaagtgggcagccagctgctggcctgggcagaggacgtcgcacggcaggcaggcgccgagctgaccgagctttccaccagcgtgaagcgcgtggacgcgcaccgtttttatgttcgtgaagggtatacgcaaagccatttccgcttcaccaaaccgctgtag

SEQ ID NO: 3169 - DNA, 768 bp, Enterobacter cloacae
aggggcgttatgagtctgacgatcacgctgacaggaaccggaggggcgcagctggtgccggtgtttggctgcgactgcgcggcgtgccgacgggcgcgtttacaggaaaattatcgccgtcgcccctgtagcgcggcggtgaaattcaacgatgcggtcaccttgctggacgcgggtattccacacctgatggacgactggcccgcggggagtttcaggcagtttttgcttacccattatcatatggatcacgttcaggggctgtttcctctgcgctggggcgtgggggcgaccattccggtttacggtccgccggacgacgcaggctgtgacgacctgttaaaacatccgggccttctggatttcagccacacggtggagccgtttgtgacgtttgaacttcagggcctgcgggtgacgccgctgccgctcaaccattcaaaactcacgtttggctatctgctggagtccgcccacagccgcgtggcgtggctttctgataccgccggactgccggataaaacggtgacgtttctgctaaacaatcagccgcaggcgatgattgtcgactgtagccatgaaccgcgcccggagacgccgcgcaaccattgtgatttgaatacggtggttgcgctgaacgaggtgattggctgtccgcaggtgatcctgacgcatatcagccatcagtttgacgtgtggatgatggataacccgctgccgtccggcattgaagcggggtatgacgggatggtgatggtgctggattag

SEQ ID NO: 3170 - DNA, 1548 bp, Enterobacter cloacae
agtgcagatatcgacattcacaggagatccgccatgagcagaaccccggttttagagatgcgccacattgccaaaacctttggcaatttccacgcgctcaagggcgtggatttgacggttttccccggtgagatccacgcgctgatgggggaaaacggcgccggaaagagcacgctgatgaagatcctcgcaggcgcctataccgccagcagcggcgacatcctcatcgacggtcagccgtttcacatcaaagggccgaaggatgcgctggccgcaggcattaccctgatttatcaggagatgcagcttgctcctaacctgaccgtggcggaaaacatttttctcggtagcgagctgtcgcgcggcgggctggtccagcgcaaagagatggctgcccaggcccaggcggtcattgaccgtctgggcgcgcagttcagcgccaccgacctggtcatgaaactgaccatcgccgagcaacagcaggtggagatcgcccgcgcgctgcaccgcaatagccgcattctggtgatggacgaacctaccgccgccctctcctcacgcgaaacccaccgtctgttcgaactgattttgcgcctgcgcgatgaagggatggcgattatctacatcagccaccgcatggcggaagtgtatgaactctctgaccgcgtcagcgtgctacgcgacgggcaatacgtcggcagcctgacgcgcgacaagctcaacgcctccgagctggtgcgcatgatggtgggtcgtccgttaagcgacctgttcaacaaagagcgcgatattccgctcggcagcccgcgtctgaacgtgcatcacctcacggatggcaaaaaagtgcagccgtgcagtttgcaggttcgctccggtgaaatcgtcgggctggcagggctggtcggcgccgggcgttctgagctggcgcagctgatcttcggcgtgcgcaaagccaccggcggcatgattgaggtggacggcgaaccggtggtgatccactccccgcgcgcggccattgagaacggcatcggttttctcaccgagaaccgcaaggagcaggggctatttctggagctggcggcgcaggagaacatcaccatggcgacgctggagcgcgacgccaccttcggctggctgaaccgcaaaaaagcgcagtcgatttccgatgacgccatcgccctgctcaatatccgcgtgccgcattctcaggtgcgcgcaggcgggctctccggcggcaaccagcaaaaactgctgatctcccgctgggtggcgataggcccgcgcattctgattctggacgaacccacgcgcggcgtggacgtcggggcaaaaagcgagatctaccgcatcatgaaccagatggcgcgcaaaggggtggcgatcctgatgatctccagcgagctgccggaagtagtaggaatgagcgaccgggtgtacgtgatgcgggaaggcagcattgcgggtgaactgcacgggcgcgacatctctcaggaaaacatcatgacgctggcaaccggcgtgaacgacacacatcatcaggcggtgtaa

SEQ ID NO: 3171 - DNA, 1008 bp, Enterobacter cloacae
tcgacaaataccgtacccgacaccatcaaagtgcataacaacaataccctacgtgaggaatacagcatgagattgaagcccttagtgaccgcgctctgtgctggcgcgctgctggccgcaaccccgtttgcgcaggcaaaagatctgaaatccatcggcgtgacggtgggcgacctggctaacccgttcttcgtgcagatcaccaaaggtgccgagctggaagcgcgcaagctggcgggggacaacgtcaaggtgacgctggtctccagcgggtacgatctgggccagcaggtgtcgcagattgataacttcattgcggcgaaagtggacatgatcatcctcaacgccgcggattccaaagggatcggcccggcggtaaaacgcgccaaagaggcggggatcgtggtcgtggcggttgacgtggcggcggaaggagccgatgcgaccatcacctccgataacacccaggcgggggaaatggcctgtaagtacattaccgaccgcctgaaaggtaaaggcaacgtggtgatcattaacggaccgccggtttctgcggtacaaaaccgcgtggagggctgccagaccgagttcaggcgccacccggatatcaaagtgctctcggataaccagaacgccaaaggcagccgtgaaggcgggctggaggtcatgacctccctgctggcggctaatccgaagatcgacggcgtattcgcgattaacgatcctaccgcgatcggcgccgatctggccgcgaagcaggcgcagcgcaacgagttctttatcgttggtgtggatggcagcccggacggtgaagaagccctgaagcgcgaaaattccctgtttgtggcgacgccagcgcaggatccgcaggtgatggcggcgaaggcggtggagatcggctatgacattcttcagggcaaacctgcgccgaaagagcccgtgctgatcccggtgacgatgatcgataaaaagaacgtcggcacgtataaggggtggacggttaaatga

SEQ ID NO: 3172 - DNA, 816 bp, Enterobacter cloacae
ggccacatttatcgtgaggccgggcacatgcaaactgtcattcgcgtcgagaaactgagcaaaaccttccatcacaacaaggcgctgcatgccgttgatctgaccgtccagcagggcgaaatggtggcgctgttggggccgtctggttcaggtaaatccacccttcttcgtcacttgagcggcctgattacctgtgacaaaacgccggaaagccgcgtcgaactgctggggaacaccgtgcaacatgcggggcgtctggcgagcgatattcgcaaaagccgcgctcagacgggctatatctttcagcagttcaacctggtgaaccgcctgaccgtgctcgagaacgtgctgattggcgcgctcggcagcaccccgttctggcgcacctgcctgcgctggttctccctatcccagaagcaagaagccttacaggcgctgacccgcgtcggcatggcgcatttcgcccaccagcgcgtctccacgctctccggcggacagcagcagcgcgtcgccattgcccgcgccctgatgcagaaagccaaaattatcctggccgatgaacctatcgcctcgctggatccggagtccgcccgcatcgtgatggaaaccctgcgcgacatcaatcagaacgacggcatcaccgtggtggtgacgctgcatcaggtggattacgccctgcgctactgcgagcgcatcgtcgccctgcgtcagggacatgtgttctttgatggcgcaagccaccagtttgataacgaacgttttgaccatctctaccgcagcgtaaaccgcgtcgaagagcgcgcgcaggctgcataa

SEQ ID NO: 3173 - DNA, 846 bp, Enterobacter cloacae
agcggtgcagtaacgcctttctccctctccctcaagggagaggggactaaacccaaaggagccaacatgcaaaccatcaccctcccgccgccaaaacgcagctggttctcgctcataagctgggctgttctgctggcggtgctcgttatctcctggaagggcgcggagatggatccgctgctgctcttcagggactcaggcaacatggcgaccttcgccgccgacttcttcccaccggacttcagccagtggcaggactacctcgttgaaatggcgatcaccctgcaaattgccgtctggggcaccgccctctccgtgatcctctccattccgtttggcctgatgagcgccgaaaacatcgtgccatggtgggtttaccagccgatgcgccgcctgatggacgcctgtcgcgccatcaacgaaatggtctttgcgatgctattcgtggtcgccgtcggcctgggtccgttcgcgggcgtgatggcgctgttcatccacaccaccggcgtgctctccaagctgctctccgaagcggttgaagccatcgagcccggcccggtggaaggcatccgggcaaccggagcgaacaaaatcgaagagatcctgtacggcgtcctgccgcaggtgatgccgttgctcatctcctattccctgtaccgcttcgagtccaacgttcgctccgccaccgtagtcggcatggtgggcgcaggcggcattggcgtcaccctgtgggaagcgattcgtggtttccagttccagcaaacctgcgccctgatggtgctaatcatcgtcaccgtcagcctgctggatttcctctctcaacgtttgcgtaagcacttcatctga

SEQ ID NO: 3174 - DNA, 1170 bp, Enterobacter cloacae
gctgaccgagcgcccgcatccgttcccgctcggtatcgacctgatcctgacctgcggcgagcgcctgctggcgatcccgagaaccactcacgtggaggtgtgctgatgtacgttgccgtcaaagggggcgagaaggcgatcgccgccgcccatgccttgcaggagcacagacgccggggggatgacgccttacccgagctgagcgtcgcccagattgaacagcagttaaacctggccgtcgaccgcgtgatgaccgaaggcggcatcgcagaccgcgagctggcggcgctggcgctgaaacaggccagcggcgataacgtggaagccatcttcctgctgcgcgcttaccgcactacgcttgcgaagctggcggtaagcgagccggtgaaaacggcggaaatgcgtttagagcgccgtatttctgcggtgtacaaagatattcctggcggccagctgcttggtccgacctacgactacacccatcgcctgctggacttcactctactggcgaacggtgaaacaccgcagctcagcgtctctgacgctgaacaagacgcctctccgcacgtctttagcctgctggcaaaccaggggctggcgaaggcggaagaggacaccggcagcacaccggatgacatcacccgcacgccgccggtctatccctgttcgcgctcgtcccgcctgcaacagctgatgcgcggcgatgaagggtatctgctggcgctggcctactccacgcagcgcggctacgggcgcaaccacccgttcgcggcagagatccgcagcggttatctcgatgtcgaaattgtgccggaagagctgggttttgcggtgaacatcggcgaactgctgatgaccgagtgcgaaatggtcaacggttttgtcgcgccagagaatgaagatccgcattttacccgcggctacgggctggtgtatggcctgagcgagcgcaaggcgatggcgatggcgctggttgaccgtgcgctccaggcgccggactacggcgagcatattgcaggcccggcacaggacgaagagttcgtgctggcccacgcggataacgttgaggccgccggctttgtctcgcacctcaagctgccgcactacgtcgatttccaggccgaactggaactgctgaaacgcctgcaacgggagcgcgccaatggctaa

SEQ ID NO: 3175 - DNA, 840 bp, Enterobacter cloacae
agtggtgctggacgacacgggcaaacggatgtttgtctgctccgacaccgattactgccgccaacagagcgaggcgaacagccaatgaaaccgctgctttcggttaataacctgactcacctttatgcgccgggcaaaggctttagcgacgtgtcgtttgagctgtggccgggcgaagtgctgggcattgtcggcgagtccggctccggtaaaaccaccctgctgaagtccatctccgcgcgcctgacgccgcagaatggcgacattttgtatgagggcgtgtcgctgtatggcatgagcgaagccgagcgccgccgcctgctgcgcaccgagtggggcgtggtgcaccagcacccgatggatggcctgcgccgccaggtctcggcggggggcaacatcggcgaacggctgatggccaccggcgcgcgccactacggcaacatccgcgccacggcgcagcactggctggaagaggttgaaatccccgcctcgcgcatcgacgacctgccgacaaccttctccggcggcatgcagcagcgtttacagattgcccgcaatctcgtcacccatccgaagctggtgtttatggatgaaccgaccggtgggctggacgtctccgtgcaggcgcgcctgctggatctgctgcgcggcctggtggtggagctgaacctggcggtagtgattgtcacccacgatttaggcgttgcgcgcctgctggcggaccgcctgctggtgatgaagcagggtcaggtggtggaaagtgggctgaccgatcgggtgctcgacgatccccatcatccgtacacccaactgctggtgtcctcggtattacagaattaa

SEQ ID NO: 3176 - DNA, 690 bp, Enterobacter cloacae
gaggccaacatgatccacgttgaaaatgtcagtaaaacctttgtgctccaccagcaaaacggtgtccgcctgccggtactgcaaaatgcctcattagaggtcagcaacggcgaatgcgtggtgctgcatggccattccggcagcggaaaatccaccctgctgcgctccctgtacgccaattatctgccggacgaaggccatatccatatccgccataacaatgaatgggttgatctggtccaggctcccgcgcgcaaagtgctggaagtacgccgctcgacgatcggctgggtcagccagttcctgcgggtgatcccgcggatctccgccctggacgtggtcatgcagcctctgctggatctcggcgtgccgcgcgaaacctgcgccgctaaagccgccagcctgctgacgcgtctcaacgtaccggagcgtctgtggcacctcgccccgtcgaccttttccggcggcgagcagcagcgcgtcaacatcgcccgcggctttatcgtcgattacccgattttactcctggatgaacccaccgcctcgctcgacagtaaaaacagcgcagcggtgatagaactgatcgaacaggccaaagcgcgcggcgcggcgatcgtcgggatcttccacgacgacgccgtacgccatcgcgtggcggacagactgcacccgatggggacaaacgtatga

SEQ ID NO: 3177 - DNA, 1083 bp, Enterobacter cloacae
agaggccattaccgatacggttgcggaacagatgcgcatcttcggcagcgcggggcaggcataatggaacgcaaagggattatcgccgcaggcaacatgctggtggatcacgtccaccagatcgtacagtggccggagcgcggctggctggcggaaatcacccacagtgagcgctcaaccggcggtgcgccgctcaacgttctgctgacgctggcgaaaatgcacgtcggcctgccgttacaggcggtggggctgattggggaagacagcgacggagactatattctggcgatgctcgaccagtatcacgtcaatcgccagcgcgtgcagcgtacaacgttcgccccaacgtcgatgtcgcaggtgatgaccgaccccagcggacagcgcacttttttccactcgccgggcgccaaccgcctgctggatcttcccgccttcgatcgtttagacggatcgctgaagatcttccatctcggctacctgctgctgctcgacagcctggacatgccggacgaggaatttggcacccgcagcgcgcggttactggcacagatgcgcgatcaggggtatgaaacctcgctcgatctggtgtcccgcaagggcgatccgcgctatcagccgctggtgctccctgccctgcgccatcttgattatctggtgattaacgagctggaagccggtgagtttagcgggcttgagatccgtgacggccatgatgcgctgaacatggcccatatcgccgacgctgccacacaactgctggcggcaggcgtgcgacagcgggtggtgatccactgtccggaaggggcatggggtgaagcgccgggtgaaaaagggcaatgggttccgtcgtggaagctgacgcaggacgagattatcggcagcgtcggcgcgggcgacgcgttttgcgcgggctttttatacggctgccatgaatccctgccgctgacggagagtatttatctggcgcacgcctgcgcgcgggccagcctgctggcggctaatgcaattgacggcgcgaaaacactggccgagcttcagacgtttattcaggagaacggtcaggcggctttctcatga

SEQ ID NO: 3178 - DNA, 444 bp, Enterobacter cloacae
gaactgtttaactggagcaaagtgatgaaaaaagtcgtcacggtttgcccttattgtgcctcaggttgcaagatccacctggtggtcgataacggcaaaatcgtccgggcggaagcggcgcagggtaaaaccaatcagggcacgctgtgcctgaaaggatattacggctgggattttattaacgatacccaaatcctcaccccgcgcctgaaaacccctatgatccgccgcgagcgcggcggcaagctggaagccgtctcctggaatgaagcgctggattacgtcgccacgcgcctcagcgccatcaaggccaagtatggcccggatgcgattcagaccaccggctcctcacgcggaaccgggaatgaaaccaactatgtgatgcaaaaattcgcgcgcgccgttattggtaccaataacgtcgactgctgcgctcgcgtctga

SEQ ID NO: 3179 - DNA, 1728 bp, Enterobacter cloacae
cacggcccatcggttgcaggtctgcaccagtcggtcggtaacggcgcaatgagtaatgccatcaacgagatagataacaccgatctggtgttcatcttcggctataacccggcggattctcaccctatcgtcgcgaatcacgttattcgcgccaaacagaacggggcgaaaatcatcgtctgcgatccgcgtaaaattgaaaccgcgcgcattgcggatatgcatatcgcactgaaaaacggctcgaacatcgcgctgttgaatgcgatggggcacgtcattattgaggagaatctctacgaccaggcgtttgtcgcgagccgtacggaagggtttgaagagtatcgcaagattgtcgaaggctatacgccggagtcagtagaggcgataaccggcgtcagcgcacaggagatccgccaggcggcgcggatgtacgccggggcgaaaaccgccgctattctgtggggcatgggtgtgacccagttctaccagggcgtggaaaccgtgcgctcgctcaccagcctcgccatgctgaccggcaatctgggtaaagcgcatgtgggcgtgaacccggtgcgtggtcagaataacgtgcagggtgcgtgtgatatgggcgcgctaccggatacctatccgggctaccagtacgtcaaattcccggaaaaccgcgagaagtttgcgaaggcctggggcgtggaaagtctgccggcacacaccggataccgcatcagcgagctgccgcaccgcgcggcgcacggtgaagtgcgtgcggcctacatcatgggtgaagatccgctccagaccgacgccgaactgtccgcagtgcgcaaaggctttgaggatctggagctggtgattgttcaggatatctttatgaccaaaaccgcggcagcggcggatgtgattttgccgtcgacctcctggggcgagcatgaaggtgtctatacggcggcagaccgcggtttccagcgcttcttcaaggccgtcgagccgaaatgggatctgaaaacggactggcagatcatcagcgaaatcgccacccgcatgggctacccgatgcactacaacaacacccaggagatctgggacgagttgcggcatctgtgcccggacttttatggggcaacctatgaaaaaatgggtgagctgggctacatccagtggccgtgccgggatgagtcagaatccgatcaggggacgtcattcctctttaaagagaagttcgacaccccgaacgggctggcgcagttcttcacctgcgactgggtcgcgccgatcgataagctcaccgacgagtatccgatggtgctctccaccgtgcgtgaagtgggccactactcctgccgttccatgaccggcaactgcgccgcgctggcggcgctggcggatgaaccgggttacgcgcagatcaacaccgccgatgccgaacggctcggtattgaagatgaagcgctggtgtgggtgaattcgcgtaaaggccgcatcattacccgcgcgcaggtcagcgaccgtccgaacaaaggggcagtctatatgacctaccagtggtggattggcgcctgcaacgagctggtgaccgagaacttaagcccgataaccaaaacgccggagtataaatactgcgccgtaaacgtggagcccattgcggatcaacacgctgcggaacagtatgtgatcgacgaatataacaagctgaaagcccgactgcgcgaaagcgcaatgggttga

SEQ ID NO: 3180 - DNA, 189 bp, Enterobacter cloacae
gacgtactactttccagccgcctggtgaaaacccgtatcctcgacatggcgcgtaccgcgctgaacgtggtgggtaatgccctggcggtactggtaatcgctaagtgggaacacaagttcgaccgtaaaaaagcgctggcgtatgaacgcgaggtactgggtcgttttgataaaacggctgaccagtga

SEQ ID NO: 3181 - DNA, 2310 bp, Enterobacter cloacae
gggcaccaaaccgcagaggagcccaaacccatgccatcacgccccccgttcttcaccagcgcccgcggtcgcctgctgatatttaacctgctggtggtggcggtaacgctgatggtcagcggcgtggcggtgctcggctttcgtcatgccagccagatccaggagcaggtgcagcagcaaacgctggatgacatgaccggcagcatgaacctcgcgcgcgacacggccaatgtggcaacggcggcggtgcggctgtcgcaggtggtcggtgcgctggagtacaaaggcgaagctgagcggcttaaacagacgcaaatggcgctgcgccactcgctggagcagcttgccgatgcgccgctggcgcagcaggagccggcgctggtgacgcgtattattcgcaggagcaatgagttacagcagagcgtgacgggaatgctggagcgcgggcaaaaacggcatctggagcgtaacgcgctgctcagcgcgctgtatcaaagccaaagctacctgcgtcatttgcaggatatcaaccgtcgttacgcgagcaatgtgccagacgcccggcagcttgcagagatggacaggctgatcgttgccgccattgataccccttcaccgcgcgccacggtgcagcagctggatgcagtaaccgcgatgttacccgcgagcgccctgcaaccggtggtcaacctggtgctcccggattttaatgatgagctgcgcaagctcgcgccactgtcgaagcagctggaagagagcgatctgtccatcagctggtacatgttccacatcaaggcgctggtagcgatattaaaccgcgacatcaatcagtacgttgaacaggtggcgcaggcctcccggctgcgtaccgcccaaagtcaccaggagctgcgctccatcagcgtgtttatcagcgttttcgcggtgctggcgctgatcatcaccggctgcgcctgctggtatatttatcgcaatctgggctccaacctgacggctatctcaagggcaatgtcgcgtctcgctcacggagagcagaatgtgtcggtgcccgcactacagcggcgtgatgagctgggggaactggcgcgcgcgtttaacgtttttgcacgcaataccgcttcgctggagcacaccacgcggctgcttaaggagaagacctcgcagatggaggtcgaccgcatcgaacgtcaggggctggaggaggcgctgctgcacagccagaaaatgaaggcggtcgggcaactgacgggcggtctggcgcatgattttaataacctgctggcggtgattatcggcagtctggagctgaccgattcagcgtcaccggacgcgccgcgcatcactcgtgcgctcaaagccgcggaacgcggggccatgctcacccagcgtctgctggccttctcgcgcaagcaatccctgcaaccccatgcggtagagatgaagccgctgctggagaacctgagcgagctgatgcggcactcccttcccgccacgctgacgctggatattgaagcgcaaaccccggcctggcccgcatggattgacgtcagccagctggaaaacgccattatcaacctggtgatgaacgcccgtgatgcaatggaggggcaaaacggtgtgattaaaatccgcacctggaaccagcgtgtgacccgcagcgacgggcgcaggcaggatatggtcgcgctggaggtgattgaccacggctgtgggatgtcgcaggaggtgaaatcgcaggtctttgaaccgttcttcaccaccaaacagaccggcagcggcagcggattagggctgtcgatggtgtacggctttgtgcgtcagtccggggggcgcgttgagatcgaaagcgcgccggggcagggaaccaccgtgcggctccagctgccgcgctcgacgctgcccgcgttctccaatgatgccgcgctggcgaccacggccccgacagaaagtgagctgcttgtgctggtcctggaagatgaggcgggcgtgcggcagaccctgtgtgagcaactgcaccagcttggctacctgacgctcgaagccgaaaacggcgagcaggcgctgaacatgctggacgcatcaccggatatcggcatgtttatcagcgacctgatgctgccgggcggcctgagcggtgcggaggtgatcggccatgtacgcagccactatccgcagttgccggtgctgctgatcagcgggcaggatttgcgcccggcgcataacccacagctgccggacgttcagttactgcgaaaaccgttcacccgcgcacagctggcgcaggcgctgcgcaaggtgatggtaatttga

SEQ ID NO: 3182 - DNA, 237 bp, Enterobacter cloacae
atgatgcactccggcagctggggggcgaccatccgctcgtcggcgatccctgcccccgtcaggcgcagcatgcggccaccgctcaggctggagacctgcaaaatcagcgtagcgctggtttccggtgcgacggcgctgccttcgctcagggcattaagttgttcatggctgatttgctcgtcggccacggcgaagaccgcctgctggggctgctcgaccagcggcgcgttggtgtga

SEQ ID NO: 3183 - DNA, 417 bp, Enterobacter cloacae
ctcatttccattcctcgttatgggtcgttatgcagcctgcgcgcgctcttcgacgcggtttacgctgcggtagagatggtcaaaacgttcgttatcaaactggtggcttgcgccatcaaagaacacatgtccctgacgcagggcgacgatgcgctcgcagtagcgcagggcgtaatccacctgatgcagcgtcaccaccacggtgatgccgtcgttctgattgatgtcgcgcagggtttccatcacgatgcgggcggactccggatccagcgaggcgataggttcatcggccaggataattttggctttctgcatcagggcgcgggcaatggcgacgcgctgctgctgtccgccggagagcgtggagacgcgctggtgggcgaaatgcgccatgccgacgcgggtcagcgcctgtaa

SEQ ID NO: 3184 - DNA, 909 bp, Enterobacter cloacae
tattcaaaccttattcgcggcagagcaaccatgacaacacagctactggacggtcccgggcggacgctggagtgtattcatccaaaatttatggtcgatttggtccagggggcggatgctgcacgtcacgccctcctggggccacagcaactacaatttcgtgagcgtttgacgcaggagatcattacgcagacccggctgcggccgtgggcaatggcgggaatgctcaacgaaaatgcagcactgcggctgggtctggcggagaaacttgccggtatgctcgaccccggacaccttgcgctgacccgtatgtccgacaggctggtagccctgcgccagcaggtgaatccacgcctccctcaacctcccggattgttgcaacagtacgaggagctctccgcacatttcaaccagcgtgccgcctataaagagaaagcgctcgcgcagcgaggccttacggttcaggcgggtgagcacagcgagcaaatttttacccgctggcgagccgggcagtatgacggctggtcgctggctggccgctgctttatcgtgctggaagagttgcgctggggggcgtttggcgatgcctgtcgtctggcgaatagtgatgtggcggccatgctgaaagataacctgcgcagcatggccgcaaattatctggcacaggagattaatgcttctcccaccacccggcatttttaccatcagtggctgacgacgcccgcttctcccggtctgattgattataaagatatgctgggctggctgggggactggtgtcaggcggaaaaacatccggtgagctggtcagtgacgcagagctggcaaacggtcgcgctggggatgccaagactctgttcggcaaaacggcttgtggatggcatggtggaagagatatttggtacgtga

SEQ ID NO: 3185 - DNA, 1587 bp, Enterobacter cloacae
ggagattcgcatggagcggatctctggttcacagcttgcaaaatgcgctgtgaaacggacggggctgagtctacgaggaaagctatgcttagaaggaaaaaagtaaaacccatcacgctgcgcgatgtcaccattattgatgacgcgaaactgcgcaaagcgattacagcggcctcgctcggtaatgcgatggagtggttcgattttggtgtttacggctttgtggcctatgcacttggtaaagtgttcttccccggtgccgatcccagcttgcagatgattgccgcgctgggtacgttctccgttcccttcctgattcgccctcttggtggtcttttcttcggcatgctgggtgataaatatggtcgccagaaaatcctggctattactattgtcatcatgtcgataagtacattctgtatcggccttattccgtcctatgcgaccattggtatatgggcgccgattctgctgttgatctgtaagatggcgcagggcttctccgttggcggcgaatataccggtgcatcgatttttgtcgccgagtattctccggaccgtaaacgcggctttatgggcagctggctggactttggttcgattgccggattcgtcatgggcgcgggggttgtggttctgatttcaaccgtagtgggtgaagagaacttccttgactggggctggcgtattccgttcttcctggcgctgccgctgggcatcattgggctttacctgcgtcacgccctggaagagacgcctgcgttccagcagcacgttgaaaagctggagcagggtgaccgtgaagggttacaggatggcccgaaagtgtcgttcaaggagattgcgaccaaacactggcgcagcctgctgacctgtattggtctggtgatttccaccaacgtcacctattacatgctgctgacctacatgccgagctacctgtcgcataacctgcactactcggaagaccacggtgtgctgattattatcgccatcatggtaggtatgctgtttgtgcagccgattatgggtctgttgagcgaccgctttggccgtaagccattcattattctcggcagcgtcgccttgttcgcactggcaattcccgcctttattctgattaacagcaatgtgctggggctgattttcgccggtctgctgatgctggcggtgatcctcaactgcttcatcggggtgatggtttctacgctgccggcaatgttcccgacgcatattcgctacagtgcgctggcggcagcctttaatatctccgttctgattgcgggcctgacgccgacacttgctgcttcactggtggagagcacgcagaacctgatgatgcctgcttactatctgatggtcattgcggtggtcggcctgattaccggtattaccatgaaggagacggcgaatcgtcccctgaaaggggcaacgcctgcggcgtctgatattcaggaagcgaaagagatcctgcgtgagcactacgataatgtagagcagaagattgaagatattgacgcagagatcgaggcgctccagaaaaaacgttctcgcctggttgaccagcatccgagaattaacgagtga

SEQ ID NO: 3186 - DNA, 744 bp, Enterobacter cloacae
cggaagcatgcgatgaaaccggcgattctggtggttgacgatgatgtcgcagtctgcgaactgctacaggatgtgctcagcgagcacgtctttaccgtactgacgtgtcactctgggcaggacgcggtgaaccgtgtccagcaggactccggcattgcgctggttctgctggacatgatactgccggatatcaacggattacaggttttactgcaactgcaaaagcagcgaccatcgctaccggtggtaatgctgacggggctgggaagtgaatcagatgtggtcgtcgggctggaaatgggcgctgatgattacatcggaaaaccgttcaatccgcgcgtggtggtcgcccgcgttaaggcggtgctgcgtcgtaccggcgcgctggacgcggagcctgccgcgccgcgcgttgaaggtattgcctttaacggctggacgctggacaccacccgctgcgagctgagcgatccgcagcgtaataccgtgccgttaacccagggcgaatatggcctgctgctggcattaacgcaaaacgcccgccgggtactgagtcgtgaacagctgctgaagctgacccacagcgaaagcgccgaggtctttgaccgcactatcgacgtgttgatcatgcggctacggcgaaaaattgaggtcaatccgcaccagcctctgctgatcaaaaccattcgcggtctgggctatgtttttgccacggacgtttcccatcatgagaaagccgcctga

SEQ ID NO: 3187 - DNA, 240 bp, Enterobacter cloacae
caggtcgtcacagcctgcgtcgtccggcggaccgtaaaccggaatggtcgcccccacgccccagcgcagaggaaacagcccctgaacgtgatccatatgataatgggtaagcaaaaactgcctgaaactccccgcgggccagtcgtccatcaggtgtggaatacccgcgtccagcaaggtgaccgcatcgttgaatttcaccgccgcgctacaggggcgacggcgataattttcctgtaa

SEQ ID NO: 3188 - DNA, 1023 bp, Enterobacter cloacae
aagcgcgtcgatcgctgcgcagcgctcggcgtgcgttttgtcgcggccaagtacgtagccgtagcccagcgtgccgcttttcaggcggatcaccgcgcgggtgagggtggcatcgccggcgaagaagcgctcgccggtgccgcccatgcgtgcctggatctgcaccaggccgatctccggcgcgcggatcgtgtcgtaatccggcgtcaggccgagcgcgttcatgcgggcagccagcgcagcaggctggctgtgggccagcacgcgcatccagcgctgacgagtggaggtgtcgaagtgcattcagtgctccatggtaaattcaatcatgtcggcgcgggtcaggctgacggagtattccgttgcgttgacgtcgccgtcacggtggttgagggtgcgcacgcagagcagcggggccatgttggggatctccagcaccttgctctctttcgcctgcgcgcggcgggcgctgatgcgcgtctgggtgcgtttgagcacgatacccgtcgcgtcctgaagaaaatcatgcagggaaccgctggcgaaatgttgcagaacgggccagagggtgaggtccgcgaagtagtggtcgatctgacagaccgccacgccgttcacccggcgcaacgtgcgcaggtgaacgacgttgtcgccctcctgaatccccagcgcgtccgccacgtggcgggaggccgggcgcaggacagacagcagcttttcgctggtggggtggctgccctgatcgagaaggttctggctaaaacgcgcctgggcattaagcgggtagtcaaacggacgcatcagcaccagcacgccgacgccctgacgacgctggacccagccgcgctccaccagttgatcgatggcacgacgcagggtgtgacgattcacttcgtagcggtcggcaagctgctgctcggcaggcaggtagtctccgcagcgatagtgcgtgcgcagctccacttcgagctttgccgcaatctcttgccagcgggtggggtaactggtcggatgtctggataa

SEQ ID NO: 3189 - DNA, 2370 bp, Enterobacter cloacae
gggaaggcttttatcatgcacacacagaccatatttgaattaagccaggaagctgaacgtttgttacagctcgctctgaacaatcttgattcattaaaatctatgccgattgcaaagctggatagcacaaccgctgccatgagcggcgttaataacaacgttttgccattgcattttagcgcacgaggtgtcgacgctcagcaggcgatgctgaataatgaattacgcaaaataacccgcctcgaaatggtactggcgattgtgggtaccatgaaagcgggaaaatcgaccaccattaatgcgattgtgggcacggaagtgctgccgaaccgcaatcgtccgatgacggcgcttcccacgctgatccgccatacgccgggccagaaggagccggtgctgcattttttgcacgtttcgcccatcgataccctgattacccagttgcagaaaaaactgtgcgataaagatcgcggcaagctggcgcggcgtctggaaatcgacaaggacatgaatacgctgctggagcgcatagaaagaggtgaggcgtttgaaaaacatcacctgggcgcggagcccatctttcattgtctgaaaagcctgaacgatctggtgcggctttctcaggcgctgggcgtggagtttccgttctctgagtatgccgcgattgaacatattccggtgattgaggtggagtttgtgcatctcgccggtctggatgcgcacctggggcaactgacgctgctcgacacgccggggccgaacgaggccggtcagccgcacctgcaaaaaatgctcaatgagcagttggcgcgcgcctccgccgttctggcggtgatggactacacccagcttaaatccatttctgatgctgaggttcgtcaggcaatttcggctgccgggaaatccgtgccgctttacgccctggtcaacaaattcgatcagaaagatcgtaacagcgacgatgaagagcaggtgcgggcgatgatttccggcacgctgatgaaagggaatatttctccggggcaaatttatccggtctcttccatgtgggcctatctggcaaaccgcgcccgctatgagatgaacgtccatgggcgccttcccgatcatcaggatcagcgttgggtacaggattttgccgaggccgcgctgggccgccgctggcgaacggccgacctggacgatattgaccatattcgccatgcggcggatctgctgtgggaggattcgctgttcgaacagcccatccgcaaactgatttacgcggcttacgccaacgcctcactgttcgctttacggtcggcatcgcataagctgctgaactatgcgcaaaatgccagagaatacctggactttcgccatcagggactgacggtcgcttttgatgagctggagctgaatattgcgcgcctggaagaggatatgacgatgctgcgtaagcggcagagcgtggtgagcgatgaggtccagcatgaagttgaagaggcgctcaacgcaacggatgcttttctgcttcgccagaaagatgaacttcaccaggcgctgggcgacatttttagccgcccgtctattcttgacttagcaggccgcgagccatccagtttgcgtgaagacgacgcggatgcgatccagcagctggtgcttgacgatgaagggcaggcgcagattgtcctgagcaagatccgatcgtcatgcgagcagattatgctgaatgcgcagagcagaattggccgggagctggcgttacgcttcgatcagctggagtctacgctcgcccgatcgttgaatgaggcgatgcgacccatcgagacgcgaattaaggaacagctcagtcatgccggatttcgggcgcggattagcttcccggcgtttcaggcaaaccagcttaatttcaatacgcgcgggttatttaatgatgccattgtgcaggacacccctcccgccagtcagccagcaggggcaggcagcgtacgtaataccgtctcgcgctggctcaataatcccggctggggctgggaggagtatgtcgtgacgcgcacacgctatgtcatcgacatcgctcagcttcatggcaaatttacgcaacataccgatcagttttgcgatcaaattcgtaaagctttggccgcgcaggtcgatgtctctgttacggcaggtatggcaacgttctttgcagagttttcgttgtgcctgaccgggttacaggaaagcttgcgtgatagccttgccgttcggcagcagaatgagcattcaacccgggcgcttagccagttgttgaagcaaagtatgaccactgcggcgtggattcaggaagatacccgactgttacgcgatgatattcaaaccttattcgcggcagagcaaccatga

SEQ ID NO: 3190 - DNA, 891 bp, Enterobacter cloacae
cgaatacagcatgttaatgctgggtggtttgatggtgctgatgatgatctggcgtccgcagggtctcctgccgatgacccgtccacagctgaagctgaaacgcacacaggcgaaaggagagcaggcatgaagcctttattatccgttaacggcctgatgatgcgttttggcggcctgctggcggtcaacaatgtgaatctggatctgcacaagaaagagattgtctccctgattggcccgaacggcgcgggaaaaaccacggtcttcaactgcctgaccggcttctacaagccgacgggcggcaccatcatgctgcgcgatcagcatcttgaagggctgccgggccagcagattgcccgcatgggcgtggtgcgtaccttccagcacgtgcgtctgttccgcgagatgacggtgattgagaacctgctggtggcgcaacatcagcagctgaaaaccggcctcttctccggcctgctgaaaaccccggccttccgccgcacgcaggaagaggcgctcgatcgcgccgcgacctggctcgaccgtatcggcctgctccagcacgccaaccgtcaggcgagcaacctcgcttacggggatcagcgtcgcctggagattgtgcgctgcatggtgacgcagccggagatcctgatgctcgacgaaccagcggcaggtctcaatccgaaagagaccaaagagctggacgagctgattgccgagctgcgcgaccatcacgacaccaccatcctgctgattgagcatgacatgaagctggtgatgggcatttcggaccgtatctacgtggtaaaccagggcacgccgctggcaaacggcacgccggaagagatccgcaacaacccggacgtgatccgcgcataccttggtgaggcataa

SEQ ID NO: 3191 - DNA, 1350 bp, Enterobacter cloacae
tatcgcgcatccggcacaataagagagatgacaatgacatcgttacgacacacagctttgggtctggcactgggtctggcttttgcgacgaacgcaatggctgtgacgaccattccgttctggcattccatggaaggggagttgggtaaagaggttgactccctggcgcaacgtttcaacgacacccacccggattacaaaattgtgccggtgtacaaaggcaactacgagcagagcctgagcgcgggcatcgccgccttccgtaccggtaacgcgcctgcgctgttacaggtttatgaagtgggcaccgcgaccatgatggcctccaaagccatcaagccggtgtacgaggtgttcaaagaggcgggcattaactttgacgagtcccagttcgtgccaaccgtggcgggatactacacggattccaaaagcgggcatctgctgtcccagccgtttaacagctccacgccggtgctgtactacaacaaagacgccttcaggaaagccggtttagatccggagcagccgccaaaaacctggcaggacctggccgaatacaccgcgaagctgaaagcggcggggatgaagtgcggctacgccagcggctggcagggctggatccagattgaaaacttcagcgcctggcacggcctgccggttgccaccaaaaacaacggcttcgacggtaccgacgcggtgctggagttcaacaagccggagcaggtgaagcacatcgcgctgctggaagaactcaacaagaagggtgacttcagctacttcgggcgtaaagacgaatccaccgagaagttctacaacggcgactgcgccattaccaccgcctcatctggctcgctggcagacatccgtcactacgccaaattcaattacggcgtgggcatgatgccgtacgacgctgacgtcaaaggcgcgccgcagaatgccatcatcggcggggcgagcctgtgggtgatgcagggtaaagacaacggcacctacaaaggcgtggccgagttcctcgacttcctggcgaagccggaaaacgccgccgagtggcaccagaagaccggctacctgccgatcaccaaagccgcgtacgacctgacccgcgagcagggcttctacagcaagaacccgggcgcggatatcgcgacgcgtcagatgctgaacaagccgccgttgccgttcaccaaaggcctgcgtctgggcaacatgccgcagatccgcaccatcgtcgatgaagagctggaaagcgtctggaccgggaagaaaacgccacagcaggcgctggattccgcggtagagcgcgggaatcagctgctgcgccgctttgagcagtcgacgaagtcttaa

SEQ ID NO: 3192 - DNA, 891 bp, Enterobacter cloacae
cctatgtcatcatcccgtccggtgttccgttcccgctggctgccgtacctgttggtcgcgccgcagctggtcatcaccgtcatcttctttatctggcctgcgggcgaagcgctgtggtactcggtacaaagcgtcgatccgttcgggctttccagccagtttgtcgggctggacaactttaccgcgctgttccacgacagctactacctggattccttctggacgacgatcaaattcagcgcgctggtcaccgtcagcggtcttgtcgcgtcgctgtttttcgccgcgctggtggattacgtagtacggggcagccgtctgtatcagaccctgatgctgctgccctacgccgtggctcccgccgtggccgccgtgctgtggatcttcctgtttaacccgggccgcgggctgattacccacttcctgggtgagtttggctatgactggaaccacgcccagaatagcggtcaggcgatgttcctggtggtgttcgcctcggtgtggaagcagatcagctataacttcctgtttttctttgccgcgctacagtctatcccgcgttcgctggtggaggccgccgccatcgacggcgcagggccggtgcgccgcttcttccggctgtcgctgccgctgatcgccccggtgagtttctttctgctggtggtgaacctggtgtacgccttcttcgacaccttcccggtgatcgacgccgccaccgcgggcggcccggtgcaggcaaccaccacgctgatttacaagatctaccgcgagggctttgccgggcttgatctctcagcctctgctgcacagtcggtcgtgctgatgttcctcgtcatcatcctcacggtggtgcagttccgctatgtcgaaagtaaggtgcgctaccaatga

SEQ ID NO: 3193 - DNA, 1119 bp, Enterobacter cloacae
ccatgcagcgcgcgtttgtccgcggcctggtcgatagcgagaaataagatggcaggtttaaaattacaggcagtaaccaaaagctgggacggcaaaacccaggtcattcagccgctgacgctcgacgtggcggacggggaatttatcgtgatggtcggcccgtccggctgcggaaaatccaccctgctgcgtatggtggccgggctggagcgtgtgacgtccggggatatctggattgaccgccagcgcgttaccgagatggaacccaaagatcgcggcatcgcgatggtattccagaactacgccctctatccgcacatgagcgtggaagagaacatggcctgggggctgaaaattcgcggtatgggcaaaggccatatcgaggagcgcgtgaaagaggccgcgcgcattctggagctggacggcctgctcaagcgtcgcccgcgcgagctctccggcggccagcgccagcgcgtggcgatggggcgcgccatcgtgcgcgatccggcggtatttctgttcgacgaaccgctgtcaaacctcgacgccaaactgcgcgtgcagatgcgtcttgagctacagcagctgcatcggcggctgggaaccacgtccctctatgtgacccacgatcaggttgaagccatgaccctcgcccagcgcgtgatggtgatgaacaaaggcatcgccgagcagattggcaccccggtggaggtctacgaaaaaccggccagccgttttgtggcgagctttatcggcagcccggcgatgaacctgctggacgggcggatcaatgcggcgggaacccacttcgagctggaaagcgggatggcgttgccgatcaactggtactatcgtggctacgccgggcgtaagatgacgctcggtatccgcccggagcatattggtttgacgtctcaggcggacggcggcgtgccgctggtgatggacacgctggagatgctgggcgcagacaacctggcgcacggacgctggggcgagcaaaagctggtggtgcgcctgccgcatcaggagcgcccgaaggcaggcagcacgctgtggctgcatatgccggaaaatcacctgcacttatttgacggtgaaacaggacaacgagtatga

SEQ ID NO: 3194 - DNA, 1083 bp, Enterobacter cloacae
tttctcaaccttccctttaaacggggaaggttgagctttgtccgtgataaactgagcaaatctctcacttcaagatttctcaggacgatgaaaaagaaacgccccgtacttcaggatgtcgccgatcgcgtcggtgtgaccaaaatgacggtcagccgttttttacgtaacccggaacaggtttccgtggcgttgcgtggcaagattgccgccgcccttgatgaactgggttatatccccaaccgcgcgcccgatattctctccaatgcgaccagccgtgcggtgggtgtcctgcttccttccttaaccaaccaggtattcgccgaagtgctgcgtggcatcgaaagcgtcaccgatgcgtttggctatcagaccatgctcgcccactacgggtacaagccggaactggaagaggaacgtcttgaatcgatgctttcctggaacatcgacggcctgattttaacggaacgtactcacaccccgcgcacgctgaaaatgattgaagtggcaggcattccggtggtggagctgatggacagccagtcgccgtgcctcgacatcgccgtggggttcgataactttgaagcggcgcgtcagatgacggcggcgatcatcgcccgcggtcatcgccatgtggcctatctgggtgcgcgtctggatgaacgtactatcatcaaacagaagggatacgagcaggcgatgctcgacgccggtttaaccccgtacagcgtgatggtggagcaatcttcttcttacacgtcgggtattgagctgatgcgtcaggcgcgacgcgagtatccgcaactggacggtattttctgtaccaacgatgaccttgcggtcggcgcggcgtttgagtgccagcgtctgggtttaaaaatcccggatgatatggcgattgccggtttccacggccacgacattggccaggtgatggagccgcgtctggcgagcgtcctgaccccgcgtgaacgcatgggccgcattggtgcagaacgcctgctggcgcgcattcgtggtgaggcagttacccctaaaatgttagatttaggtttcaccttgtcaccgggtggatctatttaa

SEQ ID NO: 3195 - DNA, 549 bp, Enterobacter cloacae
caattgactgagggacaccctttgagcacgactaatcacgatcaccacgtttacgtcctgatgggcgtgtccggtagcggtaaatctgccgtggcgagcgaagtggcgcatcaactccaggctgcgtttcttgatggtgacttcctccatccgcgtagcaacatcatgaaaatggcttccggcgagccgctgaacgacgacgaccgcaaaccgtggttgcaggcgctgaatgacgccgcgttcgcgatgcagcgcaccaataaagtctccctgatcgtctgttccgcgctgaaaaaaacctatcgcgacctgctgcgcgacggcaacccgaacctctctttcatctacctgaaaggcgatttcggggtgattgaaagccgcctgaaggcgcgtaaaggccacttcttcaaaacccagatgctggtaacgcagttcgaagcgttgcaggagccgggtgctgacgagcaggatgtcttagtggttgatatcgatcagccgctggaaggtgttgttgccagcaccatcgaggttattaataaaaggcagtaa

SEQ ID NO: 3196 - DNA, 1344 bp, Enterobacter cloacae
gttttgagtacattaacgctagttttgacagcagtgggttccgtattgctgctgctgtttttagtgatgaaggcacgtatgcacgccttcgttgctttgatggtggtttctattggtgctggtctcttttccggcatgccgctcgacaaaatcgcggcgacgatggaaaaagggatgggcggcacgctcggcttcctggccattgtggtggcactgggcgcgatgtttggcaagattttgcacgagacgggcgcggtcgatcagattgccgtcaagatgctgaaatccttcgggcacagccgtgcgcactacgcgattggtctggccggtctgatttgcgcgctgccgctgttctttgaagtggccgttgtgctgctgataagcgtggcgttctccatggcgcgccatactggtactaacctcgtgaagctggtcattccgctgtttgcgggcgtggcggcggcggcggcgttcctgctgccggggcctgcgccgatgctgctggcctcccagatgcatgctgactttggctggatgatcctgattggcctgtgtgcggcgatcccggggatgattatcgccggtccgctgtggggaaactttatcagccgttacgttgagctgcacattccggacgacatcaccgagccgcacctgggcgagggtaaaatgccgtccttcggcttcagtctgtcgctgatcctgctgccgctggtgctggtgggcctgaaaaccatcgctgcacgctttgtgccggtggggtcaaccgcttacgaatggttcgaatttattggtcatccgttcactgcgattctggtggcgtgtctggtcgctatttacggcctggcaatgcgtcagggcatgccgaaagatcgcgtgatggagatttgcggcgccgcgctgcaaccggcggggattatcctgctggtgatcggggcgggcggcgtgttcaagcaggtgctggtggattccggcgttggcccggcgctgggcgaagcgctgaccggaatgggcctgccgattgcggtcacctgctttgtgctggccgcggcggtgcgtatcattcagggctccgcgaccgtggcgtgcttaaccgccgtgggtctggtaatgccggtgattgaacagctgaactactccggcgcacagatggcggcgctctctatctgtatcgcgggtggctcgattgtggtgtctcacgtgaacgacgcaggcttctggctgttcggtaaatttaccggcgcaaccgaagcgcaaaccctgaaaacctggacgctgatggaaaccatcctcggcacgacgggtgcggttgtcgggatgattgcgtttacgctgctgagctga

SEQ ID NO: 3197 - DNA, 2049 bp, Enterobacter cloacae
aagccatggccgtccgaactccctgagcctgacgctgccgccgcttggcacaatctggctggtgcgggagggagaatgacgcagcttacggcaggtaaacccgaaccgctcggggcgagttttgacggaaagggggtgaacttcacgctcttttccgcccatgcggagcgggtggaactctgtgtgtttgacggggaaggtaacgagcaccgttacgatttaccggcgcgcacgggggatacctggcatggctacctggccggaggacggccggggatgcactacggttttcgcgtacacggcccctgggagccctctcaggggcactggtttaacccggcgaagctgctgattgacccttgtgcgcaccgggtggacggtgagtttaaagatgacccgctgttccacgttggctacggcgaacctgaccacctcgacagcgcgcccgtcgcgcccaaaagcgtggtggtgcacgatctctacgactgggaagacgatgccccgccgcgtacgccttggggcaacaccgttatttatgaagcccacgttaaagggctgacgtatctgcacccgtcaattcccaaagagatgcgcggcacctacaaagcgcttgggcatccgacgatggtcgcgtacctgaagcacttagggatcaccgcgctggagctgttgcccgtggcgcatttcgccagcgagccgcggctacagcgtctcgggttaagcaactactggggctacaacccgctggcgttgttcgccctcgatccgcgttatgcggtgaatcctgagaaggcgcgggatgagtttcgcgatgcggtgaaggcgcttcacgcggcgggtatcgaggtcattctggacgtggtgttgaaccacagtgcggaaagcgatcttgacggcccgacgctctcacagcgcggaatcgataaccgtagctattattggatcagggacgacggcgattacgagaactggaccgggtgcggtaacaccctcaacctcagtcatccggccgttacgcattacgcgtacgagtgcctgaaatactgggttgagacgttccacgtggacggttttcgcttcgacctggcgccagtgatggggcgcaccccggcgttcagccagcaggcgccgctgtttgaggccatcaaaaactgcccggtgctttcaaaggtgaagctgattgcggagccctgggacatcggcgagggcggttatcaggtggggaacttcccgccgctgtttgccgagtggaacgaccacttccgcgatgccgtccgccgcttctggctgacgcgcgatctgtcgctgggggagtttgccggtcgctttgccggctccagcgatctctttaagcgtgacggcaaacgtccgtcggccaccattaacgtggtgacggcgcacgacggttttacgctgcgcgactgcgtttgtttcaatcagaaacacaatgaggcaaacggcgaggagaatcgcgatgggactaacaataaccatagctttaaccatggtatagaagggttaggcggaagtctggatgtgatcgagcggcgacgcgccagcgttcatgcgctgctgacgacgcttttgttgtcgcagggcacgccgatgctgctggcgggcgatgagcacggccacagccagcacggcaacaacaacgcctattgccaggacaacaccctgacctggctcgactggggagaagcgaacagcgggctgacccatttcaccgcggcgctgatccatcttcgccagcgcatccccgcgctcaccgccgaccgctggtgggaagagggcgacggcaacgttcgctggctgaataaagacgcgcaaccgttaagcgcgcaagagtggcaacacggcataccctgtctgcaaatcctgctttcggatgcgtggctggtgacgctgaacgcgacggatgacgtcgcagagattgttttacctgacggggagtggcgagccattcctccctttgccggagcggataatccggttgttatggctgtctggcacgggcctgcgcacggagtgtgcgtattccaaagatga

SEQ ID NO: 3198 - DNA, 927 bp, Enterobacter cloacae
tatacgctaagtgcggatccttccaggcccgtggtgaagacctgcgatccaaaacaggccgtcgcggtcgccaacaaaattgttaacgacggtatccagtacgtcatagggcacctgtgttcctcttccacgcagcctgcgtctgatatctacgaagacgaaggcattctgatgatcaccccgggcgccaccaacccggaactgacccagcgcggctaccagcacatcatgcgtaccgccggtctggactcctctcaagggccaaccgccgccaaatacatcctcgaaaccgttaagccgcagcgtatcgccatcattcatgataaacagcagtacggcgaaggcctggcgcgttccgtacaggacggcctgaaaaaaggcggggcgaacatcgtcttcttcgacggcattaccgccggtgaaaaagacttctccgcgctgatcgcccgcctgcaaaaagagaatatcgacttcgtttactacggcggctactacccggaaatggggcagatgctgcgccaggcgcgcgccaccggactgaaaacccagttcatggggccagagggcgtgggcaatgcctccctgtccaacatcgcgggggattctgccgaaggcatgctggtgacgatgccaaaacgctatgaccaggatccggcgaataaggctatcgtggatgcgctcaaggcgcagaagaaagatccaagtggtccgtacgtctggatcacctacgcggccgtgcagtctctggccaccgcgctggatcgtaccggcagcaaagaaccgctggatctggtgaaagatttaaaagcgcacggggcgaacaccgtgattgggccgctgaactgggatgagaaaggcgatctgaagggatttgaatttggtgtctttaagtggcacgccgacggttcgtcctcggtcgccagataa

SEQ ID NO: 3199 - DNA, 1362 bp, Enterobacter cloacae
agatgtggtgtcgtttgccctgctaattctggttctgctggtgatgcctaccggtattctgggccgtccggaggtagagaaagtatgaaaccgatgcattttgcgatggcgctgctctctgccgccatgttcttcgtcctggcgggcgtctttatgggcgtccagttagggctggacggcacgaagctggtggtggataccgcccccgacatccgctggcagtgggtgtttatcggcaccgctgtggtgttcctgttccagctgctgcgtccgctgttccagaagacgctgaaaaacgtctccgggccgaaattcgtcctgccggcgatcgacggtacaaccgtgaaacagaagctgttccttgtggcgctgctggtggctgccgtggcgtggccgtttatggtatcgcgcgggacggtggatattgccaccctgaccatgatctacgtgattctggggctgggtctgaacgtggtggtggggctgtctggcctgctggtgctgggctacggcgggttctacgccatcggcgcgtacaccttcgcgctgctgaaccactattacggcctcggcttctggacctgtctgccgctggcggggctggtctctgccgcggcgggcttcctgctcggcttcccggtgctgcgcctgcgcggtgactacctggcgattgtgaccttaggcttcggcgaaatcgtccgtatcctgctgctcaacaataccgaggtgaccggcggtccgaacggcatcagccagatcccgaaaccgaccttcttcggcctggagttcagccgtaccgcccgcgaaggcggctgggataccttcagcaacttctttggcatcaaatacgatccgtccgaccgcgtgatctggctctatctggtggcgctgctgctggtggtgattacgctgtttgtgatcaaccgtctgctgcgcatgccgctgggtcgcgcgtgggaagcgctgcgcgaagatgagatcgcctgccgctccctgggcctgaacccgacccgcatcaagctgaccgcatttaccatcagcgccgcgtttgccggtttcgccggaacgctgtttgccgcgcgtcagggcttcgtcagcccggaatcgttcacctttgccgaatcggccttcgtgctggcgattgtggtgctcggcggaatgggctcgcagttcgccgtgatcctcgcggctatcctgctggtggtctcccgcgagctgatgcgcgactttaacgaatacagcatgttaatgctgggtggtttgatggtgctgatgatgatctggcgtccgcagggtctcctgccgatgacccgtccacagctgaagctgaaacgcacacaggcgaaaggagagcaggcatga

SEQ ID NO: 3200 - DNA, 741 bp, Enterobacter cloacae
tccgcgcataccttggtgaggcataagatggaaaaagcgatgttaacgttcgacaaggtcaacgcgcactacggcaaaattcaggcgctgcacgatgtcagcctgcatatcaatcagggcgaaatcgtcaccctgattggggctaacggcgcgggcaaaaccacgctgctcggcaccctgtgcggcgacccgcgcgccaccagcgggcggattgtgtttgatggtaaagacatcaccgactggcagaccgccagaatcatgcgtgaagcggtggcgattgtcccggaagggcgtcgcgtattctcccgcatgacggtggaagagaatctggcgatgggcggtttcttcgcccaccgggatgaataccagacccgcatcaagtgggtgtacgaactcttcccgcgcctgtgggagcgtcgtattcagcgcgcgggcaccatgtccggcggcgagcaacagatgctggcgattggccgcgcgctgatgagccagccgcgtctgctgttgctggatgaaccgtcgctcggtcttgcgccaatcatcatccagcagattttcgacaccattgagcagctgcgcaaagaggggatgaccatcttcctcgtcgaacagaacgccaaccaggcgctgaagctcgctgaccgcggctatgtgctggagaacgggcgcgtggtgctctccgataccggcgatgcgctgctggcgaacgaagcggtgcggagcgcgtacctgggcggatag

SEQ ID NO: 3201 - DNA, 2205 bp, Enterobacter cloacae
aaaaacaggatgaataccatgtccgatcgtatttcgagagacgtgattaatgcgcttattgcgggtcactttgccgaccccttttctgtgctagggatgcaccgtacagaggccggactggaagttcgtgcgctgttaccggatgcaacagaagtgtgggttatcgaacccaaaaccggccgcaaggtgggtaatctggaatgcctcgactcgcgtggcttcttctcgggcgtcatgccccgccgtaaaaatccttttcgttatcagcttgccgttatctggcacggtcagcaaaacctgattgacgatccctatagcttcggcccgcttttaaaagagatggacgcctggctgctgtccgaagggacccatttacgcccttacgaaacgctgggtgcccatgcggataccatggacggtatcaccggcacgcgttttgccgtatgggcgccaaacgcccagcgcgtctccgttgtcgggcagttcaactactgggacggtcgtcgtcaccccatgcgcctgcgccgggaaaccggcatttgggagctgtttatccccggcgcgcacaacggtcagctctacaaattcgagatgatcgatgccaacggcaagctgcgcattaaatctgacccgtacgcctttgaggccgaactgcgcccgaataccgcctcgctgatttgcggcctgccggagaaggttgtccagacggaagagcgcaagcaggctaaccgctttgatgcgccgatctccgtctatgaagtgcatctcggctcgtggcgtcgccacaccgataacaacttctggctgagctatcgcgagctggcggaccagctggtgccgtacgccaaatggatgggctttacgcacctggaactgctgccgatcaacgagcacccgttcgacggcagctggggctatcagccaaccgggctgtatgcgcctacgcgccgctttggtacgcgcgatgacttccgctatttcatcgatgccgcgcacgccgccgggctgaacgtcatcctcgactgggtgccgggccacttcccgtcggatgattttgcgctggcagagttcgacggcacaaagctttacgagcacagcgacccgcgcgaaggctatcaccaggactggaacacgctgatctacaactacggtcgccgtgaagtatcgaactacctggtcgggaacgcgctgtactggatcgagcgtttcggcattgatgccctgcgcgtcgatgcggtggcgtcgatgatttaccgcgactacagccgcaaagagggtgagtggatcccgaacgagtatggcgggcgtgaaaacctcgaagcgattgagtttctgcgcaacaccaaccgcatcatcggggagcaggtggaaggtgccgtgaccatggcggaagagtccaccgacttcccgggcgtttcccgtccaccgtcaatgggcggactgggcttctggtacaagtggaacctcggctggatgcacgacacgctcgactacatgaagctcgacccggtttatcgtcagtatcaccacgataagctcactttcgggctgctctacaactacaccgaaaacttcatgctgccgctgtcgcacgatgaagtggtgcacggcaagaaatccattctcgaccgcatgccgggggacgcgtggcagaagtttgccaacctgcgcgcctactacggctggatgttcgccttcccgggcaaaaagctgctgtttatgggcaacgaatttgcgcaggggcgcgaatggaaccacgataccagccttgactggcatctgctggaaggcgcggacaactggcaccacggcgtacagcgtctggtccgtgacctgaacctgacctatcgccaccacaaagcgctgcacgagctggactttgatccgtacggctttgagtggctggtggtggacgaccacgagcgctcggtgtttgtctttgcgcgccgcgacaaggcgggtaacgagatcatcgtcgccagcaacttcacgccagtgccgcgtgaacactaccgcttcggcattaaccagccgggcaaatggcgcgaaattctcaataccgactccatgcactaccacggcagcaatgcgggtaacggcgggctggtgcagagcgatgccattgaaagccatggccgtccgaactccctgagcctgacgctgccgccgcttggcacaatctggctggtgcgggagggagaatga

SEQ ID NO: 3202 - DNA, 1647 bp, Enterobacter cloacae
tatcgattcggcagtcctgctgccggatgtctgggtagggcgctcatgtcgtctgcgtcgctgcgttatcgaccgtgcctgcgtcattcccgaagggatggtgattggggaaaatgcggaagaagatgcgcgtcgtttctaccgttcggaagaggggatcgtgttagtaacacgggaaatgttgcggaagctgcaaatcaaacaggagcgatgatgcaggttttacacgtatgttctgagatgttcccgttgttaaaaacgggcggactggcggatgttcttggtgcactaccggcggcgcaaattgccggaggggtggatacccgcgtgttgttgcccgcttttccggatatccggcgtggtattcccgatgcaaaggttgttacccgtcgcgagaccttcgcgggacgtatcaccctgctgtttggacattacaatggcacagggatttacctgattgatgccccgcatttatacgatcgacccggcagcccgtatcacgataccaacctgtacgcctataccgataacgtgctgcgctttgccctgctcggctgggtgggggcggagatggccgtcgggctggatccgttctggcgtccgaacgtggtgcacgcgcacgactggcacgcggggctggctcctgcgtatctggcggcgaaggggcacccggccaaatcggtgtttacggtgcacaacctggcgtatcagggcatgtattacgcgcatcatatgaatgacatcgatctgccatggtcgttctttaacatgcacgggctggagtttaacggacagatttctttcctgaaggcgggtctgtactacgccgaccatatcacggcggtcagcccaacctacgcgcgtgaaattacccagccggagttcggttacggtatggaagggctgctgcaacagcgccaccgtgaaggtcgtctgtcgggcattctgaacggcgtagatgaacagatctggaatccggaaacggacctcctgctggcggcgcgctatggacgcgactccgtggaggacaaagcggagaacaagcgccagctacagattgcgatggggctgaaggtcaacgacaaggtaccgctgtttgcggtggtcagccgcctgaccagccagaaagggctggatctggtgctggaagcgctgccgggattactggagcaaggtgggcaactggcgctgctcggcgcgggcgacccggtattgcaggaaggtttccttgcggccgcggcggaacatccggggcaggtgggcgtgcagattggctatcacgaagcgttctcgcaccgcatcatgggcggcgcggacgtgattctggtgccgagccgtttcgagccctgcggcctgacgcagctctatggtctgaaatacggcacgttgccgctggtacgccgcacgggcgggctggcggatacggtgtctgacagctccctggaaaacctggcggatggtatcgccagcgggtttgttttcgaggacagtaatgcctggtcgctgcttcgggcgatccggcgtgctttcgtcttgtggtcccgtccatccctgtggcgttacgtacaacgtcaggcgatgtccatggactttggctggcacgttgcggcgcagtcctaccgcgacctttatcaacgcttgatgtaa

SEQ ID NO: 3203 - DNA, 2466 bp, Enterobacter cloacae
cgaggcgaagttactgatatgaatgctccatttagctactcttcccccacgctcagcgttgaggcgttgaaacactccatcgcctataagctgatgtttaccattgggaaagatcccgttattgccaacaaacatgagtggctgaacgccacgctgtttgcggtgcgcgaccgtatggtcgaacgctggctgcgctccaaccgcgcccagctttcgcaggagacgcgacaggtgtattacctgtcgatggagtttctgattggtcgcaccctctccaatgcgctgttatcgctcgggatttatgacgacgtcaaaaacgcactggaagagatggggctggatttagaagagctgattgacgaagagaacgacccggggctgggtaacggtggtctcgggcgtcttgccgcctgcttcctcgattcactggcgacgctggcgctgccggggcgcggctacggtattcgctacgactacggcatgttcaagcagaacatcgtggatggccgtcagaaagagtccccggactactggctggagtacggtaacccgtgggagttcaagcgccacaacacgcgctacaaggtgcgttttggcgggcgtattcagcaggaaggtaaaaaatcccgctgggtggaaaccgaggagatcctggccgtggcctacgaccagatcatccccggctacgacaccgatgcgaccaatacgctgcgcctgtggaacgcgcaggccagtagcgagatcaacctgggtaaattcaaccagggcgactacttcgcggcggtggaagataaaaaccactctgagaacgtatcccgcgtcctgtatccggatgactcgacctactcaggccgcgagctgcgcctgcgtcaggagtatttcctcgtctcggcaacgattcaggatatccttagccgtcactatcagctgcacaaaacctatgcgaatctggcggaaaaaaccgctattcacctcaacgatacccatccggtgctgtcgatccctgagctgatgcgcctgctgattgacgagcataagttcagctgggatgacgcgtttgaagtaacctgccaggtgttctcgtacaccaaccatacgctgatgagtgaagcactggagacgtggccggtggatatgctcggcaaaattctgccgcgccatctgcaaatcatcttcgagatcaacgactacttcctcaagaccttgcaggagcagtacccgaacgataccggtctgctgagccgcgcctcgatcattgatgaatccaacgggcgtcgcgtacgcatggcctggctggcggtggtgatcagccacaaggtcaacggcgtatcagagctgcattcgaacctgatggtgcagtcgctgtttgcggacttcgcgaagatcttcccgacgcgtttctgcaacgtgaccaacggcgtcaccccgcgccgctggctggcgctggcgaaccagccgctctccgacgttctggatgagaacattggccgcacctggcgcaccgatttgagccagctgagcgagcttgagcagcacatcgatttcccgacggtgaacaaagcggtacgggaagccaagctgctgaacaagaagcgtctggcggtctggctggcgatgcatctgaacgtggtggcgaacccgaaagcgctgttcgacgtgcagatcaaacgtatccacgagtacaagcgtcagctgatgaatgtcctgcacgtcattacccactacaaccgcattaaggctgacccgacggcggagtgggtgccgcgtgtgaaaatctttgccggtaaggcggcctccgcgtattacatggcgaagcacatcattcatctcatcaacgatgtggcgaaggtggtgaaccacgatccggacattggcgataagctgaaggtagtgtttatcccgaactacagcgtaagcctggcgcagctgattattccggcggcggatctctctgagcagatttccacggcggggacggaagcatccggcaccagcaacatgaagtttgccctgaacggcgcgctgactatcggcacgctggacggcgcaaatgtcgaaatgctggagcatgtgggcgcggagaatatctttatcttcgggaatacggcggaagaggtggaggcgctgcgcaagcagggctactcgccgcgtgagtattatgaagaggatgaagagttacgccaggtgctgacgcaaatcgcaaccggagtgtttaaccctgaggagcctgggcgctatcgtgacctggtggactcgctgattaactttggcgatcactatcaggtgctggcggattaccgcagctacgtggattgtcaggataaggtggacgaactgtaccgtcagcaggagaagtggaccagcaccgcgatgcataacatcgccaacatgggctacttctcgtcagacaggaccatcaaagagtatgccgagaatatctggcatattgatccggtgcggttgtaa

SEQ ID NO: 3204 - DNA, 939 bp, Enterobacter cloacae
aaaggtttgcatatgtccgagcagtttctctactttttgcagcagatgtttaacggcgtcacgctgggaagcacttacgcgctgatcgccatcggctacacgatggtttacggcattatcggcatgattaacttcgcccacggcgaggtgtacatgatcggtagctacgtctcctttatgatcatcgccgcgctgatgatgatgggcatcgacagcagctggctgctggtagccgccgggtttgtcggcgcgattgtgatcgccagcgcctacggctggagtatcgaacgggtagcctaccgaccggtgcgcagctccaagcgcctgatcgcgctgatctccgccatcgggatgtccattttcctgcaaaactacgtcagcctgactgaaggttcacgcgacgtggcgctgccaagcctgtttaacggccagtggattgtgggggccagcgaaaacttctccgcctctgtcaccaccatgcagctggtaatctgggttgtgacctttattgcgatgctggccctgaccctgttcatccgctactcccgcatgggacgcgcctgccgcgcctgcgcggaagatctgaagatggcgagcctgctcgggattaacaccgaccgcgtgattgccctgaccttcgtgatcggcgcagcgatggcggcggtggctggcgtgttgctcggtcagttctacggcgtaatcaacccgtacatcggctttatggccgggatgaaagccttcaccgcggcggtactgggcggcatcggcagcattccgggcgcgatgatcggcggcctgattttgggcgtggccgaagcgctctcctctgcgtatctgagcaccgaatataaagatgtggtgtcgtttgccctgctaattctggttctgctggtgatgcctaccggtattctgggccgtccggaggtagagaaagtatga

SEQ ID NO: 3205 - DNA, 858 bp, Enterobacter cloacae
ggtgcgctaccaatgattgagaaccgtcgcgggctgacgattttcagccataccctgctaatcctgggcatcctcgtcatcctgttcccactgtacgtggccttcgtcgccgccacgctggacaccaaagcggtgttcgacacgccgatgacgctgatcccaggcacgcatctgttcgagaacatgaagactatctggacgcagggcgtgggcgctaacagcgcgccgttctggctgatgatgctcaacagtttcatcatggcgttcggcatcaccgtcggcaaaatcaccgtgtcgatgctttcggccttcgccatcgtctggttccgctttccgttgcgtaacctgtttttctggatgattttcatcaccctgatgctgccggtggaggtgcgtatcttcccgacggtggaggtgatcgccaacctgaagatgctcgacagctatgcgggcttgaccctgccgctgatggcctcggcgaccgccaccttcctgtttcgccagttctttatgaccctgccggatgagctgattgaagccgcgcgcattgacggggcctcgccgatgcgcttcttccgcgacatcgtgctgccgctgtcgaaaaccaatctcgcggcgctgtttgtgatcacctttatctacggctggaaccagtatctgtggccgctgctgatcgttcaggacgtcaacctcggcaccgccgtggcaggcatcaaaggcatgatcgccaccggcgaaggcaccaccctctggaaccaggtgatggcggcgatgctgctcacccttatcccacccgtagtcattgttttagccatgcagcgcgcgtttgtccgcggcctggtcgatagcgagaaataa

SEQ ID NO: 3206 - DNA, 756 bp, Enterobacter cloacae
aacaggacaacgagtatgagcaactggccttacccccacatcgtcgcccaccgtggcggcggtaaactggcgccggaaaacaccctggcggcaattgacgttggcgcacgctacggccacacgatgatcgagttcgacgccaagctctcgaaggacggcgaaattttcctgctgcacgacgacaacctcgaacgcaccagcaacggctggggcgtggcgggtgaactgccgtggcgtgacctgctgaaggtggacgccggaagctggttcagcggcgaattcaaaggcgaaccgctgccgctgctggcggaagtggcggaccgctgtcgtcaacacggcatgatggccaatattgaaatcaaaccgaccaccggcaccgggccgctgacgggtaaagtgattgccattgccgcgcgtgagctgtgggaagggatgaccgcgccgctgctgtcgtcgtttgatatcgacgcgctggaagccgcacaggccgccgttccggagttgccgcgcgggctgctgctggatgcgtggcgagaagactggcgcgcgctgacgacccgcttaggctgcgtgtcgatccacctcaaccataagctgctggatgaagcgcgcgtgacgctgttgaaggaggccggtctgcatatcctggtgtataccgtcaacaaaccccagcgtgcagccgagctgctgcgctggggcgtggacagcatctgtaccgatgcgattgaccagatcgggccgaactttatttattaa

SEQ ID NO: 3207 - DNA, 1782 bp, Enterobacter cloacae
gcggggaatatgggccccttcacctggagaacaataatgatgaaaccaacctttttgcgctgggtcgccatcgctgcgctgatggcaggcggcacatttaccgtggcggccaacccgcccgccgctccaccggtctcttacggcgtggaggaggatgtttttcaccccgtgcgggcgacgcacggcatggtggcctcggttgacgcgctggcaacgcaggtgggcgtcgatattcttaaacagggcggtaacgcggtggatgcggcggtcgcggtgggatatgcgctggcggtgacgcatccacaggcggggaacctgggcggcggcgggtttatgatgctgcgcacgaaagacggtaaaaccacagccatcgacttccgtgagatggcgccgaaccaggcctcccgcgatatgttcctcgacgatcagggcaacccggacagtaaaaaatccctgacctcgcaccttgcctccggcacgccgggcaccgttgcgggcttctcgctggcgctggaaaaatacggcacgctgccgctgaataaagtggtgcagcctgccatcaggctggcgcgcgacggcttcgtcgtcaacgacgcgctggcggacgacctcaaaacctacggcagcgaagttattcccaatcatgagaacagcaaggctatcttctggaaagacggcgagccgctgaagaagggcgataagctggtgcagaagaacctcgcaaaaagtctcgaactgattgccgaaaacggtccggatgccttctataaggggccgattgccgatcagattgcggatgagatgcagaagaacggcgggctgatcaccaaagcggatctggcggaatataaggcggtggagcgcgagccgattagcggcacctatcgcggctacgaggtcttctccatgccgccgccgtcttccgggggcattcacatcgtgcagatcctcaatattctggaaaacttcgatatgcacaagtatggcttcggtagcgccgatgccatgcaggtgatggccgaggcggaaaagcgcgcctacgctgaccgctcggaatacctcggcgacccggacttcgtgaaggtgccgtggcaggcgctgaccaacaaggcctatgccaaatcgattgccgatcagatcgacatcaacaaggctaagccgtcgagcgagatccgcccgggcaagctggcgccgtatgaaagtaaccagaccacccacttctcggtcgtggacaaagacggaaacgcggtggcggtgacctacacgcttaacaccaccttcggcaccgggattgtggcgggcaatagcggtattttgctgaacaacgagatggatgatttctctgccaaaccgggcgtgccgaacgtctacggcctggtcggcggcgatgcaaatgcagtagggccaaagaagcgtccgctatcatccatgtcgcccaccattgtggtgaaagacggcaaaacctggctggtgaccggcagccctggcgggagccggattatcaccaccgtactgcaaatggtggtgaacagcatcgactttgggatgaacgtcgccgaagcgaccaatgcgccgcgtttccatcaccagtggctgccggacgagttgcgcgtggagaagggctttagcccggacaccctcaagctgcttgagcagcgcgggcagaaggtggcggtgaaggaggcgatgggcagcacccagagcattatggtcggaccggatggcgcgctgtttggcgcgtcggacccgcgttcggtggatgatttaacggcggggtattga

SEQ ID NO: 3208 - DNA, 1041 bp, Enterobacter cloacae
gccatgacactacattgcgcatttattggatttggcaaaagcaccacgcgttaccaccttccgtatgttctcaaccgtaaagagacctggcacgtcgctcatatctaccgccgcagcgcgaagccggaagaacagtctccgcagtattcccatattcatttcaccagcgatcttgatgaagtgttaaatgatccgcaggtgaagctggtggtggtctgtacccacgccgacagccactttgactacgcgaaacgcgcgctggaagcaggtaaaaacgtgctggtggaaaaaccgttcactccgaccatcgccgaagcgaaggaactctttgcgctggcgaaaagcaaaggcctgaccgtcacgccgtaccagaaccgacgctttgacagctgcttcctgacggcgaaaaaggcgattgagagcggcaaactcggcgagatcgtggaaatcgaaagccacttcgattactaccgcccggtggcggaaacccagcccggactgccgcaggacgggtcgttctacggtctgggcgtgcacaccatggaccagattatttctctgtttggccgcccggaccacgtggcgtatgacatccgcagcctgcgcaataaggccaacccggacgatacctttgaagcacagctgttctacggcgatctcaaagccatcgtgaaaaccagccacctggtgaaaatcgactacccgaaatttatcgttcacggcaagaaaggctcctttatcaagtacggcattgaccagcaggagaccagcctgaaggccaatatcatgccgggtgaaccgggctttgcggcagatgattccgtgggcgtgctggagtacgtgaacgacgagggcgtgacggtcagggaagagctgaagccggaaacgggcgactatggacgcgtctatgatgcgctgtttgagaccctcacaaacggcacggcgaattacgtcaaggaatctgacgttctgaccaacctggaaatcctcgaacgggccttcgaacaggcttctcctgccacggtaaccctcgcgaaataa

SEQ ID NO: 3209 - DNA, 819 bp, Enterobacter cloacae
gcaaaaacggctcctctgcgcttgttcacaatttttgaacagaggagtcaattttcaccctctatgatcccagggcgtttgcgtccacacttactccatcgaaacgaactgagggtgaaaacaatgatctacttacgcaaagcaaacgaacgtggtcacgcgaatcatggctggctggactcatggcattcattctcgtttgccgactactacgacccgaacttcatgggcttctccgcactgcgcgtgattaacgatgacgtgattgatgcaggccagggcttcggtacccacccgcacaaagacatggaaatcctgacctatgtgctggaaggggcggttgagcaccaggacagcatgggcaacaaagagcaggttccggcgggcgagttccagattatgagcgcggggaccggggtgcgtcactctgagtacaacccgagcaaaacggaaaaactgcacctgtatcaaatctggatcattccagaagagaccggcatcacgccacgctacgagcagcgccgcttcgacgcgaaacagggcaaacagctggtgctctcgccggatgcgcgtgaaggttccctgaaagtgcatcaggatatggagctgtaccgctgggcgctggcgaaagatgaacagtctgtgcaccagatcgccgccaaccgccgcgtgtggatccaggtggtgaaaggggaggtgtccatcaatggcactaaagcgacaaccgccgatggtctggccgtctgggatgagcaggcgctctccgtgcatgccgacagcgaaagtgaaattctgctgtttgacctgccgccggtctaa

SEQ ID NO: 3210 - DNA, 1173 bp, Enterobacter cloacae
tgtgaagcatatcccagttcaatactggcttgcacaatcagcacacaccccttgcaggaaaaaaatgctatgaaaaacgttggttttatcggctggcgcggtatggtcggctctgtactcatgcaacgcatggttgaagagcgcgatttcgacgccatccgcccggtcttcttctccacttcccagctcggccaggctgcaccgtcctttgggggtaccacaggcacgttgcaggatgcttacgacctggaggcgctgaaggcactcgacattattgtgacctgccagggcggcgattataccaacgaaatctatccgaagctgcgtgaaagcggctggcagggctactggattgacgcggcctcttcgcttcgcatgaaagacgatgccatcattattcttgacccggttaaccagggcgtcatcaccgacggcctgaacaacggcgtgaaaacctttgttggcggtaactgcaccgtcagcctgatgctgatgtccctcggcggtctgttcgcacaggatctggtggagtgggtctccgtggcgacctaccaggcggcgtccggcggtggcgcgcgtcatatgcgcgagctgctgacccagatgggccagctgcaccagagcgtcgctgccgagctggcagacccggcgtccgcgatcctcgatatcgagcgtaaagtcactcagctcacccgcagcggcgagctgccggtggataacttcggcgtaccgctggccggcggcctgatcccgtggatagacaaacagctggataacggccagacccgcgaagagtggaagggccaggctgagaccaacaaaatcctcggcaccgcgaacaccattccggttgacggtctgtgcgtgcgtatcggcgcgctgcgctgccacagccaggccttcaccattaaactgaaaaaagatgtgtctattccgaccgtggaagagctgctggccgcgcataacccgtgggcgaaagtggtgccaaacgatcgcgatatcaccatgcgcgaactgaccccggcagccgtcaccggcacgctgaccaccccggttggccgcctgcgcaagctgaacatggggccggagtacctctccgcgttcaccgttggcgaccagcttctgtggggtgccgccgagccgctgcgccgcatgctgcgccagctggcgtaa

SEQ ID NO: 3211 - DNA, 1374 bp, Enterobacter cloacae
tccggttgttatggctgtctggcacgggcctgcgcacggagtgtgcgtattccaaagatgataaaaaaggagttagtcatggttagattagagaagaacgatccgttaatgttggcgcgccagctaccattaaaaacagttgccctgatactcgcgggcgggcgtggtacccgtctgaaagatttgaccatcaagcgcgctaaaccggccgttcactttggtggtaagttccgtattatcgattttgcactgtcaaactgcctgaactcaggcattcgccgtattggcgtcattacccaatatcagtcgcacacgctggtgcagcacattcagcgcggctggtcattcttcagcgaagagatgaacgagtttgtcgatctgctcccggcgcagcagcgcgttcacggggagaactggtaccgcggcacggcggatgccgtgacccaaaacctcgacatcattcgccgctacaacgcggaatacatcgttatcctcgccggggaccacatctacaagcaagattactcccacatgctgatcgaccacgtcgaaaaaggggcgcgctgcaccgtggcgtgcctgccggtgcctgttgcggaagcaaccgcgtttggcgtgatgcatgtagatggcgacgacaagattatcgactttgtcgaaaaaccggcgaacccgccaaccatgccgggagacgacaccaaatcgctcgccagcatggggatctatgtctttgacgccgattatctttatgaactgctggaagaggacgacaaagacgagaactccagtcacgacttcggcaaagacattatcccgaaaattaccaaagctggcatggcgtatgcacatcccttcccgctgtcctgcgtgcagtccgatccaaatgcggaaccttactggcgcgatgtgggaacgctggaagcgtactggaaagccaacctcgatcttgcgtccgtcacgcctgagctggatatgtacgaccagaactggccgattcgcacccatatggaatcgctgccgccggcgaagttcgtccaggaccgctccggcagccacggtatgacgctcaactcgctggtctctggcgggtgcattatctccggttcggtggtggtgcagtccgtgctgttcccgcgcgtgcgtataaactcattctgtaatatcgattcggcagtcctgctgccggatgtctgggtagggcgctcatgtcgtctgcgtcgctgcgttatcgaccgtgcctgcgtcattcccgaagggatggtgattggggaaaatgcggaagaagatgcgcgtcgtttctaccgttcggaagaggggatcgtgttagtaacacgggaaatgttgcggaagctgcaaatcaaacaggagcgatga

SEQ ID NO: 3212 - DNA, 258 bp, Enterobacter cloacae
cgcaggccaccgtggatcagcttggagctggcggacgacgtcgcgcaggcgagatcgttagcttccagcatcagcacggataaaccgcgtcctgcggcatcaaccgcaataccggcaccgttgatgccaccgcctatcacaatcagatctttggtttccataacaccctcatgcactttcgttaaagctcaaaaatgttcgatatcgctcataatagcaaaggaacgcgcttttggtaacatcaaaaaaacaatttag

SEQ ID NO: 3213 - DNA, 477 bp, Enterobacter cloacae
aggggcccatattccccgcttaagcctggttcacaactcttaaaaaatcatcgttatgcaggaatgaggataaacttaagagaagcctcaaaggaggagataaccatgaaacgattactgatcctgaccgcgctgcttccgttcgccgcgctcgcacagccaatcaacaccctgaacaacccgaaccagccgggctacgtcattccgagccagcagcgtatgcagacggagatgatgagccagcaacagcagcagaaagggatgctcaatcagcagttaaagacgcagacccaggtgcagcagcagcacctgcaaaaccagatgaataccaacacccagcgcgtacagcagggccagatgcttgaacagccgctgcctaatacaaacggtgggatgttaggaggcggagtatcgcaaagcagcggtcagcagcacatgctgccgacccagcagaacggcagtatgcttaataaataa

SEQ ID NO: 3214 - DNA, 318 bp, Enterobacter cloacae
tcgaccgcgcccgtctcgtgcaaaatcttgccaaacatcgcgcccagtgccaccacaatggccaggaagccgagcgtgccgcccatccctttttccatcgtcgccgcgattttgtcgagcggcatgccggaaaagagaccagcaccaatagaaaccaccatcaaagcaacgaaggcgtgcatacgtgccttcatcactaaaaacagcagcagcaatacggaacccactgctgtcaaaactagcgttaatgtactcaaaacttactgccttttattaataacctcgatggtgctggcaacaacaccttccagcggctga

SEQ ID NO: 3215 - DNA, 507 bp, Enterobacter cloacae
ctgactgaggcacaaggaatgagtgagatagtgatacgccacgctgaaccgaaagattacgacgccattcgtcagatccacgcccagccggaggtgtaccacaacacgctacaggttcctcatccttcaatggaaatgtggcaaatgcggctaggcgaacagccgggcattaaacagctggttgcctgcattgatgatatcgtggtaggccacctcaccattgatgtcgcccagcgaccacgccgcagccacgttgccgatttcggtatatgcgttggcgcagagtggcataaccgcggcgtggccagcgcgctgattcgcaccatgattgatatgtgcgacaactggctgcgcgtcgaccgcatcgagttaacggtgtttgtggataacgaaccggcaatcgcggtgtacaaaaagcacgggtttgagattgaaggcaccggcaggcgctatgccctgcgcaacggcgagtatgtggatgcgtattatatggcgcgaatgaagtag

SEQ ID NO: 3216 - DNA, 1536 bp, Enterobacter cloacae
gctttaacgaaagtgcatgagggtgttatggaaaccaaagatctgattgtgataggcggtggcatcaacggtgccggtattgcggttgatgccgcaggacgcggtttatccgtgctgatgctggaagctaacgatctcgcctgcgcgacgtcgtccgccagctccaagctgatccacggtggcctgcgctacctggaacactacgaattccgcctggtcagcgaagcgctggccgaacgcgaagtgctgctgaaaatggccccgcatctggcgatcccgatgcgcttccgcctgccccatcgcccgcatctgcgtccggcgtggatgatccgcatcggtctgtttatgtacgatcatctgggtaaacgcaccagcctgccgggttcaaccggtttgcgttttggctcagaatcggtccttaagcctgaaatcgtgcgcggtttcgaatattccgactgctgggtggacgatgcgcgtctggtactggctaacgcgcagatggtcgagaagaaaggcggcgaggtgaaaacccgcacccgcgccaccgccgcacgccgcgaaaacggcctgtggattgtggaagcggaagacgtggataccggcgagaagtttagctggaaagcgcgcggcctggtgaatgccaccggcccgtgggtgaaacagttcttcgatgacggtatgcacctgccttctccatacggcatccgcctgattaagggcagccacatcgtggtgccgcgcgtgcatacccagaaacaggcttatatcctgcaaaatgaagacaagcgcattgtgtttgtgatcccgtggatggacgagttctccatcatcggcaccaccgacgtggagtacaaaggcgatccgaaaaacgttgagatcgacgagagtgaagtcagctacctgttgaaagtgtacaacgcgcactttaagaaacagctggcgcgcgatgacgtggtctggacctactccggcgtgcgtccgctgtgtgatgacgagtctgactcaccgcaggccatcacccgtgactatacgcttgatattcacgacgttgacggtcaggcgccgctgctctccgtgtttggcggtaagctcaccacctaccgtaaactggcggagcacgcgctggagaaactggcgccgtattacaaaggcatcggcccggcgtggacgaaaggcgccgtgctgcctggcggcgatatcggcgataaccgcgacgattacgccgcgaagctgcgtcgccgcttcccgttcattaccgaaggcatggcgcgtcactacgcccgcacctacggcagcaacaccgaactgttcctcggcgacgcgaaagagattgccgatctgggcgagcattttggccatgagctatacgaagccgagctgcgctacctggtggaacacgagtgggtgcgccgtctggacgatgccatctggcgtcgtactaaagaagggatgtggctgaatgccgagcagcagtctcgcgtggcgcagtggctggcgcaacatgcgggaaagcgtgaattgtcgctggcgtcgtaa

SEQ ID NO: 3217 - DNA, 600 bp, Enterobacter cloacae
tttaagatgagtgaaatcatttccgcagcggttttattgatcctgattatggatccgctcggtaatctgccgatcttcatgtcggtgctgaagcacaccgagccgaagcgccgtcgggcgatcatgatccgcgagctgctcatcgccctgctggtgatgtttatcttcctgttcgccggtgaaaaaattctcgctttcctgaacttacgcgccgaaacggtctccatttccggcgggatcattttgttcctgattgccattaagatgattttcccgagcgcggagggcagcagcagcggcctgcctgcgggtgaagagccgtttatcgtgccgctggcgattccgctggtcgccgggccaacgattctggccacgctgatgctgctgtcgcatcagtatccgaatcagatgagccatctggtgattgccctgctgatcgcctggggcgggacgtttattatcctgttgcagtcgtcgctattcctgcgcctgctgggtgagaaaggggtgaacgcgctggagcgcctgatggggctgattctggtaatgatggcaacgcagatgttcctggacgggatacgggcgtggatgaaaggatag

SEQ ID NO: 3218 - DNA, 639 bp, Enterobacter cloacae
ggcctctcgcagcgctgttccttccagccgcctggtgaagacccttataatctcaacgacttgtattcagataagatatcgcactggattaagatgaaaacaatcgaagttgatgacgaactctatcagtatattgccagccagacgcggcatattggggagagcgcgtccgacattttacggcgcatgcttaaaatttccgccgcctcacagcccactcctgtcactaaagatgtcgtgtctcagccgagcgttgttgcacaagtaaaacctgccgtcatgccggcaaaggacaaagtgcgcgcgatgcgcgagctgctgctgtccgatgaatatgccgagcagaaaaaggccgttaaccgctttatgctggtgctgtctacactttactcactggataacaacgcatttgcagaagcgacagagtcgctgcacggtcgcacgcgcgtttatttcgcaggcgacgagcagaccttgctgcaaaatggcaaccaaaccaaacccaaacacgttcccggtacgccatactgggtgatcaccaataccaatacgggccgcaagtgcagcatgatcgaacatatcatgcagtccatgcagttcccggcggaattgatcgaaaaggtttgcggtacaatttaa

SEQ ID NO: 3219 - DNA, 1665 bp, Enterobacter cloacae
cccttgcatcagaaggaccaggcaatggcaaatcacagccgtgcaggacaacctgcgcaacaacgcgatttgattaacgtcgctcaactgaccgcgcagtactacgtgctgaaaccggtggtgggcaacgcacaacacgcagtgaagtttggtacatctggccaccgcggcagcgcggcgcgccacagctttaacgaaccgcacattctggccattgctcaggccatcgcggaagagcgcgccaaaaatggcgtcaccggtccgtgctatgtagggaaagatacccacgccctgtctgaacctgcttttatctccgtgctggaagtgctggcggcgaacggcgtagacgtgattgttcaggagaacaacggtttcacgccaacgcctgcggtgtctaacgctattctggtacacaacaaaaaaggtggcgcgcaggctgacggcattgtgatcaccccgtcccacaacccaccggaagatggcggcatcaagtacaacccaccaaacggtggcccggcggataccaacgtcacgaaagtggtggaagatcgcgccaacgcgttactggctaacggtctgaacggcgtgaagcgtatctcactggatgaagccatggcctccggccacgtgaaagagcaggatctggttcagccgttcgtggaagggctggcggatatcgtcgatatggccgctatccagaaagccggtctgaagctgggcgtggatccactgggcggctccggtattgaatactggaaacgcattgccgagcactacaagctggatctgaccatcgtgaacgatcacgtcgatcagaccttccgctttatgcacctggacaaagacggcgcgatccgtatggactgctcctccgaatgcgcaatggctggcctgctggcgctgcgcgacaagttcgatctggcgtttgctaacgacccggactacgaccgtcacggtatcgtcaccccggctgggctgatgaacccgaaccactacctggctgtggccattaattatctcttccagcaccgtccgcagtggggcaaagaggtcgcggtgggtaaaacgctggtctcttccgccatgattgaccgtgtggtcgatgcgctgggccgcaagctggtggaagtgccggtgggcttcaagtggtttgttgacggtctgcacgacggcagcttcggctttggcggtgaagagagcgcgggggcatccttcctgcgcttcgacggcaccccatggtcaaccgataaagacggcatcatcatgtgcctgctggcggcggaaatcaccgcggtcaccggtaagaacccgcaggaacattacaacgagctggcggaacgttttggtgcgccaagctataaccgtatccaggctggcgccacgtctgcgcaaaaagcagctctgtcaaaactctctccggagatggtcagcgccagcaccctggcaggtgacccgatcaccgcgcgtctgacggcggcaccgggtaacggcgcatccatcggcggcctgaaggtgatgaccgaaaacggctggttcgccgcgcgtccatccggtacggaagatgcgtacaaaatctatagcgaaagcttcctcggcgctgagcatcgtcagcagattgagaaagaagcggtagagattgtcagcgaagtgctgaaaaacgcgtaa

SEQ ID NO: 3220 - DNA, 303 bp, Enterobacter cloacae
gtagtaaaattacaaacaaagcggtattattttaaccaggtcacagatttcacattttccggagacggtttccggccaactacaggggagaaaaatatggatctttataaagagtttccggctcatatcattttcatgcgtcgcactttcgccgttgtggctggcgtgctggccctgccggtgatgctgttctggaaagatcgcgcacgtttctacagttacctgcatcgcgtctgggcgaaaaccagcgagaagccggtgtggatggatcaggccgagaaagcaacctgcgatttctactga

SEQ ID NO: 3221 - DNA, 1125 bp, Enterobacter cloacae
gccgcgcctgagcgtaccggcgggcagcgtggcgattggtggcgagcaaacgggaatttatccgctcgcttcaccgggaggctggcagctgattgggcacacgtccacgccgttattcgaaccaggccaggacgcgcccatactcctgcgtccgggggatacgctgcgctttatcccgcagaaggagggagtatgttaacgcttattcgcgcagggctttacacctcggtacaggatgccgggcgttttgggctgcgtcagtcgggcgtgagctactgcggtgcgcttgatcgtccctcgctggagattgccaacctgctggtaggtaacgcaggcagcacggcggcgttagaaattacgctgggtcagtgcgtgattgagtttggtcaggaagcctggtttgccttaaccggcgcgggctgtgacgcgacgctggacggcaaagcggtgtggaccggctggcgcctgcgggcgaaggccgggcagcgtctgacgctcaagcgtcctctgcacggcgtgcgtagctatcttgcggtagcgggggggatcgacgtgccggaggtgctgggctcatccagcaccgaccagaaagcgggaatgggcggccatgaaggacggctgctgcgcgacggcgatcgtctgcgaataaagacctcaacgcgccatttcaccaccacgcagggcgtgaaacagctgctgtgggggaacgtgatccgcgccttaccaggaccggaataccaggagtttgatgaagccgcgaaagagtctttctggcgctcgccgtggaagatcagcccgcagagtaaccgcatgggttaccggcttcagggacagccgctgacccgcacgactgaccgggagctgctttcccatggtctgttgccgggggtgattcaagtgccaggcaacggacagcccatcgtactgatgaacgatgcgcaaaccacgggaggatatccgcgtattgcctgcattatcgaagccgatcgctaccatctggcgcaaattcctctcggtcagccaattcattttgtgcagtgttcgctggaggaggcactgaaagcccggcaggatcagcagcgttatctcgaacagctggcgtggaggctcgatggtaaagattga

SEQ ID NO: 3222 - DNA, 501 bp, Enterobacter cloacae
catttggaagcaatgttttgcatgacgcgcagttatagaaaaggaacgctgtctgacccgcatcgcagtccggaggaaggaaacaataagaacagcatgtgggcgttattcatgataagaaatgtgaaaaaacaaagacctgtcaatctggatctcaaaacgatccgattccctgtaacagcaatagcgtccattctgcaccgtgtttctggtgtgattacgtttgtggcggtcggtatcttgctgtggttactgggaaccagcctctcatcccctgaaggattcctccaggcctcagccatcatgaacagcttcttcgtgaaatttatcatgtggggcattctgaccgcgctggcctatcacgtggttggtggcgttcgccatatgctgatggactttggctacctggaagagacgttcgaggccggtaaacgtaccgctaacatttcatttgtgatcactgtcgtgctttcacttctcgcaggagttctcgtatggtaa

SEQ ID NO: 3223 - DNA, 1434 bp, Enterobacter cloacae
tggacaattgccaggagttttatgcccacccatctggtttggtttcgcgcggatttacgcattcacgacaacttcgctctcgcggcggcctgccgcgctaaagacgcgaatgtgctggccctgtttatcgccacgcctgaacagtggcggcagcatgacatggcgccccggcaagcggcactgctcagcgcgtatctgaatgacctgcaacattcactggccgaaaaaggcattccgctgatctataaagaggcccatgattttgccgctcagcgtcagacggtgcaggcaatctgccagcagtacgcagtaacgcatctttattacaactatcagtatgaattcaacgagcagcagcgggatcgtcagctggagaaatcccttgcgggcgtggtctgtgaaggctttgatgacagcgtgatgctcgcgcctggcagcgtaatgaccggcagtcacgagatgtataaagttttcacgccgtttaaaaatgcctttatcaaacgcctgaaagagggactacctgagtgtgttaccgccccgtccgtgagaggggaaacgataacggatctgccggcgatcaggctgaattatccccagcagtcgttcgatgaaacagtattccccgccagcgagaaagcggctatcgcccggttgcgtcagttctgcgcgcagggggcggttgagtacgaggcgcgtcgggattttccagcgattgaaggcaccagccgcttgtcggcctgtctagcgctgggcgcgctctctccgcgccagtgtttacatcgcctgctggcggaacagcctcaggcgttagacgggggggcgggcgcagtgtggctgaacgaactgatctggcgtgagttctatcgccatctgatgacgtatcatcctgatttgtgtaaacatcggccctttattcgttggaccgaacaggtacagtggcagtcgaatgagaagctgcttaaggcatggcagcatgggcttaccggcttcccgattgttgatgcagctatgcggcagctcaatgaaaccgggtggatgcataaccgtctgcgtatgattaccgccagcttcctggtgaaggatctgcttatcgactggcgaaccggagagcgttattttatctctcagctgatcgatggcgatctggcggcgaataacggcggctggcagtgggcggcctccaccggaacggatgcggctccctattttcggatcttcaatccgaccacgcagggacaacgatttgacgccgacggcgagtttatccgccgctggctgcctgagcttaaggatgtcccggccaaagccattcatgaaccctgggtatgggcggataaacagcgtgttaccctgaactatccccgtcccattgtcgaccataaacaggcgcgcgtcgccacgctggcggcgtacgaagccgcccgaaaagtttga

SEQ ID NO: 3224 - DNA, 657 bp, Enterobacter cloacae
gtgcagcgagcgcgttgttatcttctgggtgaaaccgcagtggttctggaacttgagcctccggtgacgcttgccacgcaaaagcgtatctggcgtctggctcagcgactgcccgagctacccggcgtggttgaagctattccgggtatgaataatatcaccgtggtgctgcgtgatccgcacacgggggcgctggatgccattgagcgtctgcaacgctggtgggaggagagcgaggcgctggagccggaatcgcgcacgattgagatcccggttgtctatggcggcaagggaggccccgaccttggcgtggtggccgagcactgtggattaacggagaagcaggttgtggagctgcatagctcagtcgactatgttgtctggtttttgggatttcagccgggtttcccttatctgggcgggttatcgccccagctgcatacgccgcgccgggctgagccgcgcctgagcgtaccggcgggcagcgtggcgattggtggcgagcaaacgggaatttatccgctcgcttcaccgggaggctggcagctgattgggcacacgtccacgccgttattcgaaccaggccaggacgcgcccatactcctgcgtccgggggatacgctgcgctttatcccgcagaaggagggagtatgttaa

SEQ ID NO: 3225 - DNA, 792 bp, Enterobacter cloacae
aagcccggcaggatcagcagcgttatctcgaacagctggcgtggaggctcgatggtaaagattgatttaaacgccgatctgggagagggcagcagcgccgatgcggcgctgatgacgctggtctcctcggtgaatatcgcctgcgggtttcatgccggcgatgcgcagaccatgctggcgagcgtgcgcaatgccatgaaaaacggcgtggcgataggcgctcaccccagctttccggaccgggaaaactttggccgcacggcgatggatctgccgcctgagacggtttacgcgcaaatgctctaccagatcggcgcgctggaggcgatagtgcgcgctgagaatggcgtgttgcgccacgtcaagccgcacggcatgctctataaccaggcggcgaaagatccggtgctggcggatgccattgcccgcgcggtgcgggactgcaatccgcgtctggtgctggtgggcctggcgggcagcgagcttattcgtgccggcgaacggctggggctgagcacgcggcaggaagtgtttgccgatcggggatacctgccggacggcagcctggttccgcgcacgcgggccggtgcgctgatcaccgacgaaggtaaagcgctggcgcagacgctggagatggtgcgcttcgggcgagtaacctcaacggagggtacaacggcaaacgttcaggctgatacggtgtgcttacacggtgacggcgagcatgcgctccagtttgcgcgacgcctgcgggcggcgttctcggaagagggcattgttgtcagcgcagaataa

SEQ ID NO: 3226 - DNA, 804 bp, Enterobacter cloacae
aaggacaataacatgccagaaggtccggagatccgccgcgcggcggatagcctggaggcggcgataaagggcaaacctctgacacacgtctggtttgcctttcctcaactcaagccgtttgaatcgcagctggtggggcagacggtgacccacattgaaacgcgcggcaaagcgttactcacccacttttcccataacctgacgttatacagccataatcagctttacggcgtctggcgggtggtggaggcggacgagcagccgcaaacgacccgcgtgctgcgagtgcggctacaaacggcggataaggcgatcctgctctacagcgcctctgatatcgaaatgttaacgccagagcagttgctcacgcatccgttcttacagcgggttgggccggacgtgctggatatgcgcctgacggcgagcgatgtgaagacccgactgctatcgcccacattccgcaaccggcagttttccgggctgttgctcgatcaggcatttctggcagggctgggaaactacctgcgggtggagatcctctgggaagtcgggctggcaccgcagcacaaagcgtcgcagttgagcgatgaacagcttgaggcgctgtcccacgcgctgctggacatcccgcggctgtcgtacaacacgcgcggcatggtggatgagaacaagcatcacggggcgctgttccggttcaaggtgtttcatcgggcggggaagaagtgcgagcggtgcggcgggattatcgacaggattatgctctcttcgagacccttttactggtgtccacattgtcaaaaataa

SEQ ID NO: 3227 - DNA, 1860 bp, Enterobacter cloacae
accgctggcgattcgccttccgctgcaactgattattgttgttgctctgctggtttacgtcatttatggatttgttgtggtgtggggtgtgtaatgaaactgccagtcagagaatttgatgctgttgtgattggtgcgggtggcgcaggtatgcgcgccgcactgcaaatttcccagagcggccagacctgtgcgctgctctctaaagtattcccgacccgttcccacacagtgtctgcgcagggcggtatcaccgttgcgctgggtaattcccatgaagataactgggaatggcacatgtacgatacggtaaaaggttccgattacatcggtgaccaggatgccatcgaatatatgtgtaaaaccggcccggaagcgattctggagctggaccacatgggtctgccgttctcccgtctggaaaatggcaccatctatcagcgtccgtttggcggccagtcgaaaaacttcggcggcgagcaggcggcacgtaccgcagcggcggctgaccgtaccggccacgcgctgctgcacacgttatatcagcagaacctgaaaaaccacaccaccatcttctccgagtggtatgcgctggatctggtgaaaaacgccgatggcgccgtggtgggttgtaccgccctgtgcatcgaaactggtgaagtggtctacttcaaagcccgcgctacggtgctggcgaccggcggtgcaggccgtatttaccagtccaccaccaacgcccacatcaacaccggtgacggtgtcggtatggctatccgcgcgggcgtgccggtgcaggacatggagatgtggcagttccacccaaccggtatcgccggtgcgggcgtactggtgacagaaggctgccgtggtgaaggtggctacctgctgaacaaacatggcgagcgcttcatggagcgttatgcgccaaacgcgaaagacctggcgggccgtgacgtggtggcgcgttccatcatgatcgaaattcgtgaaggccgcggctgtgacggcccttggggtccacacgcgaagctgaaactcgaccatctgggtaaagaagtgctggaatcccgtctgccgggcattctggagctgtcccgcaccttcgcgcacgtcgacccggtgaaagagccaattccggttatcccaacctgtcactacatgatgggcggtattccgaccaaagtgaccggtcaggcgctgaccgtgaacgagcagggcgaagacgtggtcatcccaggcctgttcgcggtaggcgaaatagcctgcgtatccgtgcacggcgcaaaccgtctgggcggcaactccctgctggacctggtggtatttggtcgtgcggtggggctgcatctccaggaatctattgccgagcagggcgcgctgcgtgatgcgaccgacgacgaaatcgatgcctctcttgagcgcctcaaccgctggaacggcaaccgtaacggcgaagatccggtggaaattcgtaaagcgctgcaagagtgtatgcagcacaacttctcggtattccgtgaaggcgacgcgatggccaaagggcttgagcagctgaaagcgattcgcgagcgtctgaagaatgcccgtctggacgatacctccagcgagttcaacacccagcgcgttgagtgccttgagctggataacctgatggaaaccgcgttcgccactgcaatgtcggcaaacttccgtaccgaaagccgtggcgcccatagccgcttcgacttcccggatcgtgatgacgaaaactggctgtgccattccctgtatctgccagagtcggaaaccatgacgcgtcgtagcgttaatatggaaccgaaactgcgtccggcgttcccgccgaagattcgtacttactaa

SEQ ID NO: 3228 - DNA, 732 bp, Enterobacter cloacae
tgcggagacaggataatgaaactcgaattctcagtttatcgttataacccggatgtagacgatgctccgcgtatgcaggattacaccctcgaagcggaagaaggtcgcgacatgatgctgctggatgccttaatccagctgaaagagaaagatcctacgctgtcgttccgccgctcctgccgtgaaggggtgtgtggttctgacggtgtgaacatgaacggcaaaaatggcctggcctgcatcacgccaatttctgcgctaaaccgccctggccagaaaattgttatccgtcctctgcctggcctgccggtcgtgcgtgatttggtggtggacatggggcaattctatgcacaatatgagaagattaagccttacttattgaataatgggcaaaatccacccgctcgcgagcacttacagtctcctgagcagcgtgaaaaactcgatgggttgtacgagtgtattctctgtgcatgctgttcaacgtcatgcccgtcgttctggtggaatccggataaatttatcggccctgcgggtctgctggctgcctatcgcttcctgatcgacagccgcgataccgaaaccgagaatcgtctggaagggctaagtgacgctttcagcgtattccgctgccatagcatcatgaactgcgtcagtgtgtgtcctaaggggctgaacccaacgcgcgccatcggccatattaagtcgatgttgttgcagcgcagtgcgtaa

SEQ ID NO: 3229 - DNA, 1260 bp, Enterobacter cloacae
cgcgctgaacgtcgattaattaaaggatacataatgagtagcgtagatattcttgttcccgacctgcctgagtccgtagcagatgcaaccgtcgccacctggcacaaaaaaccaggcgacgcggtaacccgtgacgaagtgctggtagaaatcgaaactgacaaagtggtactggaagtaccggcttcagcggatggcattctggatgcagtcctggaagatgaaggtacgaccgtcacttctcgccagatcctgggtcgcctgcgtgaaggtaacagcgcgggcaaagagtccagcgccaaatctgaagaaaaagcgtctaccccggcccagcgccagcaggcgtctctgtccgatcagaccaacgacgcgctcagcccggcgatccgtcgcctgctggctgagcacagcctcgatccggcagccatcaaaggcaccggcgtgggtggccgtctgacgcgcgaagacatcgacaagcatctggcaaaagcgccttctgaggcgaaagcggaagcgaaagcccctgcggcagcaccagcggcacagcccgctctgggcgcacgtagcgaaaaacgcgtgccaatgacccgcctgcgtaagcgcgtggccgagcgtctgctggaagcgaaaaattccaccgcgatgctgactaccttcaacgaagtcaacatgaaaccaatcatggacctgcgcaagcagtacggtgacgcgtttgaaaaacgtcacggtatccgtctgggcttcatgtccttctacgtgaaagcggtagttgaagcgctgaaacgctacccggaagtgaacgcgtctatcgatggcgatgacgtggtttaccacaactacttcgatgtcagcatggcggtttctactccacgcggcctggtgaccccggttctgcgtgacgtagataccctgggtatggctgacattgagaagaaaatcaaagagctggccgtgaaaggccgcgacggcaagctgaccgttgaggacctgaccggcggtaacttcaccattaccaacggcggcgtgttcggctcgctgatgtctaccccgatcatcaacccgccgcagagcgcgatcctgggtatgcacgccattaaagatcgtccaatggcggtagacggtaaagtggagatcctgccgatgatgtacctggcgctctcttacgatcaccgcctgatcgacggccgcgagtccgtaggcttcctggttgccattaaagagctgctggaagatccaacgcgtctgctgctggacgtctag

SEQ ID NO: 3230 - DNA, 948 bp, Enterobacter cloacae
cagcggcctgaatattattgcagcgaaaagtctgacggatgcagctcagcaggttgttgccgcagtggaggggaaataatgtctgttttaattaataaagataccaaggttatctgccagggcttcaccggtagccaggggactttccactccgaacaggcaattgcctacggtacgcagatggtaggcggcgtaacgccaggtaaaggcggcaccacccacctgggcctgccggtgttcaacaccgtgcgtgaagccgtagaagcgacgggcgcaaccgcgaccgtgatctacgttccggcgccgttctgcaaagactctattctggaagcgatcgacgcaggcattaagctgatcatcaccatcaccgaaggtatcccgacgctggatatgctgaccgtgaaggtgaagctggacgaagcaggcgtgcgcatgatcggcccgaactgcccaggcgttatcaccccgggcgaatgcaaaatcggcatcatgccgggccacattcatcgcccaggcaaagtgggcattgtgtcccgttccggtaccctgacctatgaagcggttaagcagaccaccgactacggtttcggccagtccacctgcgtgggcatcggcggtgacccgatcccgggctctaacttcatcgacatcctgaagctgttccaggaagatccacagaccgaagcgatcgtgatgatcggtgagatcggtggtagcgcggaagaagaagcggctgcttacatcaaagatcatgtgaccaagccggtggtgggttacatcgcgggtgtgaccgcgccgaaaggcaaacgtatgggtcacgcgggcgcgattatcgcaggcggtaaaggtacggctgatgagaaattcgcagcactggaagccgcaggcgtgaaaaccgttcgcagcctggcggatatcggtgaagcactgaaatccatcattaagtaa

SEQ ID NO: 3231 - DNA, 1686 bp, Enterobacter cloacae
caggaaacgaagatgaaagctgtatctcgcgttcatatcacgccacatatgcactgggaccgggagtggtacttcaccaccgaagcgtcacgtattcttctggtcaataatatggaagagatccttacccgtcttgagcaggacgcagagtataaatactacgttctcgacggccagacggcggtgctggaagattattttgccgtgaaaccggaaaacaggccacgcgtgaaggcgctggtggcggccgggaagctgattatcgggccgtggtatacccagacggacaccacccttgtctccggcgagtcgattgtccgaaatctgatgtacggcattcgcgactgtctggcctttggcgagccgatgaaaattggctatctgccggactccttcggcatgtcttcccagctgccacacatttacaacggttttggcatcacgcgcaccatgttctggcgcgggtgttccgagcggcatggtaccgataaaaccgaatttctctggcaaagtcaggacggcagtgaagtgacggcacaggtgctaccgctgggctacgcgattggtaagtacttaccggaggatgaggccgggctgcgcaaacggctcgacacgtacttcgaggtgctggaaaaagcctccgtgacgaaagaaattttgctgcctaacggccatgatcagatgccgctccagcagaacatctttgcggtgatggataagctgcgcgaaatctatccgcagcgtcagtttgtgatgagccgcttcgaggaggtgtttgaccacattgacgcgcaccgcgatgaactggcgacgctgaaaggggagtttattgacggtaaatatatgcgggtgcaccggacaataggctccacgcgaatggacatcaaaatcgcccacgcccggatagagaataaaatcgtcaatgtccttgagccgctggccacgcttgcctggacgctgggctttgagtatcaccacggcttgctggaaaaaatgtggaaagagatcctcaagaatcacgcccatgacagtatcggctgctgctgtagtgacaaagtgcatcgtgaggtgatgtcacgcttcgagctggcggaagacatggccgataacctgacatgcttctatatgcgcaagattgtcgacaacatgccgcagtgcgaggaagacaaactggtgatgtttaacctcacgccctggccgcgtgaggaagtgattaacactacgatacgtctgcgcgccagccagttccgcctgctggacgatagggggaatgaaatcccttactgcctgcgcagcgcgcgtgaaatcgaccccggcttaatagaccggcagattgtgcattacggcaactacgatccctttatggagtttgatatccagctcaaccagatcctgccatcaatgggttaccgcacgctctatatcgagccgcacgtggctggcaagctgctggcgccagaaacaacgtcggaggcattactggaaaatgctttctgggaaataacgttaaacgacgacggcaccctgcgtctgctcgataaagcgtccgggcttatctatgaccgcgcgctggaaatagaagagagctcggatgatggcgatgagtacgactactcgccttcacgggaagagtggagactcacttccgcgcaggcgtattttaccacacggccgcgatccagcaga

SEQ ID NO: 3232 - DNA, 834 bp, Enterobacter cloacae
actatccccgtcccattgtcgaccataaacaggcgcgcgtcgccacgctggcggcgtacgaagccgcccgaaaagtttgagagaatgatgatgaaaaacagtgaactggaacgcctgattaacgaaaaactcaacacggcttcgtttagcgactacggcccgaatggcttgcaggtggaggggcgcgagacggtgcaaaaaattatcaccggcgtgacggcaagccaggcgctgctggatgaggcggtgcgtcaggaagccgatgcggtgattgtccaccacggttatttctggaaaaacgaatcaccgattattcgcggcatgaagcgcaaccgactcaaaacgctgctggcgaatgacatcaacctgtacggctatcacctgccgctcgatgcgcatcctgagctggggaacaacgttcagcttgcgcaactgctggggattaccgtgatgggtgaaattgaacccctggtgccgtggggcgaactgtcgatgccggttccgggtctggagctggcctcgtggatcgaagcgcgcctggggcgtcgtccgctgtggtgcggcgacaccgggccggataccgtgaagcgcgtggcatggtgcaccggcggcggccagggctttattgacagcgcggcgcgttttggtgtcgacgccttcattaccggcgaagtctccgagcagactatccactcagcccgtgaacaaggcctgcatttttacgcggcgggccatcacgccaccgagcgtggcggcatccgcgccctcagcgagtggctgacggaaaataccgatctggatgtgacgtttattgatatccctaatccggcctga

SEQ ID NO: 3233 - DNA, 399 bp, Enterobacter cloacae
catttcatttgtgatcactgtcgtgctttcacttctcgcaggagttctcgtatggtaagcaacgcctccgcattaggacgcaacggcgtacatgacttcatcctggtccgtgctaccgccatcgttctcaccctttacatcatctatatgatcggtttcttcgcgaccagcgggacgctgacgtgggaaatctggagtggtttcttcggatcggccttcaccaaagtgttcaccctgctggccctgttctccatccttattcatgcctggattggcatgtggcaggtgttgaccgattacgttaaaccgctggcgattcgccttccgctgcaactgattattgttgttgctctgctggtttacgtcatttatggatttgttgtggtgtggggtgtgtaa

SEQ ID NO: 3234 - DNA, 2817 bp, Enterobacter cloacae
gggatcacgatgcagaacggcgcaatgaaagcctggctggactcttcttacctctctggttcaaaccagagctggatagaacagctctatgaagacttcttaaccgatcctgactcagtggacgcaaactggcgttccatgttccagcagttgcctggtacaggggtcaaaccggatcaattccattcaaaaacacgtgattatttccgtcgtctggcgaaggatgcctcacgttactcttctgcgatttccgaccctgacactaatgcgaagcaggtaaaagtcctgcaacttatcaacgcttatcgcttccgtggtcaccagcatgcgaatctcgatccgctgggactgtggcagcaggaacgtgtagcggatctcgatccggcttatcacgatctgaccgaggccgatttccaggaaagctttaacgtaggttcttttgccatcggcaaagacacgatgaagctgggcgatctgattgacgcgctcaagcaaacctactgcggctccatcggcgcggaatatatgcacattacctccaccgaagagaaacgctggatccagcagcgtatcgaatccgtggcaggccacgcgaatttctcagcagaagagaaaaaacgtttcctcagcgaactgaccgcagcggaaggccttgagcgctatctgggcgcgaaattccctggcgcaaaacgcttctcactggagggcggcgatgcgttagtcccgatgctgaaagagctgattcgtcatgccggtaagagcggtacgcgcgaagtggtgctgggcatggcgcaccgtggacgccttaacgtgctggttaacgtgctgggtaaaaagccgcaggatctgttcgacgaatttgcgggtaaacataaagagcacctcggcaccggtgacgtgaagtaccacatgggcttctcgtctgatatcgaaaccgagggcggtcaggttcacctggcgctggcatttaacccgtcgcacctggaaatcgttagcccggtggttatcggttccgtgcgtgcgcgtctggatcgtctggacgagccgagcagcaataaagtgctgccaatcaccattcacggtgatgcggcggtcacagggcagggcgtggttcaggaaaccctgaacatgtcgaaagcgcgtggttatgaagtgggcggtaccgttcgcatcgtaatcaacaaccaggtgggcttcaccacctctaacccgctggatgcgcgttccaccccgtactgcaccgacatcggtaaaatggttcaggcgccaattttccacgttaacgcggatgaccctgaagccgttgctttcgttacccgtctggcgctggacttccgtaacaccttcaagcgcgacgtgttcattgacctcttctgctaccgccgtcacggccacaacgaagcggatgagccaagtgcaacccagccgctgatgtaccagaaaatcaaaaaacatccgacgccgcgtaaaatctatgctgacaagctggaaagcgaaaaagtggcgacgctggaagatgcgaccgaaatggtcaatctttatcgcgacgcgctggacgcgggtgaatgcgtggtcaaagagctgcgtccaatgaacatgcactcctttacctggtcgccgtacctcaaccacgagtgggacgagagctacccgaacaaggttgagatgaagcgtttgcaggagctggctaaacgcatcagcaccgtgccggaagcgatcgagatgcagtcccgcgtggccaagatctatggcgatcgccaggccatggcggcgggtgagaagctgttcgactggggcggggcggaaacgctggcctatgcgacgctggttgacgaaggtattccggttcgtctgtccggtgaagatgcgggtcgtggcaccttcttccaccgtcacgcggttgtacacaaccagtctaacggttcaacgtatactccgcttcagcacgtgcataacggtcagggccagttcaaggtctgggactccgtgctgtcagaagaagcggttctggccttcgaatacggctatgccaccgcagaaccccgcaccctgactatctgggaagcgcagttcggtgacttcgccaacggtgcgcaggtggttatcgaccagttcatctcctccggtgagcagaagtggggccgtatgtgcggtctggtgatgctgctgccgcacggctatgaaggacaagggccggagcactcctccgcgcgtctggagcgttatctgcaactctgcgccgagcagaacatgcaggtttgcgtgccgtccactccggctcaggtttaccacatgctgcgtcgtcaggcgctgcgcggtatgcgccgtccgctggtagtcatgtcgccaaaatccctgctgcgccatccactggcggtctccagcctggaagagctggcaaacggcaccttcctgccggccatcggtgaaattgacgagctggatccgcaggccgttaagcgtgtcgtaatgtgttctggtaaggtttattacgacctgctggaacagcgccgtaagaacgatcagaaagatgtcgccatcgtgcgtatcgagcagctttatccgttcccgcatcaggcgatgcaggaagtgctgaaacagtacgctcacgttcatgattttgtctggtgccaggaagagccgctcaaccagggcgcatggtattgcagccagcatcatttccgtgaagtgattccatttgggtctgccctgcgttatgcaggtcgcccggcctccgcctctccggcggtagggtatatgtccgttcaccagaagcagcaacaagatctggtcaatgacgcgctgaacgtcgattaa

SEQ ID NO: 3235 - DNA, 1194 bp, Enterobacter cloacae
cgattacctgaaggatggatagaacacatgaacttacatgaatatcaggccaaacagctgtttgcccggtatggcttaccggctccggtgggttatgcctgtactaccccgcgtgaagcagaagaagccgcgtctaaaatcggtgccggcccgtgggtagttaaatgtcaggttcacgctggtggccgtggtaaagcgggcggtgtgaaggttgttaagagcaaagaagagatccgtgcgtttgctgaacattggctcggcaagcgtctggtaacctaccagacagatgcgaacggccagccggttaaccagatcctggttgaagcggcgaccgacatcgcgaaagaactgtacctcggcgcagtcgtagaccgtagctcccgtcgcgtggtgttcatggcgtctaccgaaggcggtgtggaaatcgaaaaagtggcggaagagaccccgcacctgatccacaaagtggctatcgatccgctggcgggcccaatgccttaccagggtcgtgagctggcgttcaaactgggtctggaaggcaagctggttcagcagttcaccaagatcttcatgggtctggcgaccatcttcctggagcgcgatctggcgctgatcgagatcaacccgctggtgatcaccacccagggcgacctgatctgcctcgacggcaagctgggcgctgacggcaacgcgctgttccgccagtccgatctgcgcgaaatgcgcgaccagtctcaggaagatccgcgtgaagcgcaggctgcacagtgggaactgaactacgtggcgctggatggcaacatcggctgcatggttaacggtgcgggcctggcaatgggcaccatggacatcgttaagctgcacggcggtgagccagcgaacttcctcgacgtgggcggtggcgcaaccaaagagcgcgtaaccgaagcgttcaaaatcattctctctgacagcaacgtgaaagcggttctggtgaacatcttcggcggtatcgtacgttgcgacctgatcgccgacggtatcatcggcgcggtagaagaagtgggcgttaacgttccggttgttgtacgtctggaagggaacaacgctgaactcggcgcgaaaaaactggctgacagcggcctgaatattattgcagcgaaaagtctgacggatgcagctcagcaggttgttgccgcagtggaggggaaataa

SEQ ID NO: 3236 - DNA, 1929 bp, Enterobacter cloacae
gggaggatctttatgaacctgacgactctgaccgacccccgtgctgtctgcgtgcaggcgcagtttaccagccgtgatgaggcaatccgtcagcttgcgacgcggctggtagcgttgggcaaaatagccgacgccgatacgtttctggcagaggttttccatcgcgaatcgcttggcccgacggcgctgggcgagggactggccgtacctcatggtaaatcagcggcggtaaaggaagcggcttttgccgtggccacactgtgtgagccgctggcctgggaaggcgtggacggaccggaggaggtcgagctgatttttttgctcgccattcctcccgcacaagcggggtcaacgcatattcaggtcctgacggaactgacgtctcgcctggcggatgacgatctcaggggccgcgtgatgacggcgaccagcgctgaagcggtgcttgcggcgctggaaacggcgcctgacgcgcaagaaaccgccgttgcggagaatgccccgacgatcgtctgcgttaccgcctgtccggccgggatcgcccatacctacatggcagcggaatatctcgaaaaagcgggacgaaagctcggcgtcaatgtggtggtcgaaaagcagggggcaaacggtattgaggggcgcatcaccgcgcagcagttgcaggaggcaaaagcgtgtatcttcgcggcggaagtggcgattaaagagcgcgagcgttttcaggggatccctgccatttccgtgcccgtcgcggaacccttgcgccatgcggaagcgctcattgagcgtgcgctggcgctacagcctgtatccgatgcgcgtcctgcgcacgtcgacacggacgcgaaaaagtgcgttaaaaccgaactcaagcaggcgctgctcagcggtatctcctttgcggtgccgctgattgtcgctggcggcacggtgctggccgtgtcggtactgctggcgcaaatcctgggcttgcagcatctgttcgatcaggaaaattcgtggctgtggatgtaccgcaaactgggcggcgggatgctcggtattctgatggtgcctgttctggcggcctacaccgcttactcgctggcggataaacctgcgctaacgccaggctttgcggcgggtcttgccgccaatatgatcggctccggctttctgggggccatcgtcggcgggctgattgcgggctacctgatgcgctgggtgaaaaaccacatccggctgagtagccgctacaacggctttctgaccttttatctttatccggtgattggcgtgctgggcgcaggcagcctgatgctgtttgtgatcggcgaaccggtggcctggatcaataacgccctcaccgcctggcttaacggtctgtccggcgcgaacgcgctgctgctgggggcgatcctgggctttatgtgctcgttcgatctgggcggtccggtcaacaaagcctcttacgcgttctgtctgggggcgatggccaatggcgtatacgggccttatgcgatttttgcctccgtcaaaatggtatcggcctttaccgtgacggcatcaacgatgctggctccgaacctgttcaaacagttcgaaattgaaaccggcaagtccacctggctgctggggctggcgggcatcaccgaaggagcaattccgatggctatcgaggatccgttgcgggtcatcggctcatttgttctggggtcaatggcgaccggagcgattgtcggggcgatggggattgggctatccaccccgggcgcgggcattttctctctcttcttactgcatgatgccgggctgggtggcgtgatggccgctgccggctggtttggcgccgcgctgattggcgccgcaatctctacgctcattttactcctctggcgacgccaggccgtgaagagcggcgcctacgtgactgaagacataacatcctaa

SEQ ID NO: 3237 - DNA, 1695 bp, Enterobacter cloacae
tgcggaggcattctgatggctgctcaggcgtttttgcttattgccagctttttactggtactgtttgtgttcgccaggccgctgggaacagcgctggcgcggctgataaacaacgtgccattgccgggcacgcgaaatattgaaaatgtgctctggcgcatttcaggtatcagcgaccgggaaatgaactggcgccaatacctgatggcgatactgcttctgaatatcgtggggctaattgccctctttacgctgctgatgctccagggcagtctgccgttgaacccgcagcagttaccgggtttatcctggcatctggcgctgaacacggcggtcagctttgtcaccaacaccaactggcagtcttacgccggtgaaaccacgctcagctacttcagccagatggccgggttaaccgtgcagaactttctttctgcggccagcggtatcgcggtgatcttcgccctgacgcgcgcgtttgcccgtcagaatgtcagcactctcggcaacgcctgggttgatgtcacacgcatcaccctttggatcctggtgcctgttgcgctgattattgccctgttctttattcagcaaggcactctgcaaaacctgctgccttatacccctttcacctcgcttgaaggggccagggaactcctgccaatggggccggtggcgtcgcaggaagcaatcaagatgctgggcaccaatgggggcggcttcttcaacgccaattcatcgcatccgtttgaaaacccaacggcgttaaccaattttgtacaaatgctggcaatcttcctgatccccaccgcgctctgcttcgcctttggcgatgtagttaacgatcgccgccagggccgtacgctgctgtgggccatgtcgttaatcttcgtggtctgcgtagcactggtgatgtgggccgaatggtacggcaacagccactttatgcagctgggggctaacagcaatatcaacctggaaggcaaagagagccgcttcggcattcttgccagcagtctctatgcggtggtcaccacggcggcctcctgcggggcggtgaacgccatgcatgactctttcaccgcgcttggcggcatgatcccgatgtggctgatgcagattggcgaggtagttttcggtggggtcggttcggggctgtacggcatgctgttgttcgtcctgctcgccgtgtttatcgccgggctgatgatcggccgcacgccggaatatctcggcaaaaaaatcgacgtccgcgaaatgaaattaaccgcgctggcgatcctggtcacccccgcccttgtgctgctcggtaccgccctggcgctgatgaccgacgtcgggcgcagcggcatctttaacccgggcattcacggctttagcgaagtgctttacgccgtttcgtctgccgcaaacaacaacggcagcgcctttgcagggttaagcgccaactcaccgttctggaactgtctgctggcgttctgcatgttcgtcggtcgtttcggcgtgattattcccgtcatggcgatcgccggaacactggtgaataagaagatccagccgaccaccaccggtacgttaccgactcacggcgcgctgttcgtcggcctgctgattggcaccgttctgctggtaggtgccctgacctttatccccgccctcgcgttaggcccggttgcggaatatctctctttacgctga

SEQ ID NO: 3238 - DNA, 2067 bp, Enterobacter cloacae
ttttgcggagaatttttcatgagtcgtaaacaactggccctgctcgaaccgaccttagttcgtcaggccctcatggatgcggtaaaaaaactgagcccgcgcgtccagtggcacaacccggtgatgtttattgtctggactggaagtttactcaccaccgtactggcgattgccatgggaacgggacaccttttggggaatgcaacctttaccggcgccatcagcctgtggctgtggtttaccgtgctgttcgccaacttcgccgaagcgctggcggaaggccgcagtaaagcgcaggccaacagtctgaaaggggtcaaaaaaaccgcctttgcgcgcaaattacgcgaacctaaatacggcgcgcacatggaccacgtaccggcggatgaactgcgtaaaggtgacgtggtgctggtggaagccggcgacatcatcccctgcgacggggaagtgattgagggcggcgcgtcggtagacgaaagcgccattaccggggaatccgcaccggtgatccgtgagtcgggcggagatttcgcctcagttaccggcggaacgcgcattctttccgactggctggtgatccagtgcagcgttaacccgggcgaaacctttctcgaccggatgatcgccatggtggaaggcgcacagcgtcgtaaaacgccgaacgagatcgccctgaccattctgctggtggcgctcaccattgtcttcctgctggcaacggcgaccctgtggcccttctccgcctacggcggtacagcggtcagcatcaccgtactgatcgccctgctggtctgtctgatccccaccactattggtggcctgctttccgcgattggcgtggcggggatgagccggatgctgggcgcgaacgtcatcgccaccagcggacgcgccgttgaagcggcgggggacgtagacgttctgctgctggataaaaccgggaccatcaccctgggcaatcgtcaggcctctgactttttacctgctcccggcgtggatgaaaaaacgctggctgacgcggcgcagctttcctcgctggctgatgaaacgccggaaggccgcagtatcgtgatcctcgccaagcagcgctttaacctgcgccagcgcgacgtacaaagcctgcacgccacgttcgttcccttcacggcgcaaacccgcatgagcggcattaacattcaggaccggatgatccgtaaagggtccgttgatgccattcgccgtcatattgaagccaataatggacacttccccccggaagtcgaccatctggtggaaagcgtggcgcgtcagggggcaaccccgctggtggtggcggaaggtgcaagcgttctgggggtgatcgctctgaaggatatcgttaaaggcggtataaaagagcgtttcgcccagatgcgtaagatgggcattaaaacggtgatgatcaccggggataaccgtctgactgcggcggccattgccgccgaagcgggcgtggatgatttcctttccgaagcgacgccggaagcgaagctggcgctcattcgccagtatcaggcggaaggtcgtctggtggcgatgaccggcgacggcaccaacgacgccccggcgctggcgcaggccgacgtggcggtggcaatgaactccggtacccaggcggcaaaagaggcgggcaacatggtggatctcgactcgaacccgaccaagctgatcgaggtggtgcacatcgggaagcagatgctgatgacgcgcggctcgctgaccacgttcagtatcgccaacgacgtggcaaagtatttcgccatcattccggcggcgtttgcggcaacctacccgcagctaaatgccctgaacgtgatgcacctgcactctccggcctcggccattctgagcgcggtgatcttcaacgcgctgattattgtctttcttattccgctggcgctgaaaggggtgagctataaggcgctgacggccgccgccatgctgcgccgtaacctgtggatttacggtctgggtgggctggtggtgccctttattgggatcaaggttatcgacatgttgctaacgctgttcgggctggtttaa

SEQ ID NO: 3239 - DNA, 588 bp, Enterobacter cloacae
aaggtggatccaatgacgatgttacgtcccgctatactgttgtttattctgctgtctctgattaccggcgggctttacccgctgatgactaccgcgctgggccagtggtggtttcaggatcaggccaacggctcgctgattatccagaacggtgaaaaccgcggctcgcgtctgattgggcagaactttacggacccacgctacttccagggacgcccttccgccactgcggaaagcccgtataatccaatggcctccggcggcagcaatctggcgggcagtaaccctgacctggacaaagccattgctgaacgcgttgccgccctgcgcgctgcgaatccgcaggccagccgtgaggtgccggttgagctggtcaccgcctccgcgagcgggctggattacagcctgacgccggacgcggtggtctggcagatcccacgcgtggccgccgcccgtcagctgaccgtcgagcaggtgagccagctggttgcagaacatacgcaaaagccgctggtcagcttcatcggcatgccggtagtgaacattgttgagctgaatctggcgctggatgcgctaaggaagaactaa

SEQ ID NO: 3240 - DNA, 2688 bp, Enterobacter cloacae
atgaccgacgagcccatgcgcccggatccggacaggctgcttgaacagacggctgaagcccaccgtggcaagctgaaaatttttttcggcgcctgcgcgggtgtcgggaaaaccttcgccatgctgacggaagcccagcggcttcgggcgcaggggcttgatattctcatcggcgtggtggaaacccacggtcgcaaagagactgctgcgctgctgacggggctggcgacgcagccgccccagcgtatcagccatcgcgggcggctggtcacggagtttgatcttgatgccgccctcgcccgccgccctgccctgatcctgatggacgaactggcgcacagcaatgcgccaggctcccgccatccgaagcgctggcaggatgttgaggagctgcttgaggcaggcattgacgtcttcaccacggtgaatgttcagcatctggaaagcctgaacgacgtggtgagcggcgtaaccggtatccaggtgcgggaaaccgtccccgatccgttttttgattctgccgatgaagtcgtactggttgacctgccgccggacgatctgcgccagcgcctgcatgaaggcaaagtgtatattgccggccaggccgaacgcgccatcgaacattttttccgcaaaggaaacctgattgccctgcgcgagctggccctgcgccgcaccgccgatcgcgttgatgaccagatgcgcgcctggcgagacctacagggacaagagcgcgtctggcacacgcgggacgccattctgttatgcattggtcacggcagcggcaacgaaaaactggttcgcaccgccgcccggcttgcagcgaagtttggcagcgtctggcacgcggtctacgtcgaaacgccgcagctgcatggcctgccggaaaatcagcgccgcgccattttgagcgcgctgcggctggcgcaggagctgggcgccgaaaccgcaaccctttccgatccgcaggaagataaagccattctgcgctacgcgcgggagcacaacctgggcaagattgtcattggacgtcgccagcaccgccgctggtttagccgcgaatcttttgccgacaggctggcccgccgcgcgccggatcttgatttagtcatcgtcgcgctggatgacaagcccgcccccctgcccaaccgtacgccggatgctcgcacctttggcgataaatggcgcattcagatccggggctgcatggtggccgtggtcctctgcgccctgattacggtgattgccagccagtggctcatcgccttcgacgccgccaatctggtcatgatttatctgctcggcgtcgttgtggtcgcgctcttttatggccgctggccgtcggtgctggcgacggtgatcaacgtcatcagcttcgatctcttctttattgctccgcgcgggacgcttgctgtctcggacgtgcagtacattctgacctttgccgtgatgcttaccgtcgggctggtgatcgggaatctgacggcaggcgtgcgctaccaggcacgcattgcccgctatcgcgagcagcgcacgcgccatctgtatgaaatgtcaaaatcgctggcggttggccgcacgcagcgagatatcgtgcagaccagcgagcagtttatccgttcgacctttcatgccagtaacctgattttgctccccgacgaacaagggcgccttcgcccgctgacctccccttcggggatgacgccctgggatgaagcgattgcccgctggagtttcgataagggtttacctgccggagccggcaccgacacgctgcccggcgtgccttaccagatcctgccgctgcgcagcgcggataaaaatcacgggctggtcatcgtcgagccgtctaacctgcgtcagctgatgatccccgagcagcagcgcctgcttgaaaccttcaccctgctggtcgccagcgcccttgaacggctggcgctcaccgccagcgaagagcaggcgcggctggcaagcgagcgcgaaagtattcgcaactcgctgctggcagcgctgtctcacgatttgcgcacgccgcttaccgtgctgtttggccagtccgaaattctgacgctggatctggcggcggaaggatcaaagcacgcgatgcaggccagcgaaattcgccagcacgtgctgaataccacgcgcctggtgaacaacctgctggacatggcgcgcattcagtccggcgggtttaacctcaaaaaagagtggctcacccttgaggaggttgtcggcagtgcgctgaagatgctggagccgggtctcggcgggcgccatattgagctggacatgccggaacccctgacgttaatccatgtggatggcccgctgtttgagcgcgtgctgattaatcttctggaaaatgccgctaaatacgccggggcaaaggcccggctggggattgctgccagggtggataaacgtgtgctgcggctcgacgtctgggataccgggccgggtattccggccggacaggagcgcgctatattcgaaaaatttgcgcgcggtaataaggaatccgccattcctggcgttgggctggggctggcgatctgccaggcgattgtcgacgtgcatggcggcaccatttccgcagagaaccgcccggaaggtggggcacgcttttgtgttacacttcctctggaaagcccaccagaacttgatgaattaccagaggatttgtga

SEQ ID NO: 3241 - DNA, 195 bp, Enterobacter cloacae
aatgatcggttattggtgatctgtttcacagttaatcccttttccctggataaaatgaccatgctttcaattactgaaaggaaactgaacatggaaaacaataatcgtttaatgccccatataaggcggacaacacatatcatgatgtttgcccaccgaaactgttttgactttcatctctttaacgcccggtag

SEQ ID NO: 3242 - DNA, 2214 bp, Enterobacter cloacae
aataaagagataaagatgaaaacgttaaaaattgccgtcagccgtgcctgccctgaatgctttaccacttcgcgcgacattgtggatatcaccgcatcggattatattgatgtggcagccgtggttctggccgtgagcgatattttcaatggcgccatagaagaaatagaagccacgggattcggtattccggtgtttattgccacgcataaagaagaaagggttccggctgaatttctgtcgcgtattcacggcgtttttgagtactccgacaccagcaatgcgtactacggacgccagcttgaagcggctgcgcagaagtacgaaacccagctccgcccgccgttcttccgcgcgctggtcgattacgtccagcaggggaacagtgcgtttgactgccccggacatcagggaggccagttcttccgccgccatccggccggaaaccagtttgtcgatttctttggcgaaacgcttttccgcgccgatctgtgcaatgccgacgtggcaatgggcgatctgctgatccatgaaggcgcgccatgcatcgcccaacagcatgcggcaaaagtctataatgcggataaaacctacttcgtgctgaacggcacctcctcttccaacaaagtggtgctcaatgccctcctcacgccaggcgatctggtgctgttcgatcgcaataaccataaatctaatcaccacggagcactgttacaggcaggcgcgacgccggtgtatctggaaacggcgcgcaacccgtacgggtttatcggcggtattgacgcacactgtttcgacgagagttacctgcgggaactggtgtcagaggtcgcgcctggtcgcgcgcgggatgaacgtccgttccgtctggcggtgatccagctgggcacctacgacggtaccatttataacgcccgtcaggtggtggataagattggtcacctgtgcgattacattctgtttgactccgcctgggtgggttacgagcagtttatcccgatgatggccgactgctcgccgctgctgctggagctgaacgaaaacgatccgggcattctggttacccagtcggtgcataagcagcaggcgggcttctcgcaaacctcgcaaatccataagaaggacagccatataaaaggccaggcgcgctatgtcccgcataagcgcctcaacaacgcctttatgatgcacgcctccaccagcccgttctatccgctgtttgccgccctggatatcaacgcccgcatgcacgaggggcaaagtgggcgcaacatgtggatggactgcgtggtgaccggtatcgaagcacggaaactgatccttcagaactgtcagtttattcgtccgttcgtgccagagacggtggatggccgtccatgggaaagctgggatacggcagagattgcaaccgatctgcgcttcttccattttgttccgggcgaacgctggcacgcctttgagggatatgccgagcatcagtattttatcgatccctgcaaactgctgctgaccacgccaggcatcaacgcccgcaccggcgagtacgatgatttcggcgtgcccgccaccatcctcgccaacttcctgcgtgaaaacggcatcgtgcctgaaaaatgcgacctcaactccattctcttcctgctcaccccggcggaggacatgggcaaattgcagcagctcgtcgcccaactggtgcgcttcgaaaaactgctccagagcgatgtgccgctgaaagaggttctgccctctctttataagcaacatccggaacgttatgcggattataccctgcgtcagatttgtcaggagatgcacgacctctatgcccgccataacgtgaagcagctgcaaaaagagatgttccgcaggtctcacttcccgcgcgtcatgatgaacccgcaggaggcgaactatgcctatctgcgcggtgaggtcgagctggtgtccctgcgcgacgcggaaggccgtatcgccgcggaaggcgcgctgccttacccaccgggggtgttgtgcgtggttccgggggaagtctggggcggttccgtgctgcgctacttcgccgcgctggaagacgggatcaatctgctgccgggctttgcgccggagttacagggggtttacgtcgaggagtgtgacggtcgcaaacaggtgcgctgctacgtcatcaaacaacctgccgctcagccatcgctgctgaaaggagaaaaattatga

SEQ ID NO: 3243 - DNA, 750 bp, Enterobacter cloacae
ttccctgaaaaggtattaaataggcgtgacccaatgggcaataaaccgatgtaccggcagatcgccgatgcgttccgcgagaaaattaatgccggtgagttaaaacctggcgacgcgctgccgacagaatccagccttcaggaggcgtttagcgtcagccgtgtcaccgtgcggcaggcgttgaagctgctcgccgacgagcagatcatcgaaagtattcagggcagcggctcgtatgtaaaagaggagcgggtgaattacgatatttatcagctcaccggcttttacgaaaagttagcggatcgcaacgtcgatacgcacagcgacgtcagcgtcttcgaagtggtgaaagccgatgagcggctcgcgacaaaactggcgctcaatccggatgataaggtctggcacgtcaagcgcgtacgcttcatcagggaaaagccggtgaatctggaagagacatggatgccgctggcgatgttccccgacctcacctgggaagtgatggaacagtcgaaataccattacattgagcagatcaaaaagatggttatcgatcgcagcgagcaggagctggtgccagtcatgccatcggacgaggcgattgccgccctggcgctcgatccggcgaaaccgattctggaaaaagtctcccgcggctttctgaaagacggccgggtatttgagtacagtcgcaacgtgtttaactccgacgactataaattcactctggtggctaaacgcagacaataa

SEQ ID NO: 3244 - DNA, 1221 bp, Enterobacter cloacae
aaggcacgctcggtcaggatgttattgatatccgtacgctgggttccaaaggggtattcaccctttgaccctggattcacctccaccgcatcttgcgaatccaaaatcacctacattgacggtgacgaaggtatcctgctccatcgcggcttccccatcgatcagttagccaccgaatccaactatctggaagtgtgctacatcctgctgaacggcgaaaaaccgacgcaggctcaatacgatgaatttaaaaccaccgtgacccgtcacaccatgatccatgagcagattacccgtctgttccatgcgttccgtcgtgactctcatccgatggcggttatgtgcggtattaccggtgcgctggcggcgttctaccacgattctctggacgtgaataacccacgtcaccgtgatatcgcggcgttccgtctgctctccaaaatgcctaccatggcggcgatgtgttacaaatactctatcggtcagccgtttgtgtatccacgcaacgacctctcctacgcgggtaacttcctgcgcatgatgttctccacgccatgcgaagagtatgaagtgaacccggtgctggagcgcgcgatggaccgtattctgatcctgcacgctgaccacgaacagaacgcctcgacctctaccgtccgtaccgcaggctcttccggcgcgaacccgttcgcctgtatcgctgcgggtatcgcctccctgtggggaccggcgcacggcggcgcgaacgaagcagcgctgaagatgctggaagagatcagctccgttgagcatattcctgagttcgtgcgccgcgcgaaagacaagaatgactccttccgtctgatgggcttcggtcatcgtgtttacaaaaactacgaccctcgcgcgaccgtcatgcgtgagacctgccacgaagtgctgaaagagctgggcaccaaagatgatctgctggaagtggcgatggagctggaacacatcgcgctgaacgacccgtacttcatcgagaagaaactctacccgaacgtcgatttctactctggcattattctgaaagcgatgggcattccgtcttccatgttcaccgtgatcttcgccatggcgcgtaccgtgggctggattgcgcactggaacgaaatgcacagcgaaggcatgaaaatcgcccgtcctcgtcagctgtataccggctacgagcagcgtgattttaagtctgacctgaagcgctaa

SEQ ID NO: 3245 - DNA, 693 bp, Enterobacter cloacae
attaccagaggatttgtgattaacgttctgattgttgaagatgagctcgctatcagccgatttctgcgtaccgcgctggaaggcgacggtttgcgcgttcatgaagccggaacgcttcaacgagggttgattgaagccgcgacccgcaagccagatctggtgatcctggatctgggacttccggatggcgacggcatcgattttattcgtgaggtgcgtcagtggagccagatgcctattctggtgctctctgcccgcaccgaagagacggataaaatcgccgcactggatgccggagcggatgattatctgatcaaaccgtttggcattggcgagttacaggcccggcttcgtgtggcgctgcgtcgacacagtgccacctccccttccgacccggtgtacgcctttggcgatatccgcgtcgatcttgctgcacgccgcatcgtaagaggagaagaagagatccaccttacgcctattgagtttcgtctgctggccgtgctgctcaataaccatggtaaagtgttaacgcagcgacagctgttaagccaggtctgggggccgaatgctgtcgagcatagtcactatttacgcatttatatgggacaccttcgccagaagcttgaagccgatcccgcgcgtcctcgtcatttattaacagaaaccggtatcggatatcggtttatgatctga

SEQ ID NO: 3246 - DNA, 1389 bp, Enterobacter cloacae
cggtcgcaaacaggtgcgctgctacgtcatcaaacaacctgccgctcagccatcgctgctgaaaggagaaaaattatgagtaaggccaacaagatgggcgtggtgcaactcactattctcaccatggtgaatatgatgggttcggggatcatcatgctgcccaccaagctcgctgaagtggggacgatttcgattatctcctggcttgttaccgccgtgggttcgatggcgctggcatgggcctttgccaagtgcggaatgttcagccgcaagtccggcgggatgggtggctatgccgaatatgcgttcggtaagtccggtaactttatggcgaactatacctacggcgtgtcgctgctgatcgccaacgtggcgattgccatttccgctgtcggttacggcacggagctgtttggggcgacgctgaccccggtgcagattgggctggcaaccatcggcgtgctgtggatctgtaccgtcgccaactttggcggcgcgcgcatcaccggacaacttagcagcattaccgtctggggcgtgattatcccggttgtcggcctgtgcatcatcggctggttctggttcagcccgaccctgtacgccaactcctggaatccgcatcacgtaccgttcttcactgccgtgggatcgtccatcgccatgacgctgtgggccttcctcgggctggagtcagcctgtgcgaatgcggaagtggtggaaaacccggagaaaaatgtgccgatcgcggtactcggcgggacgctgggggcggcggtgatctatatcgtctcgaccaacgtgattgcgggaattgtgcccaacatggatctggccaactccacggcgccgttcgggctggcgttcgcgcagatgtttacgccggaggtagggaaagtgatcatgggactgatggtgatgtcctgctgcggctcgctgctgggctggcagttcaccatcgctcaggtgtttaaatcctcggctgacgaaggctatttcccgaaaatcttctcccgcgtcaccaaagcggatgcaccggtgcagggcatgctggcgattgtcatcttccagagcggattgtcgctgatgaccatcagcccgtcactgaacagccagtttaacgtgctggtcaacctggcggtggtgacgaacatcattccgtacattttgtcgatggcagcgctggtgattattcagaaggtggcgaaggttgatccgcgcaaagcccgtgcggccaatattgtggcgctgattggcgcaatttacagcttctatgcgctctattcctccggccaggaagcgatgctgtatggtgcgatggtgacctttatgggctggacgctgtacggtctggtgtcgccgagatttgaattgaagaacaagcacagttag

SEQ ID NO: 3247 - DNA, 531 bp, Enterobacter cloacae
gagggaattcttatgagtgtgcagcaaacaaaagctgaactgcttttagctattgataaaaatttcagtaaattaattagttacctcaaagcaatcccgccagaaattacctccgataactcaatggatggacacgctaaaggaacagagatgagtgttcgtgacctcgtttcgtatctgatcggatggaatgctcttgttgtaaagtggatcacttctgatgctaaaggtctgcctgtcgactttccggaaactggctataaatggaatcagcttggccttcttgctcaaaaattttactcagattacagtgggttaacttatgaattgttaataattgaacttcagactgtaaaaaatgaacttgtgaagcttattgatgagcgtaccgatgatattttgtatggaagaccatggtacacaaaatggacgatggggagaatgatctcatttaatacatcttcgccttatgctaacgctaatggaagattaagaaagtgggcaaaaaataataatatcagtttaaagtaa

SEQ ID NO: 3248 - DNA, 600 bp, Enterobacter cloacae
aattatatggacgaaaaatcgctctatgcccacatccttaacctgactgctccatggcaggttaaatcccttaccctcgatgaaaatgcaggttccgttactgttacagtcggaatcgctgaaaacattcagttaacctgcccgacctgcggtaaatcctgccctgttcacgatcaccgacatcgtaaatggcgtcaccttgatacctgccagttcgccaccctggttgaagccgatgtcccccgaatcatgtgcccggaccatggttgtcagaccctgcctgttccatgggcgggaccgggaagccgctacacgctgttgttcgagtcgttcgtcatctcatggctgaaaatcagcaccgtcgatgccgtcaggaaacagctgaggctgagctggaatgccgtcgataacattatgcagcgggcggttaagcgtggactcgcccgccgtaaagccccgcagtcagcacgtcacctctgtgttgatgaggtcgccttcaaaaagggtcatcagtacgtcacggttatctctgatacacagggacaggccctggagctcagggatgatcgcggggttgaaagcctggcgggttacctctag

SEQ ID NO: 3249 - DNA, 315 bp, Enterobacter cloacae
agcctgggtgaccgtcagatcgaatccatcaaaaccctgtcgatggacatgaatcaggcttatatcagcgcagcccgtatccacctgcctaacgcggtagaaaaaatcgccttcgatcacttccatgtcgcgaaaatgctctgtgccgtcgtggataaaacacgacagtccgagatgagaatcatcccgttacaggcccgaaaaagtgcacatcgctcccgttatctgtggttgtacggccgccataaacgtcatggtcgaatagcagaaagactggaggcggcgcagatggtcctgccttgtcagcgccagtga

SEQ ID NO: 3250 - DNA, 807 bp, Enterobacter cloacae
ggagctgctgtgatgtacgaactggaaacactgctgaaccgcctgaaaatggaacacctgagctatcacgttgaaaatctgcttgagcaggcagcaaagcaggaactgaactaccgggagttcctgtgtatggcgctgcagcaggagtggagcgggcggcaccagcggggaatggaggcccggctgaagcaggcgcgcttgccgtgggtgaaaacgctggagcagttcgacttcagcttccagccgggcatagaccggaaggtcgtccgtgagcttgcaagtctggcgttcgtggagcgcagtgaaaacgtgatcctgctgggcccgccgggcgtggggaaaacgcatctggcggtcgctctgggagtcaaagccgcggatgcgggccaccgggtgctgttcatgccgctggacaggctggttgccacgctgataaaggcgaagcaggaaaatcgtcttgaacgtcagctgcagcaactgagttatgcgcgggtgcttatcctggatgaaataggttatctgccaatgaaccgtgaggaggcgagcctgttcttccggctgctgaaccgccggtatgaaaaagcgagcatcatcctgacgtcaaacaaagggttcgccgactggggcgaaatgttcggagataacgtgctggcgacggcgatcctggaccgtctgctgcaccactcaacgacgctgaacataaaaggagaaagctaccggttgaaagagaaacgcaaggccggggtgctggcaaaaagcgcaacgccaatcagtgatgttgaaatggtggaaagcggacagcgttaa

SEQ ID NO: 3251 - DNA, 1200 bp, Enterobacter cloacae
ggttcccacaccgaaaaggattccagcatgctgagcagagaggactttttcatgataaagcaaatgcgccaacagggtgcttacattgtcgatatcgcaacacaggtcggatgttccgaaagaaccgtcaggcgatatctcaaataccctgagcccccggcccgtaaaacacgccataaaatggcaaaactcaagccgttcatggattacatcgacatgcggctggcggaaaacgtctggaacagcgaggtcattctcgccgaaattaggacgatggggtacaccggcgggcgctctatgctgcgctattacatccagcccaaacgtaaaatgcggccctcaaagaaaaccgtgcgcttcgaaacccagcccggttaccagctgcagcacgactggggagaagtggaagtcgacgtggccgggcagcgatgcagggtgaacttcgccgtcaatacgctggggttctcccgccgcttccacgtctttgccgcgccaaaacaggacgctgagcacacatacgagtcgctggtgcgcgccttccgctactttggcggcagcgtgaaaaccgtgcttgtcgataaccagaaagccgccgtgctgaaaaacagtaacggcaacgtggtgttcaacgccggcttcctgctactggccgaccactatggcttcctgccgcgggcgtgccgccctcgccgggcccggactaaaggtaaggttgagcggatggtgaaatatctcaaggagaacttcttcgtccgctaccggaggttcgacagctttccccatgtcaatcaactcctggagcagtggatagcagatgtggctgacaggcgtgaacttcgccagttccgggagacgcctgcagagcgcttcgttgttgaacaaacacatctgcagccactgccagcaaccgacttcgataccagctacttcgatatccggcacgtgtcctgggatggctacatcgaggttggcggcaaccgctacagcgtgcccgagtcgctgtgtggtcatccggtctcgatccggatctcgctggatgacgagctgcggatctacagcaacgaaaatctggccgcgacccaccggctcagcggggcttcatcgggctggcagacagtgccggagcaccatgctccgctgtggcaacaggtcagtcaggttgagcaccggcccctgagcgcgtatgaggagctgctgtga

SEQ ID NO: 3252 - DNA, 333 bp, Enterobacter cloacae
cagcctgaaaccagccgttgctgggcaatgaaagagatggcccgggagctctggaaccgtcggtatgacgggcacagcagacgtctgtggctggaatggatcgcgatggccaaagatgtgggagtcccgcagctgagcagtgcagcccggacgttacgtaaacggctgtacgggatcctgaatgccatgaagcacagggtatcaaacggcaacgcagaatcactgaacagtaaaatacggttgctgagaatcaagtcgagaggataccggaacaaagagcgcttcaaaatcgcagtgatgttccattacggcaggttaaacatggggttatga

SEQ ID NO: 3253 - DNA, 597 bp, Enterobacter cloacae
tgcgcacctgacacaccccgttcgcggggtgtttctttattccttacaggagaaatgattatgtcctcacgcggcgttaacaaggttattcttgtcggaaacctcggccaggatcctgaagttcgttatattcctaacggcagcgcagttgccaccctttcgctggccacgtctgagagctggcgcgataagcagtccggtgaacagaaagaagtgaccgaatggcaccgggtggttattttcggcaagctggcagaaattgcgggtgaatatctgcgtaaaggctcccaggtttacatcgagggccagctgcgcacacgcaaatggaccgatcaggccggccaggataaatacaccacagaggtggtggtcaatattggtggcaccatgcagatgcttggcggtcggcagtccggcagcggtcagaatacgtcttcccggaatgactggggccagcctcagcaaccttccggaccgactcacagtggccaggcttccggcagcagtgccggtgcgccaccgatggacttcgatgatgatataccgttcattggattcgggtatggagtaccaaaatcggcaatccatgcactctga

SEQ ID NO: 3254 - DNA, 2112 bp, Enterobacter cloacae
aggaggcagacgatgagtaaccgttacgtcattgaagctctgctgcgtccggccgttgagctgaataccgccgtggtatcgggcatggcggcgtatgtctgtgtgcaggcaccctgggctgtcgccctggcaccctctgtaagctatgtcaccgcagccgggtttgcggcgctggccgtcacccgcacgcatcaggggatgaagattattcgctaccgccggaatctccgccgtctgccgcgctatgttatgagcaccaaacagatccccgtcagccatcgtcgcctgtttctcggccgggggttccgctggacccagaaacacacccagcgcctgcaggatacgctgcgcccggaagtggcccgctacctgcagccgaaccgcttttatcagggcgcgcgtcagcttgaattgctgacagagcatcgtctgccctggctggggaagctgctgagcgccgatacgccgctgaacccggtgcggccattaccgccggtgggtgggaatccggcgctgcacggcatcgagcccgacgaaaaagacgttaccctggccctgggggagcgcgttggccatacggtggtgtacggcaccacgcgcgtcggtaagacccggctggcagagctgctggtcacccaggatatccggcggggtgaagtcaccatcgtgtttgatccgaaaggcgacgcagacctgatgaaacgcgtctgggcagaggcccaccgggccgggcgcggggatgagctgtatatctttcatctcggctggcctgaaatttcagcccgttataatgccgtcgggcgttttggtcgcgtgtcagaggtggcgtcccgcgtggccggtcagctgtcgggtgaggggaacagcgcggcattccgcgaatttgcctggcggttcgtcaacatcatcgcccgtgcgctggtcgccctgggtgagcgccctgactacacgctgatcatgcgctacgtgaacaatatcgccgatctctatatccgctatgcggaaaaaatcatccaggcgcagctgccagctctgcagacgcagattgagaataatcagcaggtgctgggagaggacgacgtgccccgtaacatgcagggtcagccggatgccttacgtatctgggccattgaggttgccctgagttcagaagagggtaaaaaactctatgatcccatccttgacgggctgcggtcagcggtacgttatgaccgtacttactttgacaaaatcgtggcgtcgctgctgccgctgctggaaaaactgaccaccggcaagaccgccgagctgctgtcgccggattatcaggacattgacgacacgcggccgatttttgactgggaacagatcatccgtaaaaaagccgtggtgtatgtggggctcgatgcgctcagtgacagtgaagtggcgagcgcggtcggtaactccatgttcgccgatctggtgagtgtggccgggcacatttataaacacggtatcaatgcgggcctgccgggcgggaaagaagggaagtccctgattaacctgcactgcgatgagtttaacgagctgatgggggatgagtttattcctctcatcaacaaagggggcggtgccggcatgcaggtgacggcctatacccagacgtcttctgatattgaggcacgcatcgggaatgcggccaagacggcccaggtacagggtaactttaataacctgattatgctgcgcgtcagggagaaccgcaccgccgagctgctgaccacgcaactgccgcaggtggagatttacaccaaaacgctggtctccgggcaccaggacacggccgatgtcaatgcagaccaggacttcacctcaagcacccaggaccgcgtcgggacggtaaaagtcccgctactggagccggccgatatcgtgacgctgccaaaagggcaggcgtttgccctgctggaaggcgggcaactgtggaaaatccgcatgccgctgcctgccggggatgctgatgatgtgctgatgccggaaagcatcgagaaaatagcggaggagatgcggcgcagctatcacagcggcgaatcctggtggcgggacggtccggccctgaacgtgccggtcacaggaggggcgaatggctga

SEQ ID NO: 3255 - DNA, 2025 bp, Enterobacter cloacae
cgcgggaggcaacacatgcaactctttctgtgtgaaaaaccctcccaggcaaaggatattgcccgcgtgctgggtatcagcaagcgtgagcagggatttatcagcggcggtaacatcgttgtgacctgggcggtcggccatttactcgaaactgccagccctgaagcctatggcgagcagtatggcaggccgtggcgtgccgatgtcctgcctgtgctgcctgaggcctggaaaatggtcgtcaaagagcagacaaaatcgcagttcaccgttatcagtaagctgctcaaaaaggcctctgaggtggtcatcgccaccgatgccgaccgcgagggagaagttatcgcgcgtgagctgctggaatactgccactacagtggcgcggtgcgccggctctggttatcagccctggatgaggccagtgtgaaggaagcactgagcagtattcttccgggggaaaaaacagccctgctgtatgatgccggcaagggccggagccaggctgactggctcatcggtatgaacctgacccggctttataccctcaaagcccgtgactcaggggtgtcagaagtgctgtccgtcgggcgggtacagacgccgacgcttgccatggtggttaaccgggataatgaaatcacgtcctttgtgccaaagccctggtggcaggtacatgcgcttattgaaaaagagggcgtccggttccgggctggctgggtgcccgttgagcagtactgtgacgaggaaaagcgttgcatcaatcctcaggcagcccgggcggtgggacagctttgtcagcagcagggcagggctacggtactggaggtgacacagaagcgggagaaaacggcggcacccctctgttttgacctgggcacccttcagcaggtctgttcccgaaaattcggcatgggcgcaaatgatgtgctcgccattgctcagtcactttacgaaacccataaagcgaccacctacccccggacagactgcggttttctgccaacctccatgcagcaggaaattcccgacgtgctggcagcagtggcgaaatccgatcccgctgtggccccggtactgaatcagctggacaggaagtttgtctcgcgtgtctggaatgacaagaaaatcaccgcgcaccatgccatcattcccacccgacaggcatttgatttgtcgcgcctcagcgccgatgagctgaaggtctaccagctgattcgccagcattatttcgcccagttccttccgctgcaggaatctgacgtgacagaggcgtctttcaatatcggtggccagctgttccgtacacgcgggaaagtcggtgtggtgacgggctggaagtcattgttccaggctgaaaaagatgacgatgaagaggacgccgatggtgacagtatggcgctgccggcgctggcaaaaggggatatttgcgctgtcaccggtgctgaggttaaggatatgaaaaccagtccgccaaaaccgttcacggaggggacgctgattgctgccatgaagaacgcggccagtttcgtcagtgacccgaagctgaagaaagtgctgcgtgataacgccggtctgggcacagaggcgacgcgtgcgggcgtactcgaaaccctcttcaaacgacactatctggagaaaaaagggaagcacatccactcaacgcaggtggcacgagagctgattgcggccctgccggaaacgctgacgagcccgggcatgaccgcattatgggagcaggcactggatgatatttcgcaggggaaaatgtcgcttgcggtctttatgcaaaagcagctgcagtggacccgtcaccttgtcgaaaaaggccgccaggacagtgtgaaaatcaccgctcccgtcacgcctccctgcccgttatgcaaagggcccacacgtaaacgtaaaggtaaaaatggtgatttctgggggtgcatacgctatccggactgtgagggaattatcagtacaggtaagaagaaagcagcgaagcgtaaaaaaacatcggttaaggctaaaacagaataa

SEQ ID NO: 3256 - DNA, 579 bp, Enterobacter cloacae
gccgtaatgagcgcgccatatatcaatggtctgctgatggcgcacccttacggggcggtcatactggtcgtcctgttcctggtggtgatggtttttctgaacctgcgccggcgggagaaagccagcacccgccgtcaccggcgataccgggcaacggcggggagggtactgaataagcttaacagcctgccgggagacgggcagcgcctgacttatctgcgcaaaatcagcccctatgtctttgaagagctgttgctgtctgcctttgaacgtcaggggctgaccgtggtgcgtaatgcctcctacagcgctgacggcggccttgatggccaggtcatcatcgacggggaatactggctgattcaggccaaacggtacagccgtgctgtttcccccgcacatgttgaggactttgaccggcttctcctgcagaccggccgccgcggtctgtttgtccacacgggccgtaccgggaagatgagccgcgccattcgcacgacatcaccgcgcctgcgcatcatcagcgggcaacgcctgctgaccattctcgccgggcaggacgtccggcagtatctctga

SEQ ID NO: 3257 - DNA, 1482 bp, Enterobacter cloacae
tatctgatgaggaaaaccgtgaaaaaaacaccttcattttcagccgctcgcgtaagcctgctgctgaccggctccctgctgaccgtcctcccggccgcgcacgcagccgatgatgacaataccatcctgggcatgtccctgccgcaggtgaacaacagcgccatcggttacggcaagtccgtggatggggcggtgtcagacaaactgttctacaccctcggcggcggctcggtcatttcccagccggccacgcgcggcaatatgcagaagctggggctgaataccggctggagcagtgacctgatgtgcggcaattttgacctgaaaaccaccgtcggcaaccagctcaacggcgtcacatccggctttaaaaacctgatgggcgacgtgattcagggggccaccggcgcggtggccagtctgccggcgatggtcattcagcgggccaaccccggtctgtatgacatgctcacaaacggcgtgcttcaggccaatgtgtcattcgacaaggcgcagctcaactgccagaacatggcgaaaaagatgatggacttcagcgacagcagtaactggacgcagcaggccatgatggatgaatacaagtctgttgtgaacagcggagacactgacgcggttcgtgcagatgaggcggggcggaaagtcaccggcacgtcgggcaacaactggattggcggtcagaaacgtgggggggcggggcagcccgccatccgtgtcacccatgaccttgttgctgccggctacaacatgatgaacggtctgcctgtcaccgctaattcgactgtcggcgaaagcagctgtaacggtggcgcatgctctaaattcggcagcgcggaagaggcggcggccatgaccgtgaaggtgctgggcgatcgttcgatgcgcacctgtgccaacgcgagcgaatgtaccagcggtgatgcggatgaccagcccggtacgaccgttgccggcaccggctttgccccactgctggaagaggcaaccaaagccaacgctgagcagctggtcaggctcgtcaacggtacggaaaagcccacggccgcgaatctggcgaagctgaaaacaggcggactgccggtgacggccggcgtgattaaagccctgcagcgtgatccggataatgctgccctgaccgcccgtcttgccggcgagctggccatgtctgacacggtggaaacggcgctgctgatgcgtcgcatgatggttaccggtatgtcggagccgaatgctgccgctcagccaaaggccattgataccgccggtcagcgtatcgaggcgctggatcgggaaatcgcggcgctgaaaaacgagatggagatgaagcgtgaactgtcacgtaattcagtgctgaccattatcgacagggagaatcagcgcgtcgaaactaacccgcagacccagtcagatgacaataccgacagtcgcttcaaccagatggcagcgccgcagtcggctgaatga

SEQ ID NO: 3258 - DNA, 294 bp, Enterobacter cloacae
cggggatcgttgaagataaccaagcattgtttctggaggcctggaatgactatttcagctaaacgggtcagcttcgatgaggccacgatgtgggttgaactcaacgacgcccgtaccatcggtgtgccgctggcatggtttccacgcctgttgcatgcttcaactgaacagcttaacagctatgaactgagtccccgtggtatccactgggacgcgctggacgaagacatttctattgcgggtttgcttgaaggccgcggcgatgtgacccatcgtccccataaagtagcctga

SEQ ID NO: 3259 - DNA, 1518 bp, Enterobacter cloacae
aacaggaggcccgccatgcagattaaatctaatgccctggtgaagtttatcgtgccggccgtggtgattgccgggctggccgtggggcttaaaagctgcaaaaacgaaccggcagagccgtcccaggcaaaacaaagcggcggccccctgcataatctcccgccagatgaactgaaggcgctgggtgtggaaggcgacacgccggaggacaccctgcgcacgctcatcggccggctgaacgatgtgcgtgagcgccagaaaacgctggataaacagaacgcggatttggtgaaagaaaacgagcggttgcgccgacgcaatcaggacgtttcaggacaggtgaatgaggccgttaatggtctgcgcgagcagtacgacaagcggcaggcgcagcttcagaacgaacaactgagcctgacggcgaaaatccaggagctgaccgacaaactcaaaaagcctgacagcgagaaaaaaacggcggacagcgatatcccgctggggctgggcctggacggcatgggcagcagcaccggcggggcggcgtctcagggcagcgacggcatgatgtgggtcgcgccgacggaccagaaagaggcggacccgcgggacgcggccagcggcaaggcatcacctcagttcccgacttcttttctgggtgaaaatgagctgacccgacagaaagcggcctatgaggagaaagtgaagggacgtacgaatgaaaaaggggcggaagagagcgccgagccggtttacacgctgccggaaaattccacgctggtcggcagccgcgccatgacggcactgcttggccgtgtgcccatcaacggcactgtgaccgatccttatccgttcaaggtgcttatcggtaaggataacctgacggcgaacggcatcgagctgccggacgtcgaaggggcgattgtttcggggacagccagcggtgactggacgctgtcctgcgtacgcgggcaggttaacagcatcacctttgtcttttccgacggtacggtgcgcaccctccccagacccgacaccagtaacaacgccggcgggcaaaataataacgcccaggctaaacaggataccagcaccagtggcggtatcggctggatctcggatgaaaacgggatcccgtgcattggcggcgaacgtaagtccaacgcctccacctacctgcccaccatctttggcctgtcggctgccggtgcggcgggtgaagcgatgagccaggggcagtacaccacgcagaacaacgtgaatggcatttcggccaccatgacaggcgacgccggacaggcggcgctggggaaagccatttccggcggcatgtctgaaaccaccgactggatcaaacagcgttacgggatgacgtttgatgccatttatgtgccacccggtgcccgtcttgccgtgcatatcacccgtcagctggccattgattatgaagagaagggccgtaaggtgcgctacgacttcaccctgccgggtggcgtcagtgacaacggcggactggactga

SEQ ID NO: 3260 - DNA, 327 bp, Enterobacter cloacae
tttgaggggcgagttatgccaattcctttagaacagacgatgtgttgggataaaagttcgcagaaaaattcagcaaacacaccggttttgatgatggcggctatcgccagacttacaggtagcaatccatcactggcatgcgttccgttgtttggtgatggggtttcatgtggtttcccttctccggcacaggattatgtcgaaaaacgtctttccctcgatgacctttgcatccgctatccggaaagtacctatctggtgcgagcagagggggattcgatgcttaatgccgggattaaagacggtgatttactaatagtgaggtat

SEQ ID NO: 3261 - DNA, 1428 bp, Enterobacter cloacae
ggtttcatgatgagtaaagtcaaacaaacagatatcgatcagctgatcgtcctggtcggcggacgcgacaacatcgccaccgtcagccattgcattacccgcctgcgcttcgtgctgaacgatccggccaaagccaacccgaaggccattgaagagctttccatggttaaaggctgcttcaccaatgccgggcagttccaggtggtgattggtaccgaagtgggcgattactatcaggctctgctggcgactaccgggcactcttccgcagataaagagcaggcgaagaaagccgcgcgtcagaatatgaaatggcatgagcagctgatttcccattttgcggagatcttcttcccgctgctgccagcgctgatcagcgggggcttaattctgggcttccgtaacgtcatcggcgatgtgccaatgagcgacggcaaaaccctggcgcagatgtacccggcgctgcaaagtatctatgacttcctgtggctgattggcgaagcgatcttcttctatctgccggtcgggatctgctggtccgcggtgcgcaagatgggcggaacgccaattctcggtatcgtgctcggcgtgacgctggtctctccgcagttaatgaacgcttacttacttggtcagcaaacgccagaggtgtggaacttcggcctgtttaccatcgccaaagtgggctatcaggcgcaggtgatcccggcattgctggcgggtctggcgctgggctttattgagacgcgcctgaagcgcatcgtgccggattacctgtatctggtggtggtcccggtctgctcgctgatcctggcggtgttcctggcgcacgcctttatcggtccgtttggccgcatgattggcgacggcgtggccttcgcggtccgtcacctgatgaccggcagcttcgcgccaatcggtgccgcgctgtttggcttcctctacgctccgctggtgatcaccggcgtgcaccagaccacgctggcgatcgatatgcaaatgatccagagcctcggcggtacgcctgtctggccgatcatcgccctgtctaacattgcgcaggcctcggcggtaaccggcatcatcatcgtcagccgtaagcacaacgagcgtgagatctccgttccggctgccatctccgcttacctcggcgtcactgaaccggcgatgtacggtatcaacctcaaataccgcttcccgatgctttgcgcgatgatcggctccggtctggcgggcttgctgtgcggcctgaacggcgtgatggcgaacgggattggcgtcggcggcctgccggggatcctctccattcaacccgctttctggcaggtatttgcgctggcgatggcggtggcgattatcatcccaatggcgctgactaccgtggtttatcagcgtaagttccgtcagggcacgttgcagattgtttaa

SEQ ID NO: 3262 - DNA, 1695 bp, Enterobacter cloacae
ttctctctttcggggcgcagttgcgccccttcgcatttgcaggaacgcactatgaatacccttcctcactggtggcagaacggcgtcatctatcagatttacccaaagagtttccaggataccaccggcagcggcacgggcgatctacgcggcgtaacgcagcgcctggactacctgaaaaccctcggcattgacgctatctggctgacgccgttttatatctcgccgcaggtggataacggttacgacgtggcgaactacactgccattgacccgacctacggcacgctggacgactttgacgaactggttgcccgggcgcatgaacacggtatccgcatcgtgctggatatggtctttaaccacacgtccacgcagcacgcctggttccgcgagtcgctggataaagcgagtccgtaccgccagttctatatctggcgcgacggtacgccggatacgcttcccaacaactggcgctccaaatttggcggcaacgcctggcgctggcatgccgaaagcgaacagtattatctgcacctgttcgcaccggagcaggcggatctcaactgggaaaacccggcggtgcgcgccgagctgaaaaaagtgtgcgagttctgggccgatcgcggcgtggacggcttacgtctggacgtcatcaacctggtttcaaaagatcaggatttcccggacgataccctcggcgacggtcgccgcttctacactgacgggccgcgcatccacgaatatcttcaggagatgagccgggacgtctttaccccgcgtaacctgatgacggtgggcgagatgtcctccacctcgctggagaactgccagcagtacgcgtctcttgatggccgcgagctgtcgatgacctttaacttccaccacctcaaggtggactaccccggcggcgaaaaatggacgaaggcaaagccggacttcgtggcgctgaaaacccttttccgccactggcagcaggggatgcacaataaagcctggaacgcgctgttctggtgtaaccatgaccagccgcgcatcgtgtcgcgctttggtgacgaaggggaacaccgcgtggcggcggcgaaaatgctcggcatggtgctgcacgggatgcagggcacgccgtatatctaccagggtgaagagctgggtatgaccaacccgcatttcagccgtatcaccgactaccgcgacgtggaaagtctgaacatgttcgccgaacagcgggctaacggacgcgataccgatgaactactggcgattctggcgagtaagtcacgcgataatggccgcacgccgatgcagtgggacgcctcgcataatgcgggctttaccgaggccgagccgtggattggcgtttgcgacaactacgaaaccgtgaatgtccgcgcggcgctggacgaccccgattcggtgttctacacctaccagtcgctgattcgcctgcgcaaaaccctgccggtactgacgtggggggattatgaggatctcctgcctgaccacccttccctgtggtgctatcgccgccagtggcaggggcaaacgctgatggtggtggcgaacctgagccatttgcctcaggaatggcaagcggacgctctcagcggcgagtcgcaggtggtgataagcaactaccccgcccctcacacctcaatgcttcgtccgtttgaagccgtgtggtggctaaagcagtaa

SEQ ID NO: 3263 - DNA, 483 bp, Enterobacter cloacae
gggcatcaggttaacgctatgaattatcaccagtactaccccgtcgacatcgtcaacggccccggcacccgctgtaccctgtttgtatcaggctgcgttcacgagtgccccggctgctacaacaaaagcacctggcgcctgaactcgggtatgccgtttaccgctgagatggaagaccgcatcatcaacgacctgaacgacacgcgcatcaaacgccaggggatctcgctctccggcggcgacccgctccatccgcaaaacgtgccggagatcctgaagctggtaaaacgcatccaccacgagtgcgcgggaaaagacatctgggtctggacgggctataagctggatgaactgaatgcgcagcagatggaagtggtggatctaattaacgtcctggtcgacggcaagttcatgcaggatctaaaagatcctatgcttatctggcgcggcagcagcaaccaggttgtgcatcatctgcgttga

SEQ ID NO: 3264 - DNA, 588 bp, Enterobacter cloacae
ctggtaacattagcctctttttttaaggagcctgacatgactaagcagcccgaagactggctcgacgacgttcccggtgatgacatcgaagacgaagatgatgagatcatctgggtcagtaaaagtgaaattaaacgtgacgccgaagagttaaaaaagcttggcgcagaaatggtagaactgggtaagaatgcgctggataagatcccgctcgaccaggatctgcgtgatgccattgaactggcacagaaaatcaagaaagaagggcgtcgccgccagcttcagcttatcgggaaactgctgcgtcagcgcgacgtggagccgatccgtcaggcgctggacaaactgaaaaaccgccacaaccagcaggttgcgctgttccataagctggagcagatccgcgaccgtctgatcgagcaaggtgatgacgcggtacctgaagtgctgaacctgtggccgaatgccgaccgccagcagctgcgttctttgatccgtaacgcgaagaaagagaaagaagggaataagccgccgaagtcagcgcgtctgattttccagtatctgcgcgagctgtctgagaacgaagagtaa

SEQ ID NO: 3265 - DNA, 468 bp, Enterobacter cloacae
cccgtgcgaatgggcgcaaaaaaacaacgccaccttacggtggcgttgtcgtttttcagaactggtctctgtctaaccagttaccgctttcaatcagcgttaacccgtcgaccgaacgttggtacacgtacatccatgcactgccgtaaggcgtctggatcaactggcgagcgtattcaccgcccctggtgcgcaaggcatcaagttcggccagcgtggcattatcaatacgataaacctcaccctgtaccgttccgttccccggaactgcgcctggatagtggcccagactgtacaactggtagttttcgattgtgtaatttcccagcaactgggcgttggtcatccagtggctgttgccttgcctggttcgtaaactgccgtaaacaaatattcgcattgctaaaactcaaactgatagagcagatcaagtgcctggtctacgccggacactgcttccagatatag

SEQ ID NO: 3266 - DNA, 567 bp, Enterobacter cloacae
ggaaacaccatgaccctacgtaacctcctggtagcagcttgcctgttgctgccgctgatggcttccgcacataacattgaaaaaggacaacgtgtcccgccggtcggcattgctgaccggggagaattgattctcgacaatgataagtttagctacaaaacctggaatagcgcgcagcttgcgggcaaagtgagagttgtacagcatattgccggacgtacatccgctaaagagaaaaacgctaccctcgtggaggcgatcaaggccgcaaaactcccgcacgatcgctaccagaccaccaccatcgtgaacaccgacgacgccattcccggctccggcatgtttgtgcgctcaagccttgagaacaataagaagctctatccctggtcgcagtatatggtcgacagcaacggcgtgacgcgtaaggcgtggcagctggaagaggagagttcagcaattgtcgtgctggacaaaaacggtcgcgtagagtgggttaaagacggcgcgctgacgcaggatgaggtgcagcaggtggttgccctgctgcataagctgctgactcagtaa

SEQ ID NO: 3267 - DNA, 2073 bp, Enterobacter cloacae
acaattccgctatctgtgaagcaattctggtttcagcgcccttttttctggcagcattcacacttctgtaagcaacaaatactacatacatattcttttgtggcttggatcgaaaaaaggactcctcagatgattaagtttagcgcaacgctcctggcaacgctgattgcggcaagcgttcaggcagcgacggtggatctccgtattctggaaaccaccgatctgcacagcaatatgatggacttcgattactacaaagatacccctacggaaaaattcggactggtacgcacggcaagtttgatcaacgccgcccgcggtgaagtgaaaaacagcgtgctggtcgataacggggacttaattcagggcagcccgctcggagactacatggcggcgaaggggctgaaaaaaggcgagatccaccctgtctataaagcgatgaacaccctggattatgcggttggcaacctgggcaaccacgaatttaactacggcctgaaatacctgcacgacgcgctggcaggggcaaaattcccgtacgttaacgccaatatcatcgacgttaagacgaagaagccgcgcttcaccccttatctgattaaagagaccgaggttgtcgaccaggacggtaaaaaacagacgctgaaaatcggctatatcggttttgtaccgccgcagatcatgacgtgggataaagccaacctcgacgggaaagtaaccgtcaacgacattaccgaaaccgcgcgcaaatacgtgccgaagatgcgggcgaaaggggcggatgtggtggtcgtcgtggcccactccggcctctcggccgacccgtatcaggtgatggctgagaactccgtgtactatctcagccaggtgccgggcgtggatgcgatcctgtttggtcacgcccatgccgtcttcccgggcaaagatttcgctgatatcaaaggcgcggacatcgaaaaagggacgctcaacggtgtgccatcggtgatgccgggcatgtggggtgaccaccttggcgtggtggatctggtgctgaataacgacagcggaagctggaaagtcacgcagtcgaaagcggaagcgcgtccgatctacgacgcagcggccaaaaaatctctggcaggggaagataaaaagctggtcgacgtcctgaagcatgaccacgacgcgacgcgtgaatttgtcagcaagccgatcggtaaatcggctgataacatgtacagcttcctcgcgctggtacaggatgacccgaccgtgcaggtagtcaacatggcgcagaaagcctatgcggagcactatattcagggcgatccggatctggcaaatctgccggtactgtctgccgcggcgccattcaaagtgggcggacgtaagaacgatccggccagctacgttgaggtggaaaaaggccagctgaccttccgtaatgccgccgatctctacctctatcccaacacattcgtggtggtgaaagccaccgggaaagaggtgaaggagtggctggagtgctctgccggacagttcaaccagatcgatccgcacagcagcaaaccgcagtcgctgattaactgggacggtttccgcacctacaacttcgacatgatcgacggcgtggattatcagattgacgttacccagcccgcgaaatatgacggcgaatgtcaggccattaatccgcaggcagaacgcatcaaaaacctgaccttcaacggcaaagcgattgatcctaatgccactttcctggtggtgaccaacaactaccgcgcctatggcggtaagtttgccggtacgggtgacagccatatcgcctttgcctcaccggatgagaaccgttcggtgctggcggcgtggatcagcgcggagtcgaaaaaggcgggtgaaattcatccggcggtggataacaactggcgacttgcgccgatccacagcgacactaagctggatattcgctttgagacatctccgtccgataaagcagccgcgtttatcaaggataaggcgcagtatccgatgcaaaaggtcgcgacggatgatattgggttcgcgatttatcaggtggatttgagcaggtag

SEQ ID NO: 3268 - DNA, 2151 bp, Enterobacter cloacae
aatggagtgatcatgacaccgcatgtgatgaaacgtgatggctgtaaagtgccgtttaaatcagagcgcatcaaagaagccattctgcgtgcagctaaagcagcgggagtcgatgacgcagattactgcgccaccgtcgcagaagtcgttagcagccagatgcatgaacgcagccaggtggatatcaacgagatccagaccgcggttgaaaaccagctgatgtctggtccgtacaagcagctggcgcgcgcctacattgagtatcgtcacgaccgtgacgtccagcgtgagaaacggggtcgccttaaccaggagatccgcggcctggtagagcaaaccaactcgtcgctgctcaatgaaaatgccaataaagacagcaaagtgatcccgacccagcgcgacctgctggccggtatcgtcgccaagcactatgcccgtcagcatctgctgccgcgcgatgtagtctcggcgcacgagcgcggtgagatccactatcacgatctcgactactcgccgttcttcccgatgtttaactgcatgctgatcgacctgaaaggcatgctgacccacggttttaaaatgggtaacgccgagattgagccgccgaaatccatctccaccgcgacggcggtcacggcgcagatcatcgcccaggtggcgagccacatctatggcggcaccaccattaaccgcattgatgaagtgctggccccgttcgtgaccgagagcttcaacaaacaccgtaaaacggcggaagagtggcagatcccgaatgctgacggttacgcccgttcccgcaccgagaaagagtgctacgacgccttccagtcgctggaatatgaggtaaacacgctgcacaccgccaacggccagacgccgtttgtgaccttcgggtttggcctcggcaccagctgggaatcacgcctgatccagcagtctattctgcgcaaccgtatctccggcctcggtaaaaaccgtaaaacggcggtgttcccgaaactggtgttcgccatccgcgacggcctgaaccacaagtttggcgatccgaactacgacatcaaacagctggcgctggagtgtgcgagcaagcgtatgtacccggatatcctcaactacgaccaggtggtaaaagtcacgggttcgtttaaaacgccaatgggctgccgcagcttcctcggcgtgtacgaagatgagaacggcgagcagatccacgacgggcgtaacaacctgggcgtcatcagcctgaacctgccgcgcatcgcgctggaagccaaagggaatgaagcggccttctggacgctgctggatgaacgtttacagctggcacgtaaggcgctgatgacccgcatcgcccgtcttgaaggggtgaaagcccgcgtcgcgccaattctctatatggaaggagcctgcggcgtgcgcctgaaagcggacgatgatgtgtcggagatcttcaaaaacggtcgcgcgtcgatctctcttggctatatcggcattcacgaaacgattaacgcgctgtttggcgacaagcatatctatgacaacgacgccctgcgtgagaagggtatcgcaattgtgcagcgcctgcgcgatgcggtagaccagtggaaagaggaaactggttacggtttcagcctgtacagcacgccgagtgaaaacctctgcgatcgcttctgccgtctggacaccgccgaattcggcatcgtggaaggcgtgaccgacaaaggttactacaccaacagcttccacctcgatgtggagaagaaggtgaacccgtacgacaagatcgacttcgaagcggcttatccgcccatcgcgaacggcggttttatctgctatggcgagtacccgaacattcagcacaacctgaaggcgctggaagacgtgtgggattacagctatcagcacgtgccgtactacggaaccaacacgccaattgacgagtgctacgagtgcggctttaccggtgagttcgagtgcaccagcaaaggcttcacctgtccgaaatgcggtaaccacgatgcagcccgcgtctccgtgacccgccgcgtgtgcggctacctcggcagcccggatgcccgtccgtttaacgccggtaagcaggaagaggtgaagcgcagggtgaaacatctggggaatgggcagatcgggtaa

SEQ ID NO: 3269 - DNA, 1050 bp, Enterobacter cloacae
gattgttggacatcaaccgctttactcaacataagatgcagggaaagtgttatgaaaacgttaggtgaatttattgtcgaaaagcagcacgagttctctcatgctacgggtgagctcactgctttgctgtcggcaataaagctgggcgctaagatcatccaccgcgatatcaacaaggccggtctggtcgatatcctgggtgccagcggtgccgagaacgttcagggtgaggttcagcagaaactcgacctgttcgccaatgaaaaactgaaagcagcactgcgcgcgcgcgacatcgttgcgggtatcgcctctgaagaagaagatgagatcgtcgtattcgaagggtgtgaacacgcgaaatacgttgttctgatggatccgctggacggctcctccaacatcgacgttaacgtttctgtcggtaccattttctccatctaccgtcgcgtaacgccggttggcacgccggtgacggaagaagacttcctgcaaccgggcagtaaacaggttgctgccggttatgtggtgtatggctcgtccaccatgctggtgtacaccaccggctgcggcgtacacgcctttacctacgatccgtccctgggcgtgttctgcctgtgccaggagcgtatgcgcttcccggagaagggcaacacctactccatcaacgaaggcaactacatcaaattcccgaacggcgtgaagaagtacatcaaattctgccaggaagaggataaagccacccagcgcccgtacacctcacgctatatcggctcgctggtggcggatttccaccgtaacctgctgaagggcggtatttacctctacccaagcaccgccagccacccggacggaaaactgcgtctgctgtacgagtgcaacccaatggcattcctggccgaacaggcaggcggcaaggcgagcgacggtaaagagcgtattctggatatcgtgccagaaagcctgcaccagcgccgttcgttcttcgtcggcaaccgccatatggtggatgacgttgaacgcatgatccgcgaattcccggacgcgtaa

SEQ ID NO: 3270 - DNA, 630 bp, Enterobacter cloacae
aggcgcgagggagagaagtcgaaaacaggcggagactttcagcgccagttggctataatacctgccacttgtttaccatccattttaaaggacaccgacatgagcttactcaacgtccctgcgggtaaagaactgccagaagacatctacgttgtgatcgaaatcccggccaacgcagatccaatcaaatacgaaatcgacaaagacaccggtgcgctgttcgttgaccgtttcatgtctaccgccatgttctatccgtgcaactacggctacatcaaccacactctgtctctggacggtgacccggttgacgtactggtcccgacgccgtacccattgcagccaggctccgtcattcgctgccgtcctgttggcgtgctgaaaatgactgacgaagcgggtgaagatgcgaaactggttgccgtaccgcacaccaagctgagcaaagagtacgatcacattaaagatgtgaacgacctgccagagctgctgaaagcgcagatcgcccacttcttcgagcactacaaagatctcgaaaaaggcaaatgggttaaagttgaaggctgggataacgcagaagcggcgaaagcagaaatcatcgcctctttcgagcgtgctgctaagaagtaa

SEQ ID NO: 3271 - DNA, 672 bp, Enterobacter cloacae
ccgaaacaacgctaccccggaggccccaccgtgagtttatttgataaaaagcatctggtatcacaagccgatgcgttaccgggacgcaacacccctatgccagtggcgacattacacgccgtaaacaaccattcaatgacaaacgttcctgatggaatggagatcgccctgtttgccatgggctgcttctggggcgtagaacgcctgttctggcaactgccgggcgtgtacagcaccgctgcgggctacaccggaggatatacgcctaacccaacctaccgcgaagtctgttccggtgagaccggtcatgctgaagcggtgcgtgtggtgtatgacccgagcgtcattagctatgaacagctgctccaggtgttctgggaaaaccatgacccggcgcagggcatgcgtcagggtaacgatcacggcacccaataccgttcggccatctacccgctcaccccagagcaggaggccgcggcccacgccagcctgacgcgtttccaggaagcgatgcaggcggccggtgataaacgtcaggtcacgacggaaatcgctaccgcgaaaccgttctactatgccgaagacgaccaccagcagtacctgcataaaaatccgtacggctactgcggcattggcggcatcggcgtctgtctgcctccacaacaggactga

SEQ ID NO: 3272 - DNA, 1341 bp, Enterobacter cloacae
actatgttaaacagtattttagtaatactttgtcttattgccgtcagtgcatttttctcgatatcggagatctcgctggctgcctcccgtaaaatcaaactgaagctgcttgccgacgagggcaacatcaacgcatcacgcattctgaaaatgcaggaaaatcccggcatgttctttaccgtggtgcagattggcctgaacgcggtcgccattcttggcggtatcgtgggtgatgcagcgttttctccggcgttttatggcctctttgttaagtacatgtccgtagagctggccgagcagttgagcttcatcctctccttctccctggtgaccggcttgttcattttattcgcggacctgaccccgaaacgcatcggtatgattgcgccagaagctgtggctttgcgtatcatcaacccgatgcgcttctgcctttatgtcttccgtccgctggtgtggttctttaacggcctggcgaacgtcattttccgcatcttcaagctgccgatggtgcgtaaagacgacatcacctccgatgatatttatgccgtggtggaagccggggcgctggcaggcgtgctgcgcaagcaggagcacgagctgattgagaacgttttcgaactggaatcccgtaccgtgccgtcctccatgaccggccgtgaaaacatcatctggttcgatctgcatgaagacgagcagagcctgaagaccaaagtggcgcagcatccgcactccaagttcctggtctgtaacgaagatatcgaccatatcatcggctatgtggactccaaagacctgctgaaccgcgtgctggcaaaccagagcctggcgctgaacagcggcgtgcagatccgcaacaccctgattgtgccggacaccctgacgctctccgaagcgctggaaagtttcaaaaccgccggggaagacttcgcggtgatcatgaacgaatacgcgctggtggtgggcattattaccctcaacgacgttatgacgaccctgatgggcgacctggtcggccaggggctggaagagcagattgttcagcgtgacgaaaattcatggctcatcgatggcggtacgccgattgaagacgtcatgcgcgtgctcgacatcgacgagttcccgcagtccggaaactacgagaccatcggcggctttatgatgtttatgctgcgtaaaatcccgaaacgtaccgactcagtgaagttctccggcttcaagtttgaagtggtggatattgataactaccgcatcgatcagctgctggtaacgcgtattgatagcaaaccgaccgtgctggtgccgaaactgccggatgcggaagagaaggtgtcggcgtaa

SEQ ID NO: 3273 - DNA, 225 bp, Enterobacter cloacae
ttcgcaggagatacaagaatgaaaattttccaacgctacaacccgcttcaggtggcgaagtacgtgaagatcctgttccgtggacggttgtacatcaaggatgttggcgcttttgagttcgataagggcaaaatccttatcccgaaagtgaaggacaaacagcacttgtctgtgatgtccgaagtcaaccgtcaggttatgcgtctgcaaactgagatggcttaa

SEQ ID NO: 3274 - DNA, 2940 bp, Enterobacter cloacae
attatgagtttatggaagaagataagcctcggggtgctgatttttatcgtattactgctcggtacggtggcgtttctggtgggcaccaccacgggcctgcatctgctgtttaacgccgcgaaccgctgggtgccggggctggaaatcggccaggtgacgggcggctggcgcgatctgcgcctgaaaaatatccgttacgaacagcccggcgtggcggtgaacgcgggcgagtttcatctggcggtcaagctcggctgcctgcgtgacagccaactgtgcgtaaacgatctgtcgctaaaagacgttaacgtggcgatagattccaaaaaaatgccgaagtctgagcctgtcgaagaagaggacagcggcccgctgaatctctccacgccgtacccgattgcgctctaccgggttgcgctggataacgtcaatatcaaaatcgacgatacgacggtatccgtgatggatttcacctccggtctgcgctggcaggagaaaaacctcaccctgaccccaacctccctgcaagggctgctgattgcgctgccgaaggtggccgacgtggcgcaggaagagatcgtcgagccgaagatccagaacccgcagccggaagaaaaaccgctgggcgaaacgctgaaagatctcttctcgaaaccggttctgccggagatgaccgacgtgcatctgccgctgaacctcaatatcgaagagtttaagggcgagcagctgcgtctgacgggtgataccgatctgacagtcttcaacatgctgcttaaagtcagcagcatcgacggcaacatgaagctcgacgcgctggatatcgactccagtcagggctcggtgaacgcctcaggcaacgcgcagctgcgcgacaactggccggttgatattacgctgaacagcgccctgaacatcgatccgctgaagggcgaaaaggtgaaggtgaaggtcggcggcgcgctgcgtgagaagctggagttcggcgtgaacctttccggaccggtggatatggtgctgcgcgggcaaacccagctggcagaggccggtttaccgctcaaccttgaggttgtcagcaagcagctttactggccgttcaccggcgaaaaacagttccaggctgacgatctgaagctgaagctgagtggcaaaatgaccgactacacgctgtcgttccgcacggcagtgaaggggcagggggtaccgcccgccgatatcaccctggatgcgaagggtaacgagttgcaggttaacctcgacaagctgaccgtggcggcgctggaaggaaaaacagagctgaccgcgctgctcgactggcagcaggcgatcagctggcgcggcgagctgaagctgaccgggatcaacaccgctaaagaggtcccggactggccgtcaaaactggatggcctgatcaaaacccgcggtagcctgtacggtggcacctggcagatggacgtgccggaactcaagctcaccggcaacgtgaagcagaacaaagtcaacgtagagggctcgcttaagggcaacagctatctccagtgggtgatcccgggcctgcacgtggcgctgggccgcaacacggcagatatcaaaggcgagctgggggtgaaagatctcgatctggatgccaccatcgacgcgccaaatctcgataacgccctgccgggtcttggcggcacggcgaaggggttagtgaaggttcgcggtacggtggaggcaccgcagctgctggcggacatcaccgctaataacctgcgctggcaggaactttccattgcccgcgtgcgcgtcgaaggggacgtgaaatcgaccgatcagatcggcggaaacctggatctgcgcgtggagcgtatctcccagccggacgtgaacatcagtctggtcacgctggcggcaaaaggtaacgaaaagcagcacgatctccagctgcgcgtgcagggcgagccggtctccgggcagctgcacctgacgggcagttttgaccgccaggcaacgcgctggaagggcgtactggataacacccgcttcagcacgccggtcggcccgctggtgctgtcccgatccatcgcgctggactaccgcaatgcggagcaaaagttaagcattgggccacactgctggaccaacccgaatgctgagctgtgcgtgccgcagaccattgatgcgggcgcggaaggacgcgcgcagatcaacctcaaccgtttcgacctggcgatgctgaaaccgtttatgccggaaaccacccaggccagcggggtcttcagcggtaaagcggacgtcgcgtgggacaccaccaaagaggggctgccgcagggcagcgttacgctctccgggcgtaacgtgaaggtgacgcaggaggtcaatgacgcgccgctgccggtagcgttcgacaccctgaatgtgaacgctgacctgcgtaacaatcgtgctgaactgggatggctgatccgcctgaccaacaacggtcagtttgacggacaggtgcaaattaccgatccgcaagggcggcgcaatctcggcggcaacgtcaatattcgcaacttcaacctggcgatggtgaatccgatcttctcgcggggagaaaaggcggcggggatgctcagcgccaacctgcgtctggcgggggatgcgcaaagcccgcagctgtttggccagatgcggttaaacggcgtggacattgacggtaactttatgccgttcgatatgcagccaagccagctgacgatgaactttaacggccaaagctcaaccctcagtggctcagtgctgacgcagcagggacaaatcaacctgagcggtgacgcagactggagccagctcgacaactggcgcgcccgtattgcggccaagggcagcagggtgcgtatcacggtaccgccgatggtgcgcctgacgtttcgccgaactggtgcttggaggcaacccgggttttttcacccttga

SEQ ID NO: 3275 - DNA, 834 bp, Enterobacter cloacae
cgccgtgttgacgtaccgtggcgcgcatcgtgttcacgaagtcccggaaagcgcggtggggtctccagtgatggagttatgctcaatgaaaatctgaaacctgttgaacagaagagcgctggcataccgatcaatagtaatcttatcgtgcacgtggggaataacgtgcgtttggacgcgtttgggctgaaggcgagactcacgggtgacctgaaagtggcgcaggatcaacaggggcttggcctcaatggacaaatcaatattcctgaagggcgcttccatgcctacggtcaggatttgattgtgcgtaaaggcgagctgctgttctccggtccaccggatcagccggtactcaatatcgaagcgatacgtaacccggaagccaccgaagatgatgtgattgcgggcgtgcgcgtgacgggctccgccgatgaacctaaggcagagatcttctctgacccggccatgtcgcaacaggaagcgctctcttacctgctgcgcggccagggtctggatagccaacagggcgatggtgcggcaatgacatcaatgttagtcggtctgggggttgcacaaagtggtcaggttgtgggtaaaatcggcgagacgtttggcgtaagcaatctggcgctggacactcagggcgtgggtgactcttcgcaggtagtggtcagcggctatgtactgccgggtctacaggtaaaatatggcgtggggatctttgactcactggctacactcacgttacgttatcgcctgatgcctaagctatatctggaagcagtgtccggcgtagaccaggcacttgatctgctctatcagtttgagttttag

SEQ ID NO: 3276 - DNA, 1053 bp, Enterobacter cloacae
atgccatcgcggcgtaaggagtcaaatgtgatgtcccgttctctttcgcaaactggcgaagcgaagcgccgcttcacctggccgaccggcacgccgcaaatcgtggcgctgctgctggtgctgctggtggatagcctggtggctccgcattttttccagatcgtcgtgcaggatggccgcctgtttggtagcccgatcgacatcttaaaccgtgccgcgcccgtggcgctgctggcgattggtatgacgctggtcattgccaccggcgggatcgacctctccgtcggtgcggtaatggcgattgcgggcgccaccgccgcctcgatgaccgtcgccgggcacagcctgccggtggttctgctggccgcgctgggctccggcgtgctagccgggctgtggaacggcattctggtcgcggtgctcaagatccagccgtttgtcgcgacgttgattttgatggtggccgggcgcggtgtggcgcagcttattacctccggtcaaatcgtcacctttaactccccgagcctggcgtggatcggcagcggtaattttctgttcttcccgacgccggtgatcgtcgcgctggtgacgctggtggtgttctggcttttcacccgcaaaacggcgctcgggatgttcatcgaagcggtggggattaacattcgggccgcgaaaaacgccggggtaaatacgcggctgatggtgatgctgacttacgtgctgagcggcgtctgtgctgcgattgccggggtgatcgtggccgccgatattcgcggagctgatgccaataacgccggactctggctcgagctggatgcaatccttgcggtggttatcggcggtggatcgctgatgggcggacgttttaatctgctgctctcggtggtgggggcgttgattattcagggtatgaataccggtattttgctctccgggttccagccggagctgaatcaggtcgtcaaagcggtcgtggtgcttatcgtgcttatcgtgcagtcgccgcgctttatcactctcattaagaggttccgcggtcatgataaaacgtaa

SEQ ID NO: 3277 - DNA, 1209 bp, Enterobacter cloacae
tcgtcccctctcccctttggggagagggttagggtgaggggaaacaaaccgcacacacccgaaggagccaccatgcacacccgaaccctgcttgtcgcttcactctcaatgctcgccaccgccgctgtcgcccagacgcaatacgcctgggtgggtacctataatccgaacggcgaagggctgtaccgctttaccgtcgacccgcaaaccggtgcgctgaacgataaaacgctggtgagcaagctgccgaacgccgcgcagttaaccgtctcacacgacggcaaaacgctctatctggcaagcgaagtggagcagggcgtggtgcaggcgctgcgcatcggcgataacggcacgctgagcgagctgaatcaggtggcctccggcggcgcggggccggtatatctttccctgacgccgaacggtaaacatctgctggtggcaaactacatcagcggaactgtcgcggtgctgcccgttaacgcagacggcagcctgagcgatgctacggacacccatcaggacaaaggcgaaccgggcgcggcgaagccggaagctgccgtcgagggcagtttcgccatcagcgatcataacggcccgcatgcgcacatgatcgccgccgatccgagcgggaaatacgttttttccaccgatctggggctggatcgcatctatcagtaccgttttgacgatcaaaccgggaagctgactccgaacgatccgccgtttatcagcgcctcctcaaaaggggccgggccgcgccacttcgtctttacgccgaaaggtgatgccctgtggctgattaacgaagaggcgtctacgctcacccattatgcgctggacagtaatggcaggctgaaagagggtaaaacggtttcagccctgccggacggttataaaggcaccagttttgctgccgggctggcgctaagtgccgacgggaaacagctgtatgtcgctaaccgtttgcataacagcatcgggcactttaccgtaacggcagagggtacgctgacgcatcaggatgatgtctggacgcgcggcgactatccgcgcaccctgacgctcgataagcagggtcgctggctgtacgtcatgaaccagcgcagcgacaacattacccgtttccgcgtggcaccggacggcaagctgagcgccgagccagactataccccggtcggcagcccatcccagatggtcatttcaccttaa

SEQ ID NO: 3278 - DNA, 774 bp, Enterobacter cloacae
gttatgcccactgcgttaacgaagaggtggagaatgttagataaaatttgtcagctcgcacgggatgcgggtgatgccattatgcaggtgtacgacggtgcgaaaccgatggatgttgtcagcaaagcggatgactccccggtgacggcggcggatatcgcggcgcatgcagtgatcctgaaaggtttgcaggccctgacgccggatattccggtcctttctgaagaagcgccccagagctgggatgaacgtcagcactggcagcgttactggcttgtcgacccgctggacggcacgaaagagtttatcaagcgtaacggtgaattcaccgtcaacatcgctctgattgaaaacgggaaagcggtactgggcgtggtttatgccccggtgatgaaggtgatgtacagcgcggcggaaggtaaagcctggaaggaagagtgcggcgtgcgtaagcagatccaggtgcgtgatgcccgtcctccgctggtggtgatcagccgctcgcacagtgacagcgagctggaggaatatctgcaacagctgggtgaacaccagacgacgtcgattggctcgtcgctgaagttctgtctggtggcggaagggcaggcgcagctgtacccccgtttcgggccgacgaacgtctgggatacggcggcagggcatgcggtggcggcggccgctggcgcgcatgtgcatgactggcagggtaagccactggactacaccccgcgcgaatcattcctgaatccgggcttccgggtgtcactttactga

SEQ ID NO: 3279 - DNA, 1860 bp, Enterobacter cloacae
gaaatatttgggtgttacaccctttttcaacccgtaatttgggtttttggctttcaggccgtattttgccgcggagcggcactgcatttgcttccagggtggaaacagggatattcaggagaaaacgtgacaaagatccgccagttatgtttagtcagcttactgctgaccagcgggattgccagcgcggcgaatgtccgtttgcaggttgaggggttatccggggcgctggaaaaaaacgtgcgtgcgcagctttctactatccagagcgatgaggtcacgccggatcggcgttttcgcgcgcgcgtggatgacgccattcgcgaaggcttaaaggcgttggggtactacgaacccaccatcgatttcgatttacgcccgccgccggcaaaaggacgtcaggtgttgattgcccgcgtctcgccgggcgaacccgtcctgattggcggcacgaacgtggtgctgcgcggcggcgcgcgcacggatcgtgactacctggatctgctcagcacccgtccgaaagtgggcaccgtgctcaatcacggggattacgatcgttttaaaaaatcattaaccagcgtttcgctgcgcaaaggctacttcgacagccagttcaacaaaagccagctaggcgttgcgcttgagcgacgtcaggcattctgggatatcgattacgacagcggcgagcgctaccggtttggcgatgtgaccttcgaaggatcgcaaatccgtgatgagtatctgcaaaacctggtgccgtttaaaaagggcgactactaccagtccagcgacctgggcgagctgaaccgtcgtttgtccgcgacgggctggtttaactccgtggtggtggcgccggaatttgataaatcccgtaaaacgaaagtgttaccgctgcatggcgtggtctctccgcgcaccgaaaacaccattgagaccggtgtcggctactccacggacgtcggcccgcgcgtgaaagcctcgtggaaaaaaccgtggatgaactcctacggccacagcctgaccaccagcgtgagcctgtctgcgcctgaacagcagctggacttcagctataaaatgccgctgctgaaaaatccgcttgagcaatactacctcgtgcagggcggctttaagcgtaccgatttgaacgataccgagcaggactcgacgacgcttgcggtatcacgcttctgggatctctccagcggctggcagcgcgccattaacctgcgctggagcctcgaccactttacccaggcaaacgtcactaacaccaccatgctgctttatccgggcgtgatgatcagccgtacccgctcgcgcggtggcctgatgccgacctggggcgactctcagcgctactccatcgattactccaacactgcctggggctccgacgtagacttctccgtctttcaggcgcaaaacgtctggatccgcacgctgtacgacaaacaccgctttgtgatgcgcggtaatctcggctggatcgaaaccggtgatttcgaacgcgtcccgccggatctgcgcttcttcgccgggggcgaccgcagcattcgcgggtataagtacaaatcgatctcacctgaaaacgacaaaggccagttgaccggggcgtcaaaactggcgaccggctcgctggagtaccagtacaacgtcagcggcaagtggtggggggcgatgttcgttgacggcggtgaagcggtgaacgatatccgccgcagcgatttcaaaaccggcgcgggcgtaggcgtgcgctggcagtcaccggtcgggcccatcaagctcgatttcgccgttccggtgggcgacaaagacgaacacggtttacagttttacatcggtctggggcctgaattatga

SEQ ID NO: 3280 - DNA, 1089 bp, Enterobacter cloacae
atcaggtcgtcaaagcggtcgtggtgcttatcgtgcttatcgtgcagtcgccgcgctttatcactctcattaagaggttccgcggtcatgataaaacgtaatttgccgttaatgatcacgctgggcgtgttcgtgctgggatacctttactgcctgacccagttcccgggcttcgcctccacgcgggtgatttgcaacatcctgaccgacaatgcctttttaggcattatcgccgtcggcatgacgtttgtgatcctctccggcgggatcgatctctccgttgggtcggtgatcgcctttactggcgtgttccttgccaaggcgattggcttttggggcatttcgccgctgctggcttttccgctggtgctggtcatgggctgcgcgttcggcgcctttatggggcttttgatcgatgcgctgaaaatcccggcctttattatcaccctcgccgggatgttcttcctgcgcggcgtgagctatctggtgtcggaggagtcaattcccattaaccacccgatctacgacacgctctccagcctggcgtggaaaatccccggcggggggcgcctgagcgcaatggggctgctgatgctgggcgtggtggtgatcgggatcttcctcgcccaccgtacccggtttggtaaccaggtttatgccattggcggcagcgccacgtccgcgaacctgatgggaatttccacgcgcagcacgactatccgcatctacatgctttcgaccgggctggccaccctcgcggggattgtattctcagtttatacccaggcaggctatgccctggcgggggtgggcgttgagctggacgccattgcctcggtagtgattggcggtacgctgctcagcggcggagtggggacagtcctcggcacgctgtttggcgtggcgatccaggggctgattcagacctatatcaacttcgacggcacgctcagctcctggtggaccaaaatcgccatcggcattctgctatttatttttatcgcgctccagcgcggcctgacggtgctgtgggagaaccgccagagctcgcctgttacccgggtgaatacatctttaacagagcgataa

SEQ ID NO: 3281 - DNA, 1623 bp, Enterobacter cloacae
cggccgatactctttttttatgcccagaaatatctcgctaccggaaataacatcatgcttaaaacgctatcgattcgtaccggcttgctctctttactggccgttatgacccttctgctgctgattgtcagcggcatcggcatttatgcccttacacaaagttccgcttctctccagcgcatcaatcatcttcagggtgaacagatggtgcagctgaatgccggctatacgctgatcctgcgcgcgcgtaacgaagcggggcaggccgttcgcatgatggaggtcggcctgctggacgatgcggccagggcggtcaaaaccattaaccaggaagtggcgctggcacagaaaacgctgaaggacgtgatcggcagcggcgtggcggatgagcaggggcaaaagctgctggataacgtcgccgcgagcctggcggtgtacaaccagcagggtatcagcccgatgctgaaagccctgaacgagcaaagcgcggacagctattacgatctgctggaaaacaagctggtcccggtggcgaagcagtttgataacgatatgcaggcgttccaggcatggagcgaggcgcgcggcaaagcggaggtgagcgccgtgcaggcgagtaaaacccgcgtgctgatcttgattatcgtcgcggcgctgctgacggctggcattatcgtgctggcctggctggttctgcgccatatgctgctcgagccgctttcagcctcgattgcccagctggaacatgtggcggccggggatttaacccataccctgaacgcgccggcgagccaggaatttaatcgccttaacgcggcgatcgaagggatgcgccagtcgctgatggactccgttctgcgggtgcgtgacgccagctcgcagattgataccggcagccgcgagctgacggccgggaatatgaacctggctcagcgcacggaatccaccgccacctcgctggagcagacggccgccagcatggaagagatcaccgccacggtgaaacttaacgccgataacgccgagcaggcgcaccaactggcgaagtcggtctccgataccgccgatcacggcagcgaaatggtctgctatgtcattgagaagatgcgcgacatctccggcagctcggcacgcatcgccgatatcctgagcgtcatcgacggcattgccttccagaccaatattctggcgctgaacgcctccgttgaagcggcgcgtgcgggtgagcaggggcgaggttttgcggtcgtggcgggtgaggtgcgtaatctcgccagccgcagtgctgatgcggcgaaagagatccactcgcttatcagcgattcgcaaacccacgtgaacgagggcagcgagctggcgcagcaggccggtgagacgatggacgagatcgccaccgaagtactgcgtatgaccaaactgatgcgtgaaattgcgacggcctctcaggagcaaagccgcggtattgagcaggtgaatatcgctgtcaatcagatggatgaaacggcgcagcaaaatgcggcgctggtccagcaatcatctgcggcaacacgttccctggaggagcagtctcgcgagctgatggaagcgatggcctccttcaaattgacgacgcaaacggcatga

SEQ ID NO: 3282 - DNA, 1377 bp, Enterobacter cloacae
cgtatgcgcattcatatattggggatttgtggcactttcatgggcggactggcaatgctggcgcgctcgctgggccatgaagtgacaggttcggacgccaatgtgtatccgccgatgagcacgctgctcgagaagcagggaatttctctgattcagggatacgacgccagccagctggagccgcagccggatctggtgatcgtgggtaacgccatgacccgtgggaatccatgcgttgaagcggtgctggagcgcaatatcccgtacatgtctggcccgcagtggctgcatgattttgtcctgcgcgaccgctgggttgtcgccgttgccgggacgcatggcaaaaccaccaccgccggtatggcgacctggatcctcgaagcctgcggctacaagccgggctttgtgatcggcggcgtgccgggcaatttcgacgtctccgcacgtctgggcgacagcccgttctttgtgattgaagcggatgaatacgactgcgcgttcttcgacaagcgctccaagttcgtgcattactgcccacgcacgctgatcctcaacaaccttgagttcgatcacgcggatatctttgacgacctgaaagcgattcagaaacagttccaccatctggtgcgcattgttccgggtcagggccgcattatcctgccggagaacgacatcaacctgaagcagactatggcgatggggtgctggagcgagcaggagctggtgggcgagcaggggcactggcaggcgaaaaagctcaacgcggatgcctccgaatgggaagtgctgctcgacggtgagaaagtgggcgaggtgaagtggggcctggtgggcgagcacaacatgcacaacggcctgatggcgatcgccgcggcgcgtcacgttggcgtactgcctgcggatgccgccaatgcgctgggcacgtttatcaacgcccgtcgccgtctggagctgcgtggcgaagcccacggtgtgacggtgtatggcgatttcgcgcaccacccaacggccattctggcgacgcttgccgcattgcgtggcaaagttggcggcaccgcgcgcattctggccgtactggaaccgcgttcgaacaccatgaaaatgggcatctgcaaagacgatctcgcgccgtccttagggcgtgccgacgaagtcttcctgctgcaaccgcagcatattccgtggcaggtggccgaagtggccgacgcctgcattcagccggcgcactggagtgcggacgtggatgtcttagcggatatggtggtgaaagccgcacagcctggcgatcacattctggtgatgagcaacggcgggtttggcgggatccatcagaagctgctggacggtctggcgaagaaagccgcggccgcagagtaa

SEQ ID NO: 3283 - DNA, 1176 bp, Enterobacter cloacae
tacccgcgggcgctccggcgcccgccctatcaggagaaccccatgtttgatttactcctgcgccgtgcgcgcctcgccgacgataccctgaccgatatcgccattcaggacgggaagatcgccgcgacaggcgacattaacgctcccgcccgcaaaacggttgagcttaacggtgatgtgttcgtcagcgcgggctggattgactcccacgtccactgctacccgaactccccgatttaccacgacgagccggacagcgtgggcattgccaccggcgtcaccaccgtggtggacgcgggcagcaccggggccgacgacgtggacgatttctacgccatcacccgcaaagcctccaccgaggtgtttgccctgctgaacatctcccgcgtggggctgatcgcccagaacgagctggccaatatggccaatattgacgccgacgcggtgaaagaggcggtgaaacgccatcctgattttatcgtcggcctgaaggcgcgcatgagcagcagcgtggtcggtgaaaacggcatcaccccgctggcgcgcgcgaaagcgatccagaaagagaacggcgacctgccgctgatggtgcacattggcaacaacccgccgaacctcgacgaaatcgccgagctgctgagctccggcgacatcattacccactgctacaacggcaagccaaaccgcatcctgacgccctccggcgagctgcgtgcctccattacctccgccctgaagcgcggcgtgcgtctggacgttggccacggtacggcgagcttcagctttgaagtggcgaagcgcgctattgcgatgggcattctgccgcacaccatcagctcggatatttactgccgcaaccgcatcaacggcccggtcggctcgctggcaagcgtgatgtcgaaattcctcgccatcggcatgtcattgccgcaggtgattgactgcgtcaccgccaacgccgccgacggcctgcgcctgacgcgcaaaggccgcattcagcctggcctcgacgccgatctgacgctgtttaccctcaagcgccagccgacggtgctgacggatgccgaaaacgacagcctacaggctgaacacattctggtgccgcttgccgcgatccgcgcgggcaagggctacatgaccgaacaagggagcacggaacatgccttcgatttatga

SEQ ID NO: 3284 - DNA, 1923 bp, Enterobacter cloacae
gaggacaacgacgtgcgatttccgaaccaacgtttagcgcaacttttcgatctgttgcaaaacgagacgctgccgcaggacgagctggcgcagcggctgtcggtttccacgcgaaccgtccgggcggatatcaccgccctgaacgcgctgctggccagccacggcgcgcagttcattttgagccggggcaacggctatcagctcaaaattaatgatgtggcgcgctatcagcaattgcaggcgtcccacccgcgcgcgctgcgtattccgcgaaccggacctgagcgcgtgcactatctggtggtgcgttttctgacgtcagccttttccatcaagctggaggatctggccgatgagtggttcgtcagccgggccacgttgcagagcgacatggtggaagtgcgcgagtggtttcaccgttacaacctgacgctggaaacccgccctcgccacggcatgaagctgtttggcagcgagatggcgatccgcgcctgcctgaccgacctcctgtgggagctggcgcagcaggacagcctgaacccgctggtgaccgacgtggcgctgaacgcgggcgtggcggaaaagatggtgccggtgctgcacgatgcgctgacgcgccatcacattcgcctgaccgacgaaggcgagctgttcctgcgcctgtactgcgcggtgtcggtgcggcgcatcagcgaagggtatccgctgccggaattccacgcggaagacgtggaagagaacgtgcatgaggcggcgaaagatatcgcggtggctatccaggagctggcgggcaaagcgctgtcgccgtcagaagagagctggctgtgcgtgcacattgcggcgcggcagatccaggagatcgccccgagcgccattaatgctgacgacgacgaagccctggtcaactacattctgcgctacatcaacacccactataactacaacctgttgagcgacgagcaactgcatgcagatctgctcacgcacatcaaaaccatgattacccgcgtgcggtatcaaatcatgatccccaatccgttgctggataacatcaagcagcactacccgatggcgtgggatatgaccctcgcggcggtgtctagctggggcaaatacaccccgtatgtgatcagcgaaaacgaaattggttttctggtgctgcatatcggcgtcgggctggagcgccactacaacatcggctatcagcgccagccgcgggtgctgctggtatgcgacgcaggtaacgcgatggtgcgcatgatcgaggcggtacttcagcgtaaatacccgcagattgaggtgacgcgcacgctcacccttcgcgagtacgagcttgccgatgccattggcgaagactttgtgatctccaccgcccgcgtgagcgaaaaatccaaaccggtggtgatgatcgccccgttcccgaccgattatcagttagagcagatcggcaagctggtgctggtggaccgcacccggccgtggatgctggaaaaatacttcgacgcggcccatttccgcattatcgacaagcctgtcgaccagcaaacgctgttccgcgagctgtgtgaacagcttgaagcagagggctttgtcggtgcggagtttctggattcggttatcgagcgtgaagccatcgtcagcaccatgctcggcgacggcattgcgctgccgcactccctcggcctgctggcgcaaaaaacggtggtctacaccgtgctggcgccgcagggcattcagtggggagatgaaaccgcccatgtcatcttcctgctcgccatcagcaaaagcgagtacgaagaggcaatggcgatttacgacatctttgtcactttcctgcgtgaacgcgcgatggcgcgcctgtgccagtgcgagaattttgcggcgtttaaggctgtggcgatggagagtttgagtcggttttga

SEQ ID NO: 3285 - DNA, 354 bp, Enterobacter cloacae
gttttagcaatgcgaatatttgtttacggcagtttacgaaccaggcaaggcaacagccactggatgaccaacgcccagttgctgggaaattacacaatcgaaaactaccagttgtacagtctgggccactatccaggcgcagttccggggaacggaacggtacagggtgaggtttatcgtattgataatgccacgctggccgaacttgatgccttgcgcaccaggggcggtgaatacgctcgccagttgatccagacgccttacggcagtgcatggatgtacgtgtaccaacgttcggtcgacgggttaacgctgattgaaagcggtaactggttagacagagaccagttctga

SEQ ID NO: 3286 - DNA, 1104 bp, Enterobacter cloacae
aatgaaagcgattacaaacttgtgattaacgttttattcacttttctgaagtgtgatgtaacgcaatccgtaacatattccattggctatagttcatccgcggaacatcttttaaccaacaataacctaccctacgaggacgttcatatgtggaagcgcttacttcttgttacagcagtttcggcagccatgtcgtctatggcgatggccgcacctttaaccgtgggattttcgcaggtcggatctgaatccggctggcgcgccgctgaaacgaatgtggcgaaaagtgaggccgaaaagcgcggtattacgctgaaaatcgccgatggtcagcaaaagcaagagaaccagattaaagcggtgcgctcgtttatcgctcagggcgtggatgccatctttattgccccggttgtcgctacgggctgggagccggtgctgaaggaagccaaagatgctgaaattccggtcttcctgctcgaccgttccatcgacgtaaaagacaaatctctctatatgaccaccgtcaccgccgataacgtgctggaaggcaaactgattggtgactggctagtgaagcaggtggatggcaagccgtgtaacgtggttgagttgcagggcaccgtcggagcgagcgtggctatcgaccgtaagaaaggtttcgcggaggccatcgccaaagcaccaaacatcaaaatcatccgttctcagtccggcgacttcacccgcagcaagggtaaagaggtcatggaaagcttcatcaaggcagaaaataacggcaaaaatatttgcatggtttacgcccacaacgacgacatggtgatcggcgccatccaggccatcaaagaagcgggcctgaagccgggcaaagatatcctcaccggctcgatcgacggcgtaccggacatctacaaagcaatgattgacggcgaagcgaacgccagcgtggagctgacgccaaatatggcgggcccggcattcgatgcgctggagaaattcaagaaagacggcacccagcctgagaagttgaccatcaccaaatccacgctctacctgccggacacggcgaaagaagagttagagaagaagaaaaatatgggctactaa

SEQ ID NO: 3287 - DNA, 1614 bp, Enterobacter cloacae
ccctcttcccggaggggagagggaaaagggcgggttgggcagaaaattaaagatgggcacgacatagtcccctctcccctccggggagagggtcagggtgagggggaaaccatgaccaccgaacaacaccaggaaatccttcgcacagagggcctgagtaaatttttccctggcgttaaggcgctggataacgttgatttcagcctgcggcggggggagatcatggcgttgctcggcgaaaacggggcggggaagtcgacgctgattaaaaccctgaccggggtctatcacgccgatcgcggcgctatctggctggaaggtaacgccatttcgcccaaaaacaccgcacatgcccagcaactggggatcggcacggtctaccaggaagtgaacctgctgccaaacatgtcggtagcggacaacctgtttattggccgcgagcccagacgttttggcctgctgcgccgcaaagagatggaagcgcgcgccgcgaagctgatggaatcgtatggcttctctctcgacgtgcgcgaaccgctgaaccgtttctccgtggcgatgcagcagatcgtggcgatctgtcgcgctatcgatctctcggcgaaagtgctgatcctcgatgaacccaccgccagcctcgatacccaggaagtggagatgctttttaccctgatgcgccagctgcgtaatcagggcgtcagcctgattttcgtgacgcatttcctcgatcaggtttacgaggtgagcgaccgtataacggtgctgcgcaacggcagctttgtcggctgccgggaaacgcgcgagctgccgcagatagagctggtcaaaatgatgctgggccgcgagctggagaccaacgcgcttcagcgcgcgggccgtacgctgctgagcgaaaaaccgatcgccgcgtttcacgattacggcagaaaagggaccatcgcgccgtttaacctcgaggtacgccccggtgaaattgtggggctggcgggtctgttaggctccggccgcaccgaaaccgccgaagtcatcttcgggatcaaacctgccgacagcggaacggcgctgatcaaaggcaaactacaaacgctacgttcaccgcatcaggcgtcgtgcctcggcgtgggcttctgcccggaggacaggaaaacggacggtattattgccgccgcctcggtgcgggaaaacatcattctggcgctacaggcccagcgcggctggctgcgtccgatccctaagcgcgagcagaacgcgattgccgagcgcttcatccgccagctcggtatacgtaccccgagcgcggaacagcccatcgagttcctctcgggcggtaatcagcagaaggttctcctctcgcgctggctgctgaccaaaccgcaattcctgatcctcgacgagcccacgcgcggtatcgacgtgggcgcgcacgccgaaatcatccggcttatcgaaacgctctgcgccgacggtctggcgctgctggtgatctcgtccgagctggaggagctggttggctatgccgatcgcgtcatcatcatgcgcgatcgcaggcaggtggcagagatcccgctggataaactgtcggttccggcgatcatgaatgccatcgcggcgtaa

SEQ ID NO: 3288 - DNA, 1434 bp, Enterobacter cloacae
aaaaagaggctaatgttaccagttaagacgcgcactgaaaaacggttctctgttagacttcatttaactctctcttacagtatggcatttgcgatgaaagtaacctcacaagttgaagcgcagcgtaagattctggaagaagccgtctccaccgcgctgacgctcgcttcaggtaaatcagatggcgccgaagtggcggtcagcaaaaccaccggcattagcgtgagcacccgctatggcgaagtggagaatgtagaatttaatagcgatggcgcgctggggatcaccgtgtatcaccagaatcgcaaaggcagcgcgtcgtctaccgatctcagcccggatgccatcgcccgtacggtgcaggcggcgctggatatcgcgcgttacacctccccggatccttacgctggcgtggccgataaagagctgctggcgtttgacgcgccggatctcgatctgttccatcccgcggaagtgacgccggatgaagccattgagctggccgcgcgtgccgagcaggcctctttgcaggctgacaaacgcatcaccaataccgaaggcggcagctttaacagccactacggcattaaagtgtttggtaactcccatggcatgttgcaggggtactgctcaacccgccactcgctttccagttgcgtcatcgccgaagaaaacggcgacatggagcgcgactacgcctataccattggccgcgcgctgggggatttgcagtctccggagtgggtgggtaaagcgtgcgccgaacgcacgctgtctcgcctgtcgccgcgcaagctctccaccatgaaagccccggtgatttttgccaacgaagtggcgaccggtctgtttggccatctggtaggcgctatcgcgggcggttcggtgtaccgtaaatcgaccttcctgctcgactcgctgggcaagcagatcctgccggaatggctgaccatcgaagagcacccacacctgctgaaagggctggcctccacgcctttcgacagcgaaggcgtacgcacggaacgccgggatatcgtgaaagacggcattctgacccagtggctgctgaccaactactctgcgcgtaagttggggctgaaaagcaccgggcacgcgggtggcatccacaactggcgcattgccggacagggcctgaattttgaacagatgctgaaagagatgggcaccggcctggtggtcaccgagctgatggggcagggcgtgagcggtatcaccggcgattactctcgcggtgcagcgggcttctgggtcgaaaacggtgaaattcagtatccggtgagcgaaatcaccatcgccggcaacctcaaggacatgtggcgcaatattgttacggtcggtaacgatattgaaacacgcagcaatattcagtgtggttctgtattactgcctgagatgaaaatcgccgggcaataa

SEQ ID NO: 3289 - DNA, 390 bp, Enterobacter cloacae
gcaatgcgtaaacacctgttagcgatcgtcgcggcttcaacgctggttcttggctcatctgcgtttgctgccgatctcgaagacaacatggacatcctcagtcaaaatctgaaggtggtgaagaaaaccgacaatgcggcggaaatgaaagacgcactgacgaagatgcgtgaagctgcgctggatgcgcaaaaagcgacgccgccgaagctggaaagcaaagcggcagacagcgccgagatgaaagactaccgccacggctttgacgtgctggtcggccagattgacggcgcgctgaagctggcgaacgaaggcaaagtgaaggaagcccaggcggcagccgatcagtttgcggcgacccgcaacgcgtatcacaagaagtatcgttaa

SEQ ID NO: 3290 - DNA, 1140 bp, Enterobacter cloacae
ccgaacaagggagcacggaacatgccttcgatttatgagaagtacaacttaaagcaggttatcaacacctctggccgcatgacggcgctgggcgtctccacgccgcgcccggaagtggtgcaggcggcgatgaacggcatgaatcactatttcgagatgaaggagctggtcaataaaaccggggaatacatcgcgaagctgctggaggtggaaggggcgacggtggtctcctgcgcgtcggcgggcattgcccagtccgtggcggctgtgctggtgaaagacagcgactggctgctggaaaacctgcacgtcacaccgattgaaaataacgagatcgtcctgccgaaaggccacaacgtgaattttggcgcgccggtgggcaccatggtggcgcttggcggcggcaagctggtggaagcgggctacgccaacgaatgttccgccgatcagctggcggcggcgatcaccccgcgcacggcggctatcctctacattaaatcgcaccactgcgtgcagaaaagcatgctaagcgtcgagcaggcggcggttgtcgcgcgtaaacacgacttgccgctgatcgttgatgccgcggcggaagaagatctgcatacctattaccgatccggcgccgatctggtgatctacagcggcgcgaaggcgatcgaaggcccaaccagcggcctggtgattggcaaaacccagtacgttgagtgggtgaagcgccagacggcgggcattggccgcgcgatgaaggtgggcaaagagggcattcttggcctgacctgcgccatcgaacactacctgacggccaccaaagagagcggcgccgagatggtggcgaaaatgacgccgtttatcgaggcgctcaacaccctgaacggtgtgaccgcgcgcgtggtctgggacagcgccggacgcgacatcgcccgcaccgaaattaagttcgacgaagccaccacgggcgtcggcacgggtgacctggtgaacgcgctgaagcagggcgaatacgccatctatttccgtggctacaaggccaacgaagggattattgaggcggacgtgcgcagcgtaaatgctgaccagctgaacatcgtgtaccgtcgcattagcgaagtattaggacaggagaaaaacgcatga

SEQ ID NO: 3291 - DNA, 789 bp, Enterobacter cloacae
aaagatttaattagatcactttcgcgactaaaatctgcccgctcaaacgcagtcattgcgtttttctttacttttaacaggccagacatgactaacagcaatcgcatcaagctcacatggatcagcttcttctcttacgccctgaccggcgcgttggtgatcgtcaccgggatggtgatgggaaatatcgcagactacttccagctgcccgtttccagcatgagtaacaccttcaccttcctgaacgcggggatcctgatctctattttccttaatgcatggctgatggaaatcgtgccgctgaaaacgcagctgcgttttggcttcgtgctgatggttgccgccgtggcgggcctgatgttgagccacagcatcgccctcttctctgccgccatgttcgtactgggcctggtgagcgggatcaccatgtcgatcggtacgtttctgattacgcacatgtatgaaggccgccagcgcggcgcacgtctgctgttcaccgactccttcttcagcatggccgggatgattttcccgatggtcgccgcgtatcttctggcgcgcagcattgagtggtactgggtatatgcctgcattggtctggtctatgtcgcgatctttattctcaccttcggctgcgagttcccggtgctgggcaaaaaagcgcagactacatccgagccggttgcgaaagaaaaatggggtatcggcgtactgttcctctccatcgccgcgctgtgttacatcctcggccagctgggctttatctccctgggttccagagtatgctaa

SEQ ID NO: 3292 - DNA, 360 bp, Enterobacter cloacae
acgtattccggtgatgctggtggaggaaaacgcatgagccagtgggtaaacatctgcaatattaacgacattctgccagcaaccggcgtctgtgccctgctgggcaacgagcaggtggcgattttccgccctcgccacgatgaacaggtctatgccatcagcaatatcgacccgttcttcgaggccagcgtgctctcccgcggtctgattgcggagcaccagggcgaactgtgggttgccagcccgctgaaaaagcagcgcttccgcttaaccgacgggcgctgcatggaagatgaaagcttctcggtcaaacactacgacgtccgcgtgaaggacggcgaggtgcagctgaaagggtaa

SEQ ID NO: 3293 - DNA, 756 bp, Enterobacter cloacae
tcggataacgtccctgcgcgacaagttgtgctaccctgtcgcgcacgtttcttctggctggagttcccccttatgcatcttgatatcgactggcaggcggtcgataccgtcctgcttgatatggacggcacgctgcttgatctcgcctttgataactatttctggcaaaagctggtcccggaaacttacggtgaacagcaggggatctccccggcagaagcgcaggaattcattcgttcgcaatatagcgcggtgcagcatacgctaaactggtactgtcttgactactggagcgagcgactcggtttggatatttgtgccatgaccaccgcccagggcgcacgcgccgtactgcgcgaagatacggtcccgttcctggacgcgctgaaagcctgcggtaagcgccgtattttgctgacaaatgcgcatccccataacctggccgtgaagctggaacataccggtcttgcttcgcaccttgatttattgctttccacccacacatttggttatccgaaagaggatcagcggttgtggcatgccgtggtagaagaaaccggtttacagccggaacgcacgctgttcattgacgacagcgagccgattctggattctgcggccgcttttggcattcgctattgtctgggcgtgaccaatccggattccggcctggctgaaaaaagctatctgcgacatccggggctgaacgactatcgccggatgatcccctcactcaccgtgaaggagacgccatga

SEQ ID NO: 3294 - DNA, 249 bp, Enterobacter cloacae
cctctcgtggaatcaggcgctatgcaattcactccagacagtgcgtggaaaattatcggttttacccgtgagataagcccggcctatcggcagaagctgctgtccctgggcatgctacccggctcatcgttccaggtggtgcgcgttgcgccgttgggcgatcctgttcatatcgaaacccgacgcgttaatctggttctgcgtaaaaaagacctcgcattaattgaagttgaatctttatcccgttaa

SEQ ID NO: 3295 - DNA, 2349 bp, Enterobacter cloacae
caagccagcggtttcagtgagtctattacaatgaaaaaattaactattggcttaattggcaatcctaattccggcaagacaaccttatttaatcagttaaccggcgcacgccagcgtgtgggaaattgggcaggcgtaacggttgaacgcaaagagggccagttcactacaacagataatcaggtcacgctggttgatttaccggggacctattcactcaccacgatttcatcccagacctcactcgatgagcaaattgcctgccactatattctgagcggcgacgcggatctgctcatcaatgtggtggatgcctccaatctcgaacgaaatctgtatctcacgttacaactgctggagctgggtattccctgcatcgtggcgcttaacatgctcgacatcgccgagaagcaaaagctgcgcatcgacgtcgatgccctctccgcacgcctgggctgcccggtggttccgctggtttctacccgcgcacgcggcattgacgccctgaagctggcgattgaccgccacacgggcaatgccgacgtcgaactggtgcactacgcccaacccctgctgcgcgaagccgggcaactggcgcaggagatggacaacagcatgcccgccagacaacgtctgtggcttggcctgcaaatgctggaaggcgatatctacagccgcgcctacgcaggcgatgcggcggataagctgggcgtcgcgcaggctcgcctgagcgacgagctggacgatcccgctctgcatattgcggatgcgcgctatcaggccatcgccgctatctgtgacgtggtcagcaatgcattaaccgctgaacccagccgcttcaccgccgccgtggataagattgtgctcaaccgcttcctcggtttgccgatctttttactggtgatgtacgtgatgttcctgctcgccattaacatcggcggtgcattacaacctatctttgatggcggctctgtcgctatcttcgtgcacggtattcagtggctgggctacaccctccacttcccggaatggttgaccatcttccttgcgcaggggatcggcggcgggattaataccgtcctgccactagtaccgcagatcggcatgatgtacctgttcctctccttccttgaggattccggctacatggcgcgcgcggccttcgtaatggaccgcctgatgcaggcgctggggctgccggggaaatccttcgtgccgctgattgtcggttttggctgtaacgtgccgtcagtcatgggcgcgcgtacgctggatgccccgcgcgaacgcctgatgaccatcatgatggcgccgttcatgtcctgtggcgcgcgtctggcgatcttcgcggtctttgccgcggcgttctttggtcaggaaggggcgctggccgtcttctccctgtatgtgctgggtatcgtgatggctattctcaccggcctgatgctgaagcacaccatcatgcgtggcgaagcgtcgccgttcgtgatggaactgccggtttatcacgttccgcatctgaaaagcctgattattcagacatggcagcgcctgaagggcttcgttctacgcgccggtaaggtgattgtggtggtcagcattttcctgagcgccctgaacagcttcaccctgagcggccaggccgcggacaacattaatgactctgccctggcctccgtcagccggatcattacgccggtcttcaaaccgattggcgttcaggaagacaactggcaggcaaccgtgggcctgttcaccggcgcgatggcaaaagaggtggttgtcggcaccctgaacacgctttacaccgcggaaaacatccaggaagaggagttcaacccggcagcgttcaacctcggcgatgaactgcttggcgcggtggaagagacctggcagagcctgaaagacaccttcagcctgagcgtactggcgaacccgattgaagccagcaaaggcgacggcgaaatggcgaccggagcaatgggcgtgatgggccagaaatttggcagcgcgtcggcggcctacagctacctgatcttcgtcctgctctatattccatgcatctcggtcatgggcgccattgcccgtgagtccagccgcggctggatgggcttctccattctgtgggggctgaacattgcctactcgctggcgaccgtgttttatcaggccgtcaattacagccagcatccgcgctacagcctggtctgtatcctcgcggtgatcctgtttaacgtaatggtgattggcctgctgcgccgggcgcgtagccgcgttgacattaacctgctggcaacgcgcaaaaccccaacgacctgctgtaacagcccagcaggcgactgtcactga

SEQ ID NO: 3296 - DNA, 585 bp, Enterobacter cloacae
gccaaagctatgatccgtatttccgattctgcacaagcgcactttgccaaactgctggcaaatcaggaagaagggacgcagatccgcgtgtttgtgatcaatccaggcactccgaatgcagagtgtggtgtctcttattgtcctccggatgccgtggaagcaactgacactgcccttaaatttgaacagctcaccgcgtacgttgatgagctgagcgcgccgtatcttgaagatgcggagattgatttcgtcaccgaccagctgggttctcagctgacgctgaaggcaccgaacgcgaaaatgcgtaaagtctctgacgatgccccgctgatggagcgtgtggaatatctgctgcaatcgcagatcaacccgcagctggccggccacgggggacgtgtttccctgatggaaatcaccgaagatggtctggcaatcctgcaattcggcggcggctgtaacggctgctccatggtcgatgtaaccctgaaagaagggatcgagaagcagctgttgaacgaattcccggaactgaaaggcgtgcgcgatctgacagagcaccagcgcggcgagcactcctactactga

SEQ ID NO: 3297 - DNA, 747 bp, Enterobacter cloacae
ttttcccgatggtcgccgcgtatcttctggcgcgcagcattgagtggtactgggtatatgcctgcattggtctggtctatgtcgcgatctttattctcaccttcggctgcgagttcccggtgctgggcaaaaaagcgcagactacatccgagccggttgcgaaagaaaaatggggtatcggcgtactgttcctctccatcgccgcgctgtgttacatcctcggccagctgggctttatctccctgggttccagagtatgctaaaggtctgggcatgagcctgaacgacgcgggtaaactggtgagcgatttctggatgtcttacatgttcggcatgtgggcatttagctttatcctgcgcttcttcgacctgcaacggatcctgaccgttctggcgggtctggcgaccgtgctgatgtatctgttcatcaacggttccccggagcatatgccgtggttcatcctgaccctgggcttcttctccagcgcgatttatacctcgatcatcacccttggctctcttcagaccaaagtggcctcgccaaagctggtgaactttgtgctgacctgcggcaccatcggcaccatgctgaccttcgtggtcacgggcccgattgttgctcacagcggcccgctggcggcgctgcataccgctaacggtctatacgccgtggtgtttatcatgtgcttcgtgctgggctttgtgacccgtcaccgtcaacacaacccgtcaacagctacccactaa

SEQ ID NO: 3298 - DNA, 2469 bp, Enterobacter cloacae
gccgatgctgagcagttcgatattaccgtgttctgtgaagaaccccgcaaggcgtacgaccgtgtgcacttgtcttcctacttctctcaccataccgccgaagagctctctctggtgcgtgaagggttctacgagaagcatggcgtaaaagtgctggtgggcgaacgcgctatcaccatcaaccgtcaggagaaagtaatccactccagcgccggacgtacggttttttacgataagctgatcatggcgacgggctcgtatccgtggatcccgcctattaaagggtcggaaacccaggattgcttcgtttaccgtaccattgaagacctcaacgccattgaatcctgcgcacgtcgaagcaaacgcggcgcggttgtcggcggtggtctgctgggtctggaagcggcaggcgcgctgaaaaacctcggcgttgaaacccacgttatcgaatttgccccgatgctgatggccgaacagctcgaccacatgggtggcgatcagctgcgccgtaagatcgaaagcatgggcgtgaaagttcacaccagcaaaaacaccaaagagatcgttcaggaagggactgaagcacgcaaaaccatgcgctttgccgacggcagcgagctggaagtggacttcatcgtcttctccaccggtatccgcccgcgcgacaagctggcaacgcaatgcggtctggccgtcgcgcagcgcggtgggatcatgattaacgacacctgccagacctccgacccggatatttacgccatcggcgaatgcgccagctggaacaaccgcgtattcggcctggtcgcgcctgggtacaaaatggcgcaggtcgccgtggatcatatcctgggcagcgaaaacgccttcaccggcgcagacatgagcgccaagctgaagctgctgggcgtggacgtgggcggtattggcgatgcgcatggtcgcaccccgaactcccgcagctatgtttatctggacgaaagcaaagaagtctacaaacgtcttatcgtcagccaggacaacaaaaccctgctcggggcggtgctggtgggcgacaccagcgacttcggcaacctgctccagctggtattgaacgccattgagctgccggaaaacccggacgcgctgatcctcccggcgcacgcctccagcggtaagccgtccatcggtgtggataaactgccggacagcgcgcaaatctgttcctgcttcgacgtcaccaaaggcatgctgatctccgccattaacaaaggctgccacaccgttgcggcgctgaaggcggaaaccaaagccgggaccggctgcggcggctgtattcctctggtcacccaggtactgaacgccgagctggcaaaacagggcattgaagtgaacaacaacctgtgcgagcacttcgcttactctcgccaggagctgtaccacctgatccgcgtggaaggcattaagtcctttgacgaactgctggagaaacacggccagggctatggctgtgaggtatgtaagcctaccgttggttcgctgctggcgtcctgctggaacgaatatgtgctcaaaccagaacacactccgcttcaggacaccaacgataacttcctggccaatattcagaaagacgggacttactcggtgatcccgcgttctgccggaggggaaatcaccccggaagggctggtcgccgtgggtcgtatcgcccgtgagtttaacctgtacaccaaaatcaccggttcccagcgtatcggcctgttcggcgcgcagaaggacgacctgccggaaatctggcgtcagctgattgaagcgggcttcgaaaccggccacgcgtacgccaaagcgctgcgcatggcgaaaacctgcgtgggcagcacctggtgtcgctacggcgtcggcgacagcgtgggattcggcgttgagctggaaaaccgctacaaaggcatccgtaccccgcacaaaatgaagttcggcgtctccggctgtacccgcgaatgtgcggaagcgcagggtaaagacgtgggtattattgccaccgagaaaggctggaacctgtacgtgtgcggcaacggcgggatgaaacctcgccacgcggatctgctggccgccgatctcgatcgcgatacgctgatcaaatacctcgaccgcttcatgatgttctacattcgtaccgccgataagctgacccgtaccgcgtcctggctggataatctcgaaggcggcatcgactacctgaagtcagtcattatcgacgacaagctgggcctgaatgaacagctggaatccgagatgactcgactgcgcgaggcggtgatttgcgagtggaccgaaaccgtgaacacgccagcggcgcagacgcgcttcaaacactttatcaacagcacccagcgcgacccgaacgtgcaggtggtgccggagcgtgaacagcatcgtccagcgaccccgtatgaacgtattccggtgatgctggtggaggaaaacgcatga

SEQ ID NO: 3299 - DNA, 183 bp, Enterobacter cloacae
caaggaatgcatatgttcaaactggctaaagctgccgtactggtcggcctgttaacaactctgacggcctgcaccggtcacgttcaaaatactaaaaataattgcagctacgattacctgctgcatccggcgatctccatttcgaagatcatcggcggttgcggcccggcggcacagcagtaa

SEQ ID NO: 3300 - DNA, 2625 bp, Enterobacter cloacae
atcaggcttgcctttatactaccgcgcgattgtttagaaactgcccaggctaaaccaaatgggaaatctccggtgaagttcgtaaagtatttattgatccttgcagtctgttgcattctgctgggagcaggctcgattattggtttgtacaaatatgtcgagccgcaactccctgatgtcgccacgcttcgtgatgtgcggcttcagatccctatgcaggtctatagcgccgatggtgaactgatggcgcaatacggcgagaaacgtcgtatcccactgaccttaaatcaaattccacccgtgatggtgaaggcttttatcgccaccgaggacagccgtttttacgagcaccacggtgtcgatccggtcggtattttccgtgcggcaagcgtggcgctgttctccggtcatgcctctcagggggcaagtactattactcagcagctggcgcgtaacttcttcctcagcccggaaaagacgctgatgcgtaagatcaaagaggtgttcctcgcgatccgcattgagcaactgctgagcaaagacgagatccttgagctttacctcaacaagatctatctgggctaccgcgcctatggcgtaggggctgcggctcaggtctattttggtaagccgatcgatcagctcacgctgagcgaaatggcgaccattgccggcctgccaaaagcgccatccacgtttaacccgctctactcgcaggaccgcgccaccgcgcgccgtaacgtggtgctgtcgcgtatgttgagcgaaggctatatcagtcagtctgagtacgataaggcgcgcagcgacgttattgacgccaattaccatgcgccggaaatcgccttctctgcaccgtatctcactgaaatggttcgccaggagatggtgagtcgctacggtgataaagcgtatgaagatggttatcgcgtctataccaccgtgacccgcaaagtgcagcaggctgcccagcaggcggtgcgtaataacgtgatggattacgatatgcgtcacggctatcgcggcccgtccaacgtgctgtggaaagtgggggaaggcgcatgggacagtaaaaaaatcactgattccctgaaagcgctgccgacctatggcccgctgcgtccggctgtcgtcacccaggccgatccacaggaagcggtggcgatgatggccgatggcacatccgtttcgctgcgcatggagggtgtccgctgggcgcgtccgtaccgctctgacactcttcagggcccgacgccacgtaaagtgaccgatgtggtacaaaccggacaacaaatctgggtccgtcaggtcggtgatgcctggtggctggcgcaggtgccggacgtcaactctgcgctggtctccatcaatccgcagaacggtgccgtgatggcgctggttggcgggttcgatttcaaccagagcaaatttaaccgcgcgacccaggcactgcgtcaggttggttcgaacatcaaaccgttcctgtataccgcggcgatggataaggggctgacgctcgccagcattctcaacgacgtgccaatttcccgctgggatgccggtgcgggctctgactggcagccgaagaactctccggcgcaatacgctggccctatccgtctgcgtcagggccttggccagtcgaagaacgtggtcatggttcgcgcgatgcgtgcgatgggcgttgattatgcggcagagtatctgcaacgcttcggcttcccggcgcaaaacattgttcataccgaatctctggcgctcggctccgcgtcctttacgccgctccaggtcgctcgtggctactcggtgatggcgaacgggggattcctggtcgatccgtatttcatcagcaatatcgagaacgatcagggcggcgtactgtttgaagcgaaaccgaaaattgcctgccctgaatgcgatattccggtgatttacggcgacacgccaaaatccaatgtcctggaaaacaaggatatggaagatgtggcgatctctcaggaacgtcagaatctggcggtgccgcagcctcagctggaacaggccaatcaggcgctggtcgcccagagtggcgtgcaggagtacgccccgcacgtgatcagcacgccgctgtcgttcctgattaagagcgcactgaacaccaacatctttggcgaaccgggctggcaaggcaccggctggcgagcgggccgcgatttgcagcgccacgacatcggcggcaaaaccgggacaaccaacagttcaaaagatgcctggttctcaggttatggcccgggcgttgtcacctcggtctggattggttttgacgatcaccgccgcactctggggcgcacaaccgcttctggcgcgattaaagatcagatttccggttacgagggtggggctaagagtgcgcaaccggcctgggatgcttacatgaaggccgctctcgagggcgtgccggagcagccgctaacgcctccgccgggcattgtcacgatcaatattgaccgcagcactggacagctcgcgaatggcggtaatagccgtgccgagtatttcatcgagggtacgcagccaaccacgcaggcggtgcatgaggtgggtacagagatcattgataacggcgagacgcacgaactgttctga

SEQ ID NO: 3301 - DNA, 351 bp, Enterobacter cloacae
ttggcctgctgcgccgggcgcgtagccgcgttgacattaacctgctggcaacgcgcaaaaccccaacgacctgctgtaacagcccagcaggcgactgtcactgaggggaaaaagatggcatcgttgattcaggttcgtgacttactggcgttacagggacgaatggaggcgaagcagctcagcctcagcctgcatacgccgcagccgatgatcgatgccatgctggaaaggctggaggcgatggggaaagccgtgcgcattcaggaagagccggacggttgtctgtccggcagttgcaagagttgtcctgaaggtaaagcctgtctcagggagtggtggacgcttcgctga

SEQ ID NO: 3302 - DNA, 1383 bp, Enterobacter cloacae
ggtaacgtcgtggatcacctgccgattttttgtcaattacgcaaccgcgactgcctgctcgtgggcggcggcgatgtggctgaacgcaaggcgcgcctgctgttagaggcgggcgcccgactgaccgttaacgccctcaccttcgccccacagtttgacgtctgggcgcaggaagggatgctcacccaggtgcagggcgaatttgatgaatccctgctggatacctgctggctgaccatcgccgcaacggataacgatgacgttaaccagcgcgtcagcgacgcctgcgaagcgcgccgcatcttctgtaacgtggtggatgcgccgaaagaggcgagctttatcatgccgtcgattattgaccgttcaccgctgatgattgcggtgtcgtccggtggccgctcgcccgttcttgcccgtctgctgcgggaaaaactggaagccgtgctgccgcagcatcttggtcagattgcccaatacgccgggctgctgcgttcccgcgtgaagcaaaccttcgcaaccgtgggcgaacgccgtcgcttctgggagaagttctttgtcaacgacaggctggcgcagtcccttgccaatcaggacaccaaagccgttgaagagacgaccgaacagctcctgagcgagccgctggaccatcgcggtgaagtggtactggtgggcgcaggtcccggcgatgcgggcctgctgacgctgaagggtctccagcagatccagcaggcggacatcgtggtgtatgaccgtctggtctctgatgacatcatgaatctggtacgccgcgatgctgaccgcgtgttcgtcggcaaacgggcaggttatcactgcgtaccgcaggaggagatcaaccagatcctgctgcgggaagcgcagaaaggtaagcgtgtggtgcgtctgaaagggggcgatccctttatctttggtcgcggcggcgaggagctggaaactctctgcaacgcgggcattccattctccgtggtgccgggtattacggcggcatccggctgttctgcctattccggcattccgttaacccatcgcgactatgcccagagcgtgcgcctggtgacgggccacctgaaaaccggcagcgagctggactggcataatctggccgctgaaaagcagacgctggtcttctacatggggctaaatcaggcagccacgattcaggcgaaactgctggagcacggcatggaagcagatatgccggtcgcactggtggaaaacggcaccgccattacgcagcgcgtggtcgatggcgtgctgacgcagctgggtgagctggcgcagcaggttgaaagcccggcgctgatcgtggtgggccgcgtggtagcactgcgtgaaaaactgaactggttctccagccactaa

SEQ ID NO: 3303 - DNA, 2151 bp, Enterobacter cloacae
gatggggaaagcatgagcaccattttgatttttctcgctgctgtgctggcctgcgcgtcgattgcggtgtgggtattcaggcgccgcgtacatcgccgttatcggctgccctttttaaacgcgttcgccggggcaaacacgcgcaagctttcgccagaggaacgcagcaccgttgagcagtatctcgacacgctgaaccgatcccggctttcgcctggccctaccggcgccagcaccgcccccgtatcgctcaaccttaacgcccaaagcgacaccgttctgtgcgtgacgcgctccattacccgctatggcatcacaaccgacgatcccaacaaatggcgttactatctcgactctgttgaagtgcacctgcctcccttctgggaacagtatatcaacgacgaaaacagcgtcgagctcatccataccgatacgctgccgctggttatctcccttaatggtcatactctgagcgaatatgttcaagaagcgccacgctttgcgctggaacgcgcgagcggaacgcaggcctctattcgtggtgaagagacagagcagattgaactgctcaacatccgccaggaaacgcatgaagagtacgtcctgagccgcccggatggcattcgcgaagcggtgttgattgtcgcctcgttcctgctctttttcatctgcctgctgacgccggacgtgtttgttccgtggctcgcgggtggcgcagtactgcttctggccgccgggctgtggggcatatttgccccgccggcaaaaacgtcattacgcgaaattcactgcctgcgcggaaccccaaaacgctggggactgttcggtgagaacgatcaggaacatatcaacaatatctcgctcgggatcatcgatcttatctatccacgccactggcagccgtggattgcgcaggacctgggccacaaaacggatattgatatctatctcgaccgccacgttgtacgccaggggcgctacttatccctgcacgacgaagtgaaaaacttcccgcttcagcactggcttcgcagcgcggtgattgccggtggcgccgcgttaatcttcctcatgctgctgcttttcgtgccgctggatatgccaattaaatttaccctgtcatggatcaaaggggcgcaaaccgtggaagccaccagcgtacagcagctcgaagaagcgggtgtacgcgtgggagatacgttgcgcctcaaaggcaccgggatgtgtaatatccactcaccgggtgcctggaacacgcgccagaactcgccgttcgcgccgttcgactgctctcagatcatctggaatgacgcctctccgctgccgctgccggaatcggatgtggtcaataaggccactgcgctcacccagacgattaatcgccagctccatccaaaaccggatgatgattctcgcgtcagccctgccctgcgttcggctattcagaagtcgggcatggtgctgctggatgactttggcgaaatcgtcctgaaaaccgaggatctctgttccgcccaggatgactgtatccggctgaagaacgcgctcgtcaacctcggcaacagcaaagactgggacgcgctggtgaaacgcgccgaagcgggacgcctggacggtgtgaacgtgcttctgcgtccggtcagcgccgagtcgctggataatctggtggcgacctctaccgcccccttcgtgatgcgtgaaaccacccgtgccgcccaggcgcttaacagcccggcgccgggcggttttgtgattgccagcgatgaaggcagcgacctggtggatcaaccttatccgcaggtttcgctgtatgactatcctgcccaggagcagtggagcgaattccagcgtctggcgcagatgctgatgcagacgccattcagcgcggaagggatcgtcaccaccctcttcaccgacgccaacggcacgcgtcatattggcctgcaccgtatgccggatagcgctggcctgtggcgctatatagggacatccctgctgctgattgcgatgctggcgtgcatcgtctggaacggttatcaggccgtacgccgctatcagcgttcccgcacgcggctggcagaaatccaggcctactacgaaaattgccttaacccgaaactgatctcctcttctgagagcctgatcggataa

SEQ ID NO: 3304 - DNA, 477 bp, Enterobacter cloacae
aaaaagctatctgcgacatccggggctgaacgactatcgccggatgatcccctcactcaccgtgaaggagacgccatgaaagaaaaaccctctgatggggtaagactggataaatggctgtgggccgcccgtttttacaaaacgcgcgcccttgcccgtgaaatggttgacggcggaaaggtgcattacaacggtcagcgcagcaaaccgagcaagctggttgaactgaatgccacgttaacgcttcgccagggcaacgatgagaaaacggtggtggtgaaagccattaccgaacaacggcggcccgcaaccgaagccgttttgctgtatgaagagacggccgaaagcatagagaagcgcgagaaaaccgcgctggcgcgcaaaatgaacgcgctaactatgcctcacccggaccggcgaccggataaaaaagagcgccgcgatctgatgaaatttaaacacggtgagagcgagtaa

SEQ ID NO: 3305 - DNA, 903 bp, Enterobacter cloacae
ccctcacctgcacgagagatgaaaatggcccaacacgaccaattacaccgctatctgtttgaacaattcgccgtgcgcggcgagctggtcaccgtatccgaaacctggaaacagattctggaaaaccacaactacccgctgccggtgaaaaccctgttgggcgaactgctggttgccaccagcctgctgaccgccacgctgaagttcgctggcgatattaccgttcagttgcagggtgatggcccgatgtcgctggcggtgatcaacggtaataaccagcagcaaatgcgcggcgtggcgcgcgttcagggcgatatccctgaaaatgcggatctgaaaacgctggtcggaaatggctacctggttatcacgatttcgcctgaagagggtgagcgctatcagggcgttgtcggtctggaaggcgacacgcttgccgcctgcctggaagattactttatgcgttccgaacagctgccaacccgtctgttcatccgcaccggtgaagtagatggtcagcctgctgccggtggtatgctgcttcaggttctgcctgcgcaggatgcgcagaccaatgatttcgagcatctggcaacgctgacggaaaccatcaaagcggaagagctgttcaccctgtcggcgaccgacgtgctgtggcgtctgtaccacgaagaagaagtgacggtttacgatccgcaggatgtggaatttaagtgcacctgctctcgcgagcgttgtgccggcgccctgaaaacgctgccggatgaagagatcgacagcatcatggcggaagacggtgagatcgatatgcactgtgattactgcggtacgcactacgtgtttaattcgatggatatcgcggagatccgcaataacgcctctccggcggatccgcaggttcactaa

SEQ ID NO: 3306 - DNA, 1677 bp, Enterobacter cloacae
catccccagaaaaaccctacaatttcaggcagtacatattggctaaggagcagtgatatgcgtgttaatggtttaaccccgcaagatctcaaggcttatggtattcacgacgtccaggaagtggtctacaaccccgattacgatacgctgtatcaggaagagctcaatccggctctggaaggatacgagcgtggtgtgttgacgaacctgggtgctatcgccgtcgatacgggtatttttaccggtcgttcgccgaaagataagtatatcgtccgagacgacaccacccgcgatacgctgtggtgggctgataagggcaaagggaagaacgataacaaaccgctctccccggaaacctggcagcatctgaaaggacttgtcacccatcagctttccggcaagcgtctgtttattattgatgcgttctgcggcgctaacgccgacacccgtctctccgtacgatttatcaccgaagtggcctggcaggcgcattttgtgaagaacatgttcattcgtccaaccgatgaagaactgcaagacttcacccctgactttatcgtgatgaacggcgcgaaatgcaccaacccgcagtggaaagagcagggtctgaactccgaaaactttatcgccttcaacctgaccgagcgtatccagctgatcggcggtacctggtacggcggcgaaatgaagaaagggatgttctcggtcatgaactacctgctgccgttgcgcggtatcgcctccatgcactgctcggcgaacgtcggggaaaaaggcgatgtagcagtgttcttcggcctttccggcaccggtaaaacaacgctgtccaccgatccaaaacgtcgtctgattggcgacgatgaacatggctgggatgatgacggcgtgtttaactttgaaggcggctgctacgcgaagaccattcgcctgtcggaagaggcagagccggatatctaccacgcgattcgccgcgatgcgctgctggaaaacgtcaccgtgcgtgccgatggctctatcgacttcgacgatgcgtctaaaaccgaaaacacccgcgtctcttacccgatctaccacatcgagaacatcgtcaagccggtatcgaaggcgggtcacgccacgaaggtgattttcctgaccgcagatgcattcggcgtgctgccaccggtttcccgcctgaccgccagccagacgcagtaccatttcctctccggctttaccgctaaactggcgggtaccgagcgcggtgtgaccgagccaaccccaaccttctccgcctgcttcggcgcggcgttcctgtcgctgcacccaacgcagtacgcggaagtgctggtgaaacgcatgcaggcatccggcgcccaggcatacctggtaaacaccggctggaacggtacgggcaaacgtatctccatcaaagatacacgcgccatcatcgacgcgattctggatggttcgctggataacgccgagacctttacgctgccgatgttcgatctggcgatcccaacagcgctgccgggcgtggatacgcgtatcctggatccgcgtaacacctacggttcaccggaacagtggcgtgagaaggctgaatcgctggcgaaactgtttatcgaaaacttcgagaagtataccgacaccccggcgggtgctgcgctggtgagtgctggaccgaagctgtag

SEQ ID NO: 3307 - DNA, 801 bp, Enterobacter cloacae
cgatcaataacagcgtgcgggcaaacgaacttcgcggcgagaagcgcattcgcctcatgctttagagccgtccgggacaaacacgtagcccagaccccaaacggtctgaatataacgaggatgcgccggatcttcttccaccatgcgacgcagacgagagatctgcacgtcgatagaacgctccatcgcggagtattcacgaccacgcgccaggttcatcagcttgtcacgggagagcggctcacgcgggtggctgaccagcgctttcagcaccgcgaactcaccgctggtgagcggcattggctcatcttcacggaacatctcacgggtgccgaggttcagcttgaacttaccgaatgcaatgacggcctcttcctgagatggcgcgcccggcagttcgttcgcctgacgacgcagcacggcgcgaatacgcgccagcagttcacgcgggttaaacggctttggaatgtagtcatcagcgccaatctcaaggccgacaatacggtcgacttcttcacccttcgccgtcaccatgatgatcggcatcgggttgctctggctgcgcagacggcggcaaatagagagcccgtcttcgccaggcagcatcaggtccaacaccatcaggtggaaagattcacgcgtcagcagacgatccatctgttccgcgttcgcgacgctacgaacctggaagccctgctcggtcagataacgttccagcagcgcacgcaggcgcatgtcgtcatctacgaccagaattttgtagttctcttgcattgtgtgtactcccaaaggttcggataa

SEQ ID NO: 3308 - DNA, 654 bp, Enterobacter cloacae
aaaagtgcacgggttcgaccagcaaattctggtataaattctagacgaaattgttacaaagcatatttaacagcagcttatctgttcatttcatcacataaatcattattaatcttgtctgttacactgtgcgctacgtattgtgcgcaaagacagttaaccggcattaaaggctgcaccatgaaaacgcctctgatcacccgcgaagggtacgagaaactcaaaaaagagatggattacctgtggcgcgaagagcgtccggaagtgaccaaaaaagtcacctgggccgcaagtctgggcgaccgcagcgagaatgcggactatcagtacaataaaaagcgactgcgcgaaatcgatcgccgggtacgctacctgacgaagtgtctcgagaatctcaaaattgtcgattactccccgcagcaggaaggtaaagtgttcttcggcgcgtgggtcgaaattgaaaacgacaacggcgacaccctgcgttttcgtatcgtcggctatgatgaaattttcggtcgtaaggattacatttctatcgattcaccaatggcccgcgccctgctgaaaaaagaggtgggcgatttagccgttgtccagacgcccgcaggtgaagcaagctggtacgtcaacgaaatcgtgtatgttaaatag

SEQ ID NO: 3309 - DNA, 2418 bp, Enterobacter cloacae
tccgagagcgccctccccggctggcattttttggtgtcagcccgtataactatccccctgattttcgatccacaagatgaactgaccatgatgaaagagtcgctctgccgcattattgcgggtgaacttcaggccagagccgaacaggtagaagctgccgttcgcctgcttgatgaagggaacaccgtgccgtttattgcacgttatcgtaaggaagtcaccggcggtctggatgacacgcagctgcgaaacctggagacccgtctgggctatctgcgcgagctggaagaccgacgtcaggcgatcctcaaatctatcggcgagcagggcaagctgaccagtgacctggaaaaagccattaacggtaccctgagtaaaaccgaactcgaagacctctatctgccgtacaaaccgaagcgccgcacgcgcgggcagattgcgatcgaagccggccttgagccactggccgatctgctgtggaacgagccgtctcacgatccggaaaccgaagccgccaagtttatcgacgccgataaaggcgtagcagacaccaaagccgcgctggacggtgctcgctatattctgatggagcgcttcgccgaagacgcggcgctgctggccaaagtgcgtgattacctgtggaagaacgcgcatatcgtctcctccgtggtgtccggcaaagaggaagaaggcgcgaaattccgcgactatttcgatcaccacgaacccatttctaccgcgccgtctcaccgcgcgctggcgatgttccgcggccgtaacgaaggcgtgctgcaactctccctgaatgccgatccgcagtttgacgagccgcctaaagagagccactgcgagcagatcattatggatcatctgggcctgcgcctgaacaacgcaccggcggacagctggcgcaaaggcgtggtgagctggacctggcgcattaaggtgctgatgcacctcgaaaccgagctgatgggcaccgtgcgcgagcgcgccgaagacgaagcgatcaacgtcttcgcccgtaacctgcacgatctgctgatggctgcgccagctggcctgcgcgccaccatgggtctcgatccgggtctgcgtaccggcgtgaaggtggccgtggttgacggcaccggcaagctggttgccaccgacaccatttacccgcacaccggtcaggcagcgaaagcggctgtcgtcgtcgccgcgctgtgcgagaagtacaacgttgagctggttgccatcggtaacggtacggcgtcccgcgaaaccgaacgtttctatctcgacgtgcagaagcagttcccgaaagtgacggcgcagaaagtgatcgtcagcgaagcgggggcatcagtctactccgcctctgagctggcagcgcaggagttcccggatctggacgtttccctgcgcggcgcggtctctatcgcccgtcgtttgcaggatccgctggcggagctggtgaagatcgacccgaaatccatcggtgtgggccagtatcagcacgacgtgagccagacgcagctggcgcgcaagctggatgcggtagtggaagactgtgttaacgccgtcggcgtggacctgaacaccgcttccgttcccctgctgacccgcgtggcgggcctgacccgtatgatggcacagaatatcgtcgcctggcgtgatgagaacggtcagttccagaaccgccagcagctgctgaaggtgagccgtctggggccgaaagcatttgagcagtgcgcgggcttcctgcgcatcaaccacggcgataacccgctggatgcctctaccgttcacccggaagcgtaccctgttgttgagcgcatcctggccgcgactcagcaggcgcttaaagacctgatgggcgacagcagcgcgctgcgtaacctgaaagcggtggatttcaccgacgaacagttcggtgtgccgacggtcactgacatcatcaaagagctggaaaaaccgggccgcgatccgcgtcctgagtttaaaaccgcgacctttgctgacggcgtggaaaccatgaacgacctgctgccgggcatggtgctggagggggcggtaaccaacgtcaccaactttggcgcgtttgtggatatcggtgtgcatcaggacggtctggtgcatatctcttccctcgcagacaagttcgttgaagatccgcacaccgttgtcaaagcgggcgacatcgtgaaggtgaaagtgctggaagtggatctccagcgcaagcgtattgccctgaccatgcgtctggacgagcagccgggcgacactaacgcgcgccgtggcggtaatggcggtggccgtgaacagcagcgtccggcagcgaaagccgcgaagccacgcggacgtgacgcacagccagcaggcaacagcgcgatgatggatgcgctggctgcggcgatgggtaagaaacgctaa

SEQ ID NO: 3310 - DNA, 855 bp, Enterobacter cloacae
atccaccaggtgtaccgtgaattgcgaggccagttcctcacttatgcaacgccacacttcggcgttcagtccccatccgtgcagcagcacaagatgacaatttcccgtcccaacggtctgccaccacagcgtcttcatcagttaacgttctcttttttcacatggaggttgcgtatgctaacagtgcccggcttgtgctggctatgccgaatgccacttgccttgagcgcgtggggcgtctgttccgtttgcacgcgagcgctgggttacctgaagggctgtccgcaatgcggcttgcctgccgtcagccagacgcttccctgcggccgatgcctgaaaaaagcgccgccgtggagcgcgctggtggcggtggatgattatgtattgccgctgagtcgtctggttcatcagttcaaattttccagccagatcgcgctggcgcagccgctggcacgcctgttattactggcggtattgcaggcgcgaagaacgcgtgggctaccgccggtcgacacgctcgtgaacgtgccactgtttcagcgccgccactggcggcggggatacaatcagagcgacctgctgtgccgtccgctcgcccgctggctgggttgccggtaccccgcctctgcgctgaaacgtattcatgccactgccgttcagcaccggctcaacgcccggtcgcgcaaaaggaacctgaaaaacgcctttcgccttgaattgccggtcaacggtctccatatcgcgattgtggatgatgtcgtcaccacgggcagtaccgtggctgaactttcccgactgcttttgcaaagcggcgccgcgtcagttcaggtatggtgtctgtgccgtaccttgtag

SEQ ID NO: 3311 - DNA, 1200 bp, Enterobacter cloacae
aacaatgacgttacccataacaattcaaaggccaggtcaatcatgccattattcatcgtcgctatcggtgttgtgttattactgctcttgatgatccgcttcaaaatgaacggatttatcgctctggttctggtggcacttgcagtcggtctgatgcagggaatgccgctggttaaagttatcagctccattaaagccggtgtcggcggtacgctcggcagcctggcgctgatcatgggcttcggcgccatgctcggtaaaatgctcgcggactgcggtggcgcgcagcgtattgccactacccttatcgataaatttggcaagcagcacatccagtgggcggtggtgttaaccggttttaccgtcggtttcgcactgttctatgaagtgggcttcgttctgatgctgccgctggtgttcaccatcgccgctgccgccaacatcccactgctgttcgtgggtgtgccgatggctgcggcgctgtccgtcacccacggtttcctgccgccgcacccgggtccaacggctatcgccaccatcttccacgccgatatgggtaaaaccctgctgttcggtacgattctggcgatcccgacggtgattctggcaggcccggtgtatgcgcgcttcctgaaaggcatcgataagcctatcccggaagggctgtacagcgccaaaacctttactgaagaagatatgccaggctttggcgtcagcgtctggacctcactggtaccggtgatcctgatggcgatgcgtgccatagcagagatggttctgccgaaaggtcacgcgttcctgtccgttgcggagttcctgggcgacccggtaatggcaacgctgattgcggtattgattgcgatgtttaccttcggtcttaaccgcggtcgctccatggatcagatcaacgatacgctgacctcttccatcaaaatcatcgccatgatgctgctgatcatcggcggcggcggcgcgttcaagcaggtgctggtcgacagcggcgtggataaatacatcgctgccatgatgcacgaaaccaacgtctctccgctgctgatggcgtggtctatcgccgcggtgctgcgtattgcgctgggctctgcgaccgttgcggcgatcaccgcaggcggcatcgtggcaccgctgattgccacgacgggcgtcagccctgaactgatggttatcgcggtcggttcgggc

SEQ ID NO: 3312 - DNA, 1350 bp, Enterobacter cloacae
agcatgaggcgaatgcgcttctcgccgcgaagttcgtttgcccgcacgctgttattgatcgtcaccctgctgtttgtcagtctggtgacgacctacctggtggtgctgaactttgcaatcctgccgagccttcagcagtttaataaggtgctggcatacgaagtgcgtatgctgatgaccgacaaactgcaactggaggacggcacgcagttggttgttcccccggcgttccgtcgggaaatctaccgtgagctgggcatttctctctactcgaacgaagcggcggaagatgctggcctgcgctgggcgcagcactatgaattcctcagccagcagatggcgcagcagcttggcggcccgacggaagtgcgcgttgaggtcaataaaagctcgccggttgtctggctgaaaacctggctgtcacccaacatctgggtgcgtgttccgctcaccgagattcatcagggcgacttctcaccgctgttccgatacaccctggcgatcatgctgctggccatcggcggcgcatggctgtttattcgtatccagaaccgaccgctggtcgacctggagcatgcagcattacaggtcggtaaaggtattatcccaccgccgctgcgcgagtatggcgcatcggaagtgcgctcggtaacgcgtgcgtttaaccacatggcggcaggcgttaaacagctggcggacgaccgtacgctgctgatggcgggggtcagccatgaccttcgcacgcccctgacgcgtatccggctggcgacggagatgatgggcgagcaggatggctatcttgcagagtccatcaataaggatatcgaagagtgtaacgccatcatcgagcagtttatcgattacctgcgcaccgggcaggagatgccgatggagatggcggatctgaatgcggttctgggcgaagtggttgctgccgaaagcggctacgaacgtgaaattgcgaccgaccttcaggcaggtgagattcaggtacgtatgcacccgctctccattaaacgcgcggtggcgaatatggtggtcaacgcggcgcgctacggcaacggctggatcaaagtcagcagcggtacggaactcaaccgcgcctggttccaggtggaagacgatggcccgggcatcaagcctgagcagcgtaagcacctgttccagccatttgtgcgcggcgacagcgcgcgcagcaccagcggaactggcttaggcctggcgattgtgcagcgtattgtggataaccataacggactgctggaaattggcaccagcgagcggggtggtttgagcattcgtgcgtggttaccggtgccggttttacggggtcaggtgaaagagagttaa

SEQ ID NO: 3313 - DNA, 486 bp, Enterobacter cloacae
  unsure (350)
ccgttgatgtcggcgatatgtgcgagccgaagcgatggacatggcaacgagaaggaacgaaaaaaagtgaagataaggatagggctgttactggcggtactcagccagcccctgtgggccgcgacgccaaaaccggtcaccctgctggtggatgatgtcccggtggtgcaaatattacaggcgctggtagcgcaggaggatcgcaatctggtggtgtcgccggatgtcagcggttcgctttcgctgaatttaacgcgggtgccctggaggcaggcgcttcagacggtagtgaacagcgccgggctggtattgcggaagagggcggcattttttatgtgcatacggcggcntggcaacgggagcaacaaacgcgtaaagagcaggagcgggcccagcgtctgctcgacgccccgctgcactctcacagcattccgtttgcttatgcggatgcggccgaattgcaaaaagcggcggaaaagctcttaa

SEQ ID NO: 3314 - DNA, 642 bp, Enterobacter cloacae
gataatttttcgtctgactctcgctctattgcaaatgaggtttcagttcatgtcctgctacgccgggtgtctgcgcagcggggattaccattaacgaatagtcttagtagtaccgaaaaaatggcagagaaacgcaatatctttctggttgggcctatgggtgccggcaaaagcactattgggcgtcagttagctcaacaactcaatatggaattttacgattctgatcaagagattgagaaacgaaccggagcggatgtgggctgggtcttcgacgtaaaaggcgaagaaggtttccgtgaccgagaagaaaaagtgatcaacgaactcacggaaaaacagggcattgtgctggcaactggcggcggctctgtaaaatctcgcgaaacccgcaaccgtctctccgcccgtggcgtagtggtctatcttgagacgaccatcgaaaaacagctggcacgcacgcagcgtgataaaaagcgcccgttgttgcaggttgaaacaccgccacgtgaagttctggaagctttggccgatgaacgcaatcctctgtacgaagagattgctgatgtgaccattcgtactgacgatcaaagcgctaaagtggttgcaaaccagattattcatatgctggaaagcaactga

SEQ ID NO: 3315 - DNA, 1104 bp, Enterobacter cloacae
ggtggatgtcgcgtcatggagaggattacagttactctcggggaacgtagttaccctatcaccatcgcggctggtttgtttaacgacccagcttccttcttaccactgaaagcgggtgatcaggcgatgctggtcaccaacgagacgctggctccgctttatctcgaccgtgtacgtcacctgcttgagcaggcgggcgtgaaagtcgacagtgtgattctgcccgatggcgagcagtacaaaagcctgacggtactggataccgtctttaccgcacttctgcaaaaaccgcacggtcgtgatacaacactgcttgccctgggcggcggcgttgtgggcgatctgaccggttttgcagccgccagctaccagcgcggcgtgcgctttattcaaattccaaccacgttgctctcacaggtcgattcttctgtgggcggtaaaacggcggttaaccatccgctcggcaaaaacatgattggtgcgttctaccagcctgcctcggtggtggtggatctcgactgtctgaaaaccttgccagcgcgcgaactggcgtccggccttgcagaagtgatcaaatacggcattattcttgacggggagttcttcacctggctggaagagaatatggatgcgctgctgcgcctcgacgggcaggcaatggcctactgtattcgccgttgttgtgagctgaaagcagaagtcgttgccgcagatgagcgtgaaaccggcttacgtgctttactgaatctggggcatacgtttggtcatgcgatcgaagccgaaatgggctacggtaactggcttcacggtgaagctgtcgctgccggaatggttatggcggcgcgtgcctctgaacgtctggggcagttcaggccggaagagacagcacgtatcatcgcgttgcttaaacgtgctggcttgccggtaagtggtccgcaggaaatgtctgcgcaggcgtaccttccccacatgatgcgcgataaaaaagtattagcaggtgagatgcgtctggtactcccgcttgcaatagggaaaagtgaagtgcgcggcggagtgccgcacgaagtcgtacttggcgctattgctgattgtcagcaagcgtaa

SEQ ID NO: 3316 - DNA, 873 bp, Enterobacter cloacae
agcgcaggatgctgtcggagctttctccacagccggagaaggtgtaatcagttagtcagcatgaaaaaaaatcgcgcttttctgaaatgggcaggggggaaataccccctgctcgacgatattaaaaagcacctgccgaaaggcgagtgtcttatcgagcccttcgtgggtgctggatcggtgttcctgaataccgatttttctcgttatatcctggcggatatcaatagcgaccttattagcctctataacatcgtcaaactgcgtaccgatgagtatgtggaagaggcacggaagctgtttacgccagagaacaacaacccggacgtctactatcagttccgcgctgagtttaatcaaagccaggatccgttccgtcgcgcgctgttgtttctttatctcaaccgccatggctacaacggtctgtgccggtataatctgcgtggcgagtttaacgtgccgtttggccgctataagcgtccctatttcccgcaggacgagctgtatcactttgctgaaaaagcgcagaatgccgagttctactgtctctcatatgaagagtgcatggagctggcgggcgtaaactcggtggtctactgcgacccgccttacgcgccgctgtctgccacggcaaatttcaccgcctaccacaccaatagcttcagcccggccgagcaggctcgtctggctgagatggcggaaaagctggtcagcaaaagaattccggtgttaatttcgaatcacgacacgcctgatacgcgcgaatggtacaaagccgcgaagcattttcaggtaaaagtgcggcgtagcattagcagcaacggcggcacacgtaaaaaggtggacgaacttctggcgctttatcgaccctga

SEQ ID NO: 3317 - DNA, 699 bp, Enterobacter cloacae
acacatttcaaggagatgcggatgaaacagtttttgattgccccctcaattctgtcggccgattttgcccgcctgggtgaagacactgccaaagctctcgcggctggcgcggatgtcgtccatttcgacgttatggataaccactacgttcccaacctgaccatcggtccgatggtgcttaaagcgctgcgtaactacgggatcaccgcgcccattgacgtgcatctgatggtgaaaccggttgaccgcatcgtacccgatttcgccgcggcgggtgccagcatcatcactttccacccggaagcctccgaacacgttgaccgcacgctacagctgatcaaagagaacggctgtaaggcggggctggtctttaacccggcgaccccgctgagctatctcgactacgtgatggacaagctggacgtgatcctgctgatgtccgtcaacccgggctttggtggtcagtcatttatccctcagacccttgacaaactgcgtgaagtgcgccgccgtatcgatgagtctggctatgatattcgtctggaagtggacggcggcgtgaaggtcaataacatcggtgagattgcggcggcaggggcggatatgttcgtcgcaggctccgccatcttcgatcaaccggattacaaaaaagtcattgatgaaatgcgccgtgaactggcgaaggtaagtcatggataa

SEQ ID NO: 3318 - DNA, 252 bp, Enterobacter cloacae
tggcggtgccgttttccaccagtgcgaccggcatatctgcttccatgccgtgctccagcagtttcgcctgaatcgtggctgcctgatttagccccatgtagaagaccagcgtctgcttttcagcggccagattatgccagtccagctcgctgccggttttcaggtggcccgtcaccaggcgcacgctctgggcatagtcgcgatgggttaacggaatgccggaataggcagaacagccggatgccgccgtaa

SEQ ID NO: 3319 - DNA, 786 bp, Enterobacter cloacae
ctgatgaagacgctgtggtggcagaccgttgggacgggaaattgtcatcttgtgctgctgcacggatggggactgaacgccgaagtgtggcgttgcataagtgaggaactggcctcgcaattcacggtacacctggtggatctaccgggctatggccgtagccacggctatggcgcgatgacgcttgacgacatggcggagcaggttctggaagcggcgccgcaaaaagccgtctggctcggctggagcctgggcgggctggtggtaagccagattgcgctgcgccatcctgagcgggtccaggcgctgatcaccgttgcctcatcaccctgtttcagcgcccgcgaggcgtggccgggcattaaacccgaggtgctggccgggttccagcatcagctgagcgaagacttccagcggacggtggagcgttttctggcgctacaaaccatgggaacagaaaccgcccgtcaggacgcacggacgctgaagcagacggtgctttctctgccgatgccggaggttgaggtgctgaacggtggactggagatcctgaaaacggccgatctgcgcgagccgctggcgtcgttaacggtgccgcatctgcgtatttatggctatctggatggactggttccgcgcaaggtggttccgctgctggatgcgctgtggccggagagtaaatcaatggtggttgccaaagcggcacatgcgccgttcatctctcatcctgctgagttttgttcggcgctgtccggttttatcagcgaagcgtccaccactccctga

SEQ ID NO: 3320 - DNA, 834 bp, Enterobacter cloacae
atatgctttgtaacaatttcgtctagaatttataccagaatttgctggtcgaacccgtgcacttttttagaatacgctgttccaggcttatccgaacctttgggagtacacacaatgcaagagaactacaaaattctggtcgtagatgacgacatgcgcctgcgtgcgctgctggaacgttatctgaccgagcagggcttccaggttcgtagcgtcgcgaacgcggaacagatggatcgtctgctgacgcgtgaatctttccacctgatggtgttggacctgatgctgcctggcgaagacgggctctctatttgccgccgtctgcgcagccagagcaacccgatgccgatcatcatggtgacggcgaagggtgaagaagtcgaccgtattgtcggccttgagattggcgctgatgactacattccaaagccgtttaacccgcgtgaactgctggcgcgtattcgcgccgtgctgcgtcgtcaggcgaacgaactgccgggcgcgccatctcaggaagaggccgtcattgcattcggtaagttcaagctgaacctcggcacccgtgagatgttccgtgaagatgagccaatgccgctcaccagcggtgagttcgcggtgctgaaagcgctggtcagccacccgcgtgagccgctctcccgtgacaagctgatgaacctggcgcgtggtcgtgaatactccgcgatggagcgttctatcgacgtgcagatctctcgtctgcgtcgcatggtggaagaagatccggcgcatcctcgttatattcagaccgtttggggtctgggctacgtgtttgtcccggacggctctaaagcatga

SEQ ID NO: 3321 - DNA, 591 bp, Enterobacter cloacae
agccagttcacccagcaaagacccgtcaagatgaccaaacccttacaaaagcccaccattctgaatgttgaaaccgtcgcgaaatcgcgtctgtttaatgtcgaaagcgtggatctggagttcagcaacggtgtgcgtcgtgtttatgagcgtatgcgcccctcctcgcgtgaagcggtgatgatagtgcctatcgtcgacgagcacctgatcctcattcgtgaatacgccgtgggcactgaatcctacgagctgggcttctccaaaggactgatcgatccgggcgaaacggtgtttgaagcggcaaaccgggagctgaaagaagaggtcggttttggcgcgaaagagctgacgttcctgaaaaagctgagcatggcaccgtcctatttctccagcaaaatgaacatcgttgtcgcggaagatctctatcctgaatcgctggaaggagacgagccggaaccgctgccgcaggttcgctggccgctggctcatctgatggatttgctggaagatcctgactttaacgaggcacgcaacgtgagcgcactgttcctggtacgagagtggctgaaggggcaggatcgtttgtag

SEQ ID NO: 3322 - DNA, 534 bp, Enterobacter cloacae
ttacaccgtctccctggcgctggccatgagcgaggcgccgtaatgagcatgcccaatcttttaccctggcgtcggcagcaacgtaatcagcgcctgcgtttctgggggctgctgtttgccgcctcattgctggtgatgctggcgggtggtttcagtctgcgggcgacgcagtctctcgcgttacaggcgttgcagagcgaactggcggggactcgggcggtgcacaaagtattgagagcccgtcagccgcagtcagcggggctgaaaaccccttcgccgccgtctgatccggcctggcaacccgcgctggaatcgcttgccagcgcaatgccccggcaggcgtggctgacggcgctgcgttatcagccaccctcgctgaccctgaccggctataccacttcactgccagcgctcgcagccatgaccgatgcgctgaaaagggtgacgggatttaaccccggaccggcaggcgaactgcaacaggatagcctggggcgatggatgttctcttttaaactgcatagccggaggtag

SEQ ID NO: 3323 - DNA, 456 bp, Enterobacter cloacae
ccggtgggtatctggtatcaacgctgggctgatgcacgtccttcccggcgcgtcctttgctggttgatcgcgtcggggcttgttgcgtgggcaatttggggactgctgctcaggcccgctgctctgcgttacgccgatgttcaggcgcaggccatcagtgcgaagcgaatcaacgcctcgctgtggccagaggccggacggcaagcagtgtttacgcaagtgacgccctcgcggcccttttctcccctggcatttcagcgtgaggacgcaaggctggtgtactggaagccgcagcagagtgggggagagctggcgctggatgcctcatggggcgcggttccggcgctcttttcccggctggcgcttgagaacgtgcgggtgagtgcgttttccatcatcccacagggcaaacagttacgcctcagcctgcaactggagatcggtcatgcgcagtaa

SEQ ID NO: 3324 - DNA, 315 bp, Enterobacter cloacae
cgaacggcgcgagttagtggtgtttatcacgccacgtctggtcagtattcagtaatgggtaacgatccccgcaatgattttgcattcagtttgttgcagatgtttgacgtggggcatgaattagcatacaaggagtaccgatttgagttggacttacgtcttatttccttatgcgccgggaacggtgatttaatcagttgccaaacaagccggagtattgagataatttttcgtctgactctcgctctattgcaaatgaggtttcagttcatgtcctgctacgccgggtgtctgcgcagcggggattaccattaa

SEQ ID NO: 3325 - DNA, 765 bp, Enterobacter cloacae
gtcatggataaattgcaggctattcggggtgtagcatttgacctcgacggcacgctggtcgacagcgcgccaggattaaccagcgccgtcgatcaggcgctgtatgcccttgaactccccgttgcaggcgaagagcgcgtcgtgacgtggattggtaacggtgcagacgtgctgatggagcgcgcgctgacctgggctcgtcaggagcgtgcctctcagcgttccgcgcaaggtaaaccgagtgttgaccacgcggatattccccaggatgagcagcagcgtattctgcgcaaactgttcgaccgtttctacgaagagaccgtcgaagagggcagcttcctgttcccggatgtcgctgaaacgctgagcgcgctatatgctaaaggcatcccgctggggctggtgactaacaagccgacaccgttcgttgcgcctctgctggaagcgctggatatcgcgaaatacttctccgtaattgtgggcggcgatgacgtgcagaataaaaagccgcatccggaaccgctattgctggtggcaggaaaattatccttaacgcctgcggagctgctctttgtcggcgattcccgcaatgatattctggctgccagagcggcaggttgcccgtcggttgggttgacctacggctacaactacggtgaagccattacgctgagtgagccggacgttgtgttcgaccacttcaaagatttgttgcccgcactcgggctctcgcacagtgaacatcaggaattgaataatgactaa

SEQ ID NO: 3326 - DNA, 501 bp, Enterobacter cloacae
aacagtgcgaaaccgacggtaaaaccggttaacaccaccgcccactggatgtgctgcttgccaaatttatcgataagggtagtggcaatacgctgcgcgccaccgcagtccgcgagcattttaccgagcatggcgccgaagcccatgatcagcgccaggctgccgagcgtaccgccgacaccggctttaatggagctgataactttaaccagcggcattccctgcatcagaccgactgcaagtgccaccagaaccagagcgataaatccgttcattttgaagcggatcatcaagagcagtaataacacaacaccgatagcgacgatgaataatggcatgattgacctggcctttgaattgttatgggtaacgtcattgtttcaacgacaaattccggttgtcccaactgggaacagagtgttaacggcactcatactgatgcctgcgaaaacgttaagtttagtcggctgttataagggtgttgagtgcccacgagaatga

SEQ ID NO: 3327 - DNA, 1761 bp, Enterobacter cloacae
gaaatggaaaaccgtgagacgttatccgctttaacgcgcgtagccgtcgtgctggcgggggctctacagggcgtaatttgctatgtaatcacgtggtatatcgagtacgcaaaattgccatcggatacgctgtggctgatgtgtgtagtacctgccaccgtggtaatgacaaccacgttgtctcttgccatgacgtcattcagaaagccatttttgtggctgtcactcgggatgatcggcgcggcagtcgcgggtatgggcggctggcttaagtggagcgttgcaggactcgaaagctggaatctcagagatgagatgctcgttttcggctttcatctgctgctgatgacgctgttcgtgttgccatggcttcagcggcgtctggatcccgtcccgactacctcgttctacagcgacttttatcaacgaaactggcataacgcgctgacactgctcattatttttgtttcgaatggtctcttctggctggtgcttttcctctgggccgagcttttcgaacttatcggcatcggcttttttgatcggcttttctttcattctgacgggtttatttcagtggcgattggcgtggtttcagccagtgcggccgtgctcacgcgtatgcaggtaaggttaatccttgccctgcaaaatctgctgaccctcatcgccaccggtctgcttcccctgatggcggcgctggcgctgctctttattggcgcgttgccttttgtcggctttgaatccatttcagccagaatatccgccgcgggcttgctgaccaccttagcgctgctgctgttattcctggtgacgatagtgtggcatccacagcgtcaaacactgccttactatgccccgctgcgagggatgattcgcctcgctgtggctatcgtacccgcgtatccggttctggcggggtgggcgctgtggctacgcatttcgcaatacggctggtcacccgagcgtctgtacggggtattgataaccatcgtggcgctggtctgggcgatcggtttttgcgccagcgctctgattcagcgccgtgaaccgcagaagatccatgcgtacgtcatcccggcgaccgggctgctttccctcattttcctggcgttggtccatacccccgtgctggatccgtggcgaataagtgttgcaagccatatggcccgctatcaggacggcagaataactgcggatcaagtcagcctgtatatgctcagtaacgctggacgaaaggggcgggaggcgatgctcacgctgcaaaacgatccgcagtttatctctaacccaaaacgccagcgtgaaataaatggtcttctctccaggaatgctggcggagcaggtaagatgaccgccgcgatgctggaaaaacaggtccagctcgcaccgggaatggctcatcctgataagacattgtggcaagccatgctcagcaatcagtatcgcttcgagagctgcgatagcgcccagagtaactgtttacttatgccgctggatcttaacagcgacggcaagccggaagccgtgctatttcaatttaccgatcgcacgatcgtggcttacacacaaactaacacgggctggaggatcgccggggacgcgtggaaaatgccggaggcattgaccagaggagaacttgaccgcgcattaaggcagaggaaagtgaaatctgtcgtgaagccctgggcggatattgagatttttggggagcgtgtcgatatgagctacgacagttacaataatgcgcagtggcgttag

SEQ ID NO: 3328 - DNA, 777 bp, Enterobacter cloacae
agcatggcttttaaaacgtggcaaacaggtattcatattcaacaggataaggtggttgcggtagcgctgaccagagagcgggccggatggcgtttacggcgctggtgggcggtgccgctgtcggacggcgttatcggggaaggcaaaatacttaagccagaagagctggttaacgcattacgtggctggcggaaaacattgccgcactcgcatcgggtattcctctcatttccggcaacgcgcgttctgcaacgcgcgttgccccgtccatccgttaccttgcgtgacagcgaacagctcacctgggtaggcgccgcattagcgcgtgagctggagatgcccgccgatacgctctgctttgactacgcgcaggatacgttcagcaacacttttcaggttaccgcagcgcaaaacagagaggtcgataccctgttgacgctggcgaacgcgctgcgtttgcgtctggcagcaatcgccccggatgccggtgcgctggctaatcttctctctgctgttgcccccgcccggtgcgtcgcctggagagatcagcaccagtggctatgggcgatgcgtcaccagtgggggcggcgctacaccacagaagcggcgacggtgaatgaactggcggcgctgcttgcgctttcttcttctgatatcgccgtgtttgatgctgcccgcgatccctgggaagcggtgacgctgtgccagccgccgctgccggaatgcggtgctgattacaccgtctccctggcgctggccatgagcgaggcgccgtaa

SEQ ID NO: 3329 - DNA, 468 bp, Enterobacter cloacae
gtgcgttttccatcatcccacagggcaaacagttacgcctcagcctgcaactggagatcggtcatgcgcagtaaagcccgtttagtcatcctgctttctccgcttttcctgaccgggatgcgggatcccttctctgtgccggaagagcgttgctcagccgggcagctcagccagtggcggtatcaggggatagtcagcggcagcagggatatcggccttatgcaggacgggcagaaacgctggcaccgggtaaaaacgcagatgcggttaccgacaggctggcgggtgagcgcgatagatagacaacaactgaccgttgatgtcggcgatatgtgcgagccgaagcgatggacatggcaacgagaaggaacgaaaaaaagtgaagataaggatagggctgttactggcggtactcagccagcccctgtgggccgcgacgccaaaaccggtcaccctgctggtggatga

SEQ ID NO: 3330 - DNA, 1149 bp, Enterobacter cloacae
  unsure (195)
tgtcccggtggtgcaaatattacaggcgctggtagcgcaggaggatcgcaatctggtggtgtcgccggatgtcagcggttcgctttcgctgaatttaacgcgggtgccctggaggcaggcgcttcagacggtagtgaacagcgccgggctggtattgcggaagagggcggcattttttatgtgcatacggcggcntggcaacgggagcaacaaacgcgtaaagagcaggagcgggcccagcgtctgctcgacgccccgctgcactctcacagcattccgtttgcttatgcggatgcggccgaattgcaaaaagcggcggaaaagctcttaagcccgaaaggcagtctctccgtcgacaagcgcaccaaccgtttcctggtcagggataaccagacggtggtggatatgctccagcgctgggctgtgcagatggatctgcccgtcgagcaggtggaactggcggcgcagattgtgaccatcagtgaaaaaagcctgcgtgaactgggggtgaaatggaacctcgctgacgcaacggaggccagtaaagtgggtcaggtcacgacgctgggtgcggacctgtcggtggccagtgcgaccacccacgcagggtttaacatcgggcgcatcaacggcaggatgctggatcttgagttgtcggcgcttgagcaaaagcagcaggtggatatcatcgccagcccgcggctgctggcatcgcacatgcagccggccagcatcaagcagggcagcgaaattccgtatcaggtttccagcggcgagagcggggcgacatccgttgaatttaaagaagcggtattaggcatggaggtcacgccggtggttctgccgggtggtcgtgtgcgcctgaaactgcatatcagtgaaaatatgcccggccaggtgctgcaacaggcagacggcgaaacgctggcgatcgataagcaggagatcgaaacgcaggttgaggtaaaaagtggggaaacgctcgcgctgggcgggatcttttcgcaaaagaataaaaccggacgcgacagcgtgcccgtgctgggcaacattccgtggctgggtcagctgttccgccatgacggaaaagataacgaacggcgcgagttagtggtgtttatcacgccacgtctggtcagtattcagtaa

SEQ ID NO: 3331 - DNA, 1290 bp, Enterobacter cloacae
atggatgaattcaaaccagaagacgagctgaaacccgatcccagcgatcgtcgtactggtcgttctcgtcaatcttcagaacgtgataacgagccgcagatcaactttgacgatgtcgatctggatgcagacgatcgtcgcccttcgcgtagccgcaacgcgcgcaatgagcgtgaagacgaggagtttgaatccgaagaagagttaatggatgaacagcctgttaaacgtcgaccgcgcaagcgtaaaaaagcggtagcggcaaaaccggcctcccgtcagtacatcatgatgggccttggcgttctggtgctggtattgctgattgtcggcattggttccgcgctaaaagccccttctacccattctaccgagcagaccgcgtctgccgagaagagcatcgacctgtctggtaacgatgcgagcaaccaggcgaatggcgctcagcctgcgccgggcaccacttccgcagagcagaccgcaggcaacaccagcaccggtcaggatatctctctgccgcctgtctcttctaccccgactcagggccaggcgccagctacgcctgaaggccagcagcgtgttgaggttcagggcgatctgaacaacgcgctgatgcagccgcagaatcaggaacaggttaacgctgccgtggtgaactccacgctgccaactgaaccagccaccgttgcgccagttcatggcagcaatgcccagcagcagacgacggcaacggaaactaaaccgcgccagacgcagactgcaccacgccaggagcgtaagcaggctgtgattgagccgaagcgtgagacgaaaccacaggccgtggcaaaagcgccagaaacgaaagcgccagcgcagacaaaacctgcggtgagccagccggttaaagcgccaacgcctgcggcaaccgctgctccgaaagcgacggcgaccacagcggcgcctgctgcaacaacacctgcggctcccgcagccaaaacgggcgcttcgccaggtaaaacgacgggcaacgtgggttctttgcagtcggcctcttccagcaactacacccttcagctgagcagttcgtctaactatgacaacctcaacgcctgggcgaagaaatcgaatctgaaaaactacgtggtttatcagacgacccgtaacggtcaaccgtggtatgtgctggtgagtggtatttatgcttccaaagatgaagcaaaacgtgccgtttccacgctgccagccgacgtgcaggcgaaaaacccgtgggcgaagccgattcatcaggtgcaggccgatctgaagtaa

SEQ ID NO: 3332 - DNA, 1008 bp, Enterobacter cloacae
ataatgactaagcccatcgtttttagtggcgcacagccttcaggtgaactgaccattggtaactacatgggtgcgttacgtcagtgggtgagcatgcaggatgactaccactgcatttactgcatcgtggatttgcatgctatcaccgcgcgtcaggatcccgagaagcttcgcaaagcaacgctcgatacgctggcgctgtacctggcgtgcggtatcgatcccgagaagagcaccattttcgttcagtctcacgtgccagagcacgcgcagctgggctgggcgctgaactgctacacctatttcggcgagctgagtcgcatgacccagttcaaggataagtctgcgcgctactctgagaacatcaacgccggtctgtttgactatccggtgctgatggcggccgacattctgctgtaccagaccaaccaggtgccagtgggtgaagaccagaagcagcacctggagctgagccgcgatattgcccagcgcttcaatgcgctttacggcgacgtgttcaaagtgcctgagccgtttattccgaaatccggcgcgcgcgtgatgtcgctgctggagccgaccaaaaagatgtccaagtctgacgataaccgcaacaacgttatcggcctgctggaagatccgaaatcggtggtgaaaaagctcaagcgtgcggtgaccgactccgatgagccgccagtggtgcgctacgacgtgcagaacaaagcgggcgtatccaacctgctggacattctctccggtgtgaccggacagagcatccctgagctggaaaaacactttgaaggcaagatgtacggccacctgaaaggcgaagtggcagacgccgtttccggcatgctgaccgagttgcaggagcgctatcaccgttaccgtaacgacgaagctttcctgcaaaaagtgatgaaagagggcgcagaaaaagccagcgcgcgcgcgtcggaaaccctgacagcggtgtacgaggcgattgggtttgtggcgaaaccttaa

SEQ ID NO: 3333 - DNA, 1638 bp, Enterobacter cloacae
ggcagcggagaggttcgcatgacccaggttaacgacgttcgcgacgcacacgtcgagacgacgcccgcaccgacggtttcgccgtggcagccgctgagccagccggtgttccgcatgctgtggatcgccacggtggtctctaacgtcggctcatggatgagcgacgtcggcatcaactggagcatgctgaccctgagcgccgacccgctggatatcgcgctggtacaggcggcgagcagcctgccgatgttcctcttcgccctgccgtccggggtgatggcggacatcgttgaccgacgtaaatacctgctcttctcccagctgtgggtgttcatcgccgccgccgggctgacgctgctctccttcaccggacacgtcacccctaccgttctgctggtggcgacgtttctgctgagcgtgggcgcggcgatgagctcgccgccgttccaggccgtggtgcccgatctggtgagcaagccggaactgggcgccgccgtggcgctgaactcgctcggggtcaatatcagccgggcgattggccctgcgctgggcggttttctgctctcgctcgccgggccgtggatggtgtttgccctgaacgcgctctccgtggtcggcgtggcgtgggtgctgtggcgctggcgtcctgcgccgtccgtgcagcgcctgccgccggagcacttcttctccgcggtgcgctccggcattcgctacgtgcacgccgcgccggtgctgcgcaacgtgctggtgcgcaccgtggcgttcttcgttttcggcagcgcgggctgggcactgctgccgctggtggcgcgccgcgagctgggcctgggcccggcaggctacggcgtgatgctggcgtgcattggcctgggggcgattgccggggccattctgctgccgcgcctgcgccagcggctgaacgccgaccggctgatggtagccgcgagcctggtttttgccctcaccatgctggcgctggcgttcgtgcgccacgtctggctgctcaacctgtttgagttcttcaccggcttcgcgtggattgcggtgctctcgacgctgaacctcggcgcgcagcgcagcgccgcccgctgggtgaaagcccgcgcgctggcggtttatctgacggtgttcttcggctcgatgaccgcaggcagcgccctctggggacagatcgcgtcgcagtttggcaccccgacctcgctggtggtcgccacgctggggatggtgctggcaagcgcaacggtgttccgctggaagctggagaaagatcctgatttaaatctcgacctcagcggccagccgctggacggcgtgaagatcgacctgccgaacgagcgcggcccggtgctggtctcgcacgagtacatcatcgacccgcacaacgcgaaagcgtttttgcaggcggtgcacgagctgcgccgggtgcgccgccgcgccggggcgatgagctgggcggtatacgaggatattgagcgccccggactgtttatcgagaccttcctgatgggctcgtggattgagcatctgcgccagcaggaacgccacaccatgaatgacctcctgttgcagagccgcgttctggcttttcatcagggcacaacatcaccggctattcgctacctggtcgcgccggtataa

SEQ ID NO: 3334 - DNA, 846 bp, Enterobacter cloacae
ccatcacctgtacaggaacacactatggcaacgtttaaggcacaagacggcacgcagatttactacaaagattgcggcgcaggcaaaccggttctcttcagccacggctggccgctggacggcgacatgtgggacagccagctgaactacctggccgagcgcggctttcgcgccatcgcctttgaccgtcgcggctttggccgctcggatcagccgtggaacggctactactacgacacctttgcgtccgacatcaacgacctgattaccaccctggaccttcatgaggtgatgctggtgggcttctccatgggcggcggcgacgtgacgcgctacatcaacaactacggcagcgcgcgcgtggccggtcttgcgctgctgggcgcggtgacgccgatcttcggcaaatcggataccttcccgcagggtgtggatcagagcgtgttcgacggcattcgcgacgggctgcgtaaagatcgcgcccagttcatcagcgacttcgccaccccgttctacggtatcaatgccgggcagaccgtttccgccggtgccctgacccagacgctgaacatcgccctgctggcgtccctgaagggcaccatcgactgcgtgaccgcgttcggcgaaaccgacttccgcccggatatggcgaaaatcgacgtgccgacgctggtgatccacggcagcaacgaccagatcgtgccgtttgaaacgaccggcaagctggcggcggaaatgatcaaaaacgccacgctgaaggtgtacgacaacgcgccgcacggcttcgcgctgacccaccaggaccagctcaacgaagatctgctggcgtttgtgaagtcgctgtaa

SEQ ID NO: 3335 - DNA, 1017 bp, Enterobacter cloacae
ttgcgggttgattggtctgagttttgcgagcatcatcgcaaaactactggctcctgtaaccgaactatgaccatcgcaaaatctcttagtcaaaaaattgccgggatgaaaacagcctggtacaacaaagcaccagcgttgaataaacccttacttgttctgtacgttctttcccagtacaagaaaggccatgagcgacttttccagtttcaggacgaaatacaagatcaactacgagatttgctaaaacgctacgggccaaaacgaagcaactatgaagttctaatgccattctggcggttaaagcatgatggcttctgggcactggaaggaacagactctgcactccttaaaagccctgaggaaccgaggctgcagacggtcttagataacaacgtgcgcggtggctttgatgttacctccttttttctattacaaaatcagaaactcttgatcgattcgctcgcaaaacaggtagttgtacaatatttacctatagaatttcactctgcgctgttcaaggaactggggtttgaaacacatgagccatttgaggtaaatgaaaacccgaacgaccgaatcgctctcgttcaaccagacattgatattatcactcaggatctcgcgatagacgaaacaacccgaacagcattgattcaggccagaatcggacaaggtaatttccgggcagaatgcctgagactgtatcccgcctgtcctgtaacaggtattacatttcagccattattgagagcgagccatatcatgccctggtccgcatgccaaactgcgaaagaaagattagatccgtataacggtctcatgcttgcggctcatattgatactttatttgactctggctggatttcattcgctaacgaaggtgacgttctgataagcaatcatcttgattttggtacatgcgacaaactgaatttaccagagaggatcattgcgttgccgaaaccctcatacaattacatgcaatggcaccgacaaaatgtttttaagggttaa

SEQ ID NO: 3336 - DNA, 858 bp, Enterobacter cloacae
agacttcctcgagccgcgcccggacctcgcgccgggcatggaggacgagctggagcgcgtggtgcgccatctggtggagcaccgctggccgttccgcctgcacgccacctacaacgaatccatcagccgcatgctggacgtcttcgagaaggtgaaccgcgacattccgttcaacggcctgcactggttcttcgaccatgcggaaaccgttacccaggccaacatcgaccgcatcaaagaactgggcggcggcattgccgtccagcaccgcatggccttccagggcgaatactttgccgagcgctacggcatcgaagccacccgccacacgccgccggtagcgaaaatgctcgagaccggcgtgccggtgggcttagggacggacgccacccgcgtggcgagctacaacccgtggaccgcgctctactggctggtctccggccgcaccgtcggcgggatgcagatgtacgaccacagcgcccgtctggaccgcgataccgccctgatgctctggacccagggcagcgcgtggttctccagcgagcagaatcagaaggggcagatcaaggtcggccagcttgccgacctggcagtgctgagcaaagactacttccgcgtgccggaagaggagatcaagggcatcgagtccgtcctgacggtggtgaacggcgacatcgtctacgccgcaggcagctttggcccgctcgcgccgccggccatcccggtcctgcccgagtggtccccggtggtgaaggtgccgggtcactaccgcagcgcgccgccgcaggccgcccgcgtgggcatgagtgtggctcaccactgcagcggcccgtgcggggttcacagccaccagcatga

SEQ ID NO: 3337 - DNA, 1179 bp, Enterobacter cloacae
tgcgccggagaaagtccaggattccagaaaggaacttctcagcgtatgaccgatcttgctgaacgtgacgatacgcaggctcgggcagctgtttcgcgtattcctttgcggaatatctggctattgatgctgtacgcctccagtctgtttcgccaccacgggcgcagcatggttgccgctgaaaacaatccggaggagatcccggcgctggtggccaggatcctgcttcacgaagtggagcagcggctgttaaggcatttaagtatgggataccaaactcgccgcgccacgcttaacagggtaaggggacgcattgatgttctgcgcacaaccagtcgacaattgcttgagcgggcacaggtagcctgccagtttcaggaaatgacgctggacacaccacgaaatcgctatgttcgctctgcgttagagcaccttgttccgctgctcagcaacggcccgctggctgcgcaatgtcgcgcaatggcaatcaatttgcgtcgtcgtggtattgaggggggtatgcccagtaaaggtgaactgccgtcaatcacacgttttggccgccacgatgcggcggataaagccatggtcgatgccgcgaagctggcatttgaattatggctaccaacccaaactgcggggcaaaaactgttgccaacgccgtctaatgatccttactggatgcgcaagctgttcgagaaaagtatggcgggtttctatcacttccatcttcccaaaaaagactggacagtcgctgccggaaaagagttgaaatggggattaacgtctcaaagtgcagggagcgaaagtattttcccaaccatgaactcggacattattcttgagcacaagcaacctgcacagcgcgtcatcatcgacaccaaattcaataacattctgactaaaggctggtatcgcgataagagcttgcgcagcggttatatctaccagatttatacctatctgcgaactcaggagaaccgaacagatccattatctctccgttcagctggattattacttcatccagccgtcgatgtaatgctctacgaattcgttgaggtacagggtcataaaatccactttgccaccgtagatttagcagcagatgccgccacaatgactcagcaattattgaaattagcgcgtgattgctgtgggataactgacgtgaattaa

SEQ ID NO: 3338 - DNA, 1035 bp, Enterobacter cloacae
tgcgaattcgcgaaagggagaggacggatgaagcgaaaaacgaaagtgacgatgaacgatattgcgcgggcggcaggggtgtcgcaggcaacggtatcgctggtgcttaaccagtcccgcaacatcaagctcagcgacgatacccgccagcgggtcatcggcgtcgctaccgagctcggctacgaccgcctccccgccgtacacgccccgcgcaaccaggaagagatcgccctgctggtgagctccatgcagagcttcgacccgtttatcgacgccatcagccaggcgcgggaagcggcgtggcgcaacgagactctgctcaccgtctacgactacggcgacgacatcgagctggcgctgaacatcatccgccagctggagaagcgcaactgcatcgggattgtcctcgcctcaccggtcaccacgctggtggacatgacggcattccaggactgcacccgcatcccgctggtgctgctcaaccagcgcgaccccggctcgccgctgctgccgtcgtttatcccggacgactacgccaacgcttttcaggtgactaaacacctcatcgcctgcggggcgacgcgcatcgcccacatcaccggcgagagctggatggaggcctcgcgccagcgtctggcgggctaccaggccgcgctgcagcaggccggactcgcgtgcgacgacggcctggtgcgccagaccaactggcagttcagcgagtcctttaccgccaccacctccctgctggaactggccgagcgcccggacgccatcttctgcgccagcgactggctggcgattggctgctatcaggcgctggcggtgaacggcgtgcgcatcccgcaggacatgctgctggcgggctacgacgaccagaagatttccgaacagctcaccccgccgctgaccagtatccagctgccctacagcgagctgggacggctggcggtggagtacctgtgcaatcaggaagatgccgccacgcacgtgacgctggcgggcaggctgaaggtgcgcgcctcaagcctcgtctga

SEQ ID NO: 3339 - DNA, 618 bp, Enterobacter cloacae
atggaacacattgtttatgtggttgatgacgatgacacagtcagacagtccgttgtcaggctgctggaatccgcggatatgcacgcccttggcttttcctcagcagaagcctttctcagccatccctttgaggatctgccctcctgcgtgatcctcgatatgcagatgcccacgataaccggatttgatgtcgcagatgcgctgaaagccagcgggcgggaaataccgatcatctttctcaccggtcacggcaccatccctatgtccgtccgggcgatcaaaggcggagcctacgaatttctcactaagcccgttgaatccagcgcgctcatcggctccatcgaatccgcgctcagactggcacagcacaacgccgcccgcgtcaaagagcactacgccctgaagcagcgccacatgtccctcacgccgcgcgagaatgaggtgcttgagctggccatcagcggcaagctcaacaagcagatcgccgccgagctgggcgtcagtgagatcacggtgaaagtgcaccgccgccgggtaatggagaaaatgcaggtccgctccgtggccgaactggtcagggccgtcgagcgcctgaccaaacatcaaccagtggaataa

SEQ ID NO: 3340 - DNA, 1884 bp, Enterobacter cloacae
tctggagctcttatggttaccctcggtaaagccgatctcattctggttaacggccagtttcacaccgtcgatcgcgagaatcctctcgcagaagccgttgccgtgcgcgacggaaaatttctggaagtgggtaccgtcgccgaggtgatgcaacaccacggcgacggcactaaggtggtcgacttaaaaggccacaccgccatccccggcctgaacgactcgcacctgcacctgatccgcggcgggctgaactacaacctcgagctgcgctgggaaggcgtgccgtcgctcgccgacgccctgcggatgctgaaagagcaggccctgcgcacgccgtcgccccagtgggtgcgcgtggtgggcggctggagcgagttccagtttgccgagcgccgcatgccgacgctggacgagattaacgacgccgcgccggataccccggtcttcattctgcacctgtacgaccgcgctctgctcaaccgcgccgcgctgaaggtggtcggctacaccaaagagacgccaaacccgccgggcggggagatccagcgcgacgccaacggcaacccgaccgggatgctgattgcccgtccgaacgccatgatcctctacgccacgctggccaaagggccgaagctgccgctggagcagcaggtgaactccacccgccagttcatgcgcgagctgaaccgtctggggctgaccagcgccatcgacgcgggcggcggcttccagaactacccggaagattacgaggtgatcgccgagctgcacgagaaaaagcagatgaccatccgcatcgcctacaacctgtttacccagcgtccgggccacgagctggaagactttgaaaaatggaccgacatgctcacgccgggccagggcagcgatttcttccgccaaaacggcgcgggcgagatgctggtcttctccgccgccgattttgaagacttcctcgagccgcgcccggacctcgcgccgggcatggaggacgagctggagcgcgtggtgcgccatctggtggagcaccgctggccgttccgcctgcacgccacctacaacgaatccatcagccgcatgctggacgtcttcgagaaggtgaaccgcgacattccgttcaacggcctgcactggttcttcgaccatgcggaaaccgttacccaggccaacatcgaccgcatcaaagaactgggcggcggcattgccgtccagcaccgcatggccttccagggcgaatactttgccgagcgctacggcatcgaagccacccgccacacgccgccggtagcgaaaatgctcgagaccggcgtgccggtgggcttagggacggacgccacccgcgtggcgagctacaacccgtggaccgcgctctactggctggtctccggccgcaccgtcggcgggatgcagatgtacgaccacagcgcccgtctggaccgcgataccgccctgatgctctggacccagggcagcgcgtggttctccagcgagcagaatcagaaggggcagatcaaggtcggccagcttgccgacctggcagtgctgagcaaagactacttccgcgtgccggaagaggagatcaagggcatcgagtccgtcctgacggtggtgaacggcgacatcgtctacgccgcaggcagctttggcccgctcgcgccgccggccatcccggtcctgcccgagtggtccccggtggtgaaggtgccgggtcactaccgcagcgcgccgccgcaggccgcccgcgtgggcatgagtgtggctcaccactgcagcggcccgtgcggggttcacagccaccagcatgactttgcccgcacgtcagcgatgccggtatccgacgataacgctttctggggggcgctgggctgcagctgctttgcattctga

SEQ ID NO: 3341 - DNA, 2028 bp, Enterobacter cloacae
ttattcactcaggcttacaatcccgtaaaattcattcgccaggttactgaagcctgtaattttactggagagcatatggacgcagttgagcaagacgtcagattcgaatgggcagacttttatcaggcttttgcctctcagctactgacctggcgaaatcgaagagaggagttggtggcgggtattcaccgcattgctgctgagattggtagtatgtcacacctacaggacaagcccgctaatggcgtcccccatcctttgaaagacatttgtcctttcaccactatgggcttgtttaatcgctcgcttaccgttaccaaccgaagaaatatcgcagccagcctggcaaaactgataggcgtacgcgaaaaggttcctgaatcgttcgacggtattccgctactgaacaatcagaaatcatggttctttggctatgagaaatcacgtaagcctgaagacatcgatacgctgtgggaaatgttttctcaggcaatctccttcgccgacaccccaaacgccgatcccgctgacttcctcttttcttatgacgccgcatctaacgtgcgcaatgtgggctggaacctgacaatgggattgtactggctacgcccctggttctaccctacgctggatagccagtctcagtactacatccagaaagtcctgaacattaaaatcattaaaaaaggtgccaaagggcgctgtagcggacacaactatcaggccgtagccctggcgctcaaaaaggcttttacccagccaaactatccggttcactcctttcctgaactctctctggcggcatggaatatcgatttgcaacagtcaaatgatgaagtcgagcggctgacatggaaagcgtatttgctcaataagatcaaggtgctgtgcctacgaaaagacagcccctttttctctttgagggagttaaaagaggcctatctggatgagattaaggcggattatcccaataacaatactattgaatcatccatttcatattatctgcaaaaactacgtgacgatgatgaactggagtttcagacccccggcaattatgaatacctcaacttcgataaaggtgaattgcagagcatcaccgaggaaacggttgaagagaacgtgcccgcggaaatcccccacaagccttacacgataagcaatttgatcgatgagggctgctttttagaagaggaaaaaatccaattcatccttcagcggttacaggccaaaaaaaacctgatccttcagggcccgccgggaaccggtaaaacctggcttgcgcgccgtctggcgtattgtctgatgggcgaggaaacctctaagcgcatcagcgcggtgcagttccaccctaccctctcctacgaagactttattcgaggctggcgtcctaacaatgaaggacgtttagcactggtagacgggccttttctccatgcaatcgacaaagcagtaaacgatccgacaactaagtacgtggtcattattgaggagattaaccggggcaatcctgcgcaaatttttggcgaaacgctgacgctgatggaggcggataaacgtacgccgaacgaggcgcttgagctctcatatcgatctgatatgcatgaaaaaacctacattcctgaaaacctgtatatcatcgggacgatgaatatcgctgaccgctcgcttgctctgctagacctggcattacggcgccgctttgcgtttattgatctaaagcccgagtttaacgacgcgtggaaaaaatgggttaaccaacggtttaatgtgagcctggaaacattagcccttatcgaatccaaattaaccgcgttaaatgaaaaattgtccagggatgcggccctgggacctcaattttgtatcgggcatagctatgttaccccacctgcggggttgaaaattgacgacgggatggcctggtacgagcaggttgtcgaaaccgaaatctgccctttacttgccgaatactggtttgatgcgccggagaaagtccaggattccagaaaggaacttctcagcgtatga

SEQ ID NO: 3342 - DNA, 1014 bp, Enterobacter cloacae
ggagtctttatgaacgcaccaactatcctcaccggcgaccgcccaaccggcccgctgcacctcggccacttcgtcggatcgctgcgccagcgcgtggcgctccagcagacgcacagccagtttgtgctgattgccgaccttcaggggctcaccgataacggcagcaacccgcagaagatccgcgataacatccccgaagtgctggccgactacctcgccgccggtatcgacccgaacctgaccacgatctgcctgcagtctgccctgcccgccctcgccgatctgacgatgctgtatatgaacatcgtcaccgttgcccgcgtggagcgtaacccgacggtgaaaaacgagattgcgcagaagggctttgcccgctcgctgccggtcgggtttatggcctaccccatcagccaggcggcggacatcaccgcgtttaaggccgagtgcgtgcccgtcggcgacgaccagttgccgatgattgagcagaccaacgagattgtgcacaagatgaacagcctgctgcccgccccggtgctgcgccactgcaaggcgatgctgagcgacaccagccgcctgcccggcatcgacggcagcgccaagatgtcgaaatcgctgggcaacacgctgcacctttcggccagcgaagagaccattcaccgtgcggtcagcgccatgtacaccgacccgaaccacctgaaggtgagcgacccggggcagattgaggggaacgtagtgtttacgtatctcgatgcgtttcacccggacaaggacaaagtggcggcgatgaaggcgcactatcaggcgggcgggctgggtgaccgggtgtgcaagaacgagctggaggggtgcctgcaggagctgattgcgccgatgcgggagcggagggcgatgtatatgcgtgacaggggagagttaatggcgatgctgaagcgcgggaccgaacgggcgcagggggtgacgcaggagacgttgagggaggttaaggttgggttgggggtgccggtgtttagttaa

SEQ ID NO: 3343 - DNA, 370 bp, Enterobacter cloacae
gggggttggctcggatcggcacgtccgttgtgaaaacgcgaggattggacctgaccaggggccggagttcacttgccgtgcactggatcgatgggcctgtgaacatggtgtggatttgcgcttaatccagccgggcaatccaacgcacaacggatttattgagagctttaacggacgatttcgcgatgaatgtttgaatgagcactggttcagcgatatcgttcatgccaggaaaattattaatgactggcggcaggattataacgaatgccgcccgcactccacgctgaattatcagacaccgtctgaatttgcagcgggctggagaaagggtcattctgagaatgaagattccgacgttactaactga

SEQ ID NO: 3344 - DNA, 414 bp, Enterobacter cloacae
agaagacccaacccagccgctcaccgtctgcgcgtggcgcctgccgccggaagaggagggcgagacgttcttccagcatccgctggaccagaccgcgctggcgctctcggacgtggtgagcttccacgcctacacccacacggggcggatgacggcgattatccagcagctgcaacagctcggacgaccgctgttctgtaccgaatggctggcgcgccacgtgggcagcaccatcgaagagcagctcccgctgatgtacgcggcgaaggtcgcgccgtaccagtgggggctggtgcgcggcaaaacccagacgtggctgccgtggccggtggtgatgaaggagtccacggactactgccgcctctggttccacgacgtgttcgaggagaacggtatcccgttttcacgcgctga

SEQ ID NO: 3345 - DNA, 1155 bp, Enterobacter cloacae
tcgcgcctgtttaccctctcactggtgctaaccatggcgtatcaactgaacctgaactggccggaatttcttgaaaaatactggcaaaaacaacccgttgtactgaaaaatgccttcccgaattttgtcgaccccattacccctgatgaactggcgggtctggcgatggagccggaagtcgatagccgcctggtaagccacgctaacggcaagtggcaggcgagcaatggcccgtttgagcatttcgataacctcggtgaaaccggctggtccctgctggcgcaggcggtgaaccactggcataagcccgccgcagagctggtgcgtccgttccgcgtcctgccggactggcgtctcgatgacctgatgatctccttttctgtcccgggcagcggcgttgggccgcatatcgatcagtacgatgtgtttatcatccaggggatgggcagccgccgctggcgcgtgggtgacaagctgccgatgcgtcagttctgcccgcatccggctctgctacatgtcgatccttttgagccgatcatcgacgaagatctggcgccgggcgatatcctctacattccgcctggattcccgcatgacggcttcacccatgaaaccgcgctcaactactctgtcggttttcgcgggccgaacggtcgcgatctgatcagcagctttgccgactatgcgctggagaacgatctgggcggcgaacactacagcgatccggatctgacctgccgcgaacacccgggccgcgtggagcagtacgagcttgatcgcattcgcgagatgatgatcgacatgattagcaagccggatgatttcacgaaatggtttggcagcttcgtctccacgccacgtcacgagctggatattgccgccgccgagccgccgtattccgcagaagaggtgctggacgcgcttcagggcggcgaaacgctgtcgcgcctgagcggcctgcgcgtgctgaacgttaacggcagcttctttatcaacagtgaacaactggaaacggcggatgtgaacggggcagacgcgctgtgccgctacaccgagctcggccaggccgagctgggtgacgcactgaataatccggcgtttgtggacgaactcaccgggctgattaaccaggggtactggtacttcgacgagtaa

SEQ ID NO: 3346 - DNA, 516 bp, Enterobacter cloacae
aatgcaaggagcaatagaatggccgtacctgtacatctttttttaactaatgacggcggcacaatgatttgtggttcttgtgacgttgcacaaagggaaggaagtattgagctaagaggattacaacataaccttagcctaccaacagactcggcaacgggcaaggtcaccggcactcgccaacattcgccgtttcagtttaccaaggaactggatagctcttcgccctatctgttcaaagcggcagcaacgggtcagacccttaaaacggcagaattcaggttttaccatattaactattccgggcaagaggaggagtattaccgaatcacgctcgagaacgttaaggtcatttctgtgagtccagtaatgtacgacacccgaggctgtccggggacggggcatatggaggaagtggcgtttaattatgagaagattacccatttgtacaaggacggtaacttgttagcgcacgacgcgtggaacgaacgtccaacatcaggttccgctgcttga

SEQ ID NO: 3347 - DNA, 1113 bp, Enterobacter cloacae
atattatcagtaagaggacgcgtaatgaaagagcagtggagcagggagcaggcacaggcgtggtatcagcagaagggctggctgtgcgggtttaactacctgccgtcgacggcggtgaactggaccgatatctggcaggcagagacctttgatgccgctaccatcgagcgcgagctgggctgggcggcggacgcgggctacaacaccctgcgcatcaacctgccgtttatcgtctgggagcacgaccgcgacgggctgatggcccgcatcgaccggtttttgacgattgccgacgaccgcggcttcagcaccatgctgaccctgatggacgactgcggtttctccggcgacgagccgtatctcggcccgcaaaagccgccggtgccgggcaagcacaacagccaggcggcggcgagcccggggcgcgacaaggtgtgcgatccggactgctgggcagacattgagcgctatatccgcgacgttgtccgccagttccgcgaggataagcgcgtgctgctgtgggatctctacaacgagccgggcaaccgcggcattttcgcgaccggcacgcaggaggtgcagtacgacgcgaagctggagtcctgcgcgcacgagttgatgaagctggcgttccagtgggtgcgtgaagaagacccaacccagccgctcaccgtctgcgcgtggcgcctgccgccggaagaggagggcgagacgttcttccagcatccgctggaccagaccgcgctggcgctctcggacgtggtgagcttccacgcctacacccacacggggcggatgacggcgattatccagcagctgcaacagctcggacgaccgctgttctgtaccgaatggctggcgcgccacgtgggcagcaccatcgaagagcagctcccgctgatgtacgcggcgaaggtcgcgccgtaccagtgggggctggtgcgcggcaaaacccagacgtggctgccgtggccggtggtgatgaaggagtccacggactactgccgcctctggttccacgacgtgttcgaggagaacggtatcccgttttcacgcgctgaaatcgcgctgatgaagaagctgcgcaaaatcgccccggatccgcagggctaa

SEQ ID NO: 3348 - DNA, 1434 bp, Enterobacter cloacae
cgacccggcgcgctgtcgccgggcaaccaggtacgcactatggcaacgacaatgaaaataccgtctcgcgagttatggtcctactttggctatggtttaggtcagtgttttagctttggtttagtgggttcgtttattaactatttttacaccgacgtgctggggatctcggcgctggcggcgagcaccatcttcctgattgcccgtgcatgggacgcagttcacgatccgctgtttgccagcattatggacaccattaacagccggttcggcaagtttcgccactttttgctgatcgcgccgctgctgatcaccggcgtcacgctgctgtcgttctataaaatcgaagcggatatgaccaccaaaatcctctacgccggtgtgacgtatatcctgtggggaacgctgtacgccatctccgatatcccgttctggtcgatgtcgtcggtgatgaccaacgactccgcccagcgcacccgcgcggtgacggcggcaatgctcggggtgaacgccgggatcgcttgcgccaacatcttcttcccgaagctggcggcgttcttcgcccagtacagcaacgataaaggctactttatggcggcgctggtgatgatgctggtggggctgccgctgatgctcaacggttttatgcagatcaaagagcgcgtgccgccgagcccggaaaaggtgaccatccgcgacaccttccacaacctgcgccagaacaagccgctgtttatcgtcctgctgtcgttctttttctgcgtgttccacaacgtggcgggcgggctctatatctatttctttatcaacaatatgggcgacggcagcctgcaaatggcgattggcgtgatgggcattgtggcggcggtgctgtgcctggtcgccccgatgctgacgcgccggatgcagaagcggaagctgtttatgatcctctgcgggctggacgtggcggtgcgcgtggtgatgtggttcacgggctatcagcacacggcgctgctgtttatcctgctcggcctgagcacgctgttcgtgatgatgaccaacatcctcacctcgtcgatgattgccgacaccatcgagtacgcggagtaccacactaacaagcgctgcgcggcgatcaccttctccgggcagaccttcaccggcaagatgtcggtggcggtaggcggcgggttaatcggcgtgtttctgacgatgatcgactatgtgccgcaggcgcaggcccagagcgatagcgtgctgtcggggctgttcttcgggatttgcctgctgccggcgattgggtcgctgatccgcatgggctttatgtcgcgctttacctttaccgaggagaagcatgcggaagtgtgtcggctgctggcggagcgtcggcatcatgtagaaaatagccgtgcagagaatgagcggctggagcgtccggctccggcgaactaa

SEQ ID NO: 3349 - DNA, 468 bp, Enterobacter cloacae
atgcgtaccgaagatcagtggtaccgcgcccccagcgcccgcgaaggaaagccgcgacgcgtaacgatttgtttgaggaaagacagcatgacgctgccgtggcgcattgccatcattgatgacgaacgctctgttcgcagcgggctcagtaacctgctgcaatcggaagggtatgctaccgataccttcgattcggcagaggtgttcttgagccaccctctcgccctgtccggcgcgtcgctggtgatcgccgacatcaagctgcgcggcatgaacggcatcgagctgtttgagaagctgcggttgctggccatgccgccaccgccaatactctttatctccggccatgctgatgaaaatatgcagcggtatgcactcagtctgggcgccgctgcatttttgcgtaagccgattaacatcgatattctgctggatcatattcagcgggagctgacccgccgacaataa

SEQ ID NO: 3350 - DNA, 5595 bp, Enterobacter cloacae
ggatcgcggatgaacgaacatacgtcgcctgcattttggcccgcccggggtagtctccatgaagggcgggcttttgttctgaaagaggatgtcatttttaccgtgctggcgcaggagggcggcatctcctggatgaacgggcggcatccccagtccggcggttcgtttattattgccaccgcggtcagcgatgaagaagaggagcgggcaacgcggctgctgaaaaacgagtttgccctgcgcgatcgccttcatgacggctgggctatccggcccgtcgcttcaacccagtaccgcggacgttttgcgctggtctacgcgccattctgctttgaactgctggcgtgccgggcaggtaaggcgatttccgggatcgcccgctttatcgagatggcgatccgcatctgcggtcccctgcgccagatgcatcagcacaacctgatccacggcgatatcaaacccggggcgatcttcgttcatcacgacgccacctgccgtctgtgcagcttcggtctttcctgcggcacctccgacgccttctcccagtcccggcttgccgcgtctggcggcacgcccgcctacatgtcaccggaacacaccacgcgtacccggcgcgccgttgacagccggagcgatctctacagtctggggatcgtgctttatgaacttctgaccgggcgattgccgtttgaactgagcgctgatgaccagaccaactgggcgcattatcacattgcctctgaaccgcttgcgccgggtcgggtgcgcccggacgtacccggcatgttgtcgaccattatccttaagctgctggagaagaatccggagaatcgctatcagaccgtcgacgggctgattgccgacctcaggcgctgccaggcgacgctgaccgttgaaggcgaaattgtcgactttattcccggccagcaggatcgctctccggcgatccatctggccgattcacttttctctgcgcatccgcaggccagcgacgtcatcgccgcgtttgagcgggtcagccagagcggtgcgccggaagtggtgacgattggggggccttcggggatcggcaaatcttccgtgatcgccaccacgctgaaatcgctgcaacagcgcaaggtgctgctggcggtgggcaaggtcgatcaatattctcccacgctgccctacggcgtgctgagttcggcgtttcggacgctcacgctgcacctgctcgggctgccagccggggaggtggcgacgtggaaaatccgtctgtcgcgcgcgctggaaggcttcgaggagctggccgtcagcctggtgccggagctgaatttactccttgagaacaaaccgcgtttctccgcggataccttttccatcgacgcgcgggcgcgcttcagccatatggtgctggcgctggtgaaaaccttcgccacccagggcgcgccgctggtgctgctgctggatgatgtacagtggatcgacgccgccagcctgcaaacgctcgatcacctgctgcgcgcctgcggcgccatcccgctgctggtggtggtggcgcaccgcgatctcagttcgctttctgatcccaccttgcagaccgcgctggcgagcctgccggaggcggcgcaatacgccacgacgattgtgccgcagccgctgtcggtgaaggccgtggcgcgctggctcgggggaatttttcatgcccgcagtagcggcaccgccgatcttgccacgctgatccatgaaaaaaccggcggcaacccgcttttcgtgcaggagtttttccgtcgcatcgtcgatgacggactggtggtgcacaacaaatatcaggggaaatggcattacgatctccaggccatccgcgcccggcactacaccgagaacgtggtgacgctggtgcttgaacagctcaaggagatgcccgacgagacgcgccgcctgctgggcagcatcgcctgcctcggctgcacgggcgagctggagatgctgtgccgcgtggtggggcggtcggcggcggaaatccgctacgcgcttcatccggcggttaccgctcagctgattgtgctgacggagaaagagtacgcttttacccacgatcgggtgcaggaagccgcctttgccctgctggatgagggcgagaaaagccatctgcacctgaccaccgccagcctgctggcggatgccgcacggcagacggcgggcaacgaactgctgttccgcgcggttcaccacgtcagcgccgcgctggactgcatccagcctgcaccccagcggcagcgattccgggagctgagccttcaggccgcgcggcgtgcgaagcgtaccggcgattacctttccgccttaagctatatccagaccgccagagcgctggggaatgcgggcccggtctcggactttatgctggatatcgaagaggcgggctgtgagtttgcgctcgggcacctggagcgcacgcgtgcgctgtgcgatgcgatcctcggttcaccgggcgggctgacggagaaagcgctggccgccaacctgctggcggaagtgtatatgcgccagtcggagatccgcctggcgctggaggcgtcgttatgctggctgggcgtgttcgggatccagatcagccgctacccggaaaatgccgaatgtgacgaggcctggcagcagttctgtcaacgcaccgccgacgcgccgctgaacccgttttctcagcttaagctgatggagaacgcagagaccgaagcggtgatgaacctgctttacagcgccagtattttcgccagctttacctgcccgcgcctgcactttttactcctgtgccggatgatgcacctcacgctcgatcacggcatcaccggcgcctccaccacggcgatggcctggtttggcgtgctgattggtcaccgctacgccgaataccgtctcggatttgagtacggcacgctggctcgtgagctggtgaaccgccacggctatgatgcctatgaagccaaaactctgctgccgctcgaccagctcagcgtctggacccagccgctgtcgtacactatcgagtgcgcaaaggcctgctttacctcggcggtgacccacggcgacatgacgatggcctgtttcgcggcctgtcatcagatcattaacttcctctcccggggcgatcatctggatggcgtgctgaccagcatcgatcgcggtctggcctttgtacgcaaaacggattatcaggacattgaaaccgttctgcacattcagcgccgctacgtggagtttttacgcacgccggtgacgggcccatggagcgccgcccaggcgctgcctgacgatctgctgcccgcgccgccggagcaggcgcccgagcagacctcgaccatgctgttctggtactggctctatcgcgggatggcgcacttttcctgcggcgaatacgccgacgcgcaggcggatttagagagggcgggctggtatgcgtggtccgcgccgggtcatattcatctgctggattaccatttttacagcgcgctggcgctctcccgtcagctcacgccggagaccttctcggcggattatcgccgcagtattcatcaccattacgacaaaattgccctctgggcgcggatcaattcgggcacgtttgccgataaagaagcgctgatttacgccgaaatcgtccgtctggacggcatgaacagcatcgcgctggagcagtatgaaaaagcggtgcggctctcgcgggagggcggctttaacccgatcaatgccctggcgcacgagctggcagggcgtttctcgctggcctgcggctacccgaccgcctccgacgcccatttccgcggcgcgattgccgcctgggggcgcgccggggcgcaggccaaggtgcgccagctggagcaggatttcccgcatctgctggcctccgggcagagccgcgcgtatgacacggcggccttcgcccagaacgaggtgatccgcgatttacagagcgtcatcaaagcctcacgcgccttgtccgaagaaattaacctcgagcgtttaattgaaaacctgatgacgctgctgcttgaacgggccggggcgcagcgtggcctgctgctgcgcgttagcgataatcacatcccggagatcgaggccagtgcctggaccagtaccgacggggtgcgggtgcgcatcctgaaggcgtcaccgatggcgacggacatgccgctgtcggtgctggccgcagtgatccgcaccgggcaggagatccgcaccggcaaaccggaggagttccacccgttcagccaggatccgtatctggtgacgtccggcgccgccgtgatgtgtgtcccgatgttcaaacaggcgcggctggtgggggtgctgtatctggaaaaccgcctgatgccggaagtgtttaccgccgaacattcgcgcgtggtcagcctgctgggcgcgcaggcggcggtttcgctggagacggcgcggctttacgccgagctgctggcggaaaacatccagcgccgacgggtggagaaagagctgcgcgccagccagacctcactgatgctgggcgagcagatcagccataccggcagctggcgctgggagctggtgcaggatctgatgtttatgtctgaagagtacgcccgtatccttggcctgccggagcagcaaaagatgatctcaatggcggagtttttaaccttcgtgcatgaggacgattatggccggatcagcaccctcgttaaccagagcgtgcgcgacgggctgtcgatgcgcgcggagtttcgcattatccgcaccgacggctccgttcgctacatcctcgggattggcgatccggtcggcgtcggcagcgaagtgaatgagtattacggcatcattaccgacatcaccagccagcgggcggcggaagatgcgatgcgggtggcgcaggcggatctggcgcgagtctcacgggccaccaccgtcgggcaactgacctcctcgatcgcgcacgagatcaaccagccgctgatgtcgattgtctcgaacgccggcgcgagcctgcgctggctcaaccgcgatccggcgcggctggacaaagtgcgcgaggggctggaggagatcgccgccgagggcgagcgggcaggggagatcattcgcagcattcagtctctgacgcgcaagcaggaccccacgtttacgcgtattgatctgcacttcctgatccaccacatcattatgctttcacgcagcgaacttgagctgcgacacataagcgttgattatcttctgaacgctgacgacagctttatcatcggcgacagcgtgcagatccagcaggtgctgcttaacctggtgatgaatgcgatggaagcgatggcggaagtgacggatcgcccgtgcagcatcacgatctccaccgcgaactgcggcgaggggaaggtgatctttgagatcgccgataccggcagcggcattgaaccggagctcaccgagcggatctttgactcgttctattcgaccaaagcgcagggaatggggatggggctgaccatcagcgccagcatcattgaacggcaccgggggaaactgagcgcgcgccgcagagagccgtacggcacggtatttaccttcgcgttgccgcttgccggacaggaggagtaa

SEQ ID NO: 3351 - DNA, 630 bp, Enterobacter cloacae
gcgcgacaagctgaggacataacgatgcactacacactgaaaagcagtgacgataaagaaaaagcggaaggaacaaacggcgcgggcgctctacagcaaaaactgctggaatcccgttcgattgtcatctccggtgaaatcaaccaggagctggcccagaaagtcatcactcagatgatcctgctgcaaagcgtcagtaacgatccgatcaagctgtacatcaacagccagggcggccatgtagaagcgggcgataccatccacgacttcattaagtttatccgtccggaagtacacgttattggcaccggctgggtggcaagcgccgggatcaccatcttcctggcggcgaaaaaagagcaccgctactcgctgcctaatacccgctttatgatccaccagccgctgggcggcgtgcgcggtcaggcaacggatattgagatcgaagcgcgggagatcatccgcatgctggaacgcgtgaacaagctgattgccgacgccaccggccagccgctggagaaagtgaagaaagacaccgaccgtaacttctggatgtcaccggcggaagcgctggactacggcatcgtgggcaaactgatcacccattatgacgagctgaacctggattaa

SEQ ID NO: 3352 - DNA, 1017 bp, Enterobacter cloacae
ttgctgccattgcaaatggatggtactgttttgcctgtcctttcccgatgcaggccccgaatgatgctccagagtgaaaataaatcagcgaaacgcatattttttgttgaagattttcaggtattcggcgagcgctatggcatcgactaccgtttcccccagttaaaagaggctcaggtcagcggtagccccgtgttgcaggggaatgttgaagagatgatgctctcgtccggcatttcgctgacccattccgacgtacgtgtattacagccctatgaaaccacctctcgccacagcagcccgctctatatgctggtggtgctggaagggtgcgtgacgctcacgctcaatggtatcaattatcctgtccgcccgggcatggcgttcagctcacatctgagtgaagatcaggtaatgagcgcgcgtcacgatgccgacagcacgctgaaaacgctctcgtttggcgtgtacccgcacgatgccggacgtgaagccttgcttgagtcattgcttctggaatggcaaagcctgaatgcacccgcgtttgtctggcaggttcccgagtttgtgatgtcaggtattctgcatgcgcagcggcaggggggaagcgtgctctcacgcaagctgttgcttgaggggctgatgtatcagctgctcggccatggcctcaaccagcgccagcagccttgcccaagccgccctgagcatgcgcgtcttgaacgcgtgcggagcctgctggaacagtctcctgaacgggatcatactctcgcgcagctggcagccctggctgcaatgagcccaagcagcctgcgtagcaagttccgtcagcgctatggctgcaccctcttcgactatctccgcaactgtcgccttgcgctggcgcgccgctatctgctggaaggccacagcgtgcagcaggcggcgtggatgtgcgggtatcagcatgccaccaacttcgccaccgcgtttcgtcgtcattacgggatttcaccgggtgacgtgcgcaaactccgctaa

SEQ ID NO: 3353 - DNA, 279 bp, Enterobacter cloacae
ctgagtgttgtatctaatcgtgggggcaggtcacagcgtctgaatgaagccttggaaaagttgaatgaaatgggtatcactacgaagctggtcaaccgtgttcacagtaagattgtggttggtgatgaggggctgctctgcgtcggttcctttaactggtttagcgccgcgcgagaggaaagataccagcgatacgatacgtcgatggtctatcgcggtgatagcttaaaagctgagatcaaaacgatttattccagccttgagcagcggcagttataa

SEQ ID NO: 3354 - DNA, 477 bp, Enterobacter cloacae
gagttgtatatggctgcgacgaattttaagccagagtttactgtttgcaaaacagaatcagacgctttcaccggcatgattgaaaaccgcgagctggtgcgcaaaaacagcgcccgccgtcttcacggaaaccagcccaacgcggcgcccgtccatccgcgagcggagactccgcaggacagtgccgcttgctgcgaactgtatgcgcgcatagacatgaaatatcttctgctgggtggtgaatggttaacccgtgcaggctttatcaacggtatgcccgtaaaaatccgtgccatgaaagactgcattgtaattacgccccagcatacaagagaattatggggatgccttgaaggtatgagtgtggtgaatataaataaacagaaagtcgcgcagtggttgaagacgtttccgggagcgctgaatgatactggagatatcccggtagttaagcgcaatatagtacaggcaaaataa

SEQ ID NO: 3355 - DNA, 612 bp, Enterobacter cloacae
cgttgtaatgccgaaaggggtcttagatgtgagaaagccgcctttcggcggctatctgaaaatggggaaaactactccatgccgcctttaagaaggcagccaccagcggtttacggtgagcacggcgtggtttatgttcatctctttaccgtaccacgtccggcgcgaaaaacaaaagggcacgtcatgctgcaatcactcaaccacctgaccctcgcggtcagcgacctgcaaaaaagcgtcaccttctggcacgagttgctggggctgaccctgcacgcccgctggaatgccggggcctatctcacctgcggcgaattgtgggtctgcctgtcgtacgacgaggcgcgccagtacgtgccgccgcaggagagcgactacacccactacgcgtttaccgtggcggaagaggattttgaaccgttctcgcagaggcttaagcagacgggcgtcaccgtctggaagcagaacaaaagcgagggggcgtcgttctattttctcgacccggacgggcacaagctggagctgcacgtgggcagcctcgccgcgcggctggcggcgtgtcgcgaaaagccctatgcgggcatggtgtttacctcagacgaggcttga

SEQ ID NO: 3356 - DNA, 711 bp, Enterobacter cloacae
cctttaacctcactggataatcttatgaccacttctaagctcgaagtcttaacccctgccaactgtcagatcattttcatcgaccaccagccgcagatggcgttcggcgtgcagtctattgaccgccaggtgctgaaaaacaacaccgtggcgctggcgaaagcggctaaggtgttcaacatcccaaccatcatcaccaccgttgagactgaaagcttctccggcaatacctatccggaactgctggacgtgttcccgggccaggacattctggagcgtacctccatgaactcctgggacgaccagaaggtgcgcgacgcgctgaaggccaacggcaagaagaaggtggtggttgccggcctgtggaccgaagtgtgcaacaacagctttgccctgtgcgcgatgctggaaggcgactacgaaatttatatggtggcagacgcctccggcggcacctccaaagaagcccacgacttcgcgatgcagcgcatgatccaggcgggcgtgatcccggtgacctggcagcaggtgatgctggagtggcagcgtgactgggcgcgcaaagagacctacaccgcggtgatggatatcgtgcgcgagcactccggcgcctacggcatgggcgtggattacgcctacaccatggtgcacaaagcgccgtctcgccagaagagcgagcaccgcaccttagcgccggttccggctcgctaa

SEQ ID NO: 3357 - DNA, 2112 bp, Enterobacter cloacae
gaaatatctctggagagggttatgtttgctaaatcgcgtctggcactgctggtgggatgggttaccggtagcgtcgcttttcctttactggcgcaggatgcccaaaaaactgacaccgtggtggtgacctcgcagatgcagtctgcggccaccaagcttgaaacaccggatattgaaaccccgcagtcggtctctatcgtcacgcgcgagcagttcgaagagcagggcgcaaccagcgtgcgtcaggccgtgagctacacgccgggggtctacagcaaccagatcggggcgtcaaaccgctttgactacatggtgctgcgcggcttctcggacggcagtctggacaacgtctacctcgacggcctgaagatgatgggcgacaccaattcccacagctcgctggtggttgacccgtggttcctggacagtatcgaagtcgtgcgcggtccggcctccgtgctctatggccgctcatcgccgggcgggattgtggcgctcacctcccgtaagccatcgttcgatcctggcggggagattaagctcttcgccggtaacaataaccagcgtggggcgatgttcgacgtgaccggcccggttgatgataacgaccgcgtggcggtgcgcctcagcgggatgacccgctatgctgattcccagttcgatccgctcaaagaagagcgttacgccctgatgccgagcctgacctggcgtatcaccgacaacacccgtctggatctgatggcctacctgcaccgcgatccggaaggcggcagccactccggcctgccatatgagggcaccgttgtaccgcacagcggtaagaaaatctccaacaccttcttcgagggcgaggacgattacgacaagtacgatcgtcgggaaaacatggtcggctataacatcgagcacctgtttgacagcggctggtctgtgcgccagaagctgcgctacctgcacaccaaagtcgagctgaaccaggtgtatgccgcaggctggctgaatgacaccgagctgaatcgcggctattccggctctgacgagaagatgaacgccatcaccctggataaccaggtcgacggcagcttcgacaccggggaggtgaaccaccgcgtgctgatcggcatggactatcaggaccgcaccaacaacgtcaccggctactacggcggcttcccgccgattgacgctttccatcctgtttacggcgcgaagccggactacatcacccagtacagcagggaaaaacacaagctgcgccagaccggctactacctacaggatcagatgtccattgaccgctggcgcctgacgctgggcgggcgttacgaccaggtgagcgtgtcgaacgtcgacaactttaaccacacccgcagcgatctggataaaaacagatacagcagccgcgcggcgctgctgtatctgtttgataacggcgttgcgccgtacgtcagttactctaccgcctttacgccgaccagctttgccgacgagcagggcaatatcctggatccgatgaagggcaagcagtgggaagcgggcgtaaagtatgagccagaggggatgaacagccagttcagcgcctcggtgttccgcatcaaccagaagaacattgccactaaagaggagccgaccgatccgtaccgttccattggtgaaatcgaatccgaaggcgttgagctggaggcgattggtcagctgaccgacagcctgcgtatgcaggcggcgtacacctacacggatattcgctacaagaagagcagcccggaagaggagggcaagcgcgccgtttatgccccgcgtaacatggccagcgcctggctgagctacgacgtcaaaaccggcctgctggacggcctgaccgtcggctccggcgtgcgctatgtcaacgggatcgccagcgatcgccagaacacccatacgcttccgtcgtacacgctggtggatatgaccgtggggtatgacctgtcaaaagtggggctcacgggcgtgagcgcgcagttgaacgtcaataacctgacggacagaagctacgtcgcggcctgtaactctctctcttactgctacttcggtgcagaacgcagcattgtgggcagcgtttcgtggaagttctga

SEQ ID NO: 3358 - DNA, 1143 bp, Enterobacter cloacae
gttaagtcggtaccaggcttagtctgcctgcaaaaacgtgggcttggatcacacgctccgacatcatgtcggacttacgggagcatcactatgactgatattgcgcagctgcttggcaaagacgccgacagccttttacagcatcgttgtatgaccattccagccgaccagctttatctgcctggccatgattacgtagaccgggtcatggtcgacaacaaccgtccgcctgccgtactgcgaaacatgcagacgctttacaataccggccgtctgggcgggaccggctatctctccattctgcccgttgaccagggcgtagagcactcggcgggagcgtcgtttgctgctaacccgctctactttgacccgaaaaacattgtcgagctggcgattgaagcagggtgtaactgtgtggcatcgacgtatggcgtgctggcctccgtttctcgccgctatgctcaccgcattccgttcctcgtcaagctgaaccacaacgaaaccctgagctacccaaccgaatatgaccagacgctgtacgccagcgtcgagcaggcgttcaacatgggcgcggtggcggtcggggcaaccatctatttcggctctgaacagtcgcgacgtcagattgaagaaatctccgcggcgttcgagcgtgcccacgagctgggcatggtaaccgtgctgtgggcctatctgcgtaacgcgtcattcaagaaagacggcgtggattaccacgtatcagcggatctgaccggtcaggcaaaccacctggcagcaaccatcggcgcggacatcgtgaagcagaaaatggccgagaataacggcggctataaagcggtgaactttggctataccgacgaccgcgtgtacagcaagctgaccagcgacaacccgatcgatctggtgcgctaccagctggcgaactgctacatgggccgcgccgggctgattaactccggcggtgcggcaggcggtgaaactgacctgaccgacgcggtgcgcacggcggtcattaacaaacgtgcgggcggtatggggctgatcctgggccgtaaggcgtttaaaaaatccatggccgacggcgtgaagctgattaatgcggttcaggatgtctatctggacagtaaagtcacgattgcctga

SEQ ID NO: 3359 - DNA, 618 bp, Enterobacter cloacae
ggcttcagggcgcgatgcacgaaaggagaaagtgccatgcgtctttgtgaccgcgatatagaagcctggctggatgaaggccgcctgtctatcaccccgcgtccgccggttgagcgtattaacggcgtgaccgtcgatgtgcgtctggggaataaattccgcaccttcagcggccacacggcaccgtttatcgacctcagcgggccgaaagacgaagtcagcgcggcgctggatcgcgtcatgagcgacgaaatcgtcatcgacgaaggagaggcgttttatctccatcctggcgaactggcgctggcggtgacctttgaatcggtcacgctgcctgcggatctggtcggctggcttgacggacgctcttccctggcgcgtctgggcctgatggtgcacgtcaccgcgcaccgtatcgatccgggctggtcgggccgtatcgtgctggagttctttaacgccggtaaactgccgctggcgcttcgtccgggaatgatgattggtgcgttgagcttcgaaccgctgaccggcccggcagaccgtccttataaccgccgtcaggacgcaaaatatcgcgaccagcagggtgcggttgccagtcgtatcgataaagactga

SEQ ID NO: 3360 - DNA, 2235 bp, Enterobacter cloacae
ggcggtatacaccttactagaccagtctgcccgtcagtgggcgcaggcactgaaagctcagcagggataacaatgacagaaaaaacaagaccttctgccgccccgacgtcgggcagtgatgaaatcgatatcggtcgcctggtcgggaccgttattgaagcgaaatggtgggtgctgggtattaccgccatctttgccgtggcggcgatcgtttatacgctgttcgcgacgcctatttacagcgccgacgcgctggtgcagatcgaacaaaataccggtaattcgctggttcaggatatcggttcggcgctggccaacaagccgccggcatcggaagccgaaattcagctgatccagtcgcgcctggtactgggcaaaacggttcacgatctggggctggatatcgcggtcaccaaaaacaccttcccggtgtttggcgcaggctgggatcgcctgatggggcgcagtaacgatacggtaaaagtgaccgacttcgtgatcccaaaaggggcaggggaccaaacctttaccctgaccgtgctgggaccaaaacagtatcagctgaccagcgacgcgggcttcagcgcacgcggcgaggtggggcagatgctgactaaagagggcgtcagcatcaaggtcagcgcaattcaggcgcatgagggcggggagtttacggtcaccaaattctcgacgctcgggatgatcaacaacctgcaaaacaacctgaccgtcaccgaaaacggcaaggataccggcgttctgagcatgaccttcaccggtgaagacaaggatcaaatccgcgacatccttaatagcatcacccgcaactatcttgagcagaacgtagagcgcaagtcagcggaagccgcaaaaagcctggcgttcctcagtaaacagctgccggaggtgcgcgcccgtctggatgacgctgagaacaagctgaacgcgtaccgtcaggacaaagattccgtcgatctgccgctggaggcgaaatcggttctcgactccatggtgaatattgatgcgcagctgaacgagctgaccttcaaagaggcggagatttccaagctctataccaaacgtcacccggcgtaccgcactttgctggagaaacgtcgtaccctggaagaagagaaggcgaagctgaatgaccgcgtaaccgcgatgccgaagacgcagcaggaaattgtacgcctgacgcgtgatgtggaatccggccagcaggtttacatgcagctgctgaacaaacagcaggagctgaaaatcaccgaagccagcaccgtcggcgacgtgcgtatcgttgacccggcgattacccagccgggcgtgctgaagccgaagaaggcgctgattatcctcggcagtattattctcggcctgatgctttccatcgtcggcgtgctgctgcgctcgctgttcaaccgcggtatcgaaagcccgcaggtgctggaagagaacgggatcagcgtgtacgccagcatcccgctctccgagtggcagaagtcccgtgacagcgtcaaaaccgttaagggcgtcaagcgttacaaacagagccagctgctggccgtgggtaacccgactgacctggcgattgaagcggtgcgcagcctgcgtaccagcctccacttcgccatgatgcaggccaaaaacaacgtcctgatgatgaccggcgttagcccatcaatcggtaaaaccttcgtctgcgccaacctggcggcggtggtgagccagacaaacaagcgcgtgctgttgatcgactgcgatatgcgtaagggctacacccatgagctgctggggaccaacaacgttaacggtctgtcggaaatcctgctcggtaaaggggaaatcagcgagagcgccaagccgacgtcgattccgaaatttgacctgatcccgcgtggccaggtgccgccgaacccgtctgaactgctgatgagcgagcgctttacgcagctgattgagtgggcgagcaaaaactatgacctggtgctgatcgataccccaccaattctggcggtcaccgacgctgccgtggtagggcgtcatgcgggcaccacgctgatggtcgcacgctatgcggtgaacaccctgaaggaagttgaaaccagcctgagccgctttgagcagaacggtattgaggtgaagggggtcattctgaactccatcttccgccgcgcgaccgggtatcaggattacggctattacgagtacgaatacaagtctgacagtaaataa

SEQ ID NO: 3361 - DNA, 510 bp, Enterobacter cloacae
cgggcttcgggggaaataatgtttctggaagattgtcgcgctaacagctggagcctgcgcccgtgctgcatggttctggcctaccgttttgcgcacttttgctcggtgtggcgcaaaaaaaatgtgctgaacaatatctgggccgcgccagtgctggtgctgtaccgcatcatcaccgaatgcttttttggctatgaaattcaggccgctgccaccattggccgccgctttaccattcatcacggttatgcggtggtcatcaacaagttcgtcgtcgcgggtgatgatttcaccattcgccacggggtgacgatcggcaaccgcgggccggacagcctggcctgcccggtcatcggcaataacgtcgagctgggcgccaacgtggtgatgatcggggacattaccgtgggtaataacgtgacgattggcgcaggcagcgtggtgctggacagcattccggacaacgcgctggtggtgggcgagaaagcccgcgtgaaggtgataaaatga

SEQ ID NO: 3362 - DNA, 1116 bp, Enterobacter cloacae
  unsure (1113)
ttgccacccacagcgacgccgcgcgggaagtgctggagaaatcgggcggtaaaaccttcagtgaaaacgaggtgctgccgctggtgcagttgtcgaaggccgatatcgcgcaggctgtttttggcacggacctggaatcgttccgcaaccgcagccgcaaagcttacagtggacaacagatgctggaggagtatgtctcgttctatcagaatctgtagttatctgctgctgccgctgatctacctgctggtcaacgtcaagattgcccagctcggcgaaagcttcccgatcactatcgtcaccttcctgccggttctgctgttgctttacgttgacaagcttaacctcaaaaagctgatgattgcgctgggcatcgggtttggtctgacggcgtttaactacatctttggtcagtcgctggacgccagcaaatatgtcacctccaccatgctgtttgtttatatcgttatcattattggcatggtgtggagtattcgctttaaaactatttctccgcacaattataggaaaatcctcaggttcttttatattgtcgtcgggctgattgttgtgcttgcggcaatggagatggcgcaaattattctcacaggcggcagtagcctgatggaaataatttcgaaatatcttatatacagtaacagctatgtactgaacttcattaagtttggtggcaagcgtacaaccgcgctctattttgaaccggcgttttttgctctggcattaatctcaatttggctcagcatcaaacagttcggtatcaaaacccccaagaccgatgctatgattcttgcaggaatcgttctgtcagggtcgttctccggggtaatgacgtttattctgttttacctgctggagtgggcgttccagtacctgaacaaagaggcgattaagaaaaaactgccgctggcgataatctctctgacggtatttttagtgggcgtgatatttgcgtttccgtacatttctgagcgtctgggtgatttgggaacggaagggtcatcgtcctattatcgcatcattggtccactggtgatggtgggttattccttaacccacctagatgtcttcaccacgagccgccggcatccgacntag

SEQ ID NO: 3363 - DNA, 1140 bp, Enterobacter cloacae
tcaatgatgaaatccaaaatgaaattgatgccattattggtgtctgtgaccttgatgagtggttgcacggtctttcccggcagcaatatgtcgacaatgggcaaggatgtgattaaacagcaggatgctgattttgatctcgacaaaatggtgaatgtgtatccattaaccccacgtctggtggaacaattacgcccacgtccaaatgttgctcagccaaatatgtctctggaccaggaaattgcctcttaccagtatcgcgtgggtccgggtgatgtcattaacgtgaccgtctgggatcacccggagctgaccacgcctgcgggccagtaccgcagctcaagcgacaccggtaactgggtacagtccgatggcaccatgttctatccctacattggcaaagtgcacgtcgcgggcaaaacgcttgctgagatccgtagtgatattaccggccgcctggcgcagtacattgctgacccgcaggtggacgttaatatcgccgcgttccgatcccagaaagcctatatctctggccaggtcaataaatccggccagcaggctattactaacgtcccgctcaccgttcttgatgcgatcaatgccgcaggcggcttaaccgacggcgctgactggcgcaacgtggtgctaacccacaacggcaaagagcagcgcatttcgcttcaggcgctgatgcaaaacggtgacctgacccagaaccgcctcctctatccgggcgacattctgtacgtgccgcgcaatgacgatctgaaagtgttcgtgatgggtgaagtgaagaaacagagcaccctcaagatggacttcagcggtatgaccctgaccgaagcgctgggcaatgcggaaggcatcgacctgaccgcctccaacgccagcggtatcttcgtgatccgtcctatcaaaggcgagaacgcgaagggcaagattgccaacatctaccagctggatatgtccgacgcgacgtcgctggtcatggcaacgtcgttccgtctccagccgtacgatgtggtctatgtcaccaccgcgccggtcgcccgctggaaccgtctgatcaaccagttgctgcctaccatcagtggcgttcgctacatgacggatacggcgagcgacgttcataactggtaa

SEQ ID NO: 3364 - DNA, 450 bp, Enterobacter cloacae
gccgcgatgtttaacaaaattctggtggtgtgcgtggggaacatttgccgttcccccacggctgaaaggctgttgaaaaattaccagcctgcgttaacggtcgactccgcagggctgggcgcgctggtcggaaaaggtgccgacgaacgtgccgcaagcgttgcccttgagcataacctctcactcgacgggcacgttgcccgtcaggtctctggccggatgtgccgggaatatgacctgatcctcgcgatggaaaaacgccacattcacgcgctgtgcgatatcgcaccggagatgcgcggcaaggtgatgctgtttggtcactgggatggtgagcgcgaaattcccgatccgtatcgcaagagccgcgaggcctttgaggcggtatacaccttactagaccagtctgcccgtcagtgggcgcaggcactgaaagctcagcagggataa

SEQ ID NO: 3365 - DNA, 852 bp, Enterobacter cloacae
ggggaaaatatgaccacacaacgccctttgatttctatctatatgccgacatggaatcgtcagcagctggcgatccgcgcgattaaatcggtcctgcgtcaggattacgataactgggaactgattatcgtggatgactgttcctcctcttacgaacaactgcaaaagtttgtagaagacctgaacgacccacgcgtgatgtacacgcacaacgctatcaactccggggcgtgtgcggtgcgcaaccaggcgattatgcaggcgaaagggcagtatctgaccggtatcgacgacgatgacgaatggacgccaaaccgtctgtcgatcttcctgtcgcacaaagcgcagctggtgacccacgcgtttctgtatgccaatgactatgtctgccagggcgaggtctattcgcagccggccagcctgccgctgtatccgaaatcaccgtattcccgacgcctgttctacaagcgcaacattatcggcaatcaggtgtttacctgggcatggcgctttaaggagtgcctgttcgataccgagctgaaggccgcgcaggattacgacattttcctgcggatggtggtggagtacggcgagccgtggaaggtggaagaggccacgcagatcctgcacatcaatcacggggagatgcaaatcacctcgtcgccgaagaaattctcgggctacttccatttttaccgcaagcacaaggacaagtttgaccgtgccagccggaagtatcagctcttcaccctgtatcagatccgtaacaagcgcatgaactggcgcacgttgctgacgttgctgtcggtacgtaacggcaagcgtctggctgacgggcttcgggggaaataa

SEQ ID NO: 3366 - DNA, 1020 bp, Enterobacter cloacae
tcgaatccaataaacacaataaatccccatgccggtgagaaggggcgagactttagcgaaatgtctgccaggcgacaacaggaatatgaaagcaaggcgcaacgcgatctttcggtttatgctgaggtaaatacaaaaggagagacaatgtacaccctgaactggcaaccgccttacgactggtcgtggatgtttggctttcttgccgcgcgtgcggtcacgggggttgagaccgttacgaaggattactacgagcgcagttttggctatgccgggcaccagggcgttttccgggttacgccagacagcgcaacccatacgcttgcggtgtcgctcagccctggcctgatcccggtggcggatatctgcctggaccgcatcgcccgcctttttgacctcgattgcgacccgcagcacattgcacagaccctcggcgatctcggcgcggcgcggccggggttacgtttgcccggcgcaatggatgcttacgagcagggcgtgcgcgccattcttggacaactggtaagcgtggcgatggcggctaaactggcgtcacgggtggtggcgctgtgcggtgaacccatccaggacgcgccgggctacctctgctttcctccgccagaggtactggccgcggtggatccgctggcgttgaaagccctcgggatgccgctcaagcgtgcggagtcgttgattcatctggcgcagtcggtggtggacggtgaattcccgctgttcccgcccgcgaacgttgaggacgggatgaaggcgctacagcagcgccccggcatcgggcgctggaccgcgaattatctggccctgcgcggctggcaggcgaaggatgttttcctgccggatgattatctgattaaacagcgctttgccggtatgacgcccgcgcagatccgtcgctacgccgagcgctggcagccgtggcgatcgtatgcgctgttacatatttggtacaccgacggctggtcgccgtcagttgatggcgaaatagctggtattaagcagtag

SEQ ID NO: 3367 - DNA, 534 bp, Enterobacter cloacae
cagccgctccacttcgccctgtttgttcagtacccggttcgccagcgaacgaatgtggcggatgccatccttgacgcgaatgcgaaattccagcttgaaaggcaccctggcctgaagggattctcgcagcacctgttcggcgtgggtgcgatcttcaggcaccatggccgcatgccagagctgccaggtgggtttaatgtgcgtggggatctcgtacagctcaaacatccgcttatcccagctgatcacgtccggctcgagatcccactcccatatcccgatgccaccggcttcgttcgcgagggtgatacgctccatcaggcgcttattgacccactcggtctgtttcaggtcgttgatatcttcaatctgggcaataaagtagagcggggtgccgtcggcatggcgcacaacggagacggccagcagcgcccacaccaccgcgccgctgcgagtgtagtagcgtttttcgaggctgtagctattgatctccccgttaatcagctgtcccaactgctccaggtcggtatttaa

SEQ ID NO: 3368 - DNA, 693 bp, Enterobacter cloacae
cgctccggcgtcgtccttccttacatccaggttaatcaggtcgctaaatttatgactgataagtctcatcagtgcgtcatcataggcatcgccggcgcatcggcttcaggtaaaagtcttattgccagtacgctttatcgcgaactacgtgaacaagtgggtgatgagcatatcggtgttattcccgaagatagctattacaaagatcaatcccatctttcgatggaagagcgcgtaaaaaccaactacgaccaccccagtgcgatggatcacagcctgctgttccagcatctggaagcgctaaagcgcggcgaggcaattgagctgcccgtctacagctacgtggaacatacccgcacccaggaaacgatccgtatcgagcccaagaaggtgattatccttgaagggattttgctgctcaccgacgcccgtctgcgcgaatcaatgaacttctcgattttcgtcgacaccccgctggatatctgcctgatgcggcgtatcaaacgcgacgttaacgaacgcggccgctccatggactcggtgatggcgcaatatcagaaaaccgttcgcccgatgttcctgcaatttattgagccttcgaaacaatacgccgatattatcgtgcctcgtggcggtaaaaaccgtattgccattgatatcttaaaagcgaaaatcagtcagttttttgaataa

SEQ ID NO: 3369 - DNA, 1881 bp, Enterobacter cloacae
agactgatctgtgagttcactgaggaagccatgagaagagttctgacaacgctgatgattttgctggtggtgctggtggctggcctttcagcgttggtgctgctggttaacccgaatgacttccgggcctacatggtgcggcaggtggaagcgcgcagcgggtatgaactcaagctggacgggcccctgcgctggcacgtctggccgcagctcagcattctctccggacgtatgtcgctcaccgcgccgggcgccgcgcagccgctggtgacggcggataacatgcgtcttgatgttgcgctcatcccgctcttatcccatcagctccaggttgaacaggtgatgctgaaaggggcggtgattcagcttacgccgcaaaccgaagccgttcgtcaggcggatgcgccggtcgcaccgcgtgaaaacaccttgcctgacgtcccctctgataccggctggtcgttcgatattggtaatctgaaagttgctgacagcgtgctggttttccagcatgaggatgacgaacagatcaccgtacgcaatatcaatctcaggatggagcaggacgccaatcatcacgccaccatggagttctccgggcggatcaaccgcaatcagcgcgatctcaacctgtcgatgaacgcaaacgtgaacgcttctgactatccgcaccagctgacggcggacgttcagcagctcaactggcagctgaccggcgcggatttacccgcgaaggggattgccggccaaggcacgatgcaggcggtgtggcatgaagagcgcaaacagctcgaactgaacgcgctcaacctccaggccaacgacagttccctgaaggggcaggcgagcgtcacgcttgatgagaaacctaagtgggtgctggatctgcaattcgacaagctgaatctcgagaacttgcttccgctccaaccggtgaacgcgaccgatgagggagccacgcaggtagggcaaagccaggccacgcagtcgcgtccggtgatctcctcaaatctcgatctgcctgactacaacggcctgcgcggatttaccgccgacattctgctgaaagcgaacagcgtgcgctggcgtggaattgattttaccgacgtcagcagccagatgttcaaccacaacggcctgctggtcatctccgagctcagcggaaaaatgggagcagggaacctctcgctgccgggcacgctggatgtacgcaaagacgttgccagcgccgcgttccagccgcgtctggaaaacgttgaaattggcaccatcctgaaagcctttaattacccaattgccctcacggggcagctgtcgctggcaggggatttctctggcacgaagattgatgcggatgccttccgtcgtagctggcaggggcaggcgcacgttgagctgaaagatacgcgcatggaagggctgaacttccagcagctggtgcagcaggcggtagagcgcagcagcagcgtgaaagcgaatgaaaactacgacagcgcaacccgtctcgacagctttaccagtgagcttgccctcgacgacggtcagctctcgctggacgacatgcagggcacttcgtcactgctggcgctgaccggaaccggcgcgctggatctggtgaaagagacggcagacacccgcttcaacgtccgcgtgaaggctggctgggaaggcgaaggccagcttgtagagttcctgaaagagacgccgataccgctgcgcgtttatggaaaatggcaggcgctgaattacagtttgcaggtcgatcagatcctgcgtaagcaccttcaggatgaagcgaaacgtcggctgaatgactgggcggaccgcaataaagagtctcagtcaggtaaggacgtgaaaaaactgctcgataagctgtga

SEQ ID NO: 3370 - DNA, 1308 bp, Enterobacter cloacae
cgtgacgattggcgcaggcagcgtggtgctggacagcattccggacaacgcgctggtggtgggcgagaaagcccgcgtgaaggtgataaaatgaacattctgcaatttaacgtacgcctcgcagagggcggggcggcaggcgtagcgctggatctgcaccagcgcgcgctgcaaaaaggattacagtcgcgcttcgtttacggttacggcaaaggtggcaagaaaagcgtcagccatgataactatccgcaggtgctgaagcagacgccacgtctgacctccatcgccaatatcgcgctgttccgcctgtttaaccgcgacctgttcggcaacctgaataatctctaccgcaccgtcacccgcactcgcggcccggttgtgctgcactttcacgtgttgcacagctactggctgaatctggaagaggtggtggcgttttgtggcaaggtgaaggcgcataagccggatacccgattcgtctggacgctgcacgaccactggagcgtgaccggacgctgcgcctttaccgacggctgcgaaggctggaaagataactgtcagaaatgccctacgctcagcaactacccgccggtgaagatcgatcgcgcgcatcagctggttgagggtaagcgtcagttgttccgcgatatgctctcgctcggctgcacctttatctccccaagccagcacgtggcggatgcttttaatagcctgtacggagcagggcgctgccagatcatcaacaacggtattgatgtggcgacggaagcgatcctggccgaactgacgcccgtagccgttaccgccggtaagccgaaaattgcggtcgtcgcccatgacctgcgttacgacggcaaaaccaaccagcagctggtgcgcgacatgatggcgctcggcgataagattgagctgcatacctttggcaaattctccccgttcgaaggcgctaacgtggtgaaccacgggtttgaaaccgacaagcgcaaattgatgagcgcgctgaacggtatggacgcgttggtgttcagctcccgcgtggacaactacccgctgatcctgtgcgaagcgctctccatcggcgtgccggtgattgccacccacagcgacgccgcgcgggaagtgctggagaaatcgggcggtaaaaccttcagtgaaaacgaggtgctgccgctggtgcagttgtcgaaggccgatatcgcgcaggctgtttttggcacggacctggaatcgttccgcaaccgcagccgcaaagcttacagtggacaacagatgctggaggagtatgtctcgttctatcagaatctgtag

SEQ ID NO: 3371 - DNA, 1449 bp, Enterobacter cloacae
cacgaccaaaaacgtcgtgatccgacgcggcaaaaggagtgcaccatgaaattctggcgtccggggatcaccggtaagctttttgtggcgattttcgccacctgtatcgtcctgctgattactatgcactgggcggtgcgggtcagctttgagcgcggctttattgactacatcaagcacggtaacgaacagcgtttacagggcttaagcgacgcgctgggggaacagtatagcctgcacggtaactggcgttttctgcgcaacaacgatcgctttatatttcaaattctgcgctcgctggagcacgataatgacgacgaccgtccgggaccgggcatgccaccgcacggctggcgcacccagttctgggtaattgatcaggagatgcgcgtgctcgttggcccacgctctccggtaccgccggacggcacaaagcgcgccattacctcgaacggcgccacggtgggctgggttatcgcctccccggtcgagcggctgacgcgcaacaccgacatcaactttgaccgccagcagcgtcagaccagctggttgattgtcgcgctttctaccctgcttgcggcgctcgccaccttcccgctggcgcgcggcctgctggcgccggttaagcgcctggtggaaggcacgcacaagctggcggcgggtgatttctcgacccgcgtggacacccgcagccaggatgaactgggcaagctggcgcaggacttcaaccagctcgccagcacgctggaaaaaaaccagcagatgcgccgcgattttatggccgacatttcgcacgagctgcgcaccccgctggcggtgctgcgcggcgagctggaggcgattcaggacggcgtgcggcagttcacccccgagtcggtggcctcgcttcaggcggaagtcggtacgctgaccaaactggtggacgatctgcatcagctttccatgtccgacgaaggcgccctggcttaccagaaagcaccgatcgatgtgatcaatatccttgaagtcgtgaccggcgcattccgcgagcgcttcgccagccgtgacctgaaaatcaacctttcgctgccggacagtgcggtggtgttcggcgacagagatcgcctgatgcagctgttcaataatctgctggagaatagcctccgctacaccgacggcggcggcgcgctgcatatctccggcaggcaggaaaacgggcgctttgccctgacctttgcggactccgcccctggcgtgaaggatgcgcagctggaaaaactgttcgagcgcttctatcgcaccgaaggttcacgcaaccgcgccagcggcggttccggccttgggctggccatttgcgttaacattgtggaggcccatggcggcaccatccgcgccgcccattcgccttttggcggggttagcattacagtagagttacctctggaacgggatttatcgagggaagcatga

SEQ ID NO: 3372 - DNA, 3417 bp, Enterobacter cloacae
aatgtttgtactagcataaaccaaattattaatttcacgcgtccggacctggctcctgacaacatggcgtccctggatagagcggtaatgaataaacaataccagcgggttttggttactaccccacatcctttactgcggcttgtctgtctgggtctggtcacgttcatcttcaccttattttccctcgagctgactcgcttcggtacgctgctggcgccattgtggttcccgacttcaataatgatggtagcgttttaccgccacgcgggaaaaatgtggcccggcattgccctcgcctgctcttttggcaatatctttgcctcgtggatgctcttctcatgggaatcgctcaacatcacctacacggcgatcaatatcattgaggccacggttggcgcgctgttactgcgtaaactgctcccctggtataatccgctgcaaaacctcaacgactgggtccggcttgccctcggcagtgcccttgtgccgccgctggtggggggcgttctggttcattttctggtgccgagcgcggagccgctgcgtaatttccttgtctgggtactttcagaggccattggcgcgctggcgctagtgcctttaggtctgctgtttaaaccgcattacctgctgcgccaccgcaatccgaaactgctgctggaaacgctggtgaccctggtcgttacgctggttctttgctggacggcaatcacctggctgccgtggccattcacctgcatcatcgttctgctgatgtggagcgcggttcgtctgccgcgtatggaagcgttcctgatatttttattcaccatcatgatggtgtccctgatgatggcgcgaaatccgctctccatgacgccctcctccatgatcgtcaccttcaacgcgccgtggctccccttcctgatgatgctgctccccgccaatattatgacgatggtgatgtatgccttccgggccgagcgtaaacatattacggaaagcgaagaacgttttcgtaatgcgatggaatattccgcgattggtatggcgctggtgggcattgagggccagtggctccaggccaacaaggcgctgtgcaatttcctcggttacagccagtctgaactccagtcgctcacgtttcagcagttaacctggccagaagatttaaataccgacctggagcagttgggacagctgattaacggggagatcaatagctacagcctcgaaaaacgctactacactcgcagcggcgcggtggtgtgggcgctgctggccgtctccgttgtgcgccatgccgacggcaccccgctctactttattgcccagattgaagatatcaacgacctgaaacagaccgagtgggtcaataagcgcctgatggagcgtatcaccctcgcgaacgaagccggtggcatcgggatatgggagtgggatctcgagccggacgtgatcagctgggataagcggatgtttgagctgtacgagatccccacgcacattaaacccacctggcagctctggcatgcggccatggtgcctgaagatcgcacccacgccgaacaggtgctgcgagaatcccttcaggccagggtgcctttcaagctggaatttcgcattcgcgtcaaggatggcatccgccacattcgttcgctggcgaaccgggtactgaacaaacagggcgaagtggagcggctgttagggatcaacatggatatgaccgaggtgaagcagctgaacgaggcgctgttccaggaaaaagagcgcctgcatatcaccctcgactccatcggcgaagcgttgctgtgcaccgatatcgacatgaacatcacctttatgaacccggtcgccgagaagatgagcggctggtcgcaaagcgaagcgctgggtcagcccgttctgaaggtgctgcacattaccttcggcgagaacggtccgttaatggaaaacatccacagcggcgatatgtcccgtaccgatatcgaacaggacgtggtgcttaactgccgcaatggcggcagtttcgacattcattacagcattacccccctcagcactctggaaggtaacaccatcggctcggtgctggtgattcaggacgtgaccgagtcgcgcaaaatgctgcgccagctgagttacagcgcctcacatgacgccctgacccacctggcgaaccgcgtcagctttgaaaaccatctgaagcgtctgttgcagacagtacaggagacccatcagcatcacgcgctggtctttatcgatcttgaccgttttaaggcggtgaacgatacggcaggccacgcggcgggcgacgctctcctgcgcgaactctcttcgctgatgctgaccatgctgcgctccagcgacgtgctggcgcgtctgggcggcgacgagtttggtctgctgctgccggactgcaacgtcgaaagcgcacgctacattgcgggccggttgatcgacgccatcaacaactatcatttttcctgggaaggacgcctgcaccgcattggtgccagtgcggggattacgctgattgacgacaccaattatcaggctgcggaagtgatgtctcaggccgatatcgcctgctacgcctcgaaaaacagcgggcgcggcgtggtcaccgtctacgaaccccagcaggagaggatccacagcacgcgcagcatgatgtcgctggatgagcagtggcacatgattaaagataaccatctgctgatgatcgcccgcagcgtcgcctcgccgcgcattcccgagagcagtagcttctggctgatttccttgcggctgtggaccagccagggggaagtgctggaagagcatgccttccgcgccgggctggcggagccggagctgctgcacgccctggaccgacgtatcttcagcgaatttttccgtacctatgccgcacaggtggcggccaaaggaatgggcgtcgcgctgccgctctcagaagcgggtttagccagcgtcacgctggtggatgagctgctcgacctcattaccaaaggtccgctgccggcgcggctgctgcatctggcgatcgccgctgatgtgctgagcaatacggatgaaaacgtgcagcagggtctgcaaaagcttcgtcaggctggctgtcgcgtggtgctgacgcgggttggacgcgatatgaacgtcttcagccagctcagcgccaacaccgctgattatctgctgctggatgcagacgtggtgacaaacgtccacggcaatctgatggacgagatgatggtcaccatcattcagggccatgcccagcgtctgggcataaaaaccattgccgggccatgccatcagtcaattatgatgaatacgctgtcgggcatcggcgttgactttatctacggcgacaccattggggaagcgcagccgctcgatctactgcttaataccagctatttcgccatcaactga

SEQ ID NO: 3373 - DNA, 3186 bp, Enterobacter cloacae
ccggctgaccgaaggggcgcaggtcgaggtggtggaagcgcagaatacaggagcaaaagcctgatgcaggtgatgccgccgagctctacaggtgggccatcacgcctgtttattttacgaccggttgcgacgaccctgttgatggtggcgatcctgctggccgggatcattggctaccgttttctgcccgtgtcggcgctgccggaagtggactacccgactattcaggttgtcaccctctatccgggcgccagtccagatgtggtgacgtccgccatcaccgccccgctggagcgtcagtttggccagatgtctggcctgaagcagatgtcctcccagagctcgggcggtgcctcggtcgtcacgcttcagttccagctcgcactgtcgctggacgtcgctgaacaggaggtgcaggccgccattaacgccgccaccaacctgctgccgtctgacctgccgaacccgccggtttacagcaaggtgaacccggcagacccgccgatcatgacgcttgccgtcacctcctccgccatgccgatgacgcaggtggaagacatggtcgaaacccgcgtggcgcagaagatttcgcaggtgacaggcgtcgggctggtgacgctcgcagggggacaacgccccgcggtgcgcgttaagctcaatgcccaggccattgccgcgctggggttaaccagcgaaaccattcgcaccgccatcagcagcgccaacgttaactcagcgaagggctcgctggacggcccgacccgcgcggtcacgctctccgccaacgaccagatgcagtccgccgatgaataccgtcagctgattattgcctaccagaacggcgcaccgatccgcctgggcgacgtggcaaccgtcgaacaaggcgcggaaaacagctggctcggggcgtgggctaataagcagcaggcgattgtcatgaacgttcagcgccagccgggcgcgaacattattgataccgccgacagcattcgcaccatgctgccgcagctggtggaaagcctgccaaaatcggtcagcgtgaaagtgctctctgaccgcaccacgaatattcgcgcgtcagtgaccgacacccagttcgagctgatgctggcgattgcgctggtggtgatgatcatctacctgttcctgcgcaacgttccggcaaccattattcccgccgttgccgtgccgctctcgctggtcgggacgttcgcggtaatggtatttctcgacttctcgattaacaacctgacgctgatggcgctcaccatcgccaccgggtttgtggtggacgacgccatcgtggtaatcgaaaacatctcgcgctatatcgagaaaggtgaaaagccgttagccgccgcgctgaagggcgcgggggagatcggctttaccattatttcgctcaccttctcgctgattgcggtgctgatcccgctgctgtttatgggcgatatcgtcgggcggctgttccgcgagtttgccgtgacgctggcggtcgccattctgatctctgccgtggtgtcgctgacgctgacgccgatgatgtgcgcccgcatgctgagccacgaatctttgcgcaagcaaaaccgcttctccctcgcctccgagcggatgttcgagcgcattattgccgcctacggccgcgtgctggcgaaagtcctgaaccatccctgggcgacgctcggcgtggccctcggcacgctggcgctcagcgtcatgctgtggattttcattccgaaaggcttcttcccgattcaggacaacggcattattcagggcacgcttcaggcgccacagacggtctccttcgccaacatggcgcagcgccagcagcaggtgtctgagatcatcatgaaagatccggcggtggaaagcctgactgcctacgtgggcgtggacggcaccaacccgtcgcttaacagcgcgcgcctgcaaattaaccttaaaccgctcgatgaccgtgacgatcgcgtcaacgcggttattgagcgtctgcaaagcgctgtggcgcgcgtaccgggcattgagctgtatctgcaaccgatccaggatttaaccattgatacgcaggtgagccgcacgcagtaccagtttacgctccaggccacctcgcttgatgcactcagcacctgggtgccgcagctggtggacaagctgaaagcactgccgcagatttctgacgtcagcagcgactggcaggataaagggctggcggcgtacgtgaacgtcaaccgcgacaccgccagccgtctgggcattaccatgtccgacgtggataacgcgctgtataacgcctttggccagcgccttatctccaccatttacacccaagcgaaccagtatcgcgtggtgctggaacataacaccgagaacacgcccgggcttgccgcgctggactcgatacgcctgaccagcaaagacggcgggattgtgccgctcagcgccattgccagcgtggaagagcgtcacaccccgctgtcgattaaccatctcgatcagttcccatccaccaccatttcgttcaacgtgccggacggttattccctgggcgaagcggtggaggccattctgggtgcggagaaagaactcagcttcccgtccgatattcagacccagttccagggcagtactctggcgttccaggccgcgctgggcagcaccgtctggctgattgtcgcggcggtggtggcgatgtatatcgtgcttggcgtgctgtatgaaagctttatccacccgatcaccattctctccaccctgccgacggcgggcgtgggggcactgctggcgctgatgctggcggggagcgaactggacgtgattgcgatcattggcatcattctgcttatcggcatcgtgaagaaaaacgccatcatgatgatcgactttgcgctggccgccgagcgcgagcagggtatggcgccgcgcgaggccatttaccaggcctgtctgctgcgttttcgcccgatcctgatgaccaccctcgccgccctgctgggcgcgctgccgctgatgctgagcaccggcgtgggggccgaactgcgccgtccgctgggcatcgggatggtcggcggcctgctcgtaagccaggtgctgacgctgtttaccacgccggttatctacctgctgtttgaccgtctggccctgtggacgaaaagccgcttcccgaaacgtgaagaggaggcgtaa

SEQ ID NO: 3374 - DNA, 3078 bp, Enterobacter cloacae
gtgaagtttttcgccctcttcatttaccgtccggtggcgacgattttactctccgtcgctattaccctgtgcggcgtgctgggcttccggctgctgccggtggccccgctgccgcaggtcgatttcccggtgatcatggtcagcgcctcgctgccgggtgcctcgccggaaaccatggcctcatcggtggcgacgccgcttgagcgctcgcttggtcgaattgccggggttaacgagatgacctccagcagttcgctgggcagcacgcgcatcattctggaattcaatttcgaccgggacatcaacggcgcggcgcgtgacgtgcaggccgcgattaacgccgcccaaagcctgctgccgagcggcatgccgagccgtccaacctatcgcaaggccaacccctccgacgcgccgatcatgatcctgacgcttacgtcagagacctactcccagggcgagctgtacgattttgcctccacccagctggcgcaaaccatcgcccagattgacggcgtgggcgacgtggacgtcggcggcagctccctgcccgccgtgcgcgtggggctgaatccgcaggcgctgtttaaccagggcgtgtcgctggacgacgtgcgttccgccatcagcaacgccaacgtgcgtaagccgcagggcgcgattgaggacaacagccaccgctggcagatccagactaacgacgagctgaaaaccgccgccgagtatcagccgttgattattcactacaacaacggcgcggcggtgcgcctgagcgacgtcgccagcgtcaccgattcggtgcaggacgtgcgtaacgccgggatgaccaacgccaaaccggcgattttgctgatgatccgcaagctgccggaagccaacatcattcagacggtgaacagcatccgcgcgcgcctgccggagcttcaggaaacgattccggcggctatcgatctccagattgcgcaggaccgctcccccaccatccgcgcctcgcttgaggaggtagagcaaacgctgatcatctccgtcgcgctggtgatcctggtggtgttcctgttcctgcgctcggggcgcgcgacgctgatcccggcggtggcggtgccagtatcgctgataggcacctttgccgccatgtacctgtgcggctttagccttaacaacctgtcgctgatggcgctgacgattgccaccgggtttgtggtggatgacgccatcgtggtgctggagaatatctcgcgccatctggaagcgggcatgaagccgctccaggcggcgcttcaggggacgcgcgaagtgggcttcacggtcctgtccatgagcctgtcgctggtagcggtattcctgccactgctgctgatgggcggcctgccggggcgactgctgcgcgaatttgccgtcacgctttccgtcgccattggtatctcactggtgatttcgctgacgctgacgccgatgatgtgcggctggatgctaaagcgcagccaaccgcactcgcagccgcgcaggaaaggctttggccgcgtcctgatggcgatgcagtccggctacggcaaatcgctgaaatgggtgctgaaccacacgcgtattgtcgggctggtgctgatcggcaccatcgtcctcaacgtctggatgtatatcaccatcccgaaaacctttttcccggagcaggataccggcgtgctgatgggcggtattcaggcggaccagagcatttcgttccaggcgatgcgcggcaaactgcaagactttatgaaaatcatccgggaagatccggccgtggataacgtcaccggctttaccggcggctcgcgcgttaacagcgggatgatgtttattacccttaagccgcgcggtgaacgtcacgaaacggcgcagcagatcattgaccgcctgcggctgaagcttgccaaagagccgggggcaaatctgtttttgatggccgttcaggatatccgcgtcggcggacgacaggctaacgccagctatcagtacaccctgctctcggatgacttagccgccctgcgcgagtgggagccgaagatccgtaaagcgctggccgcgctgccgcagctggcggacgtgaactctgacagccaaaacaacggtgcggagatggcgctcacctacgatcgtgaaaccatggcccgcctgggcattaacgtggaggcggccaacagcctgctgaacaacgccttcgggcagcgtgaagtctctaccatctatcagccgatgaaccagtacaaggtggtgatggaggtggatccgcgctacacccaggacatcagcgcgctggacaagatgtttgtgatcaatgatgacggtaaggcgattccgctgtcgtacttcgccagctggcagccgtcgaacgccccgctgtcggtgaaccaccaggggctttccgccgcctcgaccgtctcgtttaacctgccaaccggctcgtcgctgtctgaggccagcgatgccattaatcgcgccatgacccagctcggggtgccctcctcggtgcgcggcagctttgccggtacggcgcaggtgttccaggacaccatgaactcgcaggttattttgattctggcggccattgccacggtttatatcgtgctgggcgtgctgtacgaaagctacgtgcacccgttgaccattctctccacgcttccctctgcgggcgtgggggcgctgctggcgctggagctgttcggtgccccattcagtcttatcgcgcttatcgggatcatgctattgattggcatcgtgaagaaaaacgcgataatgatggtcgactttgccctggacgcccagcgcaacggcaacctgacgccggacgaggcgatattccaggcctgtctgctgcgttttcgcccgatcatgatgaccacgctggccgcgctgttcggcgcgctgccgctggtcatatccggcggtgacggctctgaactacgccagccgctggggatcacgatcgttggcggcctggtgatgagccagctgctgacgctctacacgacgccggtagtctatctgttctttgaccgcctgcggctgcgtttttcgcgtaaaaagagaaccacggtgaccgagtaa

SEQ ID NO: 3375 - DNA, 1416 bp, Enterobacter cloacae
atgaccgacctacccagtaacgttcgctggcaattgtggatcgtcgcgttcggcttctttatgcagtcgctggacacgactatcgtgaacaccgccctcccctcgatggcgaaaagcctgggggagagcccgctgcacatgcatatggtgattgtcgcctacgtgctgacggtcgccgtgatgctgcctgccagcggctggctggcggataaagtcggcgtgcgaaacatcttcttcaccgccattgtgctgtttaccaccgggtcgctgttttgcgcccaggccaataccctcgaccagctggtgatggcgcgcgtgctacagggcgtcggcggcgcgatgatggtacccgtcgggcggttaacggtgatgaaaattgttccgcgcgcgcagtatatggcggcgatgaccttcgtcaccctgcccggtcaggtcggcccgctgcttggcccggcgctgggcgggattctggtggagtatgcctcctggcactggatcttcctgatcaacctgccggtcggtattatcggcgcgattgccaccctgacgctgatgccgaactataaaatgcagacccggcgctttgatttctttggcttcatcctgctggcagctggcatggcgacgcttaccctcgcgctcgacgggcaaaaagggctggggatctcctccctgtcgctcgccctgctggtagcgctgggtgtcaccgccattctctggtatctgtggcatgccagaggtaacgctaacgcgctgttcagcctaaatctgttcaagaatcccacctaccgtcttggtctgttcggcagctttgccggacgcatcggcagcggcatgttgccgtttatgacgccggtatttttacagattgggatgggcttctcgccgttccatgccgggctgatgatgatcccgatggtacttggcagcatggggatgaagcgtattgtggtgcaggtggtgaaccgctttggctatcgccgcgtgctggtggccgccacgatcgggctggcgttggtctgcctgctgtttatggccgtggcgctgctgggctggtactacatcctgccgctggtgctgttctgccaggggatcatcaactccatgcgattctcgtcgatgaacaccctgacgctgaaagatctgccggacgagctggcaagcagtggtaacagtctgctgtcgatgatcatgcagctctccatgagcgtgggggtcacggtcgccggattgctgctcggcatgtacggtcagcaccatctcagcgccgacacccccgtcgcgcatcaggtctttttatacacttacctcagcatggcggtaattatcgctctgcccgcttttatctttgccagagtgccgaatgacacgaccaaaaacgtcgtgatccgacgcggcaaaaggagtgcaccatga

SEQ ID NO: 3376 - DNA, 357 bp, Enterobacter cloacae
ttgtcgcgctttctaccctgcttgcggcgctcgccaccttcccgctggcgcgcggcctgctggcgccggttaagcgcctggtggaaggcacgcacaagctggcggcgggtgatttctcgacccgcgtggacacccgcagccaggatgaactgggcaagctggcgcaggacttcaaccagctcgccagcacgctggaaaaaaaccagcagatgcgccgcgattttatggccgacatttcgcacgagctgcgcaccccgctggcggtgctgcgcggcgagctggaggcgattcaggacggcgtgcggcagttcacccccgagtcggtggcctcgcttcaggcggaagtcggtacgctga

SEQ ID NO: 3377 - DNA, 1386 bp, Enterobacter cloacae
cctgtcatcagaacgagaacaaacatgtttaaaccggaactcctttccccggcgggaacgctgcaaaatatgcgttacgctttcgcctatggcgccgacgccgtctacgcgggccagccgcgctactcgctgcgcgtgcgtaacaacgaattcaaccacgagaatcttcagctcggcatcaatgaagcgcatgccctgggcaaaaaattctacgtggtggtgaacatcgcgccgcacaacgccaagctgaaaacattcattcgtgacctgaagccggtcgtggagatggggccggacgcgctgatcatgtcggacccgggtttaatcatgctggttcgggagaatttcccggagatggacattcacctctcagtgcaggctaacgccgtcaactgggcaacggtgaaattctggaaacagatggggctgacccgcgtcattctgtcccgcgagctgtccctcgaagagatcgaagagatccgcacccaggtgccggatatggagatcgaaatcttcgttcatggcgcgctgtgcatggcctactccggccgctgcctgctctctggctatatcaacaagcgtgacccgaaccagggcacctgcaccaacgcctgccgctgggaatataacgttcaggaaggcaaagaggatgacatcggtaacatcgtgcataaacacgagccgatcccggtcaccaacgttgagccaacgctgggtatcggcgcgcctaccgacagcgtgtttatgatcgaagaagccaaacgtccgggtgagtacatgaccgccttcgaagacgagcacggcacctacatcatgaactctaaagatctgcgcgccatcgcgcacgtcgagcgtttaaccaagatgggcgtacactccctgaaaattgaaggccgcaccaagtcttactactactgcgcccgtaccgcacaggtatatcgcaaagccatcgacgatgccgctgccggtaaaccgttcgacaccagcctgctggaaacgctggaaggtctggcgcatcgcggctataccgaaggtttcctgcgtcgtcacactcacgacgactaccagaactacgagcatggctattcgatttccgaacgccagcagtttgtaggcgacttcaccggcgagcgtaaaggcccgctggccgccgtcgccgtaaaaaacaaattcactaaaggcgacagcctggagctgatgacgccgcagggcaacatgaacttccgactggagcacctggaaaacaaaaaaggtgaggcgattgaggtcgcacctggcgacggccatgtggtctggctgccggttcctgaagaggtggagctggagtttgcgctgctgatgcgtaattttgaaggtgaaaatacccgaaatccacacggcaaatag

SEQ ID NO: 3378 - DNA, 1629 bp, Enterobacter cloacae
tcgaagtgtgacattagtcatataacagaaggtattgcatttactatggaatggattgccgatccatcaatctgggccgggctggtgacgctggtcgtcatcgaattagtgctcggcattgataacctggtgtttatcgccatccttgccgataaattacccccttcacaacgcgaccgcgcccgcgtgacgggtcttctgctcgccatggtgatgcgtctgctgttactggcctcaatctcgtggctggtgacgctgaccaaacccttattcagcgtgcagggtctgagctttagcgcccgcgacctgatcatgcttttcggcggattgttcctgctgttcaaagccacggttgagcttaatgagcggctggaaggtaaagacagtgaaaaccccacccagcgacgcggcgctaaattctggccggtggtcgcacagatagtggtgctggatgccgtcttttctctcgactccgtgatcacggccgtcgggatggttgaccatctggcggtgatgatggccgccgtgatcatcgccatcaccctgatggtgctcgccagtaaagccctgacgcgcttcgtgaacagtcacccgactatcgtcatcctctgtctgagcttcctgctgatgattggctttagcctggtagcggatggttttggcttccatatcccgaaagggtatctgtacgccgccattggtttctcggtgctgattgaatttctcaaccaactggccattttcaaccgtcgccgttttctctccgcgaaccagacattacgtcagcgcaccgcagatacggtgatgcgcctgctgagcggcaaaaaagaggatgccgagctggatgctgaatccgcggcgatgcttgccgaccacagcgacgggcagatcttcaacccgcaggaacgccggatgatagagcgcgtgcttaacctcaaccagcgcacagtgagcagtatcatgacctcccgccatgacattgagcatattgacctgacggcgccggaagagcagatccgtgccctgctggataaaaaccagcacacccgcgtggtcgtgaccggcggtgaagaggaagaagagctgctgggcgtggtacacgtgattgacctgctgcaacagcagcttcacggcgagccgctcaacctgcgcgcgctggtgcgccagccgctggtcttcccggaagcgctgccgctgctctccgcgctggagcagttccgcaacgcgcgcacccacttcgcgtttgtcgttgatgagtttggttctgtggaagggctggttacgctcagcgacgtgatggaaaccatcgccggtaatctgcctaatgaggtggatgagatcgatgcgcgccacgatattcagaaaaacgccgacggcagctggaccgccaacggccacatgccgctcgaagatctggtgcagttcgttccgcttccgctggacgagaagcgcgaatatcacaccatcgccggtttgctgatggaaaatctgcaacgtattccgcagccgggggaagaggtccaggtgggggattacatgctcaaaaccttgcaggtagagagccatcgcgtgcagaaggtgcagctgataccgctgcgcggtgaagatgagatggattttgaggtgtag

SEQ ID NO: 3379 - DNA, 1452 bp, Enterobacter cloacae
accgaaagatcgcgttgcgccttgctttcatattcctgttgtcgcctggcagacatttcgctaaagtctcgccccttctcaccggcatggggatttattgtgtttattggattcgactacggcaccgcaaactgctcggttgcgataatgcaaaacggacaaccgcagctcctgaaaatggaaaacggcagtacgctgttgccgtcaatgctctgtgcgccgacgcgtgaagcggtgagcgagtggctgttccgccatcatcaggttcctgctaccgcagcggaaacccaggcgctgctgcgccgtgcggtcagctttaaccgcgaggaagatatcgacgttaccccttccagcgtgcagttcggcctctcttccctcgggcagtacattgaagatccggaagaggtctacttcgttaaatcgccgaaatccttcctcggcgccagcggcctgaagccacagcaagtggcgatgtttgaagatctggtctgcgcgatgatgctgcacatccgcaatcaggcgcagtcccaggtgccggatgctatcacccaggcggtgattggccgtccgatcaacttccaggggctgggcggcgacgaagccaaccagcaggcgcaggggatccttgagcgtgcagcgcaccggactggcttccgtgacgtggtattccagtatgagccggttgcagcgggactggattttgaagccacgctgacggaagaacaacgggtgctggtagtggacatcggcggcggaacgacggactgctcattactgctgatgggtccgaagtggcatcaccgtcgcgatcgtgaaaatagtctgctggggcacagcggctgccgagtgggcggtaacgatctggatattgccctggcattcaagagcctgatgccgctgctcggcatgggcggtcaaaccgagaaaggcatcgccctgccgatcctgccgtggtggaacgcgattgccatcaacgacgtccctgcccagagtgatttttacagcaccgcgaatggccgtttcctcaacgatctggtgcgtgatgcacaggatgcagagaaggtcgcgctgctgtataaggtgtggcgtcagcgcctgagctaccgcgtggtgcgcaccgccgaagagagcaaaatcgccctttccgatcgtcctgagcatgcggtttcgctgccgtttatcagtgacgatctggctacggctatcacccaggaagggctggaaatggcgctgactcagccgcttcagcgtattctggagcaggtgcagctggcgcttgagaatggcaaagtgaagccggacgtgatttacctgaccggcggtagcgcccgttcgccgctgatcaagaaagcgctggcggaacagctgccggggatcccgattgccggcggcgatgactttggctccgttacagcagggctggcgcgctgggcgcaggtggtgtttagctaa

SEQ ID NO: 3380 - DNA, 1215 bp, Enterobacter cloacae
gaacgtataacgatgaaaggcagtaacaaatcccgctgggcaatcgccgctggtctgattgtggtggtcctggccgccgcctggtactggcacagccagtccgcgaactccacggcacctgctggcgccagtagcccctcacaacgcccaacgggcggcgggcgccacggtatgcgcggcggtgcgctggcaccggtgcaggcggcaacggcggtgaataaagcggtgcctcgttatctctccgggctgggaaccattactgccgccaacaccgtgacggtacgtagccgcgtagacggtcagctgatggccatccacttccaggaaggtcaacaggtgaaagcgggcgatctgctggcggaaatcgatccaagccagtttaaggtggccctggcgcaggcgcaggggcaactcgcgaaagacaaagccaccctcgccaatgcccgccgcgatttagcccgctatcagcagttggtaaaaaccaacctcgtgtcgcgccaggagctggatacccagcaatctctggtcagtgaatctcagggcaccatcaaggccgacgaagccgcggtcgccagcgcccagctccagctcgactggagccggatcaccgcgccgattgacggccgcgtgggcctgaaacaggttgatatcgggaaccaaatctccagcggcgataccacgggcatcgtggtgatcacccagacgcaccctatcgatctcgtctttaccctgccggaaagcgacattgcgacggtgatacaggcgcagaaggccggaaaatcgctggtggttgaagcctgggatcgcaccaacaagcagaagctgagcgaaggttcgctgttgagcctggataaccagatcgacaccaccaccggcaccatcaagctaaaagcacgcttcaacaatcaggacgatgccctgttcccgaatcagttcgtcaatgcgcgaatgctggtcgcgaccgaagaaaacgccgtggtgatcccgacggcggccctgcaaatgggcagtgaaggcaactttgtctgggtgctgaacagcgaaaacaaggtcagcaaacacctggtgaaaaccgggatccaggacagtcagacggtggtgatcagcgccgggctgtccgcaggcgaccgcgtcgtaaccgacggtattgaccggctgaccgaaggggcgcaggtcgaggtggtggaagcgcagaatacaggagcaaaagcctga

SEQ ID NO: 3381 - DNA, 768 bp, Enterobacter cloacae
cattacagtagagttacctctggaacgggatttatcgagggaagcatgaccgagttaccgattgacgacaacacaccgcgtattttgatcgtggaagacgagcctaaacttgggcaactgctgatcgactatttgcgcgctgcgagttacgcgccaacgcttatcagccacggcgaccaggtgctgccctacgtgcgccagacgccgccggatctgatcctgctggatctgatgctgccgggtaccgacggcctgaccctgtgccgcgaaattcgtcgtttctccgatgttcccatcgtgatggtgacggccaaaatcgaagagatcgatcgtctgctggggctcgaaatcggcgctgacgattacatctgcaagccttacagcccgcgggaggtggtcgctcgcgtgaaaaccatcctccgccgctgtaagccgcagcgtgaattgcaggtgctggatgcgcaaagcccgctgatcgtcgacgaaagccgtttccaggcgagctggcgcagcaaacttttggatctcacccccgcagagtttcgcctgttgaaaacgctctcccacgagccgggcaaagtgttttcccgcgagcagctgctcaaccatctgtatgacgattaccgcgtggtgaccgaccgcaccatcgacagccacatcaaaaacctgcgccgcaagctggaggcgctggacgccgaccagtcgtttattcgcgcggtgtacggcgtggggtatcgctgggaagcggatgcgtgcaggattgcctga

SEQ ID NO: 3382 - DNA, 921 bp, Enterobacter cloacae
ctaaaaaagggagcaacccggatggcaacctatccagacagtttattaattcttaacggcaagagtgcaggcaacgatctgctgcgccaggcgattaccgaattgcgtgaagatggcgcgcgcattcacgtgcgggtgacctttgaaaaaggcgatgcggcgcgctatatcgatgaaggtatcaggttaggcgctgagaccatcatttccggcggcggcgacggaacgatcaacgagatcgccggtgcgctcattgacctcaacgccgcagctcgcccggcgatggggattttaccgctcggtaccgccaacgattttgccaccagcgccggtatacctgaggatttaggcaaagcactgcaactggctatcctcgggaaagcgaccgccgtcgatattgcgcaggtgaatgaaagaacctgctttatcaatatggcaacgggcggtttcggcacccgcattaccagcgaaacaccggaaaaactgaaagccgcgctgggcggcgtttcgtatctcatccatggcctaatgcgcatggacaccctcaagcccgacagctgtgaaattcacggtgagaacttccactggcagggcgacgcgctggtgattggtatcggcaacgggcggcaggcggggggcggtcagcagctttgcccggaagcattgatcaacgacggtcaattacagctgcgtatttttaccggcgacgggctgctgcctgcgctgtttacgacgctgacgcagccagaggagagccccaatatcatcgacgggaaatccgcgtggtttgaagtgatcgccccacacggcatgacctttaacctcgacggagagccgctcagcggcgagcgattccgcattgaggtgttgcccggggcgttgcagtgccgattgccgccggactgcgtgctgttgcgctga

SEQ ID NO: 3383 - DNA, 285 bp, Enterobacter cloacae
caacttaatcgcataaagaaaggacaaaaaactgtagttactcttttaaatgataaaattagatttaatggaagcgtagaaagcatttctaaagggattcttgattatagtaacaagggctctcaaggcgaactacatgaggtcaacccaacttttgaatgggtacggctacctatgcgtattcccgtaagaatcgcaattccttctaatcaagataattatgatcttcttgtatctggtatgacttgcactgtaactatatctgaaaaccatgaaaaactttga

SEQ ID NO: 3384 - DNA, 1392 bp, Enterobacter cloacae
gcgcggatgcgccactcccgtggtgaagaacgtagatcagcggccgatcgtgatgctgcgtttgaaaagattaacgaagcacgtagtccactgctgccgcagttaggcttaggtgcagattatacctacactaacggttttcgcgataataacggcatcaactcgaatgccaccagcgcctctttacagttaacgcaaaccctgttcgacatgtccaaatggcgtgagctgagcttgcaggaaaagagcgcgggcatccaggatgtgacctatcagacagatcagcagacgctgatcctgaataccgcgaccgcctacttcaacgtactgagcgcgattgacgccctctcctacaccgaagcgcagaaacaggcgatttatcgtcagttagatcaaaccacccagcgcttcaacgtgggcctggtcgccatcactgacgtacagaacgcccgttcacagtacgacaccgtactggcaaacgaagtgaccgcacgtaacaatctcgacaacgcgctggaatcactgcgtcaggtcaccggtaactactatcctgagctggcctctctgaacgtggacagcttcaaaacagacaagccgcaggcggttaacgccctgctgaaagaggcggaaaaccgcaacctgaccttgctgcaggcacgcctgagccaggacctggcgcgcgagcagatccgtcttgcacaggatggtcacctgccaaccctgagcctgagcgcctctaccggcgtatcggataccagctacagcgggtctaaaaccaacactgcccagtatgacgacaacaatatgggccagaacaaagttggcctgagcttctctctgccgctgtaccagggcgggatggttaactctcaggttaagcaggcgcagtacaacttcgtaggcgcgagcgagcagcttgaaagcgcgcaccgcaacgtggtccagaccgtgcgttcttccttcaacaacgtgaacgcgtccatcagcagcatcaacgcctataaacaggccgttgtatctgcgcaaagctctctggacgcgatggaagcgggttactccgtcggtacgcgtactatcgttgatgtgttagacgcaacgaccacgctgtacaacgcgaaacagcagctctccagtgcgcgttaccagtacttgatcaaccagctgaacatcaagcaggcgctgggtacgctgaacgagcaggatctgcaaatgctgaacagcacgctgggcaaaccggtttccacgtcgcctgacagcgtcgcgccggaaaatccacagcaggatgccgccgtggataatttcaccgctaacagcagcaccccggttgcacagccagcggcagcgcgtagcacctcacctgccagcagcggcacgaatccgttccgcaattaa

SEQ ID NO: 3385 - DNA, 204 bp, Enterobacter cloacae
agatcccccggatttcacccctcgtcgcttcattttcaaccactcatcctctatcctgagcgttattaccactgggtcctggaagacaaatatgaaacggacaaaaacgatgaatcacgcgtcgttccgcaaaagctggaacgcacgccacctgacacctgtcgcgctggcggtcaccgccgtctttatgctggcaggctgtga

SEQ ID NO: 3386 - DNA, 1200 bp, Enterobacter cloacae
tgcgaccggctcctcaactcgctcaatgggcggctgatcatggaacgagtcagtattgccgagcgcccggactggcgcgaaaaagccaccgaatacggtttcaactttcacaccatgtacggcgagccgtactggtgtgaagatgcttactataagctcacgcttgctcaggtcaaaaagcttgaagaagtgaccgcagagctgcaccagatgtgcctgaaggtggttgagaaagtcatcgacagcgatgagctgatgaccaaattccgcattccgaagcacacctggagctttgttcgtcagtcctggaaaacgaaccagccttcgctctactctcgcctcgatctggcatgggatggcgtgggtgaaccgaagcttttagaaaacaacgcagatacgccaacctccctgtacgaagccgcgttcttccagtggatctggctggaagatcaggcgaatgccggaaacttgccggaaggcagcgatcagttcaacagccttcaggaaaagctgattgaacgtttcgtcgaactgcgtgaacagcacggtttcaacctgttgcacctcgcctgctgccgcgataccgaagaagaccgcggtacggttcagtatttgcaggactgcgcagccgaagcggaagtggcgacggaatttctctatatcgaagatatcggtttaggtgaaaaaggtcagtttacggacatgcaggatcaggtgatcagcaacctgttcaagctctatccgtgggaatacatgctgcgggaaatgttctctaccaaactggaagacgctggcgtgcgctggctggaaccagcctggaagagcattatctccaataaagccctgctgccgatgctgtgggagatgttcccgaatcacccgaacctgctgcctgcttattttgccgaagatgatttcccaccgatggagaaatacgtcgttaagccaatcttctctcgtgaaggggcaaacgtctcgattatcgaaaacggtaaaacgctggaagcagttgaagggccgtacggtgaagaagggatgatcgtccaggcgttttatcaactgccgaagtttggcgacagctatacgctgatcggcagctggcttattaacgatcagcctgccgggattggcattcgcgaagatcgcgcgctgattacgcaggatctgtcgcgtttctacccgcatattttcgtcgagtaa

SEQ ID NO: 3387 - DNA, 2532 bp, Enterobacter cloacae
tgtacaaataattccgttacgtcacggtatcagccgactggcaatccatgccggtcggcactctttatttattcgagtaacaggatgatgacatacaaagtacaatggataatcatcattgcgtccctgttaatgacgatagttgcctctgccactgaatttaatataaacgccatcgataaagatcagcgcggcagcgtcgatttatcacgttttaaagatcaaatatcggttacgccgggaagctatttcgttacggtttcagttaatgatattccgctggcaaatggctggcagcttcgctggcgagacataaataacgcagttcaggtctgtattccccccgagctggccgatacattcgcatttcaggatgacgttcgtcacgctttaccggaaaaagagggatgcgttgatttcgccgccagaccagacatcaaatttacttttgagcaaggcagccagaccctgaaagtaacgatcccccaggcgtggctgcaataccgtgcggttgactggatgccgccatccacctgggacaacggcgtgccaggcgtactgctggattacaatctttttgccagccattatcagcccaatagcagcggcagcaatgacaacgccaatacctatggtaccgccggtgcgaacatgggcgcgtggcgcctgcgaagcgattaccagtacacgcgaagcgatactgaagcaggctcagagcagaatggccgtttttcacgcgtgtatatgttccgccctctgccctcgatcggtgcgaaactgacgctgggtgaaacggatttccagtcctccatttttgacgccttcacctacaccggcgcatcgctaatcagcgatgaacgtatgctgccatggtcgctgcgcggctatgccccacagattaccggaatagcacaaaccaacgccaccgtggccgtaagccttgccgatcgcgtgatttaccagagtaaagtgccaccaggaccctttgttattcaggatcttaaccagtcggttcagggcacgctggacgtcaaagtcacggaagaagacggacgcgtcaacaccttccaggtctcggctgaatccgtgccgtttttaacgcgcaagggccaggtgcgctataagctcgcggcgggtaaagcgcgccagggcgcctcccatgatgttgaagataatgccttcatgagcggcgaattttcctggggcatgctgtcgcacacctctctgtatggcggcacgctggccgatggcgaccgttatcgttccgtcgctgccgggatcggccagaatatggcctggctgggggcgctctcttttgacgtcacgcaggctaccagccagctgccacaccagcgcagccagacgggttacagctatcgcattaactacagcaagcgtttcgataccaccggcagtcagcttacgctcgccagctaccgctactcagacccacagtttttgagctacgcccgctacctggattatgacaacggtgaccgccagtcggaaaaacaaaccctgagcgtgacggcaagccagtacatttcagcgttatccctgaacctgtacgtcaatatgctgcgtcagacatggtggaatgattcaccctccacgaccggcagcatcacggcgggctacaactttgatataggtcgctggaagaaccttggcgtaaccctgtcctggagtaaaacgcattacgaggaggaagacgaaaatgacgatactcagttttatctctcgctcagcgtaccgctcgatcccgatcatcgacttaactatgacctgcgtaacagcgacacgctgagccataacgtgtcgtggtatgacacgtcggatcgcaataatacctggggcgtttccgcaggtacggagagcgggaagccagattccggcgcgcaggtcagcgggaattatcagcattattctgcgtacggcgatctcaatctctccggcagctataaagctaacgaatataactccctcagcgcgagctggagcggttccttcacctcaacggcgaaaggcgccgcgctgcaccggcgcagttacggtaatgaaccccgcgtaatggtcagcaccgacggggtaggccatatcccgctgaacatgtcgcgcgatgaaactaaccgttttggcatcggcgttttaccgtcattctccagctattccccctccagcgtgcaggtcaatatgaacaaccttccggatggcgtggacgtggacaaccgcgtcgtgacctcaacctggactgagggggccattggttatcgtcagattgccacgcgcgcaggtcaggacgtaacaggcgttttgcggatgtcgtcaggaacaccaccactcggggcgattgttcgcctggatgaaagcaatttacaggttgggatggtggccgatgaaggccgcgtctggctcggcgccgttgagccagaacagcagtttcgcgtgacatggggcgacaaccaacagtgtcgcttctcgttaccttctcacttagaaaacagtatgcagttgatactgccgtgccagtaa

SEQ ID NO: 3388 - DNA, 771 bp, Enterobacter cloacae
gaaatcatcatgaaattaacgccgattaaaagcctgtgcctgatgctgatcagcacaacatttaccgcccacgcggccattaacctggaccgcacgcgcattgtttttccagaaagcgacaaggccagcagcctgaaagtggacaaccagagcaaggcgctgccttatctggcgctctcctggattgaagatgaaaaggggcaaaaagaagatgtgcactttatggcgcttccccccattcaacgtatcgaagcgggcgcctcgtcgcaggtaagaattgttaaacaagccgctacccgccagttgccaaaagacagggaatcgctgttttatttcaacctgcgtgaagtaccgcctaaaagcaccagcgccagcgaggagcgcagcgtgatgcaggttgccatgcagagccgaattaagctcttctggcgtccggaagcgattcgcaaaaaatctggcgaactgactgaaatgcgtatggaaattaccgccaacgcgaaagggctcacggtccacaaccctacgccgtactacatcacgctggcgtggctgagcaaaaatgccaaaaccatgctgccgggttttgacagtctgatgattgcgcctttcgccacggcaaccgcctctaccggcgattaccacggtagttattacagcatcggctacatcgacgattacggcgcactgaaaaaagtcgacgtacagtgcaccggaacggtgctatgtaagcttaacgaacggaaaatcgataaagatgcgaaagctcactag

SEQ ID NO: 3389 - DNA, 600 bp, Enterobacter cloacae
gcgactgcatctcagcggtggcgatctgacgcccgtcgcggaccatccgtgggtcggcacgctgctgttctatccggcccgggaagcacatctcgacacggtgcgcgagcggctcgccccgctggaaaactttggcggggcgacgctcaccgacgatctgctgtcggtgcgttttctctcgcacgacaacctgatttgtcagcgggtgatgcgcgatatctggcagtcgcttcgcccgcttttaacccccaaaaccgcctgttcgccgcgcatctggcagacataaagagaaacgctatggaactgactcccagagaaaaagacaagctgttgctgttcaccgccgcgctggttgccgaacgccgcctcgcgcgcggggtaaagctcaactatccggaatcggtcgcgctgatcagcgcctttattatggaaggcgcgcgcgatggcgaaaccgtcgcctcgctgatggaagccggccgccacgtcctgacgcgcgatcaggtgatggagggcgtaccggagatgatcccggatattcaggtggaagccaccttcccggacggatccaagctcgtcaccgtccacaacccgatcgtgtaa

SEQ ID NO: 3390 - DNA, 255 bp, Enterobacter cloacae
tgccagcggcaaaccgaatttattaaaggtgagagttacatgccggtaattaaagtacgtgaaaacgagccgttcgacgtagcactgcgtcgcttcaaacgttcatgcgagaaagcaggtgttctggctgaagttcgtcgtcgtgagttttatgaaaaaccaacgaccgaacgtaagcgcgctaaagcttccgctgtgaaacgtcacgcgaagaaactggctcgcgaaaacgcacgccgtactcgtctgtactaa

SEQ ID NO: 3391 - DNA, 1980 bp, Enterobacter cloacae
gtgccgaatatcgatcgggaagcccccggcagccgcactgagaggcagcggcaaaaatataagtacgccctcgctttaaaggttggcagcccatcgccgacaccaatcaaacgaattaagtgtggataccgtcttatggagcaaaacccgcagtcacagctgaaacttcttgtccaacgcggtaaggagcaaggctatctgacctatgccgaggtcaatgaccatctgccggaagatatcgtcgattcagatcagatcgaagatatcatccaaatgatcaatgacatgggcattcaggtgatggaagaagcaccggatgccgatgatctgttgctggctgaaacctccaacaacactgacgaagatgcggaagaagctgctgcacaggtcctgtccagcgtggaatctgaaatcgggcgtaccactgacccggtccgcatgtacatgcgcgaaatgggtaccgttgaactgttgacccgcgaaggcgaaattgacatcgcaaaacgcatcgaagacgggatcaaccaggttcagtgctctgttgccgaatacccggaagcgatcacctatctgctggagcagtacgatcgcgttgaagcagaagaagcgcgtctgtccgatctgatcactggctttgtcgacccgaacgctgaagaagatatggcgccaaccgccactcacgtcggttctgagctgtctcaggaagagatggatgacgacgaagacgaagatgaagaagaagacgacgacagcagcgatgacgacaacagcatcgaccctgaactggcgcgtgagaaatttgccgagctgcgtacccagtacgaagtgacgcgtgacaccatcaaagcgaaaggccgcagccatgccgccgctcaggaagagatcctgaagctgtctgaagtgttcaaacagttccgcctggtgccaaaacagttcgactacctggtgaacagcatgcgcgtgatgatggatcgcgtacgtacccaggaacgtatcatcatgaagctgtgcgttgaacagtgcaaaatgccgaagaagaacttcatcaccctcttcaccggcaacgaaaccagcgaaacctggttcaacgccgctatcgcgatgaacaagccgtggtctgaaaagctgcacgacgtgaaagaagacgtacagcgcggcctgcaaaaactgcatcagattgaagaagagaccggcctgaccatcgagcaggtaaaagacatcaaccgtcgtatgtccatcggtgaagcgaaagcccgccgtgcgaagaaagagatggttgaagcgaacttacgtctggttatctctatcgccaagaaatacaccaaccgtggcctgcaattcctggatctgattcaggaaggcaacatcggtctgatgaaagcggtagataagtttgaataccgtcgtggttacaagttctccacctatgctacctggtggatccgtcaggcgatcacccgctctatcgcagaccaggcgcgcaccatccgtattccggtgcatatgattgagaccatcaacaaactcaaccgtatctctcgccagatgttgcaggagatgggccgcgagccgacgccggaagagctggctgaacgcatgctgatgccggaagacaagatccgtaaagtgctgaaaatcgctaaagagccaatctccatggaaacgccaatcggtgatgatgaagattcgcatctgggtgatttcatcgaggataccaccctcgagctgccgctggactctgccaccaccgagagcctgcgtgccgctacgcacgacgtgctggctggcctgaccgcccgtgaagccaaagtgctgcgtatgcgtttcggtatcgacatgaacaccgaccacacgctggaagaagtgggtaaacagtttgacgtgacccgcgaacgtatccgtcagatcgaagcgaaggcgctgcgtaaactgcgccatccgagccgctctgaagtgctgcgtagcttcctggacgattaa

SEQ ID NO: 3392 - DNA, 1203 bp, Enterobacter cloacae
ctcaaatacttaagcgccagagcgaaaggcatcatgagcacaccgatcaaacggctagaaatcattaaaaatgccattgagctggaagatgacgacatcatccggagccagttgaaacgtctcaaagaggaagcctttgacgatgaactcctgtccatcgtcgcggcgcttgagcagaaaaactacaccgcagcccttcgcgctatcaccacctggctgcaaagccagcgcgccgttaccccgtggcgtgacccgcaactggcggccagcaagctggagctaaaagccctggaagagcgtctgcgcgatctgattgatcgtcgtaacgcccgggtacagcagcttgacgaattcaacgatctctatttctcccgcctcgggccgttgatgcagcagatcctcgccctgcgtaaaacgctggcggagcttaacctgcgtcgtcagcaggcggagacgcgtcgccgggaagaggattaccgccgctgccagagctatatggcgcaggccgtagaggttctgacaacgctcacccggcgctggcgagatctgcctgcggattccgttcaggcggcagaggcgcgcaagcatcttcagcagcaaagtaatctgattgccaacctgctggccgaagcgatggagctggagaccggtttaacgcgtgaagaagagccagcacgtcaggcgcgcgatgaggccaacgaagagtacaagaagtatcgcgaacagcatcatgatgccgaagttcgcctgcgtaaaggcaaggatctctctgaagaggatcggaacgagctgaagcggctctggcgtcaggcgagcaagttatgccacccggatctggttgccgatgatttaaaagaagaagccaacaggatgatggtgcaactcaaccaggccaaacagcgcggcgacgtgaaggccattcgcttgctggtcgcccgtctgcaacaagggtttgaaccgatgatggcgagcgacaggctgaacgacctggaacgtattcgtaaaaagatggcgcaggtgcgtgagcaaatcgacaccctggtgaacgagctggcagagctggagaaagaagagtcctggctgctcgtctcgtcgctcagcaatatggaagcctactttgcccagcaggagaaagcgctgaaagaggtatgcgcctcgctcgaacatcaggtgagcgaagcgcagctggatcccgctgcctga

SEQ ID NO: 3393 - DNA, 783 bp, Enterobacter cloacae
tcccccccgaacgtaagccaacgtaaagatcccccggatttcacccctcgtcgcttcattttcaaccactcatcctctatcctgagcgttattaccactgggtcctggaagacaaatatgaaacggacaaaaacgatgaatcacgcgtcgttccgcaaaagctggaacgcacgccacctgacacctgtcgcgctggcggtcaccgccgtctttatgctggcaggctgtgagcaaaacgacgaaacggtttcgctgtatcaaaacgccgacgactgcgcgagcgcaaccggtaaagccgctgagtgtacgacggcgtataacaacgccctgaaagaagcggaacgtaccgcgccgaaatatgcctcacgcgaagactgtgtagccgaattcggtgaaggccagtgccagcaggcacctgctcaggcgggtatggcaccggaaaaccaggcgcaggcacagtccagcggcagcttctggatgccgctgatggcgggttatatgatgggccgtttgatgagcggcggtgcgggctaccagcagcagccgctgtttagctccaaaaacccgaacagcccggcctacgggaaatacaccgatgccaccggcaagggttacggtgctgcaacgcctggccgtacgatgaccgtaccgaaaaccgcaatggcgccgaaaccagccaccaccagcaccattacccgtggcggcttcggtgagtctgttgccaaacaaaccaccatgcagcgtagtgcgaccggctcctcaactcgctcaatgggcggctga

SEQ ID NO: 3394 - DNA, 375 bp, Enterobacter cloacae
aaaaagtcgacgtacagtgcaccggaacggtgctatgtaagcttaacgaacggaaaatcgataaagatgcgaaagctcactagtttcctgcttacattgctgcttacaacgctgcctttgaaagaagcgctggcgctcaactgctatctgggtggatctggcggccccgtcgaggagacaaaaacgatctccccttttgccatacccagcaacgctcaggttggccaaaaaatatgggagtctgatgacattaaaattccggtgacgtgtgacaataacgtcacaagcggtttcaagccggaagatgtttttgcctgggtaaacccttatcctgccgcaaccgatccctattatgaactgggcgtcaccttatga

SEQ ID NO: 3395 - DNA, 1578 bp, Enterobacter cloacae
aaagaaagacgctcagtaaaccgttcgttatgccttataaccaaatgtgatttttgtcaccttctgcctgtggtaactgttagagacacaacacaaccacacaaaaagaaaatggcagaaatcacagattcaactccccttccagcggcaggaaacaccccggatggcgatatcaagtgggtacgcagcgcatcggacgtttcacgtctcgttaatgacggctctcagggccgggccaatgcccgcatcgtggtcggtatcgcgctcgggggaatttttctcgatgcctacgatctcggcgcgctggcattcggcatcaaagacatcacccgcgaatttaacctgacgcccgccggtaccggcatggtggcttcagccattacgtttggcgcgattgtcggggcgctgctcggcggctatcttacggataaaatcgggcgctaccgcgtctttatggccgatatggtattctttgtcgttgccgctatcgcctgtgcgctggccccgaacgaatatgtgctggcgggcgcgcgctttgtgatgggtcttggcgttgggatcgaccttcccgtcgcgatggcgtttctcagcgagttcgccagactgaaaggcccggggaataaagcctccagcgtcgcgatgtggtgtcccacctggtatgctgccatcagcatctcttatcttctggtgctcttcttttacgccgtactgccggaaagccacagcgactggctctggcgtctgatccttggctttggcgcggtgcccgcgctggtgattatcgccatccgtagccgctatatgagcgaatccccggtctgggcggcgaatcagggcaatctgaaggaggcggcgtctatcctgcggcagtcttacaacattaatgcccacgtaccgcaggatgcgctcgaccagcccgcgcctgttgtgaacaaggcaaaatggtcgaactacctgaacctgttccgcggtatctatctgcggcgtaccacgctcgccacgctgctgtcagtcgtctcctcgttcgcctataacgccgtagcctttggcctgccggtgatcatctccagcttctttgtgcagtcgatgctgaccaccattctgatctcgctggcgcttaatctgctgttcgcgtttgtcggcgggctgctggcggtgcgctatgttccgcgcttcggcgcatggcggatgtcactggcgggttatgcgtgccagctggcggcgctgctcggcctggcgctgattggccgccctgacggggccacggaaggcgtggtcgccgtcgcgatgctggcgctgttcctgtttggccagggttttggtccgggtgcgcacaccatgacgtttgcctctctgagctacccgacctcgctgcgcggtgtgggtgtggggcttaaccagacgctgatgcgcagcagttcaacgctatcactgtttctgttcccgctgctggtcgcctcgctggataccgccgtgttctgggtgattgcgctggcgccgtttatcggcctggcctcgctgctggcgatccgctgggagccgtcggggtatgatgtggatgcagaggattatcgctag

SEQ ID NO: 3396 - DNA, 846 bp, Enterobacter cloacae
tgcggaagtggaagcaccatgttagcaactcaggtcactgataattcatacaaaggctggcaggcctcgcttgccctccagttttgtcatacccctgagaaaaccctcctccattccgcgcgtcacaccgggccacttaccgttcagcgtccgttttatcccgaaggggaaacctgccacctttacctgctgcacccgccaggcggaattgtgggcggggatacgctggatatttccgtgcggctcgacgccaaaagccatgccctcatcaccatgcccggcgccagcaagttctatcgcagcagcggcccgctggcctgcctcagtcagcatttttacctcgacgaagaggccacgctggagtggctgccgcaggacaccattattttccccggcgctaacgccgcgctgcgttccgtctttcacctgcacgccaccagcacgctgctggcgtgggagctgtactgtctgggccgtccggtgataaacgaaaccttcagccaaggcacgctggagagccgccttgaggtgtgggtggatggcgagccgcgtctgattgagcgactgcatctcagcggtggcgatctgacgcccgtcgcggaccatccgtgggtcggcacgctgctgttctatccggcccgggaagcacatctcgacacggtgcgcgagcggctcgccccgctggaaaactttggcggggcgacgctcaccgacgatctgctgtcggtgcgttttctctcgcacgacaacctgatttgtcagcgggtgatgcgcgatatctggcagtcgcttcgcccgcttttaacccccaaaaccgcctgttcgccgcgcatctggcagacataa

SEQ ID NO: 3397 - DNA, 399 bp, Enterobacter cloacae
tcccggatattcaggtggaagccaccttcccggacggatccaagctcgtcaccgtccacaacccgatcgtgtaaggagcgcgtgatgatcccaggtgaataccggatccagtccggcaacattgctctcaacgtcgggcgcgaaacccgaagtgtgatagtggaaaaccacggcgacaggccgatccaggtcggatcgcactaccacttttacgaggtcaacccggcgctgaagttcgatcgcgaggccacccgaggctaccggctgaacatcccggcgggcaccgctgtgcgcttcgagcccggccagaagcgggaagtgacgctggtgcaggtgacgggcgcacagcgcattttcggttttcgcggcgagatcatgggcgaggtgaaacatggctga

SEQ ID NO: 3398 - DNA, 726 bp, Enterobacter cloacae
aaccttcggtggcgggctgatcgtctctgccctgctggcgctgatgagctgatggagcacgcccgccagcggctgcgcctgatgcagctctccagcagtagcctgccggtcggatcgtttacctggtcgcaggggctggagtgggccgttgaggccggatgggtcacggacgctgaggccttcaggcgctggcagatccagcagatggagcagagctttttctgcgtcgacctgccgctgtttatccgcctttatcgtgcctgcgagaagcaggacgtcgcgacagcaaaacgctggacggcatacctgctcgcctgccgggaaacgcgcgagctgcgcgatgaagaacgcaaccgtggcgcggcctttacgcgcctgattaaaagctgggaacccgcctgcccgccagaatggttgccgctgttgacgcagagccagctctgcggtatggcgtggctcggcgtgcgctggggcattagcgcgcgcgagctggcgctgagcctgggctacagctggattgagagcgcggtgatggcgggcgtcaagctggtgccgtttgggcagcaggccgcacaacagctgattatcgacctgagcgaccattttgccgccgggtttgaacaggcatttttacgtggcgacgacgcgctgggggccgctacgccgctgtccgccatcgcctccgcgcgccacgaaacccaatattcacgactattccgttcctga

SEQ ID NO: 3399 - DNA, 627 bp, Enterobacter cloacae
ggagtcaatatggctgattacaaacatcccctgcgcgttggcgtgggcggcccggtagggtcgggcaaaaccgccctgctggaagcgctctgcaaggcgatgcgcgatacctatcacctggcggtggtgactaacgatatctacaccaaagaggatcagcgcatcctgaccgaggcgggtgcgctggagccagagcgcatcgtgggcgtggaaacgggcggctgtccgcacaccgccatccgcgaagatgcttcaatgaacctggcggcggtggaagcactcagcgagaagttcggcaatctggatctgatcttcgtcgaaagcggcggggataacctgagcgcgacctttagcccggagctggcggacctcaccatctacgtcatcgacgtggccgaaggggaaaaaatcccgcgcaagggcgggccggggatcaccaaatccgattttctggtgattaacaaaaccgatctcgcgccgtacgtcggcgcctcgctggaggtgatggagcgcgacaccaaccgcatgcgcggcgagcgtccgtggacctttactaacctgaaagcgggagacggtctgggaacgatcattgcgtttctggaagagaaagggatgctgcgggtgtag

SEQ ID NO: 3400 - DNA, 1812 bp, Enterobacter cloacae
ggccgtgcttccggaaggaatgcgcggcttgttttcgtttataagtcgcttaaatttttggggcatatggccggaagaatcccacgcgttttcatcaatgacctgcttgccagaaccgacatcgtcgatctcatcgacgcgcgggtgaagctaaaaaagcagggcaagaactaccatgcgtgctgtccgttccataacgaaaaaaccccctctttcaccgtaaacggtgaaaagcagttctaccattgcttcggctgtggcgcacacggcaatgccgtcgattttttgatgaactacgacaagctcgagttcgttgaaaccggtcgaagattggcggcgatgcataaccttgaagtgccgtatgaagcgggcagtgggccaagtcagatcgagcgccatcagcggcaaacgctgtaccaactgatggatggcctgaattcgttttaccaacagtctcttaagcactctgcggctgagcctgcgcgtcagtatctgaacaagcgcggactgagtgacgatgtgattgcgcgtttcgctattggttacgccccgcccggctgggacaacgtgttaaagcgttttggcggcaatagcgaagatcgtaaatccctcatcgacgcaggcatgctggtcaccaacgaccagggacgaagctacgaccgcttccgtgaacgggtgatgttcccgatccgcgacaagcgtggccgggtgataggttttggtggtcgcgtgctgggtgatgccctgccgaaataccttaactccccggaaaccgatattttccataagggccgccagctttacggtctttatgaggcacagcaggataatgcggaacctccgcgtcttctggtcgtcgaaggctatatggatgttgttgcgctggcgcaatacgacattaactatgccgttgcgtcgctgggaacgtccaccacggcggaccatatccagctgctgttccgcgtcaccaacaacgtgatttgctgttacgacggtgaccgcgcaggacgcgacgccgcctggcgagcgctggaaaccgcgttgccgtatatgaccgacgggcgtcagttacgctttatgttcctgcccgacggtgaagacccggatacgctggtgcgtaaagagggcaaagcggcgtttgaagcgcggatggagcaggctcagccgctctccacgtttctgtttaacagcctgatgccgcaggttgatttgagtacccctgacgggcgcgcgcagctcagcacgctggcgctgccgttaatcagccaggtgcccggcgaaacgctgcgcatctatctgcgtcaggagttaggcaacaagctcggcattctggatgacagccagcttgaacgtttaatgccgaaacaggctgaaaacggcacggtacgccccgcgcctcagctaaaacgcacaaccatgcgtatactgatagggttgctggtacaaaaccccgaacttgctccgcaagtgccgtcgctggcgggtttgaaccacgaaaaattgcccgggcttggcttattttcagaattggtcaacacttgtttgtctcagccaggtctgaccaccggacaacttttagagcattatcgcggcacaaaagaggccgctacccttgaaaaactgtcgatgtgggacgatatagcagataaggatatcgcagaaaaaacgttcaccgactcactcaaccatatgtttgattcgatgcttgagttgcgccaggaagagttgatagctcgcgagcgcacccagggcctaagcagcgaagaacgccgggagctctggatgattaaccaggaactggcgaagaaataa

SEQ ID NO: 3401 - DNA, 504 bp, Enterobacter cloacae
ggaagaaacatgcgacacgaacacgacggcggcggacgccggccacgattttttggtcatggcgatctgcggctggtgatcctggatatcctgacccgcaacgcgagccatggttatgagctgatcaaagagatcgagaacctgacgcagggacattacacgccaagccctggcgtgatctatccgactctggattacttgcaggatcagtcgcttatcatcattaccgaagaagagaacggccgtaagcggattgcgattaacgccgccggagaacagtggctggaagataaccgggaacagctggagcagatccagacgcgtatcaaggcgcgctccgtcggtttccagctgcgcaaaaacccgcagatgaagcgggcgctggataacttcaaagcggttctggatctgaaggttaatcagggagagctcagcgacgcgcagttaaaacagattatcggcgtgattgaccgcgcggcactggagatctcccagctggattaa

SEQ ID NO: 3402 - DNA, 783 bp, Enterobacter cloacae
ggagaatgcatgtcagtaccgttgattttgaccatacttgcgggcgccgcaacctttatcggtgcgttcctcggggtactcgggcaaaaaccctctaatcgcctgctggccttctcgctgggtttcgccgccgggatcatgctgcttatctcgctgatggagatgctgcccgccgcgcttcacaccgaagggatgtcgcctgttctgggctatggcatgtttatcattggcctgctgggttattttgcactcgaccgtattcttcctcacgcgcacccgcaggatttaatgcaaaaaagcgttacccccgttccgggaaatatcaaacgcacggccattctgctgacgctgggtatcagcctgcataactttccggaaggtatcgccacctatgtcacggccagcagcaacctggaaataggttttggtgtggcgctggccgtggctttgcacaatattcctgaaggacttgccgttgccgggcccgtttatgccgccacgggttcaaaacgtacagctgtcttttgggcaggtatctccggcatggctgaaattctcggcggcgtgctggcgtggctgatcctcggtagcctcgtatccccggttgtaatggctgcaattatggctgccgtggccgggattatggtcgcgctctctgtcgatgagctgatgccgctggcaaaagagatcgatcccaacaataacccaagctacggcgtgctgtgtggaatgtcagtgatggggatgagcctggttctgctgcaaacggcaggtattggctaa

SEQ ID NO: 3403 - DNA, 681 bp, Enterobacter cloacae
aaccatctaaaaatatatttaagtcacgttaatcgcgtctccccgccccaatccgtatacttttcgagtattctgaaattaacattcacattacgaatcaatctgaaaaaggatattttcatgtatatgggtaaaaaattgctgttagcggcagctatggctgccattgtatcgggttctgcgtttgctgatgatcaaggctcaggcaaaatcaaattcaaaggcgtggttattgacgcaccatgcagcatcgctccagacagcgttgataaagaagtcgacctgggtgaagtgactacggccgttatcaacgccaacaaaaaatccacgccggttccggtcgatatcaatctggaaaactgccagcttgacgatccggcagacgaaaccgacacgccaattactaaagtggaagtgacctttaccagcgcagcgacagatgcgacggataccagcctgatgagcaacacctttgcaaacggtgcgcagaacgtgggcgtccgtctgctggataacgcggaaggcaacatcacgcttggtcagccaaacgtgcttgatctgctggcgggttcaaccacccagacgctgcatttcaaagcggttatggaagtcccaacaggtaaaactgcgacggcaggccaggttgaagccacggctaactacgtcctgatgtacaaataa

SEQ ID NO: 3404 - DNA, 741 bp, Enterobacter cloacae
gatgccacaggccagcccaacggcgtggatacccgccagtgcctggacaacgataacatcaccatttacaccccggatcaaatccgccagatgggttgggagaatcgcatctgctctggcaatccggatgatatccacattacgcgcacgttcgtcgcccgtttacgacttttcgtgagaattaaggctatgccgccacatggctatgtcagctcgctcagcgattacatcgttgtgcagtttgacggtaagggcggcgttaatcagatggccgatgcgaagaaccttaagtatcacatcaacggactgcaaaacattacggtgcttgattgcggggcgacgtttaccatttaccctgagaatcaggagatcgactttggcaccttcagcgcgcgcgacatcgtgaatcagcagacgcgtatgcgcacgttttcaatacgaaccaccaaagtgcaggatgcccagtgctcggatggatttaagatggactcgtcgttttacacaaccgaaacgctcagcgcagacgacactgcggtactgatagggaatgggttaaaactgcgtattcttaacggaacggccccttacaccttcaaccagtacaaagagtacgccgattttacgggcgataagatgaatgttgagcaaaactacacagctgaactttcacgggaagaagggaaagcgattcagtccgggccgttcgaaaccgtggtactgttcaaaattaactaccactag

SEQ ID NO: 3405 - DNA, 342 bp, Enterobacter cloacae
cacgctacaataggcactaacaccttttcatcaagggaaacgacaatgattgacccaaagaaaattgagcagatcgcgcgtcaggttcatgagtccatgccgaaaggtattcgtgagtttggtgatgacgttgagaagaaaatccgccagacgttgcaggcacagttggttcgccttgatttagtcagccgcgaagagtttgacgtgcagacgcaggtgctgctgcgcacccgcgagaagctggcgctgctggaacaacgtttgaccgagctggaaaaccgcaatgcgccggaagaagtgaagccagcgccagctattccaccggtggatgaccaggcataa

SEQ ID NO: 3406 - DNA, 702 bp, Enterobacter cloacae
ttccgattgatgatgaatcctttgcgtagcgacactgataccactactatcgttccactttttatgaaaataacgactgatatgcttaaattacgcctgattggacttactttactcgcttttagcgccgcaaccgcggtccacgctgaagagaaacgttacgtttctgatgaactgaatacctgggtacgcagcggccctggagacaattatcgcctcgtgggtacggtaaatgccggcgaggaagtgaccctgctgcaaactaacgcagacaccaattacggtcaggttcgtgacagctctggccgcacctcatggatcccgctgaaagagctgagcacggtgccaagcctgcgcacccgcgtgccggatctggaaaatcaggtgaaaaccctgactgacaagctgaacaacatcgacggcacctggaaccagcgcaccgcagagatgcagcagaaagtggcgcaaagcgacagcgtgatcgccggtctgaaagatgaaaatcagaagctgaaaaatgagctgatcgtcgcgcagaagaaagtgaacgccgcgaatctacagctggatgacaaacaacgcaccatcatcatgcagtggtttatgtatggcggcggagtgctgggcgtcggtctggtgctgggtctggtgcttcctcaccttatcccaagccgtaaacgtaaagaccgctggatgaactaa

SEQ ID NO: 3407 - DNA, 1302 bp, Enterobacter cloacae
ctcgtcttctctgccacacttacgtatcatcttgcgaaaagagaaaacgggagtgttggcgtgaagagttatctggtcggtggtgcggtacgtgatgcgttattaggtctgccggtcaaagataaagactgggtcgtggtcggtgccacgcccgaagcgatgattgacgcgggctaccagcaggtaggccgcgattttcctgtgttcctccatccgaaaagccgggaagagtacgccctggcgcgaaccgaacggaaatccggttccggttataccggcttcacctgctatgccgcgccggatgtgacgctggagcaggacttactgcgccgcgatctcaccattaatgccctggcgcaggacgaaaacggccatattatcgacgtctacggcggccagaacgatctgcgcgaccgtcttttacgccatatttcccccgccttttctgaagatccgttacgcgtactgcgcgtggcgcgttttgccgcccgttatgcccatctcagcttccgcatcgccgacgagacgatggcgctgatgacggccatgaccgacgcgggcgagctggaacacctgacgccagaacgcgtctggaaagagaccgaaaacgccctgactacccgtaatccgcagatctttttccaggttctgcgcgactgcggggcgctgaaagtgctgttcccggaaatagatgcgctgtttggcgtgcccgccccggcgaaatggcacccggaaattgataccggcattcacaccctgatgacgctgagcatggccgctatgctcagtcctgaagtggacgtgcgcttttccactctctgccatgacctcggcaaagggttaacgccaaaggaattgtggccacgccatcacgggcacggtccggctggcgtaaagctggttgaagggctttgccagcgcctgcgcgtgccgaatgacattcgcgatctggcaaagctggtcgccgagttccacgacctgatccacaccttcccgatcctaaaacccgccaccatcgtcaggctgtttgataacatcgacgcctggcgcaagccgcagcgcgtggagcagatcgcgctcaccagcgaggctgacgtgcgcgggcgtaccgggtttgaagcgtccgattatccgcagggtcgtttgctgcgtgaggcgtgggacgtagcgaaagcggtgccaacgaaagaggtggtggaggcagggtttaaaggcccggagatccgcgaagagctgacgaagcggcggattgatgcggttgcggcgtggaaggaaaaacgttgccctcagccgaaagactga

SEQ ID NO: 3408 - DNA, 735 bp, Enterobacter cloacae
atacaatatccatcacgacctgcctgctttttggctaaaccggataccacttccggcgaattatgcgtattatccacagatgctgagaatacagatacattttcaaaacggaacagcgttatgagtgcaatcgcgcctggaatgattatcctcgcctacctttgcggctcaatctccagcgccattctggtctgccgcatcgccgggttgcctgacccgcgtgaaagtggttccgggaatccgggggcgaccaatgtactacgaattggcggcaagggagcagccgtagcggttttgatttttgacgttctgaaaggaatgcttcccgtatggggcgcgtatgcgctcggcgtcacacccttctggctggggctgatagccatcgccgcctgcgtcggccacatctggcctgttttctttggttttaaaggcggtaaaggcgtggccactgcgtttggcgcaattgcgccgatcggctgggatctcaccggcgtgatggcgggcacctggctgctgaccatcctgctgagcggttattcgtcgctgggcgccatcgtcagcgcactgatcgccccgttctatgtctggtggtttaaaccgcagtttaccttcccggtgtcgatgctctcgtgtctgatcctgttgcgccatcacgacaacattcaacgcctgtggcgtcgtcaggaaacgaagatctggacgaagctcagacgtaaaaagaaagacgctcagtaa

SEQ ID NO: 3409 - DNA, 1707 bp, Enterobacter cloacae
aacatggctgagatttcacgccaggcgtatgccgatatgtttggccccacgaccggggataaagtgcggctggccgacagcgaactgtggatcgaagtagaagacgatctcacgatctacggcgaagaggtcaagttcggcggcgggaaggtgatccgcgacggcatgggacaggggcagatgaccgccgacgactgcgtggatctggtgctcaccaacgcgctgatcgtcgatcactgggggatcgtgaaagcggatatcggcgtaaaaaatgggcggatcttcgccgtcggcaaagccggaaacccggacattcagcccggcgtgacgatcccgattggcgcagcaacggaggtgatcgcagccgaaggcaagattgtcaccgctggcgggatcgacacccatatccactggatctgtccgcagcaagcggaagaggcgctggtctctggcgtcaccaccatgatcggcggcggcaccgggcccgcggcaggtacaaacgccaccacctgcacgccggggccatggtatatcgcccgcatgttgcaggctgccgatacgctgccggtgaatattggcctgctgggcaaagggaacggttcaaacccggacgcgctgcgcgagcagatcgcggcaggtgccatcgggcttaagatccacgaagactggggcgcgacgcctgcggccatcaactgctcgctggaagtcgctgaagagatggatatccaggtggcgctgcacagcgacacgctgaacgagtccggttttgtcgaagatacgctggccgccatcaccgggcgcaccatccacaccttccacaccgaaggggcgggcggcggccatgcgccagatatcatcaccgcctgtgcgcacccgaatattctgccctcctccaccaacccgacgctgccctacacggtcaacaccatcgacgagcacctggacatgctgatggtttgccatcacctcgacccggatatcgccgaggacgtggcgtttgccgaatcccgcattcgccgggagaccatcgccgccgaagacgtgctgcacgatatcggcgcgttctcactcacctcgtcagattcacaggcaatgggccgcgtgggggaagtgattatccgcacctggcaggtcgcgcaccgcatgaaggttcagcgcggcgcgctgccggaagagaccggcgataacgacaactttcgcgtgaagcgctatgttgccaaatacaccatcaacccggcgctgacccacggcattgcctatgaggtggggtcggttgaggcgggcaagctggcggatctggtggtctggtccccggcgttcttcggcgtcaagcccgccaccatcgtcaaaggtgggatgatcgcctgcgcaccgatgggcgatatcaacgcctctatcccgacgccgcagccggtgcattaccgcccgatgtttggctcgctgggcgccgcacgccacgccacgcgcctgacgtttatctcacaggccgccagtgcgaacggcatcccgcagcagctcaacttgcagagcgccacggcggtggtgaaaggctgccggacggtgaaaaaggcggacatgatccacaacgctctgcaaccgaacatcaccgtcgactcgcaaacctacgaggtgcgcgtcgacggcgaactgattaccagcgaaccggctgacgttctgccgatggcacaacgctatttcctgttttga

SEQ ID NO: 3410 - DNA, 474 bp, Enterobacter cloacae
ggagtgatgatgatttatctgacccaacgcctggaccacgcacacccgactaccgccagcgtcacgctgccgattgacgtgcgggtgaaaagccgcgcccgcgtggccctgaacgacggtcgcgaagccgggctgatgctgccgcgcggtttgctgctgcgcggcggcgatctgctgaccaccgacgacggcagcgaggtgatcgaagtgatcgcggccccggagtcggtttccgtggtgcgctgcgccgatccgttcctgctcgcccgcgcctgttaccacctgggcaaccgtcacgtgccgctgcaaattatgcccggcgagctgcgctaccaccacgaccacgttcttgacgacatgctgcgtcagttcgggctggaggtgaccttcgccagcctgccgtttgaaccggaagcgggggcttacaccagcgatgcccacagccatggccactcccacgctcattcacattaa

SEQ ID NO: 3411 - DNA, 888 bp, Enterobacter cloacae
tatttcattaacaacataacttattctgaaaaacaaaaaagccgtttaccccggaggaataaacggctttatcgaagcatgcatttcttaatgcagcacggtaaccgcatcttcaagacgtccggcccggtgcttaaccatcgcggaaatctgcgcgctctcttcgaccaggtcagcatttttctgcgtaatgctgtccagttctgccacggcacgggtcagctctgtcaggcctgtcgcctgctcggaggtggagtggctgatctgcgcgataagctgcgtgacgtttttcacctgctcgacaatatcatccatggtacgtcccgcggcgtggacctgatcggcgcccgactgcactttgctggcgctggcgtcgatcagcttacgaatatcgttagctgcattcgcgctgcggctggcaagatgacgcacttcgcccgccaccaccgcaaagcctttcccctgctcgcccgcgcgtgccgcctcaaccgcggcgttcagcgccagaatattggtctggaaggcaatgtcattgataagcgaggtaatagagccaatgcgctgggtactgtcggctatgtcatccatggttttcaccacggtctgcatcacggtgcccccctgcgtggccgcgctgctggcggccatcgacagcttgtcgacttcggctgcggtctcagagttactctgcaccgacgccgccatctggttcattgttgccacggtctgctgaacgttagccacggtctggcgcgtgcggtcgttgagatcttcattgccctgcgccagcctgtcgctaccgtcgcgcacgcttatcacctggctggagacgtcgttgatcaaccagcggcacatcagccccagctgtccgacggcccgcagcgttag

SEQ ID NO: 3412 - DNA, 1644 bp, Enterobacter cloacae
aaaaacgatcaaagtcataaagttagcgagtttcctgtcgataacagcgatcgtctgagaaataatcacatcgatggggtaaatatgttcatacatgacgtaaagatcggcacgaaattatttctggcgtttggattatttattgtcctgatggtcgtcagcgcaagcttgtctctgatgagcctgaatcgggcaaacaatggaatgcaaaccatccttaccagcgattatccaacgacggtaaaagcgaaccagttaatcgacaacttccaggaatttatcagcacgcagcagctcatgctgctggacgaacaggggacgtacacggcgcaatcagagcagcgtctgaaggcgatcagcgagcgcatcgccgcaatcctgagcgagctggacaacgctctcaaggataaaaaatcccaacaggtgctggccgatatccacggcgtgcgccagcaatatcttgactcgcgctaccgcattttgcaggccgtgcagaataatgaccgtgcgggcgcgataaacgaaatgatgaccaacaccctgaacctgcaacagtcctataaagcgaaagtgcaggcgttgattgcgatccaggaccatgaaatgcagagtgcgggcgagcaggtggaaggtgatttccgcaccaatcgtctcctgctgatcctgattacgctttttagcgtcgcggcagccagcctgactggctggttcattgtgcgatccattacccgcccgctgaacgacgcggtgaattttgcggaggccattgccgatggcgatctcaccggcagcattacctcgcacggtaaagatgaaaccggactgctactcaccgcacttatggagatgaaaacgcgcctgctggagattgtgcagcaggtgcaaaccggatcggaaaacatctccagcgccgccgcgcagattgtcgcgggcaaccaggatctggctgcccgcacggaagagcaggccagttccgttgaacagacggctgcgtcgatggagcagattaccgccacggtgaagaataccgcgtcccacaccggagaagcgacgaacctgtctgccgatgcggctgctgtggtcaaaaacaacggcgagatgatgaagcaggtcaccagcaagatgcgcctgatcaacgaaacatcgaacaggatgtccgacattatcgacctgatcgacgccattgccttccagactaatattctggcgctgaacgcggcggtcgaagcggcgcgcgcgggtgagcatggtcgtggctttgcggtggtggcgggcgaggtacgtcagctcgcgcagaaaagtgcaacatccgcaagtgagatccgccagctgattgaaagctccacaagccagacgcaggacggcatgaaccttgtggagaaggccagcgggcttatcaacggcatggtcggcaacgtggaagagatggacgtcatcctgcgtgagattcgccaggccagccacgaacagacggaaggcatctcgcagatcaacagcgcgattggcctgatagacgccaccacccaacagaactccgcgctggtggaggagtccgttgcggcggcggcatcccttaacgaacaggccatgcacctgaaggagctggtccgcgtgttccgcgtgagcgacggcgtgctggcttaa

SEQ ID NO: 3413 - DNA, 825 bp, Enterobacter cloacae
caatcattatcattaaaaattcattccgatatatcgtattcacctgagaagggcatcaacatggcatctacccgttaccctcaacgtgtccgcaatgacctgcgttttcgtgagctgaacgtgatgcgcactgagcgagtcagtgcaggatttcagcgcattgtgctaggcggcgaggcgctggagggctttagctctcgcggctttgacgaccataccaaagtctttttcccggcaccgggcaccactttcgtgccgcctgtggtgactgatgaaggcatcgactggggcgacggcgtgcgtccgcaggcgcgtgactataccccgctgtacgatgacgaaaaacatgagctggcgctcgatttcttcgttcatgatggtggcattgccagcaactgggcggtagaggcgaaggtgggcgacaagctgaccatcggtggtccgcgtggttcgctggtggtgccggaagattacgcctggcagctgtacgtgtgcgacgagtcgggcatgcccgcgctgcgccgccgtttagaaggcatcgcaaaactgcctgttcgcccggcgatccacgccatcgtcaccgtgggcgatgcggcgtaccaggactatctggcgcacctgagcgggttcaacatcacctgggttatcggccacaacgagcaggcggtggccgaccatcttgccgcgctggacgtgccggaagaggattactttatctggctcaccggggaggggaaggtggtgaaacgcctgagccgtcagtttgaaaccgacgcaattgacccgcagctggtgcgtgccagcgcgtactggcacgccaaataa

SEQ ID NO: 3414 - DNA, 390 bp, Enterobacter cloacae
ccaaaaagcaggcaggtcgtgatggatattgtatttatagagcaactttcggtaatcaccacaattggtgtttacgactgggaacagaccatcgagcagaaactggtgttcgatatcgaaatgggctgggataaccgcaagtcagcgaaaagcgatgatgtgaatgattgtctgagctacgccgacatcagtgaaacggtcatcggccatgtggaagggcaacgatttgcgctggtagaacgcgtggcggaagaggtggcagacctgctgctgagcaaatttaactccccgtgggtgcgcattaagctaagcaagccgggcgcggtggcgcgcgccgccaacgtgggcgtgattatcgagcgtggcacaaatctgaaaggaaagatttaa

SEQ ID NO: 3415 - DNA, 822 bp, Enterobacter cloacae
atgagcgatatgcactcgctgctggtggcggcaatactgggtgtggtcgaaggattgacggagtttttgccggtgtccagtacgggccatatgattatcgttggccatctgttgggctttgaaggcgataccgcaaagacgtttgaggtggtgatccagctgggctctatcctggcggtggttgtgatgttctggcgtcgtctgtttggtctgatcggcatccacttcgggcgtttgccgcagcgtgaaggagagggcaaggggcgtctgacgctgattcatattctgctcgggatgatcccggcagtggtgctggggctggtgttccacgacaccattaaatcgctcttcaacccgattaacgtgatgtacgcgctggttgtcggcggcttcctgctgattgccgccgaagtgctgaagccaaaaaccccgcgtgcggaaggtctggacgatatgacgtatcgtcaggcgtttatgattggctgcttccagtgtctggcgctgtggccgggcttctcccgttcaggggcaaccatttccggcgggatgctgatgggcgtgagccgttacgcggcgtctgagttctcgttcctgctggcggtgccgatgatgatgggcgccaccgcgctggatctctacaaaagcatcggcttcctgaccgtgggtgacattccgatgttcgccgtgggctttatcaccgcctacattgtggcgctgatcgccatcaaaaccttcctgcaactgattaagcgtatttcgtttattccgttcgcgatctaccgctttatcgtcgcggctgccgtgtacgtggtcttcttctga

SEQ ID NO: 3416 - DNA, 1512 bp, Enterobacter cloacae
agaactatgtcgcccaggaatgaatatccgctggacgatgacaccacgcttatgtcgaccaccgacctccacagctacatgacccacactaacgacacctttgtgcaagtgagcggctttacgctccaggagctgctcgggcaaccgcacaacattgtgcgccatccggatatgccgaaagcggcttttgccgacatgtggtacacgctgcaaaagggcgagccctggagcgggattgtcaaaaaccgacgtaaaaatggcgatcactattgggtacgcgccaatgcggtaccgatggtgcgtaacggccagatgacgggctatatgtccattcgtacccgcgccaccgaggacgaggtcgccgcagtggagccgctttataaggcgctcaacgaaggacgtagcaaaaaacgcattcataaagggctggtggtgcgcaaaggctggctcggcaaattaccggcgatgccgctgcgctggcgcgtgcgcagcgtaatggcggtactttttgcggtgatggccgcaacgctggttgccagtgctgcgggctgggcttcgctggtggcggcagccgtgttgatgctgcttggcaccctggtgtttgagcaacagattgtccgcccggtggaaaacgtcgcacggcaggcgctcagggtcgctaccggagagcgtaacagcgtgcagcatcttaaccgcagcgatgaactggggctaacgctgcgggccgtcggacagctggggctgatgtgccgctggttgatcaacgacgtctccagccaggtgataagcgtgcgcgacggtagcgacaggctggcgcagggcaatgaagatctcaacgaccgcacgcgccagaccgtggctaacgttcagcagaccgtggcaacaatgaaccagatggcggcgtcggtgcagagtaactctgagaccgcagccgaagtcgacaagctgtcgatggccgccagcagcgcggccacgcaggggggcaccgtgatgcagaccgtggtgaaaaccatggatgacatagccgacagtacccagcgcattggctctattacctcgcttatcaatgacattgccttccagaccaatattctggcgctgaacgccgcggttgaggcggcacgcgcgggcgagcaggggaaaggctttgcggtggtggcgggcgaagtgcgtcatcttgccagccgcagcgcgaatgcagctaacgatattcgtaagctgatcgacgccagcgccagcaaagtgcagtcgggcgccgatcaggtccacgccgcgggacgtaccatggatgatattgtcgagcaggtgaaaaacgtcacgcagcttatcgcgcagatcagccactccacctccgagcaggcgacaggcctgacagagctgacccgtgccgtggcagaactggacagcattacgcagaaaaatgctgacctggtcgaagagagcgcgcagatttccgcgatggttaagcaccgggccggacgtcttgaagatgcggttaccgtgctgcattaa

SEQ ID NO: 3417 - DNA, 519 bp, Enterobacter cloacae
acaggagtagagatgatcaacgatattctggcccctggcctgcgggtggtgttctgcggtattaatccgggcaagtcatcggcgcacaccggttttcactttgctcatccgggaaatcgcttctggaaggtgatccaccaggccggatttaccgacaaacagcttaagccggaagaagagcagcagctgctggatacgcgctgtggcatcaccatgctggtcgagcgacccacggtgcaggcgagcgaagtgaatctgcatgagctgcgcgctggcgggcgtgagctgatcgcgaaaattgaagactatcagcccgcggcgctggcgatcctcggcaagcaggcctacgagcaggcgttcagccagcgcggtgtgaagtggggtaagcaggacattaccattggcgtaacgcaggtttgggtgttgccgaaccccagcgggctgaacagggcgacgctggacaagctggtggaggcgtatcgggaacttgatgaggcgcttgtggtgagggggctttag

SEQ ID NO: 3418 - DNA, 1323 bp, Enterobacter cloacae
cgcacgcaaaagtacaaggctatggcacaagagatcgaattaaagtttatcgtcgaaaaagacagcgctgacgcgctccgccagcatctgaatacgctgtccggcgagcaccatgaacccgtacagctgctcaacatctattacgaaacgccggacaactggctgcgcaaccatgatatgggcctgcgcatccggggtgcgaacgggcgctacgagatgacgatgaaaatcgccggtcgcgtggtgggcggtttacaccagcgtccggaatacaatatcgacatcagtaagccagaacttgagctggatcgttttccggcggaagtgtggccggaagggatgctgcccgcaacgctgtcggcagaggcgcaaccgctgttcagcaccgatttctggcgcgagaaatggctggtgacggaaggcaagagccgcattgagatcgcgtttgatcggggtgaaattaaggctggtgaagagcaggagccgatctgcgaattggaactcgaactgcttgaaggcgacgcgagcgatgtgctgaagctggcgcgcaagctggtgaaccagcctggactgcgtcagggcagcctgagtaaagcggcacgcggctatcacctggccgccgggaatgcgccgcgcgtgctgcgagaaaccccgattctgcgcgttgtgccgaaagcctccgttgagcaggggatggaagcggcgctggagctggcactctctcagtggcagttccacgaggagctgtgggcgcgtaacgtgaaaaatgccaaaaaacaggtgctggccgctatggggctggtacgtcataccctgacgctctttggcggcattgtaccgcgtaaagccagcactcacttacgtgatttgctcactcaaaccgaaacgctgatgctttccgacgtgtcggcacaaacggcgatctacagcccgcaaaacgccagcgcgaaactggcgctgaccgaatttctggtgacgcgcggctggcgcaccttcctcgatgcgaaagggcaggccaaaattgcggaaaacttcaaacgttttgcggatatccacctctcccgtcacgcggccgaactgagaaccacctttgcgcatccgctgggcgaccagtatggcgatcagcttccccgcctggcgcgtaacatcgacagcatgttgctgctgtcgggtgcgtatgagggcgtgaaggcgcaggcctggctggagaactggcaggggcttaagcatgccatcgagacccgtcagcagattgagatcgagcatttccgcaacgaggccatttcgcaggatccgtactggctgcacagcggaaaacgttaa

SEQ ID NO: 3419 - DNA, 2877 bp, Enterobacter cloacae
ttctggcaaggaacccctgatatgccgctttcttcgcagttacagcagcactggcagaccgtttgcgaacgcctgcctgagtcgttacccgcgtcatcgttaagcgagcaggcgaaaagcgtgctcacgttcagtgattttgtgcaggagagcgtcagcgctaacccggactggctggcagagctggaaagcgcgccgccgcaggctgacgagtggcggcattatgctggctggctgcaaaccgcgctggcagaggtggcagacgaagccacgctgatgcgcgttctgcgtcagttccgccgccgggtgatggtacgcattgcctgggcgcaggcgctggagctggtgagtgaagagagcaccttgcagcagttgagcgagctggcgcagacgctgattgtcgccgcgcgggactggctctacgccgcctgctgtaaagagtggggcacgccgtgcagcgaggaaggggttcctcagccactgttgatcctggggatgggcaagctgggcggctgcgagctgaacttctcctcagacatcgatctgatttttgcctggcccgagaacggctccacacgcggcggccgtcgcgagctggacaatgcccagttctttactcgtctggggcagcggctgattaaggcgctggatcagcccacgcaggatggttttgtttaccgcgtggacatgcgcctgcgtccgtttggcgacagcgggccactggtgctgagctttgccgcgctggaagattactaccaggagcagggtcgcgactgggagcgttacgcgatggtcaaagcgcggatcatgggcgacagcgacgatgcctacgccaacgagctgcgcgccatgctgcgcccgttcgtgttccgccgctacatcgacttcagcgttatccagtccctgcgaaatatgaaagggatgattgcccgcgaggtgcgtcgccgtggcctgaaagacaacatcaagctcggtgctggcggtattcgtgagatcgaatttatcgtccaggtcttccagctgatacgcggcgggcgtgaaccttctctgcaatcccgctcgctgctgccgacgctaagcgctatcgatcagctgcatctgctgccggaaggcgacgcgcaaacgctgcgtgactcttatctcttcctgcgtcgtctggaaaatttgctgcaaagtatcaacgacgaacagacccagacgttgccgggcgatgagctgaaccgggcgcgtctggcctgggggatgcgggtggatgactgggcggcgctgacgcaacggctggaagcgcatatggcgggcgtgcgccgcatctttaacgatctgatcggcgacgacgaaactgaatcgcaggacgatgcgctctccgagcactggcgcgaactgtggcaggacgcgcttcaggaagatgacaccacgccggtgctggcgcacttaagcgacgatgcccgccatcgcgtggtggcgttgattgccgatttccgcctcgaactgaacaaacgcgctatcggcccacgcggtcgtcaggtgctggatcatctgatgccgcatctgctgagcgatgtctgctcccgcgacgatgcgccggtgccgctgtcgcgcatgatgccgctgctgagtgggatcgtcacgcgtaccacttaccttgagctgttaagcgagtttcccggtgcgctgaagcacctgatttccctctgcgccgcctcgccgatggtggcgaacaagctggcgcgttatccgctgctgctggacgaactgctcgacccgaataccctctatcagccgacggcgacggatgcctaccgcgacgagctgcgtcagtatctgctgcgcgtgccggaagaggacgaagagcaacagcttgaggcgctgcgtcagtttaagcaggcacagatgctgcgcgtggcggcggcagatatcgccggtaccctgccggtaatgaaagtgagcgatcacttaacctggctggcggaagcgatcatcgacgcggttgtccaccaggcgtgggtgcaaatggtagcccgctacggccagccgaagcaccttgctgaccgtgaaggccgcggttttgcggtggtggggtacggcaagctgggcggctgggaactgggctacagctccgatctggatctgattttcctccacgactgtccggcagacgtcatgaccgacggcgaacgtgagattgacggacggcagttctacctgcgcctggcccagcgcatcatgcacctgttcagcacccgcacctcatccggcattctgtatgaagtggatgcgcgtctgcgcccgtccggcgcggcaggcatgctggtcacctcgacggaggctttcgccgactatcagaagaacgaagcctggacgtgggagcatcaggcgctggtgcgcgcccgcgtggtgtatggcgatccgcagctcaaaacgcagttcgatgcgatccgcaaggcggtcatgacgaccccgcgcgagggcagtacgctgcaaaccgaagtgcgggaaatgcgggagaagatgcgcgcgcaccttggcaacaaacatcgcgatcgctttgatatcaaagccgatgaaggcgggattaccgatattgagtttatcactcagtacctggtgctgctgcacgcgcacgataagccgaagctgacccgctggtcggataacgtgcgcatactggaactgctggcgcagaacgacattatggatgagcaggaggcgcaggccttaacccgcgcctacaccacactgcgtgatgagttgcaccatctggcattacaggaacagccgggccatgtggcgctggactgtttcgccgacgaacgcgcgcaggtgactacaagctggcagaagtggctagtggaaccgtgcgtaacaaaacaagtgtga

SEQ ID NO: 3420 - DNA, 1032 bp, Enterobacter cloacae
aacgaggtaaaacaagtcatgcgtgtactgggtattgaaacatcctgcgatgaaaccggcatcgcgatttacgacgacgaaaaagggcttctggccaaccaactgtatagtcaggtgaaattgcacgctgactacggcggcgtcgtgcctgaactggcctctcgtgaccacgtgcgtaaaacggttcccctgatccaggcggcgctgaaagaggccgggttgagtgcaaaagatattgatgccgtggcctataccgcaggaccgggcctggtcggcgcgctgctagtcggcgcaacggtagggcgttcactggccttcgcgtgggatgttccggccattccggttcaccatatggaagggcaccttctggcgccgatgctggaagacaatccgccagcgttcccgtttgtggcgctgctggtttccggtggtcatacccaactgatcagcgtaacgggtattggcaagtatgagctgctgggcgagtcaattgacgatgcagccggtgaagccttcgacaaaaccgccaagctgctggggctggattacccgggcggcccgatgctctcgaaaatggccgcacagggcacggaagggcgctttgtcttcccacggccgatgactgatcgtccggggctggatttcagcttctccggtttgaaaaccttcgcggcgaacaccatccgcaataacgacgacagcgagcagacgcgtgccgacatcgctcgtgcgttcgaagatgcggtggtggatacgctgatgatcaagtgcaaacgcgcgctggatcagaccggctttaagcgcctggtgatggcaggcggcgtgagcgccaaccgtacgctgcgcgcgaagcttgcagagatgatgcaaaagcgtcgtggggaagtgttctacgcgcgtcctgaattttgtaccgataacggggcgatgatcgcctacgccgggatggtgcgcctgaacgctggcgcaacggctgacctgagcgtgtccgtgcgtccgcgctggccgctggcggagctgccggaggcgtga

SEQ ID NO: 3421 - DNA, 1449 bp, Enterobacter cloacae
atctttctggagtcaggaatgaaagtaacactgccagagtttgaacgtgctggagttatggttgtcggtgatgtgatgctggatcgctactggtatgggccgaccagccgcatctctccggaagcaccggtaccggtggtaaaggtcgacaccattgaagagcgtcccggtggcgcggcaaacgtggcgatgaacatagcctctctgggcgcacattcgcgtctggttggcctgaccggcattgacgatgcggcgcgtgcgctgagcaagtcgctggcggacgtgaatgtgaagtgtgacttcgtttctgttccgacccacccaaccatcaccaagcttcgcgtgctgtcgcgtaaccagcagctaatccgcctcgactttgaagaagggttcgaaggcgttgatcccgagccgctgcacgagcgcattaaccaggcgttgggcaatattggcgcgctggtgctgtctgattatgccaaaggcgcgctggcgagcgtgcagaccatgatccagctggcgcgcaaagccagcgttccggtgctgatcgacccgaaaggcaccgattttgagcgctatcgcggcgcaaccctgctgacgccaaacctctctgaattcgaagcggtggcgggcaagtgcaaaactgaagaagagctggttgagcgcggcatgaaaatcatcgctgatttcgagctgtctgcgctgctggtgacccgttccgagcagggcatgacgctgctgcaaccgggcaaggcgccgctgcatatgccaacccaggcgcaggaagtgtacgacgtgaccggtgccggtgatacggtgattggcgtgctggcggcgacgctggcggcgggtaactccctggaagaagcatgctacttcgcgaacgccgcggcgggcgtggtcgtcggtaaactcgggacctccaccgtttcgccaattgagctggaaaacgcggtgcgtgggcgtgcggataccggctttggcgtcatgaccgaagacgagctgaaagtggccgttgccgccgcgcgcaaacgcggtgaaaaagtggtgatgacgaacggcgtgttcgacatcctgcatgcgggccacgtgtcgtatctggcgaatgcgcgcaagctgggcgaccgcctgattgtggcggtcaacagcgatgcctcaaccaaacgtctgaagggtgaaacgcgtccggttaacccgctggagcagcgcatgatagtgctcggcgcgctggaagcggtggactgggtggtctcatttgaagaagacaccccgcagcgcctgattgccggaattttgcctgacctgctggtgaagggcggtgattacaaaccagagcaaatcgcaggtagcgaagaggtctgggcgaatggtggtgaagtaatggtgctcaactttgaggacgggtgttcaaccaccaacatcattaagaagatccagaaagacagtcagtaa

SEQ ID NO: 3422 - DNA, 666 bp, Enterobacter cloacae
ggtttttttaccatgaatcagacgctactttcctcttttggcacttcaactcaacgtgttgaacatgcactggatgccctgcgcgaaggccgcggtgtgatggtgcttgacgatgaaaaccgtgaaaacgaaggcgacatgatttttgccgccgagaacatgaccgttgagcagatggcgctgaccatccgtcacggtagcggcatcgtatgcctgtgcatcaccgaagaccgtcgccagcagcttgatctgccgatgatggttgaaaacaacaccagcgcctttggtactggcttcactgtgaccattgaagcggcgcatggcgtaaccaccggtgtgtcggcggctgaccgtctgaccaccgtgcgtgcagcgattgctgatggtgcgaaaccttccgatctgcaccgccctggtcacgtcttcccgctgcgcgcgcagccgggcggcgtgctgacccgtggtggtcataccgaagcgaccatcgatctggtgacgctggctggcttcaaacccgcaggcgtgctgtgcgaactgaccaacgatgatggcaccatggcgcgtgcgccggagtgcatcacctttgcgcgtctgcacaatatgccagtggtgacgattgaagatctggtagagtaccgccgcgcgcacgagcgcaaagccagctga

SEQ ID NO: 3423 - DNA, 825 bp, Enterobacter cloacae
gcctatcacattgacacctcctctaaggatatcaccatgtcttcttctcgtatgccagcactgtttttaggccatggcagcccaatgaacgtcctggaagataacgtctatacccgcgcctggcgtcagttgggtgagacgttaccgcgtccgaaggcaattgtggtggtctctgcgcactggtttacccggggtaccggcgtgacggccatggaaacgccaaaaacgattcatgattttggcggctttccgcaggcgctgtatgacacgcattatcctgcgccgggctcccctgagctggcgcagcggctggttgatctgcttgcccctgttccggttgcgctggacaaagaagcctggggctttgaccatggctcatggggggtgttgatcaaaatgtatccgaatgccgatattccgatggtacaactgagtatcgacagcaccaaaccagctgcctggcacatggagatggggcgtaagctggcttcgcttcgtgatgagggcatcatgctgattgccagtggcaacgtggtacacaatctgcgtacggtacgctggcacggtgaaaatacgccgtacccctgggcaacagcctttaatgactatgtaaaagacaacctggcctggcaagggccggtcgaacggcaccctttggtgaactatctggagcacgatggtggttcgctctctaacccgacgccggaacacttcttgccattgctgtatgtattaggcgcatgggacggtcaggaggttattacaaccccggtcgacggcattgagatggggagcttgagtatgctgtcggtgcaggtggggtaa

SEQ ID NO: 3424 - DNA, 906 bp, Enterobacter cloacae
actgacagtctgattaatcacctgtttacggccatgtctctcgtttacgacacctttgaaacgttacgccaacaaaatgcggtgctgcgggaaaccgtcgcgctcaatactggcattcaactggcggcgtggtacaacaagcacgacacgatcaccgtgaaaagcaaccatcacacccttagcctgtacgtggcagatggctatgaaagctatcaaaaaacgccgggtggctggaaaaatggcggtgggccggatcgtttttgtctgatgccggaagagagcgaatccacgtgggatattcgtgacgacctgtcgttcgtgcacctctactgcaccgatgaacacctgcgggacgtgggggagaaaatctgggataaacgaccgctatcgctgacgctggaggaaaaaatattcggcagcgatccgaaaatcaccgccctttatcgccagtttttgctcggctgcgactggcagcaaaacgccaatcagctcaccctgagcaccgcgtcgaccttattgctgacgcatttagtccagcactattccagcgtacagtggaagctgccggtagtgaccggcgggttatcgccgtttgtgctgcgcaacgtgctggcctttatcgaggaaaacctggcgcaacccttaacgctggcggaactggcgggccaggccgcactcagtgagtatcactttgcgcggatgttccgccagtcgatgggcctggcgccgcatcagtacgtcatgcagcgccgcatggagaaggccaaagcgatggtgcagcacacgaccacgccgctcaccgacatcgcgctggcctgcggatttaactccgccagccatttcagtaaccgttttcgcagcatgaccggcattacgccgtcacagctacgcgcggcgaaggcgtga

SEQ ID NO: 3425 - DNA, 1386 bp, Enterobacter cloacae
atcctgcctctgcaacctggcaccctttttgctctcctgaaactgacgttactttttctgcgtccgggcggtaacggacgtcttcgcacagctttctttttcaggagtgaaaatatgcaccgtcgtacctttataaaagcgttcgccttgtccgcctccgtggtcgccatggggttcagttttggcgtccaggccgcagagaccattaaagtcgggatcatgcactcactctccggcacgatggccatttcagaaacgcccctgaaagatgtcgccctgatgaccatcgatgaaattaacgccaaaggcggcgtgctcgggaaaaagctggagccggtggtggttgacccggcctccaactggccgctgtttgccgaaaaggcccgccagcttctgagccaggataaggtcgccgtggtgtttggctgctggacctccgtatcgcgtaaatcggttctgccggtttttgaggagctgaacggtttgctgttctatccggtgcagtacgaaggtgaagagatgtcacctaacgtcttctataccggcgcggcgcctaaccagcaggcgatcccggcggtggagtacctgatgagcgaggacggcggcagcgcgaaacgcttcttcctgctgggaacggactacgtttacccgcgcaccacgaacaagatcctgcgcgccttcctgcactcgaaaggcgtggaagataaagatattgaagaggtctacaccccatttggtcatagcgattaccagaccatcgtcgccagtatcaagaaattctctgcgggcggtaaaacggcggtggtctccaccatcaacggtgattccaacgtgcctttctataaagagctggcgaaccaggggctgaaagccacggacgtgccggtggtggcgttctcggtgggcgaggaggaactgcgcggcattgataccaagccgctggtgggtaacctggcggcgtggaactactttgaatccgtcgataacccgaccaaccagacctttgtcgcggcctacaaagcctacgcgaaagcccataagctgccgaatgccgataccgtcgtcaccaacgatccgatggaagcgacctacgtcggcctgcatatgtgggcgcaggcggttgaaaaagcggggacaaccaacgtggacaaagtgcgcgcggcaatggcgggccagtcgttcaacgcgccgtccggctttacgctgaccatggatgccaccaaccaccacctgcataagcccgtcatgattggtgaaatcgaaggcaacggccagttcaacgtcgtctggcaaaccgaacagccggtacgcgctcagccgtggagcccgtttatcgccgggaatgacaaaaaacctgaccagccgatgaaaaccgccagcaactaa

SEQ ID NO: 3426 - DNA, 1092 bp, Enterobacter cloacae
agggagggtgacagactgatgagccagccattgaccttaacactggcgcgcagggcaccgcgcaccgcgcaaatcttcggcagtctgctggttgcggcgctgctggtgctgccttttctcgcgctgttacccgcaacgcatccgctggccgtttctacgtggatgttgacgctcatcggcaagatcctctgctacgcagttgtcgccgtggccctcgatctggtctggggctatgccggtatgctctcgctggggcacggcatattcttcgccctgggcggctatgcgatgggcatgtacctgatgcgccaggcggccggggacgggctgcccgcgtttatgtcgtttctctcgtggagcgaactgccctggttctggtggggaacgcagcattttgcctgggctctggtgttaattgtgacgatccccggcctgctggcgctggtcttcggctggtttgctttccgctcgaagatcaaaggggtctatttctccatcatgacccaggcgctgacctatgcgggcatgctgctgttctttcgcaacgaaaccggctttggcggcaataacggctttaccggctttaccacgctgctcgggttttccgtcacggcgactaccacgcggatcgcgctgtttctcgcaacggtcatgctgctgctgctggccctgggcataggctacgcgctggcgaagagtaaatttggccgcattttaacggcggtgcgcgatgcggaaaaccgtctcacgttctgcggctacgatccgcgcggtttcaagctgctggtgtggacgctttccgccgtgctgtgtggcctggcgggggcgctgtacgttccgcaggtgggtattatcaacccgggtgaaatgtcgccgaccaactcgattgaagcggccatctgggtggcgctgggcggccgcggcacgctggtgggcccggtgatgggcgcggcgctcgtcaacggtgcgaagagctttttcaccgtggcgatgccggagtactggcagctgtttctggggctgattttcatcgccgtgacgctgtttttaccacgcggcgtgttcggtctgtttcgtaagggagagaattaa

SEQ ID NO: 3427 - DNA, 681 bp, Enterobacter cloacae
ggactgcggtgcattatgttggatttgattaaagcagtggggcttgggctggtggtgttgctgccgctggcgaacccgttaacgacggtggcgctttttctggggctggcggggaacatgaacagcgcggagcgcaatcagcagtcgatgatggcctctgtgtacgtctttgccataatgatggtggcttattacgccgggcaactggtgatgaatacctttggtatttcgattcccggtctgcgtatcgctggcgggctgatcgtggcctttattggtttccggatgctgttcccggcgcacaaagcgcacgaatccccggaagccaaaagcaaatcggaggagcttgaaagcgaaccgagcgccaacatcgcgtttgtgccgttagccatgccgagcacggcagggccgggaacgattgcgatgatcatcagttccgcctcaacggtgcgtgatgggtcgacatttccgcactgggttatcaccgttgcgccgccgatcatttttgcgcttattgccattattgtctgggggtcattgcgcagttccggggcgattatgcgctgggtgggcaagggggggattgaagctatctcccgtctgatgggcttcctgctggtctgtatgggcgtgcagtttattattaacggcgtgctggagattgttaagacgtatcattga

SEQ ID NO: 3428 - DNA, 849 bp, Enterobacter cloacae
cgaacgcggttgttttcattgaagataaagaacaacacaacaaaaacaggcggtaacacaatgcaggagattgatttttatctggtagatgcgttcagcgcgtcctcctttggcggcaacccggcggcggtgtgccccctcgacgcgtggctaacggatgagacgttactgcggatggcacaacagcataaccagtcggaaaccgcgttttttgtgtgtaccaaaggggggatcgagttgcgctggttcaccacgctaaccgaggttaatctgtgtggtcacgcgacgcttgccgcggcgtatattctgtttaacgaactggattatccggactcacgccttcattttgacactgcctctggtcgcctgaccgtcagccgtgaaggtgactggatgacgctggacttcccggcctgcccgacgcaggcgcagacgccgccaccggagttgctcaccgcactcggtatcagccactacgtcgaggcgcgaaaaggccgcgcctgggtgctggtactggagagccgcgagcaggtggaagccattaatccggatttctccgccatgacgccgggggagcataaagtggccgtcaccgcccgggacgaaggagaatacgactttatcagtcgtttcttctcgccgggcgtggccgtgccggaagatcctgtcaccggctccgcgcacaccatgctgatcccttactggagtgaacggcttggcaaaacacagatgtttgcccgccaggtttccgcccgtggaggagacgtacgctgcgaactcaagggcgaccgcgtgcggatgggcgggcaggcggcgctgtatctgaagggcacagtatttctgcgctga

SEQ ID NO: 3429 - DNA, 1428 bp, Enterobacter cloacae
cagagtaggccacaatcaatcaactgttattacgtggaggacatcatgacgtattcatctgctacccatgcccactctgtcaacccggctaccggcgaaacgctggctgcttacccgtgggcaacgtcccgtgacgttgagcgtgccattgcacaggcggataccggttttcgtcaatggcgacgcgaaagcgtggcgcaccgggcgcaaaaacttcgcgatctgggtgcggcactgcgtagccgtgcggaagagatggcgcagactatctcccgggagatgggcaagcccattgtgcaggcgcgtgcggaggtggctaagtccgccagcctttgcgactggtacgctgaacacggcccgtcgatgctgcacccggaatcaacccaggtcgaaaatgcggtgattgagtaccgtccgctgggacctattcttgcggtgatgccgtggaatttcccgctctggcaggtgctgcgcggtgcggtgccgatcctgctggcagggaacagctatctgcttaaacatgcgccaaatgtgctcggctcggcggagctgatcgggaaggtattcgcggatgccggtttcccggagggggtctttggctgggtgaacgcgacgaatgacggcgtcagccaggcgattaacgatcggcgtatcgcggcggtgaccgtaaccggcagcgttcgggctggtgcggcaattggcgcgcaggcgggcgcggcgctgaagaaatgcgtgctggagctgggcggttccgatccgtttatcgttctgaacgatgcggatcttgatctggccgtcaacgcggcggtggccggacgttatcagaataccggacaggtttgtgcggcggcaaaacgctttattgtggaagcgggcgtagcggacgcctttacccaacgctttgttgacgcggtcaaggcgctgaagatgggcgcaccggatgaggaagataactatattggcccgatggcgcgatttgatcttcgcgatgaactacatcagcaggtgcaggctacgctggcggaaggggcgaccctgctgctcggcggagagaagcttgccgggagcggtaactattatgcgccaaccgtactcggcggcgtcaccccacagatgacggccttccgtcaggagctgtttggcccggtggccgcgattaccgtcgccaatgatgcggcgcacgcgttgcagctggctaacgacagcgattttggcttatcggcgacggtctttaccgcgaacgatgcgctggctgaaaccttctctcgcgagctggagtgcggcggagtctttatcaacggctatagcgcaagcgatgcgcgcgttgcctttggcggagtgaagaagagcggcttcgggcgagagctgtctcatttcggtctgcatgagttctgtaatgtgcagacggtgtggaaggaccgcatctaa

SEQ ID NO: 3430 - DNA, 948 bp, Enterobacter cloacae
cctgagggcaaggagcaaagtgtggctgcggtcatccataatgagatgctggacgagattctggcgcaggttcgtccgttactggggcagggtaaggttgccgattacattcccgcgctggcctcgatcagcggtaataagctcggcatcgccatttgtactgtcgacgggcagcgttttcaggcgggagacgcgctggagcgattttctattcagtcgatctcaaaagtgcttagcctcgttgccgccatgcgccagtatgacgagcaggagatctggcagcgggtgggcaaagatccgtccggtcagccgtttaactcccttcttcagctggaaatcgaacagggtaagccgcgtaacccatttattaacgccggggcgctggtggtgtgcgatatgctgcaaagccggctgagcgcgccgcgccagcggatgctccagattgtgcggcagctttccggcatgcaggacatcggctacgatccggtggtagcgcgctctgagtttgaacactctgcacgtaacgccgccatcgcctggctgatgaagtccttcggcaactttcataatgacgttgccacggtgctgcaaaactattttcattactgcgcgctgaagatgaactgcgttgaactggcgcagacttttctgtttctggcgcatcagggccatgcccctcatctgggcgaggacgttgtctccccgatgcaggcccggcagatcaacgccttaatggcaaccagcggaatgtatcagaatgccggggagtttgcctggcgcgtggggctgccggctaaatccggcgttggcggtggggtcgtggcgattgtcccccacgagatggcgattgccgtctggagcccggaactggacgagaccggaaattcactggcgggcgtagcggcgctggaacagctgaccaaacgtcttggacggtccgtatactga

SEQ ID NO: 3431 - DNA, 987 bp, Enterobacter cloacae
tgctcagcgtcaggagacgttatgaaggcacctcaaattcccgttaatgaagcggagcgcatgaatgcgctgcgcgaatccggtctgcttgagatcgacaattatcccgcgtttgatcgtcttacgcggctggcaacacgctttttcagggtgccgctggcgatgattacgctggtggatgaccacgccgcgatcgtgaaatctgctgacggccgggcactcgccagccagcctcgcgacctctcgttttgcggtcatacgatcctgggtgacgcgccgctggtggtgagtgacacgctgctggacgaacgcttcgcggataatccgcaggtggcgggagatccgggcgtgcgcttttatgccggtttcccgctgcgtttacgcgacggggcgtgcgtaggatcgttgtgtctcattgattacgcgccgcgggagtttaccgcggcggatgccgccgtactggccgatctcagcgcgctggcggaggatgaatttgcagccgttagcgccgccacgaccgatgaactcacgggattgtttaaccgtcgcgggtttaaccagtttgcgcagtttgcactgtcggtttcgcagcgtcgggcagaaccgttaacccttggctggctggatctggaccatttcaaaaccattaacgatcgcttcggacatcaggagggtgacaaagctctgaaagcgatggccgccctgatgcgttcctcgttccgcgaggccgatctgctggtacgtttcgggggagatgagttcgcggtgctgtttgcggataccgatgagcctggcgcctggatcgccatgcagtatctcgtcgaacaaacggaaaagtataacgcgcgtcagctgcatccctggtcgttacagttctcctgggggctgagcgagttcgatcaccaccgcaacgatattcaggcatggttaaaacacgcggatgcgcaaatgtacgccatgaagcggcaacaccacggcgaaaaatga

SEQ ID NO: 3432 - DNA, 1464 bp, Enterobacter cloacae
aggacctccattgtgaacactctcaaccgtcgtgattttcccggtgcgtgctaccctgaacgtatcatccagtttggcgaaggtaacttcctgcgcgcgttcgttgactggcaaatcgacctcttaaacgagcataccgatctcaatgccggtgtggtgattgtgcggccgatccagagcgattttccgccgtcgctgagcacccaggatggtctgtataccaccattattcgtggtctgaatgagcagggagaagcggtaagcgatgcgcgtcttattcgttccgtaaatcgtgaaatcagcgtctacagccagtacgatgaatttctggcgctcgcccataacccggacatgcggtttgtcttctccaataccacggaggcgggcatcagctatcatgcgggggataagcttgacgatgcgcctgctgccagctatccggccaaactgacgcgtctgctgttcgaacgctttacccactttaacggggctgcggataaaggctggatcattattccttgtgagcttatcgactacaacggcgatgccctgcgtgaactggtgctacgttatgcacaggagtgggcactgccggcggcattcattgcgtggctgaatgatgctaacactttctgttcgacgctggttgaccgcattgttaccggctatccgcgtgatgaggtggcagagctggaagccgggctgggctatcacgacagcttcctcgacacggcggaacatttctatctgtttgttattcaggggccgaaatcacttgcagctgaactgcgcctggataaatacccactcaacgtcctgattgttgacgatatcaaaccgtataaagagcgtaaggtggcgatcctcaacggcgcgcacacggcactggttccggtcgcttttcaggccggcctggatacggttggggaagccatgaacgacgcggaaatttgcgcgttcgtagagaaagctatttatgaggagattattccggtcctggatctgccgcgcgacgagctgcactccttcgccagtgccgtaacggggcgtttccgtaatccgtacattaagcatcagctgctgtcgattgcactgaacgggatgaccaagtaccgcacccgtattctgccgcaactgctggcagggcagaaggcgaccggcaaattgccagcacgtctgacctttgctctggcggcactgattgcattttaccgtgccgagcgcaacggtgagcgctatccggtgcaggacgatgcgcactggcttgaacgttaccagcagttgtggacgcaacatcacgacaaacaggtcactacccgtgaactggtatcgtcggtgttaagcgtgagcgaacactgggaacaggatctcactctggttaacggactggtaaagcatgttgcgctggatctggatgcgattttaagcaaaggcatgcgcgatgcggtgaaaccgctctgctaa

SEQ ID NO: 3433 - DNA, 963 bp, Enterobacter cloacae
gggggatcacgtttaatagccgcgctctttacttttctgaagctgattatgattgttcgtcttcaacagcactggctgcaactgatttttgtctggcatggttcggtacttcccaaaatttatacccgactgctgcttaacttcctgctttccatcgccgtgattgtcatgctgccgtggtacacctcgctgggtatccggtttaccgtcgcgccgttcagcattctgggtgtggctatcgccatcttcctggggtttcgcaataacgcctgttattcgcgctacgttgaggcgcgtctgctttgggggcagttgatgatagcggcgcgctcgctgtttcgcgaggtaaaaaacaccttgccggatgataaacatcttggagagtttgtccgcctgcaaatcgcgtttgctaactgtctgcgaatgactctacgcagagaaaccaatgccgatcagctgtcccgctatctggctccagacgatttacgcaaagtgatggacgccaactcgccggcgaaccgtatcctgctgatcatgggggagtggctggccgtgcggcggcgtagcgggcacctttcagacattctgtttcacagcctcaacaaccgcctgaatgatatgtccatcgtgctggctggctgtgagcgtatcgccaatacgccagtcccgtttgcctatacgctgatcctgcaccggacggtgtatctgttctgcatcatgctgccgtttgcgctggtcgttgatctgcattacatgacgccctttgtctctgcactgatttcctacacctttatctcgctggacacgctggcggaagagctggaagatccgtttgggacggaagataacgatctgccgctggacgccatctgcaacatgatggagcgcgatctgttgcagatgaacgatgaagagaacatccctgaaagactgatgccggataagcattatcagctgacctga

SEQ ID NO: 3434 - DNA, 1296 bp, Enterobacter cloacae
atgacgctgtggccccgcaccttactggcccggctgctgatcattgtgctgcttggactcttactggctaacgcgctcagcctgacgctggtcatggttgagcgaatgcacagcgcgcgcacggttatgctgggcaatcttgagaatgacgtggcgaccagcgtggccattctcgaccggcttccgggcaaagagcggccagagtggctggaacggctcagtcgcggtaattatcgttatatccttggccccggcgaggcaggcgccgcaccaacggacaagcgctcgcgggatgcaattcgcaccctgaaagagacgctttcagcccaatatccgctccagtttacggcggtgccagggccgatctcccatattcaggcccatctgacgctccgcgacggcgcaccgctcactatcgatctgatcccgcgcatgccgcctgtcgccagctggttacccgtggtgctagttcttcagctgttacttgtcgcgctctgctcctggattgccgtacgccaggttgtccggcctttcctgcaattcacgcgtgcggttgattccctcgatcctgcggcccattcaccgatgactgaaaaaggaccggttgaagtgcgccaggctgcacacgcttttaatgagatgcagtcgcggatacaaacgtatctgcgtgaacgcgcgcagattctggcgtccatttctcacgatctccagacgcccatcacgcgcatgaagctgcggatcgaaatggcagatcagcccgaactccgcgataagctgctgagcgacctggataatatgtcgcgcctggtacgggaggggattgcctatgcccggtcatcagaatcactggaagagaccacgctgaagctggagctgaacgcgtgggttaacagcatcgccagtgattatcaggacattggtaaaaacgtgcagtttcatgcacgtaatgcgcgtctgccgatcgttactcgtccacaggcattgcgcagggtaatgaccaatctgctggataatgcgctcaagtttggcgatagcgcggttatagagattgatgaagatgaaaggcaggtagcgatccgtattatggataacggccccggcatcccggaggcagaactggaggcggtgttacagccgttctaccgggttgaaacgtcgcgcaaccgcgaaacgggcggcaccgggttaggcctcgccattgccgcgcagctcaccgcccagcttgacgggaaattgcatattgcaaaccgggcagagggcgggttggccgtaagcgtgactcttccgcgcggttaa

SEQ ID NO: 3435 - DNA, 1326 bp, Enterobacter cloacae
ttgtacgcctgtgtatctgcaccccgtgccgatacgcaggcagacaaaattcagcttttcgcacacggcctgaacacattcgtacggtcaaataacctcactgcaccttcgcagcaaccgtatcgtgaggtcgttatgtttctgataatcgcttttttgggcggcatgattagcctgctcagtccgtgcacgcttcccgtcattcctctgctgttcgctggctttcaggggcagcgcaaacacattctggcgcttctgtcgggaatgattgtgatgttcacgttggtggcgatggtagtaacggttgccagcgagtggatcgctgacgccaccgttatcggtcgctggattgcgctgctgatactgagcattgccgccctggctctgttcttcccgcagtttgctcagcgcattgcccgtccggcggtcagtgcgggaaacgttctcaacacccacagcgttcagcgacgcggcctggtttcggcttttctggcagggctggccgttggacttctgtggtccccctgtgccggaccgattctcggggcgatcttcagcattaatattgcgggccactcggccatcgcaaccggagcgctgttagccgcttacggcagtggatgcgcgttgatgctggggctgcttgtcgcggggggccgtaagctgataacccctctgagagtcaaatccgcattgatggcgcgtttgcgtcagggagcgggagtgatgatgttagctgccgttgcgttcaacgccagcgggatgacctcagccctgaaaggtgccaacggtattgccgaccagctggaaaacgctctgttgagccttgcgcaaccatcctccacgcaggtgaaactgcaaccagtcgctgacgcaacgccgagcagccagctaccatcattaagcggcggtacgggctgggtaaacggtgaccctgtcacgtctgaggccttgcgggggaaagttgtgcttatcgatttctggacctgggactgtatcaactgccagcatacccttccgcatgttcgagactgggcgaagaaatatgagtcacaaggtctggtggtgattggcgtccataccccggaatacccctgggaaaagccgttatcatcggtgaaaaacgcggtcaataaatggcagctgccgtaccgcgtagtgacggataataactacaaaatctggagcgcgttcggaaatcagtactggccagcgcattactatttcgatgcgaaagggcaactgcgttacaccgcgtttggcgaaggtaactacgacaagcaggaggccgtgattcagcagttgctcaaggaagcgcgttcctga

SEQ ID NO: 3436 - DNA, 1974 bp, Enterobacter cloacae
cgacgaagtatgcgcctgcactcccatcatcttgaactgctaagcccggcccgcgacgccgccattgcccgtgaagccattcttcacggtgcggatgccgtctacattggcggccctggcttcggtgcccggcataacgccagcaacagcctgcgcgacattgccgagctggtaccgttcgctcaccgtttcggggcgaaggtgtttgtgaccctgaacaccattcttcatgatgatgagctggagcccgcgcagcgtctgatcaccgatctctaccagaccggtgttgacgccctgatcgttcaggatatgggtgttctggaactggatatcccgccgattgagctgcacgccagcactcagtgcgatatccgcaccgtcgagaaggcgaagtttctttcggacgtcgggtttacgcagattgtgctggcgcgcgagctgaacctgaaccagatccgcgatatccatcaggcgaccgacgcgaccattgaattctttatccacggtgcgctgtgtgtggcctattccgggcagtgtaatatctctcacgcccagacggggcgcagcgctaaccggggcgactgctctcaggcctgccgtctgccgtataccctgaaagacgatcagggccgcgtggtggcattcgaaaaacacctgctgtcgatgaaagataacgatcagacggcgaacctcggtgcgctgatcgatgctggcgtacgctccttcaaaattgaagggcgctacaaggacatgagctacgtcaaaaatatcaccgcccattatcgtcagatgctggatgccatcatcgacgatcgcggtgatctggcgcgcgtctccgccgggcgtacagagcatttctttattccgtctacggacaaaaccttccaccgcggcagcacggactatttcgtgaatgcccgtaaaggggatattggcgcgttcgactcaccgaagtttatcggcctgccggtgggtgaagtgctgaaagtggcgaaagatcatcttgacgttcaggtgacagaaccgctggcgaacggcgatggtctcaacgtgatgatcaaacgtgaagtagtgggtttccgcgccaatacggtggagaaaaccggcgaaaatcgctatcgcgtctggccgaacgaaatgcctgccgatctctacaaagcccgtcctaatgcggcgcttaaccgtaacctggatcacaactggcagcaggccttgctcaagacctccagcgagcgccgcattgcggtggatatcgcgctggggggctgggaagagcagctgatcctgaccatgacctgcgaagacggcatcagcgtcacgcatacgctcgacggcctgttcgaggtggcgaacaatgcggagaaagcgctcaacaacctcaaggatggcgtggcgaagctggggcagaccatttattacgcgcgcaatattgaggtgaatctgccggacgcgctgttcgtgccgaacagcctgctgaaccagttccgccgtgaaacggccgagatgctggatgaagtacgcctggcaaactattcgcgcggcagccgtaaggccgaagcggtgcctgcgccggtctacccggacacgcatctttctttcctcgcgaacgtatacaaccacaaagcgcgtgcgttttatcatcgtcacggcgtgcagctgattgacgccgcgtatgaagcgcatgaagagaagggcgatgtgccggtgatgatcaccaaacactgcctgcggtttgcttttaacctttgtccgaaacaggcgaaaggcaatattaaaagctggaaagcgacgccgatgcagctggtgaatggcgatgaagtgctgacgttgaagtttgactgccgtccgtgtgaaatgcacgttatcggcaagatgaagaatcacatcttcaaaatgccgccgccgggaagcattgtggcctccgtcagccctgacgatttgatgaagaccctgccgaagcgtaaaggcagctaa

SEQ ID NO: 3437 - DNA, 420 bp, Enterobacter cloacae
ggaagattcatgagctatgttactgaatttccggctgctgagccgcaggaagccgtggggcattttctgcgtcgtctgagcgtcgagacggactgcgccgatgtccatcacgcggtatccagcggtgagcaggactttgttctgctgcacgttgtcgggaagcctgaacattttgcccggcggcatctgcccggcgcgctgcatttaccctggagccagatcaccgccgagcggatgacagcgtggccagagggcacgctgtttgtcgtctattgtgcaggcccgcactgcaacggggcggacagggcggcgctgaagctggcgcgtctgggtctgccggttaagattatgctcgggggcatgaccggctgggaagatgagcggttcgcgtttgcaggatcttcatcgcccgccctgtga

SEQ ID NO: 3438 - DNA, 1128 bp, Enterobacter cloacae
cgccgacagacagaggagatttccatgcagcgacaccacgccccgtaccgcgccgatgtagtcggcagttttttacgcccggactctgttaaacaggcccgtctgcaatttgccagcggtgagatcgatgccggtcagcttcgcgcggttgaggacgaggccattcgccatgttgtcgaacagcagtgcgcctgcggtctgcatgtggtaacggacggtgaattccgccgcgcctggtggcactttgacttctttgacgggctacagggcgtagagcgttatgattcgcagcagggcattcagttcaacggggtgcagaccaaagcccacggcgtgcgcgtaacgggcaaactgggcttcggcgatcatcctatgctggaagattttcgctacctcaaaagcatcagcggtaacgcacagccgaagatgaccattccgagcccgagcgtgctgcacttccgcggtggccgcaaggatattgatgccacggtctacccggatctgaaggattactttgacgatctggcgacaacctggcgcgatgccattcgggccttttacgatgcaggctgccgctatctgcaactggatgataccgtctgggcctacctttgttcagaagaccagcgccgccagatccgcgagcgcggtgacgatgcagacgaacttgcccgaacctatgcccgggtgctgaataaggcgctggagggcaaaccggacgacctgaccatcgggctgcacgtctgccgcggcaacttccgctcaacctggatttccgaaggcggctatgagccggtggcggaggtgctgttcggcacggtgaacgtcgacgcgttcttcctggagtacgacaacgaccgtagcggcgattttgcgccactgcgttttgtgcgcccgggtaaacagcaggtggtgctggggctgatcaccaccaagcacggtgaactggagaacccggaaggggtgaaagcgcgtctggaagaggctgcgcgctacgtggcgaaagagcagatttgcctcagcccgcagtgcggatttgcctccacggaagagggtaacagcctgagcgaagcccagcagtgggataaaattcgcctggtgacgcaaatcgccagcgacgtctggtaa

SEQ ID NO: 3439 - DNA, 1614 bp, Enterobacter cloacae
aaaccgccagcaactaagccaccaccagggagagacgtcatgaacgccatacgcatgatgattgcgattgtgtggcttaccggactgctgccagggatggcgcaggcatcggatgccgatgattttgttgccgctagccgcagccagcaaaccgccatgctgacccgctgggcagcgacgccggaacctgcacgtttgccgctgcttaaggcgctgcaacaggagaacctttataccgacagccagaagaaggcatttacccgcatcgacggcgaaatggttgccctgggcgcggcaaagagcgccgaaggaacgaccaaagccgtgcggctgaccaaccggctgcgcgtgttaaccgtcacggcgctggcgacgcatcagcttgtcagtgacagtgtcaccgaaagacgtcatgccgcgcggcaacttcagcgtgacgcccagccggatatgctcgggtttctgcaacagcgggctaatcgcgaaacggacgacatcacccgacagtcgctgaggctggcgctggcaaatcttcagctggcgagtccgcaggcggaaacgcgcctcaacgcggttgaactgttgggacagtctgacgatccggacgttcaggccacgctgacgccgttcacccgggcgcaaaccgagccggacgcacgggtacgtgccgccgccgctgagagcctggaccgtattcagcaccggctgatgtggggtgaactgctgggacaggccttcatgggcctgtcgttggggtcggtactcttgctggccgcgctcgggctggctatcacctatggtctgctgggggtgattaacatggcccacggcgaaatgctgatgctcggggcgtatgccacctggatggtgcagcaggtgatggcgcagtggatgcctcagtggctggcgctttatccggtggtggcgctgccggtggcgttttgcctgacggcaggtatcgggatggtgctggagcgcacggtgatccgccatctttatggccgcccgctggaaaccctgctcgccacctgggggatcagcctgatgcttatccagctggtccgcatgacctttggcgcccaaaaccttgaggtcgctaacccggcctggctgtccggcggggtgcaggttttcgccaacctgacgctgccgtggaaccgtattgtggtgctcgggtttgtgctgatggtgctgttcttcacctggctcattctgaacaaaacgcgtctgggtctgaacgtgcgggcggtgacgcaaaaccgcagcatggcggcctgctgcggcgtccccaccggacgggtagatatgctggcgtttggcctcgggtccggcattgccgggttgggcggcgtggcattgtcccaactggggaacgtgggaccggagctgggccagggatacatcatcgattcattcctggtggtggtgctcggcggcgtcggccagctggccggtagcgtcgcggcggcctttggtctggggatcttcaataaaattcttgaaccgcagatgggcgccgtgctgggcaagatcctgattctggtggcgatcattctgtttatccagaaacgtccgcaggggttattcgcacttaaagggagggtgacagactga

SEQ ID NO: 3440 - DNA, 681 bp, Enterobacter cloacae
tataacatccctgttcttataaaacggaatgaggattttgctgtggctgcacaacctggaaaaattgcgctgactttgggaacgctgctggtaagcggctcgctttttgcccattcgcacggtcatcagatgacggaggcggaacagaaggcggcaaacggcgtatttgaggataaagacgtcagggacaggaagctgtctgactgggacggaacatggcagtctgtttacccgttcctgcttgatggttcgctggatccggttttcgaaaagaaagcgcagaagggagaaaaatctgctgccgaggtgaaggcctactaccgcaagggttacgcgacggacgtggacgccatcggcattgaaaacaacgtgatggaattccaccgaggcaaaacggtgagcagctgccgctacgactacagcggctacaaaattctaacctatgcgtcggggaaaaaaggtgtgcgctacctgtttgagtgcaaggataacgcgagcgaggcgcctaagtttgtgcagttcagcgaccatatcatcgggccgaaagcctcttcacacttccatatctttatgggcaacacctcccacgaggcgctgctgaaagagatggataactggccgacctactacccgaatgagatgtacaaggagcaggtggtggaggagatgttgcaccactaa

SEQ ID NO: 3441 - DNA, 825 bp, Enterobacter cloacae
gaggaaccaacgatgcaggaaattgatttttatctggtagatgctttcagcgacagggcgttcggcggcaatgcggcggcggtgtgtccgctggaagcgtggctaccggatgagacgctgctgaagatggcgaagcagcataatcagtcagagacggcgttttttgtccgaacggataacgggtttgaactgcgctggtttaccacgcaggatgaaattaacctctgtggccacgcaaccctcgcggcttctcacgttatttttgaatacctggattatccgcatacggaaatcaccttcaccacgcgctttgtcggcgaactgacggtacaacgcagcggcgactggctgacgcttaatttcccggcgtggtcaaccgaggttgtcgatactccacccccagtgctgttcagcgcgctgggcattaacgcggcaaacgaggtccgtgtggggcgtgactacatggtggtgctcgacagccagcggcaggtggaggcgctgacgccggatatcactgccatgctcccgctggggaaaatggtctgcgttacagcgccgggagatgagtatgatttcgtcagccgcttcttctgcccgggggaaggggtgcccgaagatccggtgacgggatcagcgcacagcatgctgatcccgtactggagcgaaaagcttggtaaaacgcagatgtcggcccgccaggtctccttgcgcggcggggatctgcgctgcgagctgaaaggcgaccgcgtgctgattggcgggcaggccacgctgtatatgaagggaaaaattttccttcgactccaggactacgttcaactttaa

SEQ ID NO: 3442 - DNA, 1653 bp, Enterobacter cloacae
tggttctgtcattttcgtttcgtagactcgctcgcgcctaacgtattgttacagaagaaaattatgaacctaacgcaaatttttcgccgtcttgcgccgcgctttattcctcgtcagtttggcctgctgaccggcatcttttgtattattggccttttctccgccctgcaactctcttcctccttcctgctgaccgcctccctgaatcaagcccagcgtaacgaacagcgcaatcagctggcctggcagcaacagagcaggctggatcaggcccgtatttctctgctggccgcaagcgatctgctcaaccgctccggcgtgtactttatgcaggataaagagaccggctcggaagggagctggcatagcctgatggacgaggcgcaaaaatccctggcggcgtctcaacaggcatggcaagcatggctcgcacttaatcctccgcaggacgaggggcttgttaacagctatcagctgttcttcggtgccattagcgagcaggcggaagggctggtgaaaaccaacagcatcgacctcttttttgccgtacccgcccaggcctttcagaccgattttaatgacaactttgcacgctatcagcaacggagtgagaagcaggcgatacaggggcgtcagtcgctcatggaacaactctcaggcctgcaacggctgttcctgtttgcgccgctggtgctgctggccattgccatagccgtctggtttggaatggcgaagtgggtgatatccccgctacgccgtctgattatccatattaaccagcttgcggcaggggatttatcaggcacgccgcctgacgttgtgcgctttaaccgtgaaatcagccagctctgcggcagtattaccgccatgcagcttgggctacagcagctggtgactcaggtcagcgaggccactaccgccatggttgaaaatattgggtcacttgcgcaggggaatcagaagctttatcagcagtctacgcgacaagccaaagagctggaggaggtgaccgcgcatatcgccgatctcgaaacccacgttgaggggaacacaggttatgcaaaactcgcccgctcgcgcgcggatgaagcccgacaggctgccgtaggcggggagcaaatgatgacggcggtgaatggctcgatgcagacgatcgtcgaccgatcctcagagatgcgcgggatcgtcgcgatgatcgacagcgtggcgtttcagaccaacattctcgccctcaatgctgccattgaagccgcccatgcaggagagcaggggcgcggatttgcggtggtcgcccgggaagtggggttgctggccagaaaaagcagtcactctacgcaaaccatccaggcgctgattaaccactcgcttcagggcattgaggaaggatctcaggtggtaaaccgtctggaagagaatttgcaacaggtcaccgggctggtggcgaatctgagcagcctgctgaatgatatttccttggccaccctgaatcagggggatagcatccatcagatgacccgtcagcttcaggcgctgaatcaggtatcacgtcagactgatgtgctggttagcgaagcgtcaaatgcctctgagcgcctgcatcaacagtccgatcttttgttgcaggccgtctcgcgttttcgtctccctgcctga

SEQ ID NO: 3443 - DNA, 537 bp, Enterobacter cloacae
ggacgcgcaatgaactctcccatgctgattaaacctctctcccgacaggacatcctcacccacattgatgccctgaacgatattctcgtcaactgtgtcaacggcggcgcctccgtcagctttatgctgcctttttctgccgcgaaagcccaaaccttctggctcggcgtcgcagacagcgtcgggcgcgacgagcgtaccgtcctgggctgttttgatgcggagcaggggctggttggcacggtccagctgatcaccgatcagcctgaaaaccagccgcaccgtgctgatgtcgcgaaactgctggttcatgagaaagcgcgccgtaaaggggcggcaatggcgctgatggaatccctggaggcggttgcgcgtgaaaaagcgcttacggtgctggtgcttgatacctcaaccggcagcggcgcggagacgttttatcagagagcgggctggcaaaaggcgggggagatctcacgctacgccctgatgccgaacggggacatgacggcgacctcgatgttctataaatttctttga

SEQ ID NO: 3444 - DNA, 453 bp, Enterobacter cloacae
tgtgaggaacacatgacactcatcgtacgcccgttacagacagaagattacccacaatggcgaccgctgtgggatggctatattcatttttatgagtgctaccttgacgagtccgttaccgcggccacctgggacagggcgctcacagattcatcacccctgttttgccgggtcgtggagaaagacggcagcgtcatcggcttcgccatgtgcgtcctgcatgaagggacctggtcaaccgcgcccgtttgctatctggaagatctgtttgttgacgctgccgaacgtggcgcaggggcgggtaaagcgcttatcgacgccctgatcgatgaaggcaagcgggaagggtggtcaaaactctactgggtaacccgcatgaacaatccggcgcgtaagctgtatgatcactatggtgaagccgacgattacgtccggtaccgaatctcgctttag

SEQ ID NO: 3445 - DNA, 792 bp, Enterobacter cloacae
gctctgatatgtgctattttcaatccgttacctcttaatcaggagcctgcggtggagcatattgatcacatccttgtcgtcgatgacgacagggatattcgtgaactgattgtcgattacctcgtgaaatccggctaccacgcctctggcgcggcgaacgggaaagagatgcgcgtagtgctcgacaaacagcatatcgacctggtggtgctggacgtgatgatgcccggcgatgatggcctgacgctgtgtcgacagctgcgcagcagcaggcataaggatctgccgatcctgatgctcaccgcgcgcaacgaggacacggaccggatcctgggactggagatgggcgccgacgattatgtggtgaaaccgtttgtggcccgcgaactgctggcgcgtatcaaagctatcctgcgtcgttttcgtactatgccgcctaatcttcaggtgaccgaggcagggcgcctggtggtattcggtgaatggcaactggataccgtggcgcgtcatctgattgataacgaggggatggttgtggcgctcagcggggcggaatatcgccttttgcgcgtattcctcgatcatcctcaacgggtgctgacccgcgatcagctgctgaacctgacgcagggacgtgatgccgagctgtttgagcgttcgattgatctcctggtgagccgcgtgcgacagcgcctgaatgaagatgcccgcacgccggcctacattaaaaccgttcgcagcgaaggctacgtttttaccatgccggtgaccatcgtcgaggccaatgaatga

SEQ ID NO: 3446 - DNA, 1302 bp, Enterobacter cloacae
ggacaagccatgaaagcgatctccattctggcgtgtggcgcggacccaaccgcgcaacgcatgtcaacgtctgccattcagcaggccataaacagtgctcaacagaacgatgtcattgttattccgcaaggccgttttctgaccggcgcactgtttctgaaaagcggtgtttcgcttcgcctggatgctggcgcacagctcgttggaagccaggatctggctgattatcccctgataaacacccgggtggccggcattgatatgcgctggccggcagggattattaatatcatcgattgtgaaaacgtcagcattaccggtacaggtacgatagacgggcagggtgtcatctggtggcaacgcttctggggcgatgacgaacgcagcggcatggttggcgattacagcgccagaggattgcgctgggtggttgattacgactgtcagcgcccgcgcaatatcctggtctttgaaagccagaacattctgctgcgtgattttaccagtcgggagtccggattctggaacatacacctctgttattcgcgccgtatcgcggttgagggcgtgcaaatcagcaattctgcggggccgagcaccgacgggattgacgtcgactcctgcgaacaggtgcggattgaacgctgcattgtgtcctgcaatgacgacaatatttgcatcaaatcaggacgaggacgcgaagcggcgcaaaaagcacgtaccgcgcgggatatagtgattcgaggatgtacgctgaataagggatccgggatcacgctggggagtgaaacttcaggtggcattgaacgcgtcctgatagaagataacgcgtttaacggaacgggcgtcgggtttcgcattaaatcggcccgcaaccgtggcgggtttatccgtgatatcaccgtccaaaatttacgtcttacggacgtacgttttccggtgctgatccagctgaactggtttccgcagtacagctatggcgaccagagcaatttatctgataaaccagaacactggcgcaagctggctgaaggtgttgagggcgaagccggtcttactgaggtcagcggactgacgattaaaaatatgacggcgcgtcgctcagacaaaaaatatttctcgcgggcatttttcattgaggggtatccggagcgtcctgtggccgggttaacgctggaggggatttttattgacgcgacagagtttgggaaaatttccggtgtggatgggttgcgctttcaggatgtgcaggtgactgccgtagagaacacgcaagactgtaacgacagttatgaacgttga

SEQ ID NO: 3447 - DNA, 585 bp, Enterobacter cloacae
ggtatcactgtgcgctatagcgtacaagtggtatgctttgccgcaacgggaggaactatggatatcactcaacacctggcaaccacactgaaagcgctgcgtctggcgcggggctggagcctgtcaaaactggcggaagagacgggcgtgtcgaaagcgatgcttgggcaaatcgaacgcaatgagtccagcccgacggtctctaccttgtggaaaatcgccaccgggctgaacgtacctttttcggcgtttatcactccagaaagcgaaccgcaggcggtattcgatccgcagcagcaggcgatggtggtgaaaccgcttttcccctgggatgaacagcttaagttcgaccatttctccatcaccctgtcgcccggcgcgctgagcgagtccacgccgcacgaagccggggtgatcgaacatgtggtggtgataagcggtgagctggatatgcagatcgacggtgtctggcgcacaatatacgctgattccggcgtgcgttttgccggcgataaaccgcacgcgtaccgcaacagcagcgcccgtacggtgcattttcactccctgatccattatccccgctaa

SEQ ID NO: 3448 - DNA, 459 bp, Enterobacter cloacae
tggcgggaaagcgtgttttcagagcttgcgtgtagcgccagtgggtggttgccttccgcccgtcaagcaggcctgaggctgccagaacgaaaacgccagaacagatcgagagtagctggcagccgcgggcatgcgccgcgcggagcgcctggcagagcgcttcgggtacgggttcatccagccctcgccagccgggtacaacaaccagatccgccgtttcaagcagacgcagatcgccgtcggccagaatacggatcccgcccgttgcccggagctcgccgccatccacgctcgccacggcgaactgataccagtcatcgcccatctccgggcgcggcaagccaaagatttctaccgccacgccaaactcaaaggtacataaaccgtcatatgccagcacgaccgcgcgcggcgagggatgtcttaagtttgtcatctttttgctgttttctggcatag

SEQ ID NO: 3449 - DNA, 810 bp, Enterobacter cloacae
gggagagaattaatgcagccctctgaaggactctttacccgccagctaccgggcgatcgttaccgtgagcagaccgatccggtgttgcagctcgaggccattaacgtcagtttcgacggttttcaggcgttgaccgatctttcgctgaatatcggcgtcggagaattgcgctgcatcattggccctaacggcgccggtaaaaccacgctgatggacgtgatcaccggcaaaacccggccaaaaagcgggaaagctatttacgatcagtccatcgatctgacagccctggaaccggcggccatcgcccgtcagggcattggccgtaagttccagaagccgaccgtgtttgaagcgctgaccgtaggggaaaacctcgaaatcgccatgaaagccgacaggtccgtctgggcgagcctgcgggccacgctcagcggcgagcagcgcgaccgcattgacgagatgctggttttgctgcggcttggcagcgagcgcgatcgccgtgccggactgctttcccacggacagaagcagtttctggagatcggcatgctgctggtgcaggacccgcacctgttactgctggacgaacccgccgccggtatgaccgacgccgagacggaatacactgccgagctgttccgcaccctggcaggcaagcattcgctgatggtggttgagcacgatatgggtttcgttgagaccatcgccgaccacgtcacggtgctgcatcaagggcgcgtactggcggaaggttcgcttcgcgaggtacaggccaatgaacaggtgattgacgtctatctgggacgctaa

SEQ ID NO: 3450 - DNA, 594 bp, Enterobacter cloacae
  unsure (564)
ggagaggggatgttacaggttagcgaactgaatcagtactacggcggaagtcatattctgcgcggggtgagctttgaggcggtcgtcggggaagtgacctgcctgctggggcgcaacggggtgggcaaaaccacgctgctgaggtgcctgatggggctgatcccggtgaaagccggggaggtggtctggcagggaaagaccatcactcacagtaaaccgcaccagcgagtgcagtccggcgtggcgtatgttccgcaggggcgggagatttttccgcgtctgaccgtagaagaaaacctgctgatggggctgacgcgcttctcagcgggaaacgcaaggagcgtaccggaggagatttggcagcttttcccggtgctgaaggagatgaagcaccgacgcggaggcgatctttccggtggtcagcaacagcagctggcgattggtcgcgcgctggcgagccgtccacagttactgattctggatgaacccacggaaggtattcagccgtcggtgattaaagagattgggcaggtgatccgcaacctggcgaaccggggggatatngcgatcctgctgggtggagcaattttatga

SEQ ID NO: 3451 - DNA, 936 bp, Enterobacter cloacae
agtgtttacaaaattttaatatttcaggggcggaaaatgacgcggaaagacgggctgttagcgttgctggttgtcgtggcgtggggactcaattttgtggtcatcaaaatggggttgcacaacatgcctccattgatgctggcgggtctgcgcttcctgctggtggcgtttccggcgctgctgttcgtcgcccgcccgaaaattcccctcaagctgctgctgggctacggcctcaccatcagctttggtcagtttgcgtttcttttttgcgctattaaattcggtatgcctgcgggcctggcttcgctggtgcttcaggtgcaggcgttctttaccatcattctcggcgcgtttgtctttggcgaacgcttgcagggcaagcagctggcgggcattagccttgcggtctttggcgtgctggtgctgattgaaggcagcctcaacggtcagcatgtcgcgctgctgggctttatgctcaccctggcggcggggctgagctgggcgtgcggcaatatctttaacaagctgataatgcagcacgaggcgcgtccggcggtcttatcgctggtggtttggagcgcgttgatccccatcgtaccgtttatggccgcgtcatttattctggaggggccgcaggcgatgctgaaaagcctggtggagatcgacctgacgactattttgtcgctgatctacctggcgttcgttgcctcaatcattggctatggtatctggggatcgctgctcggacgctatgaaacctggcgcgtggcgccgttatcgctgctggtaccggtggtcgggcttgccagcgccgcactgttgctggatgaaacgctcagcgcgctgcaactgtgtggcgcagggctgattatggccgggctgtatatcaacgtctttggcttgcgggtgcgtcgggcgacgcgggtgcagagttaa

SEQ ID NO: 3452 - DNA, 513 bp, Enterobacter cloacae
atccggcgttggcggtggggtcgtggcgattgtcccccacgagatggcgattgccgtctggagcccggaactggacgagaccggaaattcactggcgggcgtagcggcgctggaacagctgaccaaacgtcttggacggtccgtatactgatgtccacgttagatcctctgttcgcgcgcctggctcgctccacgtttcgttcacgatttcatttagggacgaaagagcggcaatactgctgggataagggcgcagagactatcgataagcatgccgccgattttgtcgccgcgcggctggcgcctgcacacccggtgaatgacggtaagcagacgccgatgcgcggccatccggtttttatcgcccagcatgccacggcaacctgctgtcggggctgtctggctaagtggcacgctattccgcagggcgtgccgctgagtgcgcagcaacaacagtatatcgtcaacgtaatccatcattggctggtcatagaggtaaatcgtgcctcctga

SEQ ID NO: 3453 - DNA, 1074 bp, Enterobacter cloacae
aaccgcatccgcacacatctcctgtacaaacgcatggtgttatatctccgtcaactgaacttacccggagataacatcatgtttaataaactcgcatactcagccgtcgccctgaccgtatcacttggcaccgtgatgtcctgccaggcagaagcgacgggtaaggattacgcgtcggcctttaaccaggttaaacagattaacgctggcgatttgaacgtcggttacgtcgatatcgggccaaaagaggggcaaccggtgatcctgctgcatggctggccgtacgacattcacagttatgcagaagtggcccccgcgctggccgcgaaggggtatcgtgtcattgtgccgtccctgcgcgggtacggcaccacacgctttatttctgataaaacgccgcgaaacggccagccttcggcaatggcaaaagacatcgtcaacctgatggacgccctgaatatcaaacaggcggtgtttgccggttatgactggggggcgcgtacggcagatatcgttgcagcgctctggccggaacgggtgaaatcgctggtctcggtaagtggctacctgatcagcagccaggcgattggcaaacagcctttaccgccgaaggcagaggttcagtggtggtatcagttctatttcgccacgccgcgcggggcggagggctatgctaaaaatacgcacgattttgcccggttgatctggtcccaggcttcgcctgactggaaattcagcgatgccaccttcaatgccagcgccaaatccctcgataacccggaccacgttgccgtcacgctcagtaattaccgctggcgtctggggctggagaagggtgagcagaaatatgacgcctacgaacaaaagctggctacgctgccgaatattacggtgccgaccatcaccatcgagggcggtaacaacggagcaccacatcctgtacccgcagcctatgcagggaaattcaccggaaaatatgagcaccgtactttcggcgcaacggttggccacaacccgccgcaggaagatccgcaggactttgttaaagccgttgtcgacgcggataagctctga

SEQ ID NO: 3454 - DNA, 762 bp, Enterobacter cloacae
atcatgcttacaagccagcgtaaacagttgattctggaaaaactggaggcggaaggccaggtccagtcaactgcgctcagcctctttttctcggtgtctgaggacactatccgccgggatttacgtgaactggcggcagaagggcgtttgcagcgtgttcacggcggtgcactgccagcatcttcagcgattgcgccttttgccgagcgtcagtccgtcaaaatggatgcaaaaaaacgcgtggcacggcgaggcgcgcagctcatttcaccggggcaggtggtgatcattgatggcgggacgaccacctccgaacttattacattcttgccacccgatttaccgataaccgtggtgacgcacagcccgggtatcgcattgggtctggtcggccatccgagcatagaggtgatcctgatcggtggtcgtttgtataaacactccatcgtcacggtcggcgcggccgcaattgaaggcatcaataatattcatgcggatctgtttttcatgggtgtcaccggcgtgcatcctgaggccgggctgaccaccggagattatgaagaagcgtgcatcaaacgtgcattttccggcagagcggcggaaacggtggtactggcctcgccggaaaagatcaacacggcctcggcgttcgtgattggcgacctgtcgctggtgaatacgctggttgttgaaaacacaacggatgaacgctgggtgagcgccatgaaagaaaagggcgttacggtgatcgcaagccagtaa

SEQ ID NO: 3455 - DNA, 669 bp, Enterobacter cloacae
tttattcctgatgttgcacgatatatcttgtatttgcacgatagtgctgtttatgatgcttactctacgagaggagagccaaacgtgcaatcaaaacgtgcagatatacgcatcatcaacagcgaaacgttgtccgacaactggtataacctgaaaaaatacacttttgacttccagcgcagcgatggcgactggcagcggcaagagcgtgaagtgtatgaccgggggaatggcgcgacgatcctgctctataatcgcgacagcaaaaccgtcattctgacgcgtcagttccgtttcccggtgtttatcaatggtcacgaagaggatctcattgaggcggccgccgggttgctcgataaccttgacccggaaagccggattaaggccgaagcggaagaagaaaccgggtttaaggtgacgcgcgtagagaaaatttttgaggcctatatgagcccgggctcggttaccgagaaactctacttctatctggcggaatatcatccgcaggatcggaccagcgcgggcggcggcgttaaagctgagggggaagatatcgacgtgctggaaatgacgctggacgacgcgcttcagggcattgaaaatgggcagatcgtcgacggaaaaaccatcatgctgctctatcacctggccctcaaaggcattttataa

SEQ ID NO: 3456 - DNA, 783 bp, Enterobacter cloacae
acacctcaacatggagatgcgaaaatggccgactgggatccctctctttatctacagtacagcgcagaacgcacacgtcccgccgctgagttactggcccgggtgccgcttgctgacataacctcagccgtggatttgggctgcgggccaggcaacagcaccgcgctgctgaaacagcgctggccttctgcgcagatcgccggcgtggataactccccggccatgctggaggaagcccgacaggccctgccagactgccactttgttgaggcggatatccggcactacaaacctgaccagccgctcagcctgatctacgccaacgcctcattgcaatggatcccggaccattaccaccttctgccacacctggtttcactgctccagttaaacggcgtgctggcggtgcaaatgcctgacaactggcttgagccgacgcacgccctgatgcgtgaagttgcctgggaacagggctaccccgatcgtggccgcgagccattgccgggtatccatgcctactacgatattctgacggaagcgggatgtgacgtggatatctggcgcaccacctacttccatcagatgagctctcatcaggcgattattgactgggtcagcgcgacggggttacggccgtggttacaggaactcaacgaaagcgagcagaaaaactatctgaaacgctaccttgagctgctggaagagcagtatccgctccaggagaacgggcagatactgctggcttttccgcgcctgtttatggtggctcagcgggttccgtaa

SEQ ID NO: 3457 - DNA, 615 bp, Enterobacter cloacae
ttcatcgcgaagatcaaatcgcgccatcgggccaatatagttatcttcctcatccggtgcgcccatcttcagcgccttgaccgcgtcaacaaagcgttgggtaaaggcgtccgctacgcccgcttccacaataaagcgttttgccgccgcacaaacctgtccggtattctgataacgtccggccaccgccgcgttgacggccagatcaagatccgcatcgttcagaacgataaacggatcggaaccgcccagctccagcacgcatttcttcagcgccgcgcccgcctgcgcgccaattgccgcaccagcccgaacgctgccggttacggtcaccgccgcgatacgccgatcgttaatcgcctggctgacgccgtcattcgtcgcgttcacccagccaaagaccccctccgggaaaccggcatccgcgaataccttcccgatcagctccgccgagccgagcacatttggcgcatgtttaagcagatagctgttccctgccagcaggatcggcaccgcaccgcgcagcacctgccagagcgggaaattccacggcatcaccgcaagaataggtcccagcggacggtactcaatcaccgcattttcgacctgggttga

SEQ ID NO: 3458 - DNA, 912 bp, Enterobacter cloacae
tactcaccaccttattcacgaatcgagaacggcatggacttaacacagcttgagatgtttaacgccgtcgcactgaccggcagcattacccaggcggcgcagaaggtacaccgggtgccctcaaacctcaccacccgcatccgacagctagaagcggatctcggcgtggagctgtttattcgcgagaatcagcgcctgcggctttcccccgccgggcacaattttttgcgctacagcaaacagatcctggcgctggtcgacgaagcgcgaatggtcgtcgccggggatgaaccgcagggattattctcgctcggcgcgctggaaagtaccgccgccgtacgcattccggaaagtctggcgcggtttaaccagcgctatccgcgcattcagtttgcgttatccaccgggccttccggtacgatgattgacggcgtgcttgaagggacgcttagcgccgcctttgtcgacgggccgctctcgcacccggaactggaaggaatgccggtttaccgggaagagatgatgctggtcacccctgcgggccacgcggaagtgtcaaaagccacgcaggtgagcggcagcgacgtgtatgcctttcgcgccaactgttcttaccggcgtcatctggagagctggttccatgccgaccgcgtaacgccgggaaggatccatgagatggagtcctaccacgggatgctcgcctgtgtgattgccggggcaggcattgcgctgatgccccgctccatgctggagagcatgccggggcatcatcaggtggcggcgtggccgctggcggaaaactggcgctggctcaccacctggctggtgtggcgacgcggggcgatgactcgccagctggaggcatttatcgcgctgctgaacgagcgtcagccacctgcgcccagttgttaa

SEQ ID NO: 3459 - DNA, 429 bp, Enterobacter cloacae
gcttttactcaagaaaatcctgccgtaaacagaaaaagaggtatgacgatgtccagacgcaatactgacgctatcaccattcatagcattttggactggatcgaagataacctggaatctccgctctcccttgagaaagtgtctgagcgttcaggttactcaaaatggcacctgcaacggatgtttaaaaaagagaccggccattcattaggacaatatattcgcagccgcaagctgacggagattgcccaaaaactgaaagaaagcaatgagccgatcctctatctggcggaacgttacggatttgaatcgcaacaaaccctgacgcgtacgttcaagaactactttgacgtgccgcctcataagtaccgtattaccagtatgccgggtgaatcccgttatctgtatccgctaaaacattgcagttaa

SEQ ID NO: 3460 - DNA, 1011 bp, Enterobacter cloacae
atgcgtccgcctatgccagaaaacagcaaaaagatgacaaacttaagacatccctcgccgcgcgcggtcgtgctggcatatgacggtttatgtacctttgagtttggcgtggcggtagaaatctttggcttgccgcgcccggagatgggcgatgactggtatcagttcgccgtggcgagcgtggatggcggcgagctccgggcaacgggcgggatccgtattctggccgacggcgatctgcgtctgcttgaaacggcggatctggttgttgtacccggctggcgagggctggatgaacccgtacccgaagcgctctgccaggcgctccgcgcggcgcatgcccgcggctgccagctactctcgatctgttctggcgttttcgttctggcagcctcaggcctgcttgacgggcggaaggcaaccacccactggcgctacacgcaagctctgaaaacacgctttcccgccatcaccgtggtcgaagatgtgctctaccaggacgaaggcgatattctcacttccgccggcagcgccgcggggattgatctgtgtctgcacgtggtgcgccggaattacggtatggaggcagcaaaccgcgtggcgcgtcgactggtgatcccgccccatcgggacggctcgcaaacccagcaacttagccgaccggtggctcagttgcgggagagccagcgcctgggccagctgttcgattatcttcaccagcatctggccgtttcccataccgtcgaatcgctggccctgcgggtgggtatgagtcaacgcacctttctgcgccgtttccaggacgcgaccgggacaacgcccgcgcgctggttattgactgcgcgattgcagcgggcaaaagattatctcgaaaacagtcggctcagcattgataatattgcggaacaaaccggatttggacaaagcgccacgctgcgccaccatttccggcagcaatttgcgctttcgcccgcgcaatatcgtaaacattttttacagccggtacgataa

SEQ ID NO: 3461 - DNA, 237 bp, Enterobacter cloacae
atgatgttcagaaaagaattttcgctactgctggtgattagcgccctgttctcaggacagattatggcggagcacaaagggcatgaatttgtgtatgtgaaaaacgccgaccatcagcttcgtcatgaagctgacagcgacgagttacgcagcgcggctgaggagtctgcggaggggttgcgcgagcaccatgcctggcagaaatcgcgcaaaccggatacccactctgcgggttag

SEQ ID NO: 3462 - DNA, 1206 bp, Enterobacter cloacae
taccttatcccggacgttataacgcacaacggagtttccatgcaatcgactgcctctctctttcctgccgtgctggccggttttgttgccgttctggtgggctatgccagctctgccgccattatctggcaggcggctgcggcggctggcgccagtacacagcaaatcgccggatggatgaccgcgctagggctcgggatggggatcagcacgctggtattgtcgtggtggtataaagcccccgtgctgaccgcctggtcgactccgggcgcggcgttgctcgccaccagcctgcatggcgtgacgctggcggaaaccatcggggtatttatattcgcgaatacgctgattctgctgtgcggcgtcaccggcctgtttgcccggttgatgaaactgatcccgcactcgcttgccgccgctatgctggcgggcgtgctgttacagtttggcctgaaggcattcagcaatcttgagggacacatttttctttgcggcagtatgctggccgcctggctggtggccaaagctgtagcgccccggtacgccattgtcgccacgctgctggtgggcgtgttcgttgcctgggctggaggtgacgttgtcacgaacaggatgacgttatcggtcatcatgccggaattcattgcccctgcgttcaccttcaccagcctgatcagcatcggcttacctatcttcctggtgaccatggcgtcgcagaatgcgcccggcttcgccaccatgcaggcatcgggctatccgctggcggtctcaccgctgatcgttgccacaggcgggctggcgctgctgttgtcccccttcggcgtctattctatatgcatcgccgccatcaccgccgccatctgccagagcccggacgcccacccggatgccagtaaacgctggctggctgcggcggccgcaggtgggttttatctgctggcgggggtgttcggcgggtcgatttcggggctgatgtccgccctgccgctgagcggcatccagacgctggccgggctggccctgctcggcactatcagcgggagtttgtatcaggcactgaatcatgaagcagagcgcgacgcggcgatcgtcaccttcctgatgaccgccagcggcgtcacgctcctggggattggctccgccttctgggggctggtgttgggagggatctgttacgccgtcttctcacgccttcgccgcgcgtag

SEQ ID NO: 3463 - DNA, 476 bp, Enterobacter cloacae
  unsure (32)
actgcaatcggtacgtccgtccggtggtgaanaatctggccggggtggttgacctgttctcccgaaaagttatcggctggtcaatgcaaccccgcatgacaaaagagattgtcctgaacgcattacttatggcggtgtggaggcgtaatcctcaaaagcaggtactggttcactctgatcagggtagtcagtacacgagccatgagtggcagtcgttcctgaaatcacacggtctggaaggcagcatgagtcgtcgcggtaactgccacgacaacgcggttgcggaaagctttttccagctactgaaacgcgaacggattaagaaaaggatctacggaacgagagacgaagccagaagcgatatttttgattatatcgaaatgttttataacagtaagcgtcggcatggttcgagcgagcagatgccaccggctgaatatgaaaacctatattatcaacggctcagaagtgtctag

SEQ ID NO: 3464 - DNA, 600 bp, Enterobacter cloacae
aaataccagaacccaaacaaaagcataacgcttaattatggagatcagcggatgaccatacccacgcttaccaccgagcgcctgatattacgccccctgattgcagaagatgccgtccagatccagcaacgctatccgcgctgggagattgtccgctatatggtggcttcagtcccctggccctacccggaaaacggtgcagaaaattatgtcaacaacgttgcactgcccgatatggccaaagggattgcgtggttctggacgattcgccgtcgcgaagcgcctgacgaactgatggggttgatttgtctgtatgacgtggaggacaacaaccggggcttctggctcgcgccggaatttcatggccagggatatatgcgcgaggcgagcattgcggccacggattactggttcaatacgcttaacaaaccggtgttgcgcgcgccgaaagcggctgcaaacagccgctcccgacgtatttcagacagcagcggcatgcggctcatcaggacggagaagaaagcctatgtcagcggcctgctggattcggagctgtgggaaatcacccgcgacgagtggaatgcccgtcaggtcagctga

SEQ ID NO: 3465 - DNA, 480 bp, Enterobacter cloacae
gcaataatatctgccgtgactaaactacttgccagggcaaccattgtgaaaagcaccagtgacctctttaacgacataatcccactgggtcgtcttattcatatggttaatcagaaaaaagatcgcctgctcaatgactatctgtcaccgctggatatcaccgcaacacagtttaaagtgctgtgttccattcgctgcgaagtgtgtatcacgccggttgagctgaaaaaggtgctctctgtcgatctgggtgcgttaacccgcatgctggatcgtctcgtctgtaaaggatgggtagaacgaagccctaacccaaatgacaaacgtggcgtactggtgaaactgaccagcgatggcgcggccatgtgtgagcaatgtcatcaattagtaggacaaacactgcaccaggaactgacaaaaaacttaacggcggatgaagtggcaacgcttgagcttttactcaagaaaatcctgccgtaa

SEQ ID NO: 3466 - DNA, 1266 bp, Enterobacter cloacae
tcctgtaataacacaacaaaaaagcataagcatttgtcgggcaggaaaatgaaaccatcaatcaggcgctcaaccgcagcgctgctggcatcgtcattgttattaacaattggccgcggggcaacgctgccctttatgaccatatatcttacacgcgtgtacgatatgagcgtggagaatattggctatgcccttaccgtggcgttgaccattggcgtggtgtttagcctggggtttggcatcctggcggataaattcgacaaaaaacgctatatgctgatcgccatcgtcgcctttatcgccgggtttgtggccattccgctggtgaataacgtgacgctggtagtgctgttctttgccctgattaactgcgcctattccgtcttctcaacggtgctgaaagcatggtttgccgacgtgctgacctccagcgaaaaggcgcacgttttctcactcaactacagtttcctgaacatcggctggacgatcgggccgccgatcggcaccctgcttgtgatgtacagcctgcaactgccgttcttgctggcggccttctgcgccgcactgccgctcgggtttatccatttctttgtgcagaaaagcatagcctcggacagccctgaggagaaaatgccatggcaaccctcggtgctgctgaaagaccgggcgctgttctggtacacgctttccgggctgctggcgtcgtatgtgggtggatcgtttgccacctgcatttcccagtatgtcctcgctgcacatgcggacagtgatttcgcagaaaaggtggtggccgttgtgctgcccgtcaacgcggcggtggtcgtcaccctgcaatatgcgcttggacggaagatcaccgccagcaatatccgtccgctaatgaccgccgcgacgctttttttcatcctcgggctgggggggtttatgctttccggcgagaacctgatttactgggggatcgcggcagcgattttcaccctgggtgagattatttatgcaccgggtgaatacatgctgatcgacaatatcgccccgccgggcatgaaggcgagctacttctccgcacaagcgctgggctggctgggcgcggcggcgaacccgatgatcaccgggctcatcctgacccatctgccgcactggtcattatttatcattatgatggccgccatcattgcggcctggctgatgatattgcgcgggatgcgcgtgaaaagtgaagatagagtgtcgagtagcgctgcgcttacccgacctggaaaaccctaa

SEQ ID NO: 3467 - DNA, 801 bp, Enterobacter cloacae
tcagcagccgggccagtaaggtgcggggccacagcgtcattcattggcctcgacgatggtcaccggcatggtaaaaacgtagccttcgctgcgaacggttttaatgtaggccggcgtgcgggcatcttcattcaggcgctgtcgcacgcggctcaccaggagatcaatcgaacgctcaaacagctcggcatcacgtccctgcgtcaggttcagcagctgatcgcgggtcagcacccgttgaggatgatcgaggaatacgcgcaaaaggcgatattccgccccgctgagcgccacaaccatcccctcgttatcaatcagatgacgcgccacggtatccagttgccattcaccgaataccaccaggcgccctgcctcggtcacctgaagattaggcggcatagtacgaaaacgacgcaggatagctttgatacgcgccagcagttcgcgggccacaaacggtttcaccacataatcgtcggcgcccatctccagtcccaggatccggtccgtgtcctcgttgcgcgcggtgagcatcaggatcggcagatccttatgcctgctgctgcgcagctgtcgacacagcgtcaggccatcatcgccgggcatcatcacgtccagcaccaccaggtcgatatgctgtttgtcgagcactacgcgcatctctttcccgttcgccgcgccagaggcgtggtagccggatttcacgaggtaatcgacaatcagttcacgaatatccctgtcgtcatcgacgacaaggatgtgatcaatatgctccaccgcaggctcctgattaagaggtaa

SEQ ID NO: 3468 - DNA, 1248 bp, Enterobacter cloacae
ggctttaagatcgtctcctcatctttcaggcaacgaatcccagatatccctatgacaacacacacggtttcccgcagggtcgcgtggctacgcgtggtcacgctcgccatcgcagcgtttattttcaacaccacggaatttgttccggttgggctgctgtccgacattgcggccagcttccatatggaaacggcacaggttggcattatgctgaccatctatgcatgggtggtagcgctgatgtcgctgccgtttatgctgctgaccagccagatggaacgtcgtaagctgctgattgggctgtttgtggtgttcattgccagccatgtgctgtcatttatggcatggaacttcaccgtgctggtcatcagccgcgtcggcatcgcgtttgcccatgccgttttctggtcgatcaccgcatcgctcgccattcgtctggccccggcggggaaacgcgcccaggcgctgagcctgattgccaccggaacggcgctggcgatggtgttaggcctgccgatcgggcgcattgtgggtcaatacttcggctggcgcaccaccttctttgccatcggcatgggggcgctgatcaccctggtgtgtctgatcaaactgctgccaaaactgcccagcgaacactccggctcgctgaaaagtcttccgctgctgatgcgtcgaccggcgctgatgagcatctatttgctgaccgtgattgtggtgaccgcccattacacggcctacagctatattgagccgtttgttcaggttgtggcgggctttagcgctaactttgccaccgttctgctgctgatcctgggcggcgcggggattatcggcagcatcctgttcgggaagctgggcaatcagcatgcgtctgcgcttgtaagcagtgcgattggcctgctgctggcatgtctgctgttactgatgcctgcggcaggcagcgagagtcatctggcgatcctcagtctgttctggggcgtggcgatcatgattattggtctgggaatgcaggtcaaagtgctggcgctggccccggacgccacggacgtagcgatgtcgctcttctccgggatttttaatctggggattggcgccggtgcgctggtgggaaatcagatcagcctgcatgtatcgatgtcggccattggctatctcggggcgattccggcgctgatcgcgctgatctggtcggtgcttatcttccgtaaatggccggtcgcgatggaagaacagaccagccacggttga

SEQ ID NO: 3469 - DNA, 234 bp, Enterobacter cloacae
gacgtaaccgaggaaatcatgaaatttatcgcctccgccgccctcaccttgctggtgctggtttccggccagagcttcgcggagcaaacccccagtgcggggcagcaaaataatcgtgacaccatgattatgccgtccacgcaaaaccagtcgccctgggacttcaatcacatgggcgctggcagcgacaaatccgacgaattaggcgtgccgtattacaaccacgacctgtaa

SEQ ID NO: 3470 - DNA, 489 bp, Enterobacter cloacae
aaatgcaccgtacgggcgctgctgttgcggtacgcgtgcggtttatcgccggcaaaacgcacgccggaatcagcgtatattgtgcgccagacaccgtcgatctgcatatccagctcaccgcttatcaccaccacatgttcgatcaccccggcttcgtgcggcgtggactcgctcagcgcgccgggcgacagggtgatggagaaatggtcgaacttaagctgttcatcccaggggaaaagcggtttcaccaccatcgcctgctgctgcggatcgaataccgcctgcggttcgctttctggagtgataaacgccgaaaaaggtacgttcagcccggtggcgattttccacaaggtagagaccgtcgggctggactcattgcgttcgatttgcccaagcatcgctttcgacacgcccgtctcttccgccagttttgacaggctccagccccgcgccagacgcagcgctttcagtgtggttgccaggtgttga

SEQ ID NO: 3471 - DNA, 369 bp, Enterobacter cloacae
catgcaaaagcaaatcccgccagccagcccctgttccttatcccctcggataacagggaaaatttgcccccgaagcgacccaggcgtagactattgtcactgtttaaggagtggaatatgcagaatacgacccaacccattgaccgagcttcactgcttatcgaagcaaacaaactcattcgcgaccatgaagacaccctggcggggattgaagcgactggcgtggaacaacgtaatggcgtgctggtgttcagcggtgaatacttccttgatgaacaaggattacccaccccaaaaagcaccgccgtatttaacatgtttaaatacctggcgcataccctctcagagaagtaccacctggtcgattaa

SEQ ID NO: 3472 - DNA, 1584 bp, Enterobacter cloacae
acagaatatgagaacaacaacatgcaaacagccaaacctcatctcgaactgctgacctgcgaggcggcctatcgccataaccctaccgcgctgtttcatcaggtgtgcggcgcacgtcccgcgacgctgctgctggaatctgctgacattgacagcaaggacgatcttaaaagcctgctgctggttgacagcgcgctgcgcattaccgcgtcgggtgacaccgtcaccattaaggcgttatctgagaatggcgcgtcgctgctgccgctgctggatgcggctctgccttcaggtattgaaaatgagcgtcatccggacctgcgaattctgcatttcccaccggtaagccagctgctggatgaggatgcccgcctctgctcgctctccgtttttgacgccttccgtctgctgcaaaatctggtggccgtgccggaagatgagcgcgaagcgatgttctttggcgggctgtttgcttacgacctggttgctggctttgaaaatttaccggaaaccgagcagggaaaccgctgcccggactactgtttctacctggccgaaaccctgctggtgatcgaccatcagaaaaaatatacccgcatccaggccagcctgttcacgccgtctgagtcagagaaaaatcgcctcgcgcagcgcatcgcccaactgcaacagcagatgtcggaagcaccgcccgcgctgccggtgcagcgtgttgaaaagatgacctgcgaggtgagtcagaccgacgatcagtacggcgcggtggtgcgtcagatgcaaaaagcgattcgtgccggggagatttttcaggtggtgccgtcccgtcgcttttcactgccctgcccgtcgccgctggcggcttacgatgtgctgaaaaagagcaacccaagcccgtacatgttctttatgcaggacaatgatttcactctgtttggcgcgtcgccggaaagctccctcaagtacgacgctaccagccgccagattgagatctacccgatagcgggaacccgtccacgcggccgtcgtgccgatggctccctggaccgcgatctcgacagccgcatcgaactggaaatgcgtaccgaccataaagagctctccgaacacctgatgctggttgacctggcgcgtaacgatctggcacgcatttgcacgccaggcagccgctacgtggcggacctgaccaaagtcgaccgctactccttcgtcatgcacctggtctcccgcgtggtgggtgaactgcgccacgacctcgacgttctgcacgcctaccgcgcctgcatgaacatgggcaccctgagcggcgcgccgaaagtccgcgccatgcagctgatcgccgaagctgaaggacgccgtcgcggcagctacggtggtgcggtgggctatttcaccgctcacggtgacctcgatacctgcatcgtgatccgctccgcctacgttgaggacggcattgccaccgtccaggccggggccggaattgtgctggattctgttccgcagtcggaagccgacgaaacccgcagtaaagcgcgcgcggtactgcgcgccattgctaccgcacaccatgcacaggagattttctga

SEQ ID NO: 3473 - DNA, 1272 bp, Enterobacter cloacae
agtcccaaccgggcattaaagacgccagcaagctggcatcggtatttaaaactctgcgtgcatattaaggaagagaagatgacgacattacttaacccgtattttggtgagttcggtgggatgtatgtcccacaaatcctgatgcccgcgctgcgccagctggaagaagcgttcgtgagcgcacagaaagatccggcgtttcaggcggagtttactgacctgctgaaaaactacgccggtcgtccgacggcgctgacaaagtgccgcaacctgaccgaaggcactaaaactacgctgtatcttaagcgtgaagatttgctgcacggtggcgcgcataaaactaaccaggtgctgggccaggcgctgctcgcgaagcggatgggtaaaaccgaaatcatcgccgaaaccggcgcggggcagcacggtgtggcctcagcgctcgccagcgccctgctcggcctgaaatgccgcatttacatgggggcgaaggacgttgagcgccagtcgccaaacgtgttccgtatgcgtctgatgggggcggaagtaatcccggtgcacagcggttctgccacgctgaaagatgcctgtaatgaagcgctgcgcgactggtctggcagctacgaaaccgcccactacatgctcggtaccgccgcgggcccgcacccgttcccgaccatcgtgcgtgaattccagcgcatgatcggcgaagagactaaagcgcagatcctcgaaaaagagggtcgcctgccggatgcggtgatcgcctgcgttggcggcggatctaacgccatcggcatgtttgccgattttatcgacgaaaccagcgttgggctgattggcgttgagcctgccggccacggcattgaaacgggcgagcatggtgcgccgctgaagcatggccgcgtggggatctacttcggcatgaaggccccgatgatgcagaccgatgaagggcagattgaggagtcttactcgatctctgccgggctggatttcccgtccgtagggccgcagcacgcgttcctgaacagcaccggccgcgcggattatgtctccatcaccgatgacgaagcgctggaggccttcaaaacgctgtgccgcaatgaagggatcatcccggcgctggagtcttcccacgcgctggcgcacgcgctgaaaatgatgaaggaaaacccggaaaaagagcagctgctggtggtaaacctttccggtcgcggtgacaaagatatcttcaccgttcacgatattctgaaagcacgaggggaaatctga

SEQ ID NO: 3474 - DNA, 1050 bp, Enterobacter cloacae
ccccttttctgcgctgtatgcgcggcaccaatcaaaaacagagccgctgtgtggcactggaaggtgaacctggggtatccacccgctgctccatttacgcggatcgccccagcccgtgtcgcactttcgcgatgtcgggagaggatgggcaggtcaatgaggcatgcaatcgcgcccgcgcccgctatggattaccgccgctttacaaagatatgcttttccatacaagccttgatgctgccaccagcgtgttatccggtgtacaattgccggctaattaacacctgcaatactcaaggagagtgcatgtctatcacggcgaagtctgtctaccgtgacacgggaaattttttccgcaatcagttcattacctttttactgatcgcgttgttgtgcgcctttattacggtggtgctgggtcatgcgttctcacccagtgatgaacagattgccacgctgagccagggggatcatcttgcaggcagcgcagggttgtttgaccttgtgcagaatatgacgcctgagcaacagcaaatcttgctgcgcgcatctgcggcatctaccttctcgggtctgattggcaacgccattctggcgggtggcgtgttgctgatgatccaactggtatctgccggccaacgcgtcagcgcgttacgtgcaatcggggccagtgctccggtgctgccaaagctgtttatcctcatcttcctgaccacgctgctggtccagatggggatcatgttggtggtcgttccgggcgtgctgctggctatcgtgctttcattcgcgccagtaatggttgtgcaggacaaactgggcattttcaccgccatgcgcagcagcatcaggctcgcatgggccaatatgcgactggtcgccccggccgttatcagctggctgctggccaagactctgctgttgctgtttgcgccgaattttgcggtgttaacgccaaacgtcggagcggttgtcgccaatacgctgagcaatctgatttcagccgtgctgctggtctatttgttccgcctgtacatgttaattcgtcagtaa

SEQ ID NO: 3475 - DNA, 465 bp, Enterobacter cloacae
ccctattctctccagccagaaatcatagtagcatcccgcctgaagtcttcagttacgagtttaaaaacaatgacaacaaatgacgccccacagggcgaactggttttacgcacactggcaatgcctgcggatacgaatgccaatggcgatatttttggcggctggttgatgtcgcagatggatatgggcggtgcaatcctggcaaaagagattgcacacgggcgtgtggtaaccgtccgggtcgatggcatgaccttcctgcgtcctgtcgcggtgggggacgtggtgtgctgttatgcacgctgcgtaaaacgcggcactacgtctgtctccatcaacattgaagtctgggtgaaaaaagtctcttctgaaccgattggtcagcgctataaggcgacggaggcattgttcatctatgtggcggtggatagcgacggtaagccccgccagcttccacggagctga

SEQ ID NO: 3476 - DNA, 2745 bp, Enterobacter cloacae
  unsure (2733)
tcctttgttttactgtgtgttacgcaagtgggatcggctctgactatactgtcagacgtatcgagcgctggtttactaaaagagtttaaacattatcaggagagcattatggctgttaccaatatcgctgaactgaacgccctcgtcgagcgcgtaaaaaaagcccagcgtgaatatgccaatttcacccaagaacaggttgataaaatcttccgcgcggccgctctggctgctgctgatgctcgaatccctctcgctaaaatggccgttgccgaatccggcatgggtatcgttgaagataaagtgatcaaaaaccactttgcttcagagtatatctacaacgcctataaagatgagaaaacctgcggtgtgctgtcagaagacgatactttcggcaccatcaccatcgcagaaccgatcggcatcatttgcggtatcgttccaaccactaacccaacctctaccgccatcttcaaatctctcatcagtctgaagacacgtaacgcaatcattttctctccgcatccacgtgcgaaggacgccaccaacaaagcagcagatatcgtgcttcaggctgccattgcggcgggtgcgccaaaagatctgatcggctggatcgaccaaccttctgttgaactgtccaacgccctgatgcatcacccggacattaacctgattctggcgaccggtggtcctggtatggttaaagcagcatacagctccggtaaaccagccatcggcgtaggcgcaggtaatacccctgttgtgatcgacgaaacggcagatatcaagcgtgcagttgcttctgtgctgatgtctaaaaccttcgataacggcgttatctgcgcatctgaacagtctgttgtcgtggttgattcggtatacgacgccgttcgagaacgtttcgccagccacggcggctacctgttgcaaggtaaagaactgaaagccgttcaggacgtgatcctgaaaaatggcgcgctgaacgcagctatcgtaggtcagccagcgtataaaattgctgaactcgctggctttagcgtccctgctaccaccaaaattctgattggtgaagtgaaagtcgttgatgaaagtgagccgtttgctcacgagaaactctccccaacgctggcaatgtaccgtgcgaaagattttgatgacgcggtagaaaaagcagagaaactggtggcaatgggcggtatcggccacacctcttgcctgtacaccgatcaggataaccagcctgagcgtgttgcttacttcggtcagaagatgaagacggcacgtatcctgatcaacacccctgcttctcagggtggtatcggtgatctgtacaacttcaaactcgcaccttccctgactctgggttgtggttcctggggtggtaactccatctctgaaaacgttggtccaaaacacctgatcaacaagaaaaccgttgctaagcgagctgaaaacatgttgtggcacaaacttccgaaatctatctacttccgccgcggctctctgccaatcgcgctggatgaagtgattactgatggccacaaacgtgcgctcatcgtgactgaccgtttcctgttcaacaatggctatgcagaccagatcacctctgttctgaaagcggctggcgtcgaaactgaagtcttctttgaagttgaagctgacccaaccctgagcgttgtccgtaaaggtgctgaactggcgaactccttcaaacctgatgtgatcatcgcactgggtggcggttccccaatggacgccgcgaaaattatgtgggtgatgtacgagcatccggaaactcacttcgaagaactggcgctgcgctttatggatatccgtaaacgtatctacaagttcccgaaaatgggcgtgaaagcgaaaatgatcgccgtcaccactacttccggtactggttcagaagtgactccatttgccgttgtgactgatgacgcaaccggtcagaaatacccgctggctgactacgcactgacgccagatatggctatcgttgacgccaacctggtcatggaaatgccgaaatcactgtgtgcgttcggtggtctggatgcggtaactcacgctctggaagcttacgtttccgtactggcttctgagttctctgacggtcaggctttgcaggcgctgaaacttctgaaagaaaacctgccagcttcttacaacgaaggttcgaaaaaccctgttgcgcgtgaacgtgtacacagtgcggcaacaatcgcgggcatcgcgtttgctaacgccttcctgggtgtctgtcactctatggcgcacaagctgggttcacagttccacattcctcacggtctggcgaacgccctgttgatcagcaacgttatccgctataacgccaacgataacccaaccaagcaaactgcattcagccagtatgaccgtccacaggcgcgccgtcgttatgctgaaatcgcagatcacctgggtctgagcgcaccgggcgaccgtactgccgcgaagatcgaaaaactgctggcatggctggaaagtctgaaggcggaactgggtattcctaaatctatccgcgaagcaggcgttcaggaagctgacttcctcgctcacgtagataagctgtctgaagatgcattcgatgaccagtgtactggtgctaacccgcgctacccactgatttccgaactgaaacagatcctgctggatacttattacgctcgtaacttcactgttgctaacagcgagagacgnagtattcctaac

SEQ ID NO: 3477 - DNA, 642 bp, Enterobacter cloacae
aaccggaatgacattcgatgcccagccaggccgcaaaccggggatatcgcaatgagtgaagatcggcatcagcagcgccagcagcgtctgaaagaacaggttgatgcacgcgtggcggccgctcaggacgagcgcgggatcctcattgtgtttaccggcaacggtaaaggcaaaaccaccgccgcatttggtaccgccacccgcgcagtcggacatgggcagaaagtgggcgtgatccagtttatcaagggtgaatggcccaacggcgagcgtaatctgctcgagccgcatggcgttgagtttcaggtgatggcgaccggttttacctgggatacccagaaccgggaaaccgataccgcagcctgcctcgccgtctgggagcatgctaaaaggatgctctctgacccgtcgttgaacatggtgttgctggatgagatcacctatatggtcgcctacgactatctgtcgctggaggccgtgctggctgccctgaaaaaccgcccagcgcatcagacggttattgtcacggggcgcgggtgtcatcgggatattctggagctggccgataccgtcagcgagctgcgtccggttaagcatgcgttcgatgcgggaatcaaagcgcaaattgggattgattactga

SEQ ID NO: 3478 - DNA, 252 bp, Enterobacter cloacae
aactcaggagaatgccgcatgaaagagatcgtgcctgattatcgtctcgatatggtgggtgaaccttgcccttacccggccgtcgccacgcttgaagcgctaccgcagctaaagaaaggtgaaattctggaagtggtgagcgattgcccccagtcgatcaataacattccgcttgatgccaaaaatcacggctataccgtgctggatatccagcaggacggaccaaccattcgttatttaattcagaagtga

SEQ ID NO: 3479 - DNA, 564 bp, Enterobacter cloacae
ttcgtcagtaactgggatcgcagaatgaagcagtttcttgattttttaccgctgatcgtatttttcgctttttataagctgtacgacatttatgccggcacgctggcgctgattgtggcaacggctgtggtgctgatttacagctgggttcgctatcgcaaagttgaaaagatggcgctcatcaccttcctgatggtggcggtgtttggtggtctgacattgttcttccacaatgatgaatttatcaaatggaaggtcacggtgatttacggcctgtttgcgggcgcactcctcatcagccagtgggtgatgaagaagccactgatccagcgcatgctggggaaagaactgaccctgccgcaggctgtgtgggggcgtctgaatatcgcctgggcgctattttttattctgtgtggtctggcgaatatctatatcgcattctggctcccgcagaatatctgggtcaacttcaaggtgtttggcctgacggcgctgactcttatcttcaccctgctcagcggcgtttatatttatcgccacatgccgcaggatgacaagcactga

SEQ ID NO: 3480 - DNA, 2052 bp, Enterobacter cloacae
gcgctgaagcaacagccgggggtttccatcatcacggcaaaggacatagaaaaggatccaccggttaacgatctttcagaaattattcgcaaaatgcccggggttaatctcaccggaaacagcgcgacaggcagccgcggtaacaaccgccagatcgacatccgcggtatggggccggagaacacgctgattctgattgacggtgtgccggtgacgtcacgtaactcggtgcgctacagctggcgcggggagcgcgacacccgcggggatactaactgggttccgccagagatggttgagcgcattgaagtgctccggggacctgctgccgcccgctatggttcgggggcggccggcggcgtcgtcaacatcattaccaaacgcccgaccaacgactggcacggctcactctccctgtacactaaccagcctgaaaatgataaagagggggcgacaaaacgcgctaattttgatctgagcggcccccttgcgggcgatgcgttaacgatgcgcctgtacgggaatatcaataaaactgacgcagatgctcaggacatcaacaccgcgcaaaatggctcttacgccgccggacgtgaaggcgtgcgcaacaaggacatcaatgccctgctctcctggaaactcacgccacagcagattatcgatttcgactacagctacagccgccagggcaatatctacgcgggtgatactcaatacagcaacagcaacgtcagccctgacggtctggtgtcgtccctgtatggacacgaaaccaaccgaatgtaccgccagtcttatggcattacgcacaacggcatctgggactggggtcagtcaaagttcggtgtctattatgaaaagaccaacaacacccgcctggaagaaggctctacgggcaaagttgaggggatgatcaatagcgataaatacgataccagccggctggagtcataccgttcaacgggtgagctgaacattcctttcttctggctggtcgaacagacgctaaccgtgggtgcagaatggaaccgtgatgaactgaacgatccggcctcaatgcaggcgacaaatgtgtcgggagaagtgattaacggcgttcccggcacggcttctgagcgcaacagcaaaaacagcgctgacctcaccggcatctatcttgaggacaatattgaagcgcgtcagggcaccaacctgatcccagggatccgctttgattatcacaatcagttcggcagcaactggagccctagcctgaacgtctctcaggatttgggtgacatgttcaaggttaaagcgggtatcgctcgggtatttaaagcgccaaacctgtatcaatccagcgaaggctatctgctttccacccgcggtaatggctgcccgaacaacgtttccgaaggaagctgttatttgttaggcaacccggatctggatcctgaaatcagcgtgaacaaagagattggcctggcctttgcgctggaaggctacgaggctggcataacctggttccgcaacgattacaaaaacaagatcgtttcaggaacggacgtgctgggccagacaagcagcggcgcaaatatccttcagtggcagaacggaggaaaggccgttgttgaagggctggaaggcaacctcaccgtccctgttattcgcgacacgctaacctggcgtactaatgcgacgtatatgattcagtctaaaagtaaagacaccggtaatccgttgtcgattatccccaaatataccgtcaacaccatgctggactgggaggttaacagcaagctttcagccaacgtaagctggacgatgtacggccgccagaagcccagagaaaacgctgaaatccgcaaagaggaaaatgcgatgtccaacagagagatcggcgcgtattccatcgtgggtatcggcagtaactatcagctgaccaaaaacctgcgcctgaatgccggcatcagcaacctctttgacaagcagatttaccgtgaaaatgacggtgcatcgacctataacgaaccaggccgtgcgtattacgcaggcgtgaccctgtccttctga

SEQ ID NO: 3481 - DNA, 333 bp, Enterobacter cloacae
cgtaattgtcacttttaccggttaaggagctttgccgtgctttacgtgatttacgctgaagatgtacctgattctctggaaaaacgtctttccgttcgccctgcccatctggcgcgtttacagttgctacaggatgaaggtcggttgctgaccgcaggtccgatgcctgccgttgacagcaacgatccgggcgcggcgggttttaccggctccgcggtgattgccgagtttgaatctctggaagccgcgcaggcctgggcagaagcagacccgtacgtcgcagccggcgtgtacgagaaagtcacggttcgtccgtataaaaaagtattctga

SEQ ID NO: 3482 - DNA, 1512 bp, Enterobacter cloacae
atcctgatgcgtaaactcataacaatacgctttcaaaaggattttttatttatgacaaccttctacaccgtggtgagttggctggtcattttaggatactggctgttaattgccggggtgacgttgcgcattctgatgaaacgcagagcggtaccttccgccatggcctggcttctgattatctacattctgccgctggtgggcatcatcgcctatctctctttcggtgaacttcatctgggtaaacgccgcgccgaacgcgcccgcgccatgtggccctccacggcgaaatggcttgccgaccttaaagcctgcaagcatatcttcgctgaagagaacagcagcgtggccgcatctctgttcaagctgtgcgaacgccgccaggggattgctggggtaaaaggcaatcagctgcaactgatgacctcttctgatgatgtgatgcaggcgctgatccgtgatatccagctcgcccggcataatatcgagatggtgttttatatctggcagccgggcggcatggcggaccaggtcgccgaatcgctaatggccgctgcacgtcgcggtatccactgccgcctgatgctggactccgccggcagcgtggcctttttccgtagcccgtgggcaggcatgatgcgcaacgccggtatcgaggtggtcgaggcgctgaaagtgaatcttttccgcgtctttctgcgccgcatggatctccgccagcaccggaaaatggttctgatcgataactatatcgcctacaccggcagcatgaacatggttgacccccgcttcttcaagcaggattccggcgtggggcaatggatcgatctgatggcgcggatggagggaccgatcgcgacctcaatgggcatcgtctactcctgcgactgggaaattgaaaccgggaaacgcattcttcccccgccgccggatggcaatatcatgccgtttgaggaagccagcgggcacactatccacactatcgcctccggtcctggcttcccggaagatctgatccatcaggcactgctgaccgccgcgtactccgcgcgggaatatctgatcatgaccacgccctatttcgttcccagcgacgatcttctgcatgccatctgtacagcggcacagcgcggagtggatgtgagcattattatgccacgcaagaacgattcgctgctggtcgggtgggcaagccgcgcgttctttagtgagctgctggccgcaggcgttaaaatttatcagttcgaaggcgggctgttacacaccaagagcgtgctggtggacggagagctgagcctggtgggtaccgtcaacctcgatatgcgcagtctgtggctgaattttgaaattacgctggtcattgatgacgccgggttcggtggcgatctggcggcggttcaggacgattatatctcccgctcacgcctgctggacgccagactgtgggcgaaacgtccgctctggcagcgaattgccgaacgactgttttacttctttagcccgttgctgtaa

SEQ ID NO: 3483 - DNA, 342 bp, Enterobacter cloacae
caggtagtcatcatggaaatggatctgaacaatcgcctgaccgaagacgaaacgctcgaacaggcctacgatatttttctcgagctggcggtcgataatctcgaccctgctgacgtcattcttttcaacctgcaatttgaagagcgtggcggtgctgagctgttcgatccgtctgaagactgggccgaacacgtcgattttgacctcaatccggacttcttcgccgaggtggtgattggcctggcagatgaagacggcggagaaattaacgacatctttgcccgcgtcctgctgtgccgcgagaaagaccacaaactgtgccatattctctggcgcgaataa

SEQ ID NO: 3484 - DNA, 654 bp, Enterobacter cloacae
tccaatacagaaagcataatggggcaaaggcacgaaacgtgtcagcctggtctggacaatcacatgcagcttaaacgtgtggcagaagccaaactgccaaccccatggggcgatttcctgatggtgggttttgaagaactggcaaccgggcaagatcacgtcgccctggtattcggcgacatttcggggcaaacgccggtgctgtcccgcgttcattcagagtgtctgaccggtgacgcgctgttcagcctgcggtgcgactgcggtttccagcttgaagccgccctttctcatatcgcagaggaaggacgtggcgttctgctgtatcaccgtcaggaaggacgcaatattggcctgctgaataaaatccgcgcctacgcgttgcaggatcagggctacgataccgtcgaagcgaaccatcagctcggctttgctgctgacgagcgcgatttcaccctgtgcgcagatatgttcaagctgctgggcgtggacgaagtgcgtctgttgaccaataacccgaagaaagtggaaatcctcactgaagcgggcatcaatatcgtggaacgcgtgccgctgattgtcggccgcaacccgaaaaacgcgcactacctcgatactaaagccgccaaaatggggcatctgctgagcgagtaa

SEQ ID NO: 3485 - DNA, 771 bp, Enterobacter cloacae
ggagccaccgtgcattatcagccacaaaaaaaccttctacagaaccgcatcattctggttaccggtgccagcgacgggattggtcgcgaagcggcgctgacctattctgaatacggtgcgagccttattctgctgggacgtaatgaagaaaagctcaaggccgtcgcccgtgaaatcgaaaacgccggcggtacccccacgccgtggtatacgctcgatctgttgacctgtacgccagcgtcatgtcaggccattgcccagcgtatcagcacgcattatccgcgtctggatggcgtactgcacaacgcggggttactgggcgaagtgcgcccgatggatgaacaggatccggagatttggcagcaggtgatgcaggttaacgtcaacgggacgttcttcctgacccaggccttgcttcctttattactcaactccgattccggctcgctggtctttacctcctccagcgtggggcgtcaggggcgtgcgaactggggggcttacgccgtctcaaaatttgccaccgaaggaatgatgcaggtgctggccgaagagtaccaaagccgccacctgcgggttaactgtattaacccgggcggtacacgcaccaaaatgcgtgccagcgccttcccgacagaagatccgcaaaagcttaaaaccccggccgatattatgcctctttacctgtggctgatgggtgacgacagccgtcgtaaaaccggaatgacattcgatgcccagccaggccgcaaaccggggatatcgcaatga

SEQ ID NO: 3486 - DNA, 1653 bp, Enterobacter cloacae
agcgcgcgcggtactgcgcgccattgctaccgcacaccatgcacaggagattttctgatggctgacattctgctgctcgataatatcgactcctttacctacaacctggcagatcagctgcgtgcgaatggtcacaatgtcgttatctatcgcaaccacgttccggcccagacgctgattgaccgtctggcgaccatgcaaaacccggtgctgatgctctccccgggcccaggcgcaccgagcgaagcaggctgtatgcctgagctgttgacccgtatgcgcggcaagctgccgattatcggcatctgccttggccatcaggcgattgtcgaagcctacggcggttacgtgggtcaggcgggggagatcctgcatggtaaagcgtcaagtattgaacatgacggtcaggcgatgtttgccggtctgccaaacccgcttccggtagcgcgttaccactcgctggttggcagcaacattccggccgggctgaccattaacgcctcgtttgaagggatggtgatggcggtgcgtcatgatgcggatcgcgtctgcgggatgcagttccacccggaatctatcctgacgtccaacggcgggcgcctgctggagcaaacgctcgactgggcgctgcaaaagctggagcagaccaacaccctgcaaccgattctggaaaaactgtatcaggctcagaccctgagccagcaggagagccaccagctgttctccgccgtcgtgcgcggcgagctgaagcctgagcagctggccgctgcgctggtgagcatgaaagtgcgcggcgaaagcccgcaggagatcgccggtgccgcaaccgcgctgctggaaaatgccgccccgttcccgcgcccggactacccgtttgccgatattgtcgggaccggtggcgacggcagtaacagtatcaatatttccaccgccagcgcctttgtggccgcggcatgcggtctgaaagtggcgaaacacggcaaccgcagcgtgtccagccgttcaggatcgtccgacctgctggcagctttcggtatcaacctggacatgaacgccgagcgttcccgtgaagcgctggatgacctgggcgtctgtttcctgtttgcgccgaagtatcacaccggtttccgccacgcgatgccggttcgccagcagcttaaaacccgcacgctgtttaacgtgctcggtccactcattaacccggcgcacccgccgctggcgctgattggcgtttacagcccggagctggtcctgccgattgcggagacgctgcgcgtcctcggttaccaacgcgccgccgtggtacacagcggcggaatggatgaagtttccctgcatgcgcccacgctggtggcggaactgaatcacggcgaagtgctgaactatcagcttgaggccgctgacttcgggttgaccccgtaccatcaggacgccctggcgggcggcacgccggaagaaaaccgtgacattctcacgcgcttattacaaggtaaaggtgaggccgcccatgaggccgccgtggcggccaacgtagccatgctgatgcgtttacatggcgaggaagatctaaaagccaacgcccaaaaagttctggccgtactgcgctccggtgcagcttacgatcgcgttaccgcacttgcggcaagagggtaa

SEQ ID NO: 3487 - DNA, 1362 bp, Enterobacter cloacae
ataatgcagaccgttttagcgaaaatcgtcgccgataaggccatctgggtggaagcccgcaagcaacagcagccgctcgccagttttcagaatgacgtcgttccgagcagccgtcgtttttatgatgcgcttcagggcgcgcgtaccgcgtttattctggagtgtaaaaaagcgtctccgtccaaaggcgtgatccgtgacgatttcgacccggcgcgtattgccggtatctacaagcatcatgcgtctgccatttctgtgctgacggatgagaaatattttcagggcagcttcgattttctgcccgtagtcagcggcatcgcgccgcagccgattctgtgcaaagactttattatcgacccgtatcagatctggctggcgcgcttttaccaggccgatgcctgcctgctgatgctctccgtgctggatgacgagcagtatcgccagctctccgccgtcgcgcacagcctgaatatgggcgtactgaccgaagtgagcaacgaagaggagctggagcgcgccatcgcgctggaagccaaagtggtcggcattaacaaccgcgacctgcgcgacctgtcgattgacctcaaccgtacgcgccagcttgcgccgcgtctgggcgcgggcgtcacggtgatcagcgaatccgggataaacagctacgctcaggtgcgcgaactcagccactttgccaacggtttcctgatcggctccgcgatgatggaacacgacgatcttaatgcggccgtgcgccgcgtgctgttgggtgagaacaaagtctgcggcctgacccgtgaacaggatgcgcaggccgcatatgaagcgggcgcaatctatggtggtctgatctttgttgagtcctctcctcgcgccgttaatgaggaacaggcgcgcaaggtgatggcggctgcgccactgaactacgtgggcgtgttccgcgatgcggatattaacgacgttgcggctaaagcggacgcgttatccctgagcgcggttcagctgcatggcgatgaagatcaggcgtacattgatgctctgcgacatgctctggcgcctcaggttcagatctggaaagcgcaaagcgttggcgccaccctgcccgcgcgtaacctgaagcatgttgataaatacgtgctcgacaacggccagggcggcacggggcagcgtttcgactggtcactgctgcgtggcgaagtgctggacaatgtcctgctggcggggggattaagccccgataactgtgtggaagcggccaaaaccggctgcgccggcctcgatttcaattcaggcgtagagtcccaaccgggcattaaagacgccagcaagctggcatcggtatttaaaactctgcgtgcatattaa

SEQ ID NO: 3488 - DNA, 861 bp, Enterobacter cloacae
caaagatatcttcaccgttcacgatattctgaaagcacgaggggaaatctgatggaacgctacgacaacgcatttgcacaactgaaagcccgccaggaaggcgcgttcgttcccttcgtgacgctgggcgaccccggcccggagcagtcgctgaagattatcgacaccctgattgatgccggtgccgacgcgctggagctcggtattccgttctccgatccgctggcggatggcccgaccattcagaacgcaacgctacgcgcgtttgccgcgggcgtgacgccgggccagtgctttgaaatgctggcggcgatccgtcagaagcacccgaccattccgatcggcctgctgatgtacgccaacctggtgttcagccgcggcattgatgcgttttacgcagagtgcgcccgcgtgggcgttgactccgtgctggtggctgacgtgcccgttgaagagtctgcgccattccgtcaggcggcaatgcgccacaacgtcgcgccgattttcatctgtccaccgaatgccgatgacgatctgttgcgccagattgcctcttacggacgaggttacacctacctgctctcccgtgcgggcgtcaccggtgcggaaaacaaagccgcgctgccgctgcatcatctggtggagaagcttgcagaataccatgctgcaccgccgcttcagggctttggcatttcctcaccggatcaggttactgcggcgattgacgcgaaagccgccggggccatttcgggttcggctatcgtgaaaattatcgagaagaacgtggataagccacagcagatgctggctgaattacacgcattcgtcacatccatgaaagcggccacgcgcaaggcgtaa

SEQ ID NO: 3489 - DNA, 1227 bp, Enterobacter cloacae
gttcagaggttattcatgtcatggtattccttcaaacagacttacctggttaagttctggtcacctgttccggccgttatcgcggcaggcattctctctacctattatttcggtattaccggcaccttctgggctgttacgggcgagtttacccgctggggtgggcagctattacagctggcaggcgtccatgccgaagagtggggctacttcaaactgatccatcttgagggcacaccgctgacccgcatcgacgggatgatgatcattggcatgttcggcggctgttttgcggccgcgctgtgggccaacaacgttaagttgcgcatgccgaaaagccgcatccgcattatgcaggccgtggtcggcggcatcattgccgggtttggcgctcgtctggcgatgggctgtaatctggccgcgttctttaccggcattccgcagttctcgctgcatgcctggttctttgccgtcgccaccgccatcggctcctacttcggtgctaaattcaccctgctgccgctgttccgcattccggtgaaaatgacgaaagttagcgctgcctctccgttaacgcaaaaacccgatcaggcgcgtcgtcgtttccgcctcggtatgctggtcttttttgctatggttgcctgggcgatttgcacggcgatgaatcagccaaaactcggcctggccatgctgttcggcgtcggttttggtctgctgattgaacgcgcgcagatctgctttacctccgcgtttcgcgatatgtggatcaccggacgaaccatgatggcgaaggcgatcattgccggtatggccgtgagcgcgatcggcatcttcagctacgttcagctcggcgtggaaccgaaaatcatgtgggcgggcccaaatgccgtcattggcgggctgctgtttggctttggcattgtgctggcgggcgggtgtgaaaccggctggatgtatcgcgctgtggaaggccaggtgcattactggtgggtgggtctgggtaacgtgattggctctacccttctggcctgctactgggatgacgtctctccggtgctggcaacaaactgggacaaggtcaacctgctgaaaacctttggtccactcggggggctcctggttacctatgccctgctgctcatcgccttcttactggttgttgcacaagagaagcgcttcttccgacgcgccaccgccaaaactgaaactcaggagaatgccgcatga

SEQ ID NO: 3490 - DNA, 435 bp, Enterobacter cloacae
tttgatgcgttctacttttgcaggtgtgccatgagtgatcataacccgtgcatgacgtgcggagcctgttgtgcgtattttcgagtctctttctactgggctgaagccagcgatggcggcggcaccgttccggtcgatctcactgaacccttaaccccttttctgcgctgtatgcgcggcaccaatcaaaaacagagccgctgtgtggcactggaaggtgaacctggggtatccacccgctgctccatttacgcggatcgccccagcccgtgtcgcactttcgcgatgtcgggagaggatgggcaggtcaatgaggcatgcaatcgcgcccgcgcccgctatggattaccgccgctttacaaagatatgcttttccatacaagccttgatgctgccaccagcgtgttatccggtgtacaattgccggctaattaa

SEQ ID NO: 3491 - DNA, 351 bp, Enterobacter cloacae
  unsure (214)
cacgcagtttctccctggacatgctcaattgcggagcttaatgtgattcaaacgctctttgatttccctacatatttcaagttttttatcggcttgtttgctcttgttaacccggtagggatcatccctgtcttcatcagtatgaccagctatcagacggctgcggcacgaaataaaaccaacctgacggcaaacctgtcgtggcgattcatcntactaagttctctttatctcgggaacgccattcttcagttcttcggcatctcgattgattcgttccggtatagcaggcgggatcctggtggtgacgattgccatgtcgatgatcagcggcaagctgggggaggataa

SEQ ID NO: 3492 - DNA, 954 bp, Enterobacter cloacae
cattcatcaggcacacgccagaaggtacgggcaatgttgaaatttatcctgcgtcgctgtcttgaagcgattccaacgttatttattctaattacaatttccttcttcatgatgcgtcttgcaccgggcagtccttttaccggtgaacgcacgcttccgccagaagttatggccaacatcgaagcgaaataccatttaaacgatcctatcaccacgcagtacttcaactatctgaagcagcttgcacacggtgattttggtccgtcatttaaatataaagactattccgttaacgacctggtggcgtccagcttcccggtatcggctaaattaggagctgctgcatttatcctggccgttgttctcggtgtcactgcgggcgttatcgccgcgcttaaacaaaatacccgatgggattacgccgtaatgggggtcgcaatgaccggggtggttatccccagcttcgttgttgcgccgttgctggtcatgatattcgccataaccctgaaatggcttcccggaggcggctggaacggcggggcgctgaagttcatgatattgccgatggtggcattatctctggcctacatcgccagtatcgcccgtattacccgcggttcaatgattgaagtcctgcattcgaacttcatccgtaccgcccgtgcgaaagggctgccgatgcgccggattattttccgtcatgccctcaagcctgcactgttaccggtactctcctatatggggcctgctttcgtcggcattatcaccggttcaatggtgattgaaaccatttatggcctgccgggtatcgggcagctgtttgttaacggggcgcttaaccgtgactattcgctggtgctgagcctgacgatcctcgtgggcgcgctgaccattctgtttaatgccgttgtcgatgtgctgtatgccgttatcgaccctaaaatccgttactaa

SEQ ID NO: 3493 - DNA, 921 bp, Enterobacter cloacae
ctggagcacgccatgatgttgagtaagaaaaacagcgaggcgctggaaaacttcagtgaaaagctggaggttgaaggtcgtagcctttggcaggacgcccgccgtcgttttatgcataaccgcgccgccgttgccagcctggtcgtgctggtgcttattgcgctgtttgtcaccctggcgccaatgctctctctgttcacctatttcgatacggactggggcatgatgtccagcgcgccggatatggaatccgggcactatttcggtaccgactcttccgggcgtgatttgctggtgcgtgtggcgattggcggccgtatctccctgatggttggcatcgcggcggcgctggtggcggtgatcgtcggcacgctttacggttcgctttccggatacctcggcgggaaagtggactccgtgatgatgcgtctgctagaaatcctgaactccttcccgttcatgttcttcgtcattctgctggtgaccttctttggtcaaaatatcctgctgatcttcgtggcgatcgggatggtgtcctggctggatatggcgcgtattgtgcgcggccagacgctgagcctcaaacgtaaggagtttatcgaagccgcacaggttggtggtgtttctaccgccaatattgtggtgcgtcatatcgttcctaacgtgctgggcgtggtggtggtatacgcctccctgttggtgccaagtatgatcctgtttgaatctttcctgagcttcctgggattaggtacgcaagagccgctgagtagctggggcgctctgttaagtgatggcgcaaactccatggaagtgtcaccgtggttactcctgtatccggcgggcttcctggtcgtcaccctgttctgtttcaactttatcggcgatggcctgcgtgatgccctcgacccgaaagaccgttaa

SEQ ID NO: 3494 - DNA, 813 bp, Enterobacter cloacae
agaaattcagttatgattgtggtgcttagtgaaaaaggagaggacatgctttcgattgccagacgaacggccgcaggtgccgccgtattgctcgttatacccctggtcgtttggttctccggctggatgtggcagcccggacaaaacgagacgtggctgaaagccctatactggataaccgagacggtcacccagccgtgggggattattacacacgtgctgctctgtggctggttcctgtggtgcctgcgctttcgccttcgtgcggcgctggtactgtttgccattctcggcggggccatactcatcgggcagggggtgaagtcgtgggtgaaagatcgcgtgcaggaaccccgtcctttcgtcgtctggctggaaaaaacgcaccatgttccggtggatgagttctacaatttaaagcgtaaagatcgcggtgcgctggtaaaggagcaacttgcggaacagcaggatatcccgacctttttacgcaaacactggcaaaaagagaccggctttgcgtttccttccgggcatacgatgtttgctgccagctgggcgctacttggcgtaggactgctgtggccgcgtcggcgtaccctcacgattgcgattttgctggtctgggcgacaggcgtaatgggcagccggatgctgctggggatgcactggccgcgtgatttggtggtggcaacgctgatctcgtgggtactggtgacgctggcgacctggcttgcacaacgtttttgtggacccctgacgccgccgccggaagagaaggaagaaatagccgaaagggagtctggcggaacctga

SEQ ID NO: 3495 - DNA, 471 bp, Enterobacter cloacae
gttctctttatctcgggaacgccattcttcagttcttcggcatctcgattgattcgttccggtatagcaggcgggatcctggtggtgacgattgccatgtcgatgatcagcggcaagctgggggaggataaacagaacaagcaggaaaaatcagagacagcaatccgcgagagcattggggttgtgccactggcgctgccgctgatggcgggcccgggggcgatcagttccaccattgtgtggggaacgcgctaccacagcctgatgcacctgattggcttttccgtcgccattgcgctgttcgcgctgtgctgctggggcgtatttcgtatggcgccatggctggttcgcttgctgggacaaacgggcatcaacgtgattacccgtatcatgggtctgttgttaatggcgttgggcatcgaatttatcgttaccggtataaaaagtattttccccgggttagtacactga

SEQ ID NO: 3496 - DNA, 1023 bp, Enterobacter cloacae
gccgctggaggagctggtatgaacgcaatcgacgaaaaaagaaatgtgctgctcgaaatcgctgacctgaaggtccatttcgatatcaaagacggtaaacagtggttctggcagcctgccaaaaccctgaaagcggtggatggcgtcacgctacgcctgtacgaaggggagaccctgggcgtggtgggtgaatctggctgcggcaaatcgacatttgcgcgtgcgatcatcggcctggtgaaggccaccgacgggaaagtggcctggcttggcaaagatctgctggggatgaagccggatgaatggcgcgacgtgcgcagcgacatccagatgattttccaggatccgctggcgtccctgaacccgcgtatgaccattggcgaaatcattgccgagccgctgcgcacctatcatccgaagatgccgcgccaggaagttcgcgatcgggtgaaagcgatgatgctcaaggtgggtctgttgcctaacctcattaaccgctacccacacgagttttccggcggtcagtgccagcgtatcggtatcgcacgcgcgttgatccttgaaccaaaactgattatctgtgatgaaccggtttcggcgctggacgtctccatccaggcccaggtggttaacctgctacagaaactgcaacgggaaatggggctgtcgctgatcttcatcgcccacgatctggcggtggtaaaacacatttcggaccgtgtgctggtcatgtatctgggccacgccgtggagctgggtacgtatgatgaggtgtaccacaatccgctgcacccttataccaaagcgctgatgtctgcggttcccgttccggatcccgatctggaaaaaaataaaaccattcagcttctggaaggtgaactgccttcgccaatcaacccgccttcaggctgcgtattccgtacgcgatgcccaatagccgggccggaatgtgcaaaaacacggccggttctggagggcagtttccgacatgcggtttcctgcctgaaagtagacccgttataa

SEQ ID NO: 3497 - DNA, 864 bp, Enterobacter cloacae
tgtcagcccttatttttcgaggttaatgtgtcgcgattattcacgtcggcccgtcagcggctgtatcaccttttatttgatcctgagacggtttccggtcgccgtttcgaaggcctttgtggtttatttgccctgattagcgtcattattatctttatcgaatccggcgccggaacgcagtaccatatgacgtatgaggagtggcacgttttcgtctggctggaattgattgtcacgctggtgtttaccgcggaatatgtgctgagggtcattagctggccaaatccggcgaaatacgttttcagcttctgggggtttattgatttagccaccatcctgccgctgtatgtcatgtggctgtggcctgagatcagcctgaattatgtgtttgcctggcgtgcaatgcgggcgattcgtgtgttacgaatactcaaactgctgcgctttatgccgtcgctgcgggttttttgggtcgccattgtcagcgcccgccaccagctgattctcttctattcgtttattgctatcgtgatgatcgtttttggctccctgatgtatttaatcgaagggccaaaatacgggtttaccacacttaatgcgtctgtttactgggctatcgtcacggtgaccaccgtgggctatggcgatattaccccgcatacgccgctcggacgtattgtggcatcggttcttatactgatcggctattcagtaatagcgataccaacggggttaattaccacccatatgagcagcgccttccagaacagcaagcagcaacgcaaatgtccgaagtgtcagcaggggaatcatgaacccggcgcgcggttttgtcaccgctgtggaaatgctttaccggattaa

SEQ ID NO: 3498 - DNA, 648 bp, Enterobacter cloacae
aggtgcccattaaacatccaggctatcaatttttgcagtctcttcccatctgctttccgcgatatactaagtccccttaacgtcatgatattaaaagatgaatccttatctctggatttttattgtacttttggcgctggatgcgctcagggaagatttaggactttcgtcattttcctcattggcagattatgttttcgcatggggaatacattggctttattaaaggaacaaaggatgaacggaaaagtaatggcagcactctttgggattgcgatattaagcggttgtgccagcagcaaaacctcacccgaacggcacgcgttttatttcgtgtcgcatcagtccagctttactggcggcaattacacctccagcgtgcagaaaaattatcagctgaacgtggcgcagttccgcgagctttatgcccggggcaaagctgaccgcgcggaagggcggactcaggctgaagccagtgaatacgcacaaagcattcgcgatcagctaaaagaaaatgcgacgtctcaggaattgttcgcaggcaacacgaaggataaatggtcatcggacatggacagtaaagacgccatattatttggcaacgaactggccgcgacttatcttgatggctataacggcgtacaatag

SEQ ID NO: 3499 - DNA, 876 bp, Enterobacter cloacae
ctgcaatgtaaagataataacaatgttaaaaccctgatctggatgccccttttttgccctcatgtacgcttaaattgcgccaggacaaagtgtcttattgaatatgattgctatttgcatttaaaatcaaggttcggttttttaacgttgatgattatgacttcgatgacccttgatttacctcgccgctttccatggccgacgctgctttccgtcgttattcacggtgctgtcgtggcgggtctgctctatacctcggttcatcaggttattgaaatgccggcgccagcgcagccaatttctgtgaccatggtatcgcctgcggatcttgagccgccgcaggttgcgccgccgccaccacagcccgttgttgaacccgagccggagccagagccagagccggttcctgaaccgccgaaagaagcgccggtggtgatccataagccggagccgaaacctaagccgaagccaaaacccaagccggtcaaaaaggtggaagtgcgtccggttgagccacgcgccacgcagccggttgaaaatgccgccccgtcacgtccgctgatgaataacaccacgaccgcgacaaaaccgacggtaacggccccagcaggcccgcgcgcgctgagccgtaaccagccgcagtacccggcacgtgctcaggcgttacgtattgaagggcgtgtacgggtgaaattcgacgttacggccgatggacgtgtcgataacgtggaaatcctgtccgcacagccggcgaatatgtttgaacgtgaagttaaatcggccatgcgcaggtggcgctatgaagccggtaaacccggcaatgggttgattgtgaacattgtcttccgcctgaacggcggggcacagatggaataa

SEQ ID NO: 3500 - DNA, 654 bp, Enterobacter cloacae
aaccacaacgatggagcggatatgaaaaaattagcggtggcagcccttatcttaagcagtctctctggcggcgcgtacgcgcatgaagcaggcgaattctttattcgtgccggttcggcaacggtacgtccaacggaagggtccgataatgtgctgggtatgggcgggtttaacgtcagcaataacacccagttaggcctgacgtttacgtatatggcaacggataacgttggcgtcgagcttttagccgccacgccattccgtcaccgcgtcggtttaggaccgaccggggacattgccacggtgcaccatttgccaccaacgctgatggcgcagtggtacttcggcgattccagcagcaaggtgcgcccttatattggtgcaggcgttaactacaccaccttctttgatgagaaatttaacgataccggtaaagaggccgggctctccgatctcagcctgaaagactcgtggggcatggcgggacaggttggtctggattatctgattaatcgtgactggctgatcaacgcctctgtctggtatatggacattgatacggacgtgcgctttaaagctggcgggcagcagcaaagtatcaatacccgtctggatccgtgggtatttatgttctcagcaggctatcgtttctga

SEQ ID NO: 3501 - DNA, 633 bp, Enterobacter cloacae
agagagggaagtatgagtcagtttttctatatccatccggataacccccagccacgtctgattaatcaggccgtggagatcgtccgcaaaggcggcgttattgtctacccaaccgattctggctacgcgctgggctgtaaaattgaggacaaaggggcgatggagcgcatctgtcgcatccgccagctgccggacggccacaactttaccctgatgtgtcgcgatctctctgaactgtcgacctacgcttatgttgataacgtggcctttcgcctgattaagaacaacacgcccggtaactacaccttcattctgaaagggacaaaagaggtgccgcgtcgtctgttgcaggaaaaacgtaaaaccatcggcatgcgcgtgccgtcgaacccgattgcccaggcgctgctggaaaccctcggcgagccgatgctctccacatcgctgatgctgccgggcagtgagtttaccgagtccgacccggaagagatcaaagatcgtctggagaaggtggtggagctgattatccatggcggctatcttggccagcagccgaccaccgtggtggatctcaccgaagacgcgccagaagtcattcgtgaaggcgtgggcgatgttaagcctttcttgtaa

SEQ ID NO: 3502 - DNA, 1062 bp, Enterobacter cloacae
atcaaggtggaacgcgtggaattactttctcagtatgggttgtttttggccaaaatcgcgacggtggttatagctgtcgcggtgattgccgtcctgatagtcaacctgacgcagcgtaagcgtcagcgtggtgagttacgcattacccgcctgagcgaacagtataaagagatgcaggaggagatgtctctggcgctgcttgacgatcatcaacagaagctgtggctaaaagcccagaagaaaaaacataagcaggacgccaaagctgcgaaggcgaaagctaaactcgccacgccacaggctgacgcaaaaccgcgcgtctatgtgctcgattttaaaggtagcatggatgcgcatgaagtctcctcactgcgtgaagaagtgacggcggtgctggccgtggcgacagcccaggatcaggtggtggtacgccttgaaagcccgggtggcgtagtgcatgggtatggactggcggcttcgcagttacaacgtctgcgagataaacagatcccgctcaccgtggcggtagataaggtcgcggcgagtggcggctatatgatggcgtgcgtggcggataaaatcgtcgcggcaccgttctccattatcggctcgattggggtagtcgcgcagatccctaacttcaatcgtttcctgaaaaacaaagagatcgacattgaactgcatacggcgggccagtacaaacgtacgctgacgctgctcggcgaaaataccgaagagggacggcagaagttccgggaagatctgaacgaaacccaccatctgttcaaagatttcgtgcaccgcatgcgcccaacgctggacattgagcaggtggctacgggcgaacactggtacggcacgcaggcgcaggagaaagggctggtggatgaagtgggtaccagcgacgacctcctgctcaacctgatggacggccgtgagctggtgggggtgcgcttcacccgacgtaagcgcctgctcgaccgttttaccaatagcgcggcagaaagcgcggatcgcctgctgctacgctggttgcagcgcggacaaaagccgctgctgtaa

SEQ ID NO: 3503 - DNA, 2841 bp, Enterobacter cloacae
atcgtaaaacctcgccacggcggggttttttgttttatccctcgtgttggaccattcctaaatttatcaatttgggttgttatcaaaacgttacgacatctttgtgttatctttaattacagccctgatgattgtcaggacatccctgtttttaaggaggagcttatgtcgttaaccctacgcgaagccagtaaggacacattacaggcggaaaataaaacctggcgctactatagcttaccgctggctgccagaacgcttggggacatttcgcggttacccaagtcgttgaaagtcttactggaaaacctcttgcgctggcaggatggcgactcggttaccgaggaggatatccaggctctggcagggtggctgaagaatgcacatgcagacagagaaattgcctatcgcccggccagggtgctgatgcaggatttcaccggcgtaccagcggttgtggatttggctgccatgcgtgaagccgttaagcgtctcgggggcgatactgctaaggttaaccccctgtccccggtagacctcgtcattgaccactccgtcaccgtcgatcactttggtgacgacgatgctttcggcgaaaacgtccgtctggagatggaacgtaaccatgaacgctacgtatttctgaaatggggtcagcaggcgttcagccgcttcagcgttgttccaccgggcaccggcatttgtcaccaggtcaacctggaatatctcggcaaagccgtctggagtgaattgcaggataaagagtgggtggcttacccggatacgctggtgggcaccgattcacacacaaccatgattaacggccttggcgttctgggttggggcgtcggtggtattgaagcggaagcggccatgctcggccagccggtatcaatgctcattcccgatgtggtgggctttaagctgaccggtaaattgtccgaaggcatcaccgccacggatctggttctgacggtcacccagatgctgcgtaagcatggtgtggtgggtaaattcgttgaattttatggcgatggtcttgattccttgccgctggcggaccgggccaccatcgccaacatggcgccggaatatggcgcgacctgcggctttttcccgattgatagcgttacgctggagtatatgcgcctcagtggtcgcagcgaggagcaggtggctctcgttgaggcctacaccaaagcgcagggcatgtggcgtaacccgggtgacgagccggtatttaccagtacgctggaactggatatgggcaccgttgaggcaagcctcgcagggccaaaacgtccgcaggaccgcgtcgccctgagcaacgttcccaaagcctttgccgccagcaatgagctggaggttaacgccgcgcaaaaagatcaccgtccggtggactatgttctgaacgggcatcagtatcagcttcctgacggcgccgtggtgatcgccgctatcacttcctgtaccaacacgtccaacccgagtgtgttaatggctgccgggctgctggcaaaaaaagcggtagaactggggctcaagccacagccatgggttaaagcctctctggcgcctggttcgaaagtggtttccgattatctggcgcaggccagactcacgccttacctcgacgagctgggcttcaacctggtgggctacggctgtacgacctgtatcggtaactctggtccactgcctgagcctattgaagtggcgatcaggcagggtgatttgaccgttggcgcggtactttctggtaaccgaaactttgaagggcgtattcatccgctggtgaaaaccaactggctggcctcgccgccgctggttgtagcctatgcgctggccggaaacatgaacattaacctggcgaccgatccgattggtcacgatcgcaaaaatgaaccggtctatctgaaagacatctggccatcatcgcgtgaaattgcgcgcgcggtagagaaagtttccaccgagatgttccgcaaagagtatgcggaagtgttcgaaggcacagcggaatggaaagcgatcgacgtggtgggttccgatacctatgactggcaggatgattccacctatattcgcctgtcgccattcttcgacgaaatgctggcggagcctgcaccgctgaaagatattcacggcgcgcggatcctggcgatgctgggcgattccgtcaccaccgaccatatctctccggcggggagcatcaaggcggacagtccggcaggtcggtatctgcaaagccgtggcgtggaacgtcgcgatttcaactcctacggttcgcgccgtggtaaccacgaagtgatgatgcgcgggacctttgccaacatccgcattcgcaatgaaatggttccgggcgtggaagggggcatgacgcgccacctgccggatacagaggtcatttcaatttatgacgcagccatgaagtatcagcaggaggggacgccgctggccgttattgccggtaaagagtacggctccggttccagtcgcgactgggcggcaaaaggtccgcgtctgctcggggttcgcgtggtgattgccgaatcctttgaacgtatccaccgctcaaacctgatcggcatggggatcttgccgctggagttcccgcagggcgtgacgcgtaaaacgctgggtctgaccggggaagagcagattgatatcagcggtctgcaaaatctgcaaccgggtaaaaccgttccggtgaaattaacgcgcgcagatggtacgacagaagtgctggattgccggtgtcgtattgatacggcaacagagctgacctattaccagaacgacggcattttacattatgtaattcgtaagatgctggactga

SEQ ID NO: 3504 - DNA, 348 bp, Enterobacter cloacae
acacgctttatacgctcgaaccacataacgggaagtcatgtgaaatatttactcattttcttactggtgttggcgatttttgtcatttcagtcacattgggcgcgcaaaacgatcaacaggtaagtttcaactatctgctggcgcagggcgagtaccgggtgtcgagcctgctggctgtgttattcgcggcggggtttgtcatcggctggcttgtatgcggcatgttctggcttaaggttcgtgtttctcttgttcgcgctgaacgtaaaattaaacgacttgaacatcaacttacgcctgcgtctgacattccggcgagctctggtgtgccggtagtcaaggaataa

SEQ ID NO: 3505 - DNA, 1089 bp, Enterobacter cloacae
tcgaatatgctggagttgttgtttctgcttttgcctgtcgccgcagcctatggctggtatatgggccgcagaagcgcgcaacaaacaaaacaggatgaagcaaaccgactctcccgtgactacgtagcgggggtgaacttcctgctgagcaatcagcaggataaagcggtggatctgttcctcgatatgcttaaagaggataccggcaccgttgaggcgcatctcaccctgggaaacctgttccgctcgcgcggagaggttgaccgtgccattcgtatccaccagaccttgatggaaagcgcttcgttgacctatgagcaacggttgctggccgtgcagcagcttgggcgggattacatggccgcggggctttacgatcgcgccgaggatatgttctctcagctggtggatgagacggacttccgtatcggtgcgcttcagcagcttctgcaaatctatcaggccaccagcgactggcaaaaagcgattgataccgctgaacggctggtcaaactcggcaaagacaaacagcgcgtcgaaattgcccacttctattgcgagctggctctccagcagatgggtagcgatgacatggataaagccatggcactgttaaagaaaggcgcagcggccgatcgcaacagcgcgcgcatctcgatcatgatggggcgggtctttatggctaacggtgattacgccaaagccgtggagagcctgcttcgcgttatcgatcaggataaagagctggtcagcgaaacgttggaaatgctgcaaacctgctatcagcagctcggtaagcaggacgagtgggttgcgtttctgcgtcgctgtgttgaagagaatacaggtgccacagccgagctgatgctgtcagatgtcgtcgaagagcatgaagggagcgataccgcccaggtatacattacccgtcagttgcagcttcatcctaccatgcgtgtcttccataagctgatggattaccaccttaatgacgcagaagaagggcgcgctaaagagagcctgatggtgctgcgagacatggttttcaaccgcggcgactggccggatcagcgcttaattttagccaagagt

SEQ ID NO: 3506 - DNA, 1749 bp, Enterobacter cloacae
caagaagtaaaaaagaacctgacagtagcaaaaaaaactcctgcgctgtacaggccccaacaggggattacacaactggcgaaggccagtcattataatgagtggagtatcaacacaatgtccatcatcacaaaaaaaagtctggtagcggcggggattttaactgcgctaatcgcgggcaacgctgcaatggctgcggacgttcctgctggtgttcagctggctgagaagcaaacgctggtacgtaataacggtgcggaagtgcagtctcttgatccgcacaaaattgaaggtgttccagagtctaacgttaaccgcgatctgtttgaaggtctgctggtgactgacgtaaacggccacccggctccgggcgtggcggaaaaatgggacaacaaagattttaaagtctggaccttccatctgcgtaaagatgccaaatggtccgacggtacgccggttaccgccgaagatttcgtctatagctggcagcgtctggcggatccaaataccgcctccccgtatgcgagttacctccagtatggccatattgccaatatcgatgacatcatcacgggtaaaaagccagtaaccgacctgggcgtaaaagccatcgatgccaatacctttgaagtgacgttgagcgaacctgttccgtacttctataagctgctggttcacccgtccgtctccccggtaccaaaatccgcggtggaaaaatttggtgaaaaatggacgcagcctgcgaatatcgtgaccaacggtgcatataagctgaaggactgggtcgttaacgaacgtatggtgctggagcgcaacccgcagtattgggataatgcgaagaccgttatcaatcaagtcacctacctgccaatctcttctgaagtgacggacgtaaaccgctaccgcagtggtgaaatcgacatgacctataacaacatgccgattgaactgttccccaagctgaaaaaagagatcccgaaagaagttcacgtcgatccgtatctgtgcacctactattacgaaattaacaaccagaaagcaccgttcaccgacgtacgtgttcgtaccgcactgaagctggctctggatcgcgacattatcgtgaataaagtgaagaatcagggcgacctgccagcttacagctacaccccgccttacaccgacggtatgaagctggttgaacctgaatggttcaaatggtcccaagaaaaacgtaacgaagaagcgaaaaaactgctggctgaagctggctataccgccgacaagccgctgacctttagcctgctgtacaacacctctgatctgcataaaaaactggctattgccgtcgcgtctatctggaagaaaaacctcggcgtgaacgtgaagctggaaaaccaggaatggaagaccttcctcgatacgcgccatcagggaacctttgacgtggcacgtgcaggatggtgtgcggactataacgaaccgacctcattcctgaacaccatgctgagcgacagttcgaacaacaccgcacactataagagcccggcgtttgataagctgattggcgaaaccctgaaggtggcagatgacgcccagcgcgccgatctgtacgcgaaatcagaacaacagctcgataaagactctgcgatcgttccggtttactactacgttaacgcccgcctggtgaaaccatgggtagggggttataccggtaaagacccgttggataatatttccgttaagaatctttatattatcaagcattaa

SEQ ID NO: 3507 - DNA, 1050 bp, Enterobacter cloacae
tgccctcgacccgaaagaccgttaaggagcgccgtcatgactattattgaaacggcaaccgcgccacaggcgcaacagcggaccagcgcactgctggacgttaaagacctccgcgtgacgtttaaaacccccgacggtgatgttactgccgttaacgatctcaacttcgacctgcgtgccggtgaaacgctgggcattgtgggcgaatccggttccggtaaatcccagaccgcattcgcgctgatgggcctgctggcgtcaaacggcgtgatcggtggttcggcgacgtttaacggaaaagagatcctgaatttgccggaacatgagctgaataagctgcgcgcggagcagatttcaatgattttccaggatccgatgacgtccctgaacccctatctgcgtgtgggcgaacagctgatggaagtgctgatgctccacaaggggctgggtaaagccgaagcgtttgaagagtccgtcaaaatgctggatgcggtgaaaatgcctgaggcacgtaagcgcatgcgcatgtatccgcacgaattctccggcggtatgcgccagcgcgtcatgatcgcgatggcattgctttgtcggccaaaactgctgatcgctgatgaaccgaccaccgctctggacgtgaccgtccaggcgcagatcatgacgttgctgaacgagctgaagcgcgagttcaacaccgccatcatcatgatcacccacgatttaggcgtcgttgccgggatctgcgacaaagtgttagtcatgtatgcaggccgcacgatggaatacggtaatgcccgcgatgtgttctaccagccagcccatccgtactctatcgggttgctgaatgccgtaccgcgccttgatgcggaaggggagtcgctgctgactatcccgggtaacccgccaaacctgctgcgtctgccaaaaggctgtccgttccagccgcgttgtccgcatgcgatggaaatctgtaacagcgcaccgccgctggaagcgtttgtccctggccgtctgcgcgcctgctttaagccgctggaggagctggtatga

SEQ ID NO: 3508 - DNA, 639 bp, Enterobacter cloacae
gacgtgtttgcggagtttggtgtactgaatttctggacctatgttgtcggcgcattttttatcgtgctggttccaggaccgaacaccttgtttgtgctgaaaacagggattggccacggcgttaagaaaggctatctggcagccaccggtgtgtttattggtgatgccgtgctgatgtttctggcctgggcaggcgtcgccgcgttgatccagaccactccggtattatttaatattgtccgctatctgggcgcgttttatctgctgtggctgggcgggaaaatgctctggtccgttatgacgcgtcaaaaaaatgcgcacgaaagtagcgccgaaccggcaagcgcaatccttaagcgttcgctggtgctgagcctgacgaacccgaaagcgattctcttttacgtgtcgttcttcgtacagttcattgatgtcaatgcgaagaataccggcacgtcgttcctgatcctcgccacaacgcttgagctgatcagcttcatgtacatgagcttcctgattttctcaggcgcgtttgtcacgcgttacctcaaaaccaaaaagaaactggcgaagctggggaacgggctgataggtctgctgtttgtcggatttgcggcgaggctggcgtcgctgcactga

SEQ ID NO: 3509 - DNA, 951 bp, Enterobacter cloacae
tttcagtatttcacggttagtcggtatcataggggcttcggatgtctccaacctgttatgggaagtgctttgagcgataccacctacgccgtaatttatgatttacacagccatacgcaggcttcagatggcctgctgacacccgaagccctggtccatcgcgccgttgaaatgcgtgtcggcacgctggcaataaccgatcacgataccactgacggcattcccgccgcgcgcgccgagattgtccgcagcggactggcgctggatctggtggccggggttgagatctcgacggtctgggaaaaccacgaaattcatatcgttggcctgaacatcgatacagaacatccggccatgcgtgcttttttgcaagaacaaaaaacacgccgcaatcaacgcgcggagatgattggcgaacgtctggaaaaagcgcatattcccggtgcgctggaaggcgcgcgaaagctggcgaacggtggggcggtgacgcgcggccatttcgcccgttttctggtggacgctggtaaggcgacgaccatggcgaatgtctttaaaaagtatctggcgcgcgggaaaaccggatacgttcccccacagtggtgtacaataaaacaagctattgatgtgattcatcattctggcggtaaggccgtgctggcccatccggggcggtataatctttctgctaaatggctgaaaagactgctggcacactttgccgaatgcggcggtgaggcgatggaagttgcccagtgtcagcaggcacccaatgaacgttcgcagctcgcgacctacgcccgtcagtttggcctgcttggctcacagggttcagatttccatcagccctgcgcgtggattgaactggggcgcaagctctggttacccgcgggcgttgagcctgtctggcagctctgggaacagccacagcaaattgaagagagggaagtatga

SEQ ID NO: 3510 - DNA, 885 bp, Enterobacter cloacae
ggaagctcaatgagcgagaagttacagaaagtgctggcgcgtgccggccacggttcgcgccgtgaaatcgaagccattattgaagcaggccgcgtgagtgtggacggtaaaatcgccacgctcggtgaccgcgttgaaatcgtaccggggctgaagatccgcattgacggccatcttatctccgtgaaagagtctgctgaacagatctgccgcgtgctggcatactacaagccggaaggcgaactgtgtacccgcaacgatccggaaggccgcccgacggtgtttgaccgtctgccaaaactgcgtggcgcccgctggattgccgtaggacgtctggacgtgaacacctgcggcctgctgctgttcaccaccgatggtgaactggcaaaccgtctgatgcacccgagtcgtgaagtggaacgtgaatacgccgttcgtgttttcggccaggttgatgaaaacaaactgcgcgacctgtcgcgtggcgttcaactggaggacggcccagcggcgttcaaaaccatcaagtttaccggtggtgaaggcattaaccagtggtacaacgttaccctgacagagggacgtaaccgcgaggtgcgtcgtctctgggaagcggtaggcgtgcaggttagccgcctgatccgtgtccgttacggcgacatcctgctgccaaaaggcctgccgcgtgggggatataccgaactggatctgactcagaccaactacctgcgcgatctggttggcctgacgccagaaacctcgtcgaaagtggcggtagagaaagatcgtcgtcgcatgaaggcgaatcagatccgccgtgcggtgaagcgtcacagccaggtcagcagcaatcgccgctctggcagccgtaataacaacggttaa

SEQ ID NO: 3511 - DNA, 2610 bp, Enterobacter cloacae
gtaaaggtgaatatgggtaaagctctcgtcatcgttgagtccccggcaaaagccaaaacgatcaataaatatctgggcaatgactacgtggttaagtccagcgttggtcacattcgcgacttgccgaccagtggctcagccagcaaaaagagcgcagactctacctccaccaaaggggctaaaaagcctaaaaaggatgaacgtagcgcgcttgtcaaccgcatgggtgttaacccatggcaaaactgggatgcacattacgaagtgctgccaggcaaagaaaaagtcgttaacgagctgaaacagcttgctgaaaaagcagaccacatttatctcgcaaccgaccttgaccgcgaaggggaggccatcgcatggcacctgcgggaagtgatcgggggtgatgacaaacgctacagccgtgtagtgttcaacgaaattacaaagaatgcgattcgtcaggcgtttgaaaagccgggtgaactgaatatcgaccgtgtaaacgctcagcaggcgcgtcgctttatggaccgcgttgttggctacatggtctcgccgttgctgtggaaaaaggtcgctcgcggcctgtctgcggggcgtgtgcagtctgttgctgttcgtcttgttgttgagcgtgaacgcgagatcaaagcgttcgtcccggaagagttctgggaagtggatgcgaatgtcaccacgccgggcggcgatgcgctgccgttgcaggtgagccaccacaacgacaaaccgttccgtcctgaaaatcgcgatcagaccatggccgccgtggcgctgctggaaaaagcgcgttatcaggttctggatcgtgaagacaaaccgaccagcagcaagcctggcgcaccgtttatcacgtcaacgcttcagcaggcggcgagtacgcgtctgggttacggcgtgaagaaaaccatgatgatggcccagcgtttgtatgaagcgggttacatcacctacatgcgtactgactccaccaacctgagccaggacgctgtcaacatggtgcgcggctatatcgaggacaacttcggtaagaaatatctgccggatagtcctaatcagtacgccagcaaagagaattctcaggaagcgcacgaagcgattcgaccttctgacgtttccgttctggcagaatcgctgaaagatatggaagcggacgcccagaagctgtatcagctgatttggcgccagttcgtagcctgccagatgacgccagcgaaatacgactccaccacgctgaccgtcggcgcgggtgatttccgcctgaaagcgcgcggccgtattctgcgcttcgacggctggactaaagtgatgcctgcgctgcgtaaaggtgatgaagacagaacgctgccttcagtcaacaaaggtgacgagctgtcgctggttgatctggtcccggctcagcacttcaccaagccacctgcgcgctttagcgaagcatcgctggtgaaagagctggaaaaacgcggcatcggtcgcccgtccacctatgcgtcaatcatttcgaccattcaggatcgtggatacgttcgcgttgagaaccgtcgtttctatgctgaaaaaatgggggagattgtcaccgaccgtctggaagcgaacttccgcgagttgatgaactatgacttcaccgcgcagatggaagacagcctcgatgaggttgccagccataaggcagagtggaagaaagttctcgacagcttcttcagcgattttaccaatcagcttgagaaagccgagaaagatcctgaagagggcggcatgctgcctaaccagatggtactgacgagcatcgactgcccaacctgtggccgtaaaatggggatccgtaccgcgaccacgggcgtgttcctcggttgctctggttatgcgctgtcaccgaaagagcgttgcaaaaccaccatcaacctcgtgccggagaacgaagttctcaacgtgctggaaggggacgatgcggagactaacgcactgcgcgccaaacgccgctgtaagaaatgcggcacggcgatggacagctacctgatcgatccaaaacgcaaactgcacgtttgtggcaataacccgacctgcgatggttatgagatcgaagaaggtgagttccgcattaagggctatgacggtccgatcgttgagtgtgagaaatgtggttccgaaatgcacctgaaaatgggacgcttcggtaagtacatggcatgcaccaacgacgactgtaaaaacacgcgtaagatcctgcgtaacggtgaagttgcgccgccgaaggaagatccggttccgcttcctgagctgccgtgtgagaagtcagacgcgtatttcgtgctacgtgacggcgctgccggggtattcctggcggccaacaccttcccgaaatcgcgcgaaacccgtgcgccgctggtagaagagctgtaccgcttccgcgaccgtctgccggagaaactgcgttacctggccgatgcgccacagcaggatccggaaggcaataaaaccgtggtgcgcttcagccgtaaaacgaagcagcagtacgtggcggcagagaaagagggcaaagcgaccggatggtcagccttcttcgtcgacgggaaatgggttgaaggcaagaaataa

SEQ ID NO: 3512 - DNA, 990 bp, Enterobacter cloacae
atcggatggtctggcatgaaattacagcagcttcgctatatcgttgaggtcgtcaatcataacctcaatgtctcttccaccgcagagggtctttatacctcgcagcccggcatcagcaagcaggtgcgtatgctggaggatgagttaggtattcagatctttgcccgcagcggtaagcacctgacgcaggtcacgccggctggacaggaaatcatacgcatcgcacgggaagtgctctccaaagtcgacgccattaaatccgtcgccggggaacatacctggcccgataaaggttctctgtatattgccaccacgcatacacaggcgcgttatgcgcttcccggggtgatcaaaggttttatcgaacgctatccccgcgtttccctgcatatgcatcagggctcaccgacgcaaatcgcagaggccgtgtctaaaggcaatgcagacttcgctatcgcgacggaagccctccatctgtacgatgatctggtcatgctcccgtgctaccactggaaccgctctattgtcgtgaccccggatcacccgctggcggggaagggcgaagtgacaatcgaagaactggcgcaatacccgctggtgacctatacgttcggctttacgggccgttctgaactggacaccgcgtttaaccgcgccggattaacaccacggattgtctttacggcgacggatgcggacgtcataaaaacgtatgtgcgtctgggcctgggcgttggggttattgccagcatggcggtagatcctgtctcagacccggatctggtgcgtctggatgcgcatgatattttcagccacagcaccaccaagataggttttcgtcgcagcacgttcctgcgcagctatatgtatgattttattcaacgcttcgcgccacatttaacgcgcgacgtggtggatacagctgtagcgttacgctccaatgaagacatcgaagagatgtttaaagacattaaacttcccgccaaataa

SEQ ID NO: 3513 - DNA, 192 bp, Enterobacter cloacae
tatatggcagagcaacatcgtggtggtaccggtaatttcgctgaagaccgtgaaaaggcatcagaagctggacgtaaaggcggccagcacagcggcggtaatttcaaaaacgatccgcaacgcgcatctgaagcgggtaagaaagggggccagaacagtcacggcggaggccgtaaatctgataactcctga

SEQ ID NO: 3514 - DNA, 567 bp, Enterobacter cloacae
atataccgagagcatgctgcgggcccgtcggctcgcagtaccttccctttatttcactggagcgaaaatatgaatatgaaaactgttgaagatgtatttattcacctgttatccgacacctacagcgctgagaagcagctgacccgcgctctaagcaagttagctcgcgccgcatccagcgagaagttgagtgccgcgttcacggcccacctcgaagagactcagggacaaatcgagcgtatcgatcagattattgagcaggaatccggcctcaaactgaagcgcatgaaatgcgttgcgatggaaggcttaattgaagaagccaacgaagttattgagagcactgaaaaaaatgaagtgcgtgacgctgcattaattgccgcagcacaaaaagtcgagcattacgagattgccagctacggcaccctggccaccctggctgaacaattaggctataaaaaagccgttaaacttcttgccgaaacgctggaagaagaaaaagaaaccgatctcaaattaaccgatctggctgtcggcaatattaatcaaaaagcccagaaaggataa

SEQ ID NO: 3515 - DNA, 1653 bp, Enterobacter cloacae
taccgaaggttatcactaaggattactatggcaggctggcatacacgcgccattatttaccagatagatactgccctgttttacgatctgaacggcgatggctgtggcgacatcgccggaatcgccgcgaagctacgctacatccgccggatgggcgcgacggttatctggatcactccgttttacctcacgccttttctcgatgaaggctatgacgtgagcgaccatttgcaggtcgatccccgcttcggcaagctcaacgatatcatcgcctttattgaacaggcgcgggagctgggaatgcaggtcattattgagctgctgatccagcatacctcggatgcgcatccctggtttcaacaggcccgccgcaaccctcagtcaccctatcgtgactattacctgtggtccgacacggacgacgacgatacgccgccgatgttccccggcgtggagaagagtatctggacatgggacgacgaggcggggcaatactatcggcatatgttttatcaccacgagccggatctcaatctggcctcccctgcggtgctgaaggaggttgagaacatcatcatcttctggctaaagctcggggtgtcgggctttcgcctggatgcggcgtcgcacctgacaaaacaggccggacgtggggatgaaaaacgcggcctgtggatcctggagcatctgcgccgtcttatcgagcagcgtaacccggatgcgatcctgctcggcgaagtcgacgtggaggtcgaggcctacaaagattattttggtcagaacgaccggctcaacctggtgctgaatttctggctcaataagtacttctacgtcagccttgcggagaaaagcgcacgaccgctgcgcaacgcggtgaagaagatgattgtgccgcctgactcctgctgcttcgccaactggctacgcaatcatgatgagctggatctggaagggataggaaaaaaaacgaagcagaccgtcattgatgcctttgcccctgacgaagaaatgagtgtgtatcagcgaggtatccgccgccgtctggcgccgatgcttaatggcgatcgtaagcggctggccttttgccatgcggtcttgttttcgctgccgggcgtaccggtcatgcgctacggggatgagattggcatgggagatgatttggaactggaggagcgttacgccgtacgcaccccgatgcagtgggccggatcgcaaggcggcggtttctcagacgccgacccggaaacttttatcgccccgatgattgaccgcggcccgtaccgctatcaaaaaatcaacgtggcggattcgctgttgcaccgcaactcactcctgcactgcattatcgatatcgccaatacgcgctcggagttccctgagatcggcgtcgcgccgtttcgtcttattaatatcgacagcgatgcggtgctggggatctattacgaaaccgacacgcgcagcattctgaccttcgttaactttagcgataagcccgttaattttaccgccagagggatccggcatgcgacctggaccgcctgcctggcggacaaacgctacaacgacgcgctggtgtgcggcaaaaccgtcgcgcttaacctcagcggctatggctaccgctggttctggaccgatcgtaccgcactgcgctga

SEQ ID NO: 3516 - DNA, 435 bp, Enterobacter cloacae
caacaatacttaataagtcaagacatccaaaatgaaggatatcagatgaaattatcagtgatttcagctttgttaatattaattatccctactgcctgggcagataataacggcgggttacaaaagggtgacgcgccgccaccgccgcatgcgttggacagcggttatcgtggtaccgatgatgcgcgcattatgaccattactcaggcgaaagagatgcatgatggcgcctctatttcactgcgcggcaatcttattgatggcaatggcgataaatacgtattccaggataaaaccgggaaaatcgacgttattatcccgaaagccgtatttgacgacagaaccgtggaacctgacaacatgatcagtattagcggctcgctcgataaaaaatcatccccacccgtagtccgggtcagccacttgcaaaaataa

SEQ ID NO: 3517 - DNA, 573 bp, Enterobacter cloacae
accattaagcattttggcactggagcatcaatgagtattcaagaacacgttattttggtaaatgaccagggaaaagtgattggcactcaggagaagtacgccgcgcacacgtcacacaccccgctacacctggccttctcttcatggctgtttaacgctaacggagaatgtctgatcacccgtcgcgccttaagtaaaaaagcctggcccggcgtatggaccaactccgtttgcggtcatccacaggccgacgaagcgacagagcaggcgattatccgccgctgccgctttgaagtcggcgccgaaatcacagacatcacccccattgccccggagttccgctaccgtgaagccgacccgtcagggatcgttgaaaacgaaatctgcccggtctatgccgcccgcgtaacgaataccctcgcaatcaatgacgatgaagtgatggaatatcagtgggtggagctggacgcgctattccgcgcgctggacgccacaccgtgggcatttagcccgtggatggtgcaagaagcgaacactgcgcgtgaaaaactcagcgccttcgcggcgcaataa

SEQ ID NO: 3518 - DNA, 534 bp, Enterobacter cloacae
gatagttacgcgatgaatattggtctgttctatggttccagcacctgctacaccgaaatggcggcggagaaaattcgtgacatcattggcccggaactggtgacgttgcataacctgaaagatgacgcggttgccttgatggagcagtacgatgtgctgattctgggtatccctacctgggactttggtgagattcaggaagactgggaagccatctgggatcagctcgattcagtcaattttgaaggcaaaatcattgcgatgtatggcatgggcgaccagttgggctacggggagtggttcctcgacgcgctcggcatgctgcatgacaaactggcgccaaagggcgcgacgtttatcggctactggcctacggaaggctatgagttcaccagcccaaaacccgtcattgccgacggccagctgtttgtcgggctcgcgctggatgaaaccaaccagtacgatctcagcgacgagcgcctccagacctggtgcgaacaaattctgggtgagatggccgagcagtttagctga

SEQ ID NO: 3519 - DNA, 633 bp, Enterobacter cloacae
gcaccctgtccgatgcaaaaggaaaataacatgagagccttaatagccttacttctgctgtcgttatcaacgttcggtttcgccgcaccgtcagatgacgcttccagcgaccagctggcaaaactgttgtttaacgaccccaacagcccgcgaaccggcgcggcatcgccgaagctgaccatcgtctccttcacggactacaactgcccgtattgcaagcagttcgacccaatgctggagaaaatcgtgcaggaaaatcccgacgtgcagctcatcgtcaaactgctgccgtttaagggacaaagctcggtaaatgccgcgaaagcggcgctctcgacgtggcagcaggcgccggataaattctgggcgctgcaccagcggttgatgatgaaaaagggctatcacgatgacgccagcatcgccgccgcaaaggtcaagaccggaacggacagcattaaaacggatgataaaaccatggacagcctaaagatgaacctcatcctggcgcaggtgctgaatattcagggtaccccggcgaccattatcggcgaccagatggtggcgggcgccattccgtatgacgacctggaggggctggtcaaagaacagctggcaaacgcccgtggcaagtaa

SEQ ID NO: 3520 - DNA, 903 bp, Enterobacter cloacae
agcgaaaaaataacgaaagagggagaaactatgtttcgacacgtaaaacagctgcaatacacggtacgcgtagccgaaccgaatccgggcctggccaatcttctgcttgagcagtttggcgggccacagggcgaacttgccgcggcatgtcgttactttacgcaaggattgagcgacgacgatcccggtcgtaaagatatgctgatggatatcgcgaccgaggaattaagtcacctggaaattatcggcaccctggtgggtatgctgaataagggtgcgaaaggtgaactggcggaaggcgttgaaaatgaagcggaattgtaccgctccatgaccgagaacggcaacgacagtcatatcacctccctgctctacggcggcggtactccactgaccaactccgggggcgtaccatggacggcggcgtatgtggatactattggcgagcccaccgccgatctgcgctctaacattgcggccgaggcgcgcgccaaaattatctacgaacggcttattaacgtaacggacgatccgggtgttaaagatgcgctggcgtttttaatgacgcgtgaggcagcacaccagctctcatttgagaaggcgctccagtcgatccgtaacaatttcccaccgggtaaattgccgccaatcgaagagtacactaataagtactacaatatgtctgaggggggagaagttcgcggtagctggaacagcgataagcacttcgactacgtggaatctcctcagcccgcggtcgatggcggtgacggcggcgcaagcgtaacgctcacgacagagcaggccacgctggtcaaagcgatgtgcgcacgtacgaaatccgaccctaacgccgatccgcttaccggtgccgagcttggcgcaggtaagaaaaaaccgtaa

SEQ ID NO: 3521 - DNA, 1077 bp, Enterobacter cloacae
tacatcgggcacccctgcccgtccgctgtccgccgccgagtctgttccggaagaggagaagatctgatgggcgtcgatatcccggtcatctggtttgccattattgtcttcgccacgctgatgtacatcatcatggacggtttcgatctcggtatcggcatgctgttcagctttgtgggtgatgccaaagagcgcgacgtgatggtgaacagcgtcgccccggtctgggacggaaatgaaacctggctggttctcggcggcgcagggttgttcggcgcgtttccgctggcctacgcggtaataatcgatgccctgaccatcccgctgacggccatgctgatcgggcttattttccgcggcgtggcatttgagtttcgctttaaggcgaccccttcccaccgcaaattctgggactattcttttgctggcggttccctgctcgcaaccttcagccaggggatcgtggttggcgcgatgatcaacggctttgacgtggaagggcgtcgctttgtgggctcctcgctggactggttcaccccgtttaacctgttctgcgggctgggcttaattgtcgcctataccctgctggccaccacgtggctgatcatgaaaagcgaaggcgcgctgcaaaaccggatgcgcgagctgacccgccacgttctcctggcgctgattgccgtcattgcggtggtaagtatctggaccccgctcggctggcagtttgtcgccgaacgctggtttactctgcctaacttcttctggttcctgccggttccggttcttgtggcggtattcagcctgtggatctggcggctgacgcgtaatcccgacagccatgcccgtccgttcctgttaacgctgggcctgatcttcctcggctttagcggcctgggcatcagcctgtggccacacataattccgccgcacatcaccctgtgggaagccgccgcgccgcctgccagccagctgtttatgctgatcggcacgctgttaatcatcccggtgatcctggtttataccgcctggagctattacgtcttccggggcaaagtgtctgataccgaaggttatcactaa

SEQ ID NO: 3522 - DNA, 930 bp, Enterobacter cloacae
cgctgtaactatccatcaaatctcacccctaacaaggagttagctatgagtgataatgaacaacgtacgaacgcttacccaacgccacctttcccgaagcaaccccagacgccgccgggcctgtcctcagaaatggaacccgtacccgaccacggcgagaagagctacaaagggcatggacgtcttgccggtaagaaggcgctaattaccgggggcgattccggcatcggacgcgcggtagccattgcctatgcccgcgaaggggcagatgtcgccattaactatttgccggaagaggaagaagacgcagcggaagtcatcaccctgattaaagcggaaggacggaacgccgtcgcgcttccgggcgatgtgcgcgacgaaactttttgtcagaacctggtggagcaggccgtctcaaaactgggcgggctggatatcctggtgaataacgcaggccgccagcagtatcgtgagtcgctggaagaactgactacggaagattttgacgcgacctttaagaccaacgtctatgcgcctttctggatcacaaaggcggcgttgcgccacatgaaagcccctgcatccattattaacacctcctccgttcaggcggttaaaccgagcgccgtactgcttgactatgcgcagaccaaagcctgtctcgcggtgtttaccaaagcgctggcgaaacagctgggtccgaaagggatccgcgtgaacgcggtagcgcccggaccttactggaccgtgcttcagcccagcggtgggcagccacaggaaaaagtgaaacattttggcgagagtacccctctgggacgcccgggacagcccgtggagatcgcaccgctgtatgtcactctggcctcggatgagtgttcatacacctccggccaggtctggtgttcagacggcggcgacggcgtcatttga

SEQ ID NO: 3523 - DNA, 1527 bp, Enterobacter cloacae
caaattacaatttccacaaattgttatatcgtgacatttaattccgctttgctagactcgaaatcaataagtcctgaattgagaatagcaaagatgaaaaaactcaccttaccgaaagattttttatggggcggcgcggtggcggcgcaccaggttgaaggcggctggaacaaaggcggcaaagggccaagcatctgcgacgtgctcaccggcggcgcacacggcgttccgcgtgaaatcacgcaggaagtgattgaaggcaaatattacccgaaccacgaagccgtcgacttctatggccattacaaagaagacattaagctgtttgccgagatgggcttcaaatgtttccgtacctccatcgcctggacgcgcatcttcccgaaaggcgacgaaactcagccaaacgaagaggggctgaagttttacgacgacatgttcgatgaactgctgaagtacaacatcgagccggtgatcaccctctcccactttgaaatgccgctgcatctcgttcaggaatatggcggatggaccaaccgtaaagtggtcgatttctttgtgcgcttctcggaagtggtatttgagcgctacaaaaataaggtcaaatactggatgaccttcaacgaaatcaacaaccagcgcaactggcgtgcgccgctgttcggctactgctgctctggcgtggtctataccgagcacgacaacccggaagagaccatgtaccaggtgctgcaccaccagttcgtggccagcgcgctggcggtgaaagccgcacgccgcattaacccggagatgaaagtcggctgcatgctggcgatggtggcgctctatccttactcctgcaagccagaggacgtcatgtttgctcaggaatccatgcgcgagcgctacgtctttaccgacgtgcagctgcgcggctattacccgtcttacgtgctgaacgagtgggagcgccgtgggttctccatcaggatggaagcgggcgacgagcagatcctgcgtgagggcacctgcgactacttaggtttcagcgactacatgaccaacgcggtcaaagcggaaggcggcaccggtgacgccatttccggcttcgagggcagcgtgccgaacccacacgtcaaggcgtccgactggggctggcagattgatccggtaggcctgcgctattcgctttgtgaactgtacgaacgttatcagaagccgctgtttatcgtcgaaaatggttttggcgcctacgacaaagtggaagaggacggcagcatcaacgatgactaccgcatcgactacctgcgcgcccacgtggaagagatgatgaaggccgtgacctgggacggcgtggatctgatgggctataccccgtggggctgcattgactgcgtctccttcaccaccggccagtacagcaagcgctacggctttatctacgtcaacaagcacgacgacggtaccggtgacatgtcccgctcccgtaagaagagctttgagtggtataaaaccgtcattgccagcaacggcgaaacgctgtaa

SEQ ID NO: 3524 - DNA, 606 bp, Enterobacter cloacae
atattcagggtaccccggcgaccattatcggcgaccagatggtggcgggcgccattccgtatgacgacctggaggggctggtcaaagaacagctggcaaacgcccgtggcaagtaagcttccgcgcctgctgcgcgagctgggcgtgtggctgctgattggcgtagccgtgagcctggcggtggactatttccgccagcccgcgctgccgcagaatttctccgcgacggcactgcacaccctcgacggtcagcccgtcgatcttatcgccatgagtaaggagcgaccgctgctggtctacgtctgggcgacatggtgcggcgtttgccgctacaccacgccgtcggtggcggcgcttgccgcggacgggggtaacgtgatgtcggttgcgctgcgctcgggcgataacgcgacgctcgaaacatggatgaggaagaagaaggcgatgatgcccacggtcaacgacgccagcggagaactggcgcgtgagtgggacgttaaggtgacgccaacgctggtggtgatctctcacggtgaggtgaagtcgatcaccaccggctggaccagcggctggggaatgcgcctgcggctgtggctggcgtcgtag

SEQ ID NO: 3525 - DNA, 921 bp, Enterobacter cloacae
tacgcggtggcgataactaactcactcactgaacagctggcgaaacggatgacggtggataccggcatgcggatgctggtgagttttggcgtggtgctgattctgaatctgatcttcctgatggggcggcacatcaccattaaggtgatgggtttccttgtctttccgctgatcgcctatttcctgtttgtctcgctgtatctgacgggcagctggcagccgtcgcttctgacgagccagatggccttcgaccagcatacgttgcaccaggtgtggatttcgatcccggtgatggttttcgcttttagccatactccgatcatctcgactttcgccgtggaccgtcgcgagaaatacggtgaagaggcgatgggtaaatgcaaaaaaatcatgaaagtggcgtatctgatcatctgcctcagcgtgctgttctttgtgttcagctgcctgctttcgattccaccgtcgtatatcgtggcggcaaaagaggaaggggtgacgatcctgtccgcgctgtcgatgatgccttcgtccccggcatggctgggtatttctggcattatcgtggcgattattgcgatgtcgaaatcgttcctcggcacctattttggcgtgattgaaggggcaacggaaattgtgaaatcgtcgctgaatcaggtgggtgtgaagaaaagccgcgcctttaaccgcgcggtttctattctcggcgtgtcgctgattacctttgcggtctgctgcatcaacccgaacgccatttcaatgatttacgctatcagcggtccgcttatcgccatgatcctgttcatcatgccgacgctgtcgacgtacctgatcccgtcgttaaaaccgtaccgctccatcggtaacctgctgacgctgattgtaggtgtgctgtgtgtgtcggtgatgtttgtcggttga

SEQ ID NO: 3526 - DNA, 534 bp, Enterobacter cloacae
ccagataataaatcacaggagttaattatgaatcatgtagaacactaccatgattggctacgcgatgcccatgcgatggaaaagcaagccgaatccatgctggaatctatggccagccgtattgataattatcccgacttacgtgcacgaattgaacaacacgttaatgagactaaacaccaaattaccgtgctggaagaaattctcgaccgcaatgatatttcccgttcggtcataaaagattccatgagcaaaatggcggcgctcggccagtccattggcggcatgttcccttccgacgaaattgttaaaggctccatcagcggctacgtttttgagcagtttgaaattgcctgctacacctctctgctggctgcggccaaacaagcgggcgataccgcctccattcctgccattgagtccattctggaagaagagcgccagatggctgactggctgctccagcatattccacagacgacggaacagttcctgctgcgctccgatgcggacggtgttgaagcgaaaaaataa

SEQ ID NO: 3527 - DNA, 1452 bp, Enterobacter cloacae
ggctgtctggcaatgccttgtgcgctatcagttccagaggtacggagcatgttcgagcttgatgcgtttcatctggccaggatacagttcgcctttaccgtctcttttcatattctcttcccggcgatcaccatcgggcttgcgagctatctggtggttctcgaaggcatgtggcttcgcacaaaaaatgatgtctggcgctcgctataccatttctggctaaaaattttcgccgtcaactttggtatgggcgtggtttccgggctggtgatggcttaccagtttgggactaactggagcggcttttcccagttcgcgggcagcataaccggccctttgctcacctatgaagtcttaaccgccttcttcctggaagccggtttcttaggcgtgatgctgttcggctggaacaaggttggccccggcctgcacttctttgccacctgcatggtggcgctgggcacgctgatgtccaccttctggatcctcgcctctaacagctggatgcacaccccgcagggcttcagtattcagaacggtcaggtcattcccgaagactggctggccattatctttaacccctcattcccttaccgactgatccatatgtccatcgccgccttcctgtgcagcgccttgtttgtgggcgcgtccggggcatggcatctgctgcgcggtaacgatacgcccgcgatccgcaagatgttctccatggccatgtggatggcgctgatggtcgcgcccattcaggctgtggttggggatatgcacgggctgaatacgcttgagcaccagcctgccaaaatcgccgcgattgaaggccactgggaaaacccgcccggcgaggccaccccgctgctgttgtttggcgtaccggatatggaagaggaacgcaccaaatacgggcttgaaattcccgcgctcggcagcctgatcctgacgcacagcctggataaacaggtcccggcgctgaaggatttcccgaaagaggaccgccctaactcgctcatcgtcttctggtccttccgcattatggtcggcatggggctgctgatgattacccttggcgtactgagcgtctggctgcgctatcgccgtcgactctatcactcacggccattccactggtttgccctgtgcatggggcctgccggattactcgcgctgctcgccgggtgggtcaccaccgaagtgggccgccagccgtgggtcgtttacggctatctgcgcacgatagatgcggtgtctctgcacagcacgttgcagatgagcatcagcctgctggcctttatcgtggtctactgttcggtatttggcgtgggatatgtgtatctcgcccggttgattaagaaaggtccgcagcctgtgggcacgctaacgtctaatacatcgggcacccctgcccgtccgctgtccgccgccgagtctgttccggaagaggagaagatctga

SEQ ID NO: 3528 - DNA, 999 bp, Enterobacter cloacae
gcaattcaggacatcactatggcatttacaccattttctcctcgccagcccgccgcctctgcgcgtctgccgctgacgctgattactcttgatgactgggcactggcgacactgaccggtgcggacagcgaaaaatacctgcaaggccaggtcacggcggacgtggcgcagttgactgagcaccagcatctgctggccgcgcattgcgatccaaaaggcaaaatgtggagcaacctgcgtctgttccgccgtcaggacggattcgcctttattgagcgccgcagcctgcgtgacgcccagcttaaagagctaaaaaaatacgcggtcttttctaaagtcaccatcgctctggacgatgaatacgttctgctgggggtcgcgggtttccaggcgcgtgcagcgctgaaaaacctgtttgccgagctaccggatgctgaaaaacagctagtcagcgagggagcaacctccattctgtggttcgaacacccggcggagcgcttcctgctggtaaccgacgaagcaacggcggaacgcgtcactgacgccctgcgcggtgaagcacagctcaacaacagccagcagtggctggcgctgaacatcgaagcgggcctgccggtcattgacgcggcaaacagcgcgcagtttatcccgcaggcgacaaacatccaggcgctgggtggtatcagctttaagaagggctgctacaccggtcaggaaatggtggcgcgtgcgaaattccgcggcgcgaacaaacgcgccctgtggacgctggctggtcacgccagccgtgtgccggaagcgggtgaagatcttgagatgaagatgggcgaaaactggcgccgtaccggcaccgtgttagccgccgtccagctcgatgatggccgcctgctggtgcaggttgtcatgaataatgatatggagcccgacagcgtgttccgcgtgcgtgatgatgcaaacacgctcagcattgagccgctgccgtattcactggaagattga

SEQ ID NO: 3529 - DNA, 762 bp, Enterobacter cloacae
tgtccgacagcgagtttagccattgtgagtatgttcagccattccgccattgccagcctcaacaatctggaaatgatggtctacaactatgtcattaagaaccgcgataaagtgatgtacatgaccatccgcgagctggcggatgcggctggggtctccactaccactatcctgcgcttctgccgcaagctcaactgcgatggttactcggaatttcgggtgcgctttaaactctatctggagcagaacgagccgcagcaggcgaattttggtgccagtgaaattatcagcttctttaaaagcgtaaataacgaagagtttgatgcgctattagataaagccgtcgatattattttatcatctgaacgaattatttttgtcggtgcgggcacctccggatcgctggcaaaatatggcgcacgtttcttttcaaatatcggcaaattcagtaaccatatcgacgatccttatttcccggtcactaacgacatggctaaaaatgcgctggccattgtactctccgtctccggcgaaaccgaggagatcctgcgcttcgccagccagttcagcctgcaccactgcaaggtgctctccgtcaccagccatgaacattctcgtctcgcaaagctggcggactttaacctctcctggcatgtcccgcaaacgcgtattggcggcgtttacgatatcaccacgcaaattcccgtcatctatattctggaatcattaggccgaaaactggcgaagaaattaacagaataa

SEQ ID NO: 3530 - DNA, 375 bp, Enterobacter cloacae
atatttgaggcgaacatgatcaagcgacaacgcaacgctatcctgcttgtagccctggcctgcctggtggtgctgatatgcaccgcccagcggatggccgggatgcacgcgcttgtcatgaacgtcaccgccacgagccagtctgtccagcaggggcaggagagtaccgacgcaccggtaaccccgtgtgagcttagcgccaagtcgctgatgtcggtcccgcctgttttgtttgaaggcgccctgattgccgtcaccctgctgctggcgttgctggcagccagcccgccgcgccgcgaacggcagtggcctccccgcgttatctccccgccccggttaagggtgcatctgcgattatgcgtcttccgtgaatga

SEQ ID NO: 3531 - DNA, 2013 bp, Enterobacter cloacae
tttatgtttactgtattcaggcgactgctggtctgcctgctttggctatggctgcccctcagccaggctgccgacagcggctggctgcgcgccgccgataatcagcacgccagcgtcaggctgcgtgcgcaacccgaaagcactggcgaaacccgcctgctgctggacgtcgccctgcaaaaaggctggaaaacctactggcgctcgccgggcgaagggggcgtcgcacccgcgattaaatggcatcagcccgtcgaggcgaaatggcgctggcctgtgccgcagcgtttcgacgtcgcgggtatcaccacgcagggctatcacggcgatgtcagctttcccatcaccctgcggggcgacgtcccgaagatcctgagcggcgtgcttacgctctccacctgtagcaacgtctgtattcttaccgactacccgttttcactgaacatgaccgcatccgcaggcgccggttttgattacgatttcagtcgggccatgggcacccttccgctcagcggcgggttgacctcaacgcttaacgccacctatgcccccggcaagctgaccgtaacggcgcagcgtgacgcaggctggcaggcgccgtccctgtttatcgacggtatggatgatgttgatttcggcaaaccggccctcaccgtgcgcggtgattcgctggtcgccaccgtgcccgtgacggacagctggggcgaggccgcgcccaacctcagcggcaaaaccctgtcgctggttctggccgatagcgggcaggcgcaggagtccagcctgagcattcagccggggaacgccgcgccgacgctctcgttaggctgggtgctgctgatggcgctggcgggcggtctgatccttaacgtcatgccctgcgtactgcccgtgctggccatgaagctgggcacgctgatgcaaaccgaacggcaggcgcggggtcaggtacgccgacagtttcttgcgtcggtagccgggatcgtgatctcgttcctcgcgctggcgctgatgatgacggttttacgcttaggcaatcaggcactcggctgggggatccagttccagaacccgtggtttattggtgcgatggcgatggtgatggtgcttttcagcgccagcctgctggggttgtttgaaatccgtctcccttccgtcgccagcaccttcctcgccacgcgcggcggtaacgggcttgcgggtcatttctggcaaggcgcgtttgccacgctgcttgcaacgccctgcaccgcgccgttcctgggtacggcggtctcggtcgcgctggcggcgccgcttcccctgctgtgggggatcttcctggcgatgggtatcggcatgagcctgccgtggctgctggtggcggtctggccggggctggcccagcgcttgccgcgtccgggacgctggatgaacgtcgtacgcgtagtgctggggatgatgatgctcggctcatcgctgtggctgctgagcctgctaacggtgcacattggcagcctgcccgtcatcacgctgggcgtgctcctgatccttacgctgctgctggtcaccgcctggcgctaccgctggcaaacggcactgcgcgccggggtattagctgtagtggtggccggagcagtcgcgtttgtatccggctccggcggcgagggttcccgccgcgatcgtatccactggcaaccgctcagcgagcaggccattgcccgcgcgctggcggagaacaaacgggtgttcgtcgacgtgaccgccgactggtgcgtgacctgtaaagccaataaatacaacgtgctgctgcgcgacgacgtgcaggatgcgctctccgccccggacgttgtcgccctgcgcggcgactggagccgcccctcagataccatcagccagttcttaaccacgcgcggcagcgccgccgtgccgtttaaccagatctacggaccgggattaccgcagggccacgtgctgcctgcgttgttaagccgcgaagcggtgctgagcaccctgtccgatgcaaaaggaaaataa

SEQ ID NO: 3532 - DNA, 783 bp, Enterobacter cloacae
agcgaagccgctacccggcttttttattgggagaaaagaatggcaattgcactggtcaccggcgccagccggggtattggtaaagccaccgcgctacagctggcaagcgaaggctacaccgttgcggtgaattttcatcacaacatcaaagccgcgacagaggtcattaatcagatcgtggacgcgggcggtaaagcctttgccgtgcgcgcggacatcagcgatgaggcgcaggtgatggcgatgttcgccagcctcgatcgcgaaggtgagccgctcgccgcactggtgaacaacgccggaattttgtttgaacagtccaccattgaaaacctctccgctgaacgtattaaccgcgtgctggctaccaacgtcaccggctattttctctgctgccgtgaagcggtgaagcgcatgtcgcataaacacggcggcaagggcggcgcgattgtgaatgtctcctcggcggcatcacggctgggcgcgccgggggaatatgtggattatgccgcctccaaaggggcggtggattccctgactaccggcctcgcgctggaggtggcggcacatggcattcgcgttaactgcgtgcggccaggcctgatttataccgatattcacgcctccggcggcgagccggggcgtgtggatcgggtgaagtcgatgttaccgatgcagcgtggcggtcagccggaggaggtcgcccaggccattgcctggctgctgagcgacaaagcctcctatgttactggtagcttcctggagctggctggcgggaagtaa

SEQ ID NO: 3533 - DNA, 687 bp, Enterobacter cloacae
tcatcttttgttttcccggagttaagtatggtgagcagaccattaatcgcacagggatattcgctggctgaggaagtagccaacagtataagccatggcattggcctggtttttgggattgtcggcttagtgttattgctggtacaggcagtggataccaacgccagcgcgatggccattaccagctacagcctgtatggcgggagtatgatcctgcttttccttgcctcaacgctgtatcacgcgattccgcatcaacgggcgaagatatggctcaagaaatttgaccactgcgctatctatcttcttattgcgggtacctatacgccgtttttgctggtggggctcaactcaccgctgtcgcgtggcctgatgattgtgatctggagcctggcgctgctggggatcctgtttaagctgaccattgcgcaccggtttaaagtgttgtcgctggttacctatctgacaatgggctggctgtcgctgattgtggtgtatcagttagccattaagctggcggtggggggcgtgacgcttctggcggtgggcggtgtggtctactcgctgggcgtgattttctacgtctgcaagcgtattccgtacaaccatgccatctggcacggctttgtgctgggcggcagcgtgtgtcacttcctggcaatttatctgtatgttgggcaggtgtag

SEQ ID NO: 3534 - DNA, 873 bp, Enterobacter cloacae
accacggcgctgatttacgcgtggtgcagatgttgcttggacacagcgatctttcaacgacgcaaatatacacccatgtcgcgacggaacgcctgcggcagctacaccaacagcaccaccctcgcgcgtgagtgccgacgaattgttacaggaacatatatgaaaaagtctttagcgctgttcaccctgctggcagcttcggtttccggttttgcccatgcggatgatgccgccattaaacagtctctgacgaaactcggcgtcgccagcagcgagatccagccagcgccggtggctggcatgaaaacggtgctgaccaacagcggcgtgctgtacgtgaccgaagacggtaagcacatcattcagggacccatgtacgacgtgagcggcgcgcagccggtgaacgtcaccaaccagctgctgatgaaaaacctgaacgcgctcgaaaaagagatgattgtctacaaagcggcgcaggaaaagcacgttattaccgtcttcaccgacatcacctgcggctactgccacaagctgcatgaagagatgaaagactacaacgcgctgggcattaccgtgcgttacctggctttcccacgcgctggcgtgcagagccagcctgagcaggatatgaaagcgatctggtgtgcgaaagaccgcaacaaggcctttgatgacgcgatgaacggcaaaggcgtgaagcccgcgtcctgcgatatcgacatcgctaaccattacgcgctgggcgtacagtttggcgtgagcggtacgccagccattgtgctgagtaacggctatgtggtgccgggctaccaggggccaaaagagatgaaagcgttcctcgacgagcaccagaaacagatgggtggtaaataa

SEQ ID NO: 3535 - DNA, 1077 bp, Enterobacter cloacae
aaaaccgcattcaggacctcacggagcgctctgacgttcttagggggtatctttgactacgatgccaagaaagagcgtctcgaagaagtaaacgccgagctggaacagccggacgtctggaacgaacctgaacgcgcgcaggcgctgggtaaagagcgttcttccctcgaagccatcgtagatacgctggatcaaatggcgcagggtctggaagatgtttctgggctgctggagctggctgtcgaagccgacgacgaagaaacctttaacgaagccgtggcagagctcgacgtgctggaagagaagctggcgcagctggaattccgtcgcatgttctccggcgaatacgatagcgctgactgctatctcgatattcaggcaggttctggcggtaccgaagcacaggactgggcgagcatgctgatgcgcatgtacctgcgctgggcggaagcgcgcggtttcaaaaccgagattatcgaagaatccgaaggtgaagtggcgggtatcaaatccgtcaccatcaagattattggcgattacgcctacggctggctacgtactgaaaccggcgttcaccgcctggtgcgtaagagcccgttcgattccggcggccgtcgtcacacctccttcagctccgcgtttgtctacccggaagtggatgaagatatcgatatcgacatcaacccggcggacctgcgtatcgacgtttaccgcgcatccggcgcgggtggtcagcacgttaaccgtacggaatctgcggtgcgtattacccacattccaaccgggctggtaacacagtgccagaacgaccgttcccagcataagaacaaagaccaggccatgaagcagatgaaagcgaagctttatgagctggagatgcagaagaaaaatgctgagaagcaggcgatggaagacaacaagtccgatatcggctggggcagccagatccgttcttacgtccttgatgactcccgcatcaaagacctgcgcaccggggttgaaacccgtaacacgcaggcggtgctggacggcagcctggaccaatttatcgaagcaagtttgaaagcagggttatga

SEQ ID NO: 3536 - DNA, 1527 bp, Enterobacter cloacae
ggaaccaacatgtctgaacaacaagcacagggcgctgacgcggtagtcgatcttaacaacgaactgaaaacccgccgcgagaagctggcagcgctgcgcgagcagggcgtgccgttcccgaacgattttcgtcgtgaccacacctcagaccaactgcacgcagacttcgacggtaaagagaacgaagagctggaagcgctgaacgttgaagtgtccgtggcgggccgcatgatgacccgtcgtatcatgggtaaagcgtccttcgtgaccttacaggacgttggcggccgcattcagctgtacgtctctcgtgacgacctgccggaaggcatctacaacgagcagttcaagaagtgggacctgggcgacatcctgggcgctaaaggtaaactgttcaaaaccaagaccggtgaactgtctatccactgcaccgagctgcgtctgctgacaaaagccctgcgcccgctgccggacaagttccacggtttgcaggatcaggaagcgcgctatcgtcagcgttacctggatctcatctctaacgatgaatcccgtaagaccttcaaaattcgctcccagatcatggccggcattcgccagttcatggttaaccgcgactttatggaagtagaaaccccgatgatgcaggtgatcccaggtggagcctccgctcgtccgttcatcacccatcacaacgccctggacctggacatgtacctgcgtatcgcgccggaactgtacctgaagcgtctggtggtcggcggttttgaccgcgtgtttgagatcaaccgtaacttccgtaacgaaggtatctccgtacgtcataacccagagttcaccatgatggaactctatatggcctatgcggattacaaagatctgatcgagctgaccgaatccctgttccgcaccctggcgcaggacattctgggcaccacccaggtaccttacggtgaagaggtgttcgacttcggcaagccgttcgaaaaactgaccatgcgcgaagcgatcaagaaataccgtcctgaaaccaatatggcggatctggataacttcgactctgcgaaagcgatcgctgaaagcatcggtattaaggttgagaagagctggggtctgggccgtatcgtgaccgagatcttcgaagaagtggccgaagcgcacctgattcagcctaccttcatcaccgaatacccggcggaagtgtctccgctggcgcgtcgtaatgacgagaacccggaaatcactgaccgcttcgaattcttcatcgggggccgcgaaatcggtaacggctttagcgagctgaacgatgcagaagatcaggcgcagcgcttccaggatcaggttaacgcgaaagcggcaggcgatgacgaagcgatgttcttcgacgaagactacgtgaccgcgctggagcacggcctgccgccgacggctggcctgggtattggtatcgaccgtatggtgatgctgttcaccaacagccacaccatccgcgacgtgatcctgttcccggcgatgcgtccggtgaaataa

SEQ ID NO: 3537 - DNA, 636 bp, Enterobacter cloacae
ctttatcaagtaaacggtatttttatgaaaaagacagttatcgcattaattgtggctaatgtatttaccgccacttccgccttcgccgccgcggatgcgggcacctggtatagcggggcgaaattcggctggtctcattattttgataccaatatgggttcaaaagcgtttgagaacacgcattccgatcacttcgattttgaccatgataatgtcagcgggggtgtttatacgggttatcagattaccccatggcttgcggtagaaggtggttatgattatttaggcaacatgcagattaaaggccagcatggcgcaggggcgcaaatgaagacgcagggcctgcaactgtctctgaaggccagttatgccctgaccaatgactgggatatttacggccgtaccggcgcaatgggctatcgcgctgaatccgatgtaagtggtcacaatcgttttgaaacaggtgtgcgcccgcttgctgccgtgggtactgaatacgccttcaataaaaactgggcgggccgcctggagtatcagtgggtaagcaacgtgggcaatgttaaccagatcggcgtgagcagcgacctgagttccgtcaccgcagggcttagctatcgctttggtcagtacgactga

SEQ ID NO: 3538 - DNA, 1035 bp, Enterobacter cloacae
tcgaaatactctccggctgggataacgtctgaaacaaggggaaaggctatggctgtcatcgttattaccggcggtacggcgggcgtggggaaggccacggcgctgcactttgccaaagcgggctacgatgtgggcatcattgcccgcgatgagcagagcctgcgctccacagaagaggagttgtgccgtttcgggatcaacgcctgtgccgttcaggccgacgtggcggacagcaaggcggtgaccgatgctgctaacgagattgaataccggcttggggccatcgatgtgtgggtgaataacgccatgggcgggatgctggcgccgtttcgcaccatgtcgcctgaggagtttcgccgcgtcaccgaggtgacctatctgggctatgttaacggtacccgcgccgcgctggagttaatgactcctcgtgaccgggggacgattattcaggttggctccgcgctggcctaccgctccattcccttgcagtcagcctactgtggggcgaaagccgcgatccgcgggtttactgacgccgtgcgcaccgagctgatgcatgaaaacagccgggtgcagatcgcaatggtacagatgccgggcctcaacacgccgcagttcgagtgggcgaggaataaattttcctgggcgatgcgcccggttcctcccgtgtttcagccggaagtggctgccagcgcgattttcaaggtagcgcaaaaaccggtgcgggagctgtgggtgggcagcagcaccgtccagtcgattgtcgggcaatttctttttcccggctttctggatcggctgatggttaaaaaggcctgggaagggcagatgaccgatacgctaaatgcggatgaccgtcaggactatctggatcagccggttaacgatctgcataaaatccacgggcacttcaccgacgaagcaaaagagcgcgccaccagcgttacctccggcatgccggggaaagtgctgctcggctccctcgccgtcacgggtgcgatcgtggcgcgtcttatgctctcgcggagacgataa

SEQ ID NO: 3539 - DNA, 297 bp, Enterobacter cloacae
cgtggtcaggcggatcggctgagggtatgcttcttttgtcaccacaataattacagaggcaatatcatggatcaggagctactggatgcggggtaccgggcctacaccggtgagaaaattgatgtttacttcaataccgggatctgcaaacactcgggcaactgcgtgcgcggcagcgcggcgctgttcgacctgaagcgtaaaccatggatcgcgcctgatgaagtagatgcagaaacggttgtgcgcgtaattgatacctgcccgagcggtgcgctgaagtaccgccaaaaataa

SEQ ID NO: 3540 - DNA, 282 bp, Enterobacter cloacae
tgcaggaaacagaacatggatattaacaacaaggcccgtattcactgggcgtgccgtcgcggcatgcgtgaacttgatatctccatcatgcctttcttcgagtatgagtacgacagcttaagcgatgacgataagcgcctgtttgtccgtctgcttgagtctgacgatccggatttattcaactggctgatgaatcacggcaagcccgccgacaccgagttgcaacggatggtgcaattaattcaaacacggaatcaggaacgtggtcctgtggcaatctga

SEQ ID NO: 3541 - DNA, 771 bp, Enterobacter cloacae
tgcgccattcacgctgaccgaggagctgttttgtttgcaggaagcctgacgagaaacccgatcattgccgttttctgcctgacgctgacgctacttgtagcaggatgctcggggagtaaatcttcggatatgggcagttattccggtgcagtctataccgttaagcgcggggacacgctctaccgcatctcacgcgccacgggaaccagcgtgaaggagcttgcgcgcctgaataatatttctccaccgtatactattgaggtagggcagaagctcaaggttaacggcggttcttcctcagggaaaaagtcctcaacgcgtaaaacagccaaagtcacgccatcctatcaggtgcctaaatcatcctggccgccggtcggtcagcgctgctggatctggcctgcaagcggaaaagtggttgcgccgtactcgctctcggaaggtggcaataaaggtattgatatcgctgccgcacgcggtacaccggtttacgcttcaggggccgggaaggtggtctatgtcggtaaccagcttcgtggatacggtaacctgatcatgattaagcatggtgaggactacattacggcgtatgcgcataacgacacgatgctggtcaataacgggcagaacgtgaaggcggggcagaagattgcgaccatgggcagtaccgggacggatacggtgaagctgcacttccagatccgctataaggccacagccatcgatccgcagcgttatcttccggcgcagggcagtaagccgaagtgctaa

SEQ ID NO: 3542 - DNA, 702 bp, Enterobacter cloacae
cggcaatgtaaaagaaatcatgaggaaagaaatatggctgctacaaacggtatgattgatactgatgacgctgtaattttactcatcgaccatcagagtggcttattcaacacggtacgtgatgtgcctgtaccagaccttcgtaattatgtgacagcgatagccaaagttgccacgcttttaaatatcccggtgatcaccacggcctctgttcctgacggtcccaatggcccgctcatcccggaaattcacaaatatgcaccccatgccgtgtatgttccacgcaccgggcagattaatacctgggataatccggcgtttgtgaaggaagtggaaaagacgggcagaaagaccctgattattgccggcacgctcaccagcgtctgcatggcgttccctgcggttagcgctgtccacgaggggtataaggtttactgtgttgtggatgcctcggggaactggtccaaaatcgcgaccgataccaccatcgcgcgcgtggctcaggcgggggcgatccctaccgatacgtttgccattgtcgctgaattaatgagaacctggaaccgcgaggaaggttctcgctttgctgagatcctggcagagcatgtctgtccggaatataagtgcctgattgaaagtttcggcaaagctcaggaaattgccagaacgggcccggaaaccaatctggagcattataagtaa

SEQ ID NO: 3543 - DNA, 456 bp, Enterobacter cloacae
gagtcgaatatggacatggtttttcgtgccctggcaatttacctgtttctggtcattgtgtttaaagttgccgggcggcgcgccctgctacaaatgaccagttttgaccttattttgctcttaattatcagtgaagcgacacagcaggcgctacttggcgaagatttttccatcaccggtgcgatgattacaataacaacgctggtggtggtggatattatatttggcctcctgaaaaaatatttttccactgttgagaatattcttgatggcacgccggtgatattggtggagaacggtgtcccccttgccgataaactgaaaaaggtcgatgtatcctgtgatgatatattggtatcagcccgccagaatcacggtattacagaattgaaggagataaaatacgctattcttgagcgtaatggtcatatttctattattcctgacgaaaattaa

SEQ ID NO: 3544 - DNA, 279 bp, Enterobacter cloacae
ggaaccatggaaattcttgaaggccataacaagttttacgtcaacgacgccgaaggcaatcaggtagcggagattgtctttgtcccgaccggcgagcatctgagcatcattgagcacaccgatgtagatccaagcctgaaagggcagggtgtgggtaagcagctggtggcgaaggtggtagagaagatgcgcggggagaaccgtaaaattatcccgctgtgtccgtttgcgaagcatgagtttgataatacacgggagtatgacgatattcgggcgtaa

SEQ ID NO: 3545 - DNA, 2958 bp, Enterobacter cloacae
  unsure (35)
tccttaggatgtgctgcctccggcgggttaagagnagggagagggaggaaccacattcactgcacgtttcaggaaccatcgctcatgacacagactttaagccagcttgaaaaccgtggcgccttcattgaacgtcacattgggccggatgctcagcaaaggcaggagatgctgaagacagttggcgcggattcattaaacgcactgatcggccagatcgtgccaaaggacatccagcttgccacgccgccgcaggtaggcgagtccacgacggagttcgccgcgctggcggagcttaaggccatcgccggccttaacaagcgctataagtcttacattggcatgggctacaccaacgtgcagttaccgccggtgatcctgcgtaacatgctggaaaacccgggctggtacaccgcttataccccgtatcagccagaagtctcccagggccgtctggaagcgctgctgaacttccagcaggtgacgctggatctgaccggtatggatatcgcctctgcctcgctgctggatgaagccaccgccgccgccgaagcgatggcgatggcgaagcgcgtgagcaaactgaaaaacgccaaccgtttcttcgtcgcggcggacgtgcatccccagacgctggacgtggtgcgcacccgtgcggaaaccttcggctttgaggtgattgtcgacgacgctgaaaaagtgctggatcaccaggacgtcttcggcgtgctgttgcagcaggtgggcaccaccggggaagtacacgactacggcgcactgatcgccgagctgaaatcccgtaagattattgttagcgtcgccgctgattttatggcgctggtgctgctgacggcgccaggtaaacagggcgcggatattgttttcggctcagcccagcgtttcggcgtgccgatgggctacggcggcccgcacgcggcgttctttggcgcgaaagatgaatttaaacgctccatgccaggccgtattatcggcgtatcgaaagatgccgccggtaacaccgcgctgcgcatggcgatgcagacccgcgagcagcatatccgccgcgagaaagcgaactccaacatttgtacctcgcaggtactgctggctaacattgccagcctgtacgcggtgttccacggtccggctggcctgaagcgcattgccagccgcatccaccgtctggccgatatcctggcctgcggtctgcaacagaaaggtctcagactgcgtcatgaacactatttcgacaccctgtgcgtcgaggtggcagacaaagcggccgtgctggcgcgcgccgaggcagcgcaaatcaacctgcgcagcgacattcacaatgcggtcggcattacgctggacgaaagcaccacccgtgacgatatcctgaccctgttcaacgtattgctgggtgacgcacacggtctggatgttgatacgctcgacaaagaggttgcgctcgacagccgctccattcaggaaagcatgctgcgcgacgacgcgatcctgactcacccggtgttcaaccgctatcacagcgaaaccgagatgatgcgttacatgcactctctggaacgtaaagatctggcgctgaaccaggcgatgatcccgctgggctcctgcaccatgaagctgaacgccgcggctgagatgatcccaattacctggcctgaattctctgagctgcacccgttctgcccggctgagcaggcggaagggtatcacatgatgatcaaccagctctccgactggctggtgaagctgaccggttatgacgcgctctgcatgcagccgaactccggcgcgcagggtgaatacgccggtctgctggcaatccgtcactatcacgaaagccgcaacgaaggccaccgtgatatctgcctgatcccaagctctgcccacggtaccaacccggcttctgcccagatggcaggaatggaagtggtggttgtggcgtgcgacaaaaacggcaacatcgatctggccgacctgcgcgccaaagccgagcaggcgggcgacaaactctcctgcatcatggtgacctacccatccacccatggcgtgtacgaagaaactatccgtgaagtgtgtgaagtggtgcatcagttcggcggccaggtttacctcgacggcgcaaacatgaacgcccaggtgggcatcacctctccgggctttattggcgcggatgtgtcgcacctgaacctgcacaaaaccttctgcattccgcacggcggtggcggcccggggatgggcccaatcggcgtgaaagcgcacctggcaccgtttgtgccgggccacagcgtggtgcagattgaaggcatgctgacccgtcagggcgcggtctccgcggcaccgttcggcagcgcctctatcctgccaatcagctggatgtacatccgcatgatgggcgcggaagggctgaagcaggccagccaggtagcgatccttaacgccaactacatcgcaacgcgtctgaaggacgcctatccggtgctctataccggccgcgacggtcgcgtggcgcacgaatgcatcctcgatattcgtcctctgaaagaagagacgggcatcagcgagctggatattgccaagcgcctgatcgactacggcttccacgcgccaaccatgtccttcccggttgcgggaacgctgatggttgagccgaccgagtctgaaagcaaggtggagctggatcgctttatcgacgccatgctggcgatccgcagcgaaatcgaccgcgtgaaaggcggggagtggacgctggaagataacccgctggttaacgcgccgcatacccagaacgaactggtggcagagtggaaccacggttatacccgcgagctggctgtcttcccggcaggtgtggcaaacaaatactggccaaccgtgaaacgtcttgatgatgtttacggcgaccgtaacctgttctgctcctgcgtaccgatgagcgaataccagtaa

SEQ ID NO: 3546 - DNA, 432 bp, Enterobacter cloacae
ttcaaacacggaatcaggaacgtggtcctgtggcaatctgatcttcgcgtctcgtggcgctcacagtggatgtccttactgctccacggtctggtcgcggcaatggtgttattggtgccgtggccgctaagctatacccctctgtggctgcttttgctgtcgtttgtggtgtttgatagcgtgcgcagccagcgtcgaatcaacgcccgtcagggtgaaattaagctgctgatggattctcgcctgcgctggcagggaaaagagtgggagatgatggggacgccgtggatgcttaacaccgggatgatgctacggctgcgtcgggtcgaggacaaccgtcgccagcacctgtggctggccgcagacagtatggatcccgcggagtggcgggatctgcgccggctaatcgtgcaacagccgacgcaggaataa

SEQ ID NO: 3547 - DNA, 927 bp, Enterobacter cloacae
tggccagattgcagaaccaaaggggctgatgtggaaaaggatctcgcactcatcgaacagtttctcgacgcgctgtggctggagaaaaacctcgctgaaaatacgctcagcgcctatcgtcgggatctcacgctgctggtcgagtggctggcgcatcgggggctgacgcttgaaagcgcgcaaagcgatgacctgcaagggttgctggctgagcggatggaaggggggtacaaagccaccagctccgcgcgtctgctgagcgccatgcgccgcctgttccagcacctgtaccgcgagaagatccgcgcggatgaccccagcgcactgctggcatcgcctaaactgcctcagcggctgccaaaagatctcagcgaagcacaagttgagagattattacagtcgcccgcagttgaccttccgctggagttacgcgataaagccatgcttgaactattgtatgccacgggcttgcgcgtttccgagctggtgggcctgacgatgagcgatatcagcctgcgtcagggcgtggtgcgcgttatcggtaaagggaacaaagaaaggctggtgccgctgggtgaagaggcggtctactggctggagacgtatctggaacacgggcgtccgtggctgctgaacggcgtctccatagatgtattgttcccgagccagcgcgcgcagcagatgacgcgacaaacgttctggcatcgcattaaacattacgccacactggcgggtattgacagtgagaagctgtcgccgcacgttttgcgtcacgccttcgcgacgcatctgttaaaccacggcgctgatttacgcgtggtgcagatgttgcttggacacagcgatctttcaacgacgcaaatatacacccatgtcgcgacggaacgcctgcggcagctacaccaacagcaccaccctcgcgcgtga

SEQ ID NO: 3548 - DNA, 1743 bp, Enterobacter cloacae
ataattcgcgtgaaagccccgataaaactgcgccgccgcgatgcgggtgaaaccgcggatttaccagacacgcttccgctgctgctaaagcggctgtacgccagccgtggcgtgcgtacggcaagcgatcttgagcgcagcgtcaaaggcatgctgccctggcaagcgctgagtggcatcgaacaagcgagtgaaatgctctacgacgcgttccgggaaggcacgcggattgtcgtggtgggcgatttcgatgccgacggcgcaaccagtaccgcgctgagcgtgctcagcctgcgtgcgctgggctgtgataacgtgacttacctggtgccgaaccggtttgaagacggctacggcctcagcccggaagtggtcgatcaggcccatgcccgtggcgcacagatgatcatgaccgtggataacgggatctcttctcatgcgggggtcgatcatgcccatgcgctggggatcccggtactggtcaccgatcaccacctgccaggagaaaccctgcctgccgccgaagccatcattaacccgaacctgcgcgactgcgatttcccgtcgaaatcgctggccggagtaggggtggcgttttatctgatgctggcgttacgcacgttgctgcgtgataagggctggttcgaatcgcgcgggattgccgtgccgaacctcgcggagtatctcgatctggtggcgctgggaaccgtggcggacgtggtaccgctcgataccaataaccgtattctcacctggcagggcttaagccgcattcgggcaggtaaatgccgtccggggattaaggcgctgctggaaattgccaaccgcgatccgctgaagctcgcggcaagcgatttgggttttgccctcggcccgcgcctgaacgcggcggggcggctggacgatatgtcggttggcgtcgcgctgctgctgtgtgacaacatcggcgaagcgcgcgtgctggccagtgagctggacgcactcaaccagacccgtaaagagattgagcaggggatgcaggccgaagcactgaccctgtgcgaaaagctggagcgcagcggtgacaccctgccgggcgggctggcgatgtatcaccccgaatggcaccagggcgtggtgggcattctggcgtcgcgtattaaagagcgtttccaccgcccggtgatcgcgttcgcccccgccggggacggcacgctgaaaggctccggtcgttccattcaggggctgcatatgcgcgatgcgctggagcgtctggatacgctgcatccgaacctgatgattaagttcggcggtcacgcgatggcggcaggcctgtcgctggaagaggcgaagttcgacgagttccagcgtctgtttggcgaactggtcaccgagtggatcgatccggctctgttgcagggtgaagtggtttctgacggtgagctttcaccggctgaaatgaccatggaggtggcacagatgctgcgcgatgccggcccgtgggggcagatgttcccggagccgcttttcgacggacgttttcgtttgctgcaacagcgcatcgtgggcgaacgccatctcaaagtgatggtggaatcggtcggcggcggaccgctgctcgacggcatcgcctttaacgttgatacctccatctggccggacaacggcgtgcgcgaggttgagctggcctataagctggatattaacgagttccgcggtaaccgctcccttcagatcatcatcgacaatatcaggccaatttag

SEQ ID NO: 3549 - DNA, 1260 bp, Enterobacter cloacae
tttaaaattaaaccctctttctttttacgtaatcaatcgcccctgttatatctgtcggcaaattttttatttcccggaccacagatgaaaacacgactcctcctgtgcgctggcgtattagctgtctccagtgcccatgccagcgccctctatttttatgaagccggcaccgaagataccgcgcttgccggagcagggcaggcggctcgtgcgaaggacgcctcgacaatcatgaccaacccggctggcatgacgcgcttaccggatcatatggtcaccggtgggttacaggttatggatggctccatcgacaaccagctggataacgatgcccatcaaagccccggcgatgtgatgaaaaccatcccgaatgccagcgccttttatagccagaagataaacgatgatctttatgccgggatcgggctttacggtaattacggcctggggatcgactacggcagctgggcgggcgacaggctgattaaaaagagtaccatggtagccatgacgctcagcccctcgctggcctataagcttaacgaccgtctttcgattggcgcgtccgccaacgttaactacggttacttctcgctgactcgcagcgttaacgatgatgactaccagcgacgcgatgaagacctggccatgagctatcggcttgggctgctgatgcagctaactgaccagacccgagccggtattacctggaacagcgaaacggactacagcttcaatattgacggcaacgcgcgtctacagaacggcacctacgacctgccgttgtcggcacagatcagcgcgccgcagcaaatcatgctcagtctggtgcatgatattaacccgcggtggtcggttatgggcgatctcggctggcaggactggagccagttcggcgcgccgcaaatcgtcgtcggggaccagcagctgaacaacgtcagccgcctgaaggacacgtggcacggtgcggtgggcgtgcagtatcgtccaacgcctcagtggcgactgaatgccggtgtggcgttcgacagctcgccgtatgaaagccagagcgatgtggccttaaccttacctaccggcgatgagtggcgatttggtacgggagcccagtatcagattaccccggccagcaatattggtattgccgtgtcgtatcttcatatgcagtcgtcgcatgtgaaatcgccggtggcgtttgccggaagttacgaccatccttatctttggtttgccagcgtcaactacagctatcagttttga

SEQ ID NO: 3550 - DNA, 648 bp, Enterobacter cloacae
atgtctgaaggttgtaccatgcatattttaccgcctgttcgacccgaaaaatccatcgaacgactgaccgccatccttgagccgatagcggagaaagtgcacgttgttccgcgtaagcgactcacctggttacggaaggggaaacagcagatgtacctctttctggaaggggagttatccctgctgcgggcttcggatggactggtggtagtgaccgtttacgagccgcatttgtttggtattgcagagatgatccagcctacgcaggggcatcttctccgtgcggaaagggagtcgactattttacgtctcgatgcggacaaggcggctgagttgtttcgcgccgagggcgtctgggaggatgtcgccgcgctgctttcataccatacggcctatttaatatttcgtgatgcacaggtactccagcagcgtacctattccgttattcgtaaccaccttcaggaaatgattttgcttccggaagagacgcgtctgcgtaccacgattctggaatatattcaggatcgtacgctgctctctcgcagcagtatactcaatgtattatccgcccttaagcagggagaatatatctcctttaagcgcggcggatacctgcttgaagtcagacatttacccgaatcattctag

SEQ ID NO: 3551 - DNA, 2034 bp, Enterobacter cloacae
cctcctttccccccatgtaccgccagcgtgaatataactcctcgaggaagtatgaaatttaaaactctcgttagtgcgatggccgttgctggtctgctattagtctcgttgacctcattgcctgtcctggcacaaaaggaagggaagggagccactgcccatacgaaagagatgaatgatgcactttatggtcaactgcccttctttgataagaccgatttccgaaatgcgcacaaaggctttattgcctcgctgccacccgcggtgattaaagacgaaaaaggcgccgttatctggaacccccagaaatacgcttttatcaaagaagggcaaaaagcgccggataccgtcaacccgagcctgtggcgtcaggcgcagctgaataatattggcggtctgtttgaggtcacggaaggcatctaccagatccgcaacctcgatctgtcgaatatgacgattatagagggcaaagaggggatcacggttatcgatccgctgctgtctgcggaaacggccaaagcgggcatggatctttacgttcaacatcgtggcaaacgcccggttgttgccgttatttatacccatagtcatgtcgatcattatggcggcgtgcgtggcgtggtcgatgaagcgggagtgatgaccggcaaagtgaaagtctatgctccagcaggttttatggaagaggcggtatcggaaaatatcatggccggaaatgccatcagccgccgtgccagttatatctacggaaacctgttaaaggccaatgtaaaaggtcagataggagcgggtctggggacgaccacctcagcggggacggtcacgcttatcgcgcccactcacgccattaccaaagacgggcagaaagagatcatcgacggtctcacctatgattttatgctggcgccggggtcggaagcgccgtctgaaatgctctggtatgtggaagagaaaaagctgattcaagcagcagagaacgtcactcacaccctgcacaatacctactcgctgcgcagggcgaagatacacgatccgctggcatggtcaaagtacatcaataacgctctcgatcgttggggggataaagcggaaattattatcgcgcagcaccactggcccacatggggtaataagaaagtggtgaagctgatgaaaagccagcgtgatatctaccgctatatcaacgaccagacgctcagactggcgaataaggggctgacgagggatgaaatagccgcaaatttcgccctgccttacggactggctaaatcctgggcaggccgtggctattacggctcggtaagcaacaacgtcaaagccacctatgtctactatcttggctggttcgacggcaatccggcgacgctcgatgaactgcctccggtcgaggcggcgaaaaagtatgtcgattacatgggcggagcccgcgcgatccttgaaaaagcccgtgtcgattatgcccgggggaattatcgctgggtggctcaggtggtcagtaaagtcgtttttgccgatccgaataataaggcggcgcgcgaactggaagccgatgcgtttgaacagctgggataccatgcggagtcagggccgtggcgtaacgcctacctcaccggtgcgcaagagttgcgtaacggcgtgaagataaagccgacgcccaaaaccgccagcccggatgcggtccgtgccatgtcgactgagatgatttttgactacttcggcgttcaccttaacggcgtcagagcggcgaatgccagaggtatttttaacgttgatttaggccgcgagggcggcaggtataagctggagctggagaatggcgtgctgaaccatagtgccaatatccaggcagaagatccggatgcaaccattacgctcagccgcgaaacgctgaacaaaatcatccttaaggaaaccacgctgaaaaaggcgcaacaggcaggagaggtgacgatcgtcggcaacgccgcgaaggtagacgaaatgctgcgctgcatggagagcttcagtttctggtttcctgtcgtcaccccttaa

SEQ ID NO: 3552 - DNA, 585 bp, Enterobacter cloacae
aatacgctattcttgagcgtaatggtcatatttctattattcctgacgaaaattaagggcaacgcgatgagcaatcttattcacgacagtaacagcaccattagcgagctgacgaaaaagctcgccactcagcttacggacagaggtttgcggttaactaccgcagagtcctgtaccggcggcaatcttgcggttgcgctttgtgccgaagagaacaccgcggaattttatgacgttggcatggtggtgttcagcgatgcggcgaaggagaggatcctcggcgtgcggcacgaaaccattgagcgcttcaccgccgtcagtgaacaaacggtgaccgagatggccgctaaaattcgcgaaattgccgaggcggatattggccttgccatcagcggctatgcgggaccggaaggcggagacgatggcaccgcagccggtacggtctgcttcggctggaatattcgcggacagacggaaacccgcaccgtgctgttttccggtgaatgtcaggatgtggtggataaagcggtgcgttattccctgtctgaactgatcgaaatactctccggctgggataacgtctga

SEQ ID NO: 3553 - DNA, 1092 bp, Enterobacter cloacae
ccgcctctgacccatagggcgcgtctattgcatatatcggaagcaaaactgccctgctctttttttacggcaacaaattccctacaatccagcccattgcctgccaacaacaatggggatctcatgggcacgaccaaacacagtaagctgctaatccttggatctggacctgcgggttataccgcagcggtctatgctgcacgcgctaacctgcaaccggtactgatcaccgggatggaaaaaggcggtcagttgaccaccaccacggaagtggaaaactggccgggcgacccgaacgacctgaccgggccgctgctgatggagcgcatgcacgagcatgccgccaaattcgaaaccgaaatcctgttcgaccacatcaataaagtggatttgcagaaccgtccgttccgcctgacgggtgacagcggcgaatacacctgcgatgcgctgatcatcgccaccggcgcctctgcccgctatctcggtctgccgtctgaagaagcgttcaaaggccgcggcgtgtcagcctgcgcgacctgcgacggtttcttctatcgcaaccagaaagttgcggtgatcggcggtggtaatactgcggtcgaagaagcgctgtatctggcaaatattgcctcagaagtacacctgatccaccgtcgcgacaccttccgcgcggagaagatcctgatcaaacgcctgatggacaaagtggcgagcggtaacattgtgctgcataccaaccgtacgctggaagaagtaactggcgatcagatgggcgtggcggggctgcgtatccgtgatacccagaacaccgataacgtcgaaacgctggaagtggcaggcctgtttgtggcaatcggtcacagcccgaacacggctatctttgaaggtcagctggagctggagaacggctacattaaagtgcagtctggcattcacggcaacgccacccagaccagcgttccgggtgtcttcgcagctggtgacgtgatggaccatatttatcgtcaggcgatcacctctgcgggcaccggttgtgtggccgcgctggacgcagaacgctacctggacgggctggctgaacaaggtaaataa

SEQ ID NO: 3554 - DNA, 1797 bp, Enterobacter cloacae
tttcttataacgtcacctgcaaagtacgcaatggaaaaaacccgtcaacaagagttaacccgctggctgaaacagcaaagcgttctgtcccgccgctggcttatgatttcccgcgttctgggatttatcagcggtctgttgattgttgcccaggcatggctgctggcccgcattctcaaccatatgatcatggagaacatcccgcgcgaagcgctgctgttgccgtttatcgttctggtgctggttttcgttctgcgtgcgtgggtggtctggctgcgcgagcgggttgggttccatgccgggcagcacatccgctatgagatccgccgcaaggtgctcgatcggctttcagaagccgggcctgcgtggatccagggcaagccggccggtagctgggcgacgctgatccttgagcaaatcgacgatatgcacgattactacgcgcgttatcttccgcagatggcgctggcggtgtttgtgcctctgatgattgttatcgccatcttcccggttaactgggtggcggcgctgatcctgctggggaccgccccgctgatcccgctgtttatggcgatggtcggcatgggcgcggctgatgctaaccgccgcaacttcctggcgctgggtcggttgagcggtcatttcctggaccgtctgcgcggtatggaaaccctgcggatctttggtcgtggtgaagcggaaaccgaaaacattcgcctggcgtcgcaggattttcgtcagcgcaccatggaagtgttgcgcatggcctttctctcttctggcgtacttgaatttttcacctccctgtcgattgcgctggtggcggtttactttggtttctcctacctcggcgcgctggactttggtcactacggtacggcggttacgctttccgctgggttcctggcgctgatcctggccccggaatttttccagccgcttcgcgatctcggcaccttttaccatgccaaagcgcaggcggtgggtgctgccgacagcctgaaaaccttcatggaaacgccgctggcgcatccggagcgtggtgaggtaacgctgaatacgaacgatccggtgaccattgaagcacaggatttttctgttctgtcgcctgaaggcaaagtactggccggtccgctgaactttaccctgcctgccgggcaacgtgtggtgctggtgggtaccagcggctcaggtaaaagctcattgttgaatgcgctttcaggttttatggcgtacaccggatcgctgcgtatcaacaaaacggagctgcgcgagctcgatcctgatgcctggcgtaaacagctaagctgggtggggcaaaacccgcagctgccagctccgacgcttcgcgagaatgtgctgctggcacgcccggatgcgcgtgacgatgagctgcaatcggtcctcgaccgcgcctgggtcagcgagtttctgccgctgcttgcgcagggtatcgataccgtcattggcgatcagtctgccgggctgtcagtaggccaggcacagcgcgtcgcggttgcccgtgcgctgctgaacccctcttcgctaatgctgctggacgaacccgccgccagcctggacgctcatagcgagcagcgcgtgatggatgcgcttaacgcagcctcacgccagcaaaccaccctgatggtgactcaccagctggaaggtattgccgactgggatcagatctgggtgatggaaaacggacacattgttgagcaaggcgactacgccgcgcttgttgccgcgcaggggccgtttgcgaccctgctggcgaaccgtcaggaggatatctga

SEQ ID NO: 3555 - DNA, 819 bp, Enterobacter cloacae
atttatttgagtggcgaagggatgttgatggtttcaaaatactggctctttgagtcgtcatccctttatggcgatataacccgcgcgcaggaatgggcgcggacgtttattattgaggtggttatgttcagaaaattagcggcagaatgctttggcacattctggctggtgtttggtggctgcggtagcgcagtactggcagccgcatttccggaattaggtattggatttgtcggcgtcgcgctggcattcggtttaaccgtattaaccatggcattcgccgtggggcatatttccggcggtcatttcaacccggccgtcacattaggtttatgggcgggcggacgtttcccggcgaaagatattattggctatattattgcccaggttattggcggtattattgccgcggcggtgctgtacgtaattgccagcggaaaagccgggtttgacgccgcggccagcggatttgcgtcgaacggcttcggcgaacactcgccaggcggctactcaatgctgtctgctatcgtgattgaaattgtgctcaccgcaggtttcctgttggtgatccacggcgcaacggacaaatacgcgcctgcgggctttgcccccatcgctattggtctggcgctgacgctgatccacctcatctccatcccggtgaccaacacctccgttaacccggcgcgcagcaccgcggtggctattttccagggcggctgggcgcttgaacagctgtggctattctgggtgatgccaattatcggcggtattctgggcggcgtgctgtatcgcaccctgctggaaaaacgcgattaa

SEQ ID NO: 3556 - DNA, 942 bp, Enterobacter cloacae
tgtctctggcgcttaactgatactcaaaaggaccggctgttcatgttctcaggactcctcatcattcttctgcccctgattgcgggctaccttattccgctgcgtcatgaatcggccttaaagcttattaatcgttttctcagctggattgtttacgtcattctgttctttatggggatcagcctggccttcctggataatctggcgacgaacttgctttccatcctgcattattctgcggttacggtagtggttattctgctgtgcaatattgccgcgctgttctggttggaacgcactattccctggaaaaatcaccatcatcaggaaaagcttccctcccgtattgcgatggcgctggaatcattaaagctgtgcggcgtggtggtactcggttttttactgggtctgaccggctgggcatttttacagcacgcaacggaagccagcgaatatacgcttattttcctgctcttcctgattggtattcagctgcgaaataatggcatgacgctgaaacagattgtccttaaccgccggggcatgatggttgccgttatcgttgtggccagctcactggcggggggagtgattaacgcctttattctcgatctgccgctgaaaaccagcctggcgatggcgtccggtttcggctggtattcgctctccggtattctgctgaccgaatcgtttggtccggtgatcggcagcgccgccttctttaacgatctggcgcgcgagctgttagccatcatgctgatccccggcctggtaagccgcagccgctctactgcgctgggcctgtgcggggccacctcaatggactttaccctgccggtgttacagcgctcgggagggctggagatggttcctgccgccatcgtacacggctttattctgagcctgctggtacccattctgatggcgttcttctcagcctga

SEQ ID NO: 3557 - DNA, 1677 bp, Enterobacter cloacae
aatataactttaacaggtgtgattatgttttgtgtgcaatgtgaacaaaccatccgtaccccagcaggcaacggctgctcttacgcgcagggtatgtgcggcaaaaccgcagaaacgtccgatctccaggatctgctgattgcggcgctgcaaggcttgtccgcctgggccttcaaagcccgtgaatatggcattgtcgatcactatgtcgacagctttgcgccgcgcgcatttttctccacgctgaccaacgttaacttcgattctccacgcattgtgggctatgcccgcgaagcgattgccctgcgtgaagccctgaaagcgcagtgcctgaatgccgacgccagcgcccgcgtggacaacccgatggcggagctacagctggtgagcgacgacctgggcgagctacagcgtcaggccgcagaattcaccccaaataaggacaaagcggcaattggcgagaacatcctcggcctgcgcctgctgtgcctgtacggtctgaaaggtgctgcggcctatatggagcacgcgcacgtactcggccagtacgataacgctatttacgcccagtaccacaaaatcatggcatggctgggcacctggccttccgacatgaacgccctgctggaatgctcgatggaaatcggccagatgaacttcaaagtgatgagtattctggatgccggtgaaaccagcacctacggccacccaacgccaacgcaggtcaacgtcaaagcgaccgaaggcaaatgcatcctgatctccggtcatgacctgaaagatctctacaacctgctgaagcagaccgaaggcaccggcgttaacgtctatacccacggcgaaatgctgcccgcgcacggctacccggagctgcgtaaatttaagcatctgatcggtaactacggcagcggctggcagaaccagcaggtggagttcgcccgcttccctggcccaattgttatgacctctaactgcatcatcgacccgaccgtcggcgcgtatgacgaccgtatctggacccgcagcatcgtcggctggccgggcgtgagccaccttgaaggcgacgatttcggtccggttatcgctcaggcgcagcagatggcaggcttcccgtacagcgaaatcccgcacctcatcaccgtcggttttggccgtgaaaccctgctgggtgcggcggattccctgattgacctcgtcagccgtgaaaaactgcgtcacatcttccttatcggcggctgtgacggcgcgcgcggggaacgtaactacttcaccgatttcgccacccgcgtaccggaagactgcttgatcctgaccctggcctgcggtaagtaccgtttcaacaagctggacttcggcaacatcgaaggtctgccgcgcctggtggatgcgggtcagtgtaacgatgcgtattcagccatcattctggcggtcacgctggcagagaaactgggctgcggcgtgaacgacctgccgctgtcgctggtgctctcctggttcgagcagaaagcgatcgttattctgttgaccctgctctctctcggcgtgaccaacatcgtcaccgggccgactgcgccaggcttcctgacgccggacctgctggccatcctgaacgagaaatttggtctgcgttccgtgaccaacgttgaagatgatatgaagcaactgctgagcgcgtaa

SEQ ID NO: 3558 - DNA, 744 bp, Enterobacter cloacae
gtaaagactgccccgatgagtattaaactaaacggcattaactggttctacggcgcacaccaggcgctgttcgacattacgctgagttgcccggagggcgaaacgctggttttgcttggcccaagcggcgcgggaaaaagctcccttctgcgtgttttaaatctgcttgaaatgccccgttcgggaacgctggccatcgccggtaaccattttgacttcgcgaaaaccccttctgataaagcgattcgtgaactgcgtcaaaacgtgggcatggttttccagcaatacaatctctggccgcatctgacggtggtgcaaaacctgattgaagccccgtgccgcgtgcttggcttaagcaaagaccaggcgatggcgcgtgctgaaaagctgctggaacgtctgcgtctgaaaccgtacagcgaccgttatcctctgcatctctctggtggtcagcaacagcgtgtggcgatcgcccgtgcgctgatgatggagccagcggtgctgctgttcgacgagccgaccgcggcgctggacccggaaattactgcccagatcgtgagtatcattcgtgagctggcggaaaccaacattacccaggtcatcgtgacccacgaggtggaagtggcgcgcaaaaccgccagccgcgtggtctatatggaaaacgggtatatcgttgagcagggtgacgcgagctgcttcactaacccgcaaaccgatgccttcaaaaactacttatcacactga

SEQ ID NO: 3559 - DNA, 750 bp, Enterobacter cloacae
tgtgttagggaaattataatgaaaaaagtattgattgccgcgctgcttgctagcgtcagcctttccgctaccgcagcccagaccatccgtttcgccactgaagcgtcctaccctccgtttgaatccattgatgcgaacaacaagattgttggcttcgacgtggacctggcaaatgccctgtgtaaagagatcgacgcgacctgtaccttcagcaaccaggcgttcgacagcctgatcccaagcctgaagttccgccgtatcgacgccgtaatggccggtatggacatcacaccggagcgtgagaagcaggttctgttcaccaccccttactacgacaactcggcgctgttcatcggtcagaaaggtaaatacgcctccgttgacctgctgaaaggcaagaaagtcggcgtgcagaacggcaccacgcaccagaaattcatcatggataagcacccggaaatcaccaccgtgccgtatgacagctaccagaatgcgaaactggacctgcaaaacggtcgtatcgatgcggtgttcggggatacggctgtcgtgactgaatggctgaaagcgaacgacaagctggctgccgtgggtgacaaggtgaccgataaagactacttcggtacaggtctgggtattgccgtacgtcagggcaacaccgagttgcagcagaaattcaacgctgcgctggaaaaagtgaagaaagacggcacctacgaaaccatctacaaaaaatggttccagaagtaa

SEQ ID NO: 3560 - DNA, 684 bp, Enterobacter cloacae
  unsure (13)
  unsure (67)
  unsure (219)
acggagaccaggntgatgtgggattatttacccgaactgatgaaagggctgcacaccagcctgacgntgaccgtcgcgtctatcatcgtggcgctgatcctggcgctgatcttcaccttcgtcctgacgctgaaaacgccagtgctggtgtggattgtacgtggctacattacgctctttaccggtacgccgctgctggtgcaaatcttcctgatttantacggcccggggcagttcccgtcgttacaggaatacccggtgatctggcacctgctctctgaaccgtggctctgcgccctgattgccctctcgatgaacagcgccgcctacaccacgcagctgttttacggtgccattcgcgcgatcccggaaggccagtggcagtcctgcggagcgctgggcatgagcaagaaggatacgctggcgatcctgctgccctatgcctttaagcgcgcgctctcttcctattccaacgaagtcgttctggtgttcaaaagcacctcactggcctacaccatcaccctgatggaagtgatgggccacggacagctgctgtacggacgcacctacgacgtaatggtgttcggtgcggcgggtctggtctatctggtggtcaacggtctgctgacgctgatgatgcgtcttatcgagcgtaaggcgttagcgtttgagcgcaggaattaa

SEQ ID NO: 3561 - DNA, 219 bp, Enterobacter cloacae
atggccaaagaagacaatattgaaatgcagggtaccgtacttgatacgttgcctaataccatgtttcgcgtagaactggaaaacggtcacgtggtaactgcgcacatctccggtaaaatgcgcaaaaactatatccgcattttgacgggcgacaaagtgactgttgaactgaccccgtacgacctgagcaaaggccgcattgtcttccgtagtcgctaa

SEQ ID NO: 3562 - DNA, 288 bp, Enterobacter cloacae
acagcccccactccaccaccggttcattccatcttaatttataagatttacgaaggatgtcgaagcatggaaatgggtactgttaagtggttcaacaacgccaaggggtttggcttcatttgccccgaaggcggcggcgaggatatcttcgctcactattccaccattcagatggatggttacaggacgctcaaagccgggcagtccgtccggttcgatgtacaccaggggccaaaaggcaatcacgccagtcttatcgtgcccgttgaagcagaaacggttgcatag

SEQ ID NO: 3563 - DNA, 990 bp, Enterobacter cloacae
aatagcgatattccaccagaagcaggatctaacatgtcttccatcgtcgatacaccttattcaacgctgccccagcctaaatcgggctggcaactgtttaaaagcctgacatcgggttccctcacgccggggctggcgtggcaaaatccggcctatcgacgtaagtttatgttgcgctcgctggcaacgccgttcaccactgcgcgcctgctcggaaaccttgcaaaacagccccgtctgatgcagatcctgcgcgtgcagcccggcctgccgtgccgcctgcaccggccgtggctgaccgtaaatatgggtcgtcagaatacgctggacgcattgaacgatcactatcagatgatgagccgccatcttccggcgtcgctgctcaacggctacctctccagccagggcatcacgctggtgacgttaacgggcaaagaggaacagcagtttagcgttcgcctgagcgcggatgcgtttctggacaaagaaggggaagcgaccctcactttttgcgaccaccagaacacggtgctggccgagctgacctttacgctgtgcaaataccagggcaagtcaacgctcttcatcggcggaatgcagggggcgaaagcgcatgtcccgcacgagcacattcagctggcgaccaaagcctgtcacggactgttcccaaaacgtctgctggttgaagcggtcatgacgctggcaggcgccttcccggtcgagcagatcctcgcggtgagtaacgccacccacatctaccgcagctggcgctatcgcaagaaaaaagagggaaaattgctggctgactatgacagcttctggcgctcccttggcggacagcagcaggataacggcaactttgccctgccactgaccatgccacgcaaaccgatggaagagattgcgagtaaaaaacggtccgaataccgccgccgctataccctgcttgatagcctgatccaacaggtttcgcaggcgactgaccgctaa

SEQ ID NO: 3564 - DNA, 972 bp, Enterobacter cloacae
ctcatgaccatgccaacctcacaatgtccgtggcggatgcaggttcatcacatccatcaggagacgccggatgtgtggacgctgtcgctgctgtgccatgactactacccgtaccgcccaggtcagtatgcgctggttagcgtgcgtaattcggcgaataccctgcgcgcctacaccctctcctccacgccgggcgtgagcgaatacattacgctcaccgtccgtcgtattgatgacggcgcaggatccgagtggctgacccgggacgtgaagcgcggggattacatctggctgtctgacgcgcagggcgagtttacctgtgacgacaagacggaagataaattcctgctgctggcggcaggctgtggcgtgacgccgattatgtcgatgcgtcgctggctggcgaaataccgtcctcaggccgacgtgcaggtgattttcagcgtgcgttccccggaagatgtgatttttgccgaagaatggcgcaactacccggtgacgctggtggctgagcacaacgcgacgcacggttttgtcgcggggcgcctgagccgcgagctgctgcaaagcgtgccggatattgcgaaccgtaccgtgatgacctgcggcccggcgccttacatggagatcgtggagaaagaagtgaaagcgctcggcgtgacccgcttcttcaaagagcagttcttcacgcctgtagcggcagcggcgaccagcgggatgaagttcacgaagctgcaaccggcgcagactttctttggccgcgtgggcaccacgctgcttgaagcgctggaaagcaacaacgtgccggtagcggcggcctgtcgcgccggggtgtgcggttgctgtaagaccaaagtggtttccggtgagtacacggtcaccagcaccatgacgctgaccgacgcggaaattgccgagggctatgtgctggcatgttcgtgccatccgcagggcgatcttgtgctcgcataa

SEQ ID NO: 3565 - DNA, 1011 bp, Enterobacter cloacae
ggacatgccatgattgatttacgcagtgataccgttacccgcccgagccgcgccatgctcgaagagatgatggccgccccggtcggggacgacgtctacggcgatgacccgacggtcaacgaactccagcgctatgcggccgagctgagcggtaaagaggctgctctgttcctgcccaccggcacgcaggctaacctggtggcgctgctgagccactgcgagcgcggcgaagagtatatcgttggccagggggcgcataactacctgtacgaagccggcggcgcggcggtgctcggcagcatccagccgcagccgatcgatgctgcgccggacggtacgctgccgctggacaaagtcgcggcgaaaatcaaagctgacgatattcacttcgcccgcactaaactgctgagcctcgaaaacacccataacggtaaagtcctgccgcgtgaatacctgaaagcggcatgggattttacccgcgagcgcaagctcggcctccacgttgacggcgcacgtatcttcaacgccgtggtggagtacggctgcgagctgaaagcgatcacccaatattgcgactcgttcaccatttgcctctctaaagggctgggcacgccggtaggttccctgctagttggcagcgcagactacatcagacgcgccaaccggtggcgcaaaatgaccggcggcgggatgcgtcaggcgggtattctggcggctgccggactgtacgccctgaaaaataacgtgtcacgcctgaaagacgatcacgacaatgcggcgtggatggcagcgcagctgcgtgaaatcggcgctgatgtcatgcgacacgacaccaacatgctgtttgtccgtgtcggcgatgagcatgctgccgcgctgggcgactttatgaaagcccgaggcgtgctgatcaacgcctccccggtcgtgcgactggtgatgcatcttgacgttaaccgcgagcagttgaccgaggtggtgaaacactggcaggcgtttttacagcgttaa

SEQ ID NO: 3566 - DNA, 1110 bp, Enterobacter cloacae
ctaaataaaactcttaatctttcacctttcccattgcaacacatcgtaattcacgaaagaatgcgcacgaaattcttttcaacacagtggattgttatgaaggtactggttaccggggcgaccagcggcttaggccgaaatgcggtcgagtttctgcgcaacaaaggcatcagcgtgagggccaccggtcgcaatgaggcgatgggtaagctcctgcaaaaaatgggcgctgaatttgtccatgccgatctgacggagctggtctcctctcaggccaaggtgatgctcgccggtatcgatacgctgtggcactgctccagttttacctccccgtggggtacccaggaagcctttgatctcgccaacgtgcgcgccacgcgccgtctgggtgaatgggccgtcgcctggggcgtgcgtaactttattcatatttcctctccgtcgctctatttcgactatcaccaccatcgtgatattcaggaagatttccgcccggcgcgctttgcctgtgagtttgcccgcagtaaagcggcgggcgaagaggtgatcgacctgctggcccagtcaaacccgcacacccgctttaccgtgctgcgtccgcagagcctgtttgggccgcacgacaaagtctttatcccgcgactggcccagatgatgcatcactacggcagcgtgctgttaccgcgcggcggcgatgcgctggtggacatgacctattacgaaaatgccgttcacgccatgtggctggcgagccagccggagtgcgataagctggtgtcggggcgcgcgtataacatcaccaacggcgaaccctgtaccctgcgcagcattgtgcaaaggctaattgacgaattaaaaatcgactgccggatccgttccgttccctacccaatgctggacatgattgcccgcagcatggagcgttttggcagcaaatcggcgaaagagcctgcgctgacgcattacggtgtgtcgaagctcaactttgattttacgctggatatttctcgggcggagaacgagctgggatataaaccgattgtctcgctggatgaagggatagtgcgtacggcggcgtggttacgggatcacgggaagttgcaccggtaa

SEQ ID NO: 3567 - DNA, 696 bp, Enterobacter cloacae
  unsure (693)
caagcgccgccggggatgaacgtcggccttgccgtttgtgcactgattatcggcctcgtactggcgatgttctttgcggtgtgggagtccgttaagtggcgccctgtcgcatggctcggttcagcgctggtgactgtgctgcgtggactcccggaaattctggtgttcctgtttatctatttcggctcctcacagctgctgttaacgctgtcggacggcttcacgattaatctcggctttgcgcaaatcccggtgcagatgcagatcgagaacttcgacgtcagcccgttcctgtgcggcgtgattgcgctctccctgctctattcagcctatgcgtcacaaacgctgcgcggcgcgctgaaagcggtgccacagggtcagtgggaatccggtcaggcgctgggcctgtcgaaagcggcgatcttcttccgcctggtgatgccgcagatgtggcgtcatgccctgccagggctgggtaatcagtggctggtactgctgaaagataccgcgctggtaagcctgatcagcgtgaacgatttgatgctgcaaaccaaaagtatcgccacccgtacgcaggagccgtttacctggtacatcgtcgcggcggcaatctacctggtgatcacgttgctgagccagtacgttctgaagcgtattgacctgcgcgcaacgcgttttgaacggagaccaggntga

SEQ ID NO: 3568 - DNA, 1776 bp, Enterobacter cloacae
gcaaggcgactacgccgcgcttgttgccgcgcaggggccgtttgcgaccctgctggcgaaccgtcaggaggatatctgatgcgcgccctgcttccgtatcttgcactgtataaacgccacaaatggatgctgacgctcgggatcgtgctggcgatcgtcacgctgctcgccagcatcggcctgcttacgctttccggctggttcctctccgcgtctgcggccgcaggctttgccggactgtacagctttaactacatgctgcctgccgccggggtgcgcggcacggcgattacgcgaactgccgggcgctacttcgagcgtctggtcagccacgacgcgaccttccgcgtgctgcaacacctgcgtatttatacgttcagcaaactgctgcccctctcccctgccgggctggcacgttttcgacagggcgaattactcaaccgcgtggtcgcggatgtggatacgctggatcacctctatttgcgcgtcatttcacccatggtgggcgcgtttgtggtgattgtcgtggtcacgctggggttgagtttcctggatgttcccatcgcactgacgctcggcggcatcatgctgatgacgctgattattctgccacccctgttttatcgtgcaggtaaaaccaccggggaaaacctgacgcgcctgcgcggggaataccgccagcagctcaccgcctggttgcagggacaggccgagctcaccctttttggcgccagcaagcgctaccgcgcccgcatggaaaatacggagctgaactggcatgaagcccagcgtcgccagtctgaactgaccgctttctcccaggcgctgatgatgttaattggtgggattgccgtaatcgccatgctctggatggcctccggtggcgtgggcgataacgcgcagcctggcccgctaattgcgctgtttgttttctgtgccctggcagcctttgaagccttagccccggttacgggcgcctttcagcatctcggccaggtgattgcctctgcgctgcgcattacggatattgccgagcaggagccggaagtgaagttcagcgcgggtcaaaccgctgtgccggagcaggtcgcgctgacgctcagcaatgtcactttcgcctacgacaagccggcgcaaaacgcgctggaagacatcaccctttctgttgatgccgggcagcgcattgcgatccttggccgtacgggatgtggaaaatcgacacttctgcaacttctcacgcgcgcgtgggacccacagcagggcgagattcggtttaacgacgttccgctgtctggttttagcgaagcggccttgcgtaaaacggtcagcgtcgtgccccagcgggtgcatctgttcagcgctacgctgcgcgataatcttcttctggcggcaccagacgcctccgacgatacgctgcgggcaatgctggagcatgttgggctgcacaaactgcttgaagacgatggcttgaacagctggctgggtgaagggggtcgacagctttccggcggcgaactgcgtcgtctggccattgcgcgtgcgctgctgcacgatgcgccgctgatgttgctggatgaaccgacagaaggactggatgccacgactgagagtcaaatccttgatttactggcgaatgtgatgaaaggtaaaaccgtactgatggtcacgcaccgtctgcgcgggctggtgaatttcgatcagataattgtgatggacaacggacacataattgagcaaggtatcaagcaagagttgctggcaaaacaaggtcgctaa

SEQ ID NO: 3569 - DNA, 750 bp, Enterobacter cloacae
actatatttgtagcgtcttctctcgcgtactggagttctgttgtcatgcgcctggtgcagctttctcgccataatattgcgttcccttcaccggagggggcgctgcgtgaacctaacggcttgctggctctgggcggtgatctcagcccggcacggctcttaatggcttaccagcgcggcatcttcccgtggttttcgcctggcgacccgatcttatggtggtctcccgatccgcgagccgtgctgtggcctgggcagtttcacctgagccgcagcatgaagcggtttcatgcaaaatcaccctttcgcgtcacgctcaatcacgccttcggccaggttatcgaaggctgcgctgaagatcgtcatgaaggcacctggataacccgcgatatcattatcgcctaccaccagcttcatgagctgggctacgcgcactctattgaagtatggaaagaggataacctcgtcggcggaatgtacggcgtggcgcagggcacgctgttctgcggtgagtcgatgttctcccgtgccacgaatgcgtcaaaaaccgcgctgctggtgtttagcgaggaatttgcccgacgtggcggacggctgatggattgtcaggtgctgaatgagcacaccgcctcgctcggcgccgttgaaatctcccgccgacactatatcgaacatcttgaacaatgccgaaaagagacccttccacgcgatttttgggttcccagagcgctctttatgcccaatgcctaa

SEQ ID NO: 3570 - DNA, 1734 bp, Enterobacter cloacae
aggagaaggaccaccatgaaacaaaccgtggctgcatacatagcgaaaaccctggagcaggctggcgtaaagcgtatctggggcgtcaccggcgattcgctgaacggactcagcgacagcctcaacaagatgaagaccattgaatggatgcccacccgccatgaagaggtcgccgcctttgccgcgggtgccgaagcgcagctcacgggcgaactcgccgtctgtgcaggttcctgcggaccgggaaacctgcaccttatcaacggtcttttcgactgtcaccgcaaccatgttccggtgctggcgattgccgcacatattccgtcatccgaaatcggcagcggctattttcaggagacgcatcctcaggagctgttccgtgaatgcagccactattgcgagctggtctcatcaccggagcagatcccacaggtgctggcgatagccatgcgtaaggcgatcctgaatcgcggggtttcggtggttgtgctgccgggggacgtggcgctgaaggccgcacctgaaaccgccaccacccactggtactctgcgccacagccaaccattacccctgccgaagaagagctgaaaaagctggcgcaactgctgcgatactccagcaatatcgccctgatgtgcggcagcggctgcgccggtgcgcataaagagctggtggaatttgccggcaagctcaaggcgccagtggtgcatgccctgcgcgggaaagagcacgttgaatacgataacccgtacgatgtcggcatgaccgggctgatcggtttttccagcggcttccacaccatgatgaacgccgacacgctgatcctgctcggcactcagttcccgtaccgcgcgttctacccgacggatgccaaaattatccagatcgacattaatcccggcagcatcggtgcgcacagcaaggtggatatggcgcttatcggcgatatcaaatccaccctcgccgccctgctgccgctactggaagaaaaaacggaccgcaaattcctcgataaagccctgagcgactatcgcgatgcgcgtaaggggctggacgatctcgccaaaccgagcgaaaaagcgatccacccgcagtatctggcgcagcagatcagccacttcgccgacggcgatgccatcttcacctgcgacgtgggaacgcccaccgtctgggcagcacgctacctgaaaatgaacggcaaacgacgcctgcttgggtcgttcaaccatggctcaatggccaacgccatgccgcaggcgctgggcgcaaaagcgacggcaccggaacgtcaggtggtggcgatgtgtggcgacggcgggttcagtatgctgatgggggatttcctgtcggtggcgcagatgaagcttccgctgaaaatcgtggtctttaacaacagcgtgctgggcttcgtggcgatggagatgaaggccggaggctacctcacggacggcaccgagctgcacgacaccaacttcgcccgcatcgccgaagcctgcggtatcaccggtattcgggtggagaaagcctcagaggtggacgacgccctgcaacgcgccttcgccatcgacggcccggtgctggtggatgtggtggtcgccaaagaagagctggcgatcccgcctcaaatcaagctggaacaggccaaaggatttagcctctacatgctgcgcgccatcatcagcgggcgcggtgacgaggtgatcgaactggcaaaaaccaactggctcaggtaa

SEQ ID NO: 3571 - DNA, 1476 bp, Enterobacter cloacae
aacactggcaggcgtttttacagcgttaaggagcataccgtgccgcaacgtattctggtgctcggcgccagcgggtatatcggtcagcatctgaccactgcgttaagccagcaggggcaccaggtgctggcagcggcacgtaacacggaacgcctgcaaaagctacatttgcctggcgtgacgtgtcacaacgttgaccttaactggccgaaagcgcttcctgcgctgctggaaggggtcgatacgctttactaccttgtccacagcatgggcgaaggcggcgattttatcgcccacgagcgtcaggtggcgatgaacgttcgtgatgcgctgcggcaaacgccggtgaagcaggtgatttttttaagctcactccaggcgcctgagaacgagcagtcagatcatctgcgcgcccgacagctgacggcagaaacgctgcgaagcgcccgtatccccgtcaccgaactccgggcagggatcatcgtcggcgcgggttccgccgcgttcgaagtgatgcgcgatatggtctacaacctgcctgtgctgacgccgccgcgctgggtacgctcgcgcaccacgcccattgcgctggagaatttactccactatctggtggcattgctggatcacccggcggagcagcatcgcgtgctggaggcggcaggcccggaagtgctgagctatcaggcgcagttcgaacattttatgcgggtgagcggccgccgccgctggctgatccccatccccttcccgacccgctggatatcagtgtggtttttgaatgtgatcacctccgtgccgccgacgaccgccaaagcgctgatccaggggctgaagcacgatctgctggcggacgatcgcgcgctgcgcgccttaatccctcaggaattgatccgctttgacgacgcggtacgtaatacgctgaaagaagaagagaagctggtgaactccagcgactggggctacgacgcgcaggcgtttgcccgctggcggcccgagtacggctattatccgaaacaggcgggctgtacggtcaaaaccacggccagccttgcagcgctgtgggaagttgtgaaccagattggcggcaaagagcgctatttcttcggcaatattctgtggcaaacgcgcggcgcgctggatctgctggtcggtcaccggctggcaaaaggccgccctgcccatccctggctgaaggtgggcgataccgtcgacagctggaaggtgattatcgttgagccggaaaaacagctggcgctgctgtttggcatgaaggcgccagggctggggcggctctgcttcaccctgaaggacaagggcgaccatcgtgaactggacgttcgggcatggtggcatccgcacggaatgccgggtctgttttactggttgctgatgatcccggcacacctgtttatcttccgcggaatggcgaaacggattgcgctactggcagaagaaaagcgggaaaataactaa

SEQ ID NO: 3572 - DNA, 1818 bp, Enterobacter cloacae
  unsure (1710)
ccgctcaggggcattaccttactttctgctgctgttgctattcctaatcagagacggtcagtcgttatgtatcagagccactttaattttaaaaatccgccattcaggacaatcacccgtttatccggtgattttctggtgccttatcatcaggacgtgttcaacctgctgaaagagaaaacccagctggcgggtattatcgggcttttttgcgacgacgctccgcttctgagccacttcatcgacgcgctgaaagccagcagcaataccgttattgccatcaacgcgtttcccaaactgagtgccagtagcctgctgtacaaactcaacccgggaacgaaagcgattaaagatcgcatgcaggcggtggatgccgtcctgcgccagtggcaggaggggaaagcaaaatccagagtgctgacgatcgcccattccgaagccatgaaggagagctgccgtgaagtcctgggaacgctgctcacgcgcgcccaggagctgaacttccggctcgccgtggtgctgacgggtgctgcggagcaggaacgcctgctaaagcaacctgaactgcgcgaatatacgcacacacatcatgtcctgcgccccctcacctgccgcgaatacctgagctatgtgcaggcgcagtgcgaagaacacgactgtgaacattcgccgttgccgcctgcccgcgtgcgcaaaatgcacacgctgaccaaaggcaacatcagcaaactgaacgcgctggcacacctgtcaatgctcgccgcctggacggaacgcgcggcgcaggtcagcccacgccatttacgtctggcggcgggagagatcctgcccgccaaaaaacacggtaagcgcctggcaaccgtggggctgtttgcgtccgtgctgtttgccgcctgcggctggtattttacctcgtcgatcggcgcgcgcctgccgatccagctgccggtacccgtcagctggaaacagcagacgccaaaacctgaggcagccgtagtgccggttatcgacaacgaaatagttaatcagccggatgcgatgcatcagctttatctcatgtgggggtatgacgcctcggccgacgatgcgctgtgccagaacgccgctaaagtgaacctgatgtgtaaacaggggaacgcgtccccggagacgctggcgcaggaagggtatccgtgggtcagtgagctgaaaaccagcggtcaccttaactatgcagtggtcgccagggtcggagatacatcaattgacttgttaatgaataaccggacctggcaggtaagccgcagctggtttaaccggcatgcgaccggcaacttcacccagttgcaccgcctgacaccggaaggaaaagacgcgatcggcacggccagcgacagcaaagacatggcctggctcgatcagcagttaagcatcgcgttgagccagcccgaaacgcatgcccggatctggaccgcagaaatgatgaaacgcacccgcgagttccagcaaaaaatgcatctgcacgtggatggcatccccggtgaagaaacgctgatgcagctgatgcgcgtgaccaacagcacgccgggcgtactgattcaggcaacccgcaccaccccggacgcaaaaatgcaggaagaagatagcctaatgtcgaccatctgccttgcggctcagcgcagctatacaaccggggaatcggtctggttttcgtaccgcctccccagcctngaaaaacgtattcggcaaaacagcgttatggctggtcggcctttgcgccatgctggttgtcggcctgtatatgcacgtctactggaacctgcgccacccggcacctga

SEQ ID NO: 3573 - DNA, 540 bp, Enterobacter cloacae
ttaataaataaggaaatcaacatgcgctactctgctttaacgcttttagtgccatgcgcgctggtgctcagcgcctgcacaacgccggtcacgccagcctttaaggatatcggaacccgcagcggcccttgtattgagggtggcccggacgccgtggcgcaacaattttatgattaccgtattcagcatcgcggtaatgacctgaccgccctgcgcccgtacctgagcgataatctggcgaaactgctcaccgacgcttcgcgcgatccgcagcataacgccctgctgtcatccgatccgttctccagccgcgccacgctgccggacagcgccgacgtcgccagcgcatccaccattccaaatactgacgcacgcaatattcccctgcgcgtgaagctaacccaggggacgcaaacctggcaggatgaggtgctgatgatccgtgaaggccagtgctgggcagtagatgatgtacgctacattggcggcagcgttcatgccccggcaggcacccttcgccagtcgattgagaaccgctaa

SEQ ID NO: 3574 - DNA, 675 bp, Enterobacter cloacae
atgccgcggccatcttattttaaaaaatcacatcttaaatcgggtataacaatgttaagcatctatggaaaaaaattacgtccacaatatgaaatggaaagaattatttctgcaaccgcaggcgttgaagaaaaaacgttaaagaaatggcagaaaatttccactactgattccggttacattcatgtcatcgtcagcggcgaagtcgaatttcgacgtgaatctgacgaactgtgcatgtttactgtcaccggacaatgccttttcggcctatcgtcaatgtattacaacgccacccatatgtacggccttgtccggacgaatacggtcgttcgctcgatcaagaaagaggtcttcgcccagctgatgaccgaaaaaaatctgtggcctgacctgaccaaagtcctttcctggtacatatgcgtgatgagcaaacgtgatgatgttctggttgcccgcagtgcgtattctgttgttcgtgaatttttatatgagattaacgatctgactgttcatcagcaacgtgatattaacgtttatgattacattcaggaatacactaacctcgcacgtagtactattatcaaaatcctctccgatctgaaaaaaggtcaatatattgtggtggaaaaaggtcgattgcttaacctcaccgcactgcctgaaaaatattaa

SEQ ID NO: 3575 - DNA, 1293 bp, Enterobacter cloacae
aaacgggctgctgaaggtgatcggcggcgtgacgtctctggaagaagtcatgcgcgtcaccgccgagcgtgggggggatgcataatggctttttacgcctggacagcgacggatgccgcggggaaaacccagcgcgggacgttacaggccgaggggcagaagcaggttcgccagtggcttcgcgagcaaaagctgatgcccgtcagcattaccgaaacccgcgaaacggcggctggcgggaaagcgaaaaccggggtgaagctctccactccggtgctgtcgatgtttacccgtcagctttcgacgctggtcaacgccgcgctgccgctggagagcgcgctgaaagcgatctcgaagcagacggaagacaaaaagctggcggcgatggtggtggagatccgcgagaaggtggtggaaggccacaccctgttcgatgccttcagccagttcccgcgcaccttcgacaagctttactgcacgctggtgatggccggggagaaaaccggtcacctgggcgacgtgctggagaagctggcggagtacaacgagcagcgccagaaaatgaaaagtaagctgacgcaggcgatggtctacccgataaccctcaccgtggtcgccatcgcggtcatcagcatcctgctggtggcggtggtgccgcaggtgatcgagcagttcactcacatgaagcagcagctgccgatcaccacccggacgctgattgcggtaagtgatttcctgcaagcctggggcatttatattgtgggcattctggggggcggctttatcggcttcaaaacctggctgaggaatgccaaaaaccgttttcgctggcacagctggctggtgaacggctcgccgattaaaaagctggtctgcgccatcaacagcgcccgctatatccgtaccctgagtattttgcaggccagtagcgtgccgctgctggaggggatgtatatcgcgatggacggtatcgaaaaccgctatgcccggcaggtgctggagcaggccgccgacaccgtgcgccagggggcgtcgctgtatgcggcgctggaacaggcgaaattattcccgcccaccatgctgtatatgattgcctccggtgaagagagcggggaattaggtaatttaatggatcgcgcggcggaaaatcaggaatcggccttacaacatcgaattacattaacgctgtcggtctttgaaccggcgctggtggtatccatggcgacgattgttttattcatcgtgctttcaatattacaaccgcttctgcaacttaataatatggtaggttaa

SEQ ID NO: 3576 - DNA, 453 bp, Enterobacter cloacae
atcatggctttaaaacgtaaaaacctggctcgccaggcgggcttcacattgctcgaattaatggtggtcattgttattctcggcgtactggcgagtatggtagtgccaaatttaatgggcaataaggaaaaagccgatacgcaaaaagcaaccagcgatattgtcgcgctcgaaggctcgctggatatgtacaagctggataaccaccgctacccgaccacagagcagggtttgcaggcgctggtgaccaaacctgaaatcgcgccaatcccgaacggctaccgcacggacggctatatccgtcgcctgccgcaggacccctggggcaatgattatctgctggtgagcccgggtgaacacggcgcggtggacgtcttctcagccggtccggacggcgaagccaataccgccgatgacattaccaactggtctctggataagaaagagaaataa

SEQ ID NO: 3577 - DNA, 387 bp, Enterobacter cloacae
aaaacgatggctaacggcaacaaaaagcaaaaggggatgacgctgctggaggtgatggtcgctctggtgattttctccaccgccgcgctggcgctgatgaactcggtctccctgaacgtgcgttttacccatggcctggccgataccttgcaggccagttgggtggcggaaaatcagctggcggaagcacagctcacgaaaaccgacttcccggatgctgaacagcaggggacggaaatcatgggcgggcgcaggtggaactggcgtaagcagcgggtgaaaacggccgacaacgtctgggcgaatacaatacgcgtgtatgcggaaggcgatgagagccagccggttatttccctgcatatcattccgccgggagagagcaagtga

SEQ ID NO: 3578 - DNA, 486 bp, Enterobacter cloacae
atgaaagagcgaatcgcacagctgaaagcgcgctatcagaattacagcgcccgggaaaaaatcattttaaaaatatgtgccgttgccattgtgggggcagcggtgtattacacaggagtgatccccttggataatatgattaaaaatagtaaatcgacacttaaaagacaaaaagagacgcttaactggatgcgcagtgaaattgataaaaatcatcttcagatccagttagtcaaaacggataatccgcgtacggtggtcgagaatagcgcccatgaaattaacctttcgctgacggatgtgcgccaggaggggcaaactttatcgttcgtggtgaatcgggttaatgtgtatgaattaaaaagctggctgcgtgaaattaatcagaccaccggtgtgagattgcaaaaaataaacctcacgccggttgaccacctcagcgatgtgaaagcgcaggtgcaactcacctgggcaaaaaacgcatga

SEQ ID NO: 3579 - DNA, 2721 bp, Enterobacter cloacae
atttatcaggaaataaaaatgaaatttatgaagccaaaatatctggcgctctttattgcggcggcaaccagctccgcatttgcagcagcgccaggtgcaccgacgatcggctatggcaatgacaaatttgccctggtggaagtggatcaggctgcacaggattataacaatcttgtcaaagtgcataacgatggcgtggatgtaaaagttgagtggaacgtctggagtggtgatgcgccaacttctgcgaaagttctgctggacggacagaccgtatggaccggcgcagccggtgcgacgggctctgcaacgtttaaagtgaaaaaaggcgggcgttatcaggaacaggttgaagtctgtaatgccagcggctgtgcgaaaagcgccagtaagctgattattgtggctgacaccgacggtagccacctgctgccgctgaatacgtctctccaggagaacaacaaagcgttcgcgaagcataccgataaagtggttgcggcctacttcccggaatggggcgtttacgaccgtaacttcccggttgataagatccctgcggcaaacctcaaccacattctgtacggcttcattccaatctgtggcggtgacggcatcaacgacggcctgaaaaccattgaaggtggtaacagcttccgcgtgcttcagaacgactgtaagggccgtcctgactttaccgtggcgatccacgacccatgggctgcgctgcaaaaaccacaggctggcgtctccaactgggatgatccgtacaaaggtaactttggccagctgatggcgctgaaaaaagcgcatccaggcctgaaagtgctgccatctatcggcggctggacgctttccgatccgttcttccacatgggcgacccggctatccgagcacgctttgtctcttctgtgaaagatttcctccagacgtggaaattctttgacggcgtggatatcgactgggaattcccgggcggtggcggtgtaaccgaaaacctgggtaacccgcagcaggataaagcaacctataccgcactgatgcacgacctgcgcaccatgctgaacgagctgtctgcacagacgggccgtacctatgaactgaccagcgccatcggtgcaggtcgcgataagatcgaagacgtggattacactacggctcagcagtatctcgaccacatcttcctgatgagctacgacttctacggcggctggagcaacaccgttctcggccaccaggctgcgctgcgtgcgccagcatggcgtccggacactgattacaccactgaaaacggcgttaacgcgctgcttgcgcagggtgtacagccaggcaagatcgtggtgggtgcgggcatgtatggccgcggctggaccggcgtgcatggctacaccggtgacaatccattcaccggtacggcaaccggcatggtgaaaggcacctgggaaccgggcgtggttgactatcgtcagatcgtgaacgaatacaaaggcaaaccgggctgggaatacggctacgacacgaccgctgaagccccttacgtcttcaacaaatccaccggcgacctgatctcgtatgaagatgcgcgttcaaccacggcgaaaggcaagtatgttctggccaataaactgggcggtctgttcgcgtggtctatcgactctgataccggcgacattctgaatgcgatgaacgaaagcctgctgggcggcgactcgactccggttgatccggtggtcaccaaccacgcgccaatcgcgtcctctgccgatcagaacgtgtctggcccggcaaccgtcacgctcgatggctctgcttccagcgatcctgatggcgatgcgattacctacaaatggactcaggtctctggtccgtctgtcaccatcaacaacagcaccaaagcgaaagcgaccttcaatgttgcggcagcgaccaccgaccagaccatgacgttccgcctgacggtgaccgatgcaaaaggcctgagcaacgcgattgatgtccaggtggtgaacaaggcgccgaaagctaaccaggcaccggttttaaacccaatggaagcgatcacgcttgaatctggtgaaacctatgcgctgcatgcccaggctgcggacccagacggtgatgcgctgacctacgcctggagcgtaccagcagatatgcacgccaccggaactgactccgcgaacgtgaatatcacggcgccggaagtgagctcgacgtctacctacaccctgagcgtggtagtgagcgacggtaagaccagcgtgcagtctaacgtccaggttaccgtgaatccgaaagcggcgcctgcaccggtacctgctgacgaagacactaacccggtggatgacgttacccctccggctgatgatgtgactcctccgtctgacaaaggaagctgcgatgcacctgtggatgctaacgccagcaaatacgcggcgtgggaatccagcaaaatctacaacggtggcgataccgtaagcttcgaccatctggtgtggaaagcgaagtactggactcagggcaatcagcctggcttcggtgtggatgcatgggagctggtgagcaacgtgaagatgaactggcgttctgacctggtctacaacggcggcgacactaccacctatgaaggtaacgtttaccgtgcgaaatggtggacccgtggtgataacccagccaacagcgacgtatgggtaaaagaaggcgcatcaacagattgcaaataa

SEQ ID NO: 3580 - DNA, 1689 bp, Enterobacter cloacae
aggaaaaagtggccgaattgcgggggatgtatgctactcgaacgtgtggagattgtcgggtttcgcgggattaaccgcctgtcgctgcaactggaacagaacaacgtcctgataggcgaaaacgcctggggtaaatccagcctgctggatgccctgacgctgctgctttcgcccgaagagaacttgtaccacttcgttcatgatgacttctggtttccgccgggggatgtcaacgggcgcgagaaacacctgcatatcattctgaccttccgcgaatccgagcccggccgccatcgcgtgcgtcgttttcgccctatgtcggcctgctgggttccctgtgaagatgggttccagcgtattttctatcgccttgagggcgaaatggcgcaaaacgacggggtattaaccctgcgtgaatttcttgatgagaaggggaatccgatcccgctcgataatattgacgagcttgcccgacatcttatccgcctctcccccgtattgcgcttacgcgacgcgcgttttatgcggcggatccgtaacggcaccgtgccgaatatgcccgaggtggaagtaaccgcccgcgaactggatttcctcgcccgtgaactggtctcacggccgcagaacctcaccgacggccagatccgtcagggactgtctgccatggtacaactgctggagcactacttctccgagcagggaacggggcaggcgcgccaccgtctgatgcgtcgccgctcgcacgatgaacaacgaagctggcgctatctcgatattatcaaccgcatgatcgaccgccctggcgggcgtacgcatcgggtgatcctgctgggtttattctccacgcttttacaggcgaaagggacggtgcgcctggatcgggacgcgcgcccgctgctgctggtggaagatccggaaacgcggctccacccgattatgctttccgtggcgtggcatcttcttaatctgctgccgttgcagcgagtcaccaccacgaattccggagagctgctctctctgacgccggtagagtatgtctgccgcctggtgcgtgaatcgtcgcgggtcaccgcctaccggctcgggcccggcgggttaaatgccgaagatggccgacggattgcgtttcatatccgttttaaccgtgcctcttccctgtttgctcgctgctggttgctggtggaaggggaaacggaaacctgggtgataaacgagctggctcgccagtgcgggcaccactttgatgccgaagggatcaaagtgatcgaatttgctcagtctggcttaaaaccgctgatcaaatttgcgcgccggatggggatagagtggcacgtgctggtggatggcgatgaggcgggtaaaaaatatgcggcgaccgtgcgcagcctgctcaataacgatcgtgaagaggagcgggaacatctgaccgcgctgcctgcgatggacatggagcactttatgtaccgtcagggatttgacgacgtctttcaccgcgtggcgatgatcccggtggatgtacccatgaacatgcgtcgggtgattgccaaagctatccatcggtcgtcaaaaccggatttggccattgaagtcgcgacggaagccggcaggcgaggcgtggagtcggtgcccacgctgctgcgtaaaatgttctcccgcgtcctctggctggctcgcgggagggccgattag

SEQ ID NO: 3581 - DNA, 210 bp, Enterobacter cloacae
cgggtacaggctctgaacagtgatgtgcacagggtccaggcaggagtagggaaggaatacagagagacaataataatggtagatagcaagaagcgccctggcaaagatctcgaccgtatcgatcgtaacattcttaatgaattgcaaaaggatgggcgtatttccaacctcgagctttcatatttgcacagccgtggcaatacaaggtgg

SEQ ID NO: 3582 - DNA, 909 bp, Enterobacter cloacae
tatcgactacgaaacggtcgggaaagatgccagcatgctgatggtgagcgtaagcggtacggcggtgaaaacccgtcgatgaagcgttcgctctcaaccctcctgctggcgatattgctggcaggatgcgcctcggaagagggcatcgttgataaaggcgcgtacgagctggatacgcgccatcaggcgcaggcggcctacccgcgtataaaggtgctggttattcactacaccgccgacgatttcgacacctcgcttgcgaccctgaccgataaaaacgtcagctctcactatctcattcccgcaaagcccccagctccacagggcaaaccgcgtatctggcagctggtcccggagagcgagctggcctggcatgcgggcatcagcttctggcgtggcaccaaccgcataaatgatacctccgtcggcattgagctggaaaaccgcggctggcggcaaaccgatggcgtgaaaacctttacccccttcgaaccggggcaaattgcggcgctgatcccgcttgccagagatatcatcgcccgctacgacataaaaccgcagaacgtggtggcacactcggatatcgccccgcagcgcaaagacgatcctggcccgatgtttccgtggcgcgagctggcgcagcagggtatcggggcctggcccgatccggcgcgggtgaatttttatatcaacggccgaccgcattatcagcaggttgataccgcagcgctgctcgatctgctggcgcgctacggttacgaggtgccagaaaacagcacgcccgcacagcaaaaacgcatcatcatagttttccagatgcatttccgcccgcagttatggaatggcgtagcggatgtggaaaccatggcgattgccgaagcacttttagagaaatacgggcaggggtaa

SEQ ID NO: 3583 - DNA, 777 bp, Enterobacter cloacae
aaaatgaggttctcatttctgtcacggtggataacgccttgtattatgtttgtgctgctcatttttagcggccagcaagggtatctcaccttaaaagattataaaaaagttacgaataagttggctaaagctgatctacagccgccgaaaaaaacgcgcgaggataaacccttcacgctttttacggctgccgtccgtcaggagaacttagcggatgcggcaaaagccccgctggcagcggagatagagggcattgtgcgcagtgatgacgcctggctctcctttgctgttatcaaaaccccaggcggtcagcgaagctaccgtgagggtgaacctctcgccggatttaacgacgcatttattcaggaaataaacaaagataatgtggtggttaattatgaaggtgctacgcaggtactggcgttaaataaaccggactattttaaggggggcgtggatagcggcccggttacacaatcgacgaaagatgctggcgcagaaagtttgcatcttgatgattatctggtgttaaaacccatcattgaaaaaggccgactggaaggctacaggataaatccaaggaatgcctccgccttttacagtcagtcaggtctggaaaaaggcgatgtggcggttcaggttaactctgtcgatatgaccgatgaagcaaaagcgaaaagcattattgccaactggtcgaaaatgaaagaagcggatgtcgtcgtgcggcgtcacgctcacctcgaaaatattcgggttaatgttctaaacaattaa

SEQ ID NO: 3584 - DNA, 1500 bp, Enterobacter cloacae
agagtaaggcggagggataccgtggacgaactgagtaaatccctgtgtagcagcaactacgcaaaagataacggcgttctgctttacaacaatgacgtctatatccgtgaggacaccccggcgttagcactgctggaggtgcgccgggtgcttggacgcgcgttcgtcccgatcaccctggcgccggaagcgtttgatgagatgctggccaaaatctggcagcagagcagcggcgtgtcgcagcagctggtggacgacatggacgcggatatcgatctgatggcgttaaccgaggagatcccggataacgaagatctgctcgataacgacgaaaactcgccggtgatccgcctgatcaacgccattctcggcgaggcggtgaaggacggcgcgtcggatattcatatcgaaaccttcgagcgcaccctgagcattcgctttcgcgttgacggcgtgctgcgcccggtgctgcaaccggcgcgtaagctcgccccgctgctggtgtcgcgtatcaaggtcatgtcgaaactcgacattgccgaaaaacgcctcccgcaggatggccgtatctctctgcgcatcggtcggaaggccatcgacgtgcgtgtgtcgactattccgtcccagtacggcgagcgcgtggtgatgcgcctgctcgataaaagcaatctcaagcccgacatcaacaagctggggctgattgatgaagagctggagaagctgaaagggctgatcgaccgcccgcacgggatcatcctcgttaccggcccgacgggttccggtaaaagtaccacgctgtacgccatactctcggcgctgaacggccacgaacgcaacattctgaccgtggaagatccgattgagtacgagctggaaggggtggggcagacgcaggttaacccgcgcgtggacatgacctttgcccgtgggctgcgcgcgattctgcgtcaggacccggacgtggtgatgatcggggaaattcgcgacggtgagaccgcccagatcgcggtgcaggcgtcgctgaccggtcacctggtgatgtcgacgctacacaccaacagtgccgcaggggcgataacccgtctgcgggatatggggctggagtcgtttttaatcggttcatcgctgctcggtgtcattgcccagcgtctggtgcgtcggctgtgtacgcactgccggaccaccagtccgctggacgccaatgaaaaagcgctgttcagctttatggacgcgccgccagaagcgatttaccgcgcggtggggtgcgaacactgccgtcagagcggctatcagggccgcgccggtattcatgaatttctggtggtggacagcgccatgcgccgcgccatccatgaagataaggacgaaatgtccctcgaaacgcagctctttaagcaggcctacagcctgcgtgaaaacgggctgctgaaggtgatcggcggcgtgacgtctctggaagaagtcatgcgcgtcaccgccgagcgtgggggggatgcataa

SEQ ID NO: 3585 - DNA, 1116 bp, Enterobacter cloacae
tatgccggaggtggccgctgccgcggcgccagagaaagccgccgacgcgcctgggacgcccccggatgcagcccctgcgcctgccccttcgccggagaccagaccatgaagcggatccgtcaacaacagggcgtcgccctgctggtggtgctgattttgctggtgatgatgtcggcgctggccgccaaaatcagccagcagttctgccgtaatttgcagaaaacgcattatcaggtaagccagcagcagctgcgctgggcgatgcaggcccaggaaaaagtggtgaaggaccggttacagaccgacgccagcggcgagagcaagccgctggcgctggacggcgactggcatcagccgctggagacgcagggtgaagattacacggtcgtgagccaggtggaagatgcgcaggactgctttaacgtcaataacctgttgaccgccgacatcgcaccccaggggcaaagcgctcccgcggtggcggaaacaccgcgtaaagcgcggattgtagaacaacttctgacggaaagtgggctcagtccgggcacggcggaggcggtctatttccagctggtggattatctcgatggtgacagcaccacggcgaaggagggggccgaaagcgatgcgtgggctggcgtcgtgcccgcgcggcaaccggcaaatcagatgatgcgcagcatcgcggaaatcaaactgctgccggcgttccctgttacggcatatccaaaggtgagcaagctgttatgcgcgctgccggacgccgccagcaaggtggacgtgaacaccctgcaaccggaacaggccgccgtgctggcggccatgttcccgggaaaactcacgcaggatgacgccgttcgcctgctggattcgcgtccggaatcgggctgggaaaatatggaagcgttcagcaaagcgctggagcaggccttcccgcagttaaaagacgatctccagcaggtggtggatcaattttctataaacagccggtacttccgcgtgaattacaccggcaataccgatgaattaacgcttcgcgtggtcagccagcttcaggtgaataacgaagccggtgagatcgtgacgtggcagcgtcgttaccgaatgattgaataa

SEQ ID NO: 3586 - DNA, 1140 bp, Enterobacter cloacae
aacgttatgaaacaggtactttttgttcgtcccgacagccgcgagggcgggaaaataatgtggtgtgagtccggcagcgagcgcgtcgaggtggtcgacagcctggagatgctgtccgaacaccccctggctacgcgcgtttgtctcctgttacccgccagcgacatgattttccgccattttaggctaccgaaaaaggtggcttctcagggaatggccttctcgtggatggcagaagagacgctgattggcgacgtggacaacctccactggacggtactccacaaaaaaggcgccgacgtcgacgccgtggccattgacgccgaccgcctgcgcgcaacattaacccgctgccaggaggccggattaaacgtgattcaggccctgcctgatgcctggctcctgcccgtgacggcagggggcagcacactggtcgcgcaggatgatggctactggctgcgtttatcgccccatgtggcgggtgaaatggaggcaaccctgctgccgctgttaatgcagaaagccggggtcggggaagtgtggtgttacggcgatgcgcctgcgaaggtgcacgttgacgtgcagcatgcctggcagcatccgctggcgctgatccagccgcagtggcaaacctgtcgcgttaacctgcttcacggtgaattcagccttaaggccggtcatgggcgggcagcgaaaaggatgaaagccgcgatggtggcggcgggcgtgctgtctgttggtctgctgctggggccacgcattgcgatggcctggatgctggtgcagcaggaaaatcgggtgcagcaggagatcgtccaggtttatcagcaccatttccccagcatgcgccagcagaccaatatcaaatatcactttggccaaagcctgaaaaaacagagcaaggggttctttcttcagcttgaggagctggagaaagcccggcagtcagtccctgcgatggagatcgatctgctggaatacgatgcgcagcaaaacaccctgacgctgagcgtcagcgcgcaaaaccagcccgcgttgcaggcgtttgttaaccagaccagtgagaattttgattttaccttacagcctgtttcaacaaccgaaccgtataccgccatgatcgcagggaaacataaatga

SEQ ID NO: 3587 - DNA, 1845 bp, Enterobacter cloacae
tttgaaacgaacaggaaaactgaaatgaacaaaaggacgttactgagtgtactcattgcgggagcctgcgtggcgccattcatggcccaggctgcgaatctgaaggagaccagcagtgagccgtacaccatcaaagccagcgatctggcgaagaaagagaaggaactgacggacttcccgctgatggcttcggttaaagagaccatccagacgctggataacgcgcaggtcgaactgattgagccaggccgggcggcgaacccggacaacgttaaacgcgttgaagggattgtgaaagccagcgactgggaatatctcttcccgctgcgcgcccaggcctatacctacagcaacttcctgaaagccgtgggtaaattcccggcgctgtgtaaaacctataatgacggtcgtgacagcgacgccatctgtcgcaaagagctggccaccatgtttgcccactttgcccaggaaactggcggccacgaaagctggcgtccggaagccgaatggcgtcaggcgctggtccacgtacgtgaaatgggctggagcgaagggcagaagggcggttataacggcgaatgtaacccggacgtctggcaaggacagacctggccttgcggtaaagataaagacggcgatttcctgagctatttcggacgcggtgcgaaacagttgtcttacaactacaactacggtccattctctgaagcgatgtacggcgacgtgcgtacgctgctcgacaaacctgagctggtggcggacacctggttgaacctggcgagtgcgatcttcttcttcgcctatccgcagccgccaaaaccaagcatgttgcaggtgatcgacggtacatggcagccgaacgaccacgataaagccaacggtctggttccgggctttggtgtgaccacccagatcatcaacggcggcgttgagtgcggcggcccgactgaaattgcgcagtctcagaaccgtatcaaatactacaaagagtttgcaaactacctgaaagtgcctgttccggcgaacgaagtgttgggttgcgccaacatgaagcagttcgacgaaggtggcgcaggcgccctgaagatttactgggaacaggactggggatggagcgcggataccccggacggcaaaacctactcttgccagctggtgggctaccagactccgttcagcgcctttaaagaaggtgactacagcaagtgcgtgcagaagttctttaacgtgaaaatcgttaacgatgatggttcttccgttaccccggacgaaaccccggtcacgccaacaccgacgccatctggcgatgaaacgccagcgccaacaccaacgccggatgaaaccccggtcgaacctgttgtggtgaaccacgcgccggttgcgcagattgccggtccgatcggtgcagtggaagcaggtgcgcaggtttctctgagtgcggaaggctctaccgatcctgatggcaacaaactgacgtatacctggcgttcccaggatggtcagactgttaccggtcaggacaaagcggttgtgaccttcacagcgccagagtctgcgacggcgcagcagtatgaagtgagcctgaccgtcagcgatggcgagctgagcagcaccacgtcttacctgctgaacgtgaaagcgaaagcggcaacgccatccggagaagatacgtcttacccggcatggagcgcgaacagcaagtacaacgccggtgatatcgtgaacaaccacggtaaactgttccagtgcaaaccgttcccgtacagcggctggtgtaacaactctccaacgtactatgaaccaggcgcaggtctggcatgggctgaagcctggacggctctgtaa

SEQ ID NO: 3588 - DNA, 1980 bp, Enterobacter cloacae
agaagtggtcaccagcgaaaccctgcccggagccgcgcaatgacggcgctgcttgagctgaatgacattcgtcgcagctatccgtccggcgacgggccggtggaggtgctgaagggcatctccctgcgcgttgaagccggtgaaatggtggcgattgtcggggcgtcgggctcgggtaaatcaacgctgatgaacattctcggctgtctggataagcccaccagcggcacctatcgcgtggccgggacggatgtttccaccctggacggcgacgcgctggcgaagctgcgtcgcgagcattttggctttatttttcagcgttaccatctgctttcacacctgagcgcggcgcagaacgtggaggtgccggcggtgtatgcgggcgtcgagcgcaaaaaacgccttgaacgcgcgaaggcgctgttaacgcgtcttgggctggcggagcgtgttgattatcagccttcgcagctttccggcggtcagcagcagcgcgtgagtattgcccgcgcgctgatgaacggcggacaggtgatcctcgccgatgagccaaccggtgcgctcgacagccattccggtgaagaggtgatggcgatcctgcatcaactgcgcgatcaggggcatacggtgattatcgtcacccacgatccgcaggtggcggcgcaggcggaacgcattatcgagatccacgacggcgagctggtcagcaacccgccgccgcgtcagtccagagcggcggcggcgaaagaagctttgcctgtgtccaccggctggggccagttttccagcggtttccgcgaggcgctgaccatggcctggctggcgatggcggccaacaaaatgcgcactctgctgaccatgctcggcatcattatcggtattgcctcggtggtgtcgattgtggtggtgggcgatgcggcgaaacagctggtgctggcggatattcgggccatcgggactaacaccatcgacgtttaccccggcaaagattttggcgacgacgagccgcagtatcagcaggcgctgaaatacgacgatctggcggctattcagaagcagccgtgggtgaactccgccacgcctgccgtgtcgcaaaacctgcgtctgcgctacggcaacatcgacgtggcggccagtgctaacggcgtcagcggagattacttcaacgtctacggcatgacctttagcgaaggggcgaccttcaacgcggagcagctggcgggcagggcgcaggtggtggtgctggacgcgaactcgcgcagacagcttttccccaataaaacccgtgtagtgggggaagtgatcctggtgggtaacatgcccgccacggtgattggtgtggcggaagagaaacagtccatgtttggcagcagcaagatcctgcgcgtctggctgccatacagcaccatttccgggcgcattatggggcagtcctggcttaactccattaccgtgcgagtgaaggagggctacgacagcgcgctggcggaacagcagctcgagcggctgttaaccctgcgccacgggaaaaaggatttcttcacctggaacatggacggcctcttgaaaacggcggaaaagaccacacgtactcttcagctgttcctgacgctggtggcggtgatttcgctggtcgtcggcgggattggggtgatgaacattatgctggtgtcggtgaccgaacgtacgcgggagataggcatccgcatggcggtcggggccagagccagcgacgtgctccagcagtttttgattgaagcggtgctggtgtgtctggtgggaggcgcgatggggattgcgctttcgatgatgatcgccttcgcgctccagctcttcttaccgggctgggaaattggcttctcgccgatggcgatcctgacggcgtttttatgttccaccttcaccggtattcttttcggctggctgccggcgcgaaacgcggcgcggctcgatccggtggatgcgctggcgcgggaatag

SEQ ID NO: 3589 - DNA, 339 bp, Enterobacter cloacae
ataaggagagaaagtatgcagttttcaacaacgccaaccctggaaggtcaaccgattaccgagtactgcggcgtggtcaccggtgaggcgattctgggcgcgaacatattccgggacttctttgccggcattcgggatatcgtcgggggtcgctccggcgcgtacgagaaagagctgcgtaaagcgcgtgacattgcgtttaaggagctgggcgagcaggccaaagcgctgggcgcggatgcggtggtaggcattgatatcgactacgaaacggtcgggaaagatgccagcatgctgatggtgagcgtaagcggtacggcggtgaaaacccgtcgatga

SEQ ID NO: 3590 - DNA, 1944 bp, Enterobacter cloacae
acaattaacaagtgtgcagacatgaaaaaatttccctgggcgtgcgtggcgctgaccgcattgtcgttatattccagttcgctgcttgcagctaactttagcgcgagttttaaaaatactgatattcgcgagtttatcgatacggtaggccgcaatctcaacaaaaccattctggtcgacccgtccgtccagggcaccgtctcggtccgaacctacaacgtgctgacggaagatgagtactaccaattctttctgagcgtgctggatctctacggcctgtcggtgatcccgttggacaacggcatggtcaaagtggtgcgctcaagcgtggcgcgtaccgccggtgcgccgctggcagacagcaagaacccgggcaaaggtgatgagatcatcacccgcgtggtgcgcatggaaaacgtacccgttcgcgagctggccccgctgctgcgtcagctcaacgatgccactggcatcgggaacgtggtgcactttgagccgtccaacgtcctgctgttaaccggtaaagcctcggtggtgaaccgcctggtggatctggtgcagcgcgtcgataaagacggtattcagcgccgcgaaatcatcccgctgcgctttgcctctgccaaagaactttcggatatgttgaacaacctcaacaacgaagagcagaaagggcagaacgcgccgcagctggcgaccaaggtggtggcggatgacgaaaccaacagcctggtgatcagcggttcggaagatgcgcgcgcgcgtacccgttcccttatccatcagctggatcgcgagcagaataacgaggggaacacccgcgtcttctacctcaaatatgccagcgccaccaaagtggtgccggtgctgaccgggattggcgagcagctgaaagacaagccgggcgcggccaaagcgaaaaccgcgagcgcctcaaccgatctgaatatcaccgccgacgagtcaaccaactccctggtgatcaccgcgcagcctaatgtgatgaactccctggagaaggtgatcgacaagctggatattcgccgtccgcaggtgctggtggaagcgatcattgccgaagtgcaggacgggaacggcctggatctcggcgtgcagtggaccagcaagcacggcggcgtgcagttcggctccaccggcctgccaatcagccagattaaaaatggcaccatgaaaggggcaagcttcactggcctggcgaccggcttctttaacggtgattttggtgcgctggtgaccgcgctctccaccaacggcaaaaacgacatcctctccacgccaagcgtggtcacgctggataacaaagaagcgtcgttcaacgtgggtcaggatgtgccggtactttccggttcgcaaaccaccagcggcgacaacgtgtttaactccgttgagcgtaaaaccgtcggtaccaagctgaagattgtgccgcaaatcaacgatggcgacatgatccacctgaagattgagcaggaagtgtccagcgttgacaacagcgcgacggaagattcgagcctcggcccaaccttcaacacgcgcacgatcaataacgaagtgatggttcacagtggccagacggtggtgctcggcggcctgatggaaaatgtgaccaaacagtccgtctccaaagttccgctgctcggcgatatcccgctggtcgggcagctgttccgctacacctcgcaggatacctctaaacgcaacctgatggtgtttattcataccaccgtcctgcgtgacgatgacaactacagcgcagcctcgaaagagaaatatgaccagatccgggtgcgccagatgcagcgcgtggaagagaaaaagctcggtattgttgagccgagcgacaacgccgtcctgcccgcgtttccttcagcaagccctcacgtcgcaccggtgaaaacctccgcggcacgcaatccgtttaaagagtaa

SEQ ID NO: 3591 - DNA, 498 bp, Enterobacter cloacae
gaaagagaaataatgaaaaatcaacgcggctttacgttgctggaaattattctggcgctggtgatatttgccagttgcgccatgatggtggtgtccaccattccttcgcgcagcggcgcggatatatttggccagcaattaaaagcgctcgttgattatggttcagaccgtgcggtgatggacggaaatattgtcgggctggtgatcgccaccgataaatatcagctggtgacgatcgccgatgaaaatggcgagcgtcactgggtgccattatctgccggacgcatttccaccaaaggtgattttccggaagagatgcatgtgtcgctctcgccgcagcgcctggccgcgacggtgacgtccgagccgcaggtaatctttttaccggacggtgaaatcagccgctttacgctgacgctgcaaagttatgacaaacagcaccatttccgcgtggtgtcgcaaggtgcggcgccggtatcggtagaaaacgatggctaa

SEQ ID NO: 3592 - DNA, 708 bp, Enterobacter cloacae
gagccagccggttatttccctgcatatcattccgccgggagagagcaagtgaagaaaatgcgacgccagcgcggatttaccctgctggagatcatgattgcgctgactatcttcgcggtgatcagcaccctggcctggcaaattctggacggcgcgatgcgtaccagctcggcgacggatgccagcgccgcaaagctcaaccagcttcagcgcgcctggagtctgatggagcgtgattttttccagcttcaggcgcgcgccccgcgtaatgagccggagctgtttcgtcaggcgggcgatgcccttgaactgaccaccctgaatggcgtgagcggaacggtccaactggagcgcgagcgctggcggctggaagaggggcgtttgtatcgcgacgtctggccggtcattgacggcccggcggaagttaagcctgacgaagtgccgattgtcagcggcgttaaatcattgcagtggcggttttatcgtcagggctggctgaaaagctggagcgacgccgcccatctgccggacggcgtggaggttacgttgacgatggaaaacggggatacctggcgctgggtattcaccacgccgggtgatatgccggaggtggccgctgccgcggcgccagagaaagccgccgacgcgcctgggacgcccccggatgcagcccctgcgcctgccccttcgccggagaccagaccatga

SEQ ID NO: 3593 - DNA, 849 bp, Enterobacter cloacae
ccacctcagcgatgtgaaagcgcaggtgcaactcacctgggcaaaaaacgcatgaataccttcgcgctgatgcgggatgcctttccggtagggttcccgataatgagtgcgatcctgggcggcattgtgggcagttttcttggcgttgtcgccgaacgcgtaccggggatggtgatggatgaggaggggagcggtaatctgctcattccggcctcgcactgtccggtgtgccagcacgcgctcgccgcgtgggaaaacatcccgctgctcagctggcttttattacgggggcgctgccaccagtgcggcagcgcgatcccgctgcgactctttctggtcgaactgatctccgccttgttttttggcatcacggcctggtgcatgccagacgttcaggcgctgttctctttgtggttactggcggcttttttactgcctctggccatgatcgactggcagcaccagctgcttccggactgcctgacccagccgctgctgtgggcaggtctcttgcttcatgtgtttgaccacacgttgccgctacgcgatgcgctgttcggcgcggtggcgggctatctgtcgctctggctgctctactgggcttttcgtctgatcacgggacgagaaggtctgggttacggggattttaagctactggcggcgctgggcgcctggtgcggctggcaggcgttgccctctattgaactggcggcagcgttaagcggtattgtcggttatttcgccgtaaataatttaaataaaaataacctctctatttcttttggtccttatctcgcctttgctggaataggggtttttattagtcagcaaattgctttcacattttaa

SEQ ID NO: 3594 - DNA, 537 bp, Enterobacter cloacae
cccattaatcactccccctttagagggggagtgattcaaaattcattttacaggatgttggtaaggagaaataaccgaaactgtcagcaggtaaaaatgaaaaagttaattttgttgttattgataataagccaaagcgcactggcaaattgttgggataaagcggcgcattattatcatgtcgatccttatttactgtacgcgatagcgaatgtggaatccggaatgaatccgtatgcggttgggcaaaaccgcgatggcacgcgggatgtcgggctgatgcaaatcaacagttcgcattttaccgcgctggaaagcagaggcatcgacgaatatcgattaatcacggagccgtgtacatcgatcatggtcggggcttctatcctttccgggatgatcagggtgtatggctacaactgggaagccgttggcgcgtataacgccggactgaaaaaagaaaattatccgcagaggatgaaatatgcccataaggtctgggccaaatatcagcaactgaaattagcagcacgttattaa

SEQ ID NO: 3595 - DNA, 1140 bp, Enterobacter cloacae
ccagaacaactatttggaatatttatgaacctgaagggaaaacgcagaaagctgtttctgctgctggcggtagtggtgttagcgggcggattctggttatggaaggtactgaacgcgccggtaccacagtatcaaacgctgattgttcgtccgggcgagctgcaacaaaacgtgctggcgacggggaaactggatgccctgcgtaaggttgacgtgggcgcgcaggtcagcggtcagcttaaaaccctgtcagttgagattggcgataaggttaaaaaaggccagctgctgggcgtgatcgatcctgagcaggcgcaaaaccagatccgcgaagtggaagcgacgctgatggagctgcgcgcgcagcgcgcgcaggctcaggccgagcgtaatctcgctcaggtcaccctgacgcgccagcaggcgctggcgaaaacgcaggccatctcgaaacaggatctggacacagccgccacggaactggcggtgaagcaggcgcagattggcaccatcgatgcgcaaatcaaacggaatcaggcctcgctggatacggcgaaaaccaacctcgattacacgcaaatcgttgcgccaatggccggggaagtgacgcagataaccaccctgcaaggccagacggtcatcgccgcgcagcaggcgccaaacatcctgaccctggcggatatgagcaccatgctggtgaaagcccaggtatccgaagcggacgtcattcaccttaagccggggcagaaagcctggtttacggtgctgggcgatccacaaacccgctatgagggcgtgctgaaagatatcctgccgacgccggaaaaggtcaacgacgccatcttctactacgcgcgtttcgaggtgccaaacccgcagggcgtgctgcgtctggacatgaccgcccaggtgcatatccagctgaccggcgtgaaaaacgtgctgacggttccgctctccgcgctgggcgaatccgccggggacaatcgctacaaggtgaaagtgctgcgcaacggcgaaacccgcgagcgggaagtagtgattggcgcgcgtaacgacaccgacgtggtggtggtaaaagggctggaagagggtgaagaagtggtcaccagcgaaaccctgcccggagccgcgcaatga

SEQ ID NO: 3596 - DNA, 393 bp, Enterobacter cloacae
cagacatcgcggatgacagtaatagatgattgttatctaacatctgaggtagattcaaagtggttatgcataatgggtaagaccaacgattggctggattttgaccagctggcggaagataaagtgcgcgacgcgctaaaaccgccatctatgtataaagttatgttaatgaacgatgattacacgccgatggaatttgttattgacgtgctacaaaagttcttttcttatgatgttgaacgtgcaacgcaactgatgcttaccgttcattatcgtggcaaagcgatctgcggcatcttcactgccgaagtcgcggaaaccaaagtagcgatggtgaacgactatgcgagggagaacgagcatccgttgctgtgtacgctggaaaaggcctga

SEQ ID NO: 3597 - DNA, 2304 bp, Enterobacter cloacae
ggcataaaattgggggaggtgcctatgctcaatcaagaactggaactcagtttaaacatggctttcgccagagcgcgtgagcaccgacatgagtttatgaccgtcgagcacctgctgctcgcactgcttagcaacccatctgcccgcgaagcgctggaagcctgctccgtggatctggtggcgctacgtcaggaactcgaagccttcatcgaacaaaccacaccggtgctgccagccagtgaagaagagcgcgacacgcagccgacgctcagcttccagcgcgtgttgcagcgcgcggttttccacgtccagtcttccggacgtagcgaagtgactggcgccaatgtcttagtcgccatcttcagcgaacaggagtcccaggcggcctacctgctgcgcaaacacgaagtcagccggctcgacgtggttaacttcatctctcacggaacgcgaaaagacgagcctaaccaggcatcggatcccagcggacagatcaacagcaatgaagagcaagcaggcggggaggatcgtatggaaaacttcaccaccaaccttaaccagcttgctcgcgttggcggtatcgacccgctgattggtcgcgacaaagagctggagcgtgccatccaggtgctgtgccgtcgacgcaagaacaacccgctgctggtgggggaatctggcgtgggtaaaaccgcgattgccgaagggctggcctggcgcattgtgcagggcgacgtgccggaagtgattgccgactgcaccatctactcgctggatattggctcgctgctggcgggcaccaaataccgcggtgatttcgaaaaacgtttcaaagcgctgttaaaacagctggagcaggacaccaacagcatcctgtttatcgatgagatccacaccatcatcggcgcaggtgcggcctccggtggccaggtggatgccgctaacctgatcaaaccgctgctctccagcggcaagatccgcgtgatgggctccacgacgtaccaggagttcagcaacatctttgagaaggatcgtgcgctggcgcgtcgtttccagaaaatcgacgttaccgagccgtcggttgacgaaacggtgcagatcatcaacggcctgaaaaccaagtacgaagcacaccacgacgtgcgttacaccgcgaaagcggtccgtgcggcggtggagctggcggtgaaatacatcaacgatcgtcatctgccggataaagcgatcgacgtgattgatgaggcaggtgcgcgtgcacgcctgatgccagccagcaagcgtaagaaaaccgtgaacgtggcggatatcgagtccgtggtggcccgcatcgcgcgtattcctgagaagagcgtttctcagagcgaccgtgataccctgcgcaccctcggcaatcgcctgaaaatgctggtctttggtcaggataaagccattgaggccttaaccgaagcgatcaagatggcccgtgctggcctggggcatgaccacaagccggttggttccttcctgttcgccggtccgaccggcgtggggaaaaccgaggtgacggttcagctctccaaagcgctgggcattgagctgctgcgctttgatatgtccgagtatatggagcgtcacaccgtcagccgtttgattggtgcgcctccgggatatgtgggctttgaccagggcggcctgcttacggacgcggttatcaagcatccgcacgcggtcctgctgctcgatgaaatcgagaaagcgcacccggacgtgttcaacatcctgttgcaggtgatggacaacgggacgctgaccgataacaacgggcgcaaggccgatttccgcaacgtggtgttggtgatgaccaccaacgcgggcgtgcgggaaaccgagcgtaaatccatcggcctgatccaccaggataacagcaccgatgcgatggaagagatcaagaagatcttcacgccggagttccgtaaccgtctggacaacattatctggttcgatcacctgtctaccgaggtgatccatcaggtggtggacaagtttatcgtcgagttgcaggttcagctggatcagaaaggcgtgtcgctggaagtgagccaggaggcccgcaactggctggctgagaaaggctacgaccgtgcgatgggcgctcgtccgatggcgcgcgtgattcaggacaacctgaaaaaaccgctggcgaacgagctgctgtttggctcgctagtggacggcggccaggtcacggtagggctggatcaggcgaagaacgaactgacgtacgatttccagagtgcggcgaagcacaagccggaagcggctcactga

SEQ ID NO: 3598 - DNA, 618 bp, Enterobacter cloacae
cagagctttcctgagatgaagaaacccacccgcgccccggccggtcaaattcgcattatcggcggtcagtggcgaggccggaaattaccggtgccggacagccccggtttacgccccaccacggaccgcgttcgcgagacgctgtttaactggctcgccccgtctatggtagacgccaactgcctggactgcttcgccggaagcggtgcattagggctggaagcgctgtcgcgctatgctgccagcgccacgctgctggagatggagcgcggcgtcgcgcagacgttgcagcaaaatttggctacgctgaaggcaaccaacgccaaagtggtgaataccaacacgctgagcttcctcgcccaacaggggacgccgtacaacgtggtgtttgttgacccgccgttccgtaaagggctgctggaagagacgctatccctgctggagcaaaatggttggctggcggatgacgcgctgatttacgttgaaagcgaagtggaaaatggtctgccgcccgttcccgttcactgggatctgcaccgcgagaaggtcgccggccaggtggcttatcgtctgtatcaccgtcaggcacaaggaggatccgatgccagtactgattaa

SEQ ID NO: 3599 - DNA, 681 bp, Enterobacter cloacae
tcaaaaaggtacaatatgaactcctttacacaatcgcagcgcgtcaaggcgttgttctggctttcgctatttcatctgctggtgatcatctccagtaactatctggtacagctccccatctccatttttggtttccataccacctggggcgcgttcagtttcccgtttattttccttgcgacggatttaaccgtgcgtatttttggcgcaccgctggcgcggcggattatttttgcggtgatgatcccggcactgtttgtctcctacgccatctcctcgctgttttacatgggaagctggcagggcttcgaagcgctgacgcacttcaacctgttcgtcgcgcgtattgccaccgccagctttatggcctacgccctggggcagatcctcgatgtccacgtgtttaaccgcctgcgtcaaaaccatcgctggtggatggcgccaacggcctccacgctgttcggtaacgtgagcgatacgctggccttcttcttcatcgccttctggcgcagcccggacgccttcatggcagaacactggatggaaatcgctctggtggactacgcctttaaggtgcttattagcctggtcttcttcctgccgatgtacggcgtactgttgaatatgctgctgaaaaggctggcagataaatctgaaatctccgcattgcaggcaggttaa

SEQ ID NO: 3600 - DNA, 600 bp, Enterobacter cloacae
acgaatgagccgttatggccgtttatcgaaaggaagaagtcaatgcgcaatctggttaaatatgtcgggattggcctgctggttgttggccttgcagcctgtgataacagcgacaccaaaacgcctgctcagggcgcgtcagcagaaagcaacgccaccggtcagccggtgagcctgatggatggcaaactcagtttctctctgcctgcggacatgaccgaccagagcggtaagctgggtacccaggcgaacaatatgcacgtctattccgatgccaccggccaaaaagcggtgattgtgatcgtcggtgacgataccagcgaagatctgggcgtgctggccaaacgcctggaagatcagcagcgcagccgcgacccgcagcttcaggtggtcaccaacaagtctgttgaactgaaaggccacacgctgcaacagctggacagcatcatctctgccaaaggccagaccgcgtactcctccgtggtgctcggcaaggtggacaataaactgctgaccatgcagatcaccctgccggcagataatcagcagaaagcgcagaccgccgctgaaaacatcattaacaccctcgtgatccagtaa

SEQ ID NO: 3601 - DNA, 1113 bp, Enterobacter cloacae
cgctccagacgaagcccatccggcgcactacaattaacacgccccccggaaaaaggaattcttatgactgccagcccgcccgacaaagccggacttcatattttattaaaacttgcctgcctggtggttatccttgcgggtatccacgcggcggcggatatcattgttcagcttctgctggcgctgtttttcgccattgtgctcaacccgctggtgacatggtttttacgccggggcatcagccgcccggtcgcgattaccattgtggtgatggtgatgctggttgtcctgacggcgctgttcggcgtgctcgccgcctcgctgagcgaattttccaccatgctgccgcagtacaataaagagctgacgcgcaagctggtcgatcttcagcgcatgttgccgttcgtgaatctgcatatctcaccggaacggatgctgcgccggatggattccgagaaggtgatgacctacgccaccacgttgatgaccgggctttcaggggcaatggccagcattctgctgctggtgatgacggtggtgtttatgctgttcgaagtgcgccacgtgccgtataagctgcgttttgccctgaacaatccgcagatccacattgccggcttgcaccgcgcgctgaaaggcgtatccaagtatctggcgctgaaaacattgttaagcctgtggaccggcgtgatcgtctggctggggctggtactgctggacgtgcagttcgcgctgatgtggggcgtgctggcgtttttactgaactacgtacccaatatcggcgcggtgctttccgccgttccgccgatgatccaggcgttcctgtttaacggtttttatgagtgcatgctggtaggggcgctgttcctcatcgtgcatatggtgctgggtaacattcttgagccgcgcatgatgggccaccgtctgggcatgtcgacgatggtggtgtttttatcgttactgatctggggatggctgctgggtccggtgggcatgctgctctccgtgccgctcaccagcgtctgtaaaatctggatggaaaccacgaaaggaggcagtaaactcgccattcttctgggtccgggtcggccaaaaagccgtttgccgggataa

SEQ ID NO: 3602 - DNA, 1356 bp, Enterobacter cloacae
agaaaaacgatgcttaaccctcttccgcttagccagtggctcagtgcgccccgccctgacgacacccctgtcgcctggcaggacgaccatctctggacgcttggcgatctgcgccacgacgtcactcagctggtcgacacgctgcgtcgtgaagatggcgagcgctgggcgctgtgcatcgaaaacggctatctgtttattgtcgcgctgctggcgacgctgcatgcgggtaaaacgccggtcctccccgggcacagccgggcggcgcagcttaacgaacagcgggcgctgttcagcggcgtcctgagcgacaccacgctcgattttcaggggcaacagctgcgggtggcttccgctcagcgggcaggtcatcccttttcaccgctgcctgccatcggtgagatgcgcacgatcgagctttacacctccggctcgaccggcacgccgcagcgggtgagtaagccggtggtcagcctggatcgtgaggctcgtcttctggcggcgcattttggcgagcgtctggcgggctgtcacgttgtggcttccgtggtgctgcaccacctgtatggcctgacgtttcgtgtcgtcttacccctggcgctcggcctgccgctgcacgccagcctgctcaactatgccgagcagctctctgcccttcccgacgataaacgctatcttttcatcagcagtccggcgtttctcaagcggctggacgcgtcactgacgccgccccccgtcaacctgctcttctccgctggcggcgcgctgccctggcaggaggtcgccgcggttcaggcctggctcaacgtctggccggatgaaatatacggcagcacggaaacaggcgtaatggcctggcgctaccgtcaggaggaaagcacccgctggcagcctttccccggcgtgacgtttcacggcgatcgcgtgatgtcgccgctgatccccgaggtggagggggtcgtgctggatgatatcctgcacttcacggctgacgggcagttcagcctcgtcgggcgccgcggtcgggtggtcaaaattgaagataaacgcatttcactcgatgacattgagcgccgcctgttggcgctggacggcatccgcgaggccgccgcgctgacggtgacgcgcggcgggcgtcagggcattggcgtattgctggtgctgaatgaagcggtgcgtcagcaacacgaacagggcaaaaaagcgcaggagctcgcctggcgacgcgcccttcgcccctggcttgaaccggttgccgtgccgcgctactggcggatcgttgatgaaatcccggtcaacagcatgaacaagcgcgtgactgcgcagctacaggagttgtttcatgaagatccctga

SEQ ID NO: 3603 - DNA, 1728 bp, Enterobacter cloacae
cgagcgccacaccgccagcagcgggaagattcgcttatgtcagtaaccttccgtccctgcgtgctgatcccgtgctataaccacggggcgatgatggcttcggtgctggcgcgcctggcgcctttcgatctgccctgtctggtggtggacgacggcagcgatgaaaccacgcgccgcacgcttgaagcgctggcggcggatcgtccgcaggtcacgctactgcggctggccgaaaacagcggcaaaggcgcggcggtgatgcaggggctgaaagactgcgccgatcgcggcttcacccacgccgttcaggtggacgctgacggccagcacgctatcgaagacatccccaaactgctggcgctggccgaacgccatcccgatgcgctcatttccgggcagcccgtttacgatgactcgatcccccgttcgcgcctgtacggccgctggataacgcacgtctgggtctggattgaaaccctctccctgcaactgaaagacagcatgtgcgggtttcgcgtttaccctatagccccggttttgcgccttgcagcaaccacgccgctcggcaggcgaatggattttgataccgaagtgatggtgcgcctctactggcagggcaacaacagctattttctgcccacccgcgtgacctatccgccggacggggtatcccatttcgatgccctgaaagacaacgtgcgcatctcgttgatgcatacccgtctgtttctcagcatgctgccgcgcattccttccctgctgatgcgtcgccgctcgcagcactgggcgcagcagcaggaggtgaaaggattatggggcatgcgcctgatgctgcgcgtctgccaactgctggggcgtaaggcgtttaccgccctgctgtggccggttacggccgtctactggctaaccgcccgcgctgcgcgccaggcgtcgcagcagtggctgacgcgggttaaaacggtgatggcacagcggcaaatgccgcaacccgcgcggcttaacagtttttcccacttcctgcgcttcggtcatgccatgctgaacaaagtggccagctggcgcggcgaaatgaaactccatcgcgatctggtctttgcgccaggcgcgcaggaggcgctggggctcgacgatcctcagggcaaactgctgctcgcgtcgcatcttggcgatgtggaagcctgccgggcgctggcccagcgcgaaggggcgaaaaccatcaacgcgctggtctttagcgacaacgccagacgttttaagcaggtgatggaggagatggcgccgcaggcgggcattcacctgatgccggtcaccgacattggcccggagaccgccatcctcatcaaagagaagctggatcgcggcgaatgggtggcgatcgtgggcgatcgcattgccgtcaccccgcagcgcggcggtagctggcgggtgatatggagcgaatttatgggccagcccgcgccgttcccgcaggggccgtttatcctggcgtccattttgcgctgcccggtggtgctgatttttgccctctgtcagcagggaaagctgaccctgcactgcgagccgtttgccgacccgctgctgctgccgcgcggcgaacgccagcaggcgctacagcagaccgtcgaccgctatgcggagcggctggagcattacgcgctcttgtcgccgctcgactggtttaattttttcgatttctggcagctgccagagatcaacgagaaggagtaa

SEQ ID NO: 3604 - DNA, 426 bp, Enterobacter cloacae
agggtgctgaccgatccccgctttacggctgaagttgaaatcaccgttccgttccacgacgtcgatatgatgggcgtggtgtggcacggcaactacttccgctactttgagattgcccgcgaagcgctgctcaaccagtttgattacggctatcgccagatgaaagcgtccggctacgtctggccggtggtggatacccgggtgaaataccgcgacgcggtgaccttcgagcagcgcattcgcatccgcgcccacattgaagaggttgaaaaccgtctgcgcatcgcctatcaaatcttcgacgcgcaaaccgggaaacgcaccaccaccggctacaccattcaggtggcggtggaagaagcaagccgggagatgtgctttgtcagcccggccattctgttcgaacgcatggggatcgcgccatga

SEQ ID NO: 3605 - DNA, 1251 bp, Enterobacter cloacae
accgtaacggcaggcgcgaaccgattagcattgtgcagcacgcttttcactaccacatcaccattcaatatctgggtgactgagatgatttacctttctgccgttggcatggtcaacgcgctcggcaactcggctgatgaaatagcggcgaacctgatcgctggcgtggcccccgggatgcgccaacgtgcgggctggctacagggcttacccgaggccgtgctgggaggcgtggagggtgaacttccccctgtccccgagtctttttccgcccatcgcagccgcaacaaccagctgctgctggcggcgcttgcgcaaatctggcccgccgtcgatgcggccattgcgcgcgtggggcgagaccgcgtggcggttgtgctgggcaccagcacctccggactggacgagggtgatgagtacgtgcgccgcgcgcagaacggcgagcgcagcccgcagtggcaatatccgcagcaggagctgggcgatccgtcgcgctttctcgccagctggcttgcgctggacggcccggcgtataccatttcgaccgcctgctcctccagcgcgcgggcgatcatcagcggtcgtcgcctgatcgacgccgggctggtggacgtcgccatcgtcggcggggccgacagcctgagccgcatgccggtcaacggcttcaacagcctggagtccttctccccgaccctgtgcgaaccgtttggccgcaaccgtcgggggatcaccattggcgaagcggcggcactgatggtgctgacccgcgagccgggcgaggttgcgctgctgggcgcgggggaatccagcgatgcgtaccatatttccgccccacatccgcagggcgaaggggcgatccgcgccatcaaccaggcgctgaacgaggcgggcataacggcggcggacgtcggctatatcaacctgcacggcaccgccacgccgctgaacgatcgcattgaggcgcaggttatccacgatctctttggcgaccgcgtgccgtgcagctccacgaaacatcttaccggccacacgctgggcgccgcggggatcaccgaggccgccctgagctggctgatcctgacccgaagcctgccgctgccgccgcaggatttttcccgctacgcgccggacgacaccctgcccgccttcggcctactgcaccagagcgcaccgctgaataaaccggtgatcctgtcaaactccttcgcgtttggcggcaacaacgccagccttctgctggggagagtatga

SEQ ID NO: 3606 - DNA, 330 bp, Enterobacter cloacae
cgtcattcatccctgcattatgccgatgatcggcacccgcaagggcgggcggatcatcaccctgtcgtcggtgtcaggcattatgggcaaccgtgggcaggtgaactacagcgcggcgaaagccgggatcatcggcgccaccaaagcgctcgccaccgagctggcaaaacgcaaaatcaccgtcaactgcatcgcgccggggctgatcgataccggcatgatcgagatggacgaagctgcgctgcacgcggcgatgtcgattatcccgatgcagcgtatgggccaggccgaggaggtcgcggggctggcgagttacctgatgtcggataa

SEQ ID NO: 3607 - DNA, 1242 bp, Enterobacter cloacae
cggaggcatgctatgacccgccgggtagtgattacgggcatgggcggcgtcaccgcgttcggcgaggactggccgaccatctcgcgccgtctgcgcgagtatgaaaatgcggtgcgtaccatgacggagtggcaggcgtatgacggcctgcaaaccctgctcgccgcgccgattgaagacttcactctccccgctcactatacccgtaagcgcattcgcgccatgggccgcgtgtcgctgctctctacccgcgccaccgagctggcgctggagcaggcgggactaatcgacgacgcggtgctgaccaacggtcagaccggcatcgcctacggctcgtcgaccggcagcaccgggccggtcagcgagtttgcctctatgctcaccgaaaagcacacccacaacatcaccggcaccacttatgtgcagatgatgccgcacaccacggcggtgaataccgggctgttctttggcctgcgcggacgggtgatccccacctcgagcgcctgtacctctggcagccaggcgattggctacgcctgggaaacgattcgtcacggctaccagacggtgatggtggcaggcggcgcggaagagctgtgcccgtcggaagcggcggttttcgataccctgtttgccaccagccagcgtaacgacgcgccaaaaaccacgccgtcgccgtttgacgttcagcgcgatggcctggtgattggcgaaggggcgggtacgctggtgctggaagcgctggatcacgccagagcgcgcggagcgacaatttatggcgagatcgtgggctttgccaccaactgcgatgcggcgcacatcacccagccccagcgtgaaaccatgcaggtgtgtatggagcagtcgctggcgatggcgggtcttggccctcaggacattggctacatttctgcccacggcacggcaaccgatcgcggggatatcgccgagagtcaggcgaccgccgccattttcggcgacagcgtgcccatctcatccttaaagagttatttcggtcataccctgggtgcctgcggcgcgctggaagccttgctgagtctgcatatgatgcgggagggctggttcacgccgacgctcaatttaagacaaccggatgagcaatgcggcgctttagattatattatgggggaaacccgcccgattgattgcgaatttattcagagcaataactttgcctttggcggcatcaatacctcgataatcattaaacgctgggcgtaa

SEQ ID NO: 3608 - DNA, 432 bp, Enterobacter cloacae
attgagtacactggccctactctttttgatttggacaagcagctaatgaaactgactatcgtgcgtctggtgacctttagcgaccaggatcatatcgacctgggcaagatctggccggaatattccccttcatcgctggccgtcgatgaaaaccaccgcatctatgccgcgcgttttaatgaacgtctgctggccgccgtccgcgtaacgctgagcggcacggaaggggcgctggactccctgcgcgtgcgcgacgtgacccgtcgtcgcggggtcgggcagtatttgattgaagaggtgatccgcgaaaacccgagcgtaacctcctggtggatggccgacgtgggcgtagaggatcgcggcgtgatggcggcgtttatgcaggcgttagggtttacggcgcaggcgaacgggtgggagaagcgctgctag

SEQ ID NO: 3609 - DNA, 408 bp, Enterobacter cloacae
tttacgttgaaagcgaagtggaaaatggtctgccgcccgttcccgttcactgggatctgcaccgcgagaaggtcgccggccaggtggcttatcgtctgtatcaccgtcaggcacaaggaggatccgatgccagtactgattaacgtagggcgcttgctgatgctgggcgtctgggcatttttgattttgaatctggtgcacccgttcccgcgtccgctgaatatcttcattaacgtggcgctgatttttaccgcgttcatgcatgccttacagatggtgatgctgaaaaacggactgccgaaagatagcccaccgatgaccggctggcagcagctgcgggtgtttattttcggcgtatttgagctgctggtgtggatgaagaagtttaaggcgcaggtgaagaagtaa

SEQ ID NO: 3610 - DNA, 753 bp, Enterobacter cloacae
aaaatcccatcagattatgcggaattcaggatacctcgcctgccccggcattgccaaacgaccgctcgcgtcactacactggatcaggaactgatcattcagcctcaacagttacagggagttaatatgctttggtcatttatcgctgtctgtttttccgcatggctttacgtcgatgcgtcctaccgtggcccagcctggcagcgctggttatttaaacccgtcacgctattactcctgctgttgcttgcctggcaggccccgatgtttaacgccgttagctatcttgtcctcgcggggctgtgtgcttccctgattggcgatgccttaaccttgctgccgcgtcagcgcctgctgtacgccgtgggggcgttcttcctgtcgcatctgctctataccatctactttgccagccagatgacgctctccttcttctggccgctgccgctggtgctgctggtgattggcgccctgctgatcgcggtgatctggtcgcgtctggaagagatgcgtctgccggtctgtacgtttatcgccatgacgctggtgatggtgtggctggcgggcgagctgtggttcttccgtccgacggcgcctgcaatgtctgcgttcttcggtgccgcactgttgctgttgggtaatatcgtctggctgggcagccactatcgtcgccgcttccgtgcggataatgcgatttccgccgcctgttactttgccggacacttcctgattgtgcgttcgctgtatatctaa

SEQ ID NO: 3611 - DNA, 921 bp, Enterobacter cloacae
agagcccgcgctgccgcaaagcctccagttcctgcgccattacctgcgggacgagcgccagttcaccctgccgggcgagcgcctgctgtggcaatggacgcgccaatgagagggttacgttcccgcctcgatcggttatggcggatgctgatgaccggattgtgcttcgccctgttcggcctcggcggactgacgctgtcgctggtatggtttaacctgctgctgattttccagcgcgaccgcacccaacgtcgccgcctggcacgccgtactatttctgccagttttcgcctgttcctcgcggtggtacgcggtgcaggggtactggattaccgtttcaacaacctggacgttctacgcgccgagcggggctgtctggtgattgcgaatcatccctcgctgctggactacgttctgctggcgtcggtgatgaacgaaaccgactgtctggtgaaaagcgcgttgctgcgtaacccgttcgtcagcggcgtgatccgcgcggctgactatctgattaacagcgaagccgacacgctgcttgccgcaagccagcagcgtctgtcccagggcgacaccctgcttatcttccctgaaggcacccgcacccgggtgggggaagccatgaccctgcaacgtggggcggcgaatatcgccgttcgctgcaacagcgccgtgcgcgtggtggtgatccactgtagcgaacggatgctggataaacagagcagctggtataacgtgccccccaacaaacctgttttcaccgtggatgttcgcgaacgcatcaacattcatgatttttatgatgcgagtcagcacgaacccgcgctggcagcaaggcagttaaaccggcatatgcagcatcagttaacaaccggtcttcaatctttgtcaggaacgaaagatgcaagcgctctatcttga

SEQ ID NO: 3612 - DNA, 330 bp, Enterobacter cloacae
cgagatgcgtcagcacttttattccgttgccacgctcgcggcttttatccatcaacaacgcgcctgagaatgaccgctatgacagaacaacaaacgatttatcaggaagtctctgcgcttcttattacgctgtttgaaatcgccccggaggatattacccctgaggcacgtctttacgaggatctggacctcgacagcattgatgccgtcgatatggtggtgcacctgcaaaagaaaacgggccataaaatcaagcctgaaaccttcaaagcggtgcgcacggtgcaggacgtcgtggacgttgtggaacagcttcagcgcgacgcgtaa

SEQ ID NO: 3613 - DNA, 813 bp, Enterobacter cloacae
tgtctccctcgccacgggccgcgtgaacaccttccagccgagcgaggaagaattaaccacacttttcaaccagggaacaccatcatgagatccgtactggtcactggcgccagcaaaggcattggccgcgctatcgcccttcagcttgcggcggacggtttcaccgtcggcgtgcattaccatcgtgatgaagcgggcgcgcaggagacgctggaagcgattgtccaggcaggcggcgcgggccgtttactcaccttcgacgtgggcaaccgcgagcagtgccgcacggtgctggaacaggagatcgctgaccacggcgcgtggtatggcgtggtcagtaacgccggtattacccgcgacggcgcatttcctgcgctcagcgacgatgactgggacagcgtgatccacaccaatctcgacagtttttataacgtcattcatccctgcattatgccgatgatcggcacccgcaagggcgggcggatcatcaccctgtcgtcggtgtcaggcattatgggcaaccgtgggcaggtgaactacagcgcggcgaaagccgggatcatcggcgccaccaaagcgctcgccaccgagctggcaaaacgcaaaatcaccgtcaactgcatcgcgccggggctgatcgataccggcatgatcgagatggacgaagctgcgctgcacgcggcgatgtcgattatcccgatgcagcgtatgggccaggccgaggaggtcgcggggctggcgagttacctgatgtcggataaagcaggctatgtgacgcgtcaggtgatttcgattaacggaggcatgctatga

SEQ ID NO: 3614 - DNA, 798 bp, Enterobacter cloacae
acgatgaaaatcgatttaacggggaaagtagcgctggtgaccgcgtccaccggcggtattgggtttgccatcgcccgcgggctggcggagagcggtgcggaagtgatcgtaaacggacgcagcgtcgactcggtgaataaaggcattcaggcgctacagcaggtggtgcctggcgtacaggtccgtgccgccatcgccgacctgagctcgcaggagggcgttgacgaactgctcagggtcgccacgcacgtcgatattctggtgaataacgccgggatctatggccagcaggatttttattccaccgacgacgagacctgggaacgctactggcaaaccaacgtgatgtccggcgtgcgcctctcccgtgccctgttgcccggcatggtacaaaagggctggggtcgggtagtgtttatctcgtcagaatcggcctgcaatattcctgcggatatgatccactatggcgtgacaaaaaccgcccagctctcgctggcgcgcggtctggcgaagttcgtggcaggcagcggcgtgacggtgaacagcgtactgccgggcccgacaatgtcggacggttttgccgcgatgatgaaagacgaaatcgaaagaaccggtaaatcgctggagcagctggcgaaagcgttcgtgatggagaatcgtcccagctcggttattcagcgcgccgcaacggtagaagaagtggcgaatatggtggtgtatgtctgttccatgcaggcctccgcgacttccggcgcggcgctgcgcgttgacggtggcgtggtggatgacatagtttga

SEQ ID NO: 3615 - DNA, 2244 bp, Enterobacter cloacae
cgcttgactctggagtcgactccagagtgtatgctgcggttaatgagaaaattatcattaccggagactgccatgtcgactccagaaacacctaaaaaagttccccaattctcggcacttaagctcagcccggttccgccaaaagaggactgctgctgcgagggcgcgtgcgaaacccagaccgaagcgctgcctgaaagcggcaaccgctacagttgggtggtcaacggcatggactgcgcggcctgcgcccgcaaagtggaaaatgcggtgaagcaggtgccaggcgtgaatcacgttcaggtgctgttcgctaccgaaaagctgctggtcagcgccgaaaacgacgtcagcagacaggttgaagccgccgtcagcaaagcgggttataccctgcgcagcgaaacggcgcccgcagaaaaaacgtccccgctaaaagaaaatctgccccttatcaccctcatcatcatgatggccctgagctgggggctggagcagatcaaccacccattcggcaacctggcgtttatcgccaccacgctggttggcctgttcccgattgcgcgtcaggcgctgcgtctgatgagaagcggcagctggtttgccatcgaaacgctgatgagcgtggcggctatcggggcgctgtttattggcgcgacggcggaagcggcgatggtgctgctgctgttcttaattggcgaacgccttgagggctgggcggcgagccgggcgcgtaaaggggtgagcgcgctgatggcgctgaagccggaaaccgccacgcgggttattgatggtcagcgtgaaacggtcgccatcaacaccctgcgcccgggcgacgtgattgaagtgcccgcaggcggacgcctgccagccgatggggccctcgttactgccaccgcaagttttgacgaaagtgccctgaccggagaatccatcccggtagcgcgcgcggcgggtgaaaaggtgcctgcgggcgccaccagcgtcgaccgactggtgcagttgacggtcctttccgaaccgggcgacagcgccatcgaccgcatcctcaggctgattgaagaggccgaggagcgccgcgcgccggtagaacgctttatcgatcgcttcagccggatttacacccccgccatcatgctggtggcgctgctggtcaccgtcgtcccgccgctgtgcttcggcgcgccgtgggagggctggatttacaaagggctgacgctgctgctgataggctgtccgtgtgcgctggtgatctccaccccggcggcgattacctcagggctggcggcagcggcacgtcgcggggcgttgattaagggcggcgcggcgctggagcaactgagccagatccggcacgttgccttcgacaaaaccggaacgctcaccgtcggcaaaccgcaggtgaccggcgtgtatccgcaggatgtcagtgaagacgatctgctgacgctggccgccgccgtggagcaaggctccactcacccgctggcgcaggcgattgtgcgagaagcgcagtcgcgcgggctgaacatccctccggcaaccgcccagcgagcgctggtcgggtcagggattgaggctgtggtcgaaggcaaaaaagtgctgattgccgcggcggactcgcgctctactccacaggttgaggcgctggagcaggccgggcagacggtcgttgccgtgatgcaggacggtgtaccgatgggcatgctggcgctgcgcgacaccctgcgcgacgatgcgaaagacgccgtcgacgcgctgcacaggctgggagtacagggtgtgatcctgaccggcgataatccgcgcgcggcggcggcgattgccggtgagctggggctggcgtttaaggccggattgctgcctgcggataaagtcagcgcggtaaccgagctgaacagcaacgccccgctggcgatggtcggggacgggataaacgatgccccggcaatgaaagcttccaccatcggcattgcgatgggcagcggcaccgacgtggcgctggagaccgccgacgcggcgctgacgcacaaccgcctgaccgggctggcgcagatgatagatcttgcgcgggcgacgcgggccaatattcggcagaacatcggcattgcgctgggtctgaaggggattttcctggtcaccacgctgctcggcatgaccggactgtggctggcggtgctggcggatacgggggcgacagtgctggttacggcgaacgcgttgcggctgttgcgccaaaggtaa

SEQ ID NO: 3616 - DNA, 291 bp, Enterobacter cloacae
caaccggtcttcaatctttgtcaggaacgaaagatgcaagcgctctatcttgaaattaagaatctcattatctctacgctgaatctggaagaacttaccccagaggatattgatacagacgccgcgctctttggcgacggcctcggtctggactcaatcgacgcccttgagctggggctggcggtaaaaaatcagtacggcgtagtgctttctgccgaaagtgacgagatgcgtcagcacttttattccgttgccacgctcgcggcttttatccatcaacaacgcgcctga

SEQ ID NO: 3617 - DNA, 384 bp, Enterobacter cloacae
cgccctgcgcccggcgctgctgtgggccgcggtatgcctgatcctgctgggcgtgctgctgtcgctgctgcctggcgcgcggctgaacagcagcgtgctcgccatgctgccgaaacagacgctcggcgcgatccctcccgctctcaacgacggatttatgcagcgcctcgaccgccagctcatctggctggtcagccccggcaaacagccggacccgcgcgtggcgcagcagtggttaaccctgctgcaacgcagccaggcgctgagtgtcgtaaaaggtccgctggatgccgccgggcaacaggcctggggagatttcttctggcagcaccgcaatggcctggtcgatccggccacccgcgcccgcctgcaaaacggcggtga

SEQ ID NO: 3618 - DNA, 543 bp, Enterobacter cloacae
accggtgatcctgtcaaactccttcgcgtttggcggcaacaacgccagccttctgctggggagagtatgatgcactacttacctcccggggattatcttcctcacgacacgccgatgctgctgcttgagagcgtggaaagcgtcaccgatgaccgcgccgtttgcagcgtgacggtgaacgaacggggcgttctggccccgttcctggacgcggacggcaacctgcctggctggtttgcgctggagctgatggcccagaccgtgggcgtctggtctgaatggcaccggatgcaaaaagggctgccgcactgtgcgctgggcatggtgctgggcgcgcgcgagctggtgtgcgacgcagggcattttgccgcaggcagcacgctgaccatcaccatcgaacgtctgatgcaggatgaacgctttggcagcttcgagtgcaccattcatgcggatagtgtctccctcgccacgggccgcgtgaacaccttccagccgagcgaggaagaattaaccacacttttcaaccagggaacaccatcatga

SEQ ID NO: 3619 - DNA, 609 bp, Enterobacter cloacae
acgctgggcgtaactatgtaccagtttgtactgggaaagatctccacccttagcgcggacccgctggcgtcaacgctcgcagacatggcacctcagggtgcacgacacgcttcctggcttgcaggccggacgctgctcgccagaaccttatccccctcgccccttcccgagataatttacggcgagcagggaaaaccggccttcgctaacggccatccgctgtggtttaacctgagccacagcggggacgatattgccctgctgatgagcgatgaaggtgaagtgggctgcgatatcgaagtgatccgcccgcgggagaactggcaggcgctggcaaatgccgttttcagcctcaccgaacatgacgagctggaacgtgaagcgccggaagagcagctttccgcattctggcgcatctggacacgcaaagaggcaatcgtcaaacagcgtggcggcagcgcgtggcagatagtcagcattgacagcaccgcccagtcgctcccggtcagtcagctacgcttcggctcgctgagcctggcggtctgtacccctacgcctttcaccttaacggcggaagcggttacttactccggtattcctgcggcataa

SEQ ID NO: 3620 - DNA, 927 bp, Enterobacter cloacae
ataacgctatgtttgaatcaaattcatccaaaatttagattaattatgcacaagacgacgctcgaacagtgggccttgctggagagagtcatcgaggctggcagcttcgctaaggcggcggaagagacctaccgcagccagtcctcggtcagctataacctgtcgcttttgcaggagcggctgggcgtggcgctcctgatgacagagggacggcgtgccgtgctaaccccggcgggtgagctgttgctgaatcaggttaaaccgctgctgaaagccttcgcctatgttgaaacgcgcgctgcgaccctgcgcagcgggatgcgaacccgtatcgacctgatggtagacagtatttttccgcgtagccggctgttcgcgattttgcgccagtttcagcagctgtacccgcaaacgcaggtgcggcttaccgaggttctggaaaacagccgcgcagatgcgctcaatgatgaagccgacgtgatggtcttaacccgccgccaggacattaccggcctgggcgaatggctgatgaatatcgattttgttgccgtcgcgcatcacgcgcacccgcttttttcgctggatacgccgcttaatgacgagatgctacggccgtggccgcgcattcagatcgcagacagccagcccaccactcaccccaccggggagtcgtggacattctccactatcgatgccgcgatcgaagcggtgatgtatcaggttggatacggctggttaccggaagaacgcattcagaccccgctccagcagggcatccttaaaacgctgccgctcagccacggcgtacgtcgcgccacgccgctgcacctcatcgtcaaacgctccctcagcccgctggacgagcaggttgagacgctgttgcgcctttttaagcaggagccgtcatcgtcaactgctacgctttaa

SEQ ID NO: 3621 - DNA, 318 bp, Enterobacter cloacae
ggcgaggcgttcgcttatgcactgaaccagtgggatgccctgtgttactactgcgatgatggtctggcagagccggataataacgctgctgagcgcgcgctacgagcggtctgtctgggcaagaaaaactacatcttcttcggcagtgatcatggtggtgaacgtggtgccctgctgtatggtctgatcggaacgtgcaggctgaacggtatcgatccagagggttaccttcgccatatcctgagcgtattgccggagtggcccatcaacaaagtggccgaactgctgccatggaacgtagatctcaccaataaatag

SEQ ID NO: 3622 - DNA, 468 bp, Enterobacter cloacae
ttgtttgggtatgtaaacaccggagacccaaccatgaaaaagattctcgtatcatttgttgccattatggctgccgcttcatctgccatggctgcagagacaatgaacatgcatgaccaggtaaataatgcacaggcacctgcccaccagatgcagtcatctgctgaaaaaagtgcaattcagggagacagcatgacaatgatggatatgagcagtcacgatcaggccgcaatgtcccatgacatgatgcaaaacagcaattctgctgcccaccaggacatggctgaaatgcataaaaaaatgatgaaagctaaacccggagctaccaacgaaacagcaaagtcattttctgaaatgagcgagcatgagaaggccgcagctgtacatgagaaggcgaataatggtcagtcttccgttgttcaccagcagcaggctgataagcatcgcagtcagatcacccagaattaa

SEQ ID NO: 3623 - DNA, 699 bp, Enterobacter cloacae
ggcactatttgcccgagaggactaacaatgattcgctttgaacacgtcagcaaggcctatctcggcgggagacaagcgctacagggggtgacattccacctccagccaggcgagatggcattcctgaccggccattccggcgcggggaaaagtaccctgctcaagctgatctgtgggatcgagcggccaagcgccgggaaaatctggttcagcggccatgaaattagccgtcttaagaaccgtgaagtgccgttcctgcgtcgtcagattggcatgattttccaggatcaccacctgctgatggatcgcacggttttcgataacgtcgcgatcccgctgattattgccggcgccagttacgatgatatccgccgtcgcgtttcggcggcgctggataaggtcgggctgctggacaaagcgaagaacttcccaatccagctctcaggcggtgagcagcagcgcgtgggtatcgcccgtgcggtggtgaacaagcctgccgttttgctggcggatgaaccgaccggtaacctggacgatgccctctctgaagggatcctgcgtctgtttgaggaatttaaccgcgtgggggtcacggtactgatggcgacgcacgacatggggctgatctcccgccgttcgtaccgtatgctgaccctgagcgatgggcatttgcacggaggccacggtgaacaagcgtga

SEQ ID NO: 3624 - DNA, 1344 bp, Enterobacter cloacae
cgcccgctctggcgaattccctgcccctggcaaacacttactgatgcgctaagcaggcgactttcagagggtgacagggtgaaaaataacgaactgaacgaccggcgtttacaggcgacgccgcgcggtatcggcgtcatgtgtaacttctatgccgataaagccgaaaacgccacggtgtgggacgtggaaggtaacgagtatattgattttgccgccgggatcgccgtgctgaataccgggcatcgccatcctaaagttatcgccgccgtcgaaaaacagcttcacgcctttacccataccgcttatcaaatcgtcccttatgaaggctatgtatcgcttgccgagcgcatcaaccagcgcgtacccatagaggggccagccaaaaccgccttcttctcaacgggggcggaagcggtcgaaaacgcggtgaaaatcgcccgcgcgtacaccagacgttccggccttatcaccttcggcggcgcgttccacggccgtacctttatgaccatggcgctgaccggcaaagtggcgccctataagctcggcttcggcccgttccccggctcggtgtaccacgcgcaattccctaacagcctgcacggcgtcagtaccgccgaagcgttaaaaagcctggagcgcatcttcaaagccgatatcgcgcccgatcaggtggcggcaatcattattgaaccggttcagggcgagggcggattcaacgtcgcgcccgctgattttatgcaggcgctgcgtgccctgtgcgatacccacgggattttactgattgccgacgaagtgcaaaccggcttcgcccgtaccggcaagctgttctccatggaaaaccactgcgtgaagcccgatctgatcactatggcgaaaagcctggcgggcgggatgccgctttctgccgtctctggccgggcggaggtgatggatgcgcccgcgccgggcggacttggcggaacctacgcaggtaacccgctggcgattgcggcggcccatgcggtgctggatgtgattgacgaggacgatctctgcacccgcgcggcgcatctcgggcatcatctggtcgaggtgctgaataaagcgaaggatggctgtccgtatatcgccgatatccgtgggcaggggtcgatggtggcggtggaatttaccgatccgcaaaccggacagccgtcgccggaatttacccgtcaggttcaggagcgcgcgttgaacgaagggctgctgcttttgagctgcggcgtttacggcaacgttattcgcttcctctacccactcaccatccccgaagcgcagtttcgtaaagcgctggatattatttccgcctcgctgacacgataa

SEQ ID NO: 3625 - DNA, 336 bp, Enterobacter cloacae
aagtacagaatgctttttaaccataataaaacaaaatataaacacgacatcacgaatggggattcagagatgaaaaggaacgcgaagacgttaatcgcggggatggtcgcactgtcgatctcgcatgccgctatggcagacgacattaaagttgcggtagtgggggcgatgtccggccctgttgcccagtggggtgacatggagttcaacggcgcgcgtcaggccatcaaagatatcaacgccaaaggcgggatcaaaggcgacaagctggtgggcgtggagtatgacgacgcctgcgatccagtgttgacgcccggggctagaattaacgcgtcc

SEQ ID NO: 3626 - DNA, 1098 bp, Enterobacter cloacae
cgtgatgcctccttaacgggcccacgctttttattgtgtgcatggtgttttgtcttcttaaaagggttgtctatgtctgctgctcatctcggtttcccgacggaaaccgttgttgtcttcgtggtgatggccgttggggcgatgtttatcgacctcttcatgcaccgtcacgataaaccgatctcgctgaaaagcgcggttatgtggtccatcttctgggtcatgatggcgatggccttcgccggatttttatacgtgcaccacggcgcggagatggccagtctgttcctgaccggctatgcgctggaagaggtgctctccgtcgacaacctgtttgtgatgatggcgatcttcgcctggttcggcgtgccggatagatatcgtcaccgcgtgctctactggggcgtgctcggggcgattgtgttccgcggtatttttgttgccatcggcaccagcctgctgagcctggggccgtatgttgaggtcatttttgcgctggtcgtcggctggacggcggtgatgatgctgaaacgcaatgaagagagcgatgaagtagaagattattccaaccatctggcgtaccgcctggtgaaacgcttctacccggtgtggccaaaaatcagcagccatgcgtttatcctgacccagaaagaggtggatgccgaactggagaagcctgaaaacaaggatgtaatggtaggccgcgtgaagaaggcgaagcgctacgcgacgccgctgctgctctgtgttgcggtggtggagctgtccgacgtgatgttcgccttcgattccgtacccgcaatcattgccgtcagccgtgagccgctgattatctacagcgcaatgatgttcgcgatcctcggcctgcgtaccctctactttgtgctggaagcgctgaagcagtatctggtgcatctggagaaagcggtggtgttactgctgttcttcgtggcgttcaagctggggctgaatgcgaccgaccacttctggcatcacggttataacatcggcgccacggcaagcctgtttgtggtgctgggggtactggcgctggggattattgcgagcgtgatgttcccgggaaaacgtgaggcctga

SEQ ID NO: 3627 - DNA, 546 bp, Enterobacter cloacae
aggggtacgatcgtctcatcaaaacaaaggagacatcgtatgagcaccttcgataaacatgatttaagcggcttcgtcggcaaacatcttgtatatacctacgataatggctggaattacgaaatttacgttaaaaacgaaaacaccctggactaccgtattcacagtggtctggttggcaaccgttgggtgaaagatcagcaggcctacatcgtccgtgttggggagagcatctataaaatttcctggacggagccaaccggtactgacgtgagcttgatcgtgaacctgggcgaccgcctgttccacggcaccatcttcttcccgcgctgggtcatgaataatccggaaaaaaccgtctgcttccagaacgatcacattccgctgatgaatagctaccgtgatgccggaccagcgtatccaaccgaagtgattgatgaatttgccgccatcaccttcgtgcgtgactgcggtgcgaatgacgatagcgtgatcaattgcgcggccagcgagctgcctgcaaacttcccggaaaatttaaaataa

SEQ ID NO: 3628 - DNA, 246 bp, Enterobacter cloacae
acggccgtaaccggccacagcagggcggtaaacgccttacgccccagcagttggcagacgcgcagcatcaggcgcatgccccataatcctttcacctcctgctgctgcgcccagtgctgcgagcggcgacgcatcagcagggaaggaatgcgcggcagcatgctgagaaacagacgggtatgcatcaacgagatgcgcacgttgtctttcagggcatcgaaatgggataccccgtccggcggatag

SEQ ID NO: 3629 - DNA, 285 bp, Enterobacter cloacae
cggggcgtaaactacagccgtttttacctgaacgagaagaaaatgaccgacctgttttccagcccagaccacacgcttgatgctcagggcctccgttgcccggagccggtaatgatggtgcgtaaaaccgtccgtaacatgcagagtggcgaaacgctgctgatcgtcgccgatgacccggctaccacccgtgatatccccggcttttgtaccttcatggaacatgaactggtggcgcagcaaaccgagaccttgccgtaccggtatttgattcgtaaggggtaa

SEQ ID NO: 3630 - DNA, 1002 bp, Enterobacter cloacae
cgcttatctcactaccctggagttgacttaatgaaaacgaccctcaagccgttactggccgcgctgtgtctgactgctttcgcctgcaccgtttctgcccagaccattaaagccgccgatgtgcatcccgaaggctacccgaacgtggtggcggtccagcacatgggtgaaaaactcaaacaacaaaccgatggcaagctggagattaaggtcttccccggcggcgtgctgggggatgaaaagcagatgattgagcaggcgcagatgggggcgatcgacatgatccgcgtctccatggcaccggtggctgccatcctgccggatatcgaagtgtttaccctgccctacgtattccgcgatgaagaccacatgcacaaggtgatcgacggggatatcggcaagcagatcggcgacaaactcaccgccaacccgaaatcgcgtctggtcttccttggctggatggattccggcacccgcaacctgatcaccaaagagccgatcgtcaaaccggacgatctgaaagggaagaaaatccgcgtgcagggcagcccggtggcgctggccacgctgaaagcgatgggggcgaactcggtggcgatgggcgtcagcgaggtttacagcggcatgcagaccggggtgatcgacggcgcggagaacaacccgccaacctttatcgcccacaactatatgccggtcgccaaaaactacacgctgagcggccacttcatcaccccggaaatgctgctctactccaaagtgaaatgggacaagctcagcgctgacgaacagcaaaagatcctgacgctggcccgcgaagcgcagttcgagcagcgcaagctgtggaatgcgtataacgaccaggcgctggcgaaaatgaaggccggcggcgtgcagttccacgacatcgataaaacggtgtttatcaaggcgacagagccggtgcgcgcgcagtatggcgataagcatcaggatctgatgaaagccatcgctgacgttcagtaa

SEQ ID NO: 3631 - DNA, 522 bp, Enterobacter cloacae
gccggagtacgtatgtccgaactctacctgaagtggatggaccgtctgtacctgctcgccatggtggtggcgggtctctcgctactggtgatgacgattgtgatccccattggcatcttctctcgctatgtgctcaatcgcggcgaatcctggccggagccgatcgccattatctgcatggtgacgtttacctttatcggcgcggcggtgagctatcgcgccgggtcgcatatcgcggtcaacatgctcaccgaccgcctgcccgcgtcgctgcaaagagtgtgcgcgcgagtggtagatctgctgatgctgctcatctccggcctgatgtgctggtacagctactggctgtgcgtcgagctgtgggagcagccggtggcggagtttccgctcctgacctccggcgaaagctatctgccgctgcctgtcgggtcggccattttgatcctgtttgtgcttgaacgcctgctgtttggctcgcaggaaaaccgtccggtcgtgctgatcggcaatcacagttaa

SEQ ID NO: 3632 - DNA, 1467 bp, Enterobacter cloacae
tcgcagatggcaaaacaaaaaaaacgtggcttcttttcctggttgggtttcggtgaaaaagagcaagaaacagaacagaaaaccgaagaacagcaggttgtagaagagcagtcacagcctgaaacgcctgtcgaaaccgctgcggttgtcgaagcggaagagccagcgcacagcaaagaagagattgaatcctttgctgaagaggtggttgaggtcactgagcaggttcaggagagcgagaagccagagccggttatcgttgaaacccttaccgaagcgccgcaggccgctatcgaacacgaagcgctgccgctgccggaagaggttaaagctgaagaggtttctgccgaagagtggcaggccgaagcggaaaccgttgaaattgttgaggcggtggaagaagaggcggcacttgagccagagctgaccgacgaagagctggaagcccaggcgctggcggcggaagcggctgaagaagcggtcatcgtcgtaccggtggaagagcaggccgaagaagagatcgttcaggagcaggaaaaaccgacaaaagaaggtttcttcgcgcgcctgaaacgcagcctgctcaaaaccaaagaaaacttaggttccggatttatcagtctgttccgcggcaaaaagatcgacgacgatctgtttgaggagctggaagagcagctgcttattgcggacgtgggcgtggaaaccacccggaagatcatcgctaacctgactgaaggggcgagccgcaaacagctgcgtgacgccgaggcgctgtacggcctgctgaaagacgagatgggtgaaattctcgcaaaagttgacgaaccgcttaatattgaaggcaaaatgccgtttgttatcctgatggttggcgtcaacggcgtgggtaaaaccaccaccatcggcaagctggcgcgccagtttgagcagcagggcaaatcggtgatgctggcggcgggcgataccttccgtgcggcagcggtggaacagctccaggtgtggggccagcgcaacaatattccggtcattgctcagcacaccggcgcggattccgcgtccgtgattttcgatgccatccaggcggcgaagtcgcgtaacgtggacgtgctgattgcggataccgcggggcgtttgcagaacaaatcgcacctgatggaagagctgaagaaaatcgttcgcgtcatgaagaagctggacgaagatgcaccgcatgaaattatgctgactatcgacgccagcaccggacagaacgccatcagccaggcgaagctgttccatgaagcggtaggactgaccgggatcacgctgaccaagctggacggcaccgcgaaaggcggggtgatcttctccgtggccgaccagttcggcattcctatccgttacatcggtgtgggcgagcgtattgaggatttacgtccgtttaaagcggacgactttattgaggcactatttgcccgagaggactaa

SEQ ID NO: 3633 - DNA, 1083 bp, Enterobacter cloacae
gcgatgggcatttgcacggaggccacggtgaacaagcgtgatgcaatgaaccagattcggcagttcagcaaccggtttgaccgtttccgcaagcctcagggcggtggtgacggcaatcgcaatgcgcctaagcgtgccaaagcgacaccgaaaccgaactcccgcaaaaccaacgtctttaacgagcaggtgcggtatgccttccagggcgcgttgcaggatctgaaaagcaaaccgctggcgacgttcctgacggtgatggtgattgccatctccctgacgctgcccagcgtctgctatatggtttacaaaaacgtaaaccaggcggcgtcccagtactatccgtcgccgcagatcaccgtttatctggataaagccctcgacgataacgcggcggctcaggtggtggggcagattcaggccgagcagggcgtggagaaggtgaactatctttcccgcgatgaagcgctgggcgaattccgcaactggtccggattcggcggcgcgctggatatgcttgaagagaacccgctgcccgcggtggcggtggtgatcccgaaactcgatttccagggcacggattcgctcaacaccctgcgcgaccgcattacccgcattaacgggattgatgaagtgcgcatggacgacagctggtttgcccgtcttgccgccctgaccgggctggtaggacgcgtgtcggcgatgatcggcgtgctgatggtggcggcggtgttcctcgtcatcggtaatagcgtgcgcctgagcatcttcgcccgtcgcgataccatcaacgtgcagaaactgattggcgcaacggatggtttcatcctccgcccgttcctttacggcggcgcgttattaggtttttctggtgcatttctttcattgattttgtcagaaattttggtgatgcggctgtcgtcagccgtcaccgaggtggcgcaggttttcggaactaagtttgatatcagtggtttaggtttcgatgagtgcctgctgttactgctggtgtgctccatgatcggctgggtggcggcatggctggcaacggttcaacatttacgccactttactcccgactaa

SEQ ID NO: 3634 - DNA, 1290 bp, Enterobacter cloacae
acaatggatgcttttgttttgttattcaccctcgccattttgctggcgctggggatgccggtggccttcgccgtcggcttaagcgccgtggcgggcgcgctgtggattgacctgccgctggaggcgctgatgatccagatcaccagtggagtgaataaatttaccctgctggcgatcccgttcttcattcttgccggggcgatcatggcggaagggggtattgcccgacggctggttaacttcgcgtacgtttttgtcggctttattcgcggcgggctgtcgctggtgaacatcgtggcatcaacgttcttcggcgcgatttccggctcgtcggtggcggatacggcgtctatcggcagcgtgatgatcccggagatggagaagaagggctatccgcgcgaatacgcggcggcggtgacggccagcgggtcggtgcaggcgatcctgatcccgcccagccacaactcggtgatttactccctggcggcagggggaacggtttccatcgccacgctgtttatcgcgggcgtgctgccgggtctgctgctgggcgtgagcctgatggtgctctgcctgtgcttcgcccgcaagcgcggctatccgaagggggacaaaatcccgttcaggcaggcgctgaaaatcatgctcgatgccctgtgggggctgatgacggtggtgattatcctcggcgggatcttgtccgggatattcacggcgaccgaatctgccgccgtggcctgcctgtgggcgtttttcgtcactatgtttatctaccgcgactataaatggagcgaactgccgaagctgatgtgccgcacggtgaaaaccgtcaccatcgtgatgattttgattggctttgccgcggcgtttggcgcggtaatgacctacatgcagctgccgatgcgcatcaccgaattcttcacgtcgctctccgataacaaatacgtgatcctgatgtacctcaatatcatgctgctgctgattggcacgctgatggacatggcgccgatcatcctgatcctgaccccggtgctgctgccggtgaccaactcgctggggatcgacccggtgcatttcgggatgatcatgatggtgaacctggggattgggctgatcacgccgccggtcggatcggtgctgtttgtggcgagcgcggtgagtaagcagaagatcgagcacgtggtgcgggcgatgctgccgttttacggtatgttgctggtggtgctggggatggtgacgtacatcccggcgatttcattgtggttgccggggctgctagggatgcagtga

SEQ ID NO: 3635 - DNA, 369 bp, Enterobacter cloacae
tgggatttttcaatgagcaagatgccgctgtttttcattatcgtggtggcgattatcgtcattgccgcctcgttccgcttcgtgcagcagcgccgcgagaaggcggataacgatgccgcgccgctgatgcaaaagcgcgtggtggtgacgaacaagcgcgagaaaccgcttaatgaccgccgatcccgccagcagcaggtgacgcctgcgggcacaacaatgcgttatgaagcgagctttaagccggaaaccggcgggctggagatgaccttccgcctggaggcgcagcagtaccatcagctgacggtgggagagaaaggcacgttgagctataaagggtcgcgttttgtaggttttagggctgaataa

SEQ ID NO: 3636 - DNA, 858 bp, Enterobacter cloacae
atgaccaaagaaatgcaaactttagctttagcccctgttggtaacctggaatcttacatccgggctgcgaacacctggccgatgttaacggctgaggaagaaaaggagcttgctgaaaagctgcattaccagggcgatctggaagcagctaaaacgctgatcctgtctcacctgcgctttgttgttcacgttgctcgtaattatgcgggctacggcctgccgcaggcggacctgattcaggaaggtaatattggcctgatgaaggcggtacgtcgctttaacccggaagtgggtgtgcgactcgtctccttcgccgtgcactggatcaaagcggaaattcacgaatacgtcctgcgtaactggcgtattgtgaaagtcgccacgacgaaagcgcagcgcaaactgttcttcaacctgcgtaaaaccaagcagcgtctgggctggttcaatcaggatgaagtggaaatggtggcgcgcgagctgggcgtttccagcaaagacgtccgcgagatggaatcccgtatggccgctcaggacatgacgtttgatatgtctgccgacgatgacgcgtccgacagccagccgatggccccggttctgtatctacaggataaaacctctaactttgctgacggcattgaagaggataactgggaagaccaggcggcgaacaagctgaccttcgcgatggaaggcctcgacgagcgtagccaggatatcatccgtgcccgctggctggacgaagataacaagtccacgttgcaggaactggccgaccgctacggcgtctccgctgaacgtgtgcgtcagcttgaaaagaacgccatgaaaaaacttcgcgccgctatcgaagcgtaa

SEQ ID NO: 3637 - DNA, 1164 bp, Enterobacter cloacae
aataaagcgctacacaacaacatcacaacaatcgttataaccataataatggggaatctcaggatgaacatgaagggtaaagcgttactggcaggatgtatcgcgttggcattcagcgccatggcgcaggccgatattaaagtggccgtggtgggtgcgatgtccggtccggtagcacagtacggcgaccaggaatttacgggcgcggaacaggcggttgcagacattaatgctaagggcggcatcaagggcgaaaagctgcaaatcgtaaaatatgacgatgcctgtgacccgaaacaggcggtcgcggtggcgaacaaagtggtaaacgacgggatcaaatacgttattggtcacctgtgctcctcttccacccagcccgcgtctgacatctacgaagacgaaggcattctgatgatcacaccggccgcgacggcgccagagctcaccgcgcgcggctataagctgatcctgcgtaccaccggtctggactccgatcaggggccaaccgccgcgaaatacatcgtggaaaaagtgaagccgcagcgcatcgcgattgttcatgacaaacagcagtacggcgaaggcctggcccgtgcggtgcaggataacctgaaaaaagcgaacgccaacgtggtgttctttgacggtatcaccgccggtgagaaagacttctcgaccctggtcgcgcgtctgaagaaagaaaacatcgatttcgtttactacggcggctaccacccggaaatggggcagatcctgcgtcaggcgcgtgcggcgggtctgaaaacgcagttcatggggccagaaggtgtcgcgaacgtttccctgtctaacatcgcgggtgaatccgctgaaggtctgctggtgaccaagccgaagaactacgaccaggtgcctgcgaacaaacctgttgtcgatgccatcaaggcgaagaaacaggatccaagcggtgcattcgtctggaccacctacgcagcgttgcagtctctgcaagcgggcctgaaccagtcagccgatccggcggagattgccacctggctgaaagcgaactcggtggaaaccgtgatggggccgctgtcctgggatgagaagggcgatttgaagggcttcgagttcggcgtgtttgactggcatgccaatggcactgctactgatgccaaataa

SEQ ID NO: 3638 - DNA, 2394 bp, Enterobacter cloacae
ggaacattcatgttacggtacagtctcttaaccgccgggcttatgctcggcgcctccgcctttgccgcaccggcaggcgaccttcccttaatgccctggcctgcgaaggttgaacgcccgaccactcagggcgcgctggagcttaacaatcaactcaccgtgagcgtaagtggcgacgatctgggggatgcggtcaaccgcctgcgccagcgcatcgcccttcaaaccggctggacgctacagccgcaggccgaaaaacctgacaagccgaccatccgcatcgccatcgccaaaaaggtgaagccgcagccgctgccggacagcgatgagagctataaactcacggtggacgccaacggcgtaaatatctccgccaatacccgcttcggcgcgctgcgcgccatggaaaccttgcttcagctgatgcagaacggcgccgaaaacacctcgatcccgtgggtgaccattgaagattcgccgcgcttcccgtggcgcgggctgctgctcgattcggcgcgccacttcctcccgattccggatattaaacgccagatcgacggcatggccgcggcgaagctcaacgtgctgcactggcatttgaccgacgatcagggctggcgcttcagctcaaagcgctaccctaagctgacccagcttgccagcgacgggctgttctacacccctgagcagatgcgcgagattgtgcgttacgctgccgaacgcggcatacgcgtggtgccggaaattgatatgccgggccacgcgtcggcgattgccgtcgcctacccggagctgatgagcgcgctggggccatacgccatggagcgccactggggcgtgctgaagccagtgctggatcccaccaaagaggcaacttatacctttgccgacgcgatggtcagcgaactggcggcgatcttcccggatccatatctgcatattggcggcgatgaggttgacgacagccagtggaaagcgaacgctgcgatccagagattcttgcgcgacaacaaactggcggacagccacgcgttgcaggcgtatttcaaccgcaagctggagacgatccttgagaagcaccaccggcagatggttggctgggatgagatctaccatcccgatctgccgaaaagcattctgatccagtcctggcagggacaggacgcgctggggcaggtggcgcagaacggctataagggcattctctcaaccggtttctacctcgatcagccgcaatccaccgcctaccactaccgcaatgaaattgtgccgcaggggctgaacggcgtggatgtgatagcggacaccgacagcgtccagagctgggctttctccatgccgcgtctgaaaggcaagccggtggaaggcagctttacgctggtgaaaggcgatgctggctggcgcggatttattgattttgccgggaaatcgcgtcgggcggtggataacattcagtggcgggacgacaatcaggtaacgtttaccgttgatacctggatgggtgaaacgcgtccggtcgtttctgttgagaacgataagctcagcggctatttcctggtgggtaacgcccgctacccgattagcggcacgcgtctggacgcggtcccaaaaggcataccgccggtggtgccggacccggcgaacgaggccaatctgctcggcggtgaagccgcgctgtgggcggaaaacgtggtcgcgccggtgctggatatccgtctgtggccgcgcgcctttgcggtggcggagcggctatggtcggcgaaggacgtcaacgacatcgacaacatgtatacccggctccaggcgatggacagctggtcgacggtgtcggctggactacagcagcatacccagcagcaggtgcagttcacgcgcctcgccaacaatgcggatacccttccgctgcaaattctcacccaggcgcttgaaccggcgcagtattacacccgccagcatcttaagttccaggctggaaactatcatcagtttgagccgctcaaccggctcgctgatgcgctaaacgcggaaagtgcgaccgtgcgtcagatgaataaatgggcggaccgtctggtgagcgacgcggaagacacggaaagcgccgacgcgctgcgccacgtctttaaccgctggcagaacaacaccagcgacgcgctggcgctaagcgaaaacagctatcagttgaaggccattaagccggtgatccaggaggtggataagctggccgcgattggcctgaggctgacggatctggtggcgcgccagggcacgctggatgataaagagattgcgtcgatccagagcgaactggataacgcggcgaaggttcaggacgaggtggtgattgcggcggtgtacccgctggaaacgctgctgcgcgcgacgcggaatcagtag

SEQ ID NO: 3639 - DNA, 468 bp, Enterobacter cloacae
tctgagggttgtatcatgattattggcaatattcatcatctccagtcctggctgccagaagagctgcgtcaggccattgagcacgttaaggcccacgtcaccgacgcgacgccgaccggcaagcacgacatcaacggcaacagcctgttttatctggtttcggaggacatgacccagccgttcgccgagcgtcgtgctgaataccatgcacgctatctggatattcagattgtgctgaaggggcaggaagggatgaccttcagtaccctgccgcacggtacgccggacaccgactggctggcggacaaagacatcgcgttcctgccggaaggcgagcaggagaaaaccgtggtgctaagcgaaggggattttgtggtgttctggccgggtgaggtgcataagccgctgtgcgcggtgggggcacctgctaaggtcaggaaagtggttgttaaaatgctggtggagtaa

SEQ ID NO: 3640 - DNA, 429 bp, Enterobacter cloacae
gccatggcaaacccggaattactggaagagcaacgcgaagagacgcgtctgattattgaagagctgctggaagacggtagcgatccggacgcgctgtacaccatcgagcaccatttctctgcggatgatttcgacgcgctggaaaaaatggccgtggaagccttcaagctgggttacgaagtgaccgagcctgaagagctggaagtggaagagggcgacaccgtcatctgctgcgacatcctgagcgaaggcgcgctgaaggcggagctgatcgacgcgcaggtcgaacagctgatgaacctggccgagaagtttgaggtggaatacgacggctggggaacctacttcgaagatccgaacggtgaagacggcgaagagggcgacgacgaagattacgtcgacgaagacgacgacggcgtgcgtcactaa

SEQ ID NO: 3641 - DNA, 3330 bp, Enterobacter cloacae
gtcacgggatggggaatggacagtaacactcagggattcacttcatactggcgtaataccttagctgacgccgagtctggaaaaggggcatttgagcgcaaagatgaagagtcatttactcagtggatgaatgtcgatcggggaaggttggatgaagagatcgtgcaagcgttcttcgagggcgaagacgagcaggttaagaccgtcgaggtaatgttacggccgcaggtatggatccgcctgttaaagcatggcaaggaacggacggcaggcgcaccaggtatagttacgcctctggttacttccgcactgttgaaccgagaaggctttttgttcccagcatctcctgcaaccattccccgagacctgcttgaacctctccctaaaggtaccttttctattggtgagatgacggaatatgacaggtacaaaaccacacatgattcggtcacttttggtccaggagatgaggatgaaaagcgcgaggaaacagacgaacagcgggcggaacgatatgcgcgctataagcagttgtggcaaacgtaccttaaagagacaaatgaacttttaaaaagtgtggccgggaaatggctcgatgcaccagagcaatatgagccggctggatatggctatgtgattaaagccaaccagtctggcggcgccagcattcatattctgcccatgtacgatcatttactgtcgtgcaaaaaagaggtgccattactggcacgctttgcctcaaaggataaatctcctgttgagccgctccttgccagtaatgccatgttcactgagcgtctgggccattctggcgacaaatttcctctggctgtcgcacagcgcgatgccctgagccattatctcactcagcagccgggcgatattcttgccgtcaacggtcctccgggaaccggaaaaaccacactggtgctctctatcattgccacggagtgggcgagggcggcgcttaacaaaactgaaccgccagtggtgattgcgacttcaaccaacaaccaggcggttaccaacattattgaggcgttcggaaaagattttgctaccggcagcgggcctatggccggacgttggttacctgatgtaaaaagctttggcgcttacttcccgtcttcaagccgaaaagccgaggcagcaaaaaaataccagacggaagacttttttaaccgcgttgaatcccttgaatatgtagaagatgcccggttctttttccttgaaaaggcaagtgcagcatttccgactgtggaatgccattcacctgaacaggttgtggatctcttgcatcagcgtttagttgaactctctgcagagcttgagcaaatcgagcctgcgtgggacgccctgaacgccatccgcgaggagcggagcgccgtcagcgacgatctcgaacagtatattgaggataaaagaacgtcactgcttaatagcacaaatgaaatctcgttattaacgcagggtaaaaaacagtgggaacaatatcgcgccggtgagtcgttcatgttcgctctcttctcctggcttcccgccgtgcgtactaagcgtcactatcaaatgaagctgtttttagaggctacgtttggcgaaagaatgacagcattccagggcgctctgcccgatggaattgatgcctttatcaatggcctgattgaacaagcgcgtaaagagcaggccgggtatcagcagcaaatggatcttgctgaggacatttcccgacgtgaaagcgaagcagctatgcgctggcaccatattactcactcactggggaatccgggcgaaacagagttaagtctgcacgaagccgatgagcttgccgatacacagctccgtttcccaatgtttttgctggcgacgcattactgggaaggtcggtggctgatggatatggctgccatagataatattcaaaaggaaaaaggtcgtactggtgcgaaaagtacaaaggcccgctggcaacgtagaatgaagctaaccccctgtgtagtcatgacgtgcttcatgtttccttaccatatgaaaaccagcgaatttgtcggcggcaataagaaattcgacgataactatttatataactttgccgatttactaattgtcgacgaagcggggcaggtgcttcctgaggttgccgcagcctccttcgcactggcgaagaaagccctggtgattggtgacacagaacagattgcgcctatctggaatagtttgcccggtattgatatcggcaacatggttgaggagaatatccttcctggtggtactcaagaagaacttaccgaatcttatgccctggtgtgtgactcaggaaagagtgctgcatctggcagtgtcatgaagatcgcccagtttaactcgcgctatcaatatgatccggactttgcgagggggatgtatctgtacgaacaccgtcgctgtttcgataacatcattggctactgtaacaccctctgctatcacggtaagttgcagcccaaacgaggggaagaaaaagagacaatatttcctgcaatgggatatttgcatattgatggtaaaggtatgcaggctagtggaggaagccgttataacgcatttgaagctgagacgatagctgcgtggctagctgcgcacaaagaggaaatcgagcgtcattatggcgaacctctacataaagtagtgggggttgttaccccattttcggcacaagtcagtacgattaaatcgtcattacgtaagctggatattaattgtagtggcgatgaaaattcgctgacagtcggtactgttcattcattgcaaggggcggaaagggcgattgtgctgttctctcctgtatattcgaagcatgaagatggcagttttattgacagcgacagcagcatgctgaacgtcgccgtttcgcgtgcgaaagatagcttcctggtctttggcgatatggacctctttgagatccaacccggttcttcacctcggggactgctggcaaaatacctgtttgcttccactgataatgcgttgcagtttgagtttcaggagcgccaggatttaagtacatcgcaaacgcagatttcaaccctgcacggggtggagcaacatgatgcgttcctgaaccagacttttgacgctattaatcagagtattactatcgtttccccgtggctcacctggcaaaagctggaacagacaggttttctggcgtcgatgtctcaggcgcgcgcccgtggcattgatatcactgtagtaacggataaaacctttaatacagagcatacagattttgaaaagcggaaagagaaacatcagctgacctgctccccgttgattagtacaccccgatgttag

SEQ ID NO: 3642 - DNA, 294 bp, Enterobacter cloacae; identical to SEQ ID NO: 235

SEQ ID NO: 3643 - DNA, 2775 bp, Enterobacter cloacae
caggtacggctttgccacgcctgcgggaaagactgcgtccgcctttgcggatgcgggggaatgactatgctgaaaaatatcacccggcagctgcaagcgctgctgagccgtcacctgccacatcgcctgattgcgcgcgatccgctgccaaatgccaacaccatggcgggagcggcaatccccgcttccctgaccgagcgctgcctgaacgtggcggcgatggatgaaaacgaagtctggcgcgcctttggcggccacccggaagggctgaacgcgcaagaagtgtcaaaaatccgcgcggaacatggcgataaccagatcccggcgcagaaaccctctccctggtgggtccacctgtggctctgctaccgcaatccgttcaacctgctgctgacggtgctcgggattatctcttacgccactgaagatctgtttgccgcaggcgtgattgccctgatggtagggatctccacgctgctgaactttattcaggaagcgcgctccaccaaagcggcggatgcgctgaaagcgatggtcagcaacaccgccaccgtgtcgcgcgtgattaacgacctcggcgaaaacgcctggattgagcttcccattgaccagctggtgccgggcgatctggtgaagctggcggcgggggacatgatcccggcggatttacgtatcatccaggcgcgggatctgttcgtcgcgcaggcgtcactcaccggtgaatccctgcccgtagagaaggtggcgcggacccgcgatccgcagcagatgaacccgctggagtgcgacaccctgtgctttatgggcaccacggtggttagtggcaccgcgcaggcgattgtcaccgccaccggcggcaatacatggtttggacagcttgccggacgcgtcagcgagcaggagagcgagccgaatgcgttccagaaaggcattggtcgcgtcagcatgctgctgatccgctttatgatggtcatgacgccaattgtcctgctgatcaacggctacaccaaaggcgactggtgggaagcggcgctgttcgcgctctccgtggccgttggcttaacgccggaaatgctgccgatgattgtcacctccacgctggcgcgcggggcggtcaaactctctaaacaaaaggtgatcgttaaacacctcgacgccatccagaactttggcgcgatggacattctttgcaccgataaaaccggcaccctgacccaggacaaaatcgtgctggagaaccacaccgatatcgccggaaagaccagcgaacgggtgctgtacagcgcgtggctgaacagccactaccagaccgggctgaaaaacctgctcgacgtggcggtgctggaaggtgtggatgaagagtctgcccgcatgctctccgggcgctggcagaaggtggacgaaattccgttcgactttgaacgacgccgcatgtcggtggtggtcagcgagcagccggacgtgcatcagctgatctgcaaaggggcattgcaggagatcctgaatgtttccacgcaggtgcgccataacggcgagatcgtgctgctggatgagaccatgctgcgccgcatcaaacgcgtcaccgataacctgaaccgccaggggctgcgcgtggtggcggtagccagcaagttcctgcccgcgcgggaaggggactaccagcgtatcgatgaatctgatttgatcctcgagggttacatcgcattcctcgatccgccgaaagagaccaccgcacctgcgctgaaagcgctgaaagcgagcggtatcaccgtcaaaattctcaccggcgacagcgagctggtggcggccaaagtgtgccacgaagtcggcctggacgcgggcgacgtcgtcgtggggagcgacattgagctcctgtctgacgatgagctggccgaccttgcccaacgcaccacgctgtttgcccgcctgacgccgatgcataaagaacgcatcgtaacgctgctgcgtcgcgaagggcatgtagtgggctttatgggcgacggcatcaacgatgcgccagccctgcgtgcggcggatatcggtatctccgtagacggcgcggtggatattgcccgcgaagcggcggatatcattctgctggaaaagagcctgatggtgctggaggagggcgtcatcgaagggcgtcgcaccttcgccaatatgctcaaatacatcaaaatgaccgccagctcgaacttcggcaacgtcttcagcgtgctggtggcgagcgcgtttctgccgtttctgccgatgctgccgctgcatctgctgatccagaacctgatgtacgatgtctctcaggtcgccatcccgtttgataacgtggacgacgagcagatccagaagccgcagcgctggaaccccgccgatctggggcgctttatgctgttctttgggccgatcagctctatcttcgacattctgactttctgcctgatgtggtttgtgttccatgcgaatacgccagaacaccagacgctgttccagtccggctggttcgtggtgggactgctgtctcagacgctgattgtgcacatgatccgcacccgccgcattccgttcatccagagccgcgccgcgtggccgctgattgtgatgacgggcattgtgatggcgctcgggatcgcgctgccgttctcgccgctggcaagctacctgcaactccaggcgctaccgctgagctacttcccatggctggtggcgatcctcgcgggttacatggtgctgacgcagatggtgaaggggttctatagccgtcggtatgggtggcagtaa

SEQ ID NO: 3644 - DNA, 2025 bp, Enterobacter cloacae
ggcgcagctgaaaaccctgctgcaacagctcaagctctgctgagctggacgataaccatgaccatcgagaaaattttcaccccgcaggatgatgcgttttatgcggtgatcacccacgcggcggggccgcagggcacgctgccgctgacaccgcagatgctgatggaatcccccagcggcaacctgttcggtatgacgcagaacgccgggatgggttgggatgccaacaagctcaccggcaaagaggtgctgatcatcggcacccagggcggcatccgcgccggagacggacgcccggtcgcgctgggctaccacaccgggcactgggagatcggcatgcagatgcaggcggcggcgaaggagatcacccgcaacggcgggatcccgttcgccgccttcgtcagcgatccgtgcgacggtcgctcgcagggcacgcacggcatgttcgactccctgccgtaccgcaacgacgcggcgatcgtgtttcgccgcctgatccgctccctgccgacgcgccgggcggtgatcggcgtggcaacctgcgataaagggctgcccgccaccatgattgcgctggcttccatgcacgatctgccgaccattctggtgccgggcggggcgacgctgccgcccaccgtgggggaagacgcgggcaaagtgcagaccatcggcgcgcgcttcgccaaccatgagctctccttgcaggaggccgccgagctgggctgtcgcgcctgcgcgtcgccgggcggcgggtgtcagttcctcggcacggcgggcacctcgcaggtagtggcggaggcgctgggtctggcgctgccgcactctgcactggcgccgtccgggcaggcggtgtggctggagatcgcccgccagtcggcacgcgcggtcagtgaactggataaccgtggcatcaccacgcgcgatatcctcaccgataaagccatcgaaaacgcgatggtgatccacgcggcgttcggcggctccaccaatttactgctgcacatcccggccatcgcccacgcggcgggctgcacgatcccggatgtagagcactggacgcgcgtcaaccgcagggtgccgcgcctggtcagcgtgctgcccaacggcccggactatcacccgaccgtgcgcgccttcctcgcgggcggcgtgccggaggtgatgctccacctgcgcgatctcggtctgctgcacctggacgccatgaccgtcaccggccagacggtgggcgagaacctcgactggtggcaggcatccgagcgccgtaagcgcttccgccagtgcctgcgcgagcaggatggcgtggatccggatgacgtgatcctgccgccggagaaggcaaaagcgaaagggctgacctcaacggtttgcttcccgacgggcaacatcgcgccggaaggctcggtgatcaaggccacggcgatcgacccgtcggtcgtcggtgaagatggcgtttaccgccacaccggccgggcgcgggtgtttgtctcggaagcgcaggcaatcaaggccatcaagcgggaagagatcaagcagggcgatatcatggtggtgatcggcggcgggccgtccggcaccggcatggaagagacctaccagcttacctccgcgctgaagcatatctcgtggggcaagacggtatcgctcatcaccgatgcgcgattctcgggcgtgtcgacgggggcctgcttcggccacgtatcgccggaggcgctggcgggcgggccgattggcaagctgcgcgataacgacatcattgagatagccgtcgaccgactgacattaacgggcagcgtgaactttatcggcaccgcggataacccgctgacgccggaggagggcgcacgcgagctggcaatgcggcagacgcacccggacctgcacgcccacgactttttgccggacgacacccggctgtgggcggcattgcagtccgtgagcggcggcacctggaaaggctgtatttatgacaccgataaaattatcgaggtaattaacgccggtaaaaaagcgctcggcatttaa

SEQ ID NO: 3645 - DNA, 1725 bp, Enterobacter cloacae
gctcaccgatgcccgcgtggaggccatcagccagcagctgatcaagcaccgcgcggcgcagggcgaggccgttcccgacgctgcgacagccgcatcccattaaccggaggcactatggaaatcactaaccctattctgaccggcttcaacccggacccgtccctgtgccgtcagggcgaggactactacatcgccacctcgaccttcgagtggttcccgggcgtgcgcatctaccactcccgtgacctgaaaaactggtcgctggtcagcacgccgctggaccgcgtgtcgatgctggacatgaagggcaacccggactccggcggcatctgggcgccgtgcctgagctacgccgacggcaaattctggctgctctacaccgacgtgaagattgtcgactcgccgtggaaaaacggccgcaacttccttgtcactgcgccctcgattgagggaccgtggagcgagccgatcccgatgggcaacggcgggtttgacccgtccctgttccacgacgacgatggccgcaagtactacctctaccgtccgtgggggccgcgccaccacagcaacccgcacaacaccatcgtgatgcaggcgtttgacccgcagactggcacgctctcgcccgagcgtaaaaccctgtttaccggcacgccgctctgctacaccgagggcgcgcacctgtatcgccacgcgggatggtactacctgatggtggccgaaggcggcaccagctacgagcacgccgtcgtggtgctgcgttcaaaaaccatcgacgggccgtacgagctgcacccggacgtgacgatgatgaccagctggcacctgccggagaatccgctgcagaagagcggccacggctcgctgctgcagacccacacgggggagtggtacatggcctacctcaccagccgcccgctgcgtctgcccggcgtgccgctgctggcctccggcgggcgcggctactgcccgctggggcgcgagaccggcatcgcccgcattgaatggcgcgacggctggccgtacgtggaaggcggcaagcacgcgcagctgaccgtgaaaggcccgcagatggcggaacagcctgtatccattcaaggcaactggcgggaggactttgacggcagcacgcttgaccctgaattgcagaccctgcgcattccgttcgacgacaccctcggctcgctcaccgcgcgccccggctatttacggttgtacggcaacgactcgctcaactcgacctttacacagtcgaccgtggcgcgccgctggcagcactttgccttccgggcggagacgcggatgcagttctcgccggttcacttccagcagagcgcggggctgacctgctactacaacagcaaaaactggagctactgctttgtggactacgaggaggggcaggggagaaccatcaaggttattcagctcgaccacaacgtaccgtcgtggccgctgcacgagcagcccattccggtaccggaacatgcggagagcgtctggctgcgggtggacgtggataggctggtctaccgctacagctactctttcgacggcgagacgtggcacgccgtgccggtaacctatgaggcgtggaagctatcggacgactacatcggcgggcggggcttcttcaccggcgcgtttgtggggctgcactgcgaggacatcagcggcgacggctgtcacgcggacttcgactacttcacctacgagccggcctga

SEQ ID NO: 3646 - DNA, 936 bp, Enterobacter cloacae
acctggccgagaagtttgaggtggaatacgacggctggggaacctacttcgaagatccgaacggtgaagacggcgaagagggcgacgacgaagattacgtcgacgaagacgacgacggcgtgcgtcactaagcgtttcaggcggtggcgcgcgccaccgctttttcaaggcagaaccatggattacccgcagatactcgcccccgtactcaacttcctccagtgcccgaccccgcaagcatggattgataaagcccgcgacccggcgaacctgccgctgctgctcaccgaccacatggtgtgcgagctcaaggccgcccagaccgcgctgctgctggtgcgtaaatacgtcgccgacgaaagcggtgccgacgcgctgctcgagtggctcaagccctacgaacagttcaccttccgcgacggcccggagccggacttcatcgccctgcacaggcagattggcaaaagcgtgatgcccaaaaccgacgacccgtggggccaggcgcttatcgacagcatggtgctgctgattaaagaggagctgcaccacttctggcaggtgcgcgaggcgatgctggcccgcgacattccgtacgtcaaaatcaccgccagccgctacgccaaagggatgctgaaggacgtgcgcacccacgaaccgctgacgctgatcgacaagctcatctgcggtgcctacatcgaagcccgctcctgcgaacgcttcgccgcgctggctccgttcctcgacgacgacctgcagaaattctatctctcgctgctgcgctcggaagcgcgccactatcaggactacctgacgctggcccagcaggtgagcgacgacgatatctcaccgcgcatacagctttttggcgaaattgaagccacacttatctcgacaccggacaacgagtttcgcttccacagcggcgtgccggtgtaa

SEQ ID NO: 3647 - DNA, 489 bp, Enterobacter cloacae
ggtatttctatgtctgctcccgcacatttatggcttgaagatgagaatggctcgccgattgtcggttgttgtgcaatgccactgcgtcttggatctattgaattaaaatccttttcccatggcgtaactattccggttgacccaagctggggaaaactcactggtacacgcgtacatcggcctataacaatagtcaaagaatttgatcagacaacgccgcttctttaccgggcagtttgcgaagggcgaaccatgaagaaggcgacaattaaaatgtaccgtattcttgagtctgggattgaggctgagtatttcaaaattattctggaaaacgtcaagttcacaacggtagcgccgtatctctcccccggcagtatgaccagtacccacctggaaacgctggagctgcgctatgaggcaattacctggaagtataccgaaggcaatatcctgtaccgtgattcatggaacgatcgctgttgcgcatga

SEQ ID NO: 3648 - DNA, 222 bp, Enterobacter cloacae
aataatcaattgagcctaatgctatcctgcgaattcgctatgggcaaagtctggtttacgttcggtttatttgcagggcgttataataccgcccgattagtcacaaacggtatggataaatctctatactgcgcgccgatacccaactttttacttaccggaggccacatggatcccgatcccacacctctcctgacccggagaaaaccttcttaccggtaa

SEQ ID NO: 3649 - DNA, 918 bp, Enterobacter cloacae
ggagatcacatgccgcagtccgcgttgttcacgggtatcattccccctgtctccaccatttttaccgccgatggccagctcgataagcagggcaccgccgcgctgatcgacgatctgatcaaagcaggcgtcgacggcctgtttttcctgggcagcggcggcgagttctcccagctcggcgccgaagagcgtaaaaccattgcccaatttgcgatcgatcatgtcgattgtcgcgtgccggtcctgatcggcaccggcggcaccaacgcccgggaaaccattgagctgagccagcacgcgcagcaggcaggggcggacggtatcgtggtgatcaacccttactactggaaagtgtcggaagcgaacctgatccgctatttcgagcaggtggcggacagcgtcacgctgccggtgatgctctataacttcccggcgctgaccgggcaggatctgaccccggcgctggtcaaaaccctggccgactcgcgcagcaacatcgtcggcatcaaagacaccatcgactccgttgcccacctgcgcagcatgatccacaccgtcaaagccgcccatccgcacttcaccgtgctctgcggctacgacgatcatctgtttaataccctgctgctcggcggcgacggggcgatctcggccagtggcaactttgccccacaggtgtcggtaaatcttctgaaagcctggcgggataaagacgtggcgaaagcggctgagtatcatcagaccctgctgcaaatcccgcagatgtatcagctggatacgccgtttgtgaacgttattaaagaggcgattgtgctctgcggtcgtccgatttctacccacgtgctgccgcccgcctctgcgctggacgagccgcgtaaggcgcagctgaaaaccctgctgcaacagctcaagctctgctga

SEQ ID NO: 3650 - DNA, 1413 bp, Enterobacter cloacae
ttcagcacactacataagggtgtaattctgatgacgcaattaaccatgaaagacaaaattggctacgggctgggtgacaccgcctgcggcttcgtctggcaggccacgatgttcctgctggcctatttctacaccgacgtgttcggtctctccgcgggcattatgggcacgctgtttttggtctcccgcgtgctcgacgccgtgaccgacccgctgatggggctgctggtagaccgcacccgtacccgctacggccagttccgcccgttcctgctgtggggcgccatcccgtttggcatcgtctgcatgctgaccttctacacgccggacttctccgcgcagggcaaaatcatctacgcctgcgcgacctacattctcctgaccctggtttacaccttcgttaacgtcccgtactgcgccatgccgggggtgatcaccgccgacccgaaagagcgccacgcccttcagtcctggcgtttcttcctcgccgccgcggggtcgctcgccatcagcggcattgccctgccgctggtaagcatcatcggcaaaggggacgagcaggtgggctatttcggcgccatgtgcgtgctgggaatgaccggcgtggtgctgctctacgtctgcttctttaccaccaaagagcgttacacctttgaggtgcagccgggctcgtcggtggcgaaagaccttaagctgctgctgggcaacggacaatggcggatcatgtgcgcgttcaagatgatggcgacctgctccaacgtggtgcgcggcggggcgacgctctacttcgtgaaatacgtgatggatcacccggagatggcgacgcagtttttactctacggcagcctcgccaccatgttcggctcgctctgctcgtctcgtctgctgggccgcttcgaccgcgtcaccgcctttaagtggatcatcgtcgcttactctctgattagcctgctgatcttcttcacgccggcggagcatattgccctgattttcgccctcaacatcctgttcctgttcgtctttaacaccaccacgccgctacagtggctgatggcctctgacgtggtggattacgaggagagccgcagcgggcgccgcctcgacgggctggtgttctccacctatctgttcagcctgaagattggcctggcaattggcggggcggtggtgggctggatcctggcgtacgtgaactactccgccagcagcagcgtgcagccggtcgaggtgctgaccaccatcaaaattctgttctgcgtagtgccggtggtgctctacgcgggcatgttcatcatgctgtcgttctataagctcaccgatgcccgcgtggaggccatcagccagcagctgatcaagcaccgcgcggcgcagggcgaggccgttcccgacgctgcgacagccgcatcccattaa

SEQ ID NO: 3651 - DNA, 186 bp, Enterobacter cloacae
agaggcgcttcaggtggctcttgggcgaaagtactgacgacagaccagaagcgggaagccgtgatgttgatgtgtgatgcgaccggtctgtcgcaacgtcgtgcctgcaggcttacaggtttatccctgtcgacctgccgctatgaggctcaccgtccggctgctgatgcgcatttatcatggcgg

SEQ ID NO: 3652 - DNA, 1488 bp, Enterobacter cloacae
gtatggaaagaaaacatgtcgattagttcagtcattaaatctcttcaggacattatgcgtaaagacgccggtgtggacggcgatgcccagcgtctggggcagctttcatggctgctatttttgaagatttttgatactcaggaagaagagctggaactggagcaggatgactaccagttccctattccgcagcgctacctatggcgtagctgggcggcgaacagcgaaggcatcaccggtgatgcgttgctggaatttgtgaacgacgacctgttcccgacgctgaaaaacctcaccgcgcagatcgataagaatccgcgtggctttgtggtcaaacaggcgttcagcgatgcctacaactacatgaaaaacggtacgctgctgcgtcaggtgatcaacaagctcaatgaaatcgacttcagcagcagccaggagcgccacctgtttggcgatatctacgaacagattctgcgcgacctgcaaagcgccggaaatgcaggtgagttctataccccgcgtgcggtgacgcgttttatggtcaaccgtattgatccgaagcttggcgagtcgattatggacccggcatgtggtaccggcggcttccttgcctgcgcgttcgaccatgtgaaagagcattacgttaaaacgaccgaagaccataaaacgctgcaaaaacagattcacggcgtagagaaaaagcagctcccgcacctgctgtgtaccaccaacatgctgctgcacggcattgaagtaccggtgcaaattcgccatgacaataccctcaacaagccgctttcttcgtgggatgagcaggttgatgtgattgtcaccaacccgccgtttggcggcaccgaagaagacggcattgagaaaaatttcccggcagagatgcagacccgtgaaaccgccgacctgttcctgcaactgattatcgaagtgctggccgacaaaggccgcgcggcggtggtgttaccggacggcacgctgtttggtgaaggcgtgaaaaccaaaatcaaaaagctgctcaccgaagagtgcaacctgcacaccattgtgcgcttgccgaacggcgtgtttaacccgtacaccggtatcaaaaccaatattctgttcttcaccaaaggccagccaaccaaagatgtgtggttctacgagcatccgtacccggacggcgtgaagaactacagcaaaaccaaaccgatgaagtttgaagagttccaggcggaaatcgactggtggggcaatgaagccgacgggtttgccagccgcgaagaaaacaaccaggcgtggaaagtgggcatcggcgacatcatcgcccgtaacttcaaccttgatatcaagaacccgtaccagggtgaaaccatcagccacgatccggatgagctgctggcgaagtaccagaaacagcagacagacatcagcgagctgcgtaaccagctgcgcgatattcttggtgcagctctggcaggcaacaagggggcgaactga

SEQ ID NO: 3653 - DNA, 951 bp, Enterobacter cloacae
gctgcccactggaacgcgacggaatttaaaggagccatcatggaacgaaaacccactctggttgtggcccttggcggcaacgcgctgctcaagcgcggcgaaccgcttgaagcggacatccagcgccagaacatcgagcaggccgcccgcaccatcgccggcttaacggagcagtggcgcgtggtgctggtgcacggcaacggcccgcaggtcggactgctggcgctgcaaaacagcgcctacgacaaagtcacgccctacccgctggacgttctcggcgccgaaagccaggggatgatcggctacatgctccagcaggcgctgaaaaacaatctgccccagcgcgaggtcagcgtcctgctcacgcaggtggaagtggacgccgccgacccggccttcagtaacccgaccaagtacatcggcccggtctacagcgaagcccaggcaaaaacgctggccgcggagaaaggctgggtgtttaaggccgacggcagctacttccgccgcgtggtgccctctccgcagccgaagcgcattgtcgagagcgacgccatcacggcgcttatccagcgcgaccatctggtgatctgcaacggcggcggcggcgtgccggtggtggaaaacgccaacggctatcgcggcattgaggcggtgatcgacaaagacctctccgccgccctgctggcgcgccagatcgaggccgacgccctgctgatcctcaccgatgccgacgcggtgtacctcgactggggcaagccaacccaacgtccgctggcgcaggtgacgccggagctgctcagaggcatgcagttcgacgccggatcgatggggccgaaagtagccgcctgccgcgagtttgttgaggcctgcggcggcattgccgggatcggcgcgctgaatgacggcgcggagatcctggcgggcgagaaaggcacgttgattcgtaactaa

SEQ ID NO: 3654 - DNA, 1551 bp, Enterobacter cloacae
cggaagaggtcttcgaatcaccgaactccatcgtcttcgacgaagcagagaaccgcatgcacaccattaaagcggtcatggtggcgacactcggcgactaatcaccgcccggcgcgccgcggggtgcgccgggttcaggagaacatcatgggcaagttcaagtttccctccgcttacaccattctcttttttctgattgccgtggttgccgtgctgacgtggattgttccggccgggcagtaccatatggcgatgaacgaggcgctcggcaaagaagtccccgttgcgggcacctatgcacaggtagcatcacatccgcaggggctggtttcggtgctgatggcgccaattgccgggctgtacgatccggagtccggccaggccggtgccatcgacgtggcgctgtttattctgatcatcgggggattcctcgggatcgtcactaaaaccggggcgatagacgccgggatcgagcgcgtcaccacccggctgcgcggacgtgaagagtggatgatcccgatcctgatggcgctgtttgccgcaggcggcacgatttacggcatggcagaagagtcgctgcccttctataccttactggtgccggtgatgctggcggcgcggttcgatccggtggttgctgcgtccaccgtgctgctcggggcggggatcggcaccctcggctccaccatcaacccgttcgccacggtgatcgccgccaacgccgccgggatccccttcactaacggcatcgctctgcgcctggcgctgctggtgatcggctggatcatctgcgtggcgtgggtaatgcgctatgcccgcaaggtgcgcaaggatccgtcgctgtcgatcgtggcggataagcaggaagagaatctcgcccacttcctcggcaacaagggcgagcagtcgctggaatttaccccggtgcgcaaactcatcctggtgatcttcgccctcgccttcgcggtgatgatctacggcgtggcagtgctgggctggtggatggcggagatctcggcggtgttcctcgccagcgccattatcgtcgggctgattgcccgcatgagcgaagaggagctgacttcaacctttatcaacggcgcgcgagatttgctgggcgtcgcgctgattatcggcatcgcgcgcggtatcgtagtgatcatggataagggcatgattacccacaccattttgcacagcgccgagggaatggtcaccggattgtcgacggtggcgttcatcaacgtgatgtactggctggaagtggtgctgtcgtttcttgtgccttcttcgtccggcctggccgttctgacgatgccgatcatggcgccccttgccgatttcgctaacgtcaaccgcgacctggtggttacggcttaccagtcggcgtccggcatcgttaacctgatcactcccacctctgccgtcgtgatgggcgggctggctatcgcccgcgtgccctacgtgcgctatctgaaatgggtcgcgccgctgctggggattttaacggtggtgattatggtggcgttaagcctgggcgctttgttgtga

SEQ ID NO: 3655 - DNA, 300 bp, Enterobacter cloacae
tggctgttcagccacgcgctgtacagcacccgttcgctggtctttccggcgatatcggtgtggttctccagcacgattttgtcctgggtcagggtgccggttttatcggtgcaaagaatgtccatcgcgccaaagttctggatggcgtcgaggtgtttaacgatcaccttttgtttagagagtttgaccgccccgcgcgccagcgtggaggtgacaatcatcggcagcatttccggcgttaagccaacggccacggagagcgcgaacagcgccgcttcccaccagtcgcctttggtgtag

SEQ ID NO: 3656 - DNA, 2466 bp, Enterobacter cloacae
tcctatttcgttgagagctctgctatggttggcgaaaacaaaactcatctgacggaaacagacattatcaccaaatatatcctgcctgccgtcaagaccgcaggctgggatgtcatgtcacaagttcgtcaggaagtaaaactgcgcgatggcaaaattgtagtgcgtggcaaactggcctcacgtatcaaagttaaatccgccgacatcgtgctgtaccacaagccgaacttgccgttggcagtgatcgaagctaaggccaataagcacgccatcagcaaaggaatgcagcagggtctggactacgccagcttgcttgatgtgccttttgtgtttgcctccaatggtgatggtttcatcttccacgataaaaccaacccgcagcagctcgaatccgaaattgccctcagcgatttcccaacacctgagcagctctggcaaaaatactgtgcctggaaagggttcactcaggaacaattgcccgttattagtcaggattattacgatgacggtagcggcaaatctcctcgttactatcagatgcaggcgatcaaccgaacggtagatgccgtatcggctggtaagaatcgcattttgctggtcatggcaaccggtacgggtaaaacgtataccgcattccagattatctggcggctctggaaggccaaaaacaaaaaacgcatccttttcctcgctgaccgcaatatccttgtcgatcaaaccaagaacaatgatttccagcctttcggtacagcaatgaccaaagttaccggacgtaccattgatccggcgtacgaggtccatcttgcgttataccaggctattaccggaccggaagaacatcagaaagcctataaacaggtagatccaaatttcttcgacctgattgtgattgacgaatgccaccgtggcagcgcgtctgaagattcagcctggcgagagattctggaatatttcggcagtgccacacaggttggcctgacggcgacgccaaaagaaacggaagacgtctccaatatcgattacttcggtgagccggtttacacctattctctcaaagagggtattgaagacggttttctcgccccctataaagttgtacgcgttgatatcgatgttgatgttcagggctggcggcccgtcaaaggccagctggataaatacggcgaagagattgaagaccgaatctataacctgaaagattttgaccgcaaactggtcattgatgaacgcaccatgctggttgcgcagaccatcaccgattacctgaaacgcaccaatccgatggataaaaccattgttttctgcaacgacatcgatcacgccgaccgcatgcgccacgcgctggtggtgctcaaccctgagcaggtattgaagaacgaaaagtacgttatgaaaatcaccggcgacgatgacatcggcaaggcgcaactcgataactttattaatcccaagaaagcctaccccgttatcgcgacaacatcagaactgatgacaaccggcgttgacgcacagacctgcaaactagtggtactggaccagaacattcagtctatgaccaagtttaaacagatcattgggcgcggcacgcgcatcaacgaaaggcacggcaagctgtggttcaccattctcgatttcaaaaaagcgaccgagctgtttgccgacccacgctttgatggcctgccagaaaaagtgctggtggtaaaacccggtgatatctccgatgaaagctccgacttcaatgagcggctggatgaagaaaccacgaacgatgatggggataatcctcacaatgaaatgcgagaagacgccgctgagtatcacgttaaccgcgacaaccattccggaaacggtgaatttcatagcgatgatgcagacaaagtccgcaaattctatgtgaatggcgtggcggtgaaagtcctggcgaagcgcgttcagtattacgattctgacggcaagttggtcactgaatccttccaggattacacccgcaaaacgatgctgaaagacagcgagtacgcctcgctggatagcttcgtgcgcaaatggcaggaggcacctcgcaagcaggcaatcattgaagaactggcgcagctgggaattctgtgggatgtgctggccgaagaggtgggtaaagatctcgacccgtttgatttgctctgccatgtggtgtacggtcagccgccgttaacccgtcaggagcgcgcggccaacgtacgtaagcgtaactattttacgaaatacgccgaaccggctcagcaggttctcaataccctgctggacaaatacgccgatgaaggcgtgcaggaaatcgaggatgttcaggtgctaaaactgaagccgtttgatgcactgggtcgcccaattgagatcatcaaaacccgatttggcgacaaaaaggcgtatgagcaagccgttaatgaactggaaaacgaaatctaccagcttccgccacgctcagcctga

SEQ ID NO: 3657 - DNA, 915 bp, Enterobacter cloacae
tgtagccgcctttgttgccggatggcgctgcggcctgatgccctcaccccggccctctcccacggggagagggagaacaccggctccatttcattgatttttcaccccgaaaaaggtacgttttcgccttcattccagcgtggacatgccagcattatgccgattattcagtctgttgaacgtgcgttgcagatcctcgacctgttcaacgagcaggccaccgagcttaagatcaccgacatcagcaaactgatggggctgagcaagagtaccctccactcgctgctgaaaacactccagcttcacggctatatcgatcagaacccggagaacggcaaatatcgcctcggcatgaagctggtcgagcgcggccattttgtcgtgggctccatcgatattcgccagaaggcgaagggctggctgacggagctgtctcagcggaccgggcagaccacccatctggggatcctggacgggagtgaaggggtctatatcgagaagattgaaggcaagctggccgccatcgcctattcgcgcatcggccgccgcctgccggttcacgccaccgccatcggcaaggtgttgattgcctggctgggcgaggccgagctgaacgccctgctggagggctatcactacaccacctacaccccttccaccctcgcctctcgcgaagcattaatggccgccctgacgcagacccgcgagcagggctatgccctggatagcgaagagaacgagcagggcgtgcgctgcgtggcggtgccggtgtggaaccatgaatcccgcgtgattgccgccctgagcctgtcgacgctgacctcgcgcgtggacgatgcagagctggctaatttccgcgagcagcttcagcaggccgggctccagctgtcacgcgcgctgggctacccggcctga

SEQ ID NO: 3658 - DNA, 1014 bp, Enterobacter cloacae
aaattttctcgatggtcatggttatcgtccagctcagcagagcttgagctgttgcagcagggttttcagctgcgccttacgcggctcgtccagcgcagaggcgggcggcagcacgtgggtagaaatcggacgaccgcagagcacaatcgcctctttaataacgttcacaaacggcgtatccagctgatacatctgcgggatttgcagcagggtctgatgatactcagccgctttcgccacgtctttatcccgccaggctttcagaagatttaccgacacctgtggggcaaagttgccactggccgagatcgccccgtcgccgccgagcagcagggtattaaacagatgatcgtcgtagccgcagagcacggtgaagtgcggatgggcggctttgacggtgtggatcatgctgcgcaggtgggcaacggagtcgatggtgtctttgatgccgacgatgttgctgcgcgagtcggccagggttttgaccagcgccggggtcagatcctgcccggtcagcgccgggaagttatagagcatcaccggcagcgtgacgctgtccgccacctgctcgaaatagcggatcaggttcgcttccgacactttccagtagtaagggttgatcaccacgataccgtccgcccctgcctgctgcgcgtgctggctcagctcaatggtttcccgggcgttggtgccgccggtgccgatcaggaccggcacgcgacaatcgacatgatcgatcgcaaattgggcaatggttttacgctcttcggcgccgagctgggagaactcgccgccgctgcccaggaaaaacaggccgtcgacgcctgctttgatcagatcgtcgatcagcgcggcggtgccctgcttatcgagctggccatcggcggtaaaaatggtggagacagggggaatgatacccgtgaacaacgcggactgcggcatgtgatctccttattgaatcattttgttctacattgtagaacagtgttcattaaattaacgatcatactatga

SEQ ID NO: 3659 - DNA, 993 bp, Enterobacter cloacae
acctattcccagagcccctcatttgaggggcttttttttgcccggcgtcaggagataaacatgaatccgctttatcaaaaacacatcatttccataaacgacctcagccgcgaagagctggaactggttctggaaaccgcggcaaaactgaaggccaatccgcaaccggagctgctgaagcacaaggtgattgcgagctgcttctttgaagcctcgacccgcacccgcctctcctttgagacctccatgcaccgcctgggcgcgagcgtggtgggcttctctgacagcagcaacacgtcgctgggtaaaaaaggcgagaccctggcggataccatttcagtgatcagcacctacgtcgacgcgattgtgatgcgccacccgcaggagggcgcggcgcgtctggcgaccgagttttccggcggcattccggtgctgaacgccggtgacggtgccaaccagcacccaacgcagaccctgctggatctgttcaccattcaggagacgcagggcacgcttgagaacctgaacatcgccatggtcggggacctgaaatatggccgaaccgtccattccctgacccaggcgctggcgaaatttaacggcaaccgcttcttcttcatcgcgccggacgcgctggcgatgccgcagtacattctcgatatgctggacgaaaaaggcatcgcgtggagcctgcacgccagcatcgaagaggtgatgggcaacgtggatattctctacatgacccgcgtgcagaaagagcgtcttgacccatccgagtacgccaacgtgaaggcgcagttcgtgctgcgcgccggcgacctcgaaggcgcgcgcgacaacatgaaggtgctgcacccgctgccgcgcatcgatgagatcaccacagacgtggataaaacgccgcacgcctggtacttccagcaggccggaaacggcatcttcgcccgccaggcgttactggcactggttctgaatcgcgaattagctctgtaa

SEQ ID NO: 3660 - DNA, 474 bp, Enterobacter cloacae
ggggagacgaccatgacacacgataacaaactccaggttgaagccatcaagcgtggcaccgtgattgaccacatccctgcgcaggtgggctttaagctgctgacgctgttcaaactgaccgaaaccgaccagcgcatcaccatcggcctgaacctgccgtcgggcgagatgggccgcaaagacctgatcaaaatcgagaacaccttcctgaccgacgagcaggttaaccagctgtcgctgtacgcgccggacgccaccgtcaaccgcatcgacgagtacgaagtggtcggcaaatcacgcccgagcctgccagaacgtatcgaaagcgtgctggtctgcccgaacagcaactgcatcagtcatgctgagccggtttcctccagctttgcagtgaaaaagcgcgccaatgacatcgcactcaaatgcaaatactgcgaaaaagagttttctcattatgtggtgctggccaactaa

SEQ ID NO: 3661 - DNA, 1794 bp, Enterobacter cloacae
ccagctgcgcgatattcttggtgcagctctggcaggcaacaagggggcgaactgatgaccgtagagaagctaattaccgaccatatcgatatctggtcatccgcgctgcaaacccgctccacggccgggcgtggcagtaacggcaaaatcgacctctatggcattaagaaactgcgcgagctgattctggagctggcggtgcgcggcaaactggtgccgcaggatccgagtgatgaaccggcgtctgagttactgaagcgtattgccacagagaaagcggaactggtaaagcagggaaaaattaaaaagcagaagccgctgccagagattagtgaagatgagaagccgtttgaattaccagaggggtgggagctcaatagactaggtgatttaataaatgtaattaatggtcgggcatataaaaaacatgaaatgttacaggctggcactcctctgcttagagtcggtaatctgtttacctcaaatgagtggtattactcagacttagagcttgaacctgaaaaatatattgataatggtgatctgatttattcttggtctgcttcgtttggtccgtttatctggaatggtggtaaagtaatatatcactaccacatctggaagatggacatatttgatacgcaatcattagataaacactttatgaagttatatctagaatctgtatctgcgagtataaaggcttcaggcaatggtattgccatgatacacatgacaaaagaaaggatggaaaaacttgtaatcccccttcctccgcgagcagaacaactgcgtatcgttgcaaaagttaatgagttaatgtccctatgcgaccaactggagcaacaatcactgaccagcttggatgcacatcagcaactggtggaaacactgctatcaacgctgaccgactgtaaaaatgccgaagaactcgccgaaaactgggcgcgaattagccagaatttcgacacgctatttaccaccgaagcgagtatcgatgtgcttaagcaaacgattctgcagctggctgtaatgggcaaactggtgccgcaggatcctaacgacgaacctgcttctgaactgcttaaacgtattgatcaggaaaaagcacaactggtgaaagaagggagaattaaaaaacaaaaaccgttgccgccgattagtgatgatgaaaaaccgtttgagttgccggagggatgggagtggtgtcgcctagagactattacagaacttataacgaaaggttcgtcaccaaaatggcaaggagtttcatatactgataatcctaatgatgttctttttattacaagcgaaaatgttgggtcatttaagatccttcttgattcagagaaatacgttgagaaaaaattcaatgagattgaaccaagatcaatattaacacacaatgatatattaatgaatatcgttggggcatctattggtagaactgcaatttttaatatgaatagaaatgcaaacatcaaccaagcggtgtgtctgattagggttataaataattcaatgcttctttcttacttactgaatttcttcaatagcgacatttgcctttcgtatatgtttgataagcaggtcgataatgctagggctaatctaagtatgggcaatattgctaaatttgtactaccaatccctcccttgaatgaacaaaagcgtattgtagaacatattgataacctaatgtccatctgtgacaaactccaatcccacctgcaatccgtccagcaaatccagctccacttggcggatgcgctcaccgatgcagcattaaactaa

SEQ ID NO: 3662 - DNA, 1038 bp, Enterobacter cloacae
ttcaataagtggcattcgccatgtgaggataaaatgtctgatctgtacaagaaacactttctgaaattgctcgactttacccctgcacagttcacttctctgctgacgcttgccgcacagctcaaagccgataagaaaaatggcaaggaagtacagaaacttaccggtaaaaacatcgcgctcatcttcgaaaaagactcgacccgtacccgttgctctttcgaagttgccgcatttgaccagggcgctcgcgtcacgtatttagggccgagcggcagccagattgggcataaagagtcaattaaggacaccgcgcgcgtgctcgggcggatgtacgacggcattcagtatcgcggccacggccaggaagtggtcgaaacgctggcgcagtatgcgggcgtgccggtgtggaacgggctgaccaacgagttccacccgacgcagctgctggcggacctgctgaccatgcaggagcacctgccgggcaaggcgtttaacgagatgacgctggtctacgcgggcgacgcgcgcaacaacatgggcaactcgatgctggaagcggcggcgctgaccgggctggatctgcgtctggtggccccgaaagcctgctggccggaagagagcctggtggcggagtgcagcgcgctggcggagaaacacggcgggaaaattaccctgacggaaaacgtggcggcgggcgtgaagggcgcggactttatctataccgacgtgtgggtgtcgatgggcgaagccaaagagaagtgggcggagcggattgcactgctgcgtgggtatcaggtgaacgcgcagatgatggcgctgaccggcaacccggacgtgaagttcctgcactgtctgccggcgttccatgacgaccagaccacgctcggtaagcagatggctaaggagttcgacctgcacggcgggatggaagtgacggacgaggtgtttgagtcggcggcgagcatcgtgttcgaccaggcggaaaaccggatgcatacgattaaggcggtgatggtggcgacgcttggggagtga

SEQ ID NO: 3663 - DNA, 213 bp, Enterobacter cloacae
tcgatcgcaaattgggcaatggttttacgctcttcggcgccgagctgggagaactcgccgccgctgcccaggaaaaacaggccgtcgacgcctgctttgatcagatcgtcgatcagcgcggcggtgccctgcttatcgagctggccatcggcggtaaaaatggtggagacagggggaatgatacccgtgaacaacgcggactgcggcatgtga

SEQ ID NO: 3664 - DNA, 1275 bp, Enterobacter cloacae
acacctcacatggcgcatgccctttttattctgaaaaaagttaaaggaataattatggaaaagcattacgtcggttctgaaattggtcaattgcgtagcgttatgctgcaccgtcctaatttaagtctgaaacggttaaccccctcaaactgtcaggagctgttatttgatgacgtgctctcggttgaacgggcgggtgaagagcatgacatcttcgcaaacacgctgcgcgagcagggtgtggaagtcctcctgttgaccgaccttcttacgcaatcgcttgatattgcggaagcaaaagcctggcttcttgaaacacaaatctccgactatcgcctggggccaaccttcgccgccgacgtacgcggctggctggcggatatgccgcaccgcgaactggcgcgcaggttaagcggcggattaacctacggtgaaattccggcggccattaaaaatatggtggtcgatacccacacggcaaatgattttattatgaagccgctgccgaaccacttatttacccgcgatacctcctgctggatatataacggcgtctccattaatccgatggcgaaacccgcccgccagcgtgaaacgaataacctgcgggcaatatatcgctggcatcccgcatttgccgacggcgagtttattaagtatttcggcgacgagaatattaattacgaccacgccactttagaaggcggcgacgtattagtcattggtcgcggggcggtattgatcggcatgtccgaacgcaccaccccgcagggcgtggagttcctcgctaacagcctgtttaaacaccgccaggccgagcgcgtgattgccgttgagctgccaaaacaccgctcctgcatgcacctcgacaccgtcatgacccacatcgacgtggataccttctccgtctacccggaagtggtgcgcaaagacgcccagtgctggacgctcaccccggacggccgcggcggcctgctgcgcacccaggaaaccgacctgctgcacgccatcgagaaagcgctcggcattaaccaggtacgtctgatcaccaccggcggcgatgcctttgaagccgaacgcgagcagtggaacgacgctaacaacgtcctgaccatccgcccgggcgtggtgatcggctacgagcgcaacgtctggaccaacgagaagtacgacaaggcgggcatcaccgtgctgccgatcccgggcgacgagctgggacgcggtcgcggcggcgcacgctgcatgagctgcccactggaacgcgacggaatttaa

SEQ ID NO: 3665 - DNA, 1026 bp, Enterobacter cloacae
caatttaaaaaggatttccccatgaccattaacctgaaaaaccgcaacttcctgaaactgctggactacaccccggcggagatccagtacctgattgacctcgccatcgagctcaaggccgccaaaaaagccgggcgcgagaagcaaaccctggtcgggaaaaacatcgccctgatctttgaaaaaacctccacccgcacccgctgcgccttcgaagtgggcgcgttcgaccagggcgcgcaggtcacctatctcggcccaagcggctcgcagattggccataaagagtcgatgaaagacaccgcccgcgtgctgggccgcatgtatgacggcatcgaatatcgcggctatggccaggccatcgttgaagagctgggcgagtacgcgggggtgccggtgtggaacggcctaaccgacgagttccacccaacgcaaattctcgccgatctgatgaccatgctggaacactccccaggcaaaaccctgccggagctgagctttgcctatctcggcgacgcgcgcaacaacatgggcaactcgctgatggtcggtgcggccaagatggggatggatatccgcctcgtggcgccgaaatccttctggccggaggcaggcctggttgagcagtgccgcgccattgcgaaagagacgggcgcgcgcatcaccctcaccgacgacgtggaagaaggcgtgcaggggaccgatttcctctacaccgacgtgtgggtctccatgggcgagccgaaggaggcctgggccgagcgcgtcagcctgatgaagccgtatcagataaacgcgcaggtgatgaaggccaccggtaacccgaacgtcaagttcatgcactgcctgccagcgttccacaacgagcacaccaaagtgggccgcgaaatcgaaatggcgtacggcctgaaggggctggaagtgacggaagaggtcttcgaatcaccgaactccatcgtcttcgacgaagcagagaaccgcatgcacaccattaaagcggtcatggtggcgacactcggcgactaa

SEQ ID NO: 3666 - DNA, 708 bp, Enterobacter cloacae
cctgatcactcccacctctgccgtcgtgatgggcgggctggctatcgcccgcgtgccctacgtgcgctatctgaaatgggtcgcgccgctgctggggattttaacggtggtgattatggtggcgttaagcctgggcgctttgttgtgatttgccggatggcgctgcgcttatccggcctacggatcggtgcggtgccaccggttatttcgggaactgatatgggaactatgatggattacgaagagtactctcccaaagagcaactacagctaacggtctgccagcgtctgatcgcggaaaagagctatctctcccaggaagagatccgccgcgacttacaggagcggggttttgagaccatcagccagtccaccgtttcacgtctgctcaagttgcttggtgtcataaaaattcgcaatgccaaagggctaaagatttattcgctgaatccccagctgcgcccggcccccgatgcggcgcgtaccgtctctgaaatggtggtgagcgtggagcacaacagcgaatttatccttatccataccgtcgccggatatggccgcgcggtggcgcgtattctggattatcaccagttaccggaaattttaggcgtggtggccggaagcagtattgtctgggtcgcgccccgcatagtgaagcgcaccgcgctggtgcataagcaaattaattatttactcagaacgcattaa

SEQ ID NO: 3667 - DNA, 408 bp, Enterobacter cloacae
cgctgtaattctggagaaaaaatgagcaaagtactcgcgacggaaaatgcaccagcggctatcggcccatacgttcagggcgttgatctgggcagcatgatcatcacttctggccagatcccggtgaacccaaaaaccggtgaagtacccgccgacgtagcggcgcaggcgcgtcagtcgctggaaaacgtgcaggcgatcgtcgaatctgccggtctgaaagtgggcgatatcgtcaaaaccaccgtgttcgtgaaagatctgaatgattttgcgaccgttaacgccacttacgaagcgttcttcaccgagcacaacgccaccttcccggcgcgctcctgcgtggaagtggcgcgtctgccaaaagacgtgaaaattgaaattgaagcgattgccgtacgtcgctaa

SEQ ID NO: 3668 - DNA, 1449 bp, Enterobacter cloacae
atgaaactctctaaaattgcgctggcggtaaccacattaacggttgcgtcttccgcacttgcacacggatatatagaatcccctgccagccgcgcttatatgtgtaagctcggccagaatattgactgtggctctgtacaatatgaaccgcagagcgtagaaaagacctccggcttcccgacgggtgcgatgccgcctgacggccagcttgccagcgccggtattgccagctactcccagcttgataagcagagcctgaacgcctggaccaaaaatcccatgacggcaggcccgcatgaatttgtctggcaccataccgcgccgcataaaaccaccaactggcgttattacattaccaaacaaaactgggaccccaataaaccgctgacccgtgaccagttcgaattaacgccgttctgtactattaacggaaatggtcaggcaccggcgatgacaaaatccatgacctgtaatgtcccggaacgtacgggctaccaggttatttatggcgtgtgggaaattgcggataccgcaaacagtttctatcaggccattgacgttgatttcggtaacggcggcaacgtcacgccggacgacaccccagcggtgatatcccagtggagtaaaaccctgagcggacagattgccgggaataacctgaacacgggcgatagagtgattgcacgcttcttcgacgccaacggggaagttgccgccctgcgtaccgagctgaccatcggctccgttgcccagggggatacgaaccagtggtcctacgatctggcgcagaagatcaacgccgcgtacagcgatgtgcgtgtcggggtgaaggatgaagcgggcgaaattagcccggttcacggcgcgaacagcgtcttcgtcaaagacggcagcgcccttcagtccgttgcgatttcgtacgaagagcagaaggcggaagtgaatgaaaccatcgcggtatctaacccgcactacagcaaaatcgagaatggcaaggcgtccgtcaccttccacgtgaacaccaaaggcgacgtgaacgttgaagcgcacgtgatgaaccacagcggtgcggaaaaggggtatctgaagcaggagatgaataacgccagccaggacgtgaccatgaccctgactgacgtcacggcgggtcaccatatgctgaaatactacgccaccaacaaagacggcaccctgttcgcgcaggacgtgctggatctgatgctggaaagcgacgcggcggacagcaacggcccgcatgactttatcttcccggataacgtcgcgtcctacaaagcgggcaccgtagtgctacagccgaaagacggtaagacctacgaatgcaggcctgtcccgttcagcggctactgcgtgcagtacagcccaaccgcaaaccagtttgaaccaggcgtgggcgcgcactggagagaggcatgggtgttgaaggactga

SEQ ID NO: 3669 - DNA, 978 bp, Enterobacter cloacae
ttattttatcgttgttacagggaatacagcatgcagaaccgccttacgattaaagacatcgcgcgtttaagcggcgtggggaaatcgactgtctcacgcgtgctgaacaacgaaagcggtgtcagcgagcgcacacgcgagcgcgtcgaggcggtgatgaatcagcacggtttttccccttcccgctccgcgcgcgccatgcgcgggcagagcgataaagtggtcgccattatcgtctcgcgtctggattccctctccgaaaacctcgccgtacagacgatgctgcccgcgttctacgagcagggctacgatccgatcatgatggagagcaagttctccgcgcaaatggtggaggagcatctcggtatgcttcagcgccgtaatattgatggggtggtgctgttcggatttaccggcctaaaagaggacgtgcttaaaccctggcagccgtcactggtgctgctggcgcgcgacgcaagcgggtttgcctctgtctgttacgatgacgaaggggcgatcgtgatcctgatgcagcgcctgtatgaacagggccatcggcatattagctatctcggcgtgccgcatgccgacatcaccaccggcaagcgtcgccacgaagcgtacctggcgttttgtaaaaaacacaatcttcccgccgtggccgcgctgcctggtctgggtatgaaacagggatatgaacaggtcgccagtgtgctgacgccacaaaccaccgccctggtatgcgccacggatacccttgcattgggtgcgagcaaatatttgcaggagcagcgcatcggggagctgcaattagcgagcgtgggaagcacgccgctgatgaagttcttacacccggagattatcagcgttgatccgggttacgccgaatctggccggcaggctgccgcgcagctgatagagcagatcaacgggcgcgctgagccgcgtcagatcgttattcctgcccgtctctcatag

SEQ ID NO: 3670 - DNA, 1272 bp, Enterobacter cloacae
ctgagtcaggagatgcggatgttaaagcgtgaaatgaacattgccgattatgatgccgaactgtggcaggctatggagcaggaaaaagtacgtcaggaagagcacatcgaactgatcgcctccgaaaactacaccagcccgcgcgtgatgcaggcgcagggttctcagctgaccaacaaatatgctgaaggttatccgggcaagcgctactacggcggttgcgaatacgttgatatcgttgagcagctggctattgaccgtgcgaaagaactctttggcgctgactacgcgaacgtccagccgcactctggctctcaggctaacttcgctgtttataccgcgctgttgcagccgggcgataccgttctgggtatgaacctggcgcagggcggccacctgactcacggctccccggttaacttctctggcaaactgtacaacatcatcccttacggtattgatgagtccggtaaaattgactacgaagacatggcgaagcaggccaaagagcacaagccgaagatgatcatcggtggcttctctgcttactccggcatcgttgactgggcaaaaatgcgtgaaatcgctgacagcatcggcgcgtacctgttcgtcgacatggcgcacgttgccggtctgattgccgctggcgtttacccgaacccggttccacatgcgcacgttgtgaccaccaccacccacaaaaccctggcgggtccacgcggtgggctgatcctggcgaaaggcggtgacgaagagctgtacaaaaagctgaactccgccgtattcccaagcgcccagggcggcccgctgatgcacgttatcgccgcgaaagccgtcgcgctgaaagaagcgatggagccagagttcaaggtttatcagcagcaggttgctaaaaacgccaaagcgatggtggaagtgttcctgaatcgtggctacaaagtggtctctggcgggactgaaaaccacctgttcctgctggacctggttgataagaacctgaccggtaaagaagctgacgcagccctcggccgcgccaacatcaccgtgaacaaaaacagcgtgccaaacgatccgaagagcccgttcgtgacctccggtatccgtatcggttctccggccgtaactcgtcgtggctttaaagaagcggaagtaaaagagctggcgggctggatgtgtgacgttctggacaacatcaatgacgacgcggttatcgagcgcgttaaaggtaaagtgctggacatctgcgcacgcttcccggtgtacgcataa

SEQ ID NO: 3671 - DNA, 1206 bp, Enterobacter cloacae
cgcgctaacgacttgctaaagtcagggattaacgccagactatcgcctccatttcgggagggattcatggtcttgcattccacgcgctggctggcgctcagctatttcacctatttctttagttacggtatttttctgcctttctggagcgtctggctcaagggaattggtctgacgcctgagaccattggcatcctgctgggcgcggggctggtggcacgcttcctgggtagtctgctgattgcgccccgcgtcagcgatccctccttactgattaaagcggtgcgaattctggccctgctgacgctggtctttgcagtctgcttctgggttagccaccagtttgcctggctgatggtggtaatggttggctttaatctgttcttctccccgctggtgccgctgacggatgccctggcgaacacctggcaaaagcagatcaccatggactatggccgcgtgcgcctgtggggatcgattgccttcgtgatcggctctgcgctggtcgggaaactggtcagcctctatgactatcgtgccattctggcgctgctaacgctcggcatcgcctcaatgctgctcggtatgttgctgcgtccgtcggtgatgccgcagggcgaaagccgccatcaggagagcgccggctggcccgcctggcgctcgctggtggcgcaaagctggcgtttcctggcctgcgtctgtctgcttcagggggcgcatgcggcctattatggcttcagcgccatctactggcagggggcgggttactcggcttctgcggtaggctacctgtggtcgctcggcgtggtggcggaggttattatcttcgcgctgagccaaaaactgttccgtcgtttcggggcgcgtgacctgctgctgctttccgccgtgtgcggcgtggcgcgctggggcatcatgggctggacgacggagctgccgtggctgattgtggcgcaaattctgcactgcggaaccttcaccgtctgccatctggcggcgatgcgctacatcgcggcgcgagagggtggggacgttattcgtcttcaggcggtctattcagcggtggcgatgggcggcagtattgcggtgatgaccgtatttgccggtttcctctatcagcacctggggcacggtgtgttctgggtgatggcgctggtcgctttaccggccatcgttattcgccctaaagtcgctgctcgcacgtaa

SEQ ID NO: 3672 - DNA, 333 bp, Enterobacter cloacae
ggtttgagtatgtcgattacccttagcgacagcgctgccgcgcgagtaagctcttttctggcgaaccgtggtaaaggctttggcctgcgactgggcgtacgtacctccggctgttctggtatggcttacgtactggagtttgttgacgaaccggcgtctgatgacaccgtgtttgaagacaagggcgtgaaggtggtggtcgatggcaaaagcctgcatttcctcaacggcactcagctggacttcgtaaaagaaggcctgaacgaagggttcaaattcacgaacccgaacgtcaaagacgagtgtggttgcggcgaaagcttccacgtttaa

SEQ ID NO: 3673 - DNA, 1896 bp, Enterobacter cloacae
acaactcgaagaaaagctgctcgatttttaatttcggaagcaattatggccttattacaaattagtgagcctggcttaagtgccgcaccgcaccagcgtcgtctggcggtcggtattgacctgggcaccaccaattccctcgtggcgaccgtgcgcagcggccaggcggaaacgctggctgacgagcaggggcgccatctgctgccttccgtagtccactaccagcagcagggtcacgcggtcgggtttgatgcccgcgctaacgccgcgcgcgatccggccaataccatcagctcggttaagcgcatgatgggccgctcgctggctgatatccagacccgttacccgcatctgccgtatcagctgcaggccagtgaaaacggcctgccgatgattgcgaccgcggccggtctgctgaacccgattcgtgtttctgctgacatcctcaaagcgctggcggagcgtgctacggccacgctcggcggcgatctggacggcgtggtgatcaccgttcctgcctactttgatgatgcacagcgtcagggcaccaaagacgccgcgcgtctggcgggcctgcacgtgctgcgtctgctgaacgaaccgacggcggcggcgattgcctacggcctcgactccggtcaggaaggggtgatcgcggtttacgatctcggcggcgggacgttcgatatctcaatcctgcgccttagccgcggcgtgttcgaagtgctggcgaccggcggggattccgcgctcggcggcgatgacttcgaccatctgctggcagattacatccgcgagcaggcgggcatcagcgatcgcagcgatgcgcgcgtgcagcgtgaactgctggatgcggccatcgacgccaaaatcgccctgagcgatgcacagtccgtcagcgtgaacgtcgcaggctggcagggtgagattacccgcgatcggttcagagaactgattgcgcctctggttaagcgtaccctgctggcctgccgtcgcgcattgaaagatgcgggcgttgaggctaacgaggtgctggaagtggtcatggttggcggctcaacccgcgtgccgctggtgcgcgagcgcgtgggcgaattctttggccgcacgccgttgacctctatcgacccggacaaagtggttgccgtcggcgccgctatccaggccgatattctggttggcaacaagccggacagcgaaatgctgctgctggacgtcatcccgctgtctctgggtttagaaaccatgggcggcctggtggagaaagtcattccgcgtaacaccaccattccggtggcgcgcgcgcaggagttcaccaccttcaaagacggccagaccgcgatgtccatccacgtgatgcagggcgagcgtgagctggtgcaggactgccgctctctggcgcgctttgcgctgcgcggaattccagcgctgcctgcgggcggggcgcatattcgcgtcaccttccaggtggatgcggacggcctgctgagcgtcacggcgatggaaaaatcgaccggtatcgagtcgtctattcaggttaagccgtcctacggcctgaccgatggcgaaatcgcctccatgattcaggactcaatgagctacgccgagcaggatgtgaaggcgcgtatgctggcggaacaaaaagttgaagccgcacgcgtgctggaaagcctgaacggggcgctcgctgccgatgccgcgctgttaagcgccgctgagcgccaggtgattgacgacgctgccgcgcgcttaagcgccgtggccgaaggcaatgacgctgacgcgatagaagaagccattaaaaacgttgataaacaaacccaggacttcgctgctcgccgcatggacaaatctgtccgcgtcgcgctgaaaggccagtccgtggacgaggtttaa

SEQ ID NO: 3674 - DNA, 4983 bp, Enterobacter cloacae
ccaacaggcccctcaggccagggacacaggatgaaaccgtttcgcttagctgcgatctctctcgcgctgctcaccacctttacgcttgtcggctgtgataacagcgacgacaaacctcaggccgctgcccccgcagcgtctactgcatcagaacagaaaaccccggcgacaccggatcctgaaaagctggctaagctggccgcgcagagtcagggtaaggcgttgacgctgctggatgcctctgaagtgcaactcgacggcgccgcgacgctggttctgaccttctctgtaccgctggatcccagccaggattttgcgaaaacggtacatgtggtggataaaaaaagcggcaaagtggacggcgcctgggaactggcccccaatctgaaagagctgcgcctgcgccatctggagccgaatcgtaatctggttgtcaccgtcgaacgtgatttgctggcgctgaacaaagcgacattcggcattgactatgaaaaagcgattaccacccgggatgttgaaccgacggtcggattcgccagccgcggatcgctgctgccgggtaaagtggtggaagggttgccggtgatggcgctcaacgtcaacaatgtggacgtgaacttctaccgcgttaagccggagtcgctggcctcgtttgtcagccagtgggagtaccgtaactcgctgaccaactgggaatctgacaatctgctgaagatggcggaactggtctacaccggccgtttcgacctcaacccggcgcgcaacacgcgtgaaaaactgctcctgccgctcaaagatattaagccgctccagcagtctggcgtctatatcgccgtgatgaatcaggctggtcactataactacagtaacgccgcgacgctctttaccttaagtgatattgggctgtccgctcaccgttatcataaccgcctggacatcttcacccagagtcttgaaaacggtgcggcgcagtcaggcgtgactattacccttctgaacgataaagggcagactctggccgaggcgaacagcgacgccgatggtcatgcgaaactggaaaccgataaagaagccgcgctgatccttgccagtaaagatggccagaccacgcttcttgacctcaaacttccggcgctggatctggcggagtttgatatcgccggtaacccgggttacagcaaacagttctttatgtttggcccgcgcgatctctatcgtccgggtgaaacggtgatccttaacggcctgcttcgcgacagcgatggcaaaccgcttcccgatcaaccggtaaaacttgacgtgctgcgtccggacggacaggtggcgcgtacggtcgttgtgcaacctgagaatggcctttatcgcttcaactattcgcttgatagcggcgcccagaccggcatgtggcatattcgcgcgaatacgggggataaccagcagcgcatgtgggatttccacgtcgaagattttatgcctgagcgtatggcgctgaatctgaccgggcaaaaaacgccggtttccccgcaggaggatgtggactttaacgttgtgggctattacctgtacggcgcgccagctaacggcaattctctgcaaggccagcttttcctgcgtccgctacgtgacgcggtgcctgcgctgcctggcttccagttcggtgatattgccgaggagaacctgagccgcagcctggatgaagtgcagcttacgctggacgaacaggggcgcggacaggttaccaccgaaagccagtggaaagaggcgcactcgccgctgcaactgattttgcaggccagcctgctggaatcaggtgggcgtccggtaacgcgacgcgctgagcaggctatctggccggcggctgagctgccgggtattcgccctcagttcgccagcaaggcggtttacgactaccgcaccgatactaccgtcaaccagccgatcgtcgacgagaacggcaacgccagcttcgacatcgtctatgccgatgccagcggagccaaaaaggccgtttccggattacaggtacgactgattcgcgagcgtcgtgactacttctggaactggtccgagagtgagggctggcagtctcagtttgatcaaaaagatctggttgagggcgagcaggagctaaacctcaaggccgatgaaaccggtaaagtcaccttcccggtggagtggggctcataccgtctggaagtgaaagcccctgatgacatggtcagcagcgtgcgcttctgggcaggctacagctggcaggataacagcgacggcaccggggccgcgcgccctgaccgcgtgacgctgaaactggataagccatcctatcagccaggcgataccatccaactgcacatcgccgcgccggccgcaggcaagggctatgcgatgatcgagtccagtgaagggccgctgtggtggaaagagatcgacgtaccggctaacggtctggatctcgctatcccggtcgacaaggcctggaaacgtcacgatctctatctcagcacgctggtggttcgtcctggcgataaatcaaaatccgccacgccaaaacgggcggttggcctgctgcatctgccaatgggggacgaaaatcgtcgcctgaacatcgcactggataacccgcaaaaaatgcgtccgaaccagacgctttctgtgaaagtgaaagccagcgtaaaagagggggctgtgccacagaaggtgaacgtgctggtctcggctgtcgatagcggcgtgctgaacattaccgactacgtcacgccggatccgtggcaagctttcttcggtcagaagcgctatggcgcggacatctatgatgtttacggccaggtgattgaaggtcagggacgtctggccgcactgcgctttggcggagacggcgatgaactgaaacgcggcggtaagccaccggtgaaccatgtcaccattattgcccagcaggcgcagccggttacgcttgatgccaacggcgaaggcaccatcacgctgccgattggcgatttcaacggtgaactgcgtctgatggcgcaggcctggacggaagacgatttcggcagcagcgaaagcaaaatcattgtggcggctccgattatcaccgagcttaacacgccgcggttcctcgcaagtggcgatacctcccgcctgacgctggacctgactaacctgactgaccagccgcaaacgctgagcattgcgttaaccgcagccggtaagttgtcgctcgaaggtgctcagccagagccggttaagctgccgccaggcgcacgtagcaccctgtttataccggtgcgtgccctggagggctatggcgatggggaagtgactgctcaggtgacgggccttcagctgccaggtgagacgtttgcgccgcagcagaagagctggaaaattggcgtgcgtcccgcattcccggcgcaaaccgtgaatacgggcacgatgctgaatcctggcgaatcctggagtgcgccagcacagcatatcgaaggtttctcgcctgccacgctacaggggcagctgttgctcagcggtaaaccacctttgaacctggcgcgctacatacgtgaacttcaggcctatccgtatggatgtcttgagcagaccaccagcggcctgttcccgtccctctacaccaacgcggcacagctgaaggcactgggcattaaaggcgataccgacgataaacgccgtgcggccattgatatcgggatctcccgtctgctgcaaatgcagcgtgacgatggcggttttgccttgtgggataaaaacggcccggaagagtactggctgaccgcctatgtcacggacttcctggtgcgggcaggggagcagggttacagcgtgcctgccgaggcggtgaataacgccaacagccgactgctgcgctatttacaggatccgggcatgatgtccatccgctacagcgacgacacccaggccagcaaatttgctgtccaggcgtatgcttcgctggtgctggcgcgtcagcaaaaagcgccgctcggtgcgctgcgtgaaatctgggagcgccacgctcaggctgcttccgggcttccgttgatgcagctgggcatggcactcaaactgatgggggatgcaccgcgcagccagcaggcgctggatctggctctcaaaacaccccgtaacgacagccgaaactggatggcggattacggcagccagctgcgtgataatgccctgatgctctccctgctggaagagtacaagctgctgccggatgcgcaaaacaggctgctgaacgcgttatctgaagacgcgttcagccagcgctggctgtctacccaggagagcaatgcgctgttcctggccggacgatcactgcaaaccttgtcaggtgcgtggcaggcaacgacctctctctctgaacagacccaaagcagtgataaagcgcaggtagaaaacctgaacggcgatcagattggtgcgttgaagatgacgaataccggcactacgccgctgtgggtacgactggacactactggctatccggagtatgcgcctcagccatcctctaatgtcttgcagattgaacgtcatatcctggcgacagacggcagcagcaagtcgctctcttctctgaagagcggtgaactggttctggtatggctggaagtgaaggccagccagaacgtgccggatgcgctggtggtggatctgctcccggcaggtctggagctggaaaaccagaatctggcgagcagcagcgccagcttgcaggacagcggcagtgaagtgcaaaacctgctgaatcagatgcaacagtctgatattcagcacatggaattccgcgacgatcgctttgtggccgcggtgccggtcaatgaaggtcagccggtcacgctggtttacctggcccgtgccgttacgccgggaacctaccaggtgcctgttccgatggtcgagtccatgtacgttccgcagtggcgggcaacgggggcggccagtggcccgctgatcgttgttccgtaa

SEQ ID NO: 3675 - DNA, 535 bp, Enterobacter cloacae
ataatttgtccgtctgagagggacccaatgcaattgcgtaaattacttctgccaggactgctttctgttacgttattgagtggttgttcactgttcagtggcgaagaagacgttgttaaaatgtccccgctgccgacggttgaaaaccagttcaccccatctaccgcctgggacacttccgtaggcgatggtattggcgatttttattccaacctgcacccggcatttgctgacggcgttgtctatgcggccgatcgcaaaggcaccgttaaagcgctgaacgctgatgacggaaaagaagtgtggtccattaacctggcggaaaaagacggctggttctcccgtaaacctgcactgttttatggcggcctgaccgttactggcggtcacgtgtatgtgggcagcgaaaaagcgcaggtttacgcgctgaatgccagcgtcggttcggttgcatggcagaccaccgttgccggtgaatccttgtcgcgtccggtgttcaccacggggaatgagcatcggcgtttgcatctacatc

SEQ ID NO: 3676 - DNA, 1008 bp, Enterobacter cloacae
acagttcgcgcaggaggtgacgttacaatgtcagtgatctcctctcccgtcagtaagccgcgtcgctggctgcacctctggcctctggcgctctttttgttgttagcggttggcggcgcgctctggctgtggcaggcatggccgcaggtgatggtgaaaagcgtcctctggcagcgggaagttaatcagcagatgagcgtgctgctgaaagccgtggcggaaaatccgaccaaagcgggcggcgctcttctggcgttcagctttatctatggcgtgctgcatgccctggggccggggcacggcaaaattgtcatcacgacctggcttgccacgcatccgtcgaagctgaaatcgagtatcggcctgacgctggcttcttctttacttcagggcggtgtggcgattgcgctggtcgtggtcgtcctctcgctgctacagctgccggctcgccagctgcatatgagcagcttctggctggagaaggggagttacgcgctggtaggcgtgctggggttgatcctctgctggcgggcgctgaaaaaattgcgcgcgttgctgcaaaaaccaaaattcaaagcctttacgccgcatcacgttcaccatgaaaactgcgggtgcgggcatcagcatctgccgacgcaggaacaattacagaatggtgacgactggcgtgcgcgtctgatgattgtgctctcaatggggatgcgtccgtgctcgggcgcaatcatggtgctgttgttcagcaaagtgacaggcgtatttggctggggcatgctctcggcgctggcgatggcggcgggaacgtctctgacgatctcttcgttagccttgctggtgcacagcttccgtcagctggcggtaaaactcagcggcaataaaacgccggtattgtggcgacaggttggctggacgacgcttgcgttggcgggcggggtgattctgctggtggctgcggtcacgatgtggatgagcgcgctgccggtgggaagggggttgcggcctttctag

SEQ ID NO: 3677 - DNA, 537 bp, Enterobacter cloacae
caggctacccctgagattgttatggattacttcactctcttcggactacccgctcaatacccgatcgatctccaggcgctgacggtccgttttcaggatctccagcgtcagtaccatccggataaattcgccagcgggacgcaggcagagcaactggctgcggtatcacactccgccaccatcaaccaggcctggcaaacgctgcgtcatccgctggcgcgtgcagaatatctgctctcgcttcacggtttcgatctggcgagcgaacagcataccgtgcgcgacgccgcctttctgatggaacagctggagctgcgcgaagagctggatgaaattgaacaggctaaagacgaagcgcgcctggaaagctttatcacgcgcgtaaagggtatgttcgatacccgccatcagcagatggtggagcaactgaacaacgagacctgggacgtggcggcagacactgtgcgcaaactccgttttctcgataaactgcgaagcagtgctgaacaactcgaagaaaagctgctcgatttttaa

SEQ ID NO: 3678 - DNA, 363 bp, Enterobacter cloacae
aaggccagtccgtggacgaggtttaatatgccaaagattgtaattttgcctcatgcggacctctgtccggatggtgctgttctggaagcgaagaccggtgaaaccattctcgatgtagccctgcgtgcaggtatcgaagtggaacacgcctgtgaaaaatcctgtgcctgcaccacctgccactgcatcgtgcgtgaaggtttcgactctctcgccgagagcaccgaagacgaagacgacatgctggataaagcatggggtctggagccagacagccgcttaagctgccaggccgcggtgaccgatgaagatctggtcgtggagttcccacgctacaccatcaaccacgcacgcgagcactaa

SEQ ID NO: 3679 - DNA, 2343 bp, Enterobacter cloacae
tcgttgttccgtaagatgcggatagcacgcctgattcgctcccgctggctgtggctggcgggagcgcttctcgtttcaggggggctgattgtcgtcgctgaccgcgtgtggccgttgcccctgaaagaggtcaaccctgcgcgagtggtggtggatgagcagggtgttccgttgtggcgttttgccgacagcgaaggcatctggcgctatccggttaccattaaagaggtttccccacgctatcttgaggcgctgatccagtatgaagatcgctggttctgggatcacccgggcgtcaatccgctatctgtactgcgtgccgcctggcaggatctcacctccgggagagtggtttctggcgggagcacgcttaccatgcaggtggcacgccttctggatccgcatccgcgaacctttggcggtaaaattcgtcagctgtggcgggcgatgcagctggagtggcatctctccaagcgtgaaatcctgacgctgtatctgaaccgtgccccgtttggcggcacgttgcagggcgtgggcgcggcaagctggacttaccttggcaaaccgccgtctcagctgagctattccgacgcggcgctgctggctgtactaccacaagcacccagccgtctgcgcccggaccgctggccggaacgtgccgaagcggcgcggaacaaagtactcgaccgcatgctgactcagggcgtctggtctgagaagcaggtgaaagagtcccgtgaagagccggtctggctggccccccggcagatgccgcagctggcgccgctcttttcccgcatgatgctgagtaaaagtcgtgacacaaaaatagtcaccacgctggatgcagcattgcaacgacagcttgaagagctggcaatgaactggaaatcacgcctgcccgcccgcagttcgctggcgatgatcgtcgtggatcatacatccatgaaagtgcgtggctgggtaggctcggtagatatcaatgatgacagccgtttcagccacgtagatatggtcaatgcgatccgatcgccgggatcggttctcaaaccattcatctatggcatggcgctggacgatggtctgatccatcccgcttcgttattacaggatgttccaagaaaaacgggggattatcgtcccggcaactttgacagcggcttccatgggccggtcagtatgagcgaagccctggtgcgttccctcaacctgcctgcggtgcaggttctggaagcgtacggcccaaaacgttttgccggaatgctgagcaacgcgggattaccgctcattctgcctgcgggggcacagcccaacctctctctgatcctggggggcgcaggcgcacgcctggctgatatcgctgccgcctatagcgcctttgcgcgtcagggtaaggcgggccggctgcgtttacagccgggcgatccgctgatcgaacgtccgctgttatcgcagggggcggcgtggattattcgtcgcattctcgctaatgaagcacagcccctgccggacagtgcgctgccccaggttgcgccgctggcgtggaaaacgggcaccagctatggctaccgggatgcctgggccatcggcctgaatgcccgctatgtcatcggaatctggaccggacgcccggacggcacgcccgttgccgggcagtttggtttcgccagcgcggtaccgctcctgaatcaggtcaataacatgcttcagtcccgctcgatggtggatgaagcgcgcctgccgcgcgatccgcgtcccgcaagcgtaggacggggcgtgatttgctggccggggggccagtccctgcctgaagggagcgaaaactgtcggcgtcggctgtcaacctggctgctggaaggcagtgaaccgcctacgctgctgctgccggaacaggaaggtattcgcgggatccgtttcccggtctggctggataaagaaggcaaacgcgttgcggcggattgtcctgatgcgacagaaaaagtgctggatgtctggccgctgccgctggagccctggctgcctgctgccgaaaaacgggctgctcgtctccccgcccgttcagcaatttgccctccgctggataaccataatgcggcgccgctgatgttgtcaggcgtcagagaaggggcggtaattaaacgtcttccaggtgagaaaaatattaccctcaacgtttcaaccagcggcggggaggggcaacgatggtggtttttgaatggcgaaccgctggacgggcatcagaagaattattcactgcaattatatttgcctggtaaatatcaattaattgtattagatgaaacaggacaaacggcgacggtgaattttgaattagatcgctaa

SEQ ID NO: 3680 - DNA, 633 bp, Enterobacter cloacae
agcatgagtcagtttaaacattacgcaccggtgagcgacaaacagctgggtttttatatcgactcttctcgctgctcgggctgcaaggcatgccaggtggcgtgcaaagataaaaacaaccttgaggtcggacgtcgtttccgtcgcgtttatgaagtcaatggcgggaatttcatcccaaccgggcagggcggcgtcagcaacaatgtgtttgcctacacgctctctatttcctgtaaccactgtgcagacccaatctgcactaaaaactgtccgaccacggcgatgcacaagcgtccgggagacggcattgtgcgcgttgatactgataagtgcgtcggctgcggctactgcgcgtggtcttgcccttacggcgcgccacagctcaacgagcagaccgggcagatgtccaaatgtgatttctgcgtggatctccaggcgaagggagagcagcccgtctgtgtggcaacctgtccactcgaagcgattaaattcgggccgattgatgaactgcgggcgaagtatggtgcggtctgtgatgtgaaaggcctgcctgattcctccatcaccaaaccaaacctggtgatcaaagcgcatcagggcgcagagaaagaggggaaacgtcatgcatga

SEQ ID NO: 3681 - DNA, 912 bp, Enterobacter cloacae
gctgatgctgcgctttgttttcttcagtattggctgatgggcggattgacctttgccccggcgatggacgtgacgcatgcgtgcgtccgtcgccgttttcgccactcttcctgcctcgcctgcgcggacgtctgtcctgtgcaggctttttcttttaccgactcaggcgtctcggttgatgacagccgctgtattgaatgcggtgactgcctgttcgtctgccccgctggggccatcaccggcatcacgccgcgaaaacgctttctgagtggcgatacgcttgttgggccgtttactgaccgtgcgccaggggtgaatgagcttctgctgtggcacgcgcagtaccacgttcgttttatcagtatcgacgcggaacagaatcctgactggttgctggcgattgcccggctgaatctggcgcttcgtcgacgcggtgaagcggcgtgggcgtttaaacatatacccgtcaacgaggttaataccgcccggcgtgcgctgatgcacgttccccgtgaggatgtccgggtctgtagcgtcgtgcccggtcagcgtgatctgcgcagggcgttttctgcgtttagcgaggcagagataactctcgataccgaatcctgcgtactctgcggcgcgtgctggcggagttgtacggaaaacgcgattcggtttcagaacactgaactggtcgtggaaaccggacgctgtacggggtgcggcggctgcgtagcggtatgccagcatgcggcgataaacgtgacgcaaacagaaggaacagcgaaaagcgtgaccataccggcatatgaagccgtttgcctgacgtgccaccgtcatttctggtcatttacgtctgatgaaaagcagtgtccgctctgttttcatcatcaacacggtatgcgaaatacgagctgttgctaa

SEQ ID NO: 3682 - DNA, 1170 bp, Enterobacter cloacae
tgccgaacaatcagcagcacagtaacagacgggcaatgcgggagattttacatgcataaccaggctcctattcaacgtagaaaatcgaaacggatttacgttgggaacgtgccaatcggcgatggggcgcctatcgccgtccagtcgatgaccaatacgcgtactacggatgtagaagcgacggtcaatcaaatcaaagcattagaacgcgtcggcgcggacattgttcgcgtctctgtgcctaccatggacgccgccgaggcgttcaaactgatcaagcagcaggtgagtgttccgctggttgccgatattcacttcgattaccgtatcgcgctgaaagtcgctgaatacggtgtcgattgtctgcgtattaacccaggcaacatcggcaacgaagagcgcattcgcatggtggttgactgcgcccgcgacaaaaacattccaatccgtatcggcgtaaacgctggctctctggaaaaagatctccaggaaaagtacggtgagccgacgccgcaggcgctgctcgaatccgcaatgcgtcacgtcgatcatctggatcgccttaacttcgatcagtttaaagtgagcgtgaaagcgtctgacgtcttcctagccgttgaatcgtatcgtctgctggcaaaacagatcgatcagccgctgcatcttggcatcaccgaggcgggcggtctgcgcagcggttcggtaaaatcggcgattggtctcggcctgctgctctctgaaggcatcggcgacacgttacgcgtctccctggccgccgatccggtggaagagatcaaagtcggtttcgacatcctgaaatcactgcgtatccgcgcgcgtgggatcaacttcatcgcctgcccaacctgttcacgtcaggagtttgacgtgattggcaccgtgaatgctctggagcagcgcctggaagacatcatcaccccgatggacgtttccatcatcggctgcgtggtgaacggtccgggtgaagcgctggtgtccacgctgggcgtgaccggcggtaacaagaaaagtggtctctatgaggatggcgttcgtaaagatcgtctggataatagtgacatgatcgaccagctcgaagcccgcattcgtgcaaaagcgacgatgatggacgaagcgcagcgcatcagcgttcagcaggttgaaaaataa

SEQ ID NO: 3683 - DNA, 1323 bp, Enterobacter cloacae
ttgaacccattctttgggttcttttttgtatatagaaagagaataaacgtggcaaaaaacattcaagccatccgcggcatgaacgattatctgcctggcgaaaccgccatctggcagcgcattgaaggcacactgaagcaggtgctcggcagctacggttacagcgaaattcgtttgccgattgtagagcagaccccgttattcaaacgcgcgatcggcgaagtaaccgacgtggttgaaaaagagatgtatacctttgaggaccgcaacggcgacagcctgaccctgcgtcctgaggggacggcgggttgcgtacgcgccggcatcgaacatggtctcctgtacaatcaggagcagcgcctgtggtatatcggcccgatgttccgccacgaacgtccgcaaaaaggccgctaccgtcagttcaaccagcttggcgtggaagtgtttggtctgcaaggaccagatatcgatgccgaactgattatgctgactgcccgctggtggcgtgcgctcggtatttctgaacacgtatccctggagctgaactctatcggttctctggaagcgcgtgcgaactatcgcgatgcgctggtggcgttcctggaacagcacaaagagaagctcgacgaagactgtaagcgtcgtatgtacagcaacccgctgcgcgtactcgattccaaaaatcctgacgtacaggcgctgctgaacgatgcgccagcgctgggtgactacctggatgaagattctcgcgaacactttgccggcctgtgcaagctgcttgaagcggcgggcattgcttataccgttaaccagcgtctggtgcgcggtctggactactacaaccgcaccgtatttgagtgggtcaccaccagcctcggttcgcagggcaccgtctgtgctggcggtcgttatgacggtctggtcgagcaactgggtggtcgcgcagcaccggcagtaggcttcgcgatgggccttgagcgacttgttttgctggttcaggcagttaatccggaatttaaagccgatcctgttgtcgatatatacctggtggcctcaggtgcggatacgcagtctgcggcaatgcagcttgccgaacgcgtgcgcgatgcgctgccggacgttaagctgatgaccaaccacggcggcggcaactttaaaaaacagtttgctcgtgccgataagtggggcgcaagtatcgcactggtgctgggtgagtccgaagtggccaacggcgaagtggtagttaaagacctgcgctctggtgagcaaactacggtaacgcaggatggcgttgcggcgcacttgcgcactctattgggctaa

SEQ ID NO: 3684 - DNA, 651 bp, Enterobacter cloacae
cgtgaggaacagatgcaaatagttaaacaaagcgcggtagcgttatttttggcggttttcactttcgccgccggcgcacatcctcacagttttatcagcctgaaaaccgaactggtgacggacggcacgcagctcagtggcctgaagatgcactggacgatggatgaaatcacctccgccgacctgctgtacgatgccggaaacgcaaagcccggcgatgagatctggaaaaagctggcggcggaggtgatggccaacgtgctgggtcagcactacttcaccgagttctggcacaacggacaaaaggtgaaatttcttaaccgtcccacggagtacggcatgacccgcgaaggtcatcaggcggtgctgacgttcgtgcttccgctggcgcatcctcagccgctgcccgggcaaacgtaccgcttttcaacttttgaccctacctactatgtcgatatgcgctatgacaaagacagcgacgtacggctgccggacgcgctgcaaaaaagctgcaaaattggcgtgcacacccctaaacccagcgaagagacgctgaactttgcgatctcgctggataaagcagatgccccgcctgaggacatggagctgggtaaacagttcgcgcaggaggtgacgttacaatgtcagtga

SEQ ID NO: 3685 - DNA, 807 bp, Enterobacter cloacae
cagcgggatcggattatgtctctcgtttatgataatatgcccgaatattcttcagacactgaatccagacatctaaaaattatgctgcaaaacattcgaatcgtgctggtcgaaacatcgcacaccggcaacatgggctctgtggcccgcgctatgaaaaccatgggcttaacgaacctgtggctggttaatccgctggtgaaaccagactctcaggctattgctctggcggccggcgccagcgacgtgatcgggaatgcgcagatcgtggacaccctggacgaagccctggccggttgcagtctggtggtggggaccagcgcgcgctcccgtacgctgccctggccgatgctggacccgcgcgaatgcggcctgaaaagtatctcagaagcggaacaggcgccggttgcgctggtgtttggtcgtgaacgcgttggcctgaccaacgaggaactacagaagtgtcactaccacgtggcgattgccgccaatccggaatacagctcgctgaacctggcgatggcggtgcaggtcattgcctacgaagtgcgcatggcatggctggcgacgcaggagaaaccggtcgaacctaaagaagagacggcctacccgctggtggacgatctggagcgcttctacggtcatctggagcagacgctgctctcaaccggctttatccgtgaaggccacccgggtcaggtgatgaacaagctgcgccgtatgttcacccgcgcccgcccggaaagccaggagctgaacattctgcgcgggattctggcgtcgattgagcagaagaacaaagcgtag

SEQ ID NO: 3686 - DNA, 495 bp, Enterobacter cloacae
gacatgagactgacatctaaagggcgttatgccgtgaccgcgatgctggacgttgcgctcaactccgaagcgggcccggttccgttggctgatatttctgaacgacaagggatctccctctcttacctggaacagctgttctccagactgcgtaaaaatggactggtgtccagcgttcgtggcccgggcggcggttatctgctgggtaaagacgcgggcagtattgcggttggcgaagtgattagcgcggttgacgaatccgttgacgcgacccgttgccagggtaaaggcggctgtcagggcggcgataaatgcctgacccacgcgctgtggcgcgatctgagcgaccgtctgaccggcttcctgaacaacatcaccctcggtgagctggtgaataaccaggaagttctggatgtctctggtcgtcagcatagtcaggattcacagcgcagcacccgcacgcaggacgccatcgacgttaaactgcgcgcgtaa

SEQ ID NO: 3687 - DNA, 1320 bp, Enterobacter cloacae
gtattcagaatcaggccggggtggtcacaccccgcgtactcggtcgtacatccagccggttgcctgattccttgcattgaagcgatgtacggagtttatagagcaatgaaattaccgatttatctcgattactccgcaaccacgccggtggacccgcgtgttgccgagaaaatgatgcagtgtctgaccctggacggaaactttggtaacccagcttcccgttcacaccgttttggctggcatgctgaagaggcggttgatatcgcccgtaatcagattgctgacctggtcggtgccgacccgcgtgaaattgttttcacctccggtgcgaccgaatccgacaacctggcgattaagggtgcagccaacttttatcagaaaaaaggcaagcacatcatcaccagcaaaaccgaacacaaagccgtgctggacacctgccgtcagctggagcgtgaagggttcgaagtcacctatctggcgccacagagcaacggcattatcgatctgaaagagctcgaagcggcgatgcgtgatgacaccattctggtctccatcatgcacgtcaacaacgaaatcggcgtggtacaagacatcgcgaccatcggcgaaatgtgccgcgcgcgcggtatcatctaccacgtggacgcgacccagagcgttggcaaactgcctatcgacctgagccagctgaaagtggacctgatgtccttctccggtcacaaaatctatggtccgaaaggtatcggcgcgctgtacgttcgtcgtaagccacgtatccgcatcgaagcacagatgcacggcggcggtcacgagcgcggcatgcgttccggtacgctgcctgttcaccagatcgtgggcatgggcgaagcctaccgcattgcaaaagaagagatggaaaccgagatggcacgcctgcgcacgctgcgtaaccgtctgtgggacggcgtgaaagatatggaagaagtgtatctgaacggcgatctcgagcagggcgcgccgaacatcctcaacgtcagcttcaactatgttgaaggcgagtcgctgatcatggcgctgaaagacctggccgtttcttccggctctgcctgtacctctgcaagcctggagccatcctacgtgctgcgcgcgctgggtatgactgacgagctggcacacagctctatccgtttctctttaggtcgttttactaccgaagaagagattgactacaccatcaagctggttcgtaactccatcggccgtctgcgcgacctttctccactgtgggaaatgttcaagcagggcgtggatctgaacagcattgaatggtcacatcactaa

SEQ ID NO: 3688 - DNA, 411 bp, Enterobacter cloacae
tcggtacataaggagaattcaatcatggcatacagcgaaaaagtcatcgatcattacgaaaacccgcgcaacgttggctcttttgacaacagcgacgaatctgttggtagcggcatggtcggtgcgccagcatgtggcgacgtgatgaagttgcagatcaaagtcaacaatgaaggtatcattgaagacgcgcgcttcaagacctacggctgcggttcagctatcgcgtccagctccctggtcaccgaatgggtgaagggcaagtctctggacgaagcacaggcaatcaagaacacggatattgctgaagaactcgaactgccgccggtgaaaattcactgctcaattctggcagaagacgcgatcaaagccgccattgcggattacaaaagcaaacgtgaagcaaaataa

SEQ ID NO: 3689 - DNA, 264 bp, Enterobacter cloacae
ccgatgaagatctggtcgtggagttcccacgctacaccatcaaccacgcacgcgagcactaatatgggactgaagtggacagacagccgtgaaatcggcgaagcgctctacgacgcgaacccggatctcgatccgaagaccgtacgattcaccgacatgcaccagtggatctgcgatttagaggatttcgacgacgatcctaacgcatccaatgaaaaaattctggaggcgattctgttagtctggttagatgaagcagaataa

SEQ ID NO: 3690 - DNA, 1308 bp, Enterobacter cloacae
ttgctaataaggataaataaaatgaccgaagcgatgaagattacgctctcgaatcagcctgccgacgcgcgctggggcgagaaagccacctacagcattaataacgacggcattaccctgcacctgacgggcaacgatgatttgggcctgatccagcgcgccgcgcgtaagattgacggccttggcattaagcatgtgtcgctggaaggggaaggttgggacaccgaccgcagctgggcgttctgggcaggctacaaagggccgaaaggcacccgtaaaattgagtgggcgaacctcgacgaagccggtcagaaagagctggaaagccgcctgaacattatcgactgggtgcgcgacaccattaacgcaccggcggaagagctggggccggaacagctggcgcagcgcgccgttgacctgctgtgcggtgtggcgggcgaaaagatgtcctaccgcatcactaaaggggaagacctgcgcgagcagaactacatgggtatccacaccgtgggccgtggctcagagcgtcctccggtcctgctggcgctggattacaacccaaccggcgacaaagaagccccggtctttgcctgtctggtcgggaaaggcatcaccttcgacaccggcggctacagcctgaagcagagcgcattcatggactccatgaagtccgacatgggcggcgcggcgaccattaccggcgcgctggccttcgccatcacccgtggcctgaacaagcgcgtgaagctctacctgtgctgcgcggacaacatggtgagcggcaacgccttcaagctgggcgacatcattcgctaccgcaacggtaaaaacgttgaggtgatgaacaccgacgccgaaggccgtctggtgctggccgatggcctgatcgacgcctctgcgcagaagccggagctgattatcgacatggcgaccctgaccggcgcggcgaaaactgccctgggtaacgactatcacgccctgttcagcttcgacgacaagctggccgctcgcctgctggccagcgcggcggcggaaaacgaaccgttctggcgtctgccgctggccgagttccaccgcagccagctgccgtctaacttcgccgagctgaacaacaccgcgagcgcagcgtacccggcgggggcaagcaccgcagcaggcttcctgtctcacttcgttgagaactaccatgaaggctggctgcacattgactgctccgcaacctaccgtaaagcggcggttgagcagtggtctgcgggtgcgaccggtctgggcgtgcgtaccgtagcgaacctgctgacggctgagtaa

SEQ ID NO: 3691 - DNA, 804 bp, Enterobacter cloacae
gggggaaattcgacatctggaattactatgtcagaaaccaaaaacgaattagaaaccctgttggagcaggcggcgaccgagcccgcccaccgtccggcctttttccgcacgctgctggaatccaccgtctgggtgccgggcaccgcagcggaaggggagcaggttgtcgaagacagcgcgctggatctgctgcactgggagaaagacgacggcacgtcggtgatcccgttctttacctcgctcgaggccttgcaggaagcggtagaagacgaacaggcgttcgtggtgatgccggtgcgcacgttgttcgaaatgaccctggggcagacgctgttcctcaacgccaaactaccgaccgggaaagagtttactccgcgcgaaatcagccacctgattggtgacgagggcaacccgctcagcactcaggaggtgctggaagggggcgaaacgctgctgctgtctgaagtggccgagccgcccgcgcagatgattgactccctgaccacgctgtttaaaaccatcaagccggtaaaacgcgcgtttctctgctccatcaaagagagcgctgacgaaaagcctgttctgctgatagggattgaggccgacggcgatgttgacgagatcatccaggcggcgggaagcgtggcaaccgacaccttgccgggcgatgagccgattgatatctgtcaggtgaagaaaggtgagaaggggatcagccactttattaccgagcacatcactccgttctacgagcgtcgctggggtggcttcctgcgcgatctcaagaccaaccgcattatctga

SEQ ID NO: 3692 - DNA, 2418 bp, Enterobacter cloacae
aaaaaaacgagaatgcgtttttatttgaaggaacgagcaatgaaaaaaaataaacatcagggagaagggcttattcccgccatatcccggcgtcattttattcaggcagggtcggcgctcgccgccctgccgtttgtcgtcaaaaccggcaaagtacaggcacaggacgcggcggtttcagacgctacgcctgaagaaaaagtggtgcaaacctgtagtacgtttgactgcggcggcaagtgtgatattcgtgctcacgtcagtgatggcgttgtgacccgaatttcaacgcgaccggataacgcgctggatccgcagatgccagtgatgcgcgcctgcgttcggggtcgggcttatcggaaatttgtttatcatcccgatcggcttaaatatccaatgaaacgcgtgggtaaacgtggcgaaggaaaattcgaacgtattacctgggatgaagccaccacccttattgcgaatcaattaaaaactattacgcaaaaatacggtgctgcgtcacgctatgttcatgtgggcaccgcggtgtccggcgggaccttttccggcgataaaatggttcgtcgtctgctcaacttaaccggcggctatctcgaaagctatcactcggtcagtatgggtaacacggcggcggcaacgccgtatacctatggcaccgccgccagcggcagctctctggacacgctgctggacaccaaactggtcattctctgggggcataacccgacggaaaccatcttcgggcacagcaaccacttctaccagaagatgaagcaaaacggcacgcgctttatcgttgttgacccacgctattccgatacggtttcctcccttgccgatcagtggatcccattgcttcctgccacggacaatgccctgatggacgcgatgatgtatgtgatcgtcacggagaatctgcacgatcgcgactttattcaacgctacaccctgggctttgacgaagacgccatgccagaaggcgttccggccaatgaatccctgatggcttacctgagcggtgcaaaggatggcgtggcgaaaacgcccgagtgggcagagaaaatcactcacgtgcctgcacaaactattcgtcagctggcgcgcgactacgcaaccaccaaacccgccgcgctgatccagggctggggaccgcagcgtcacaactgcggcgagcgcaccgcgcgcggctcgacgatactggccacgctgacgggtaacgttggggtgaaaggcggctgggcagcaggctatggaggctgcgcaaaccgcaaatttgcggccgggccagagatgccggacaacccggtcaaagccaaaatttcggtcatgaactgggtgcaggctgctgatgatgcttctaaggtaaccgcggaagatggcctgaaggatgctgagaagctggacagcaatatccgcatcctgttctcgctggcgggcaattatctggctaaccagaacccggatcttcatcaggcaacccgtgtcctggaagacgagtcgaaaatcgagtttatcgtcgcaagcgatctgtttatgacgcctagcgccagatacgccgacctgcttttgccggaaaccagctttatggaacgctggaatatcggcgaaacctggggcacggcaagctatctgatcctgtcagaaaagctcattgaacctgaattcgaacgccgttcagactacgactggctgcgggaggtcgctgctaagcttggcgtcgagccagcgttcagcgagggccgtgacgaaaaagcgtggattgagcacatctgggagcagacgcggctgtccatgccggatgaaaacctgccggacttcgcgacgctacagaagacgcgtcagcatcttttcaaaagcgcgccgtacgttgcctttgaagacaacattcgcgatccgcagaatcatccgttcccgacgccgtccggaaaaattgagatcttctcgaagcgtctgtacgacatgcatcacccggaaattccggcgctgtcgcactacgtgcctgcccatgaagggccggaagacgagctggcgaaaaccttcccgctccagctgatcacctggaaagggaaaaaccgcgctaactccacccagtacgccaacccgtggttaattgaggcgcagcagcaaaagctgtggatcaacccgcaggatgcgcaaaagcgcggcattgcgcagggggataccgtgcgtattcataacgcgcgcggcatttgcgagatcccggcggaggtcacgccgcgcatcattccaggcgtggtggccatgcaggcaggcgcctggtggcagccggacgagcagggtatcgataaaggcggctgcgcgaacgtgctcagttccgcccgtattaccgcgcttgcgaaagggaattcccatcaaaccatgctggtggaggtagctaaagcatga

SEQ ID NO: 3693 - DNA, 819 bp, Enterobacter cloacae
tcaaagcgcatcagggcgcagagaaagaggggaaacgtcatgcatgagttaccactgctgatttttacgttgttcctgcaaggatcggttggcgttacgctgtggctggcgttcggaagcacgcaacgcagcgtgctgctgccggcagccggagcgtttgtgctggcgagcctggggctgctcgcctccgcgctgcacatgggctatccgcttaatgctcttaacgcgctgcgccacgtatccagctcctggctgagccgtgagattatctttgccagtctttatcttgcggcgcttggcttcgcaacgctgctgatgattgtcaaaaagccaggctggaagccgctgttggttgtgtcaggtctggttggtttagtcgatgtgttctgcatggcgcagatctacatgcacgcatccgtggtgacatggcagcatgttaacactctggtgctgtttatcggttcggtggggattatcggttcagcctgcatggtcgttgggacgcgttcccagtcaaccgtgcgtgcggcggttgtcattatcacgctgctggtgcttgtgcgtctggtgatgcagcccgtctggctggcagatattacgtctatggaccacaccgtggtgacgttccctcatgcaccgctacagatgctggagcaactgcgaaccgttcatctgctgagctggtgcgtatccgttgcgggtatgctgtgctttgctgcgggcggtctgaaagcggcgcgatctcccatactgctgggaggcgcgttgctgattgtcggtgagctgatgctgcgctttgttttcttcagtattggctga

SEQ ID NO: 3694 - DNA, 516 bp, Enterobacter cloacae
gcaatggcgctattgctctttataatccgcgccacaccatactcaggtatgcaaaaacaacagaacattttacagaggttatcaatggctattgaacgtactttttccatcatcaaaccaaacgcggtggcaaaaaacgttattggcagcatcttcgctcgctttgaatcagcagggtttaagatcgttggcaccaaaatgctgcacctgaccgttgagcaggctcgcggtttctacgctgagcacgaaggtcgcccattctttgacggtctggtcgagttcatgacttctggcccaatcgtggtatccgtactggaaggcgaaaacgcggtacagcgtcaccgcgatctgctgggtgcaaccaacccggacaacgcactggcaggtactctgcgcgccgactacgcagacagcttcaccgagaacggcacccacggttccgactctgttgaatctgctgcgcgcgaaatcgcgttcttcttcgctgaaggcgaagtgtgcccgcgcactcgctaa

SEQ ID NO: 3695 - DNA, 1311 bp, Enterobacter cloacae
tttcgtaaatgccgcgtgcaaacgtggcatccctgcgccagactttgtacaatgcaacgccccggacgagcagactgcttaccggggcgtttcttttcaacccaccaagggccacaacgtgtaacaacgaggccggaaaaaattatgtctgaattagtgaatacctccgaagtcgccattcctgcggttcccaataaaaatggaaaaattaacctgctggacctgaaccgtcagcagatgcgcgagttctttaaagagatgggcgagaagccgtttcgtgccgatcaggtcatgaaatggatgtaccactattgcagcgacaactttgatgacatgacggacatcaacaaagtgctgcgcaataagcttaaagaagtggctgaaatccgcgcaccggaagtggtggaagagcagcgctcttcagatggcaccatcaagtgggccattgccgttggcgatcagcgcgttgaaaccgtgtatatcccggaagacgatcgcgccacgctgtgcgtctcttctcaggtgggctgtgcgctggagtgcaaattctgctctacggcgcagcagggctttaaccgtaacctgcgcgtgtcggaaatcatcggccaggtctggcgtgccgcgaaaatcgtgggcgcggcgaaagtcaccggtacacgtccaatcaccaacgtggtgatgatggggatgggtgaaccgctgctcaacctgaccaacgtcgttccggcgatggaaattatgctcgacgatttcggttttggtctgtccaagcgccgcgttacgctctctacttccggcgtggtgcctgcgctggacaaactgggtgacatgattgacgttgcgctggccatctctcttcacgcgccaaacgacgccatccgtgacgaaattgtgccgatcaacaaaaagtacaatatcgaaaccttcctggctggcgtgcgccgttacctggagaaatccaacgctaaccagggccgcgtgaccattgaatacgtgatgctggatcatgttaacgacggtaccgagcatgcacatgagctggctgaactgcttaaagatacgccatgcaagatcaacctgatcccatggaacccgttcccgggcgcgccgtatggccgtagctcgaacagccgtatcgatcgcttctcaaaagtgctgatggagtatggtttcaccaccatcgtacgtaaaacgcgtggcgacgatatcgacgcagcctgtggccagctggcgggtgacgttattgaccgtaccaagcgtacgctgcgtaagcgtatgcagggtgagtcaatcgcggttaaaaccgtttga

SEQ ID NO: 3696 - DNA, 1011 bp, Enterobacter cloacae
cgaatgaatactgaagccactcacgatcaaaatgcagcactctccactggcgttcgtcttcgcaacgcccgtgaacaactcggacttagccagcaagccgttgcagaacgcctgtgcctgaaggtctccaccgttcgcgatattgaagaagataaggcacccgccgatctggcttcaacgtttctgcgcggttatatccgttcttacgccaaactggttcatatccctgaagacgaattactgccgatgatggagaagcaggcgcctgtgcgtgcggcaaaagttgcgccgatgcaaagcttctctctgggtaaacgtcgtaaaaaacgcgatggctggctgatgagctttacctggctggtcctgtttgtggttgtcggcctgacgggcgcatggtggtggcaaaaccacaaagcgcagcaggaagagatcaccaccatggccgatcagtcctccgctgagcttaatcagtctggtaataacggcgcgcaaagcgtgccgttgagcaccgaaggggcgacctccagcgaacctcagtcggcagcaagcaacacgcctgcaaccgagccagcggcgacgccagaagcgacgacgaatactgcgccagccacccagacccaggatcagaacgcggtcgtatcaccttctcaggccaatgttgataccgcccctgcggcaacggcaccggcagagaacaccgcggcgtcactgccaactgacccggctggcacggcggcacctgccgttgacccgaatgcgctggtgatgaattttacggctgattgctggctggaagtgactgacgcgacaggtaaaaagctgttcagcggcctgcaacgtaaagatggcacgttaaatctaacgggccaggcaccttacaagcttaaaatcggcgcaccggcagcggtacagatccagtatcaaggaaaacctgtcgatctgagccgctttatcagaactaaccaggttgcgcgtcttaccgttaatgccgaacaatcagcagcacagtaa

SEQ ID NO: 3697 - DNA, 678 bp, Enterobacter cloacae
cgcaggatggcgttgcggcgcacttgcgcactctattgggctaaggagaaggactgcgtggaaatttacgagaacgaacacgaccaggttgatgcggttaaacgcttctttgctgaaaacggcaaggcactggttgtaggggttattttaggtgttggtgcgctggtaggctggcgttactggaacaatcatcaggctgactctgctcgcggttcgtccctgaactacgaaaataccgttagcgcaatccgtgccgatcagccgcaaacgctgacggctgcggagaaatttgccgctgacaacaaaaacacctacggcgcgctggctgcgctggaagtggctcagcagtatgttgataaaaacgaactggacaaagccgctgcgcaactgtctcaggggcttgctgctgccagtgacgataatctgaaagcggtgatcaatctgcgtctggcgcgtatccaggttcagcagaaaaaagccgacgacgcgctcaaaacgcttgataccatcaaaggcgaaggctttgccgctattgttgccgatcttcgcggtgaagcactgctgagtaagggtgataaagcgggcgcgcgtaaagcgtggcaagctggcgtggatagtaaagcttcacctgcgctgagcgaaatgatgcagatgaaaataaataatttgtccgtctga

SEQ ID NO: 3698 - DNA, 951 bp, Enterobacter cloacae
agcggtgaaaaaataggggcttgctcgcgagttgaacgtggtgagcttgtcggtgtcagaaaaaacaccgacaatccttttttacggaaaagaatggaggcaaccatgtccacctcatattttgtcgctgccgactggctgattgagcacggcgacgacccggaagttcagattatcgacgcgcgcatggcccctccgggccaggagcatcgtgacgttcccgctgaataccgggcagggcacctgcctggcgcggtattttttgatatcgaagccctctccgatcacacctcttccctgccgcacatgctgcctcgcccggaagcgttttccgtggcgatgcgcgagctgggcatcagcaaagataaacatcttattgtttacgatgaaggtaatctgttttccgcgccgcgagcgtggtggatgctgaaaaacttcggcgtggaaaaggtatcgattctggcgggcggacttgcaggctggaagcgcgacgaactaccgcttcagcagggtgacgtcacgctgccggaaggggaatttgatgccacgtttgacgctaacgtggtcaagcgcctgaccgacgtgctggtcgtgagccacgaaaacacggcgcaaatcgtcgatgcgcgtcccgctccacgtttcaacgcagaagcggacgagccgcgaccgggactgaaacgaggacatatcccgggggcgctgaacgtgccgtggggcgatctggtgtttgaaggcgagctgaaaaccaccgatgaattgcgtgccatttttgaacgtcagggcgtggatttgcatcgtccggttattgccagctgcggctccggcgtaacggcctgcgtggtgatcctggcgctggcaacccttgacgcaaatgacgtgaccctgtacgacggcgcctggagtgaatggggtgcacgagacgatctgccggttgaaccggcgaaataa

SEQ ID NO: 3699 - DNA, 1353 bp, Enterobacter cloacae
aaggcctgccggtgcgcttttcagcgcccatcctttagctattcttatcaaacattcacactggatacccgacagatgatgacgacgcttgaaattccatctgtgctttccagttcgcagcgccgctgccaggtgcttttgatgctttacctgcccgatgctgccgtcaccgcacagagcataatcgctgccaacggcgtggacgacgtcatggcacggcaagatatagccgagacgcgcgatgaaatccagcgctatcatcggcttgatatcgtcacgcaccatgatggctgctaccgaattgagggttccgcccttaatcaacgtttgtgcctgctgcactggctgcgcagggcgcttcggctctgtccacattttgtcgcccaacagtttacccctgccttaaaaaccgcgctcaaacagcacggcattgcccgcccgctttatgacgatgcgaaccttcgggcgcttatcaacttttgtgcgcgcaagcttcagcgccagtttgagtcccgcgacgtacaatttttacagctctatctgcaatattgtctgattcagcatcatctgggcaatacgccggagttttcgcccgttcagcgcagctggacgctgtcccgaggggaatactttacggcgcaggaaattgtccgccactggaaacggcgcgtcccgcagggaacgcacagcgatgaacagctgttcctggcgctgctgtttatgatgcttcgcacacccgacccggtgatggataaacaccagcaggatcagcgcctgcgtcgcgccatcgtgcgtatgattgcccgtttccgggcacaaaccgggatgaacttcagcgatgagcaaggtctgaccgatcagctttatatccatctggctcaggcgctagaccgctccttgtttgacatcggcatcgacaacagtctgccggaagagatccaccgtttatacccccggctgctgcgcaccactaaagaggcgctgtttgagctggaagccgaatttggtctgcgattctccggtgaagagatggctctggtggcggtgatttttggtgcctggctgatgcaggagaccgatctgcatgaaaaacaggtggtcctgttaacgggggaaaataaagcgtgtgaagagttaattgagcagcagcttcgcgagctgacgctgctgccgctcaatattcgttatcttagcctggaggcgtttaagaaggagggcgcgccccgcgaggcggcgctggttattacgccttatccaaccgccctgccgctgttctcgccgccgctcattcatgccgttgagaccctgaacacgcagcagcaggaacacattcgcgtaatgctcgaatcgtag

SEQ ID NO: 3700 - DNA, 1572 bp, Enterobacter cloacae
gtgcgcggttcaataagagagaaagccatgaaacgagccgtgaacgccctacaaaatttcggaaaatcactttacggacctgtacttatcttacccatcgtcggcctgtttatcgcctttgggaatgtgctgggtaacggcaatctggccgagtacatgccgtttctcggccacccgctgatccagagtgtcggccagctgatcgccaagtctgccgtgtcggtgctggtcaacctggcgctggtgtttgccgttgggatccccattggactggcaacccgagacaaaggctacgcggcgctgattgggctggtaacttttatcgtgtttatcaatgccatgaacgtgacgttacagcttcagggggaactggcccctgcggaacagatgaaagccgccggacaaagcatggtgctgggcgtccaggtgctggaaatgggcgttttcgccgggatcctgaccggggcgctctccggttatctgtacaacaaatattccggtgtccagtttaacggcgcgatggcgatttactccggccactgctttgtcgcgattgtaatgctgcctgtctctatgctgctcggcgtgatcatgagcgaactctggccgtacgcacagcatggaataagcgccctggcgctggcgatcaaagggtccggtccgtttggcgtggcgatctacggtttccttgaacgcattctggtgccgacgggcctgcatcatctggtctatacgccgttcctgtataccgaactgggcggtacgcaggaggtgtgcggtacggcttaccagggcgcgcgcaatatctactttgccgagatggcctgcccggacgtgaagcagctcagcagcaccgtggtgtgggacgcacgcggcatcagcaaaatgtttggcctgcctgccgccgcgctggcgatgtacatgaccgcgaagccagagcgtaaagcgattgcgaaagcgattctgatcccggcggcgctgacctcgctgctggtcggcgtaaccgagccgattgagttctccttcctgtttgtcgccccgctgctgttcgtggtgcatgcggtgctgaccggtatcggcatgatgctgttctcgctgtttggcgttcacgccatcggcgccaacgggattatcgatttcatcctctacaacctgccgctcggcacggagaagtccaactggcccatgtacatcgtggtcgggctgatcatgttcgctctttatttcgtggtattccgcttcctgatcctgcgcttcaacatgaaaacgccggggcgtgaagatgaggaccaggagacacgcctttacagcaagcaggagtaccaggcgaagggcaataacgacgggctgggcgaatcgatcgttgtgggtctgggcggtcgggaaaatatagaggtagtggataactgctacacccgcttacgcgtcacggtgaaggacgtcgccatcatcgacgaaccgcgcctgaaagcgaccggcgcgaaagggataatcaaacaaggtaacaacgttcaggtggtctacgggctgcatgtcaaaaaaatgcgagaagccgttgagacgtttctctga

SEQ ID NO: 3701 - DNA, 1380 bp, Enterobacter cloacae
aaggagctaaagatgtttacacccccatttattctgtcgattgccggcggcggtagcacttacacgccaggtattgtgaaaagcctcatggtgcgtctgcacgatttccctctggcagagatccgcctgtatgacattgacgaggcgcgccagaacaccatcgcgcccgtggtggagaaggttattcgcgaccacagccagagcatcaaatttacggtcaccagcgacccagaagtggcctttagcggcgcgcattttgtcttcgcccagatgcgcgtcgggcagtacaaaatgcgtgaacaggatgagaagatcccgctgcgtcacggcgtggtgggccaggaaacctgcggccccggcgggctggcctacggcctgcgcacgatcctgccgatggtggagcttatcgatctggtcgatcgctacgcgcacgagaaagcctggatcgtgaactactccaacccggcggcgatcgtcgcggaaggcgtgcgccgcctgcgtccgaacgcgagggtgctgaacatctgcgatatgccggttgccgcgatgcgcaatatgggcgccattctgggcgtggatcgtcataaactggaagtggactacttcggcctgaaccacttcggctggtttacccgcgtgctggtggacggcgaagacaagctcccggagttgcgtaagcatatcgcgaagtttggcctgctgacggaagatgcggctaaaaccgatccgcagcattccgatccgtcgtgggtgaaaacctggcgcaatatcaagccgattatggataacttcccggagtacctgccgaacccgtatctacagtactacctgatgccgaaccagattgtggagcatcaaaacccggactatacccgcgccaacgaagtgatgaacgggcgcgagaaaaagctgttcgccgccgccgaagaatatcaacgcaccggaattttaccggatgccttccacgtgggcgtccacggtgaatttatcgttgacgtcgcctgttcgctggcgttcaacctgcgaagccgccatcttgtgatggtggaaaaccgcggggcgattaccaacctgccgtacgatgcggtggtggaagtgcctgcctatatcacctccgaagggccggagcccgtccgcgtgggtcaggtgccgctgttccaccagacgctcctgcaacagcagctggcctctgaacagctgctggttgaggcaaccatcgaaggcagctacgagaaagcgttgcaggcgttcactctgaaccgcaccgtgccaaccatggagcacgcgaaagcgattctggatgagatgatcgaagccaaccgcgactactggcctgcgctgcaaaaggcctggcaggacggtgaagcggtgaaaaaatag

SEQ ID NO: 3702 - DNA, 813 bp, Enterobacter cloacae
gagagaccgatgcatccgatgctgaccatcgccgtgcgcgcagcgcgcaaggcgggtaatgtaattgccaaacactacgaaaccccagactccgtagaaaccagccagaaaggcagcaatgatttcgtgacgaacgtcgataaagccgcagaagcgattattatcgaaacgatccgcaaatcttacccgcagcacaccatcatcaccgaagaaagcggtgaacatgaaggtaccgatcaggatgttcaatgggttatcgatccactggatggcaccaccaacttcgttaaacgcctgccacacttctctgtgtctattgccgtacgcatcaaaggccgtactgaagtcgccgttgtttacgatccaatgcgtaacgaactgttcaccgcaacccgcggtcagggcgcgcagctgaacggctaccgtctgcgttgcagcaatgcacgcgatctggacggcacgattctggcgacaggcttcccgttcaaggcgaagcagcacgcaaccacctatatgaatatcctgggcaagctgttcaccgaatgcgcggacttccgtcgcactggctctgctgcactggatctggcctacgtggcgaccggccgcgttgacggttactttgagctgtcactgaagccgtgggacttcgcggcgggcgagctgatcgcacgtgaagctggcgcgattgtttgcgacttcaccggcggccataactatatgtctaccggcaacatcgttgcaggtaacccgcgcgttgttaaagccatgctggcaaacatgcgtgatgaactgagcgatgcgctgaagcgttaa

SEQ ID NO: 3703 - DNA, 468 bp, Enterobacter cloacae
aactgtattacgtttataagacatcgcctgaagaggtcgtttgccatgaacagcttacgttatttcgatttcggctcctctcgttctctcctgcttttaattgcccgcattgctatcgtggtcctgtttattattttcggttatcccaagctgacggggtttagcggcaccgttcagtatatgacgtcgctcggcgcccccatgcccatgctggccgcgattattgcggtggtgatggaagtccccgccgcgattctaatcgtgctgggctttttcacccgccctctcgcggtgatctttgtcttctatacgctgggaacggcggtgattggtcaccactactgggatatgacgggcgatgcggtcctgccaaatatgattaacttctacaaaaatgtgagtatcgctggcgcatttattttgctggcgattaccgggccgggggccatctccctcgatcgacgttag

SEQ ID NO: 3704 - DNA, 783 bp, Enterobacter cloacae
accggcgaaataatggataaccgcctggcaacgctgttaacgcgcgggtcgtcgctgacccgcgcggagtatcgcgtcctcgcccacctcactgagcatccattgctggtgggcaacatcacggtgcgcgagctggcgcaggcgacatttgtctctaccgcgacgattatgcggctgtgccagaagctggggtttagcggctttagcgagtttatctggcactgcaagcagctgctttctgacacgccgcatatcaccgtacagcctgagcaacatgcggaaatgcccgcgctttttacccggttcgttgccaactatcagcagaccttccagtgggtcactcaggacaaacgccagcagtttgccagcctgctgcgccagaaagagagcttctttctctacggcgccgggttttcgtacctttttgccgagtacctgaccaagaagttgcaggtgctgggaaaaacggccttcatctccggggcgggagacagccggaatatttttctcagcaacgccgcgcgctatcaggtgtttattgccgtttcacgcagcggcgaaacggagcaggtactggataaagcgcggatcgccaaaaacgtcggcatgacgatcgtcgcgtttacccgcgcgtcggccaatacgctggcgggtatggcggacgtgcattttgctctctatgacgaagcggtacatttcgccgccgaagccgcaggtgtgacgtcgtttgagtcgaatctggtgctgctgatggatttactgctgctggaagcaacggggtga

SEQ ID NO: 3705 - DNA, 447 bp, Enterobacter cloacae
aagatgtctgtttcaacagcgagatgtaagcatatgtcgaaccaacgtaaccccgacgatttgaaaaaaaaccttacagagatgcagttttacgtgacgcaaaatcacggcacagaaccgccgttttccgggcgtttgctgcacaataaacgggaaggcgtctaccactgcctggtgtgtgatgcaccgctgtttaactcccagacgaagtacgattctggctgcggctggccgagtttttacgagcctgtcagcgatgatgcgatccgctacctgacggacacctcgcacggcatggtgcgcaccgaaattcgttgcgggaactgcgacgcccatctcgggcatgtcttcccggatggcccgcagccgacgggggagcgtttctgcgtaaattcggcttccatgagctttaccgatgatgaaaacggcgaccagatcaagggttga

SEQ ID NO: 3706 - DNA, 555 bp, Enterobacter cloacae
ccaatggacgcacttgaactgcttgttaaccgtcgtagcgcttcccgcctggccgaaccggcacccgtcggcgagcagctggaaaacattctgcgtgccggaatgcgtgcgccggaccatggcacattgcagccgtggcacttctttattattgaaggcgaagggcgcggccgcttcagccagctgctggagcagggggctgttgccgcaggccaggatgagaaggcgattgataaagcccgcaacgcgccattccgtgcgccgatgatcatcgcggtagtcacaaaatgccaggccgatcataaagtgccggtctgggagcaggagatgtctgccggttgcgcggtaatggcaatgcaaatggccgccgtcgcgcagggcttcaatggcatctggcgcaccggaccgctgaccgaaagttcggtcgtgcgtgatggctttgcctgtggcgagcacgataaaattgtcggcttcctctatctcggcaccccgcagcttaaagcctccagcaccatcagcgtgccggacaccacgcctttcgtcagccgtttttaa

SEQ ID NO: 3707 - DNA, 1926 bp, Enterobacter cloacae
ttgagatccgttaattcgatgcggttgtttattgccgaaaaaccgagtctggcgcgtgccatcgccgatgtgctgcccaagccgcatcgcaaaggtgatggctttatcgaatgcggtaacggacaggtggtcacctggtgtatcgggcacctgcttgaacaggcgcagccggatgtctacgacagccgctacgcccgctggaatctcaacgatctgccaattgtgccggaaaagtggcgtctgcaaccgcgtccttccgtcaccaaacagctcaacgtcattaagcgcttcctgcatgaggcgacggaagtggtccacgcgggtgacccggacagggaagggcaactgctggtcgatgaagtgctggactacctggagctggcgccggaaaagcgccagcaggtgcagcgctgtttaattaacgacctcaatccgcaggcggtggagcgcgcgatctcgcgcctgcgcgccaacagcgaatttattcccctgtgtgtctccgcgctggcgcgtgcccgcgcggactggctgtacgggatcaacatgacccgcgcctacaccatcctgggacgcaatgcgggctatcagggcgtactctctgtagggcgtgttcaaaccccggtgctggggctggtggtgcgtcgcgacgaagagatcgaaaatttcgtcgccaaagacttcttcgaagtcaaagcgcacatcgtcacgccgaaagacgaacgctttaccgccgtctggcagccgagcgatgcctgtgagtcatatcaggacgaagagggacggctgctgcatcgtccgctggcggagcacgtggttaaccgcattaccggccaacccgcgatagtcaccagctataacgacaaacgggaatcagagcccgcaccgctgccgttctccctttcggcgttgcagatcgaggccgcgaaaaagtttggcctgagcgcgcagaacgtgctcgatatctgccagaagctctatgaaacccacaagctgatcacctatccgcgttcggacagccgctatctgccggaggaacacttcgccggacgccactcggtgatgaacgccattggtgtccatgcgccggatctgttgccgcaaccggcggtaaacccggatacccataaccgctgctgggacgataaaaaagtcgatgcccaccacgcgataatcccgacggcgcgcaccagcaacgtcaacctgaccgacaacgaagcaaaagtctataacctgatcgcgcgtcagtatctgatgcagttctgcccggacgcggtgttccgcaagtgcgttatcgaactggacattgccaaaggcaaatttatcgccaaagcgcgtttcctcgcggaagcgggctggcgcacgctgctcggcaacaaagagcgtgacgaagagaacgacggtacgccgctgccggtcgtggccaaaggcgacgaactgctgtgcgagaagggggaggtggttgaacgacagacccagccgccgcgccacttcaccgatgcgacgctgctttcggccatgaccgggatcgcccgttttgtgcaggataaagatctgaagaagatcctccgcgccaccgacggtctgggtacggaagcaacccgcgcggggatcatcgagctgctctttaagcgcggttttcttgagaaaaaggggcgctatatccattcgaccgagccggggcgcgcgctgattcattccctgccggagctggccgccaggccggacatgaccgcgcactgggaatcggtgctgacgcagatcagcgagaagcagtgccgctatcaggactttatgcagccgctggtggggacgctttaccagctgatcgatcaggcgcgcagcacgccagtgaagcgcttcagagggatggttgcaccaggcgcgggtgcgaagaaaccgtttaaaaagaagaaaagcgcggcctga

SEQ ID NO: 3708 - DNA, 636 bp, Enterobacter cloacae
ttaatagcgaaaaacgacatattatcgtgcccttccaaagagtccagtcatcaggagaatcaggtgaaagagatatccgcctgggttgcgcccatggaaacccttcccgtcagccttagccccatcgccgccatgcagaaaaaacacttcggcgcggtgctgaaccccactcgctggtgggggcgtatgccgcgtcttttctggctggtggcgctgtttgtcggctatctggagcggcgcaaggcgcgtttgaccccggttctgcgatcgctactaatgacgcgggtctcgcagatctgccactgcgcattttgtattgatgccaacagcctgcgtctggccgagcggagcggggcgctggataaagtgcaggccgtcagcgactggcaaaattccaccctgttcagcgaagaggagcgcgcggcgctggcctatgcggaagcggtcaccgccacgccgcctgaggtggatgaaaatatcaaaagcctgctgaagcgccactttacggaagagaccatcaccgaaatgacggctctgattgcctttcagaatctttccgcccgctttaacgccgcgctggatatcccgactcaggggctgtgcgccacgtttaaaggtaaaccacatgctggataa

SEQ ID NO: 3709 - DNA, 1251 bp, Enterobacter cloacae
acaaccttttatttaccggatgaggtcgctatgtctctgtcagttacgcgtgaaaatttcgatgaatggatgatgccggtatacgctccggcggcttttattccggtacgtggggaaggctctcgcctgtgggatcagcagggcaaagagtatatcgactttgcaggtgggattgcggtgaatgcgctggggcatgcaaacccggcgttgcggcaggcgctgaatgaccaggcggcgaaattctggcataccggcaacggttataccaacgaaccggcattgcgtctggcgaagaagctgatcgacgccaccttcgcagaaaaagtctttttctgtaactccggcgcggaagcgaacgaagcggcgctgaagctggcgcgcaaatatgcgcacgataaattcggcgcgcataagagcggcatcgtagcctttaaaaatgctttccatggccgcacgctgtttaccgtcagtgcgggcggtcagccctcatattctcaggattttgcgccgctgccgccggatatccgtcatgcggcgtataacgatttacactctgccagcgagctgattgacgacaccacctgtgcggtgattgtcgagcccatgcagggggaaggcggcgtcatgcccgcccagaaagcgttcctgcaagggctgcgcgagctgtgcgatcggcataacgcggtcctgatttttgacgaagtccagaccggcgtgggccgcacgggtgagctgtatgcctacatgcactatggcgtgaccccggatgtgctctcaacagccaaagcgctcggcggcggtttcccggtgggggcgatgctgaccaccgaaaaattcgccagcgtgatgaccgtgggcactcatggcaccacatacggcggcaacccgctggcaaccgctgtcgccggacaggtgctggatatcatcaacacccctgaggtgctgaacggcgtgaagcagcgtcaccagtggtttgttgagcgactcacggccattaacagcaaaactggcctgttcaaagagatccgcggtctggggctgttaataggctgtgagcttgcccctgagtttgccggcaaagcgaagctgatttcacaggaagcggcaaagcagggcgtaatggtgctgattgccggtgctaacgtggtgcgctttgcccctgcgctgatcgtcagcgaggaagaggtcagaactggcttagatcgttttgcgctggcctgcgaacaggtgaagtccggggtgtcatcatga

SEQ ID NO: 3710 - DNA, 516 bp, Enterobacter cloacae
ctgaaagtaaggaaagacattatgcgtaaattaactgcactgtttgttgcctctaccctggctctgggcgctaccagcatggcgttcgccgccgataccgcgaccactaccgccgcgccgacggaaggcaaaatgatgatgcatcataaaggcaagccgggtatgcaccatgagatgatgatgtttaaagatctgaacctcaccgatgcgcagaagcagcagatccgcgacatcatgaaaagccagcgtgaccagatgaaacgtcctccgctggaagagcgccgcgcaatgcatgacatcattgccagcgacagcttcgataaagcaaaagcggaagcgcagatcgacaaaatggccgagcagcataaagcacgcatgctggcccacatggaaacccagaacaagatttacaacattctgacgccggaacagaaaaagcaatttaatgccaattttgagaagcgtctgacagaacgtgcagcgccggaaggtaaaatgcctgcaccaaccgaataa

SEQ ID NO: 3711 - DNA, 339 bp, Enterobacter cloacae
ccaaacaagagggaagttatcatggaaaagaaacatatctatctgttttgctctgcgggcatgtccacttcgctgctggtttctaaaatgcgcgcgcaggccgaaaaatatgaagtccctgtggtgattgaggcgtttccggaaacgctggcgggcgagaagggccagacagcagacgttattttactcgggccgcaaatcgcttatatgctgccagaaattcaacgtctgctacccaataagccggtcgaagtgatcgattccgttttatacggcaagattgatggtttaggtgtattaaaagctgccgttgcggcgattaaaaaagctgctaattaa

SEQ ID NO: 3712 - DNA, 1374 bp, Enterobacter cloacae
tacgctaagggagatattatgcaacagaaattaaaagtcgtaaccattggtggcggcagcagctataccccggaattacttgaaggtttcctgaaacggtatcatgaattaccggtcagcgaattatggctggtggatgttgaagaaggtcaggagaagctgaatattatttttgaactgtgcaaacgcatggttgaaaaagcgggcgtgcccttaaccatgcataaaacgctggatcgtcgcctggcactgaaagatgctgacttcgtgaccacgcagctgcgcgtcggccagctgaaggcgcgtgagctggacgagcgcattccgctgagccacggttatctgggccaggaaaccaacggggcaggtggcctgtttaaaggcctgcgtactattccggtcatttttgacatcattaaagacgtggaggagatctgcccgaacgcctgggtgattaactttaccaacccggccgggatggtcaccgaggcagtctatcgccataccggtttcaaacgctttatcggcgtctgcaatattccgattggcatgaagatgttcatccgcgatgtactggaactgaccgagcacgatgatctgtccattgacctgttcggcctgaatcacatggtctttatcaaagatgtgattgtgaacgggcaatcgcgctttgcggaactgctcgacggcgtcgcctctggtcgcctgactgcggcctcggtgaaaaacatcttcgatctgccgttcagcgaagggctgatccgctccctgaatctgctgccgtgctcgtatctgctttactacttcaagcagaaagagatgctggccattgaaatgggcgaatactacaaaggtggcgcacgcgctcaggttgtgcagaaagtagagaagcagctgtttgatttgtataaagatccgaacctgaacgtcaaaccgaaagagctggagcagcgcggcggggcatactattcggatgcggcgtgtgaagtgattaacgccatttacaatgacaagcaggccgagcactatgtgaacgttccccatcacgggcacatcgacaatatcccggcagactgggccgttgagatgacctgcatccttggacgcgagggtgcaaaaccgcatccccgcattacccacttcgacgataaggtgatggggctgattcacaccatcaaaggctttgaagtggcggcgagcaatgctgccctgagcggcgaactgaatgacgtgctgctggcgctgaatctcagcccgctggtgcattctgaccgtgacgctgaaaaactcgcgagtgagatgatcctggcgcatgaaaaatggctgccaaactttgctgcaacggttgagaaactgaaactcacacaccgttaa

SEQ ID NO: 3713 - DNA, 570 bp, Enterobacter cloacae
gcacaaataacgcgtctttatgaagaggaactaatgacgtatcaacaagctggacgcatcgcggtcttaaaacgtgttgctggttgggttatttttattcccgccctgatttcaacgctgatctccgtactcaaatttatgtacgatcacagcgaaaaacagccgggcatcaatgccgttatgcttgattttgcccacgtcatgattgagatgatgcggtttaacaccccgttcctgaacgtcttctggttcaactcgcccacgccggattttcaccaccagctgaatgtcggtttctggataatctatgcgttgatatttatcgcgatggcgttgcaggcctccggcgcgcgcatgagtcgccagacccgctttttacgcgaagggtttgaagatcagctgatacttgagaaggcgaaaggccctgacgggatgagccgcgagcagatcgaatcgcgcattgtcgttccgcgtcataccatttttgtgcagtttttcccgctctacatcctgccggtcatcatcattgtggccgggtatttcttctttacgctgcttggcttcctgtaa

SEQ ID NO: 3714 - DNA, 936 bp, Enterobacter cloacae
aataaaacgcgttttgggatcgttcttattcaaaaaatgaaagaagaaaatattgctatgttatttgcggctttttataatttgttacctttctatggtcgccttgtcattgatccgcaagaaagtttccgagaccgtgacggtctctttttatgttgtacggactccttaaataaaatgaagcttttgaagacagtacccgcagcactgatgctggcgggtggcgtatttgcgtcactgaatgcaaccgccgatgataccgtttttactgtcatggacgatccctccactgccaaaaaaccctttgaaggtaacgtgaatgccgggtatctggcgcaatccggtaatacgaaaagctcctccctgaccgcagacagcaccctgacctggtacggcaacaccacggcctggtcgctgtggggaaatgccagcaacacctctgctaacgatcaacgctcatcggagaaatacgcggtaggcggacgtagccgatacaacatgaccgattatgactacctgttcgggcaggcgagttggctgactgaccgctacaacggctatcgccagcgtgatgtcgtaactgcgggttatggtcgtcagttcctcaatgggccggtgcacagcctgcgttttgaattcggtccgggtgtccgttacgacgagtacaccaacggcgaagatgaaacccagccgctgggttatgcatcgggcacctatgcatggcagatgaccgacaacgcaaaattcacccagggtgtgtcggtgtttggtgctgaagatacaacgctgaactcagaaagtgcgttgaacgtggcgatcaatgaacactttggactcaaggtggcgtacaacgtaacctggaactcatccccacctgattctgcaccggaacataccgatcgccgaaccacgatttcattaggttataaaatgtaa

SEQ ID NO: 3715 - DNA, 1938 bp, Enterobacter cloacae
ggatataaaatgcctgtaattactcttcctgatggcagccaacgccatttcgaccacgctgttagcccaatggatgttgccctggatatcggtcctggacttgcaaaagcaaccattgcaggccgcgtaaacggcgagctggtagacgcgtccgatctgattgaaagcgatgcaacgcttgcgatcatcaccgcgaaagacgaagaaggtctggagatcattcgtcactcctgcgcgcacctgttaggccatgctatcaagcagctgtggccaaacaccaaaatggcgatcggcccggttatcgacaacggtttctactacgacgttgaccttgaccacaccctgacccaggaagatatcgacgcgctcgaaaaacgtatgcacgagctcgccgaaactaactatgacgtcattaagaagaaagtcagctggcacgaagcgcgtgaaaccttcgtgaagcgcggcgagagctacaaagtctcgattcttgatgaaaacatcgctcatgatgacaagccaggcttgtaccatcaccaggaatacgtcgacatgtgccgtggtccgcacgtgccgaatatgcgcttctgtcatcacttcaaactgatgaaaatcgcaggcgcttactggcgtggcgatagcaacaacaagatgttgcagcgtatctatggtaccgcgtgggccgataagaaagccctgaacgcatacctgcaacgcctggaagaggcggctaagcgtgaccaccgtaaaatcggtaagcagcttgacctgtatcatatgcaggaagaagcgccggggatggtgttctggcataacgacggctggactatcttccgtgaactggaaacgttcgtgcgctccaagctgaaagagtaccagtatcaggaagtgaagggcccgttcatgatggaccgtgtgctgtgggaaaaaaccggccactgggacaactacaaagatgcgatgttcaccacttcgtctgagaaccgtgaatactgcatcaagccaatgaactgcccgggccacgttcagatcttcaaccagggtctgaaatcctaccgcgatctgccgctgcgtatggcggagttcggtagctgccaccgtaacgagccatcaggtgcgctgcacggtctgatgcgtgttcgtggctttactcaggatgatgcgcatatcttctgtactgaagatcaggtccgtgaagaagttaacgcctgtattcgtatggtctacgatatgtacagcacctttggcttcgaaaagatcgtggtcaaactctcaacgcgtccggaaaaacgtatcggcagcgatgagacatgggatcgcgcagaggcggatctcgccgtagcgctggaagagaacggtattccgttcgaataccagctgggcgagggcgcattctacggtccgaaaattgaatttaccctgtatgactgcctcgatcgcgcatggcagtgcggaacggtacagctggacttctccctgccgcagcgtttaagcgcctcttatgttggcgaagacaacgagcgtcaggtgccggttatgattcaccgtgcgattctcggttcactggagcgcttcatcggcatcctgaccgaagagttcgcaggttttttcccaacctggcttgcgccagtgcaggtcgtggtgatgaacattaccgattctcaggcggattacgttaaagaattgacgcagaaactacaaaatgcgggcattcgcgtaaaagcagacttgagaaatgagaagattggctttaaaatccgcgagcacactttacgtcgtgtcccgtatatgttggtctgtggtgataaagaggtggaagcaggcaaagttgccgttcgcacccgccgtggtaaagacctggggagcctggacgtaagtgaagtgattgagaagctgcaacaagagattcgcagccgcagtcttcaacaactggaggaataa

SEQ ID NO: 3716 - DNA, 321 bp, Enterobacter cloacae
ggtattaaaggcggaaaacgagttcaaacggcacgtccgaatcgtatcaatggcgagattcgcgcccaggaagttcgcttaacaggtctggaaggcgagcagctggggattgtgagtctgagagaagcgatcgaaaaggctgaagaagctggagtagatttagttgaaatcagccctaacgccgaaccgccagtttgtcgtatcatggactacggcaagttcctttatgaaaagagtaagtcttctaaggaacagaagaagaagcaaaaagttatccaggttaaggagatcaaattccgtcatgtgttcaccagcaggtag

SEQ ID NO: 3717 - DNA, 705 bp, Enterobacter cloacae
ttgcctttcagaatctttccgcccgctttaacgccgcgctggatatcccgactcaggggctgtgcgccacgtttaaaggtaaaccacatgctggataaacatctgcacccccggctgaaacccgggttaaatcagctggccgccgcgctggataaaccgtttatcacgcctgatggcttaacgctcgccgggtttgcgattggcgtgctggcgttaccgtttctggcgctgggctggtatccggcggcgctgatcgccattgtgctgaaccggctgctggatggtctggacggcgcgctggcgcgtcgccgtggcctgacggacgcgggaggatttcttgatatcgccctcgacttcctgttttacgccctggtgccgtttggttttgcgctggccgctccggctgataatgcgatcgccgccgcctggctgctgttcgcgtttatggggacgggcagcagttttctggcctttgccgcgctggcggggaagcatgatatcgacaaccccggctatgcgcacaagtcgctttattacattggaggattaacggaaggaacagagaccatcgcgctgtttgtgctgtgcagcctgtttccggcgcatttcgcgctctttgcatgggtgtttggcgcgttgtgctggctgaccaccacaacgcgcatctggagcggttatatcacgctgaagtcacttccccgctag

SEQ ID NO: 3718 - DNA, 1500 bp, Enterobacter cloacae
ggagaaaacagcatgactctatggattaacggtgactgggtaacgggcgaaggtgacgcgcggacaaaaactaacccggtcggccaggaggtgctctggtctgggaacgacgcaagcgccgggcaggttgagcaggcctgtcaggctgcacgccgcgcgtttccggcgtgggcgaaacggccattctccgagcgccaggcgctggttgagaaatttgctgcgctgctggaggccaataaagccgagctgacccgcatcattgcctgcgaaaccagtaagccgcgctgggaggcaacaaccgaagtcacggcgatgatcaacaaaattgcgatatcggtgaaggcgtaccatacccgcaccggcgagcagcataccgagatgccagacggcgcggccacgctgcgccaccgtccgcacggggtactggcggtgtttggcccgtataacttccccgggcatctgccgaacgggcacattgtgcctgcgctgctggcggggaataccgtcatcttcaagccgagtgagttaacccccttaaccggagaagcagtggtaaaactctgggagcaggcggggctgccgccgggggtgctgaatctggtgcagggcgggcgtgaaaccggtcaggcgctaagtgcgctgagcgacattgacggtctgctgtttaccggcagtgccggaacgggctatcagctgcatcgtcagctggcggggcaaccggaaaaaattctggcgctggagatgggcggcaacaacccactgattgtggaagatccggaggatatcgatgccgcggtccacttgaccattcagtcggcgttcattaccgccggacagcgctgcacatgcgcccgccgcctgctggttaagcgcggcgcgcagggggatgcgttcctgaagcgtctggtggaggtgagcgcgcgtctggttcccgcgaaatgggatgccgagccgcagccgtttatcggcgggctgatctccgggcaggcggcgctgaacgtactgaaagcgtggcaggagcacgtggcgcgcggggcgaaaaccctgctggagccgaagctggttcagcccggcacgtcgctgctgacgccggggattattgacatgagtgcgacaagcaacgtgccggatgaagaggtctttggcccgctgctgtgcgtctggcgctatgacgattttgagtcggcgatcgagatggccaacaatacccgctacggcctgtcgagtggcctgatatcgccgcatcgcgagaaattcgaccagctgctgctggaagcgcgcgccgggatcgtgaactggaacaaaccgctgaccggtgcggcgagcactgcgccgtttggtggcgtaggggcgtcgggcaaccatcgcgccagcgcctggtatgccgccgattactgcgcgtggccgatggcaagcctggaaaccccggcgctgacgctgccggagacgttgaatccggggctggattttactgagggtgacgcccatgaaagcgcgtga

SEQ ID NO: 3719 - DNA, 360 bp, Enterobacter cloacae
acaagaggacggaatatgaacaagaacgtagcaggaattttaagcgcagcggcggtactgactatgctggcagggtgtacagcttacgatcgcaccaaagatcagttcacacagccagtggtaaaagacgtcaaaaaaggcatgacgcgttcccaggttgcagccattgccggtaaaccttcttcagaagttactatgatccacgcgcgtggtacctgccagacctatattctgggtcaacgtgatggtaaggcagagacctactttgtcgccctggatgatacgggtcacgtgatcaattctggttaccagacctgtgccgaatacgacaccgacccacaggcacctaaggcacagtaa

SEQ ID NO: 3720 - DNA, 291 bp, Enterobacter cloacae
aagggagagatcatgaatattgatgacatgattgcaggtatgaccccggaggtttatcagcgtctggtgacggccgttgagctgggaaaatggccggacggtgtggcgctcacacctgagcaaaaagagaacagcttgcagctggtgatgctgtggcaggcgcgtcacaataccgacgcccagcacatgaccatcgacactaacggtcagatggtgatgaaaagcaagcgcgagttgaaagaagacttcggcatcacgccgaagccgattgcgacgatgaaaatgcaataa

SEQ ID NO: 3721 - DNA, 1056 bp, Enterobacter cloacae
caggagacgtccatgagcgagcaaaccattcgtttaacgcaatacagccacggagccggttgcggttgtaaaatttccccgaaagtgctggagaccatcctgcacagtgagcaggcgaagtttgtcgacccgaacctgcttgtcggtaacgaaacgcgtgacgatgcagcggtttatgacttaggtaacggcaccagcattatcagcaccactgacttttttatgccgattgtcgacaacccattcgacttcggacgcattgcggccaccaacgccatcagcgatatctttgcgatgggcggtaaaccgatcatggcgatcgccattctgggctggccgattaacaacctcccgcctgagattgcccgcgacgtgatcgaaggcggacgctttgcctgccagcaggcgggtattgccctggccggtggtcactctatcgatgcgccggagccgatcttcggcctggccgtcaccggcgtggtgcccaccgaacgcgtgaagcgcaacagcacggcgcaaccgggctgcaaactgttcctcaccaagccgctgggcattggcgtactgaccactgccgagaagaaatccctgctgaagcccgagcatatcggtctggcaacggaagtgatgtgtcagatgaacctcgccggtgcggcattcgccaatatcgacggcgtgaaggccatgaccgacgtgaccggatttggtctgctggggcacctctctgaagtctgtcagggcgcaggcgtgcaggcgcaggtccggtatcaggatgtgccgaaactgccgggcgtggaagagtacattgctcagggcgcgttgccgggcgggacgcagcgcaacttcgccagctacggccatttaatgggcgaaatgccggaagcatggcgtaacctgctgtgcgatccgcaaacctccggcggtctgctgctggcggtgacgccggaagctgaagctgacgttcaggcgacggctgccgagtttggcatcaccctgacggccattggtgagctggtgaccgcccgcggtggtcgcccgatgattgagatccgttaa

SEQ ID NO: 3722 - DNA, 342 bp, Enterobacter cloacae
cgagatacattaaagatcccgtccggatcgaccgttatagatataaacgatgcaaaggaaacaaagtctatgaaccgttacgcaatggccgcgttatgtttgatggtgtccgccggggcacaggctgatcgcattcgcccggatgtcgaggttaacgtgccgccagaggtctttagcgctggcggccagcgtgcgcagccgtgtaatcagtgctgtatctatcaggatcaaaactattccgaaggcgcagtggtcagggcggatggcgtgctgttgcagtgccagcgtgatgaacgcaccctcagtacaaacccgctggtctggcgtcgcgtaaaagaataa

SEQ ID NO: 3723 - DNA, 1140 bp, Enterobacter cloacae
cgtggtgcgctttgcccctgcgctgatcgtcagcgaggaagaggtcagaactggcttagatcgttttgcgctggcctgcgaacaggtgaagtccggggtgtcatcatgatggtcattcgtcccgttgcgcacggcgatctcgccgggcttatgcagcttgccggtaagacagggggcgggctgacctcgctgcctgccgatgaaaaaacgctgtcggcgcgcattgagcgcgccctgcaaacctggcaggggacgttgccaaaaagcgaacagggctatgtgttcgtgctggaagataccgacacggggaccgtggcggggatttgcgctatcgaggtggccgtcgggcttaatgatccgtggtacaactaccgcgtcggcacgatggtccacgcctcgaaagagctgaacgtttacaacgcgctgccgacgctcttcctctgtaatgaccataccggcgccagcgaactctgcacactgtttctcgatccggactggcgcaaagagggcaacggttatctgctctccaaatcgcgctttatgtttatggccgcctttcgcgaccgcttcaacgaaaaagtggtcgcggagatgcgcggcgtgattgatgagacgggctactcgccgttctgggagagtctgggcgaacgcttcttctccatggaatttagccgggcggattacctgtgcggcaccggtcagaaggcgtttatcgccgagttgatgccgaagcatcctatttatacccatttcctaacgccagaagcgcaggcggtgatcggcgaagttcacccgcaaaccgccccggcccgcgcggtgctggagaaagagggatttcgctaccgtaactacgtcgacatcttcgacggcggcccgacgctggaatgcgacattgaccgcgttcgcgccatccgtaaaagccgcctggttgaggtttcagaatgccagcccgcgccgggcgagtggccagcctgcctggtctcgaacgagaattacaccaacttccgcgccatgctggtgcgaaccaacccatcatgcgagcgtctggtactgacggctgcgcaactggatgccctgaaatgtaacgctggcgacacggttcgcctggtgcggctctgccctgaggagaaaacagcatga

SEQ ID NO: 3724 - DNA, 1359 bp, Enterobacter cloacae
atccggggctggattttactgagggtgacgcccatgaaagcgcgtgaggttaactttgacggcctcgtggggctgacgcaccactatgccgggctgtcgttcggtaatgaagcctcgacgaagcaccgtttccaggtctcgaacccgaagctggcggcgaagcaggggctattgaaaatgaaggcgctgtccgatgccggtttcccgcaggcggtgatcccgccgcaggagcgcccaaacgtggccgtgctgcgccagctggggttcagcggtacggatgaacaggtggtggaaaaagcaggcacgcagacgccacacctgctttccgcagccagttcagcctcctcgatgtgggtggcgaatgccgccaccgttgcgccgtcggcggatacgctggacggcaaagtgcatctgaccgttgctaacctgaacaacaaattccaccgcgccagcgaagcggagaccaccgggcgcgtgctgcgcgccatttttaatcatgatgcgcatttcgaggtacattcggcgctgccgcaggtcgcgatgtttggcgatgaaggggcggcaaaccacaaccgtctgggcggcgactatggcgagccgggtttgcagctgtttatctatggacgggaagagggcggccacgccgcgccggttcgttatccggcgagacaaaccttagccgcaagccaggcggttgcgcggctgaaccaggttaatccttctcaggtgatttttgcccagcaaaatccgcaggtgatcgaccagggcgtgtttcataacgacgtcattgccgtttccaaccgtcaggtactgttctgccacgagcaggcgtttgcccatcaggaaaagttgctggccacgctgcgcgaacgcgtgccgggatttatgccgattcaggtgcccacgcaggcggtaagcgtgcaggacgcggtcgaaacgtatctgttcaacagccagctgctgagccgggatgacggcagcatgatgctggtgctgccgcaggagtcccgaaaccatcagggcgtctggcgctatctcagcgaactggtgcaggcggataacccgattgatgaactgcgcgtgtttgatcttcgggaaagtatggccaacggcgggggaccggcgtgcctgcgactacgcgtggtgttaacgccggaggaattgcaggccgtgaatccggcggtgatgatgaacgacacgctgttcaatactctcaatgactgggtggaccgctattatcgtgaccgtctggttcaggccgatctggttgatccgcagctgctgcgcgaaggccgcgaagcgctggatgcattatcaaccatcctgcaactgggatcggtttatccgttccagcgctaa

SEQ ID NO: 3725 - DNA, 975 bp, Enterobacter cloacae
ggagacgacatggaaaacttactggcgctgacgctggccgaagagacaccggagcggcaagagggggcaggcccttcgttccactggcgatggctggggccgggcgtgcttgaactcacgccgacggggaaatataacctgtcgctgctgctttctaccggcattcacggaaacgaaaccgcgcccgtggagattgtcgaactattgctgcgcgcgctgtatcgcgcagagttcacgctgcactgccgtctgctggtggtactgggaaatccgcctgcgctggcgcaaaataaacggtatctcgtgagcgacatcaaccgcatgtttggtggtcgctgggcgcagtttccacagagtgatgagacgactcgcgcgcaatggctggagaaggtggtcacggcgttttttgccggggcgggggaaacgcgctggcaccttgatctgcatacggccattcgcgcctcgtaccacgtgcgttttggcgtgttaccgcagcgtcatcagccgtgggatgaggcgtttctgacctggcttggcgatgcggggctggaggcactggtcttccaccagacgccaggcggcacgtttacccacttcacctgcgagaatgttggcgcgttatcctgtaccctggagctgggaaaagcgctgccgttcgggcaaaacgacctgacgcgttttacccctacgcatcaggcgctccgggcgttgctcgccggggttgcgccggaacccacccgggaacccgtcgtgcgctatcgggtcgtgcagcagatcacgcgtcaaagcgaggctttccagcttcatatggcaccccatacgctgaactttacgccgtttcgccagggcgtcctgctggcggaagatggtgagacgcgctatgcggtacagaaatccacggaatatgttttatttcctaatccgtcggtcgcgtttggtttgcgagcaggtctgatgctggaaaaaatgccctga

SEQ ID NO: 3726 - DNA, 708 bp, Enterobacter cloacae
gaccgccgggctcctgtctacaaaagcgaaaacgctgtggacaggaccggcggtttttcttttatcccatgcctaaggtctggcctgactgctgccgataatacgtctgtgaaaatgccctggcgcacggtgcgtccttcaggagtggtcatggaattctttgatatccgtaaaatgccggtcagtctctggcgtaatggtgcgggtgagacgcgtgagatttgctgttttcctcccgcgacgcgggattttttctggcgggccagtattgcctccatcgccagtaacggcgaattctccgcgttcccgggcgttgaccgggtgattacgctgctggaaggcggcgaggtgaccctggatgcaggcagggcgttttgtcatactctgaagcatcaccagccttaccgatttgcgggcgatctggcggtgaaagccgtgctcacagaggggcagatgtcgatggacttcaacatcatgacccgacgggattgctgccaggcaaaggtgcgcgttgctacccgaacgttcactaccttcgcgtcacgcggtggggtggtctttgtcttaagtggcgcctggcagctgggcgacaaattactgaccgccgatcagggtgccagctgggaagcgggcagtcataccctacgtttactggaaacgaaggggtcgctgctgttcagtgaaattacctggctgccgggtcactga

SEQ ID NO: 3727 - DNA, 1371 bp, Enterobacter cloacae
gggtattttcctatgagtaaagtcatcgcttcacttgaaaaggtactccttccttttgctgttaaaataggaaagcagcctcacgttaatgccatcaagaacggctttattaaattaatgccgttgacattagccggggcaatgttcgttttaattaacaacgtttttctgagctttggagaaggttcctttttttattcattaggaattaggctagatgcttcaactattgaaacccttaatggtttaaaagccattggcggcaacgtatacaacggtacgttgggtattatgtcgctaatggcgcctttctttattggaatggcgctggcggaagagcgtaaagtggatccgctggcggcaggcttactgtccattgccgcgttcatgaccgtcacaccgtacagcgtgggcgacgcttatgccgttggcgccaactggctgggtggggcaaacatcatttccggtattattatcgggctggtggtggccgaaatgttcaccttcattattcgccgtaactgggttatccgcttgccggatagcgttccggcctctgtttctcgttcattttccgcgttgattccgggcttcattattctctccatcatggggattattgcctgggcgctctctcactggggcacaaacttccaccagatcattatggactctatctcaacgccgctggcgtcgatgggtaacgtggtcggttgggcgtatgtcatctttacctccctgctgtggttcttcggcgtgcatggttcactggcactggcggcgctggacagcggtattatgaccccatgggcactggaaaacgtcgcgctttaccagcagtacggctccgtcgatgcggcgctggcggccggtaaaaccttccatgtgtgggcgaagccgatgcttgactcctatatcttcctgggcggtaccggggcgacgttgggtctgatcatcgcggtctttattgtctctcgccgcgctgaccatcgtcaggttgcgaagctggccctgccgtcaggcatcttccagattaacgagccgatcctgtttggtctgccaattatcatgaacccggtgatgttcattcccttcatcctggttcagccgctgctggccgcgattacgctgacggcgtactacctgggcattatcccgccggtgaccaacattgcgccgtggacgatgccggctggtctgggcgcgttcttcaacaccaatggtagcgtggccgccttcctgctggcgatattcaacctcgggattgcaaccctgctctacatgccgttcgtggcgattgcgaacaaggccgcaacggttatcgatgaagaagagagcgaagaggatatcgccctcgcactgaaattctaa

SEQ ID NO: 3728 - DNA, 351 bp, Enterobacter cloacae
aaaatgttagatttagagagtatcgttgccgaagaaaccgcagagaacgatctggaagaggtggtgatgggcctcatcatcaactccgggcaggcacgcagcctggcgtatgcggcgcttaagcaggctaagcagggcgacttcgttgccgcgaaaaccatgatggagcagtcccgtacggcgttaaacgaagcgcatctggtgcagacgaagcttatcgaaagcgaccagggcgaagggaagatgaaagtgagtctggtgctggtacatgcgcaggatcatctgatgacctccatgctggcacgcgagctggtagcggagctcatcgagcttcacgagaagatgcaataa

SEQ ID NO: 3729 - DNA, 834 bp, Enterobacter cloacae
caggaggtcagcacgatggaaatcaaaaccgcacatgagcagcagctgtttaatggcaagaattttcacgtggtgatttacaacaaaacggagagcgccagcggtctgcaccagcatgactactacgagttcacgattgttctgaccggccgctactatcaggagatcaacggtaagcgcgtcctgcttgagcgtggcgatttcgtcttcctgccgatgggatcttatcaccagagcttttatgagtttggtgcgacgcgcattctgaacgtaggcgtgagcaggcgtttcttcgagaagcattatctgccgctggtgccgttctgctttgtggcgtcacaggtgtatcgcgttaaaaatgagtttatgacctggattgaaacggttatcgcctcgctgaatttccgcgacaatgaatttgatgaatttattgaaaccgtgacgttctacgtcatgaatcgcctccgccatcaccgtgaagaacagcaggtggtggatgatattcctcagtggctgcgtagtaccgtggagctgatgcacgacaaaggacagttcagcgataacgccctggagaatatggtggcgctgtcgggtaaatcgcaggaatatttgacgcgcgccacgcagcgttattaccgtaaaacgcctgtgcaaattattaatgaaatccgcattaactttgccaaaaaacagctggaaattactaattactctgtcaccgatatcgcttacgaatcgggttacagcagtcccagtctgtttattaaaacctttaaaaaattgacttcattcacaccgaacagttaccgcaaaaatttaacggtaattaattaa

SEQ ID NO: 3730 - DNA, 786 bp, Enterobacter cloacae
gaaactgaaactcacacaccgttaagaggaggcgcgatggaaaacctgctgatcgtcaatgccgatgattttggcctgtcaaaagggcagaactacggcattattgaagcctgtcgccggggcgtcgtgacctctacaacagcgctcatcaacggtgaggcggtggaacatgcggcgcagttaagccgtgagctgcccgagctgggcgtgggcatgcattttgtgctgacgcttgggttgcccctttcaccgatgccgggtctgacgcgcgagggaaaactggggaaatggatttgggaaatggcggagcaggacgctctgccgctcgatgagattgcccgcgagctggagtgccagtttaaccgctttgtggatgtgtttggccgcgaacctacccatattgacagccatcatcatgtgcatatgatcccggcgattttcccgcttgtggcagagtttgcgcaacgtaaaggcgtggcgatgcgcgtggatcgtgaggtgcgcgggttgccggacgtcgcggtgacgtcaacggaggggttcagcagcgcattttatggcgacgagatcgacgaagcgctgttcctgaaggtgctggatgactccgccgcaaaaggggagcgctcgcttgaggtaatggcgcacccggcgtttgtcgatgagatagtacgtaagagcgcctactgctggccgcgtctggcagaactggatgtgctgacatcggcgtcgttaaagtatgcgattgccgagcgtgggtatcgtctggggacgttcagggatctttga

SEQ ID NO: 3731 - DNA, 267 bp, Enterobacter cloacae
gaatttgctttagtgaacccgtcgcttatgaaacctcttcgtcaacaaaaccgccaggttattagctatgtgccccgcgttgaacccgcgccgcctgaccatgccctgaaagtggatggttttcgcgatgtctggatgttacggggtaaatacgttgccttcgtgctgattggcgagcacttccgtcgctcccctgcgtttacggtgccagaatcggcgcagcgatgggctatgcagacccgccaggatgaagaggttgaagaataa

SEQ ID NO: 3732 - DNA, 294 bp, Enterobacter cloacae
attatgagcagtggtgatatcacccgctacgtcgtaaccgtgaatattcatgaggcgtcgctgaccgaactgaatgaactcaacaacgcgttcacgcgcgccaattttctgctcacgctgacggacgatgagggcaatattcacgatctcggctcactggcatttggcctgataagcccgctgagtcaggaagaggtgaaggcgctggccagtagcctggtggaaagcgtgactgacaaagccacggaaattgatgtggatagctgggaaaactggcataaaaaagaacaataa

SEQ ID NO: 3733 - DNA, 888 bp, Enterobacter cloacae
tctggcagacaacatgggagagacatcatgtggcaggctatcagtcatcttttaagtgagcagctgggtgaaggtgaaattgaactgcgtaacgaactgccaggcggagagatccatgccgcatggcatttacgttacgccgggcgcgatcttttcgttaaatgtgatgagcgcgaattgctccccatttttactgccgaagccgatcagcttgagctgttatcgcgcagtaaaacagtcaccgttccgcaggttttagccgtcggcagcgatcgtgactatagctttctggtgatgaactatcttcccgcgcgtcctctggatgcgcacaacgcctttattctcgggcaacagaccgcccgtttgcaccagtggagcgatcaacctcagtttgggctcgatttcgataacgacctctccaccaccccacagccaaacgcatggcagcgccgctggtcgacttttttcgccgaacagcgcatcggctggcagctggagctggccgctgaaaagggattagcgttcggcaacatcgacgcgattgttgaacatattcagcagcgtctggcttcgcatcagcctcaggcttcccttctgcacggtgatttatggtcaaacaactgcgcgcttgggcctgatggtccctatatatatgacccggcctgctactggggcgacagagagtgtgacctcgcgatgctgccgttgcaccctgaacagccgccgcaaatttatgatggctatcagtctgtctcgccgttacctgcgggtttccttgatcgtcagccggtttatcagctgtacaccttgctaaaccgggctattttgtttggcgggagtcatctggtaaatgcccagcgggcgctggaccgtattctggcggcatag

SEQ ID NO: 3734 - DNA, 615 bp, Enterobacter cloacae
atcgacagtttaccgggttttatcatgacggcggaaggccacctgcttttttcacttgcctgtgcagtgtttgccaaaaacgctgaactgacccctgtgctggcacagggggactggtggcatattgtcccttccgccgtacttacctgcctgctgccggacatagatcatccaaagtcattccttggccagcggctaaagtggatttcaaagcccatcgccagagcctttggtcatcgcgggtttacccacagcctgctggccgtatttggcctgcttacactcttctatttaaaggttccggagagctggatcgtcccggcggatgccattcagggcatggtgcttggctacttaagccatatcctcgccgatatgctgacgccagcgggcgtaccgctgctctggccctgccgctggcgtttccgcctgccaatcctcgtgccgcaaaaaggcaaccagctggagcgcgttctgtgcatggcgctgtttgcgtatgccgtctggatgccgcagacattgcccgaaaatggtgcagtgcgctggtcatcgcagatgatcaactcgctgcaatttcagttcaatcgttttattaatcaccagattgaacattaa

SEQ ID NO: 3735 - DNA, 2283 bp, Enterobacter cloacae
ggttttcaggaacgaacaaaggagaatcgtgcaatgtcgaacaatgataaaccccatcaatcccctattcatggcaccgaagaatctcaaccgggaatggactcactcgcccctgcggatggctctcataaaccgtcgccgggcctctccgcgccgggcgagcaacctactgcaccgggaagcatgaagtcacccgatgcggacaacgaaaagttaaaatctctcgacccgcaccgcaaagggggtgaaggctatgcgctgaccaccaatcagggcgtgcgcatcgccgatgatcagaactccttgcgcgccggaacgcgcggcccgacgctgctggaagatttcatcctgcgggaaaaaatcacccatttcgaccatgagcgtattcctgaacgtatcgttcacgctcgcggctctgcggcgcacggctatttccagccgtacaagagcctgaaggagatcacgaaggcggatttcctttccgatccgaacaaaattacaccggtatttgtgcgcttctctaccgtacagggcggcgcgggttcggccgacacggtgcgtgatattcgcggcttagccaccaaattctataccgaagagggcattttcgacctcgtcgggaataacaccccggttttcttcattcaggatgcgcataaattccctgactttgtccatgcggtaaaaccagagccacactgggccataccgcagggacaaagtgcgcatgacaccttctgggactacgtctccctgcaaccggaaacccttcacaacgtgatgtgggcgatgtctgaccgggggatcccacgcagctatcgcaccatggaaggctttggtattcataccttccgtctgattaacgctgaaggtaaagcgacgtttgtgcgtttccactggaaaccggtcgcggggaaagcgtccctggtgtgggatgaagcacagaagctgaccgggcgcgatccggacttccaccgtcgcgaactgtgggaatccattgaagccggtgatttcccggaatacgagctggggttacagctgatcccggaagaggacgaattcaaattcgacttcgacctgctcgacccgaccaagcttattcccgaagagctggtgccggttcagctggtgggcaaaatggtgcttaatcgcaacccggataacttcttcgcggagaatgagcaggctgcgttccacccgggccatattgtgccggggctggatttcaccaacgatccgctgctccagggccgtctgttctcttataccgatacgcagatcagccgtctcggcggaccgaacttccacgaaattcctatcaaccgtccgacctgcccgtaccataacttccagcgtgacgggatgcatcgccaggatatcgataccaacccggcgaactacgagccaaactccattaacgataactggccgcgtgaaaccccgccggggccaaaacgtggcggattcgagtcgtatcaggagcgcgtggacggaacaaaaattcgcgagcgcagcccgtcattcggcgaatattacgctcagcctcgcctgttctggaacagccagaccccgattgaacagcagcacattatcggcggtttcagctttgagctgagcaaagtggtgcgtacctacattcgcgagcgcgtggtcgaccatctggcgcatattgatatccagcttgctcagggcgtggcgaataatctcggcatcacgctcaccgatgagcaatgccatgccgcaccgccaaaagacgtgaacgggctgaagaaggatccgtccctgagcctgtacgcggtacctggcgggtcaattaaaggccgcgtagtggctattctgctgaacgataaaccgcgcgccagcgacgtactggggatcatgcgggcgctcaaaacccagggcgtacatgccaaactgctttactctcgcatgggtgaagtgacggccgatgatggctccgtcctgccgattgccgcgaccttcgccggagcaccgtcgctgacggttgatgcggtgattatgccgtgcggcgacgttgagagcctgctcggtaacggtgatgccgcctattatctgctggaagcctataagcacctgaagccaatcgctctggcaggcgatgcgcggaagtttaaaactctgctgaaggtaccggatcaaggggaagaaggcattgtcgaaggtgataacgtcgatgatgcgtttatgacccggttgtttgacctgctcgccgcgcaccgcgtgtggtcgcgcagcagtaagattgaccagataccggcgtaa

SEQ ID NO: 3736 - DNA, 951 bp, Enterobacter cloacae
ccgccacccggctcttttttaaccaccgaacacctgctacactgtatgcctgaacagtatatggagcagtatgtgagcaggcgtcaatccgccccgcgtcttgagtttgaagcggcggctatctacgaatatcccgagcatcttcgcccctggcttgaggctctgcctaaacagcctggcgtctatttcttccacggcgacagcgataccatgccgctctatatcggcaaaagcgtgaatatccgcagccgggtgatgtcgcacctgcgtacgccggatgaagcatcgatgctcaggcagtcccggcggatcacctggatcgagacggcaggcgaactgggcgcgcttctgctcgaagcccggctcatcaaggaacagcagccgctgtttaacaaacgcctgcgccgcaaccgccagctgtgttccttgcaggttaacgcaggaaaaccgcaggttgtttatgcccgggaagtggatttttcgcatgaacccaatctttacggtctgtttgccaacaaacgtgccgcactgcaaaccctgcaatccctggctgatgaattacagctttgttacggcctgttaggactggaagccaccacccgcggtcgcgcctgtttccgctccgcgctgaaacgctgcgccggggcgtgttgtggaaaagagagcgttgaagaacatcatgcccggtttatggcgggcctggcctctatcagcgttaactgctggccgtgggaaggcgcggtggcgctgaaagaaacccgcgatgcgatgacgcattatcacatcatccgcaactggctctggcttggcgccgttgaaagcctggatgacgctaccgccctgctgcgcacccctgccgggttcgatcaggatggttacaaaattctctgtaagccattattaaccggaaaatatgagatcatcgtcctcagtgacccggcagccaggtaa

SEQ ID NO: 3737 - DNA, 483 bp, Enterobacter cloacae
ccggtttcacgcccgccctgcaccagattcagcacccccggcggcagccccgcctgctcccagagttttaccactgcttctccggttaagggggttaactcactcggcttgaagatgacggtattccccgccagcagcgcaggcacaatgtgcccgttcggcagatgcccggggaagttatacgggccaaacaccgccagtaccccgtgcggacggtggcgcagcgtggccgcgccgtctggcatctcggtatgctgctcgccggtgcgggtatggtacgccttcaccgatatcgcaattttgttgatcatcgccgtgacttcggttgttgcctcccagcgcggcttactggtttcgcaggcaatgatgcgggtcagctcggctttattggcctccagcagcgcagcaaatttctcaaccagcgcctggcgctcggagaatggccgtttcgcccacgccggaaacgcgcggcgtgcagcctga

SEQ ID NO: 3738 - DNA, 1545 bp, Enterobacter cloacae
cgccctggagcaggaatggcttcgccgctacggaacccgctaagcgggctggtctgggcggcaatggcggtcatctatctgcccctgcttcccgccagcggcatgctgctggccccggcgttttctcccggcaactgggcgacgctgtttgccgacccgcagctgccgcaggcgctggccgccacgctggtgtcagcgcttatcgcgacgctgggctcactgtttatcgccctgaccctgcttgcgcttctctggccgggtgaaggctggcagcgcctgagcacccgtttgccgtggctgttagccgtgccgcacgtcgccttcgccaccagcgcgctgctgctgtttgcggaaggggggcagttttaccggatctgtacagtctgttcgccgcagcttgaccgctacggtatcgggcttggcctgacgctcgcggtcaaagagagcgcgttcgttctgtggacaatctacgccgcgctgcctgaaaagcgcctcgtacagcagaaaattgtcctgcataccttcggctacggacgaatgcaggcgctcaactggctcatcctcccggcaatcgcccccgcgctgggcgccgtgatgctggcggtgctcgcctggtcgctttccgtggtggatgtggcgatcgtgctcgggccgggcaacccgcctacgctggcggtgctggcctggcagtggctcacccagggcgatgcgcagcagcaaaccaagggaacgctgctgtgtctggtgttgctcctgctgctggcggcgcttgccgcggtgggatacggcttctggacggcatggcggcgcgcccagcctgccccctccggggtacgtcgcgcttcgcatagcgcgctgcccgcacggacgctgggcgggttactgccgctgtgcggcgtgctctgtgcgctggttctgctgatgctggcacgccgggacgacatcggccccgtcagcgacagcctttcactgggactgctgtccagcctgacagcgctggccatcctcatgatctggcttgagtggggaccccagcgcggcgcggtgtggatctggctgccgcttgccctcccggcgctgcccctcgtgtccgggcagtatgccgtggcgctgtggctgggcatcgacggccagtacgctgcggtgctctggagccatatgctctgggtcctcccgtggatgctcctggtgctgcaaccggcctggcgccggctcgatccccggcttatcctcactgccagaacgctgggctggcggcgggcgaaaattttctggctagtgaaatgcccattgatggttcgtccggccctgctggcctttgccaccggcttttccgtgagcatggcccagtacatgcctaccctctggctgggggcgggacgtttcaccaccctgacgacggaggcggtcgccctcagcagcggcggcagcattccgatcctcgccagccgggcgctgggtctgttgttgttgaccagcagcgtatttgcccttgccgcgctgctctcccggctcgtgggccgtcacagacaaggattacgttaa

SEQ ID NO: 3739 - DNA, 1404 bp, Enterobacter cloacae
ttgagatttctcgctggcaataatgtgctaacgcaatgtttttggcttcaggagagacgacaatgcccccctcttttaatgacgtcaggtttttcgatgaaacgtgtttctcaactgaccgcgctggccctgatctgcggcctcgcctcactctcctccacggcggctgatatgccccactccctcacgctggctcagcttcagacgcaaaacggcgcggtaattgatacgcgcatcagtgcgttctataacggctggccgcagaccctgagcggaacgtccgggcatgaacccgccgcacttaatctctctgccagctggcttggggcaatgagcgatgaacagctcagcggctgggcaaaacagcatcggcttacgccagacatgccggttgcgctctatggcaacgataatgacaaccagaccgtcaaaacacggctggagaaagcgggctttacccacgtctccaccctgagcgatgccctgcaacaatccgaccgtctgcaacgtctggcgcatttcgaacagctggtttatccgcagtggatccgccagttgcagcagggcaaacccgttaccgccgcaccagccggagagtggaaggtgatcgaggctggctggggtacgccgaagctttatctcctgagccacattcccgacgcgggctatatcgacaccaatgaagtggaaagcgaaccgctgtggaataaggtctctgacgaaaagctgaaagcgatgctggcgaagcacgggatccgtcacgataccaccgtcattctgtacggtcgcgacgtgtatgccgccgcgcgcgtggcgcagatcatgctttacgcgggcgtgagggatgtacggattctggatggcggctggaaggcgtggtccgacgccagcctgcccgttgagcgcggaacgcctgcaaacgtgaagccagcccctgattttggcgcgccgatcccgggccagccgcagctgatggtggatatggagcaggcccggggaatgctgcaccgtcaggacgcgtcgctggtgagcattcgttcctggccagagtttatcggtgaaaccagcggctacagctatatcaagccaaaaggtgaaattgccggtgcgcgctggggccatgcgggcagcgacgcgacccacatggaagatttccacaatccggatggcaccatgcgcagcgccgatgatattgccgccatgtggaaaacgtggaatatcctgccggagcagcacgttgcgttttactgtggtaccggctggcgcgcgtctgaagcctttatgtacgcccgcgccatgggctggcagaacgttgccgtctacgacggcggctggtacgaatggagcagccatccgcagaacccggtctccaccggggagcgcggaccggagagcgcacgctag

SEQ ID NO: 3740 - DNA, 429 bp, Enterobacter cloacae
ttattgacgaacatgctgaaaacactcgatgtggttgcggccatcctcgaaaatgagggcaagattttgctggcgcagcgtcccgaacatgccgatcagccaggaatgtgggaatttgcgggcgggaaggttgaagccggtgagacccagccggaagcgctgatccgcgaactgcgcgaagagctcggcattgaagctgtgcccgcgcggtatgtggcaagccaccagcgggaggtgtcgcagcggctgattcacctccacgcctggcatgtgcctgaatttagcggtgagctgaaggcgcattatcactcggcgctggtatggtgtacgccagaagacgcgttcacgtatgatttagccccggcggatataccgctgctggaagcgtttattcttttacgcgacgccagaccagcgggtttgtactga

SEQ ID NO: 3741 - DNA, 924 bp, Enterobacter cloacae
agaattgactgcccgccatctgcgtggggagtaacgctctttcaggcagcttcggctgcctgccccgcaaaatcaaaacaacgttttactttatttgcttttctcattccagactcctattcttacgtgcagaatgacaataacctgacttctgaggcgcgtatgatactggatgcttttactctggcaggaaaagtggcgatggtgaccgggtgcgataccggtctggggcaaggcatggccattgccctcgccgaagcaggatgcgatatcgtgggggttaaccgcaaggttcctgacgaaacggcagcgcgcgttacggcgctgggacgacgctttatcgcgattcgcgccgatcttggcaagcaggagagtattcagagcgtggtggataccgcagtcgctgagatgggccgcatcgatattctggttaacaatgccggcaccatccgccgtgccgatgcgctggaatttagtgagaaggactgggacgaggtcatcgatctcaatctgaaatcagtctttttcctctctcaggcagtggcgaaacagtttatcgcgcagggtcagggcggcaagatcattaacattgcttccatgctctccttccagggcggcatccgggtgccctcctatacggcgtccaaaagcggcgtgctgggcctcacccgcctgctggcgaacgaatgggcaacgctgggcattaatgtgaatgctattgcgccgggttatatggtgacaaataacacccggcagcttcgcgatgatgagcagcgcagccaggcgatcctcgaccggattccggcgggccgctggggtctcccggaggatttacagggtccggtggtgtttctggcttcaagagcatctgattacgttaacggtcatactctcgccgtagacggtggctggctggcgcgctaa

SEQ ID NO: 3742 - DNA, 1407 bp, Enterobacter cloacae
atcaggagaacggggatgaattttccactcatcgcgaacattgttgtgttcgtcgtattgctattgcttctcgcccaggctcgccacaaacagtggagcctggcgaaaaaggtactggtcggtctggtcatgggcgtggtgtttggcctggccttacacgctatttacggctccgacagcccggtactgaaagactccattcagtggttcaacattgtcggtaacggctatgtacagctgctgcaaatgatcgttatgccgctggtattcgcctctattctgagcgccgtagcccgcctgcacaatgcctctcaactgggtaaaatcagcttcctgaccattggtaccctgctcttcaccacgctgattgcggcgctggtgggtgtgctggtaaccaatctgtttggcctgactgctgaaggtctggtgcagggtagcgctgaaaccgcgcgtctgacggcgattgagaccaactacgtgggtaaagtggccgatctgaccgttccgcagatggtgctctccttcattccgaagaacccgtttgctgacctgaccggcgcaagcccaacctccattatcagcgtggtgatcttcgcggcattcctgggcgtggctgcgctgaagctgctgaaggacgatgcgccgaaaggcgagcgcgttctgacggccatcgataccctgcaaagctgggtgatgaagctggtgcgtctggtcatgcaactgacgccgtacggtgtcctggcgctgatgaccaaagtcgttgcaggttctaacctgcaagacatcattaagcttggcagctttgtgatcgcctcttatctggggctgggcattatgtttgtggtgcacggtatcctgctgggcgtgaacggcgttggcccgctgaaatacttccgtaaagtctggccggtgctgaccttcgcttttaccagccgttccagcgcggcatctatcccgctgaacgtcgaagcacagacccgtcgtctgggcgtaccggagtctatcgccagcttctcggcctcctttggcgccaccatcgggcagaacggctgtgcgggtctctacccggcgatgctggccgtaatggttgccccaacagtcgggattaatccgctggatccggtctggattgcgacgctggtcggtatcgtgaccattagctccgccggtgttgcgggcgtgggcggcggcgcgaccttcgctgcgctgatcgttctgcctgcgcttggactgccggtgacgctggttgccctgctgatctctgttgaaccgctgatcgacatgggtcgtaccgccctgaacgtgagtggctcaatgaccgccggtaccctgaccagccagtggctgaagcagaccgacaaaacaattctcgacagtgaagatgatgccgaactggcccatcgttaa

SEQ ID NO: 3743 - DNA, 882 bp, Enterobacter cloacae
ttgggcgaagcggataacagacgacgtaaattctgctaccatccttgcactattcaccttgcattggcagcgactatgaaatttgtctcttttaatatcaacggcctgcgtgcccgccctcaccagcttgaagcgattgttgagcaacatcagccagatgtgatcggcttgcaggagacaaaagttcacgacgatatgttcccgctcgaagaagtagcgaagctgggctataacgttttttaccacggtcagaaaggccactacggcgttgcgctgctgaccaaagatacgccggtgtcggtgcgccgtggcttcccgggtgacggtgaagaggcgcagcgccgcatcatcatggcggaaattccttccgcactcggcaatgtgaccgtcatcaacggctatttcccgcagggtgaaagccgcgatcatgaaaccaaattcccggccaaagcgaagttttatcaggatctgcaaaactacctgacaaccgaactcaaaaaagaaaacccggtgcttatcatgggcgacatgaatatcagcccgacggatctggatatcggtattggcgaagagaaccgtaagcgctggctgcgcaccggcaaatgctctttcctgccggaggagcgcgagtggatggagcgcctgctgggttgggggctggtggatactttccgcacggctaacccggaaacgcaggaccgtttctcgtggtttgactaccgctctaaaggcttcgatgacaaccggggcctgcgtattgatctgctgctggcgagcgcccccctggccgaacgctgcatcgaaaccggtatcgactatgacatccgcagcatggaaaagccgtccgaccatgcgccggtatgggcaacgttcaagctgtaa

SEQ ID NO: 3744 - DNA, 690 bp, Enterobacter cloacae
acttcagtgaatattaaaaaaattagtctcctgtgcgcccttctgggcgcatttgttttaattgttgttttgcttcctccgggcatgctctccctcgacacgctaaaaatacaccagcaaacgttgctcgctcgtgtggagcaagcgccccttcagagcgcgctgttctattttgcggtttacgtgctgctctccgcgctatcgatccccggagccgcgcttctgacgctgctcggcggggcgcttttcagcctgtgggaggcgacgctgttggtgtcatttgcctcgacgctcggcgccacgcttgccatgctcgtcagccgttatctgctgcgcgactgggtgcagcggcgctttgccgcacagatgaatacgatcgatgcggggatggatcgcgacggcgcacgctacctttttgccctgcgcctgatgccgttgttcccgttctttctggtcaatttgctgatggggctaacccgtctcagggtgcgtcactactggtgggtcagccagcttgcgatgctacctgccaccgtcatttatctgaacgccggacgcgagctgggaaaacttacctcgctgcgcgatattctgtcgccgggactgctgttcgcctttacactgttagggttattaccgctggtcactcgctggctgttttcccgttacatcccttcgattaaaaagtga

SEQ ID NO: 3745 - DNA, 1176 bp, Enterobacter cloacae
ggcattatgcgccgggtgcgtttttgcgcgtttctgacgagtctgctgctggcaacctctgccttcgccgctgagagctggcaatccattcagcaacaggccaccgggcagaccgtctggtttaacgcctggggcggtgacgaggccgttaaccgctacctcgactgggtaagcggcgagatgaaaacgcactacgccatcaacctgaagatcgttcatctggccgatgccgccgacgcggtgaagcggatccagacggaacatgccgcaggacgtagcagtaacgggtcggtggatctgctctgggtaaacggggaaaacttccgcaacctgaaagcggcaaacctgctgctcaccggctgggcgcaaaccctgcccaactggcgctacgtcgatacccgtaaaccggtaacggaagattttgccatcccgaccgatggggcagaatccccgtggggcggcgcgcaattaacctttatcgcccgtaaagcgagtacgccgacaccaccggcagatccccacgcgctgctggtatacgcccgacagcaccctggcaaggtgagctatccgcgaccgccggattttaccggcacggcgtttcttgagcagctactgctggcgctgaccgcccatccggaggcgttaaaaaacgcgccagacagtacctttgcgcaggtcaccgcgccgctgtgggattaccttgatacgctgcaccccctgctgtggcgcgaagggaacgattttcctccgtcgcctgcgcgcatggatacgctgctggccagcggcagtctgaacctgtcgctcacctttaaccccgcccatgcgatgcaaaaggtggcgagcggtgaactgcctgccgacagctacagtttcggctttctcaaaggcatgatcggcaacgtccattttgtcgccatcccggcaaacgccagcgcgagcgcaggtgcgaaagtggtggcgaatttcctgctgtcaccacaggcgcagatccgcaaagctaatcctgccgtctggggtgacccgagcgtgctggatggcgaaaaactgcctgcgaaagcggcaaaacagcttcgcgcctttaccccctcaggcacgcctgatgtgcttcccgaaccgcacgccgcctgggttaacgccctggagcaggaatggcttcgccgctacggaacccgctaa

SEQ ID NO: 3746 - DNA, 1359 bp, Enterobacter cloacae
gaggttcttatatctatggatcagacacgctctctggaaagctttcttgcccatgttcagcagcgcgacccgcaccaaagcgagtttgcccaggccgttcgtgaagtcatgaccaccctgtggcccttccttgaggaaaatccgcgctaccgccagatggcgctgcttgaacgtctggtagagccagagcgcgtcatccagttccgcgtggcgtgggtggacgatcgcaatcaggtgcaggtcaaccgcgcatggcgcgtgcagtttaactccgccattgggccgtttaagggcgggatgcgcttccatccctcggtgaacctgtcgattctgaagttcctcggcttcgagcagacctttaaaaatgcgctcactaccctgccgatgggcggcggtaaaggcgggagtgatttcgatccgaaaggcaagagcgaaggcgaagtgatgcgcttctgccaggcgctggtcactgaactctatcgccaccttgggccggacaccgacgttcccgccggagatatcggcgtggggggtcgtgaagtgggctttatggccgggatgatgaaaaagctctccaacaacagcgcctgcgtctttaccggcaaaggtctgtcgtttggcggcagcctgattcgcccggaagcgacgggttacggtctggtctatttcactgaagcgatgcttaagcgtcacgggctgagcttcgaggggatgcgcgtggcggtctccggctccggcaacgtggcgcagtacgctatcgagaaagcgatggcgtttggcgcgcgcgtggtgaccgcctccgactccagcggcaccgtagtggatgaagctggctttacggcagaaaaactggcgcgtctgtgcgaaatcaaagccagccgtgacggtcgggtagcggattatgcccgtgagtttggcctgacctatctggaaggtaaacagccgtggggcgtgccggtggatatcgccctgccatgcgcgacgcaaaacgaactggacgtggatgccgcccggacgctgattagcaatggcgtgaaagcggtggccgaaggggcgaacatgccaaccaccatcgacgccacggacctgttcctggacgcgggcgtgctgtttgcgccgggcaaggccgctaacgcgggcggcgtggccacctccggcctcgagatggcgcaaaacgccgcgagaatgagctggaaggctgagaaagtggatgcccgcctgcaccacatcatgctcgatattcatcacgcctgcgtggagtatggcggcgaggcgtctcagaccaactacgtgcgcggggcgaatatcgccgggttcgtgaaggtggccgatgcgatgattgggcagggtgtgatttaa

SEQ ID NO: 3747 - DNA, 1128 bp, Enterobacter cloacae
tccacagagccgttacgcgttttgcctgacctgcgcgaacgtgcgttaaaaaccgtcccctcttcccgtgaagaggggattttttcttttgaagaacaagaactcattaccatgcagaagaaatcaatatatgtcgcctataccggcggtaccatcggtatgcagcgctcagaaaatggctatatcccggtttccggccacttgcagcgccagctggcgctgatgcctgaatttcaccgtccggaaatgccggactttaccatccacgaatatgagccgctgatggactcctccgacatgacgccggaagactggcagcatattgcggacgatattaaagcccattacgaccagtacgacggcttcgtgatccttcacggtaccgacaccatggcgttcaccgcctcggcgctctccttcatgctggagaacctgagcaagcccgtcatcgtgaccggttcgcagatcccgctggcggaactgcgttcagacgggcagatcaacctgcttaactccctgtacgtggccgctaattacccgatcaacgaggtaacgctgttcttcaacaaccgactgtaccgcgggaaccgtaccactaaagcgcacgccgatggctttgacgcttttgcctcacctaacctgcaaccgctgctggaagcggggatccatatccgtcgtctgggcacgccgcccgcaccaaatacggcaggcgagctgatcgttcatccgatcaccccgcagccgattggcgtggtgacgatttatccggggatctccgccgacgtggtgcgcaacttcctgcgccagccggtgaaggcgctgatcctgcgctcctatggtgtgggtaacgccccgcagaacggtgagttcctgaaagagcttcaggaggcgagcgatcgcgggattgtggtggtcaacctcacccagtgtatgtccggcaaggtcaatatgggcggctacgccaccggtaatgctctggctcacgcaggcgtgataagtggtttcgatatgaccgttgaggcaacactgactaaacttcactatttactgagtcaggatctggatattgattccattcgccgcgccatgatgcaaaacctgcgcggtgaactgacgccggacgaataa

SEQ ID NO: 3748 - DNA, 651 bp, Enterobacter cloacae
ggagatcccatgaagcaacgcgccctgttactggtcgatttgcaaaatgatttctgtgcgggtggtgcgctggccgtcgcggaaggcgacagcaccgtagacgtcgcgaattcgctgattgcgtggtgtaaagctcgtggtgaagcggtggtggcgagtcaggactggcatccggcaaaccacggcagctttgccagccagcacaacgttgagcctttcagccagggcgaactggacgggctggcgcaaaccttctggcccgatcactgcgtgcagcagacggagggcgctgagctgcatccgctgctgaaccagaaggccatcgacgcggtgttccacaaaggtgaaaacccaaccatcgacagctacagcgcgttctttgataacggtcatcgtcagaagacggcgctggacgcgtggttgcgccaccatgagatcaccgagctgattgtgctgggcctggcgacggattactgcgtgaagttcaccgtgctggatgcgctccagttgggctataccgtgaatgtcatcaccgacggctgtcgcggggtaaatattcagccgcaggacagcgctcaggcgtttatggatatggccgcagaaggcgcaacgctgtatacgctggctgactggatggagacgcaggcgtaa

SEQ ID NO: 3749 - DNA, 1365 bp, Enterobacter cloacae
actccctcgcatcacaagcgaaacggcgatgctattctctcgaggctgttttttcgccacgccttttctgtggcgtggttatttttattcagtcaaagaggaaattatatgaaacgtttgcccttgctggcagcattacccttgctttgcgcgtcactggcttccgctgcgcccctgatgtccgtgggttacttcaatggcggtggcgatgttaccgccggaccgggtggcgatattcataaactcgacgtgcgccagatcacccacctcaactactcgtttggtctggtctataacaacgagaaagacgaaaccaacgccgcgctgaaagatccggcaaaactgcatcaaatctggttatcacccaaggtggcatccgatctggcgttacttcctcagcttcgtaaacaaaacccgaacctgaaagtcctgctttccgttggcggctggggcgcgcgaggtttttctggcgcagcggcaaccaaagagagccgcgcggtgtttattcgctccgcgcaggagatcgtcagtcaatacggcctggacgggatcgatctcgactgggagttcccggtcaacggcgcgtggggactggtcgagagcactccagccgaccgggataatttcaccgcgctgttaaaagagatgcgtgacgcgtttggtaagaaaaagctggtcacgattgcggtgggcgcgaatgcggaaagtccgaaaagctgggtggatgtgaaagccattgcccccctgcttgattacatcaacctgatgacctacgacatggcgtacggtactcagtattttaacgcgaatctgtatgactccagcgactggccaacggttgctgccgcagacaaatacagcgtcgattttgtggtgaataactatctggccgccgggctgaagccgcagcagatgaacctcggaattggtttctatgggcgcgtgccgaaacgtgccgtagagccagggatcgactggagcaaaccagacgcgcaaaacaatccggtgacgcagccctacttcgggccgcaggaactgagcctgttcaaatcgcttggctatgatctgaccaaagatacctatgtgaaatacaacgatatcgtccgcaagctgctgaacgatccgcaaaaacgctttaccgagcactgggacgaacaggcgaaggtgccgtggctgtcggtgaaatctgccgacgggaaggcgctgtttgcgatttcctatgagaacccgcgctccgtggcgatcaaagcggattacatcaaggagaaaggacttgccggcgccatgttctgggagtatggggctgacgacgaaaaccagctcgcgaaacagctggcggagtcgcttgggatcctgcatcagtag

SEQ ID NO: 3750 - DNA, 945 bp, Enterobacter cloacae
aaggaggtcatgatggcttcgatttatacgctgacactctccccttccctcgactccgcgaccatgacgccgcaaatctacccggaaggtaagctgcgctgtagcgcgccggtgtttgagccgggcggcggcggcatcaacgtggcgcgcgctattacccatctcggcggaaaagccaccgccatcttccccgctggcggcgccacgggagaacatctggtggcgttgctggcagatgaacaggtggccgtagacaccgtcgacgctaaagactggacccggcagaacctgcatgtccatgttgaatccagcggcgagcaatatcgctttgtgatgccgggggcgaaattgaccgatgatgagtttcgtcaactggaagagaaagtgctgaccattgaaagcggctcattactggtgatcagcggtagcctgccgccgggcgtcaaaacagagaaactgacggcgctggttcaggcggcgctccagcgcggcatccgctgcattgtcgatagctcgggcgaagccctgaaggcggcgttagaacccggacaacttgaactcgttaaacctaaccagaaagagctcagtgccctggttaatcgagaactcagccagcctgatgacgttcgtactgccgcagaagagctggtacgtacgggcaaagcacatcgcgttgttgtttctctcggtcctcagggggcgctggccgtcgataagacgggctttgtgcaggttgtgccaccgccgatgaaaagccagagcaccgtgggtgccggtgacagtatggttggcgcgatggtgctgaagctggcgcagggcgcttcgcttctggagatggcacgctatggcgtcgcggcagggagtgcagccaccatcaatcagggaacgcgtctgtgttcgcttgcggatacccagaaaattgtcgattacctcgagagaagctga

SEQ ID NO: 3751 - DNA, 684 bp, Enterobacter cloacae
ggagatgttgtaatgtcgacaccgcgcaagatacttgccgctatttttgacatggatggattgctaattgattccgaacccctgtgggatcgggctgaactggacgtgatggccagcctcggcgtcgatatcagtcgtcgtaacgagcttcccgataccctggggctgcgcattgatatggtggttgacctttggtatgcccaccagccatgggttggcccggatcgcgacgaagttacggcgcgcattatcaaccgcgccatctccctcgtagaagagtataagcctctgttacctggcgtacgcgacgctatcgccctgtgcaaggcgcaagggctgaaagtggggctggcctccgcctcaccgctgcatatgctggaaaaagtgctgacgatgttcgggctgcgcgacagcttcgacgcgctggcctcggccgaaaagcttccgtacagcaagccacatccgcaggtgtatatggactgcgccgcgaaactggggctggatccgcttacctgtgtggcgctggaagattcggttaacggcatggtggcgtccaaagccgcacgtatgcgctccatcgttgtgccggctgaagaaggccgacacgatccccgttttgccctggcggatgtcaggctgacgtctcttgaagaattgactgcccgccatctgcgtggggagtaa

SEQ ID NO: 3752 - DNA, 936 bp, Enterobacter cloacae
atcgctgtaaaacagtacactcaaaactgtgatccttgtcgtttccccgacaaagggttagttttaacagatcacactttctgtttggttctgcatagggagggcgtaatggctctgcaacaagaaattattcaggcgctgggcgcgaaacctgcgattgatgccaatgaagagatccgtcgtagcgttgattttttgaaagcttacctgtctgcacaccctttcctgaagacgctggtgctgggtatcagcggcggtcaggattccactctggccggcaagctgagccagatggccatctccgagctgcgtgacgagaccggtgacaccgcgctgcaatttattgccgtacgtctgccgtatggcgtgcaggctgacgagcaggactgtcaggatgcgatcgcgtttattcagccggaccgtgttcttaccgtaaacatcaaaggttcggtactggcaagcgagcaggccttgcgtgaagccggtattgaactgagcgattttgttcgcggcaacgagaaagcccgtgagcgcatgaaagcgcagtacagtatcgcagggatgaccaaaggggttgtcgtcggcaccgaccacgccgcggaagccatcaccggcttcttcaccaaatacggcgatggcggcacggatatcaaccccctcttccgcctgaacaagcgtcagggcaagcaactgctggcggcgctgggctgcccggagcacctgtataagaaggcgccaacggcggacctggaggacgatcgcccttccctgccggatgaagccgcgctgggcgtcacatatgacaacattgatgattatctggaaggcaaaacgctcgacgaaggtaccgctaacattatcgaaggctggtatctgaaaaccgagcacaagcgccgtccgccgattacggtgtttgatgatttctggaaaaagtaa

SEQ ID NO: 3753 - DNA, 1143 bp, Enterobacter cloacae
gtggggaccccagcgcggcgcggtgtggatctggctgccgcttgccctcccggcgctgcccctcgtgtccgggcagtatgccgtggcgctgtggctgggcatcgacggccagtacgctgcggtgctctggagccatatgctctgggtcctcccgtggatgctcctggtgctgcaaccggcctggcgccggctcgatccccggcttatcctcactgccagaacgctgggctggcggcgggcgaaaattttctggctagtgaaatgcccattgatggttcgtccggccctgctggcctttgccaccggcttttccgtgagcatggcccagtacatgcctaccctctggctgggggcgggacgtttcaccaccctgacgacggaggcggtcgccctcagcagcggcggcagcattccgatcctcgccagccgggcgctgggtctgttgttgttgaccagcagcgtatttgcccttgccgcgctgctctcccggctcgtgggccgtcacagacaaggattacgttaatgctaaccgtgaaaaatctcaccattgcgccgctcttacatgaggtcaacttccgcgtcccggcgggggagatcgtcacgctgatggggccctccgggagtgggaaatcgacccttttcgcctggatggtgggggcgttatccgctgattttaaggcgcacggcgagctgtggctgaacgatcgtcgctgcgatatgctccccgtggaaacgcgcgggatcggcattctgtttcaggatgccctgctgtttgacgccttcagcgtggggcaaaacctgatgctggcgctgccggcgcacatcgtcgggcgcgcccgccgcaacgcggtcgagcaggccctggagactgccgggctggcaaaccactacaccagcgatccggcgaccctttccggcggcgagcgcgccagggtcagcctgttgcgcgcccttctcgcccagccgcaggcattgctgctcgacgagccgttcagtcgactggataaaacgctgcgcgcctcattccgggcgtgggtattcgaggtcactcgccagcgcaggatcccggtggtgctggtcacgcatgatgaggacgatattccgcccggcggcgaggtgattgagatttctcgctggcaataa

SEQ ID NO: 3754 - DNA, 261 bp, Enterobacter cloacae
cggcctgcactttatccagcgccccgctccgctcggccagacgcaggctgttggcatcaatacaaaatgcgcagtggcagatctgcgagacccgcgtcattagtagcgatcgcagaaccggggtcaaacgcgccttgcgccgctccagatagccgacaaacagcgccaccagccagaaaagacgcggcatacgcccccaccagcgagtggggttcagcaccgcgccgaagtgttttttctgcatggcggcgatggggctaa

SEQ ID NO: 3755 - DNA, 1866 bp, Enterobacter cloacae
ggagaatacatgcgaaccctttggcgaattattgccggtttctttaaatggacgtggcgactgctcaacttcgtccgcaacctggtgatgaacatcttcttcatcctgctggttctggtttgcgcgggcatctggatgcatatcagcaacgcaaaccagtcgcagcattcgacgcgcggcgcactgttactcgatatcaccggggtgattgttgataagccatcgaccagcaaccgtctgggcgtgattggccgccagctgttcggcgcaacgtcagaccgtctccaggaaaactccttgtttgatattgtcgacaccatccgtcaggccaaagacgatcgtaacattaccggtatcgtacttgacctgaaagattttgccggcgccgatcagccgtcaatgcagtacatcggtaaagcgctgcgcgaatttcgcgacagcggtaaaccggttattgccattggcgacagctacacccaggggcaatattatctggcgagcttcgccaataagatctggctctctccgcagggtacggtcgatctgcatggcttcgccactaacggtctgtactacaaatcgctgctcgacaagctgaaggtcactactcacgtcttccgcgtcgggacctataaatccgccgtggagccgtttatccgcgatgatatgtcccctgccgctcgtgaagcggacagccgctggattggcgagctgtggcagaactacctcggcaccattgccgctaaccgtcagattaccgctgagcaggtctttccgggcgcgcgcggcgtgctggacggcctgcgcaaggtggacggcgatacagcgaaatacgcgcttgataacaaactggtcgatcagctgggttccagcgctgaaattgaaaaagcgctgaccaaacagttcggctggagtaaagaggacaaaaactacagcgccatcagcatgtatgactacgccgcgaaaaaatcggacgacagcggtgacagcatcgccgtggtgtttgctaacggggccattatggacggggaagaaacgccggggaacgtcggcggagacaccaccgcgtcgcagatccgcgatgcgcgcctggatccgaaagtgaaggcaattgtcctgcgggtgaacagccctggcggcagcgtcagcgcctctgaagtgatccgtgctgaactggccgccgcgcgcgccgcaggcaagccggtagtggtctcgatgggcggcatggcggcttccggggggtactggatctcgacgccagccaactacattgtggctaacccaagcacgctgaccggctcgattggcatcttcggcgtgatcaacaccgttgagaacagcctggattatctcggcgtccacaccgacggcgtttccacctcgccgctggcggacgtgtccgttaccaaatccctgccgcctgaggtgtctgagatgatgcagctcagcattgagagtggctataagcgcttcatcacgctggtggcggactcccgtaaaaagacgcccgatcagattgaccagatcgctcagggccacgtctggaccggccaggacgcgaagagcaacggcctggtagacagcctgggtgacttcgacgacgccgtgaagaaagcggcagagctggcgaagctcaagcagtggcacgtggactattatcaggacgaaccgacgttcttcgatatggtcatggacagcatgtccggctccgtccgtgccatgctgccggacgcgcttcaggcttatctgccggcgccggtggcgaccgcggcgaaagccatgaaagcggagagcgacaagctcgcagcctttaatgatccacagagccgttacgcgttttgcctgacctgcgcgaacgtgcgttaa

SEQ ID NO: 3756 - DNA, 1575 bp, Enterobacter cloacae
cccatgagccagcaagtcgttattttcgatactactttacgtgacggtgaacaggcattacaggcgagcctgagcgttaaagaaaaactgcaaattgctctggccctcgaacgcatgggtgtagacgtaatggaagtcggctttcccgtctcctcgccaggtgatttcgagtcagtgcagaccatcgcccgcaccatcaaaaacagccgcgtgtgcggtctggctcgctgcgtagagaaagatattgatgtggccgcggaatccctgaaagttgcagaagccttccgtatccatacattcattgccacctcccccatgcacattgcgaccaagctgcgcagtacgctggatgaagtgattgaacgtgcggtgtatatggtcaaacgcgcgcgtaactacactgatgacgtcgaattctcctgtgaagatgcaggccgcacgccgattgacgatttggcccgggtagtggaagccgcgattaatgccggagccagaactatcaacatcccggataccgtcggctacaccatgccgtttgagttctccaacatcatcaccggcctgtacgatcgcgtgccaaatattgataaagccatcatctccgtgcatacccatgacgatttgggcctggctgtgggcaatgccatcgccgccgttcacgccggcgcgcgtcaggtagaaggggcaatgaacggcattggtgaacgtgccggcaactgctcgctggaagaagtgatcatggcgatcaaggtgcgcaaagacattatgaacgtgcacactcgcatcaatcacaacgaaatctggcgcaccagccagaccgtgagccagatttgcaacatgccgatcccggcgaacaaggcgattgttggggctggcgcgttcgcccactcctccggtattcaccaggatggcgtgctaaagaaccgtgaaaactacgaaatcatgactccggaatccatcggtctgaaccaggttcagttgaacctgacctcgcgctctggccgcgcggcggtaaaacaccgtatggaagagatgggttataaggacagcgattacaacatggatcagctgtacgacgcattcctgaagctggctgacaagaaaggccaggtcttcgattacgacctggaagcactggcattcatcaataaacagcaggaagagccagaacacttccgtctggactacttcaccgttcagtcaggctcaagcgatatcgctaccgcctccgtcaagctggcctgcggcgatgaaattaaagcggaagccgccaacggtaacggccctgtggatgccatttaccaggcgattaaccgcgtcactgagtacgacgtagagctggtgaaatacgacctgacggcaaaagggcacggtaaagacgccctgggccaggttgatatcgtcgtcaactacaacggtcgccgcttccacggtgtgggtctggcgacagatatcgtcgaatcctccgcgaaagcgatggtgcatgtcctgaacaacatctggcgcgccgccgaagtcgaaaaagagttgcaacgcaaagctcagaataaagagaacaacaaggaaaccgtgtga

SEQ ID NO: 3757 - DNA, 1521 bp, Enterobacter cloacae
cacattaaggacacgataatgaccatttttaataattatgaagtgtggtttgtgattggcagccagcatttgtacggaccggaagcgttgcagcaggtgacgaaacacgcggagcacgttgtgaatgcgctgaacgcggaagccaaactgccgtgcaaactggtgctgaagccgctggggactaccccggacgaaatcaccaacatttgccgcgatgccaattacgatgacaaatgcgctggcctggtggtgtggctgcacaccttctcaccagccaaaatgtggatcaacggcctggctatcctcaacaaaccgctgttgcaattccacacgcagttcaacgcctccctgccgtgggacagcatcgacatggacttcatgaacctgaaccagaccgcgcacggcggccgcgagttcggcttcatcggcgcgcgcatgcgtcaacagcatgccgtggtgaccggccactggcaggatggccaggcacaaaaacgcattggctcctggatgcgtcaggcggtatctaagcaggatacccgtcacctgaaagtggtgcgtttcggcgacaacatgcgcgaagtggcggtcaccgacggtgataaagtggccgcgcagattaaatttggcttttccgtcaacacctgggcggtgggcgacctggtgcaggtggtgaatgacatcagcgatggcgacgttaacgcgctggtggacgagtacgaaagcagctaccgtctgacgcctgcggcacaaatcaacggcgacaagcgccagaatgtgctggacgcggcgcgcattgagctgggcatgaagcgcttcctggaacagggcggcttccacgcttttaccaccacctttgaagatctccacggcctgaaacagctcccgggtctggcggtacaacgtctgatgcagcagggctacggctttgcgggcgaaggcgactggaaaactgccgctctgcttcgcatcatgaaggtgatgtcaaccggtctacagggcggcacctcttttatggaggactacacctaccacttcgagaacggcaacgatctggtgctcggctcgcacatgctggaagtgtgtccatccatcgcggttgaagagaaaccgatcctcgacgtgcagtacctcggcattggcggcaaagcggatccggcccgtctgatcttcaacacccgtaccggcccggccattaacgccagcctgatcgacctcggcgaccgtttccgcctgctggtgaactgcgtcgatgcggtggaaactccgcattctctgccgaaactgccggtcgccaacgccttgtggaaagcgcagcctgacctgccaaccgcgtcggaagcctggatcctggccggcggcgcgcaccacaccgtattcagccacgcgcttgacctgaacgatatgcgtcagtttgccgagctgcacgacatcgaactgaccgtgattgataacgatacccgtctgccagcctttaaagacgcgctgcgctggaacgaagtctattacggttcaaaacgctaa

SEQ ID NO: 3758 - DNA, 2919 bp, Enterobacter cloacae
agccgaacaactatgccttttacacttggtcaacgctggatcagcgatacagaaagcgaacttggattaggaaccgtcgttgccgtcgatgcgcgcatggttaccttccttttccctgctaccggtgaaaaccgcctgtacgctcgcaatgactcccctgttacccgcgtaatgttcaatccgggcgacaccgtgaccagccacgaaggctggcagctgaaggttgaagacgtaaaagaagagaatggactgctcgcctacatcggtacgcgtcttgataccgacgagacgaatgttatcctgcgtgaagtgctgctcgacagcaaactggttttcagcaagccgcaggaccgtctgtttgccgggcaaatcgaccgaatggatcgcttctccctgcgctaccgcgcgcgtaagttccagagtgaacagtaccgcatgccgtggagcggcctgcgcggtcagcgtaccagccttattccccatcagctgaatatcgcccatgacgtgggccgtcgccatgcgcctcgcgtgctgctggctgacgaagtgggcctgggtaaaaccatcgaagcaggcatgatcctgcaccagcagctgctctctggcgctgccgagcgcgtgctgattgtggtgccggaaacgctgcaacaccagtggctggtcgagatgctgcgccgctttaacctgcgcttctccctgttcgacgacgagcgctatgccgaagcccagcacgacgcggacaacccgtttgaaaccgaacagttggtcatttgttccctggacttcgtgcgccgcagcaagcagcgcctggagcatctgtgcgacgctgaatgggatctgatggtcgtcgacgaagcacaccacctcgtctggagcgaggacgcgccaagccgcgaatacatggcgattgagcagcttgccgagcgcgtaccgggcgttctgcttctgaccgccaccccggagcagctgggtcttgagagccacttcgcccgtctgcgcctgctcgatccgaaccgtttccacgattttgagcagtttgttgaagagcagaaaaactatcgtccggtggcggacgccgtcgcgctgctgctggccggtaatcgtctctctaatgatgaacttaacaccctcagcgatcttatcggcgagcaggatattgagcctctgcttcaggccgcgaacagcgacagcgataatgcgggatctgcgcgtaaagagctgatcgacatgctgatggaccgccacggcaccagccgcgtgctgttccgtaacacccgtaacggtgtaaaaggcttcccgaaacgcgaactgcacaccatcaaactgccgctgccgacccagtaccagacggcgatcaaagtctccggcattatgggcacccgtaaatctgcggaagatcgcgcgcgcgacatgctctatccggagcagatttatcaggaatttgaaggcgacactggcacctggtggaacttcgatccgcgcgtggagtggttgatgggttatctgaccgcgcaccgttcccggaaggtgctggtgatctgcgccaaggcagccaccgccctgcaacttgaacaagtgctgcgcgagcgcgaaggtattcgcgccgccgtgttccatgaaggcatgtctattatcgagcgcgaccgcgctgcggcgtggtttagtgaagaggacagcggcgcgcaggttctgctgtgctccgaaatcggttctgaaggccgtaacttccagttcgccagcaatctggtgatgttcgatctgccgtttaacccagatctgcttgagcagcgtatcggccgtctggatcgtatcggtcaggcgcacgatatccagatccacgttccgtatctggagaaaaccgcccagtccgttctggttcgctggtaccacgaaggcctggatgcgtttgaacatacctgcccgaccggccgcaccatttacgatcaggtgcatgcagacctgatcggttaccttgcggcgccggaaaacaccgagggctttgatgagctgatcaaatcctgtcgagagaagcacgacgcgctgaaagcccagctggagcaggggcgcgatcgcctgctggagatccactccaacggcggtgaaaaagcgcagcagctggccgaaagtattgaagaacaggacgatgacaccagcctgattagcttctccatgaacctgttcgacatcgtcggcattaaccaggacgatcgcggcgagaacatgatcgtgctgaccccgtccgatcatatgctggtgccggatttcccgggcctgccggaagacggctgcaccatcacctttgagcgtgatgtggcgctgtcccgcgaagacgcacagttcatcacctgggagcacccgctcatccgcaatggcctggatctgatcctctcaggcgataccggcagcagcaccatctccctgttgaagaacaaagccttacctgtgggcacgctgctggtggagctgatctacgttgtggaagcgcaggcgccgaaacagcttcagcttaaccgcttcctgccgccaaccccggtgcgtctgctgctggataaaaacggtacgaatctggccggtcaggtagagtttgaaagcttcaaccgtcagctgagcgcggtgaaccgccataccggcagcaagctggtgaatgcggtgcagcaggacgtgcatgccattctgcaactgggtgaagcccaggccgaaaaagcggccagagaactgatcgatgcggcgcgtagcgaagccgatgagaagctttctgccgagctgtcgcgcctggaagcgttgaaagcggtgaacccgaacattcgtgacgatgagctggccgctattgagagcaatcgccagcaggtgctggaaagcctgaatcaggcggggtggcgtctcgacgccctgcgtcttatcgttgtgacgcatcagtaa

SEQ ID NO: 3759 - DNA, 499 bp, Enterobacter cloacae
  unsure (471)
gcggagcgcaagatggtaatggagccctacaatcccccgatggatccgtggctggtcattctgtatcaggatgagcacattatggtggttaacaagccgagcggcttgttatccgtgccggggcgtctggaagagcataaagacagcgtgatgacgcgtatccagcgtgattatcctcaggccgagtctgtccatcgtctggatatggcgaccagcggcgtgattgtggtggctctgaataaagcggcagaacgcgagctgaagcgtcagttccgcgagcgcgagccgaagaagcagtatgtcgcgcgcgtctggggtcatccggcgcaggcggaagggctggtggatttaccgctgatttgcgactggccgaaccggccaaagcagaaggtgtgttatgaaaccggcaaggccgcgcaaaccgagtatgaagtgctagagtacgcgcggcataacgtgttcatcacgagncgccagatccggcataatttaacccaac

SEQ ID NO: 3760 - DNA, 1413 bp, Enterobacter cloacae
aggggtgtaatcatggctaagacgttatatgagaagttgtttgatgcgcacgtggtctacgaagcaccaaacgaaaccccactgttgtacatcgaccgtcatctggtacacgaagtgacctctcctcaggcatttgacggcctgcgcgcgcacaagcgcccagtgcgtcagccgggtaaaacctttgccacgatggatcacaacgtttccacccagaccaaagacatcaatgcatctggcgagatggcgcgtatccagatgcaggagctgattaagaactgtaacgagtttggcgtggagctgtacgatctgaaccacccctatcagggtatcgtccacgtaatggggcctgagcaggggattaccctgccaggcatgaccatcgtctgcggcgactcccataccgcaacccacggcgcatttggcgcgctggcgttcgggattgggacctctgaagttgaacacgttctggcgacgcagaccctgaagcagggccgcgccaaaaccatgaagattgaagtgaagggcaaagcggcacctggcattaccgcgaaagatatcgtgctggcgattatcggcaaaaccggcagtgcaggcggcaccggtcacgtcgttgagttttgcggagatgctatccaggcgctgagcatggaaggtcgtatgaccctgtgcaacatggccattgagatgggcgccaaagcaggactggtggccccagacgaaaccaccttcaactatgtgaaggggcgtctgcatgcgccgaaaggtcagaattttgacgacgcggtagcgtactggaaaaccctgaaaacggacgagggggcaatttttgataccgttgtgacgttacaggcggaagagatcgccccgcaggtcacctggggcaccaacccgggccaggtgatttctgtcaacgacagcattcctgacccggcttccttcgccgatccggtcgagcgcgccagtgcggaaaaggcgctggcctatatggggctgaaacccggcgtaccgctgaccgacgtgagcattgataaagtgttcatcggctcctgtaccaactcccgtattgaagatttacgcgctgcggcagaaattgctaaaggccgcaaagtggcgccgggcgtgcaggcgctggttgtgccgggctccggtccggtgaaagcccaggcggaagcggagggtctggataagatctttatcgaagcaggcttcgaatggcgcctgcccggctgctccatgtgtctggcgatgaacaacgaccgcctgaatccgggcgagcgatgtgcctccaccagcaaccgtaactttgaaggccgtcagggccgcggtgggcgcacccacctggtcagcccggcaatggccgccgctgcggcagtcaccggtcatttcgccgatattcgcagcctgaaataa

SEQ ID NO: 3761 - DNA, 1611 bp, Enterobacter cloacae
atggcaacgcgccgtcagccgctgatccccggctggttagttcccgggctgctcgccgccgtactgatggtcgtcgtcagcctgggtgcattccttgcgctgtggtttaacgcgccagagagcgatctgctcgccctctggcacgacagctatctctggcacgtcatccgcttctccttctggcaggcgtttctctccgcgctgctgtcggcgatcccggccattttccttgcacgcgccctctatcgcagacgtttccccggcaggcttgccctgctgcggctgtgcgcgatgacgctgatcctgcccgtgctggtggcggtgttcggcattctgagcgtctacggtcggcagggctggctggcatccctcttcaacctgcttggtctggaatggaccttctccccttacggcctgaaaggcattctgctggcgcatatttttttcaatatgccgatggcgacgcgcctctttttacaggcgctggaaaacattcccggtgagcagcgtcagattgccgcccagcttggcatgcgcggctggtcgttcttccgctttgtcgaatggccgtggctgcgacgccagattgctccggttgccgcgctaatctttatgctctgcttcgccagcttcgcgaccgtactttctctcggcggcgggccgcaggccaccaccattgagctggcgatctatcaggccttaagttacgactacgatccgggccgcgccgcgctgctggcgatcgtgcagatggtctgctgcctggcgctggtgttactcagccagcggctaagtaaagcgatccccacaggtagcaataacctgacaggctggcgcgatccgcaggacagcctgcacagccgcgtcgcggattttatgctaatcgcattggcactcctgcttctgctgcccccgctgctggccgttattgttgatggcctgaatcgcaatgtgttgtcggtactgcaacagcctgtcctgtggcaagcaacgtggacctcattgcgcatcgcgctggctgccgggctactgtgcgtgatcctgaccatgatgctgctctggagcagccgcgaactgcacgcgcgtcatgcccgtaaagccggacacgcgctggaactgacgggtatgctgatcctggcgatgccgggcattgtgctggcgaccggattctttttactgttcaacagcaccatcggcctgccggaaagcgccgacggcatcgtcatttttaccaacgcactgatggccatcccttacgcgctcaaggtgctggaaaacccgatgcgcgacgtcaatagccgctacagtttgctgtgtcagtcgctgggcatgcagggctggcagcgtctgaaggtggtcgaactgcgcgcgctaaagcgtccgctggcccaggcgctggcgtttgcctgcgtgctgtcgattggcgattttggcgttgtggccctcttcggcaacgaggatttccgcacgctgccgttctggctttatcagcaaattggctcctatcgtagccaggacggcgccgtcacggcgctactcctgttgctgctgtgctttgcgttatttaccgttatcgaaaaacttccggggcgtgatgttaaaactgactga

SEQ ID NO: 3762 - DNA, 1116 bp, Enterobacter cloacae
agagaacaacaaggaaaccgtgtgatgtcgaagaattaccatattgctgtgttgccgggtgacggtattggcccggaagtgatggcacaggcgctgaaagtactggaagctgttcgttcgcgttttgcgatgaaaattaccaccagccactacgacgtgggcggtattgcgattgataatcacggtactcccctgccgaaagggactgtagaaggctgcgaaaatgccgatgccgttctttttggctccgtgggcggcccaaaatgggaacacctgccgccagcagagcagccagagcgcggtgcgctgctgccgttgcgtaagcacttcaaactgttcagcaacctgcgtccggcgaaactgtacccggggctggaagagttttgcccgctgcgcgcggatatcgcggccaacggtttcgacatcctgtgcgtgcgtgagttgaccggcggcatctacttcggtcagccaaaaggtcgcgaaggcagcggtcagcatgagaaagcgtttgataccgaggtctatcaccgttttgaaatcgaacgtatcgcccatatcgcgtttgagtcagcgcgcaaacgccgccgtaaagtgacctctattgataaagcaaacgtgctccagtcgtctattttgtggcgcgaaatcgtcagtgaagtcgctaagcagtacccggacgttgcgctgtcgcatatgtatatcgacaatgcaacgatgcagctgatcaaagatccgtcccagtttgacgtgctgctgtgctccaacctgttcggcgatattctctcggatgagtgcgccatgatcaccggctccatgggcatgctgccctcggccagcctgaacgaagaaggctttggcctgtacgaaccggcgggcggctccgcgccggatatcgcaggcaaaaacatcgccaacccgattgcgcagatcctctccctggctctgctgctgcgctatagcctggatgcaggcgatgcagcaaccgcaattgaaaacgccattaaccgggcgttagaagaaggcgtccgtaccggcgatttagcacgcggcacggcggcagtcagtaccgatgaaatgggcgacatcattgcccgctatgtcgctgaaggggtgtaa

SEQ ID NO: 3763 - DNA, 621 bp, Enterobacter cloacae
aataaggagacaatcatggcagagaaatttacccaacatacgggccgtgttgtcccgctggatgccgctaacgtcgatactgacgctatcattcctaagcagtttttgcagaaagtgacgcgcacgggttttggtgcgcatctgttcaacgactggcgcttcctcgacgataaaggcgaagtgccaaacccggaattcgtcctgaactttccggaatacaaaggcgcctccattttgctggcgcgggaaaactttggctgcggatcgtcgcgtgaacatgcgccgtgggcattgaccgactacggctttaaggtggttatcgccccaagcttcgcggatatcttctacggcaacagctttaacaaccagctgctgccggtgacgctgagtgacgaacaggtcgatgaactgtttgcgctggtgcaggcaaatccggggatttcgtttgaagtggatctggaagcggaagtggtgaaggccggtgacaagacctacagcttcagcattgatgcgttccgtcgccactgcatgctgaacggtctggacagcattggcctgacgctgcaacacgaagaggctatagccgcctacgagaaaaaacagcctgcgtttatgggttaa

SEQ ID NO: 3764 - DNA, 1680 bp, Enterobacter cloacae
ttttttgtcaggagttccccttttatgccttctggtcgtctgcaacaacaatttatccgcctctggcagtgctgcgaggggcaatcgcaggagaccacgctgaacgagctggctgaactcctcaactgctcccggcgtcatatgcgtaccctcctcaacaccatgcagcagcagggctggctaaactgggaggctgaagccggacgcggcaagcgctcgcgcctgactttcctttataccggcctggcgctacagcaacagcgggcggaggatctgctggagcaggaccgcatcgatcagctggtccagctggtgggcgacaaagccgccgtgcgccagatgctggtctcgcatctgggacgcagctttcgtcagggacgccacattctgcgggtgctctactaccgtccgatgaaaaatctgttgcccggcacggcgttacggcgttctgaaacccacatggcccgacaaatcttcagcggcctgacgcgaataaatgaggaaaacggggaactggaggcggatatcgcgcaccactggcaacagctttccccgcgccactggcgctttttcttacgccccggcattcatttccaccatggacgcgagctggagatgcgcgacgttatcgattccttagagcgagcccgcacgctgccgctctattcgcatatcgcgcggatccactccccaacggcctggacgctggatattgagctatcgcagccggacaaatggcttccgtggcttctgggctacgtcccctcaatgatcctgcctgccgagtggcgctccctgaacaatttttccagccagccgattggtacgggcccctactccgttacacgaaacaacagtaatcagctgaagatccgcgcctttgatgattactttggctacagggcgttgatcgacgaagtgaacgtctgggtgttaccggatctcaacgaagagctgagcgcaggcctgaccctggaagggccaacagccggtgaaaaggcgttcgaaagccgcctggaggagggatgctactacctgctctttgatagccgcagccatcgcggggcaaaccacgacgtacgcaggtggatcagccatattcttgcccctgctaacctgatttatcacgcagaggagcaataccagacctggtggttcccggcctatggcctgcttccgcgctggcaccatgcgcagccagtgcgcagtgaaaaacctgccggactggagaccatcaccctcagctactatcgcgatcacattgagcacaggtttatcgcaaggatcatgagcacgctgctggcagccgaaggcgtgacgctggcgatacaggaagtcgattatgatgaatggcatcgcggagacgtcatcagcgatatctggctcaacagcgcaaactttacgctgccgcttgatttctcactcttttctcacctgtacgaagtgcccctgattcagcactgtatcaaccgggactggcagcaggacgccgcacggtggcgggcaggagaaatggatctggccgcctggtgtcaggaattactggccgggcagacgatcgtaccgttgattcaccactggctgctgatccagggccagcgcagcatgcgcggcctgcggatgaacaccctgggctggtttgattttaaatccgcctggtttgcgccgccggagccataa

SEQ ID NO: 3765 - DNA, 1047 bp, Enterobacter cloacae
cgccggcgaagggatttgaggctgtctctcaaaatcctttgccactcaaccctgaggtgcaaagtgttaaaaaacgttcttcctctgctggcgctgtttgcgctgcctgtttttgctaagcctgttctgacggtctacacctacgactccttctccgccgactggggccctggcccggtggtaaaaaaagcctttgaagcggactgcaactgcgagctgaaattcgtggcgctggaagatggcgtctcgctgcttaaccggctgcgcatggaaggcaaaaacagcaaagccgacgtggtgctcgggctggataacaacctgctggaagccgccacccaaaccagactgttcgccaaaagcggcgtggcggcagatgccgttaacgtaccgggcggctggaaaaacgacaccttcgttccctttgattacggttactttgcgtttgtctacgataaaaacaagctgaagaatccgcccaaaagcctgaaagagctggtcgaaagtgaccagaaatggcgcgtgatttacgaagatccgcgtaccagcacgccgggtctggggctgctgctgtggatgcaaaaagtttacggggataaaacgccggaagcgtggcagaagctggccgcgaaaaccgttaccgtcaccaaaggctggagcgaagcctatggcctgttcctgaaaggcgaaagcgacctggtgctgagctacactacctctccggcctaccacattatcgccgagaagaaagacaactacgccgccgcgaactttgctgaagggcattatttgcaggtggaagtggccgcccgcaccgccgcgagcaaacagccggagcttgccgaaaaattcctgaaatttatgatctccccggcatttcagaacgctattccgaccggcaactggatgtacccggtcactgacgttgcgctgccggcaggctttgagcagctaaacaagccgcaaacctcactggaatttacgccgcagcaggttgccgcccagcgcgccgcatggattagtgaatggcaacgcgccgtcagccgctga

SEQ ID NO: 3766 - DNA, 921 bp, Enterobacter cloacae
agcgtccgctggcccaggcgctggcgtttgcctgcgtgctgtcgattggcgattttggcgttgtggccctcttcggcaacgaggatttccgcacgctgccgttctggctttatcagcaaattggctcctatcgtagccaggacggcgccgtcacggcgctactcctgttgctgctgtgctttgcgttatttaccgttatcgaaaaacttccggggcgtgatgttaaaactgactgatgtaacctggctttatgagcacctgccaatgcgttttaccctctccgttcgtcagggagagcgaatcgcagtgcttggccccagcggggccggaaaaagtaccctgctcaatctgattgccggttttttacagcctgccagcgggtcgatcgtcattgataatggcgagtatacctacgctccgccggctaagcgcccggtgtcgatgctgttccaggaaaacaatctgttcaatcatcttacggtgtggcagaacatcgcgctgggtatggatccggggttgaagctcaatgttgcgcagcgtcagacgctggaggcgatcgccgaacaaatgggcctggctgcgtttatcaacagactaccgggtgagctttccggcggccagcgccagcgcgtggcgctggcgcgctgcctggtgcgcaagcagccgctactgctgctcgatgaacccttttcggcgctcgaccccgctctgcgtcaggaaatgctctcgctggttgaggaggtttgcgagcgcgaacaactgacgatgctgatggtttcgcatagcatcgaagatgccgcacgcatcgcgccgcgatcggtggtgatcgcggagggacgtattttgtgggatggggaaacagaagaacttctgagtggtaaggcgggggcatcttcacttttaggtattcgtgaggtctga

SEQ ID NO: 3767 - DNA, 1770 bp, Enterobacter cloacae
cgatttttgtccctagtctctaatgttcttccatacctgttttttggatggagcaacaccatggcaattgcaattggcctcgattttggcagcgactcagttcgcgcgctggcagtggactgtacgactggccaggagatagcaaccagcgttgagtggtatccgcgctggcaagaggggcgctactgcgatgcgccaaacaaccagttccgtcaccacccgcgggactacatcgagtcgatggaagcggcgatcaaaaccgttctggcggagttgaccgacgcccagcgggccgatgtcgtggggattggcgtcgacagcaccggctcaacgcctgcccctgtcgatgccgaaggccgcgtactggcgctgcgaccggagtttgccgacaacccgaacgccatgtttgtgctgtggaaagaccataccgccgtggaagaggcggaagccatcacccgcttatgccttcagccgggcaaaactgactactcccgctacatcggcgggatttactccagcgagtggttctgggccaagatcctgcacgttacccgcgcggacgcgtcggtcgcacaggcagcggcgtcatggattgagctgtgcgactgggttcccgccctgctctccggcaccacgcgtccgcaggatattcgccgcggccgttgcagcgccgggcataaatcgctgtggcatgaaagctggggtggtctgcctccggcagcgttcttcgatgaactcgacccgatcatcaacaaaaacctgacatacccgctgttcaccgacaccttcaccgccgatatcccggtcggcacgctctgcgaagagtgggcgaaacgcctcggtctgccgcaaaacgtgaccatttccggcggcgcgttcgactgccatatgggggccgtgggcgcgggtgcgcagcccaacacgctggtgaaagttatcggcacctccacctgtgacattctgacggcagataaagccagcgtcggcgaccgcgcggtgaaaggcatctgcggccaggttgacggcagcgtggtgcctgattttatcggccttgaagcgggccagtccgccttcggtgatatctatgcctggtttggccgcgtgctcggctggccgctggatcagctggctgccgcgcatcctgaactgaaaacgcagattacggcgagcaaaaaacagctcctgccgcagctcaccgacgcctgggcaaaaaatccgtctctcgaccacctgccggtggtgctggactggttcaacggccgtcgtacgccgtttgccaaccagcgtctgaaaggagtgattaccgatctcaacctcgcgaccgacgcgcccgcgctgtttggcggcctgatcgccgccaccgcgttcggcgcgcgcgccatcatggagtgcttcatcgaccagggcattgacgtgaacaacgtgatggcgctgggcgggatcgcccgtaaaaatccggtgattatgcaggcctgctgcgacgtgttgaaccggccgctgcaaattgtggcctccgatcagtgctgtgcgctgggtgccgcgattttcgctgccgtggccgcaggcgtccatgcggatatcccgaccgcgcaacagcatatggcgagcgccgtcgaaaatacgctccatccgcagactcagcaggcacaacgctttgaacagctttatcagcgctaccagcaatgggcaaaaagcgccgaacttcactatctccctgtcgccgccccggccaaaagcaccgcggacactacggcaaccctgacacattaa

SEQ ID NO: 3768 - DNA, 828 bp, Enterobacter cloacae
agacgcgctgcgctggaacgaagtctattacggttcaaaacgctaagccctgaatgcccggtggcacttcgtttaccgggcctacggttctgtaggccggataagcgaagcgccatctggcaggagacgacaatgttagaagatctcaaacgtcaggtactcgaagccaacctggcgctgccaaaacataacctggtgaccctgacctggggcaacgtcagcgccgttgaccgggaaaaaggggtgttcgtgatcaagccttccggcgtggattacacggtaatgaccgcagaagacatggtggtggtcagcatcgaaacgggtgaagtggttgaaggcaaaaaaaagccctcctccgatacgccgactcaccgcctgctgtatcaggccttcccgaccatcggtgggattgtgcatacccattcgcgtcacgcgaccatctgggcgcaggcgggccagcctattccggcgaccggcaccacccacgcggactacttttacggcaccattccctgcacgcgtctgatgaccgatgcggagatcaacggtgagtacgaatgggaaaccgggaacgtgatcgtcgaaaccttcgaaaaacagggaatcgacgcggcgcaaatgcccggcgtgctggtgcactcccacggcccgtttgcctggggtaaaaacgcggaggacgcggtgcacaacgcgatcgtgctggaggaagtcgcctatatggggatcttctgccgccagctggcaccgcagctgccggatatgcagcaaaccctgctggataagcattacctgcgtaagcacggtgcgaaagcctactacgggcagtaa

SEQ ID NO: 3769 - DNA, 2514 bp, Enterobacter cloacae
acctttgcccggtgtcgctgcgcttaccgtgactgcggaacctgtaggccggataagcgcagcgccatccgactgaacaggcactgtataaaaccccagcaaacacccctcaaccaggctataatcaggcctggttttgttttatgggataacgccgtgacgcaggcgcaagaaggctttttactgaccagacactggcgggatacccctcagggtactgaggttgaattctggctggcaacggacaacggcccgctaaacgttacgctcccgccgcaggagtccgtggcctttattcctgaagctcacgtcgaaaaagtgaaacagctgctgcgcggagaaaacggctggcgcataaccccgcttgaactgaaagatttccaccgccagccggtttacggcctctattgccgcgcccatcgccagttaatgcgctatgaaaaactgctccgtgaagcgggcgtgacgctatacgaggccgacattcgcccgcctgaacgctttctgatggagcggtttatcaccgcccccgtctgggtagatggcaccgcgcaaaatggcaggatcgttaatgcgcgcctcaagcctagcccgaattatcgccccccgctcaaatgggtctcgctggatatcgaaaccacccgccacggcgaactgtactgcattggtctggaaggctgtgggcagcgagttgtctatatgctcgggccgccaaacggcgatgcgtccgcgctggactttaatctggagtacgtcaacagccgcccgcaactgctggagaagcttaaccagtggtttgccgagcacgatccggatgttctgatcggctggaacgtagtgcagtttgacctgcgcgtgctgcaaaaacatgccgagcgttaccgtatcccgctgatgctggggcgcggaaacagcgagctggagtggcgcgagcatggttttaagaacggtgttttcttcgcgcaggccaatggtcgcctgattatcgacggcatcgaggcgctgaaatccgccttctggaacttctcttccttctcgctggaagcggtcgcccaggaactgctcggcgaaggtaaatccatcgacaatccctgggaccgaatggacgagatcgaccggcgctttaatgaagacaaacccgcgctcgccacctataacctgaaagattgcgagctggtgacgcagatcttccacaaaaccgagatcatgcccttcctgctggagcgggcgacggtgaacggccttgcggtcgacaggcacggcggctcggtagcggccttcagccacctctatttcccgcggatgcaccgggcgggctatgtcgcccctaacctcggcgacgtgccgccgcaggccagccccggcggttacgtgatggattcacggcccgggctgtatgactcggtgctggtgctggattataaaagcctgtatccgtccattatccgcacgtttctgattgatccggtggggctggtggaggggatggcgcagccagacgatgcgcacagcaccgaaggttttcttggagcacgcttctcgcgggaaaaacactgcctgcccgaaattgtgggaaacatctggcacggccgcgatgaggccaagcgccacggcaacaagccgctctcacaggcgctgaaaatcattatgaacgccttttacggcgtgctgggtaccagtgcctgccgcttctttgatccccgtctggcgtcgtccatcaccatgcgcgggcacgagattatgcgccagaccaaagcgctgattgaatcccggggctatgatgtgatttatggcgatacagactccacctttgtctggctgaaagccgcccattcggaagacgacgccgcacaaatcggcaaagatctggtcgcctttgtgaacgactggtggcgcgaaagtttgcaaaaagagcggttaaccagcgcgttagagctggagtttgaaacccattttgcccgctttttaatgccgaccattcgcggaaccgaccagggcagcaagaagcgctacgccgggctgattcaggaaggtgacacgcagcggatggtgtttaaagggctggagacagtgcgcaccgactggacgccgctggcacagcagttccagcagacgctctacctgcgggtgttccgcaatgagccttatcaggattatgtgcgcgacaccatcgccagcctgatggcgggtgaactggatgaccagctggtgtatcgcaagcgcctgcgccgcccgctggccgaatatcaacgtaacgttcctccccacgtacgcgccgcgcggctggcggatgaagagaacgttcgccggggccgtgcgccgcagtatcagaaccggggaacgatcaaatacgtctggaccactaacggcccggaacccgttgattaccagcagtctccgcttgattacgatcattacctgacccgccagcttcagccggttgcggagggaattttaccgttcatcaatgacgactttgctacactagtgacaggacaacttgggctattttga

SEQ ID NO: 3770 - DNA, 804 bp, Enterobacter cloacae
gcagaatcgctgattcgttttctgaccggaatagttatgcaggcattgctggaacattttattacccagtccgttatgtattcgctcatcgccgtggcgctggtggcgtttctggagtcgctggcgctggtcgggctgatcctgcccggcaccgtgatgatggcggggcttggggcgcttatcggcagcggcgaggtcaatttctggcaggcgtggatggccggtattatcggctgtttgctgggggactggatctccttctggctgggctggcgctttaagaagccgctgcaccgctggtcgttcatgaaaaaaaacaaagcgctgctggataaaaccgagcatgcgctgcaccagcacagcatgttcaccatcctcgtggggcgcttcgttggcccaacgcgtccgctggtgccgatggtggccgggatgctggatctgcccgtcgcgaagtttgtggtgccgaatatcatcggctgcgtcttctggccgccgttctacttcctgccgggtatcctggcgggcgcggcgattgatattcctgacggtatgcaaagcggtgagtttaaatggctgctgctgggcacggcggtgctgctgtggctggcggtctggctctgctggcgcctgtggcgcagcgcgaaagccagtgttgatcgtctgacgcgctatcttccgcgcactcgcctgctctggctggccccgctgacgttgggggtggccgtggtggcgctgatcgcgctgatccgccacccgctgatgccggtgtacggcgagatcctgttgaaggtggtgagccgttaa

SEQ ID NO: 3771 - DNA, 1263 bp, Enterobacter cloacae
tcacccgccagcaaaatgttttttgctggcttttttcgtttactatttcacccaatttcgattcgctttcataaggacttgcgcatgctctggttgatgacgatggggcgacgcctgaatggcgtgtacgccgcttttatgctggtggccttcatgatgggcgtagccggcgcgctacaggcgccgacgctgagcctgtttctcagccgcgaggtgggggcgcagccgttttgggtgggcctgttctacaccgtcaacgccattgccgggatcctcgtcagcctgtggctggcgaaacgatccgacagccagggcgatcgccgcaagctgatcctcttttgttgcgcaatggccgtgggcaacgcgctgctgtttgccttcaaccgccattacctgacgctcattacctgcggcgtgctgctggcctctctggcgaacaccgccatgccgcagctcttcgccctggcacgggagtacgccgacaactcggcgagggaagtggtgatgttcagctcggtgatgcgtgcgcagctctcgctggcgtgggtcattggtcccccgctggcgttcatgctggcgctgaactacggcttcaccaccatgttttccatcgcggcggggatttttgtcatcagcctggcgctgatagcctttgcgctgccatcggtggcgcgcgtagagcaggtgacggacaagcccatcacgcaggtgagcggctggcaggataaaaacgtccgcatgttgtttatcgcctccacgctgacgtggacctgcaacaccatgtacattatcgatatgccgctgtggatcagcagcgatctgggactgcccgacaagctcgcggggatcctgatgggcaccgctgccgggctggagatcccggcgatgattctggcgggttactacgtaaaacgtttcggtaaacggaaaatgatggtggttgcggttgcagccggggtgttgttttatcttgggctgatcttatttcattcgcgcgaagcgctgctggcgcttcagctgtttaatgctgtgtttattggcatcgttgccgggatcggcatgctctggttccaggatttaatgccgggccgcgccgggtcggcgaccacgctgtttaccaacagtatttcgaccggagtgatcctggcgggggtgattcagggggcgctggcgcaaagttacgggcatggctcagtttactggatgattgccgcgatttcggtggttacgcttgggctgacttgccgggttaaggatgtctga

SEQ ID NO: 3772 - DNA, 513 bp, Enterobacter cloacae
gcaaaacggagagaacctgatatgcgccggatattatctgtattactggaaaatgagtcgggcgcactgtcacgcgtcattgggctttttgcgcagcgcggctataacattgaaagcctgaccgttgcgccgaccgatgatccaacgctctcccgcatgacgatccagactgtcggcgatgcgaaagtgcttgagcagatcgaaaaacagttgcacaaactggtggacgtgttgcgcgtcagcgagctggggcagggggcttacgtcgaacgtgaagtgatgctggtgaaaattcaggccagcggttacggtcgtgaagaggtcaagcgcaacacggatatcttccgtgggcagatcatcgacgtcacgccttctatatatactgtgcagcttgccggaacgagcgataagctggatgcgttcctggcctccgtcagggatgtagcaaaaattgttgaagttgcgcgctctggcgttgttggcctctcgcgcggcgataaaatcatgcgttag

SEQ ID NO: 3773 - DNA, 399 bp, Enterobacter cloacae
ttcagtgctgcgtattgcagagaggacgaacgcatgatcagcagagtgacagagaccctaagcaaagttaagggatcgttaggaagcaacgagcgccatgccttgcctggcgtgatcggcgacgatcttttgcggtttgggaagctgccactctgcttgttcatttgcatcattgtgacggcagtcatggtggtcaccaccgctcaccatacccgtttattaactgcgcagcgcgaacagatggtactggaacgcgatgcgctggatattgaatggcgaaatctgatccttgaagaaaacgcgctcggcgatcacagccgggttgaacggatcgcaacggaaaaactgcaattacagcatgttgatccttcgcaggaaaatatcgtagtacaaaaataa

SEQ ID NO: 3774 - DNA, 1782 bp, Enterobacter cloacae
gggaaaacgcgacgcatgaaagcagcggcaaaaacgctaaaaccaaaacgccaggaagaacaggccaactttgtcagttggcgttttgcgttgctttgcggctgcattttactggcgctgggtttcctgctgggacgcgtggcgtggctacaaatcatcgcgcctgacatgctggtgcgtcagggggatatgcgttctctgcgcgtgcaggaagtttctacctctcgtgggatgatcaccgaccgctccggccgcccgctggcggtgagcgtgccggtgaaggcgatctgggccgatccgaaagagctgcacgacgcaggcgggatcacccttgataaccgctggaaggcgctctcagacgcgttgaaaatgccgctggatcagctggcgtcacgcgttaacgccaacccgaaagggcgcttcatctatcttgctcgtcaggtgaaccctgacatggctgactacattaagaaactgaagctgccgggcattcatctgcgggaagaatcccgccgttactatccttccggcgaagtcaccgcgcacctgattggctttaccaacgtggatagccaggggattgagggcgttgaaaaaagcttcgacaagtggcttaccggccagcctggcgagcgaatcgtgcgtaaagaccgctatggtcgcgtcattgaagacatttcctcgacagacagccaggccgcgcacaacctggccctgagtattgatgaacgcttgcaggcgctggtctatcgtgaactgaacaacgccgtcgcgtttaacaaggcggaatcgggcagcgccgtgctggtggatgtggcgacaggtgaagtgctggcgatggccagtagcccctcatacaacccgaataattttgccggtacagcaaaagatgcaatgcgtaaccgctccatcaccgatgtgtttgaacccggttcgaccgtaaaacccatggtggtgatgacggctctacagcgaggcatcgtcaacgaaaataccgttctgaatacgatcccttatcgaattaacggtcacgaaatcaaagacgtggcacgttatagcgaactgaccctgaccggggtcttgcagaagtcgagtaacgtcggtgtgtcaaaactggcgttagcgatgccgtcctcagcgttagtagatacttactcacgttttgggctgggaaaggcgaccaatttggggttggtcggagaacgcagtggcttatatcctcaaaaacaacggtggtctgacatagagagggccaccttctctttcggctacgggctaatggtaactcccttacagttagcgcgagtctacgcaacgattggcagctatggcatttatcgtccgctgtcgatcaccaaagttgatccaccggttccgggggaacgtgttttcccggaatctatcgttcgtaccgtcgtgcatatgatggaaagcgtcgcgttacctggcggtggcggcgtgaaggccgcaattaagggctatcgtatcgccattaaaactggtacagcgaaaaaagtggggccggacggccgctatatcaacaaatacattgcctataccgcaggcgtagcgcctgcaagcaatccgcgttttgcactggtggtcgtcatcaacgatccgcaggcgggtaaatactacggcggcgccgtctccgcgcctgtgttcggggctattatgggcggcgtgttgcgcaccatgaacattgaaccggatgcgctggcgacgggcgaaaaaagtgaatttgtaattaatcaaggcgagggaacaggtggcagatcgtaa

SEQ ID NO: 3775 - DNA, 1437 bp, Enterobacter cloacae
agattatcagattgtcggcaatcgtcgtctggattactccgaccgcgtgacggcagcgcgtctgctgggagtggtggcatgattagcattacgttaagccaggccgctgcggtattgcaggggatgctgcatggtcaggatctgaccatcgaggctgtaaccaccgacacccgtaaggtgacggcgggctgcctgtttgtggcgctgaagggtgaacgttttgacgcccacgattttgcgcaacaggctaaagataacggcgcgggcgcgctgctggtcagtcgtaagctcgatatcgatttgccgcagattgtggtgaaagatacgcgcctggcgtttggcgagctggcggcatgggttcgccagcaggtgccaacacgcgtcgtggcactgacgggctcgtcgggcaaaacctccgttaaagagatgacggcggcgatccttagccagtgcggtaacacgctttatacggcgggcaaccttaataatgacatcggtgtgccgatgacgctgctgcgcctgacccacgagcatgaatatgcggtgattgagttaggggctaaccatcagggcgaaatcgcctggaccgtgagcctgacccgtccggaagcggcgctggtgaataacctggcggcggcacatcttgaaggttttggttctctggccggtgtggcgaaagcgaaaggtgaaatttataccggcctgccggatgacggcatcgccattatgaacgccgataacaacgactggctgaactggcagagcatcattggttcacgtaaaacctggcgcttctcaccgaatgcggcaaacagtgatttttcggcgaccaacattcatgtgacgtcacacggtaccgagttcaccctcacaaccccaacgggcgacatcgacgtgctgctgcccctgccgggtcgtcataacatcgccaatgcgcttgctgcggcagcgctctcaatggcggtaggtgcctcacacgcggcgattaaagcaggtctggcaaatttaaaagccgtgccggggcgtctgttcccgatccagctggctgaaaacaaactcctgttggatgactcctacaacgctaacgttggctcaatgacggcggccgtgcaggtcttgtctgaaatgccgggctatcgcgtgatggttgtgggcgatatggccgagctgggtgatgaaagcgaagcctgccatgttcaggtgggtgaagcggcgaaagccgccgggcttgaccgcgtattgagcgcaggcccgctgagcaaggccatttccgatgccagtgaagttggcgaacattttgccgataaatctgcactgatcgaacgcctgaaggcattgattacagaaaaacagattgtgactgttttagttaaaggttcacgtagtgccgccatggaagaggttgtgcacgcattacaggagaacgggacatgttag

SEQ ID NO: 3776 - DNA, 1278 bp, Enterobacter cloacae
tgtctttacccgcctggcgaaggagttaggctgatgcgtttatctctccctcgcctgaaaatgccgcgcctgccaggatttggtatcctggtatggctgtttacggcgctgaaaggctgggtgatggcttcacgggataaagattccgacagcctgatcatgtacgaccgcacgctgttctggctcacgctggggctggcagcgatcggctttattatggtcacctcggcgtcaatgcctgtcggacagcgtctggcaaacgacccgttcctgtttgccaagcgtgacgggctttacatcattctcgcgttctgcctggcgctgatcaccttacgcctgccaatgtcgttctggcagcggcacagtacggccatgctcatcgcctcaatcatcatgctgttgatcgtgctggttgtcgggagctccgttaacggggcatcacgctggattgcctttggcccactgcgtattcagccggcggagttcaccaaactgtcgttgttctgctacctggctaactacctggtgcgtaaagttgacgaagtccgtaacaaccttcgcggcttcttaaaaccgatgggcgtgattctggtcctcgcgatcctgctgctggcgcagcccgacctcggtacggtagtcgtactgtttgtcactacgctggcgatgctgttcctggcgggcgcaaaactgtggcagttcattgccatcatcgggatggggatttcggcggtggtgctgctgatcctcgccgaaccctaccgtatccgccgtgtgacctcgttctggaacccatgggaagatccgttcggcagcggttaccagctgacgcagtcgctgatggcgtttggccgcggcgaagtctggggccaaggcctgggcaactcggtgcaaaaactggagtatttaccggaggcgcacaccgacttcatcttctccattattggggaagaactgggttatatcggtgtggtattggcgctattaatggtattcttcgtcgctttccgcgccatgtcgattggccggaaagcgctggagatcgatcaccgcttctccggtttcctggcctgctctattggtatctggtttagcttccaggcactggtaaacgttggggcggcagcgggtatgttgccgactaaaggtctgacgttaccgttgatcagttatggtggttcgagtctgttgatcatgtcgacggccatcatgtttttgttacgcatagattatgaaacgcgtctggagaaagctcaggcgtttacacgaggttcacgatga

SEQ ID NO: 3777 - DNA, 564 bp, Enterobacter cloacae
ttgtacgtattttggaccaggcgggctgatatgtctcaggctgcattgaacacgcgcaaccgcgatgacgaagaagaatattcctcttcgcgccggagtaatggaacgcgtcttgcagggatcatcttcctgctcggggtgctgtgcaccgtgtttatcagcggctggatggtgctgggctggatggaagatgcgcagcggttgccgctttcaaagctggtggtgaccggggagcgacactacacgcgtaacgatgatattcgccagtcgattctggcgcttgggtcgcctggcacctttatgacgcaggacgtcaacattattcagagtcagattgaacgtctgccgtggataaaacaggcaagtgtcagaaagcaatggcctgatgaattgaagattcatctggttgaatatgtgccgattgcgcgttggaatgatcagcatatggttgatgtagacggaaattcgttcagcgtcccgagcgatcgtgtcaacaagcagaatttaccgatgttgtatggcccggcagtcatcgaaaatcgaagaataccagggttttcgtga

SEQ ID NO: 3778 - DNA, 1011 bp, Enterobacter cloacae
atcatatttttcgaagttattactgtaccttggcaaagggaatttagcgtgacggtggagtcagaaatgccagaaaataatattaaccaaccacagacttatgatggggttaagcctcagttgcgcacagtggatctcaatctgttaactgtatttgatgcagttatgcaggagcagaatattacgcgagcagcgcaatctctgggaatgtctcaacctgccgtgagtaatgccgtagccagacttaaggtgatgtttaacgacgagttattcgtccgctatggaagaggtatccagcccacggcgcgtgcattccagctattcggttcgattcgtcaggcgctacagctggtacaaaatgagcttcccggctcgggttttgaacccttaagcagtgaacgggttttccatctctgtgtttgcagtccgttagacaattatttgacgtctgttatatataataaagttgaacagattgctcctaatattcatctcgtttttaaatcatcattaaatcaaaatactgagcaccagcttcgttatcaggaaacggagttcgttctgggctatgaagagtttcgccgtccagagtttgcctgtgttccattgtttaaagatgaaatggtgttagtcgccagcaaaaaacatccccgtatgaattctccactgcgtgaaagcgatgtttacagcgagcagcatgccgtggttgctctggacagatatgcctcatttagtctgccgtggtatgacactgccgataaacaagccagcgtggcctatcagggaatggcgatggtcagcgtattgaatgtcgtttctcagacgcagctagtcgctattgcaccgcgctggcttgctgaagagttctccgattcgctgagcctgcaaattttacctctgccgctcaagctgaatagccgtacctgttatctttcctggcatgaagcggcggggcgggataaagggcatcaatggatggaagagctgctggtcaatatttgtcgtcgataa

SEQ ID NO: 3779 - DNA, 987 bp, Enterobacter cloacae
ttccgaaacattatcggaacggctgcgggacttgtctctataaatatgatggaaaattataaacatacaacggtgctgctggatgaggccgttaacggcctgaatattcgtccagacggcatctatattgatggcacttttggtcgcggtggtcactcgcgtttgatcctctctcagcttggagcggaaggacgcctgctggcaattgaccgcgatccgcaggcgattgccgttgcgcaaaccatcgatgatcctcgcttttccatcgtgcatggacctttctctgcgcttgcggattatgtcgctgagcgcggcctgaccggcaagatcgacgggattctcctcgatcttggcgtctcttcaccacagcttgatgatgcagaacgcggtttttcctttatgcgtgatggaccgctggatatgcgtatggaccccactcgcggccagtctgccgctgaatggttacaaactgctgacgaagcggatattgcctgggtaatcaaaactttcggcgaagaacgctttggcaaacgtattgcccgcgccatcgtggagcgcaaccgcgttgagccaatgacccgtaccaaagagctggcagaagtcatcgcggcggcaacgccggtgaaggacaagcacaaacatcctgcgacccgtaccttccaggcggttcgtatctgggtaaacagtgaactggaggaaatagagctggcgctaaaaagctcgctcgacgtgctggccccgggtgggcggttatccatcatcagtttccattcgctggaagatcgcatcgtaaaacgctttatgcgtgaacagagccgcggtccgcaggttccagctgggctgccgatgacggaagaacaactcagaaagctgggcggccgtcagttgcgagcattaggcaagttgatgccgggcgaagaagaggtggcagagaatccacgtgcccgtagttcagtgctgcgtattgcagagaggacgaacgcatga

SEQ ID NO: 3780 - DNA, 1509 bp, Enterobacter cloacae
ttaatcaaggcgagggaacaggtggcagatcgtaatttgcgcgaccttcttgctccgtgggtgcctatgctacctgcgcgagcactgcgagagatggtactggacagccgcgtagcggcttctggcgatctttttgtggcagtggtgggtcatcaggcggacgggcgtcgttatatcccgcaggcgattgcgcaaggtgttgctgccattattgctgaggccaaagatgaggcaacagacggtgagatccgtgaaatgcacggcgtgccggtcatctatctcagccagctgaatgagcgtctctccgcgctggcaggacgtttttacaacgaaccttccgaccagttacagctggttggcgtgacaggaaccaacggaaaaaccaccaccactcagctgatggcgcagtgggcgcagctgctgggcgaaaccggtgccgtcatgggcacggtggggaacggtcttctgggcaaagtaagcccgacggaaaacactacaggctcggcggttgacgtgcagcgtgtgctggcgggcctcgctgagcagggggcgaccttcgctgcgatggaagtctcttcccatggtctggtacaacatcgcgtggcggccctgaaatttgctgcctctgtctttactaacctgagccgcgatcaccttgattatcatggtgatatggagcactacgaagcggcgaaatggctgctttattccactcaccaccacgggcaggcgatcattaacgccgacgacgaagtcggtcgccgctggctggaaaaactgccagatgcggtggcggtgtcgatggaagatcgcattaatccgaactgccgcggccgctggctgaaggcggtcgaggtgaactaccacgatagtggggcgacgatccgcttcgcttccatctggggcgaaggtgaaattgaaagccgcctgatgggggcctttaacgtcagtaacctgctgctggcgctggcgacgctgctggcgctgggttacccgatggcggatctgctgaaaacggctgagcgtttgcaaccggtctgtggccgcatggaagtgtttagcgcgccgggcaagccgacggtggttgtggattacgcccacacgccggatgcgctggaaaaagcgctggaagcggcgcgtctgcactgcgctggcaagctctggtgcgtgtttggctgcggtggcgatcgcgacaagggcaaacgtccgctgatgggcgccatcgctgagcagttcgcggatattcccgtggtaaccgatgacaacccgcgtaccgaagagccgcgggccattatcaacgacattctggcgggcatgctggatgcgggacgtgcgcgcgtggtcgaaggccgtgcggaggccgtgactaacgccattatgcaggcgcaggagaacgatgtggttctgctggccggtaaaggtcatgaagattatcagattgtcggcaatcgtcgtctggattactccgaccgcgtgacggcagcgcgtctgctgggagtggtggcatga

SEQ ID NO: 3781 - DNA, 1416 bp, Enterobacter cloacae
actgaaaggctggccggagccgcgcgtcattgtgcgcttctggattatttcgctgatgctggtgctgattggcctggcaacgctgaaggtacgttaatcatggcagattaccagggcaaaaaagtcgttatcatcgggttgggcctcaccggcctctcctgcgtggactttttccttgcgcgtggcgtgacgccgcgcgtgatggatacgcgcgtctctccgccgggtctggacaagctgccggagcaggttgaacgccacctgggtggtctgaatgatgagtggctgctgaccgccgatctgattgttgccagccccggtatggcgctggcgcatccttccctgagcgccgccgcggatgcaggcgttgagattgtcggcgatatcgaactgttctgccgggaggcgcaggcgccgatcgtcgccattaccggttcgaacggtaaaagcaccgtcaccacgctggtgggggaaatggcgaaggcggcgggcaaaaatgtcggcgtgggcggtaacattggtctgcccgctctgatgctgcttgataaagggtgcgagctgttcgtccttgagctttccagcttccagctggaaaccacttcaagcctgcatgcggcggcggcgacgatcttaaacgtcaccgaagatcatatggacagatacccgttcggcttgcagcaataccgtgcggccaaactgcgcgtttatgaaaatgccaaagtttgcgtggtgaatgccgatgatgcactcaccatgccggtgcgcggcgcagacgatcgctgcattagctttggtattaatatgggtgactatcaccttaaccgtcagcagggcgaaacctggctgcgggtgaaaggtgagaaagtgctgaacgtgaaagagatgatgctctccggccagcataactacaccaatgccctggcggcgctggcgctggcggatgccgttggcctgccgcgatcttcaagcctgaaggcgctgaccacctttaccggcctggcgcaccggttccagcttgcgctggagcacaacggcgtacgctggattaacgattccaaagcgaccaacgtgggtagcaccgaggcggcactgaacggtctgcacgttgatggcacgctgcacctgctgctgggcggcgacggtaaatcggctgacttctcctcgctgaagcagtacctcaacggtgataacgtgcgcctgtattgctttggccgcgatggtagcgagctggcggcgttgcgtcctgaggtcgccgagcaaaccgagaccatggagcaggcgatgcgtcttattgccccacgcgtgaagcccggcgatatggtgctgctctcaccagcctgtgccagcctcgatcaattcaagaatttcgaacagcggggtgatgtctttacccgcctggcgaaggagttaggctga

SEQ ID NO: 3782 - DNA, 1479 bp, Enterobacter cloacae
agaatgaatacacaacaactggcaaaactgcgttctatcgtgcccgagatgcgtcgcgtccggcacattcactttgtcggcatcggtggtgctggcatgggcggtattgccgaagtgttagctaacgaaggctatcagatcagcgggtctgacctggcgccaaaccctgttacgcagcagctggcgtcgctgggggcgactatctatttcaatcatcgcccggaaaacgtgagcgatgcgagcgtggttgtggtgtccagcgctatctccgcggataacccggaaatcgttgcggcgcatgaggcgcgcattccggtgatccgtcgcgcggaaatgctggcggaactgatgcgtttccgtcacggcattgcggtggccggcacgcacggtaaaaccaccacaacagcgatggtctccagcatttatgcggaagcgggtctcgacccgacgttcgttaacggtggtctggtgaaagccgctggcgtgcatgcgcgtctgggccatagccgttatctgattgcggaagcggatgagagcgacgcgtcgttcctgcatctacagccgatggtggcgatcgtcaccaacatcgaagctgaccatatggacacttaccagggtgacttcgagaacttaaagcagacctttattaacttcctgcacaacctgccgttctatggccgtgcggtgatgtgcgtggacgatccggttattcgcgaactgctgccgcgcgtcgggcgtcaaattacgacctacggcttcagcgaagacgcggatgtacgcgtagaagattacaagcagatcggtgcgcaggggcatttcaccctcgcgcgtcaggataaagacctgctgcatgtcaccctgaacgcgccgggacgtcacaacgccctgaatgcggcggcggcggtggctgttgcgacagaagaaggcattgacgatgaggcgatcctgcgtgcactggagagcttccaggggacgggccgtcgtttcgacttcctcggtgaattcccactggagccggtaaacggtaagccagggtctgcgatgctggtggatgattacggtcaccatccgacggaagtggacgcaaccatcaaagcggcacgtgcgggttggccggaaaagaatctggtcatgatcttccagccgcaccgttacacgcgtacccgcgatctgtatgacgattttgccaacgtcctttctcaggttgataccctgctgatgctggatgtttatgctgcgggtgaaacgccgattccgggtgcggacagtcgttctttatgtcgtaccatccgtggacgcggtaaagtggatcctattctggttcccgacccggcgcaggtggctgaaatgcttgccccggtcctgacgggtaacgatctgatcctgattcagggcgcgggaaatatcggcaaaatcgcccgtaccttagctgaaatcaaactgaagccgcaaactcaggaggacgagcgtcatggctga

SEQ ID NO: 3783 - DNA, 1023 bp, Enterobacter cloacae
acacttttgttactgcttatccgcccgtgctggcggagaaatcagggggaaaggctgaaacatggcggacgtaaaagaggcgtgatgctttttggatcttttcgcgggccatttttatactgcttttatcgatatggacaattggtttccttcaggacccttgggagaactgaatctatggccgaaccgcaaaacgatcccttactgccgggctactcatttaacgcccatctggtggcgggactgacgccaattgaggccgagggatatctcgatttttacgtcgatcgccctcttggcatgaagggatatatcctgaacctgaccgtacgcggagaaggggtcgtcaaaaatggggatcaacagtttatctgccgccccggtgatatgctgctgttcccgccgggggagatccatcactacgggcgccacccggatgccaaagagtggtatcaccagtgggtctatttccgtccgcgcgcctactggcaggagtggctctcgtggccggccattttcgcccataccggtttatatcgcccggatgaggcgcatctggcgcagttccgtgagctgttcgcacagattattgaggcagggcaggcgggcgggcgctacgccgaactgctggccatcaacctgcttgaacaggtgctgctgcgccgcatggaggccatcaacgagtcgcttaatccgccgctggacaaccgcgtccgcgacgcctgccagtacatcagcgaccaccttgccgacagccagtttgatattgccagcgtcgcccagcatgtgtgcctgtcgccgtcacggctgtcgcatctgttccgccagcagcttggcgtgagcgtactcagctggcgcgaggatcagcgcatcagccaggcgaaactgctgctcagcaccacccgaatgcctatcgccaccgtcgggcgtaacgtcggctttgaagatcagctctatttctctcgcgtgtttaagaagtgcaccggtgccagcccgagcgaattccgtgcgggatgtgaataa

SEQ ID NO: 3784 - DNA, 1755 bp, Enterobacter cloacae
ccgtctataacaaaagcctggaggcaaagcatggagatgttgtctggcgcggaaatggtcgtccgatcgcttatcgatcagggcgtgaagcaagtgttcggctatcctggaggtgcggttcttgatatttatgacgcgctgcacacggtaggcggtattgatcatgttctggttcgtcatgaacaggctgctgtgcatatggcagacggcctggcccgcgccacgggcgaggtgggtgttgtgctcgtcacttccggaccgggggcgaccaatgccattaccggcattgcgactgcgtatatggactccattcccctggtcattctctccggacaggtggcgacgtcactgattggctatgatgcgtttcaggaatgcgacatggtggggatctcacgccccgtggtgaagcacagctttctggttaagcaaacagaagacatcccgggcgtactgaaaaaagccttctggctggccgccagcggtcgtcctgggccagtggttgtcgatctgccaaaagatattctcaatcccgcgaataaactgccttacctgtggcctgagtcggtgagcatgcgttcatataatccgacgacgcaggggcacaaaggccagattaagcgtgcgctgcaaacgctgctggctgcgaaaaagcccgtagtctatgtggggggcggcgccgtcaatgcagcctgtgaaacgcaactacgcgaactgattgagaagctgaatcttcctgtcgcgtcatcgctgatggggctgggggcattcccggctacccaccgtcaggcgctgggcatgctgggtatgcacggcacctatgaagccaatatgacgatgcaccattctgatgtgatttttgccgtcggcgtgcgttttgacgatcgcaccaccaataatctggcgaaatactgtccgcatgcgacggtgctgcacattgatatcgatccgacttcaatctctaaaacggtgccggcggatgtgccgatcgtgggggacgcacgacaggtgctggatcaaatgttggatctgctggcgcaggagaccgcgtctcaaccgctggacgagatccgcgactggtggcagcaaatcgaacagtggcgtggccgtcagtgccttaagtacgacacacagagtgagaacatcaagccgcaggcggtgatcgagacgatctggcgtctgaccaatggcgatgcgtatgtcacttctgacgtgggccaacatcagatgttcgctgcgctgtattacccgtttgataaaccgcgtcgctggatcaactctggcgggctcggcacgatgggctttggtctgcccgccgcgctgggggtgaagctggcgttgccaaacgaaacggtgatctgcgtgacgggtgatggcagcatacagatgaatattcaggagctttctactgcgctgcaatatgagttgccagtgctggtgctgaacctgaataacggttacctcggtatggtaaagcagtggcaggatatgatttattctggccgtcactctcagtcttatatgaagtcacttccggactttgtccgcctggctgaagcctatggtcatattggcatgcgggtaaccgatccgtcagagctggaagcgaagctcggcgaagcgcttgagcacgttaaaaacaatcgcctcgtcttcatggacgtcatcgtcgacggcacagagcacgtttatccgatgcatatccgtggcggcggtatggatgaaatgtggttaagcaaaacggagagaacctga

SEQ ID NO: 3785 - DNA, 1014 bp, Enterobacter cloacae
ggggcaattgtgaaactggatgaaatcgcccggctcgccggcgtgtcgagaaccacggccagctatgtgattaacggtaaagcaaagcagtatcgtgtcagcgataagaccgttgagaaagtgatggcagtcgttcgtgagcataattaccatccgaatgctgtcgccgcaggtttacgtgccgggcgcacccgctcgattggcctggttatcccggacctggaaaataccagctatacccgcatcgccaactatctggaacgtcaggctcgtcagcggggctatcagctgttgattgcctgctccgaggatcagcctgacaacgagatgcgctgcattgagcatctgctgcaacgtcaggttgacgccatcatcgtgtcgacctctttaccaccagagcatcctttctatcagcgctgggcaaacgatccgttcccgattgtggcgctggatcgtgcgctggatcgtgaacatttcaccagtgtcgtaggtgccgatcaggacgatgcagaaatgctggctgccgagctgcgtaccttcccggctgaaacggtgctgtatcttggcgctttgcctgaactttccgtaagcttcctgcgtgaacaagggttccgtacggcatggaaagacgatccgcgtgacgttcattatctgtatgccaacagctatgagcgtgaagcggctgcccagctgttcgagaaatggctggaaacgcacccgatgccgcaggcgttgtttaccacctcgtttgccctgttgcagggggtgatggatgtgacgttacgtcgcgatggcaaactgccatccgatctggcgattgcgaccttcggcgataacgaactgctcgacttcctgcaatgtccggtgctggccgtggcccagcgtcaccgcgacgtcgccgagcgcgtgcttgagattgttctggcaagcctggatgaaccccgcaaaccgaaacccgggcttacgcgtatcaaacgtaatctctatcggcgcggaattttgagccgccattaa

SEQ ID NO: 3786 - DNA, 513 bp, Enterobacter cloacae
actccttcaggtgggaatttgtgggttaaagtggtgaggaggggtgagactggcatgttccgtggagcaacgttagtcaatctcgacagcaaagggcgtttatcggtaccaacccgataccgcgaccagctgattgagaacgcttcgggtcaactggtttgcaccattgacatcaactccccatgcctgctgctttaccctttgcctgaatgggaaatcattgagcaaaagctgtcgcgactgtcgagcatgaacccgcaggaacgccgcgtacagcggctgttattgggacatgccagtgaatgtcagatggatagcgccgggcgattattgattgcgcctgtgttgcggcaacatgccggtctgactaaagaagtgatgctggtcggacagttcaacaagtttgaactgtgggacgaaacgacctggtatcaacaggtcaaggaagatatcgacgctgagcagtctgattccgaaacattatcggaacggctgcgggacttgtctctataa

SEQ ID NO: 3787 - DNA, 1128 bp, Enterobacter cloacae
tgccgccatggaagaggttgtgcacgcattacaggagaacgggacatgttagtttggctggccgaacatttggtcaaatattactcaggctttaacgtcttttcctatctgacgtttcgtgccatcgtcagcctgctgactgcgctgttcatctcgctgtggatgggcccgcgcatgattgcccgtctgcaaaaactctctttcggccaggttgtgcgcaacgacggtccggaatcgcacttcagcaagcggggtacgccgaccatgggcgggatcatgatcctgaccgcgattgtggtgtccgtgctgctgtgggcgtatccgtctaacccctacgtctggtgcgtgctgaccgttctggttggctacgggatcatcggttttgttgatgactaccgcaaagtcgtacgcaaagacaccaaaggtttgatcgcccgctggaagtatttctggatgtcggtgattgcgctgggcgtggcctttgccctttacctggcaggaaaagacaccccggctaccgagctggtggtgccgttcttcaaagacgtgatgccgcagctggggctgttctacattttgctggcttactttgtgatcgtcggtaccggcaacgccgtcaacctgaccgatggtctggatggcctggccatcatgccaaccgtgtttgtcgcgggcggttttgcgctggtagcctgggcgaccggtaacatgaactttgcaaattacctgcacattccgtacctgcgacacgcgggggaactggtgatcgtctgtacggcgattgtcggggcggggctgggcttcctgtggttcaacacctatccggcgcaggtctttatgggcgacgtcggttcactggcgctgggcggcgcactggggattatcgccgtgctgctgcgtcaggagttcctgctggtaatcatgggcggtgtgtttgtggttgagacgctgtcggtgattttgcaggtcggttccttcaagctgcgcggtcagcgcatcttccgtatggcaccgattcaccaccactatgaactgaaaggctggccggagccgcgcgtcattgtgcgcttctggattatttcgctgatgctggtgctgattggcctggcaacgctgaaggtacgttaa

SEQ ID NO: 3788 - DNA, 1107 bp, Enterobacter cloacae
aacgcgtctggagaaagctcaggcgtttacacgaggttcacgatgaatcaaccgaagcggttaatggtgatggcaggcggtaccggtggacacgtgttcccggggctggcggttgcgcaccatttaatggaacagggctggcaggtacgctggctgggaaccgcagaccgcatggaagccgacctggtacctaagcacggtatcgagatcgactttattcgtatttctggccttcgtggcaaagggatcaaggcgctgctgctggcgccggtgcgcattttcaatgcctggcgtcaggcgcgcgccattatgaagcgttttaagcctgacgtcgttctgggcatgggggggtacgtttccggccctggcggactggcggcgtggtcattagggattcccgttgttctgcatgagcagaacggtattgccggtttgaccaacaaatggctggcaaaaatcgccaccaaagttatgcaggccttccccggggcattcccgaaagcggatgtcgtagggaatccggtacgtgtggacgtgctggcgctggcgctgccagatacgcgtctggcgggtcgtgaagggccggtgcgggtgctggtcgtcggcggttcccagggcgcgcgtattttaaaccagacgatgccgcaggttgcggcaaaactgggtgatgcagtgaccatctggcaccagagcgggaagggcgctcagcagaccgttgagcaggcctacgcgcaggaaggtcagccgcagcataaagtaactgaatttattgatgatatggccgcagcctatgcatgggccgatgtcgtggtctgtcgctcgggcgcgctgacggtgagcgaaatcgccgccgccggtttaccggcgctgtttgtgccgttccagcacaaagaccgacagcagtactggaatgcactgccgcttgaaaaagcgggtgccgcgaagatttttgagcagccacaatttaccgctgatgcggtcgccactaccctggcgggctggaaccgggatgtattactggagatggcgcaacgcgcacgcgcgaccgctatcccggatgcaacggaacgggtggcaaaagaagtgagcctggcagcccaggcataa

SEQ ID NO: 3789 - DNA, 948 bp, Enterobacter cloacae
agccgcaaactcaggaggacgagcgtcatggctgataagattgctgtcctgtttggcggcacttccgccgaacgcgaggtttctctgaattcgggcgctgccgtgctggcgggcctgcgtgaaggtggcgtggacgcgcatccggttgatccgaaagaggtggacgtcacgcagctgaaagcgatgggcttcgataaagccttcatcgcgttgcacggccgcggtggtgaagacggcacgttgcaggggctgctggagctgatcggtataccgtacaccggcagcggcgtgatggcatccgccatctccatggataaactgcgcagcaaactgctgtggcagggcgcgggcctgcccgttgcgccatgggttgcactgacgcgtcgtgaatatgaattgggtctgtcggacagcgttaatacacgcattgcggcactgggcttaccggttattgttaagccgagccgtgaagggtcgagcgtgggaatgtccaaagttgataaagctgtagatttggctgacgctttagcactggcatttcaacatgatgaagaagttctgattgaaaaatggcttagcgggccggaatttaccgtcgcgatgcttggcgaagaaattttaccgtcaattcgcatccaacccgccggagtcttctatgattatgaggcgaagtatctctctgatgagacgcaatatttctgcccagcgggtcttgaagcagagcgtgaagccgaattacagtctctggtgcttaaagcgtggaatgttctgggatgtcgtggctggggacgcattgacgtaatgcttgacggtgacgggcaattttatctgctggaagcaaacacgtctccgggaatgaccagccatagccttgtgccgatggcggcgcgtcaggcgggaatgagcttctcgcaattagttgtacgtattttggaccaggcgggctga

SEQ ID NO: 3790 - DNA, 465 bp, Enterobacter cloacae
tttattgacacaccgccagccggggcgattcttgcggcgaagctgttgcctgagacggggggcgatacgctgtgggccagcgggatcgcagcgtttgaggcgctttccgcgccgctccagaccctactgagcggccagcgggcggagcaagacttcaaaaaatcattccaggaaaataagaaccgaaaaacggaagaggagcaccagcgcaggcaggaagcggtcgaaaaacatccgaccacctcgcagcagcacccggaggagcgaacgcatccggagaccggaaagcaggcgcagaaagagaaagaagggaaaaccacgcgaatcgaggacgaagcggagaaagagagcgaggcgcagctcggcaaccagaaagcgcaaatcacgaaacccgagaatcaggagcgcaggcgcaggcaggagaacgatcaggcgatcagggataaccgcgtcacgcagcattaa

SEQ ID NO: 3791 - DNA, 729 bp, Enterobacter cloacae
ccttccgaccgcctggtgaagactatcgttcaggcgacgggtgtcggtttacataccggcaagaaagtcacactgacgttacgccctgcgccggccaataccggggtcatctatcgtcgcaccgacttgaatccaccggtagattttccggccgatgccaaatctgtgcgtgatactatgctctgtacttgtctggtgaacgagcatgacgtgcggatttctaccgtagagcacctgaacgccgccctggcgggtctgggtatcgacaacattatggttgaagtcgatgcgccagaaatcccgatcatggacgggagtgctgctccgttcgtttatttgttgctggatgccggcatcgaagaactgaactgcgcgaagaaatttgttcgcattaaagagaccgttcgcgtcgaagatggcgacaaatgggctgaattcaaaccgtacaatggtttttcgttggacttcaccatcgattttaaccatccggcgattgactccagcacccagcgctatgcgatgaacttctctgcggatgcgttcatgcgccagatcagccgagctcgtaccttcggctttatgcgtgatatcgaatatctgcaatcccgcggcctgtgcctgggcggcagcttcgattgtgccatcgttgttgacgattatcgcgtactgaacgaagacggcctgcgttttgaaaatgaatttgttcgtcacaaaatgctggacgcgatc

SEQ ID NO: 3792 - DNA, 846 bp, Enterobacter cloacae
catgaggtagcactcatttatcccggggaccccatggccatcaaactcattgcaatcgatatggacggcacgctgctgctgccagaccacactatctctcctgccgttaaaaatgcgatcgccgccgcacgcgaaaaaggcgtgaacgtggtgctcaccaccggacgcccgtatgccggggtgcacagttacctgaaagagctgcacatgaaccagcctggtgattactgcatcacctataacggcgcgctggtgcaaaaggcagccgatggcagcacggtggcgcaaacggcactgagctatgatgactaccggttcctggaaaaactctcccgcgacgtgggctctcacttccacgcgctagatcgcaatacgctttacaccgccaaccgcgatatcagctactacacggtgcacgagtcctacgttgcaaccattccactggtgttctgtgaagcggagaaaatggatccggcgacacagttcctgaaagtgatgatgattgatgaacctgcggttctcgacaaagccatttcacgcattccggctgaggtaaaagagaaatacaccgtactgaaaagtgcgccgtacttcctcgaaatcctcgataaacgcgtcaataaaggcacgggcgtcaaatcgcttgccgatgcgctgggcatcaagcctgaggagatcatggcgctgggcgaccaggaaaacgatattgcgatgatcgaatatgcaggcatgggcgtggcgatggataacgccatcccgtcggtaaaagaagtggcgaacttcgtgaccaaatctaacctggaagacggcgttgcctgggcgatcgagaaatttgtcctctcctag

SEQ ID NO: 3793 - DNA, 978 bp, Enterobacter cloacae
agcgctgttcgatgcgatacggcatcaggacggcgatgcggcagagcaggcggcgctgaccatgatcgccagctcgacacgaaggttgaaggaaatcacatgacatcacgctacatcgcaattgactggggatcgaccaatctgcgcgcctggctctaccagggtgagcagtgcctggaaagcaggcaatcagaagcaggtgtgacgcgcctgaacggtaaatccccagcagcggtgttagcagaggtgacacaaaactggcgcgacggtactacgccagtggtgatggccggaatggtcggcagtaacgtaggctggaaggttgcgccttatctgtcggttccggtgcatttcactgccgttggcgagcagttaacgtccgttggcgacaatgtctggattatccccggtttatgcgtctctcgcgacgataaccataacgtgatgcgcggtgaagagacgcaactgctcggggcgcgcacgctttctccttcttctgtctacgtcatgcccgggacgcactgcaaatgggtccaggcggatgctgagcaaattcatgactttcgcaccgtaatgaccggcgaattgcaccacttgctgcttaagcactcgctggtggggaccggtttgccggagcagaccccttcgccggaagcgtttgccgccgggctggagcgcgggatcgcatcccctgccgttttgccgcaactttttgaggttcgcgcctcgcacgtgctgggaaatcttccgcgcgaacaggtcagcgaatttctgtccggcctgctgattggcgcagaggtcgccaccctgagcgacgcgttcgccgggcagcaggccatcacgctcgtcgcgggttcatcgctgacgtctcgttaccgccaggcgttccacgctatcggacgggatgttgctgcggtggaaggcgacacggcatttcaggcaggcataaggagcatcgctcatgcagtggcaaactga

SEQ ID NO: 3794 - DNA, 336 bp, Enterobacter cloacae
actggcgaagatgggctgcaagcttatcgtcacaccgaatatgaaccccgaggtgatccgccgggcggtggagtacggcatgaccgtttgcccgggttgcgccacggctacagaagcctttgccgccctcgatgcaggcgcacagtctctcaaaattttcccgtcgtcggcctttggtccggattacatcaaagcgctgaaagcggtcttacccgccagcgtgccggtctttgccgtgggcggcgtcacgccggaaaacctggtgcagtggataaaagcgggctgtgtgggcgccgggctgggcagcgatctctatcgtgccggacagcccgttga

SEQ ID NO: 3795 - DNA, 1203 bp, Enterobacter cloacae
gcgtaccgcacagcaggcggcagcatttgtgaaagcgtatcgagaggcagtgcaatgaaaataaccaaactcaccacgtaccgtttacccccgcgttggatgttcctgaaaatcgaaaccgacgaaggcgtggttggctggggcgagccggtgattgaaggccgtgcgcgcaccgttgaagccgcggttcacgagctgggcgaatacctgattggccaggatccggcgcgcatcaacgacctgtggcaggtcatgtaccgggcgggattttaccgtggcggtccgatcctgatgagcgccatcgccggtattgatcaggcgctgtgggatatcaaaggcaaagtgctgaatgccccggtctggcaattaatgggcggcctggtgcgcgacaaaatcaaagcctacagctgggtgggcggtgaccgccctgcggaagtgatcgacggtatccggcaactgcgcaacatcggttttgacaccttcaaactcaacggctgcgaagagatgggcgttatcgacaactcgcgcgcggtagaccgggcggtgaataccgtggcgcaaatccgcgaggctttcggcaacgagattgagtttggcctggatttccacggccgcgttagcgcgccaatggccaaagtgctgattaaagagctggagccgtatcgcccgctgtttatcgaagagccggtgctggccgagcaggcggaatactatccgaaactggctgaacagacgcacattcccatcgcggcgggtgaacgcatgttctcgcgcttcgagtttaaacgcgtgctggaagcgggcggcattgcgatcctgcaaccggacctctcccacgcgggtggcatcaccgaatgctacaaaattgccggaatggcagaagcctacgatgtggcgctggccccgcactgtccgcttgggccaattgcgcttgcggcctgtctgcacgtcgacttcgtctcgcgcaatgcggtgttccaggaacaaagcatgggcattcactataacaagggcgcggagctgctcgactttgtgaaaaacaaggaagacttcagcatggaaggcggtttctttaaaccgttaacgaagccgggccttggcgtggagatcgacgaagccaaagtcattgagctgagtaaaagtgcgccggactggcgtaacccactgtggcgtcatgaagacggttccgtagccgagtggtaa

SEQ ID NO: 3796 - DNA, 1398 bp, Enterobacter cloacae
cgtattccgtttacgtttttaattaaaaaaaccaaatacaccctctgtaaattacagggcatggtgagcggcttcgctatgcccaaaatctggagacagattgcgatggatattccagttactgctgcaaaaaccgggcgtcgtcgttacctgacgctgatcatgatctttattaccgtggtcatctgttatgtcgaccgcgccaaccttgccgtggcatcggctcatattcaggaagagtttggcatcaccaaagcggaaatgggctacgtcttctcggcttttgcctggctgtatacgctctgccagatcccgggcggctggttccttgaccgcgtggggtcgcgtctgacctactttatcgctatttttggctggtccgtggcgaccctgttccagggcttcgccaccgggctgatgtcactgattggcctgcgcgccatcaccggggtgtttgaagcgcccgcgtttccgaccaacaaccgcatggtgaccagctggttcccggaacacgaacgcgcttccgctgttggtttttacacctccgggcagtttgttggcctggcatttctgacgccgctgttaatctggatccaggagctactgagctggcattgggtgttcatcgtcaccggcgggatcggcattatctggtcgttaatctggtttaaggtttatcagccgccgcgcctgaccaaaagcatcaccaaagccgaactggactacatccgcgacggcggtggcctggtggacggcgatgcgcccgtgaaaaaagaggcgcgccagccgctgaccagagcggactggaagctggtcttccaccgtaagctggtgggcgtatatctgggccagttcgcggtgacttccacgctgtggttcttcctcacctggttcccgaactatctgacccaggaaaaagggattaccgcgctgaaggcgggctttatgaccaccgtacccttccttgcggcgtttttcggcgtcctgctctcgggctggctggcggacaaactggtgaaaaaaggcttctcactgggcgttgcgcgtaaaacgccgattatctgcggcctgctgatctctacctgcatcatgggagcgaactacaccaacgatccggtgtggatcatgaccttgatggcggtagcgttcttcgggaacggttttgcctccatcacctggtcgctggtgtcgtcgctggcgccgatgcgtctgattggcctgaccggcggcgtgtttaacttcgttggcggcctgggcgggatcaccgtgccgctggtcatcggttacctggcgcaggactacggctttggtccggcgctggtgtatatctctgccgtggcgctgatcggggcgctctcctacatcctgctggtcggcgacgtgaaacgagtaggctaa

SEQ ID NO: 3797 - DNA, 1281 bp, Enterobacter cloacae
tcccttcggatgttttaccctgatgcgataaccgcgcatcagggtattttcatgaaacaaatcaccttcgcttcccgcaaccaccagctcaccaacatcaacacctggacgccagacagccagtggcttgtctatgatgtccgcccgtccggcgcgtcgtttaccggtgaaaccattgagcgggtcaatgttagtacgggcgaggttgaggcgatctaccgtgcgactgacggcgcgcatgttggcgtggtaaccgttcatccggcgcaggacaaatatgtttttatccacggcccgaaaaacccggatgcagactggcagtatgattttcaccatcgtcagggggtgattgcgcacaatggtcaggtgagcaatcttgatgcgatggatatcaccgcgccttacacggcaggtgcgctgcgtggcggcacccacgttcacgtttttagcccgaacgggcagttcgtcagctttacctataacgaccatgtgctgcacgcgcgcgatccgcagctggatttgcgtaacgtcggggtggcggcgccttttggcccagtaaacccacaggggaaccatccgcgggaatatgccggcaccttctggagcgtactggtaagccgtacaacgccgaacccgaaaccgggcagcgatgaggtaaaccgcgcctatgaagagggctgggtgggcaacgacaggctggcgtttatcggcgatacggtgtctgcgaaaggcgagaaagtgcccgaactgtttattgtcgatcttcccaaagacgagcagggctggaaacgagcgggcgatgcgccgttgcagggaacgccggatacaatgcccgcgccgcctgcgggcgtcatgcaacgccgccttaccttcacccatcagaaggcgtatccggggctggtgaacgtgccgcgccactgggtgcgcagcaatccacaggggacgcaggttgcgtttttaatgcgggacgataacggcgttgtgcagctgtggcttatctcccctgagggcggcgagccgcgccagctgacccacagtgaaagtgatatccagtcggcttttaactggcatccttctggccgcacacttgggtttgtgctcgaaagccgcattgcctgctgcgatgcgcagaccggtgaggtgacgtttttgacctccgatcatggcaatccgccgtctgctgacgctgtggtgttttccccggacggacgatttattgcatggatggaagcgaaggacggtttccgccagctgtggctaacggaaaccgcacagaattag

SEQ ID NO: 3798 - DNA, 465 bp, Enterobacter cloacae
actgtgccgaactcgcttctcagaaggagatttagtatgcgtaactatgatttttcccctctgctgcgtcagtggatcggttttgacaaactggctaacgcgctgcaaagcgcaaccgaacagcagacctttccgccgtacaacatcgaaaaaagcgatgataaccactaccgcatcacgcttgcgctggccgggttccgccaggaagatctggacatccagcttgagggtgcgcgcctgaccgtgaaagggtcaccggaaaaaccagacaccgagaccaaatggctgcatcaggggcttgtcactcagccgtttagcctgagctttaccctggcagaccatatggaagtttctggcgcgacgttcactaacgggctgctgaacattgacctcacccgtaacgtgccggaagccattgcgcctcaacgcatcgccattagcgaacgcccggcgttgaatagctaa

SEQ ID NO: 3799 - DNA, 1851 bp, Enterobacter cloacae
tcgtgtgcgggctggtgccctcaccccgaccctctccctgtgggagagggtgcaaacactaaaaacggtcaccttcgggtgaccgttttgcgtttaccttcggcttttttgtgcgccatcgcccatacaaccgccgccagctctgagagaatccttatcataactaaggttatacacaggatgtggaacatgagtgatatcgcgttaaccgtcagcgtgttggcccttgtcgcggtagtggggctatggctggggaatatcaaaatccgcggcgtcgggtttgggattggcggggtgctgttcggcgggatttttgtcggccattttgccgaccagcttgggtgggtgctcagcgccgatatgctgcatttcatccaggagttcggcctgatcctctttgtgtataccatcggtattcaggtggggccgggcttcttcgcttccctgcgcatctccggtttacgccttaatctctttgccttcggcattgttgtgatgggtgggctggtcaccgcaatcctgcataaactcttcgctattccgctgcccgtcgtgctgggcatcttctccggcgccgtcacgaatacgcccgcgctcggggcgggccagcaaattctgcgcgatctgggtatccctgctgatgtcgtcgatcagatggggatgagctacgccatggcctatccgtttggcatttgcggtattttgctctcgatgtggctggtacgcgtgctgttccgcgttaacgttggacaggaggcgaaggagcatgaaagcacgctgaccaacggccatgcgctcattaaaaccatcaacattcgcgtcgaaaaccctaatctgaacaatatggcgattcaggatgttcccattctgaacagcgcgaccattatctgttcccgcctgaaacgtgatgacacgctgatggtgccttcaccggatacccttattcagcacggcgatctcctgcatctggtagggcaaccggcggatttaaacaatgcccggctggtgatcggtcaggaggtggatacctcactctcaacccgtggaacggacatgcgcgtggagcgcgtggtagtgaccaatgagaaggttctgggcaagaaaatacgcgatttgcaggttaaagagcgttatgacgtggtgatctcccggcttaaccgcgccggtgtcgagctggtggccagccaggatgccagcctgcaattcggtgatattctcaacctcgtcgggcgtccttcatctattgatgccgtagcggacatggtgggcaacgcccagcaaaaactccagcaggtgcagatgctgccggtctttatcggcgtcgggcttggcgtcatgcttggctccatccccctgtatgtgcccggcttcccggtagcactgaagctgggtctggcaggcgggccgctcattatggcgcttatcctcgggcgtatcggctccatcggtaagctctactggtttatgccgccgagcgctaacctggcgctgcgggagttgggcatcgtgctgtttctggcggtggtggggctgaaatccggcggcgattttgtcgatactctggtgaacggcgaagggatgagctgggtaggatacggcatatttattaccgctatcccactgataactgtcgggttattggcgcgtatgttcgctaaaatgaactatctcacgctgtgcggcatgctggccggttccatgaccgatccgcccgcgctggcgttcgccaataacctgcacgccaccagcggcgcggcggcgttatcctacgccacggtttatccgctggtgatgtttctgcgcatcatcaccccgcagctactggcggtgctattctgggggatgggctaa

SEQ ID NO: 3800 - DNA, 1674 bp, Enterobacter cloacae
aaaaccataaaggcctctatcccctacaggttgtttcatgaggatttaaaaatgctcagtcaaatacaacgttttggcggcgccatgttcaccccggttttgctgtttccctttgccgggatcgtggttgggatcgccatcatgcttcgcaatccgctgtttgtcggtgaggccttaaccgcgcctgataatctgttcgcgcaaattgttcacatcatcgaagagggcggctgggcggtgttccgtaatatgccgctgatttttgctgtcggcttaccgattggcctggcaaagcaggcgcagggccgcgcctgtctggcggtgctgattagcttcctgacctggaactattttatcaatgcgatggggatgacctggggtcacttctttggcgtcgacttctctgctgaacccactgccggcagcgggctggcgatgattgccggaatcaaaacgcttgataccagcatcatcggggcgattatcatttccgggctcgtcaccgccatccacaaccgatttttcgacaagccgttgccggtctttctggggattttccagggcacctcgtttgtcgttatcctcgcgttcttcgtgatgatcccctgcgcctggctgacgctgctgggctggccgaaagtgcagatgggcattgagtcgttgcaggcctttctacgtaccgctggcgcgctgggcgtatgggtttataccttcctggaacgcattctgatcccaaccggattacaccactttgtctacggcccgtttatcttcggcccggctgcggtagaaggcggcattcaggtctactgggcacagcaccttcaggaattcagccagagcactgtgccgcttaaaacgctgttcccggagggcggattcgcgctgcacggcaactctaaggtgtttggctcagtcggtattgcgctggctatctggtataccgcgtcaccggagaaccgcgtcaaagtggcaggtctgctgatcccggccacgcttaccgccgtgctggtaggcattaccgaaccgctggagttcaccttcctgtttatctcgccgttgctgtttgccatccacgccgtgctggccgcaacgatggcgacggtgatgtatatcttcggggtggtggggaacatgggcggcggtctgctggaccagttcctgccgcaaaactggatcccgatgttccataaccacgcctcgacggtattcacccagattggcatcggcctctgcttcaccgggatctacttcgtggtcttcagaacgcttatcgaacgtctgaatctcaaaacgccgggccgggaagagagcgaaatcaagctctacagcaaggccgactataaggccgctcgtgggcaaaccaccgccccggcggcagccagccagcaggtcggacaggccgctgggttcttacaggcgctcggcggcgcagcgaatatcgaaagtatcaataactgcgccacccgcctgcgtatcgccctggtggatatgacgaaaacccaaagcgatgacgtattcaaagccctgggcgcacacggtgtggtgcggcgcggcaacggcatacaggtgattgtcggtctgcacgttcctcaggtgcgcgaccagctggaatcgctgatgaaaacccctttaacaaacgaacaaaccactctgacagaggctatatcatga

SEQ ID NO: 3801 - DNA, 711 bp, Enterobacter cloacae
tacgtctcttcgcgctcagataatgaaagaaagcaggaatgtgccgccaagtgcaagcaccgaggcgataaacgtcgccgtcgtatagtatttgaaggtctcattcagggtcgcgccgcagtactgcttaaccagccagaagagagaatcggtcacgatcgtgcagccaatagcgccggacccgatggcaatggtgatgatctccgggcttacgttcgggtagagcggcagcatcggcgccactatcgccgtggcacccatcatcgctaccgttgccgaacccacggcggcgtgcagcaccagtgccaccagccaggcgagaaggatagggtgcatatgcaggttcgagagaatatgcgccagcgtctccgccagaccactggttttaaggatggcgttgaacgccccgcccgcaccgataatcagcaaaatgttggcgatagagccaaagccgtgctccgtatgggtcagcattgcgcccatgcccatgtgctggcggatccccagcaggtaataggcgacaaacacggcgataaacatcgcggtgatggggttgccgataaactccagcagggtatacagcgagccttctttcgccatgttcagctcggcaatggttttcaccagcatcagggcaatcggcagcagcacggtgaacagcgtggcgcccagcgacggcagagtgtgctcttcccgcaccttcaggtctga

SEQ ID NO: 3802 - DNA, 954 bp, Enterobacter cloacae
acgcagaaattacgtgtgggaattgtgatgaccgatgcgaatgaaggcagaaaccggctgttaaacggctggcagctgtcgaaaatgtacacctttgaagtggctgcccggcatgagtccttcgcgctggcggcggcggagctctcgctcagtcccagcgcggtgagccaccgcatcaacctgctggaagaggaactgggcattcagctgtttgtccgctcacaccgtaaagtggagctgacgcaggaaggcaagcgcgtttactggacgctgaaatcgtccctcgacaccctgaatcaggagatcctggatattaaaaaccaggcgctgtcaggtacgctaacggtgtactcccggccctcgatcgcccagtgctggctggtgccgatgctgggggattttacccgccgctacccgtcgatttcacttactattctgactggtaatgattacgtcaacatgcagcgaaccggcatcgatctggcgctctatttcgacgatacgccgccaaaccacctttctcatcactttttgatggatgaagagattttgcccgtctgctcgccggcgtatgcccgggagcatgaactgctgaaaaacccccataacctcagccactgcacgttactgcacgaccgtcaggcctggagcaatgattccggtacggatgagtggctgagctgggcgcagcatttcgcggtgaatatgccgttatcatcgggtattggcttcgatcgttctgatttagccattatcgcggccatgagtaatgtcggggtggcgatggggagaaagcggctggtgcaaaaacgtctcgaacggggggagttgattgcaccttttgatggggaaaccctcaagtgccatcagcattattacgtctcaacgcttcccggccgtcagtggccgaaaattgacgcctttatcggctggctaagagagctggcgggttga

SEQ ID NO: 3803 - DNA, 1116 bp, Enterobacter cloacae
accgtgttaaagccttttattgccactgcgatcttactctcttccggctgggcgactgccgctgagccgccgctgacggctgcccgttacgcgcagatgctgggcgtcggaatggatgtggactgggcacgcaccgagcgcggcatacgcgaattcgacccgctggtggtccgtgattttcaggcgaaaggcatacaccatgtccgtattcgggtggcgggcgaaccgacggaagcgcggctgattcacctgcgtaagctggtggaggcatgcgagcaatacggcgtcatccccatcatcgcttatcaggccgatgaatataaaaacgacccgaaagcggataccgaaaaagaggtgattaactggtggattgccgtggcgcactattttggtcagcgctcgccgttgctgggctttgacctgatctacgaaccggcggacaagctcaaccacaacgttgcttcgctcaaccgggtgtatgagaaagcgatcaaagacattcacgccattgatgccagccgcatgatttttatcgcccctcgtctgcgcgccgcgccggaggatttatccaccctgaagctgcccgcgcacagccagaattacctgctggcggagtggcatattttcccctggggtccgctgaaaacgaacggtaaatacccgtggacgtccggaactgcggctgagaaagcggctatccgtaaccgaatcaacgccgcgctgcactggcaacaaaaaaccgggcatgtgagctgggttggcggctggggggtgggcgaatcgaaaagcctgacgccaaccgcctcgcagatggcgtttgccacgtttatggcgtgcgagctgcaacatgccaacatcccgtatgcgataaacgccgatgttcagttttatgacggggaagagggggcgtggcggcctgccccagagcggctattgcaggcgatgattgcgcccgtctgtgaaaagcccggcgagaagccgggccatcatgcggttaaaccggctgttcgtgatgcgagacacgcgacgccagcggcagccagcacagcaaaatcagcagccccatcagggtcatcagcaagcctaaactcgcctgcccggtctgcggcatcatag

SEQ ID NO: 3804 - DNA, 462 bp, Enterobacter cloacae
ggagaacgcatggtctggataatgctggcaacgcttgccgtggtgtttgtagttgggtttcgtgtcctgacctcggattcccgccgcgccatcaaacgcttgagcgaacggctgggtatcaccccgatgccggtagaatcgatgatcgaccagttcggtaaaacgccgggcaatgagtttatccgctaccttgagcgcccagacgaagcgcacctgcaaaacgccgcccaggtcctgcttatctggcaggtctgcatcgtcgacgggagcgaagagaatctgcatacctggcaccgcatgctgcgtaaagcccgcctggccgcaccgatcaccgatgcgcaaatccgcctcgcgctcggcttcatgcgcgagatagagcccgatccgcaggagcttgacgccttccagctgcgctataaccagcttttcctcccggaagagggcgtgttttatctgcactga

SEQ ID NO: 3805 - DNA, 1233 bp, Enterobacter cloacae
actgcgcgacttttccgcacgtttttatcttcaggtgatgccatgacagaacatatccagcccacaaccagaccgcagaccaaagaggtgtcgcgccccaactggtcggcggttttctccgtggcgttctgcgtcgcctgcctgatcaccgtcgagtttctaccggtgagcctgctgacgccgatggcgcaggatctgggcatttccgagggcgtggcggggcagtccgttaccgtcaccgcgtttgtggcgatgttcgccagcctgtttatcactcaggcgatcggcaccattgaccgtcgtaaagtggtcattctgttcagcgtgctgctgacgctctcctgcctgctggtctctttcgctgaaagcttcaccctgctgctgctcggccgtgcctgcctggggctgggattaggcggcttctgggcgatgtccgcctcgctgaccatgcgcctggtgcccgcgcgtacggtgccgaaggccctgtccgtcatcttcggcgcggtctccatcgcgctggtgattgccgcgccgctgggcagcttcctcggcgggattatcggctggcgtaacgtgttcaacgcggcggcggtgatgggcgtgctgtgcattatctgggtgtggaaggcgctgccgtccctgccgggtgaggcggcgcaccacaaacagaacatgttcgcgctgctgaaacgtccgggcgtgctggcggggatgaccgccatcttcatggcctttgccgggcagtttgctttcttcacctatatccgcccggtgtatatgaccatggcgggctttgacgtggacggcctgacgctggtgctcctgagcttcggtatcgccagttttgtcggcacctcactgtcgtctcagttcctgaagcgctccctgaaggtggcgctggcgggtgccccgctggtgctggcgatcagcgccgcggtgctggtgttgtggggtagcgataagtgggtggcgtctgccatcgcgattatctggggctttgcctttgcgctggtgccggtgggctggtcgacgtggatcacccgctcgcttgccgatcaggcggaaaaagccgggtcgattcaggtagcggtgatccagctggcgaacacctgcggcgcggcggtgggcggcgtagcgctcgaccatctggggctgacgtcaccgctggtgatttccggcacgctgatgctgctgacggcgctgctggtggcggggaaggttaaggcgaagtag

SEQ ID NO: 3806 - DNA, 1125 bp, Enterobacter cloacae
agatgccgcatcacagtcggctgcttatgttgttatgccaatgagactgtaatgtcgctcacccgtctgttgatccgcgactttcgcaatatcgaaagcgcggatctcgctttatcccctggctttaacttcctggttggcgcgaacggcagcggcaaaaccagcgtgctggaagccatctatacgctcggccacggccgggcgtttcgcagtttgcagattggtcgcgtaattcgccacgagcaggattcttttgttctgcacgggcgtttgcagggagaggagcgagagaccgccatcggcctgaccaaagataagcagggtgacagcaaggtgcgcatcgacggcaccgatggccacaaggtggcggagctggcgctgctgatgccgatgcagctgattacgcccgaggggtttactttactcaacggcggccccaaatacagaagagcgttcctcgactggggatgctttcacaatgaagccggtttctttaacgcctggagcaacctgaagcgtctgcttaaacagcgtaacgccgcattgcgccaggtcacgcgctacgcccagctgcgtccgtgggacatggaactcatccctctagcggaacagatcagccgctggcgtgccgaatacagcgcaggtatcgccgaagacatggccgacacctgcaaacagtttttacccgagttctctctcaccttttctttccagcgcggctgggagaaagagacggattatgccgaggtgttagagagaagcttcgagcgcgaccgcatgctgacctacaccgcgcacggcccgcacaaggcggacttccgcattcgtgccgacggtgcgccggtggaagacacgctgtcgcgcgggcagctgaagctcctgatgtgtgcgctgcgcctggcgcagggggagttcctcacccgcgaaagtgggcgacgctgcctgtacctgatagatgattttgcctcggaacttgacgacgcgcggcgcgggctgcttgccagccgcctgaaagccacgcagtcgcaggttttcgtcagcgccattagcgctgaacacgttatggacatgtcggacgaaaattcgaagatgtttaccgtggaaaagggtaaaataacggattaa

SEQ ID NO: 3807 - DNA, 1038 bp, Enterobacter cloacae
caggagaaaaaaatgacagcaacaatgcaacgctggtcaatggatgcccttggtcgtgaaagcctcaggctcgttcaggagcctgttccacagccaggctcgggggaggttcgcgtacgggtaaatgccgttgcgctcaactaccgggataaaatggtgattgaaggcacgatgccgattccgctttccttcccgtttaccccagcatctgacatggcaggcgtggtggacagcatcggtgaaggcgttacgcgtttcaaacccggcgcacgcgtcatctcaaccttcttcccagaatggatcgacggcaagccgcaggcagacgcgcgcgatttgccctataaaacgtccggtggatacttccagggcatgctggccgaatatgtgattgtgagtgaaaacgcgctggtggcgtccccggaaagcctggatgacgctgaggccagtacgcttccttgcgcggggcttaccgcatggttcgcgctggtggagcgcggtcatttacgcgccgggcaatcggtgctggtacaagggacgggcggtgtggcgctattcgctttgcagatagcaaaagcgcacggcgcagaggtgtttgtctcctcgggaagtgatgaaaaactggcgcgggccaaaaagctgggggccagccagggcatcaaccgactgaaaggcgactgggctgaaaatacgctggcactgacgcaggatcgcggcatcgaccatattatcgaaaccgtgggtggggagaacctgagacattccctgcgcgccgttgccgttcatgggcggatatcggtcattggcgtgctggccgggacagaaatttctctgcctgcaagcgagctgttgctgaaatcccccgtcattcaggggattggggttggacaccgccgggcgctggaagattttgtccgtgctgttgatgtcacggagttaaaaccggtgattgagcatcgctaccgctttgacgagctggaacaggcgcttgagcatctggatcgcggtgcgtttggcaaaatcgttctcacccgcgagtga

SEQ ID NO: 3808 - DNA, 717 bp, Enterobacter cloacae
tggacttacagagcacaaggactctccatgacactcaataaaaccgatcgcattgtcatcacgctgggcactcagattgtgggtggcaaatacgttcccggttcgccgctgccagcagaggcggaactgtgcgaggagtttgaaacctcgcgcaacatcatccgggaagtgttccgctcgctgatggcgaagcggctgattgaaatgaagcgctatcgcggcgcgtttgtggcgccgcgtaaccagtggaactacctcgataccgatgttctgcaatgggtactggaaaacgactacgacccacggcttatcggcgcgatgagcgaagtccgaaatctggtggaaccggccattgcccgctgggcggcagagcgcgcaacgtcaggtgacctggcacagattgagtcggctttaaacgacatgatcgccaataaccagaatcgggaggcgttcaacgaggcggacattcgctaccacgaggcggtattgcagtcggtgcataacccggtgttacagcagcttagcgtggcgatcagctcgctacagcgagcagtatttgaacgtacctggatgggtgatgaggccaacatgccgaaaacgcttcaggaacataaagcgctgttcgatgcgatacggcatcaggacggcgatgcggcagagcaggcggcgctgaccatgatcgccagctcgacacgaaggttgaaggaaatcacatga

SEQ ID NO: 3809 - DNA, 630 bp, Enterobacter cloacae
ggagcatcgctcatgcagtggcaaactgaacttcccctgatcgcgattttgcgcggtatcacgcccggtgaggccttagcgcacgttggcgcggtgatcgacgccgggttcgacgcggtggaaatcccgctcaactccccggagtgggaaaaaagcattccggcaattgtgaaggcgtttggtgataaggcgctgattggcgctggtaccgtattacagccggagcaggtggatgaactggcgaagatgggctgcaagcttatcgtcacaccgaatatgaaccccgaggtgatccgccgggcggtggagtacggcatgaccgtttgcccgggttgcgccacggctacagaagcctttgccgccctcgatgcaggcgcacagtctctcaaaattttcccgtcgtcggcctttggtccggattacatcaaagcgctgaaagcggtcttacccgccagcgtgccggtctttgccgtgggcggcgtcacgccggaaaacctggtgcagtggataaaagcgggctgtgtgggcgccgggctgggcagcgatctctatcgtgccggacagcccgttgagcgtaccgcacagcaggcggcagcatttgtgaaagcgtatcgagaggcagtgcaatga

SEQ ID NO: 3810 - DNA, 378 bp, Enterobacter cloacae
agcctgcatgcagcacgacaaggaactttcatgaacatttcccgcctcggtgaagcaccggactaccgcttctcactggctaacgaacgcacgttcttagcgtggatccgcaccgccctgggctttctggccgcaggcgtcggccttgatcagctcgcccccgattttgccaccccgttgattcgcgaagtgctggccctgctactgtgcctgattgccggcgtgctggcgatttatggctatctgcgctggctgagaaatgaaaaggcgatgcgtctgaagcaggatctcccctacacgcgcggcttgctcattatcagtacgattttgctgatggttgcgggcgtagtgatgttactggtgctgtatgccggatag

SEQ ID NO: 3811 - DNA, 459 bp, Enterobacter cloacae
acaatcaccgtcccgacgtccgcccctaatttgttggtgacaaatagtgcggccggatgcggaggcaccacgcagtgcactgccattagtgcggtacagagcggaatggccagcttgagcagcgacgtgttggtctttttggcgatggaaaacgccagcgggatcagcagtaccacgcccacttcaacaaacagcgtaatgccgcagatcaggccgaccaggaccataatcacgtccgccgacagccagcggcagcgctgcaacgtaatcccgatgcgctctgccgcgccggagacttccatcattttgccgagaatagtgccaagaccgataaccgccgccaggaagcccagcgtaccgccaatcccgctctcaatggcgttaaccatatccagcgggctcatccccatcatcgcgccaacgaaaaagcttgccagcagcagcgcgaggaacgggtga

SEQ ID NO: 3812 - DNA, 429 bp, Enterobacter cloacae
ggggaagaaatgatgatcgtcgctgatgcaatgaaagctacgcacgcccttgttgcggccgttcctttactgggtgaacagccgagcgagaaagattataaggatgcgcttgagctggttgagtatctccttatgaacgagcccaatagccccttgctggatattgtgtgcgccagaattagccgttacgaagctaatcggccagagatagtcgcattacgcaaggagatggagtccgttcccgtcggaattgcagttttaagaaccttgatggatcaatacaatctgacgatatcggattttaaggatgaaattggtagtaaatcgatggtttcacgggttctgaatggtcagagacagcttaccctgaaccatattaaaaagctggcggccagatttggggtatcacctgcgttatttattgagtga

SEQ ID NO: 3813 - DNA, 1731 bp, Enterobacter cloacae
actacgacgcgtaaagctggctcagaagaaaaggactggagcatggcaagttcgggcacaacatccaccaagacgcgttttacaggcgcgcagctgattgttcatttactggaacgacagggcatcaccaccgttgcgggcatcccgggtgggaccgtgctgccgctgtatgatgcgttaagccaaagcacacagatccgccacgtgctggcgcgccacgagcagggcgcaggctttatcgcccagggcatggcgcgtacccagggtaaaccggcggtctgtatggcctgtagcgggccgggcgccactaacctggtgaccgccatcgccgacgcgcgtctcgactccattccgctgatctgcattaccggccaggtgccgtcctcgatgatcggcaccgatgcgttccaggaagtcgatacctacggcatctctatccccatcaccaaacataactatttagttcgcgatatcagcgagctgcctcaggttatcagcgatgcgttccgcattgcgcagtctggccgcccgggcccggtgtggatagacattcctaaggatgtccagaccgcagagatcgagatcgacattctgccggagccgggcgagcgtgcccccgcgccggagttcagcgctgagagcgtgcgcgatgcggcggcaatgatcaacgccgccaaacgcccggtgctgtatctgggcggcggggcgatcaacgccgcggatgaaatccgccagtttgcggaaaaagccaacctgccgaccaccatgaccctgatggcgctgggtatgctgcccaaagcgcatccattgtctttagggatgctgggcatgcacggcgcgcgcagcaccaactacatcctgcaagaggcggatttgctgatagttatgggggcgcgttttgatgaccgggcgattggcaaaaccgagcagttctgcccgaacgccaaaatcattcacgtggatatcgaccgcgccgagctgggtaaaatcaagcagccgcacgtggcgatccagggcgacgtggccgaggtgctggcgcagctgatcccgcagacggtggcaaccgaccgcgccgactggcgccagctggtggccgatctgcaacgcgagttcccgggcgctatcccaaccgagggcgacccgctgagccactatggtcttatcaacgctgttgccgcctgcgtggatgacagcgcgattatcaccaccgacgtcggccagcatcagatgtggactgcccaggcgtatccgctgaaccgcccgcgccagtggctgacctccggcggccttggcaccatgggcttcggcctgccagcagcggttggcgcggcgctcgccaacccggaccgtaaggtgatctgcttctccggtgacggcagcctgatgatgaatattcaggagatggcgacggcggccgaaaaccagttagacgtcaaaatcattctgatgaacaacgaggcgctgggtctggtacaccagcagcagagcctgttctataagcagggcgtgtttgcggcgacctatccggggatgatcaacttcatgcagattgccgctggttttggcctgcacacctgcgatctgaacgccgaagaagatgcccacgcggcgttgcaggatgcgatttctcgccctggcccggcgttgatccacgtgcgtatcgaccctgaacaaaaagtgtatccgatggtgccgccgggtgcggcaaatactgagatggtgggagaataa

SEQ ID NO: 3814 - DNA, 291 bp, Enterobacter cloacae
gccatgcagaaacaacatgataacgtcattctggaactcaccgtccgcaaccaccctggcgtcatgacccacgtctgcgggctgtttgcccgccgggcatttaacgtggaaggcattctctgcctgccgattcagggcagcgagcacagccgcatctggctactggtcaacgacgaccagcgtctggagcagatgatagcgcagatcgacaagctggaagacgtcaccaaagtggcgcgcaaccagtccgatcccaccatgtttaacaaaattgcggtgttcttcgaatag

SEQ ID NO: 3815 - DNA, 1515 bp, Enterobacter cloacae
cagctggcaatgaactcccttttttcgcggctgatcgccgttgtcgccagcttttttatcttctccgccgcgtggttctgcctgtggagtatcagcctgcatctggtggaacgcccggagctggcggtgctgctgttcccctttggcctgcgtctggggctgatgctgcaatgcccgcgcggctactggccggtgctgctgggcgcagagtggctgatgctgatctggctggcgcaggaagtggcgctggcgcatctgccgttattgatgaccggaagcctgctcacgcttatcccggtcgccctgatttcccgctaccgtcaccagcgcgactggcgcacgctgctgcgtcagggggcggcgctaattgccgccgcgctgttgcagtctctgccgtgggtgggtgaaaaggaggtgcttaacgccctgctgctgacccttaccggcggcctgacgctggccccgacctgccttgtgatctggcattatcttacaagcactgtctggcagccgctcggcccggcgctggtctcccagccggtgaactggcgcgcccggcatctcatctggtatctgctgctgtttgtggtgagcctgtggctccagcttggtctccccgctgaattatcacgcttcacgccgttttgtctggcgctgccgatcatcgcccttgcctggcactacggctggcagggcgcattgatcgccacgctgatgaacgccatcgcgctgattgccagccagacctggcacgatcatcctgtagatttactgctttccctgctggcccagagcctgaccgggctgctgctcggcgcgggcatacagcgcctgcgcgagctgaaccagtccctgcaaaacgagctggcgcgcaaccgccgtctggcggagcgtctgctggagacggaagagagcgtgcggcaagaggttgcccgcgagctgcacgacgacatcggccagaccatcaccgccatccgtacccaggcgggcattgttcagcgcctggcggcagaaaacgcgggcgtgaagcagggcggggcgcatatcgaacagctttcgctgggcgtctatgattccgttcgtcgcctgttagggcggctgcgcccgcgccagcttgacgatctctccctggagcaggcggtacgctctctgatgcgcgagatggagctggaaagccgcggcattgtcagccatctcgactggcgcattagcgaacctgcgctgagcgaaggccagcgcgtaaccctgttccgcgtctgtcaggaggggctgaacaatatcgtcaaacatgccagtgccagcgcggtcacgatccagggctggcagcaggacgagcgcctgatgctggtaattgaagacgacggctgcggcctgccgccgggctccggccagcagggctttggcctggcgggcatgcgcgagcgcgtaaaggcgcttggcggcacgctgagcctctcctgcacccacgggacgcgcgtcagcgtcagtttgccgttaaggacgcatcatgtttaa

SEQ ID NO: 3816 - DNA, 1017 bp, Enterobacter cloacae
cggagagcttgcatgttaacccgacgattgtcctgcctggcgctgctgatggcgctggcctcccccgcaatggccgcgaatgcacctacctacggcgagaagctggaaggttttgactacggctggccggtaaaacactttacctttacctcgcagaaccagcctctggatatggcttacctggacgtgaagccggaaaaacccaacggccgcaccgtggtgctgatgcacggcaaaaacttctgcgccggtacctgggacggcacgatccgcgcgctttcagccagcgggtatcgcgtgatcgcacccgaccagatcggcttctgcaaatccaccaagccggagcattatcagtacaccttccagcagctggcggataacacccacgcgctgctgaaaacgctgggcgtcgatcgcgtcacggttatcggccactcgaccggcggcatgctggcgacccgctacgcgctgatgtggccgcagcaggtggagcagctggtgatggtcaacccgataggcctggaggactggaaagcgcgcggcgtgccgcatattacggtcgaccagtggtaccagcgcgagctgaaggtcagcgccgacggcattcgtcagtacgagaaaaatacctactatgccggagagtggaagccggaatacgaacgctgggtgaccatgctcgccgggctgaacaacgggccgggaaaagaacgtgtggcctggaactcggcgctgctctacgacatgatctacacccagccggtgatctacgaatttagcgaactcagcatgccggtattattgatgatcggcacgaaggacaacaccgccatcgggaaagatctcgccccgcctgagatccgcaaaacgctcggcaactatgcggtgctgggaaaggagacggcgaagcgcatcccgcacgctacgctggtggaatttaacgacatgggccacgcgccgcagatgcaggatcctgagcgcttccacgaggcgctgcttaaggggcttcaggcccgctga

SEQ ID NO: 3817 - DNA, 531 bp, Enterobacter cloacae
accatgaaacaatccgccattatctggccaaacgactacctgccaggcacaaccgataactttgcatccaacgaaatcatcgtcgccgggctgagcgcaaaagagatttgggcgcagcttaacgacactaccctgtggccgaactactacagcaacgccgaagatattcgttttcacgacggcagcggtccggaactgagcgccaacgcccgcttccgctttacgacctttggcttcccggttgaggcgcaggtcacggagtatgttccgcccgttgacggcgaagccgcacggatcgcctggcacggctgggtggagggcgatgccagctcgcgtctggatgtgatccacgcctggctgtttgaagacttgccgggaaaccgcgtccgtattctgactcaggagtcgcagaaaggcgttcctgcacaggaacttgctcgcaccgtgccgaatccgatgatcaacgggcaccaggagtggatcgttgggctggcgaatgcagcgatgcaagaaaagttgtcgaaacgttaa

SEQ ID NO: 3818 - DNA, 1110 bp, Enterobacter cloacae
cccccccgcacgtatgaatggcttgccggcgcggtcggaaacaaaccgctgcagcaggtgagtggcccattaggcggccgccctacgctgcctattcttggaaacctgctgcttcaggtcgcggacggtacgctgtcgctgaccggcacagatctggaaatggaaatgatcgcgcgcgttacgctgactcagccgcacgacgcgggcgcgaccacggttccggcacgtaaattctttgatatttgccgtgggctgccggaaggcgctgaaatcgccgtgcagctggagggcgaccgcatgctggtgcgctctggccgcagccgtttctccctctccacgctgcccgctgcggacttcccgaacctggatgactggcagagcgaagttgaatttaccctgccgcaggcgacgatgaagcgtctgattgaagccacgcagttctccatggcgcatcaggacgttcgttactatttaaacggcatgctgttcgaaaccgaaggtgaagagctgcgtaccgtggcgaccgacggtcaccgtctggcggtctgttccatgccgattggcgattcactgccaaaccattcggtgatcgtaccgcgtaaaggcgtaattgaactgatgcgcatgctcgacggcggcgataccccactgcgcgtgcagattggcagcaacaatattcgtgcccacgtgggcgattttgtcttcacatcgaagctggtagacggtcgtttcccggattatcgccgcgtattgccgaagaatccggacaaaacgctggaggcgggttgcgacatcctcaagcaggcgtttgcgcgtgccgctattctctcgaacgagaaattccgcggcgtacgtctgtacgtgagtgaaaaccagatcaaaatcaccgccaacaacccggagcaggaagaggcagaggagattctggacgtcacctacgccggggctgagatggaaatcggcttcaacgtcagctacgtgctggatgtgctgaatgcactgaaatgcgagaacgttcgcatcctgctgactgactccgtttcgagcgtacagattgaagatgccgcatcacagtcggctgcttatgttgttatgccaatgagactgtaa

SEQ ID NO: 3819 - DNA, 2430 bp, Enterobacter cloacae
aatgagcgagaaacgttgatgtcgaattcttatgactcctccagtatcaaagtcctgaaagggctggatgcggtgcgtaagcgcccgggtatgtatatcggcgacacggatgacggcaccggtctgcaccacatggtattcgaggtggtagataacgctatcgacgaagcgctcgcgggtcactgtaaagacatcgtggtcacgatccatgcggacaactccgtgtccgttaccgatgacggccgtggcatcccaaccggtattcacccggaagagggcgtatctgctgcggaagtgatcatgaccgttctgcacgcaggcggtaagttcgatgataactcctataaagtttccggcggtctgcacggcgtaggcgtatccgtagtaaacgccctgtcgcagaagctggagctggttatccagcgcgaaggcaaaattcaccgtcagatctaccagcacggcgtgcctgaagcgccgctggccgtcacgggtgataccgagaaaaccggtaccatggtgcgtttctggccgagccttgaaaccttcaccaacgtcaccgaattcgagtacgacattctggcgaaacgcctgcgtgaactgtcgttcctgaactccggcgtgtcgattcgtctgcgcgacaaacgcgacaacaaagaagaccacttccattacgaaggtggtatcaaggcgttcgttgagtatctgaacaagaacaaaacgccaattcacccgaatatcttctacttctctactgaaaaagacggtatcggcgtggaagtggccttgcagtggaacgacggtttccaggaaaacatttactgcttcaccaacaacattccacagcgcgacggcggtacgcaccttgcgggcttccgcgcggcgatgacccgtaccctgaacgcttacatggacaaagaaggctacagtaaaaaagcgaaagtcagcgccaccggtgacgatgcccgtgaaggcctgattgccgtggtctccgtgaaggtgccggatccgaagttctcctcacagaccaaagacaagctggtctcttctgaggtgaaatcggcggttgaacagcagatgaacgaactgctgagcgaatacctgctggaaaacccgtccgacgcgaaaatcgtggtgggtaaaattatcgatgcggcgcgtgcccgtgaagcggcgcgtaaagcgcgtgaaatgacccgtcgtaaaggcgcgctggacctggcaggcctgccgggcaaactggctgactgtcaggaacgcgacccggcgctgtctgaactgtaccttgtggaaggggactccgcgggcggttctgcaaagcagggccgtaaccgcaagaaccaggcgattctgccgctgaagggtaaaatcctcaacgttgagaaagcgcgcttcgacaagatgctctcttctcaggaagtggcgacgctcatcaccgcgctcggctgcggcattggtcgcgacgagtacaacccggacaaactgcgttatcacagcatcatcatcatgaccgatgcggacgtcgacggctcgcacatccgtacgctgctgttgaccttcttctatcgtcagatgccggaaatcgttgagcgcggccacgtctacattgcgcagccaccgctgtacaaggtgaaaaaaggcaagcaggaacagtacattaaagatgacgacgcgatggatcagtaccaaatcgcgatcgcccttgatggtgcgaccctgcacgcaaactccagcgcgccagcgctggccggtgagccgctggagcgtctggtttccgagttcaacgccacgcagaaaatgattggccgtatggagcgtcgctatccgaaagcgctgctgaaagagctgatttatcagccgaccctgaccgaagccgatctgagcaacgagcagaccgtcacccgctgggtgaacaccctggtgagcgagctgaacgagaaagagcagcacggcagccagtggaagttcgacgttcagcagaacgctgagcagcagttcgagccgattgttcgcgtgcgtacccacggcgtcgataccgactacccgctggagcacgagtttgttaccggtccggaataccgccgtatctgcaccctcggcgagaagctgcgtggtctgatcgaagacgacgcgttcatcgaacgtggcgagcgtcgtcaaccggtagccagcttcgaacaggcgctggagtggctggtgaaagagtcccgtcgcggcctctctattcagcgttataaaggcctgggcgaaatgaacccggatcagctgtgggaaaccactatggatccggaaagccgtcgcatgctgcgcgtcaccgttaaagacgcaatcgcagcggatcagctgttcacgaccctgatgggcgatgcggttgaaccacgtcgcgccttcatcgaagagaacgccctgaaggcggcgaatatcgatatttaa

SEQ ID NO: 3820 - DNA, 429 bp, Enterobacter cloacae
tttcaggagcatttatctatgcgtaatttcgatctctctccgctataccgttctgccattggttttgatcgtctgttcaaccacttagaaaacaaccagagccagagcaacggctatcctccatacaacgttgaactggttgacgaaaaccactatcgcattgcgattgctgttgccggtttcgcagagagcgaactggagatcaccgcgcaggacaatctgctggtggtgaaaggctcccatgcgggcgagcagaaagaacgaacctacctctaccagggtatcgcagagcgtaactttgaacgcaagttccagctggctgagaacatccacgtcaagggcgcgaacctggtgaacggcctgctgtttatcgaactggaacgtgtgattccggaagagaaaaaaccgcgtcgtatcgaaatcaattaa

SEQ ID NO: 3821 - DNA, 1479 bp, Enterobacter cloacae
cgtattcaaagccctgggcgcacacggtgtggtgcggcgcggcaacggcatacaggtgattgtcggtctgcacgttcctcaggtgcgcgaccagctggaatcgctgatgaaaacccctttaacaaacgaacaaaccactctgacagaggctatatcatgaaaaaattctcagttgttattgcaggcggcggcagtacattcacgcctggtatcgtcctgatgctgttagccaaccgtgaccgtttcccgctgcgtgcgctgaagttctatgacaatgacggagcacgtcaggagatcatcgccgaggcgtgtaaaatcatccttaaggagcaggcgccggagattgaatttagttacaccaccgatcctgaagcggcctttaccgatgtggatttcgtgatggcgcatattcgcgttggcaaatatcccatgcgtgaaaaggatgaaaaaatcccgctgcgccacggcgtgctgggccaggaaacgtgcgggccgggcggcatctcctacggcatgcgctccatcggcggcgtgctggagctggtggattacatggagcagtactccccgaacgcgtggatgttgaactactccaacccggcggcgattgtcgcggaagccacgcgccgcctgcgtccgaacgcgaaaatcctcaacatctgcgatatgccgatcggcattgaagggcgtatggcgcaaatcgtcggcctgaaagaccgcaaagagatgcgcgtgcgctactacggtctgaaccacttcggctggtggacgtcgattgaagatcagaacggcaacgatctgatgccgaagctgcgcgaatacgtggcgaaaaacggttatgttccgccttcggaagatgtgcatactgaagcgagctggaacgataccttcgccaaggccaaagacgtacaggcgctggatccggacaccatgccgaacacctacctgaagtattacctgttcccggactatgtggtcgcccattccaacccggagcgtacccgcgccaatgaagtgatggatcaccgtgagaagcatgtattcagttcatgtcgggcgattatcgaagccggccattcttctgccggtgaactggaaattgacgaacatgcgtcgtacatcgtcgatctggcgaccgcgattgcctttaacacccaggaacgcatgctgctgattgtgcctaacaatggggctatccataactttgacgctgacgcgatggtagaaatcccttgtctggtcggccacaacggaccggagccgctgaccgtgggtgatattccgcacttccagaaaggactcatgagccagcaggtggcggtggaaaaactggtggtggacgcctgggagcagcgctcgtatcagaaactctggcaggcgattaccctgtcgaaaaccgtaccgagcgcatcggtggcgaaagcgattctggacgatctgattgaagcgaataaagattactggccagagctgcactaa

SEQ ID NO: 3822 - DNA, 363 bp, Enterobacter cloacae
tgttactggtgctgtatgccggatagccgcaaagcgcggcgggaagcggaccccggccttcagccggagcgaacctcgctggcctggctgcgcacgctgctggggtatggcgcgctgatcgctcttgccattaagcacaactggcaccgcacgggggcgccattctggatctccattgttgtgctggcgctggtagccatcattttatggcgctacacccgcagccgtaacctgatggacgtgtcgcagaacgactttgcgcagccgaaagcggtgcgggataagttcctcatcgccctggccgtgctgtcgttgtcactgctgtttgcggtaacccacattcaacaaattttgcacctgtag

SEQ ID NO: 3823 - DNA, 342 bp, Enterobacter cloacae
tggcaatggacgcggcaggcaagcaggatgcatttaatctcaatgaaggcaattttggatgcggtaagccagttcccgcaacacagagaagagcttctctttttaggacgagttattgaaaagagccactgcccgacgcccgctgcactgagaaaacttttcccaacgctggataacttcaagtatcttgataagcattatgttattgatattgcaaataacaatctcagagtagtggctctcatcttctttgaaagccaaaagttttatgtgcgccatgtttttactcataaggaatatgaccgttttacggagaaacatcgcactaaggggaagaaatga

SEQ ID NO: 3824 - DNA, 768 bp, Enterobacter cloacae
cgcagatcgacaagctggaagacgtcaccaaagtggcgcgcaaccagtccgatcccaccatgtttaacaaaattgcggtgttcttcgaatagatcgcttaaggtaagcgtctttcgctcttgtaggccggataagcgcagcgccatccggctttttcagaccgcaggaacacacatgaccaccatcgcccttattgacgaccaccttatcgtccgctctggctttgcccagcttctcaacctcgaaccggatttccaggtcgtggccgagtttggctccggtcgcgaggcgctggcgggcctgccggggcgcggggtgcaggtctgtatctgcgatatctcaatgccggatctctccgggcttgagctgttaagccagctgccgaaaggaatggcgaccattatgctctcggtccacgacagcccggcgctggtcgagcaggcgctcaacgcgggggcgcgcgggttcctctcaaaacgctgtagcccggatgagctgatcgccgccgtgcgcactgtctccaccggcggctgctacctgacgccggatatcgccatcaagctggcggcgggacggcaggatccactcaccagacgcgagcgtcaggtggcagagaaacttgcccagggcatgtcggtgaaagagattgccgtagagctgggattgtcgccaaagaccgttcacgttcatcgcgccaacctgatggaaaaactcaacgtcagtaacgatgtcgagctggcgcgccgtatgtttgacagctggcaatga

SEQ ID NO: 3825 - DNA, 1320 bp, Enterobacter cloacae
ggacgcatcatgtttaaaacccccgccagcgccgccccgctaagcaacaaagcggaaatcgactcccgctaccgctactggcgtcgccatatcctgattaccatctggctcggctacgcgctgttctactttacccgcaaaagcttcaacgccgccgcgccggagatcctcgcgagcggcgtgatgacccgcaccgacatcggcctgctggcgacgctgttttacatcacctacggcctgtcgaagttcttctccggcatcgtcagcgatcgctccaacgcgcgttattttatgggcgtcgggctgatcgccaccggcgtggtgaatattctgtttggcttctccacctcgctctgggccttcgccctgctgtgggcgctgaacgcctttttccagggctggggcgcgccggtctgcgcccgcctgctgaccgcctggtactcacgcaacgagcgcggcggctggtgggcgatatggaacaccgcgcataacgtcggcggggcgctgatcccgatggtggtgggtgccgcggcgctgcactacggctggcgcgcggggatgatgattgccggtggcctggcgattgtcgccgggctgttcctctgctggcgcctgcgcgacaggccgcaaaccgtcggccttccaccggtgggcgactggcggcacgacgagatggagatcgcccagcagcaggaaggggccgggctgtcccgccaggagatcctcaccaaatacgtgctgaaaaacccctacatctggctgctgtcgctctgctacgtgctggtctacgtggtgcgcgcggccatcaacgactggggcaacctgtacatgtccgagacgctcggcgtggatctggtgaccgccaactcggcggtgacgatgttcgagctgggcgggtttatcggcgcgctggtggcgggctggggctcggacaagctgttcaacggtaaccgcggcccgatgaacctgatttttgccgccgggatcttgctctccgtcggctcactatggttgatgccgttcgccagctacgtgatgcaggcggcgtgcttcttcaccatcggatttttcgtctttggcccgcagatgctgatcggcatggcggcggcggagtgctcccacaaagaggcggccggcgcggcgacgggctttgtcgggctgtttgcctaccttggcgcatcgctctccggctggccgctggcgcgggtgatcgacatctggcactggagcgggttcttcgcggtgatcgccatcgcggcgggcatctccgccctgcttttactgccgtttttgcacgcgcaggcaccgcgcgaagcgtga

SEQ ID NO: 3826 - DNA, 1524 bp, Enterobacter cloacae
cgcgcctcaccttttgctgccgagacgcgcaaaactaagaaattttcccggtttcacctggacgctgtctcaggcatctctcctggctggtttttacaatgctgcaaaaatcagctcaggagtaaaccaaccatgctggccttcttaaaccaggtgcgcaagccgaccctggatctgccgctcgacgtgcggcgcaagatgtggttcaaaccgttcatgcagtcttatctggtggtcttcatcggctacctgaccatgtatctgatccgcaaaaactttaacatcgcgcagaacgacatgatctcgacctacgggctgagcatgacccaactggggatgattggcctgggcttttccatcacctacggcgtggggaaaacggttgtgtcctactacgcggacggcaaaaacaccaagcagttcctgccgtttatgctgatcctctccgctatctgtatgctcggcttcagcgccagcatgggcgcgggctccgtcagcctgttcctgatgatcgccttctacgccctgagcggttttttccagagtaccggcgggtcgtgcagctactccaccattaccaaatggaccccacgccgcaagcgtggttcctacctcggcatgtggaacatctcccacaacctcggcggagcgggcgcggctggcgtggcgctgtttggcgcaaactacctgttcgacggccatgtgatcggcatgtttatcttcccgtcgattatcgccctgatcgtcggctttatcggccttcgctacggcagcgactccccggaatcgtacggcctcggcaaagccgaagagctgttcggcgaggagatcagcgaagaggacaaagataccgaagagaacgagatgaccaaatggcagatctttgttgagtacgtgctgaaaaacaaagtgatttggctgctgtgcttctcgaacatcttcctgtacgtggtgcgtatcggtatcgaccagtggtcaaccgtgtatgctttccaggagctgaagctttctaaagaggtggcgattcagggcttcaccctgttcgaagtgggcgcgctggtcggcacgctgctgtggggctggctctccgacctcgccaacggccgtcgcgcgctggtggcctgcatcgcgctggcgctgattatcgccacgctcggcgtttaccagcacgccagcaaccagtacgtttatctggcgtccctgttcgcgctcggcttcctggtgtttggccctcagctgctgattggcgtggcggccgtagggttcgtgccgaaaaaagcgatcggcgccgccgatgggattaaaggcaccttcgcctacctgatcggcgacagcttcgccaagcttggcctggggatgatcgccgacggtacgccaattttcggcctcaccggctgggcgggaaccttcgcggcgctggatgcggcagcgatcggctgtatcgtcctgatggcgatggtagcggtgctggaagaacgtaaaattcgccgtgagaatcgtgcgcagaaattaaaagtagcctga

SEQ ID NO: 3827 - DNA, 315 bp, Enterobacter cloacae
agagtaatgatgatgatcgcactagaagaagccgtaatggaaattatcgtcaacgccggccagtcccgcagcctgtgctttgaagccctgcacgcggcgcgtcagggcaaccttgacgaggccaaaagcctgctgcgcgaagccgacggctacgcgcgccaggcgcacaagatgcagaccaaactgattgagcaggacgcgggcgaagcccgccagccgatgacattaattatggtgcacgcgcaggatcatttaatgaattcgctattagcgcgtgaattatctgaagagattattcatttatatcagagatag

SEQ ID NO: 3828 - DNA, 1407 bp, Enterobacter cloacae
ataaaattaaactatattgagataaccatgaatacgattaaaaaacttccattaaccatggcggttatcgccgcgctttgcccaatttccgtcctcgctcaggaattcactcaggagcaaatcgacgccattgtggcgaaagcggtggataaagccctggccgagcgtcaggctaaaatggatgcggcggtcgcgaaaaaagcggacgtggtgaccgagccgcagagcgcggcgcaatccccggatatggcgatcccgttcggggttaaatttaccggctacgcccgctacggcgcgcacttccaggctgccgatcagaaatacgtggctgtcgatggctcctacaacggcgcgtccgcgatcggtcgtctgggtaacgaaggcaacggcggcgagttccagctctccaaagctttcaagggcgaaaacggcgccatctgggacatcaacgtgatgatcgaccactggggcgacgaagttaacctcaagaaagcctacgccggcgtgaccaacattatggcctccaacccgaacgcctacttctgggcgggtcgcgacttccaccagcgtccgcagcagggcatcaacgattacttctggatgaaccacgacggtcagggcgccggggtgaagaacttcgatatcggcggcgtgcagtttgacgtcgctgccgtggcggcagtggaatcctgtagcccggaagtgatggaagacgaagcgaacccgtcacgcatcacctgtaccggcgggtccggcacgggcgacaaaggtaactacgcggccacctctaaaatccacggcatgaagctcggtccgctggatctggagctgtacgccaactacggctttgattcaaaagcggtagagagcgacgagcgtctgaacgcctggcagggcggcgtggtgctgagccacaccaacgacagcggcgtgaacaaggtgatcgcccgctactccgataattctgacaacagcgtgttcaataaaaccgaagacctgaccacggtctacgccagcttcgaagggctgtacaaattcacccaggcgacgcaggtggagtacatcctcgccttccacgattacgacaatagccgcgataagaccgacaaccgcaagaactacaatgccatcgtgcgcccgatgcactggtggaacgacgttcactccacctggctggaagcgggctggcagcacgtggattacgacaacggcggcgacaacaagggctggaagctgaccctgtcgcagaacatgtctatcgccatggggccggagttccgcccgatgctgcgcttctacgtgaccggcggcaaggtggataacgaacgcaccgcgcgcgtgaacaacaccaaagatgagacgctggacgacttcaacgtcggcgcgatgtgggaggcgtggttctaa

SEQ ID NO: 3829 - DNA, 1050 bp, Enterobacter cloacae
agtaaaagcaaaacggcaacgaaagttgccgtttttaatgttcgctccctctccccgtgggagagggccggggtgagggcatcaggccgcacacaaccatgctatgctgttgaccgaattaacgacaacataacaggggagaacatgggttccacacgcaaagggatgctcaacgtcctgatcgccgccgttttatggggcagttccggggtttgcgcgcagtacatcatggagaaaagccacatttcttcgccttacctgaccatggttcgtctgctgtttaccggcgtgatcctgttgacgctctccttcgttcacggcgacaagattttctcggtcatcaaaaaccgcaaagacgccctcagcctgctgtttttctcgctggttggcgcgctcaccgtgcagctcaccttcctgctgacgattgaaaaatccaacgctgcgacggccaccgtgctccagtttctgtcgccgaccattatcgtggcatggtttgcgctggcgcggaaaacgcgtcccggcatatttgtcttatccgcgattttcacgtcgcttgtgggtaccttcctgctggtcacccacggcgacccgacgtcgctctccatctcgcctgccgcgctgttcttcggtatcgcctcagcgtttgccgcggcgttttacaccacctatccatcgacgctgattgcccgctacggcacgctgccgattgtcggctggagtatgttgattgcgggattaatgctgacgccgttctacgccggacgcggcaccaccttcgtgatcgacggcggcctgctgctggcgtttttctacctggtggtgattggcaccgcgctgacgttcagcctgtatctgaaaggcgcacagatgatcggcgggccgaaagcgagcattctgagctgcgccgaaccgctgagcagcgcgctgctgtcggtggtgttgctgggggtggcattcaccctgccggactggctggggacgctgttgattgtgtcgtcggtggtgttgatttcgatggattcacgcagaagggttaaggcatcggcgtag

SEQ ID NO: 3830 - DNA, 912 bp, Enterobacter cloacae
caaaacatcatgaaagcggatctgcgcacgctggatctaaacctgctgaaaacgcttgacgctctgctggatgaacgcagcgtcacccgcgcggcggcgcgtcttgctctgacccagcccgccgtgagcggcatgctcaaccgcctgcgggactacttcgacgatccgctctttatccgcgccccgcacggcatggtgccaaccacgcgcgcggaagcgctggccgctccggtgaagcgcattctcgcggatatcgacgtgctgcttcagcccgttgcctttgacccaaataccgctcgcctcaccttcactcttgccgctacggattatgcacttcgggcggttgttgtgccgtttatcgccgcccttaaaacacaggcgcctggcatacgcgtgcgcgtggtgcccgttacccccggtagccttgtcagccagcttgagcagggcgctattgacgtagcgcttatcaccccccacaccacgcccgatgagcttcacagccgtgcgctttatgatgaacggtacgtatgcatgatgcgcgccgatcatccaaacgccggagagccaatgacgttagaccgattttgcgcccttgagcatgtgctggtctcttacgagggagacggctttcgcggggtaaccgatagcgcgctggagaaaattggccggacgcggcacgtggggctctcggtgagccactttttggttctgccggacgtgctggccctcagcgatatgattgccgtcgtgccgtcacgcatcgcggaaaatcagacggggatgttcatctgcgagacgccagttccagtgccaggctttaccaagagcatggcctggcacggcagaacgcaccgcaatcccgcgcaggcgtggctgcgcgggctgttgctgcaaaccagtcagcgggcctga

SEQ ID NO: 3831 - DNA, 1341 bp, Enterobacter cloacae
gatatgggatctcaggtctgggttgtggcaacgctgcttgtcagcatcgtgttgattgttttaaccatcgtaaaactgaagtttcacccgttcctcgcgctgctgctggcaagctttttcgttggcgcgatgatggggatgagcccgctggatatggttaacgccattgagagcgggattggcggtacgctgggcttcctggcggcggttatcggtcttggcactattctcggcaaaatgatggaagtctccggcgcggcagagcgcatcgggattacgttgcagcgctgccgctggctgtcggcggacgtgattatggtcctggtcggcctgatctgcggcattacgctgtttgttgaagtgggcgtggtactgctgatcccgctggcgttttccatcgccaaaaagaccaacacgtcgctgctcaagctggccattccgctctgtaccgcactaatggcagtgcactgcgtggtgcctccgcatccggccgcactatttgtcaccaacaaattaggggcggacgtcgggacggtgattgtctacggtctgatggtgggcctgatggcgtctctggttggtggcccgctgttcctgaagctgctcggcaaccatctgccctataagccggttccggcggaattttcagacctgaaggtgcgggaagagcacactctgccgtcgctgggcgccacgctgttcaccgtgctgctgccgattgccctgatgctggtgaaaaccattgccgagctgaacatggcgaaagaaggctcgctgtataccctgctggagtttatcggcaaccccatcaccgcgatgtttatcgccgtgtttgtcgcctattacctgctggggatccgccagcacatgggcatgggcgcaatgctgacccatacggagcacggctttggctctatcgccaacattttgctgattatcggtgcgggcggggcgttcaacgccatccttaaaaccagtggtctggcggagacgctggcgcatattctctcgaacctgcatatgcaccctatccttctcgcctggctggtggcactggtgctgcacgccgccgtgggttcggcaacggtagcgatgatgggtgccacggcgatagtggcgccgatgctgccgctctacccgaacgtaagcccggagatcatcaccattgccatcgggtccggcgctattggctgcacgatcgtgaccgattctctcttctggctggttaagcagtactgcggcgcgaccctgaatgagaccttcaaatactatacgacggcgacgtttatcgcctcggtgcttgcacttggcggcacattcctgctttctttcattatctga

SEQ ID NO: 3832 - DNA, 756 bp, Enterobacter cloacae
tgtgcgcagagaggtctactggtgatctacaaatcaattgccgatcggctacggctgcggctgaattcttcggactacaacattggcagtccgttacccggagaaaaagcgctggcaaaggagtttggcgtagcccggatgaccgtccgcaaagcgctggatctgctggtaagctgggggctggttgaacgtcgacacggtagcgggacgttcgtggcgcgcaaagacgttcatcatgaaacgactaacctgactgggctggtggaggtattgcgccagcaggggaaagaagtgcaaagcaaggtgttgcagtttgaagtgatgcccgcgccgcccgccatcgccagccagctgcggattcaggttgatgagcggatctatttttcaaggcgggtgcgttacgtggacggaaaaccgctgatgctggaggacagctttatgccggtgaagctgttccgcaatctttccctggcgcatctcgaagggtctaagtttgattacatcgagaaggagtgtgggatcaccatcagcggcaactacgagagcctgacgccggtgctggctgataaacagctggccggttatatgaatgtgccggaacagacgccgctgctgcgcatcacttccctttcctacagcgacagcggcgagttcctcaattattccgtgatgttccggaacacaagcgattaccaggtggactaccatctgcggcgtatccacccggaagacttattagcccatcccccagaatag

SEQ ID NO: 3833 - DNA, 342 bp, Enterobacter cloacae
ataaccgaggctgatgattacagacagctgctaggagaggacaaatttctcgatcgcccaggcaacgccgtcttccaggttagatttggtcacgaagttcgccacttcttttaccgacgggatggcgttatccatcgccacgcccatgcctgcatattcgatcatcgcaatatcgttttcctggtcgcccagcgccatgatctcctcaggcttgatgcccagcgcatcggcaagcgatttgacgcccgtgcctttattgacgcgtttatcgaggatttcgaggaagtacggcgcacttttcagtacggtgtatttctcttttacctcagccggaatgcgtga

SEQ ID NO: 3834 - DNA, 1368 bp, Enterobacter cloacae
catttccccgataacttctggtggggcagcgcaagctccgctctccagacggaagggacacgagagggtgaaaccacgtgggactactggtttgcccgcgagccgaaccgttttcacaacggcgtggggccgcagcacacctccacgttttatcagcactggaaaacggacattcagctgttaaaacagctgaaccacaacagctttcgtacctcgattagctgggcgcgcctgatccccgacggcatcggtgaagtgaacccggacgcggtcgatttttacaatcaggtcattgatgagctgaatgaacagggcatcacgccgtttatcaccctgttccatttcgacatgccgatggcgatgcaggaaattggcggctgggaaaaccgtgacgtagtggacgcgtacgcccgctatgcacagatatgcttcgagctgttcggcgaccgcgtgctgcactggtttaccttcaacgagccgatcgtgccggtggaaggcggttatctgtacgacttccactaccccaacgtagtggatttccgccgggcggccaccgtggcgtatcacacggtgctggcccatgcgaaggcggttcaggcctaccgcgccgggcactacgcgggggagatcggcatcgtgctgaacctgacgccgtcgtatccgcgttcgcagaacccggcagacgtgaaggcggcgcacgttgcggatctaatgtttaaccgcagcttcctcgacccggtcctgcgcggcgaatacccggcggatctggtggcgctgctgaaatcttacgaccagctgcccgcctgcaagccggaagacggtttcctgattgcggaagggaaaatcgacctgctcggcattaactactatcagccgcgtcgcgtgaagtgtcgcgacagcgcggtgaacccgcaggcgccgtttatgccggagtggttctttgataattacgagatgccgggccgcaagatgaatccgtaccgcggctgggaaatctacgagccgggtatttacgatattctggttaacctgcgcgaccattacggcaacccccgctgctttatttcggaaaacggcatgggtgtcgaaaatgagcagcgctttattgaaaacggccagattaacgatcaataccgcattgattttatttctgagcatttatcgtggctgcacaaaggtattagcgaaggctgcaattgtcttggctaccatatgtggacatttattgataactggtcgtggtgtaatgcgtataaaaaccgctacggttttattcagctcgatgtagagacgcagcagcgcaccattaaaaaaagcggagagtggtttgccgccaccgccttaaataatagttttgataaagagtaa

SEQ ID NO: 3835 - DNA, 855 bp, Enterobacter cloacae
catttcaccaaccgatacgccatgaccatcaccgttttctgcattttactgttcgccgcactgctgcatgccagctggaacgccatcgttaaagccggaacggataaactctactcggcgatcggggtcagcggttcagccgcgcttattgccctgattttactgcccttctctcctcagccaactgccgcaagctggccatatttgttcgtctcctgtgcgttacaggtggtgtatacggtactggtggcaaaaacttatcaggtctccgacatgagccagacctacccccttatgcgcgggacggcccctctgctggtggcgctgatcagcgtaatggtgctcggggatcatctctcccggtttgcgtggtccggcatcggggtcatttgtctttcgattctggcgatggcgatgaacggccgcatgcagtcacgcaaggggctctggctggcgctgctgaacgcctgttttatcgccgggtataccctggtggacggcaccggtgtgcgactctcggacactgcgctgggctacacgctctggaccttcttcatgaacggtttctgtctgctgagctgggcaatggtggcgcggcgtcgcgaagcgtccagctacctgcgcctgcactggaaaaaagggctgctcggcggcgtcgggacgatgggatcttacggtctggcactctgggcgatgacccaggcaccgctggctgtggtcgccgcactgcgtgaaacctctattctcttcggcgcattaatcgcatttgtgcttttaaaagagaaggttgccggcctgcgcatcgcggcggcactgggtattgctgccggtgcgatcctgctgcgcctggcgtaa

SEQ ID NO: 3836 - DNA, 336 bp, Enterobacter cloacae
gtgatgatgagaaatgttctgattaagctggcgacgttcagcggggttgttttactttgcgggtgttcgagcgtgatgtcgcacaccggcggtaaagaaggaacatatccggggacgcgcgccagtgccgcaatgatctctgatgatgagacaaactggggtaccaaatctctggcgattcttgatatgccgtttacggcggttgccgatacgcttttgctgccgtgggatatgttccgcaccgacagctcagtgcgttcgcgcgttgagaaaagcgagcaggagacgctggcaaccaactccgtcatcccgcccgcagcgatgcctccacgctaa

SEQ ID NO: 3837 - DNA, 948 bp, Enterobacter cloacae
tacaattcatccatgaccgatacgctgaaagatattcccgttttcgttgcctccgttgaggcaggaagttttgcccaggccgccgtccgtctgcatttgtcgcgctcggcggtaggaaaaagcattgctcgtcttgaagagaggctgggggttcgtctgtttcatcggaccacccgcagccagaggctgaccgataacggcgcgcttttttatgaacgctgcctgcgcgcgctggaagagatccgtggcgctgaatcgcagcttgaaaccggaaaacatcaggtcagcggtcggctgcgtgttgccatgccggtgctgtttggtcgccagtgtatcgccccgctgctaatagagctggcgcaggagcatcccgggcttgagcttgaaatgtcctttagcgaccgcatcgtggatcttgtggaagaagggtttgatatggcggtgcgcaatggcaccctggctgacagcgccgtgctggtcgccagaaggctgggggtgcaccgaatggttctgtgtgccgcgccggattatctgattaagaatggccagccgcaaagcgttgatgatttacgccagtatacggccattaactacacgcgtgcgggcagagtcttaccctggcagctgatggattacgatggcacgtcgcgcacgtttattccccgctcatccctcaatatggatgatttgcaggcgatctgcgacgcggcgctggccggccacggtattgcatggttaccctgctggatggtcatcaaagaaattcatcagggaaatcttgtcccgctctttaagcaggccccggatgtacgcttcgacgttcatgccgtctggcagcagacgccacacctgccgctaagggtaagaattgccatagatatgctggtcaaacgtttaccggcagtgatgtcgctggagtttcctgcgtccataaaaaagccgcgctaa

SEQ ID NO: 3838 - DNA, 1446 bp, Enterobacter cloacae
agcgcggccagttatgttgtcgtaaagcgacgattaaatatcgatattcgccgccttcagggcgttctcttcgatgaaggcgcgacgtggttcaaccgcatcgcccatcagggtcgtgaacagctgatccgctgcgattgcgtctttaacggtgacgcgcagcatgcgacggctttccggatccatagtggtttcccacagctgatccgggttcatttcgcccaggcctttataacgctgaatagagaggccgcgacgggactctttcaccagccactccagcgcctgttcgaagctggctaccggttgacgacgctcgccacgttcgatgaacgcgtcgtcttcgatcagaccacgcagcttctcgccgagggtgcagatacggcggtattccggaccggtaacaaactcgtgctccagcgggtagtcggtatcgacgccgtgggtacgcacgcgaacaatcggctcgaactgctgctcagcgttctgctgaacgtcgaacttccactggctgccgtgctgctctttctcgttcagctcgctcaccagggtgttcacccagcgggtgacggtctgctcgttgctcagatcggcttcggtcagggtcggctgataaatcagctctttcagcagcgctttcggatagcgacgctccatacggccaatcattttctgcgtggcgttgaactcggaaaccagacgctccagcggctcaccggccagcgctggcgcgctggagtttgcgtgcagggtcgcaccatcaagggcgatcgcgatttggtactgatccatcgcgtcgtcatctttaatgtactgttcctgcttgccttttttcaccttgtacagcggtggctgcgcaatgtagacgtggccgcgctcaacgatttccggcatctgacgatagaagaaggtcaacagcagcgtacggatgtgcgagccgtcgacgtccgcatcggtcatgatgatgatgctgtgataacgcagtttgtccgggttgtactcgtcgcgaccaatgccgcagccgagcgcggtgatgagcgtcgccacttcctgagaagagagcatcttgtcgaagcgcgctttctcaacgttgaggattttacccttcagcggcagaatcgcctggttcttgcggttacggccctgctttgcagaaccgcccgcggagtccccttccacaaggtacagttcagacagcgccgggtcgcgttcctgacagtcagccagtttgcccggcaggcctgccaggtccagcgcgcctttacgacgggtcatttcacgcgctttacgcgccgcttcacgggcacgcgccgcatcgataattttacccaccacgattttcgcgtcggacgggttttccagcaggtattcgctcagcagttcgttcatctgctgttcaaccgccgatttcacctcagaagagaccagcttgtctttggtctgtga

SEQ ID NO: 3839 - DNA, 1059 bp, Enterobacter cloacae
ggagaacttcggatccggcaccttcacggagaccacggcaatcaggccttcacgggcatcgtcaccggtggcgctgactttcgcttttttactgtagccttctttgtccatgtaagcgttcagggtacgggtcatcgccgcgcggaagcccgcaaggtgcgtaccgccgtcgcgctgtggaatgttgttggtgaagcagtaaatgttttcctggaaaccgtcgttccactgcaaggccacttccacgccgataccgtctttttcagtagagaagtagaagatattcgggtgaattggcgttttgttcttgttcagatactcaacgaacgccttgataccaccttcgtaatggaagtggtcttctttgttgtcgcgtttgtcgcgcagacgaatcgacacgccggagttcaggaacgacagttcacgcaggcgtttcgccagaatgtcgtactcgaattcggtgacgttggtgaaggtttcaaggctcggccagaaacgcaccatggtaccggttttctcggtatcacccgtgacggccagcggcgcttcaggcacgccgtgctggtagatctgacggtgaattttgccttcgcgctggataaccagctccagcttctgcgacagggcgtttactacggatacgcctacgccgtgcagaccgccggaaactttataggagttatcatcgaacttaccgcctgcgtgcagaacggtcatgatcacttccgcagcagatacgccctcttccgggtgaataccggttgggatgccacggccgtcatcggtaacggacacggagttgtccgcatggatcgtgaccacgatgtctttacagtgacccgcgagcgcttcgtcgatagcgttatctaccacctcgaataccatgtggtgcagaccggtgccgtcatccgtgtcgccgatatacatacccgggcgcttacgcaccgcatccagccctttcaggactttgatactggaggagtcataagaattcgacatcaacgtttctcgctcatttcaacttgggttaatccgttattttacccttttccacggtaa

SEQ ID NO: 3840 - DNA, 291 bp, Enterobacter cloacae
gccagctttacgcgtcgtagttcaggttgcagatgcgttggctgcgttccctcaccccagtcacgtacctatgtacgctcctggggattcgctcacttgccgccttcctgcaacccgaactacttagcgtatccgggaggggtcctaaacgaaaaaccccgcccggtttgcgccggcggggttttggattcgtgtgttgatccagtccctacggcgcattgccgacgaccaccaccacacgcacgacgaccactgcggcaggttgcgcagtttttagtagggtcgaagtga

SEQ ID NO: 3841 - DNA, 1230 bp, Enterobacter cloacae
tcacttattcttcatttatctcttttggcaaaagtattcagcgacatgaaaaagcaacggaacgtgaacttattgttgatgctggtgttactggtggccgtcgggcagatggcgcaaaccatctacattccagcgattgccgatatggcaaaagatctgagcgtccgcgaaggtgcagtacagagcgtgatggcagcctatctgctaacctatggcgtttcacagctggtttatggtcccctgtccgatcgcgtcgggcgtcgtccggtcattctggtgggcatgagcattttcatggtagcgacgatgatcgccattaccactcacagcctgaccgtcctgattgccgccagcgcccttcagggtgtgggcaccggcgtcggcggggttatggcgcgtaccctgccgcgtgatatgtaccagggcacacagcttcgccacgccaacagtctgttaaatatgggtattctggtcagcccgctgctggccccgctgattgggggtctgctggacaccgtctggtcctggcgcgcctgttacgccttcctgctggtgctgtgcattattgtcaccttcagcatggggcgctggatgccggaaacccgcccaaaagacgcgccgcgcacgaagctcatcgccagctacaaaacgctgttcggtaatgggtcctttacctgttatctgttgatgctaatcggcggcctggcgggcattgcggtgtttgaagcctgttccggcgtgctgctgggcgcgggccttggcctgagcagtatggtggtgagtattctgtttattctgccgatcccggcggcgttcttcggcgcatggttcgccggacgtccgaacaagcgtttctccaccctgatgtggcagtcggtgatcagctgtctgctggccgggctgatgatgtggatcccggggctgtttgacgtgatgtcggtctggacgttgctcatcccggcagcgctgttcttcttcggcgcgggcatgctgtttcccctcgccaccagcggcgcgatggagccgttcccgttcctcgcaggcacggcaggcgcgctggtgggcggtttgcagaacatcggttccggcgcgctggcctggctttcggctatgatgccgcagaccgggcaggcgagtttaggcttgctgatgaccctgatggggctgctgattttgctgtgctggctgccgctggcgtcgcgtgtctcgcatcacgaacagccggtttaa

SEQ ID NO: 3842 - DNA, 1389 bp, Enterobacter cloacae
gaccttcaaatactatacgacggcgacgtttatcgcctcggtgcttgcacttggcggcacattcctgctttctttcattatctgagcgcgaagagacgtattatggaaaacgcaactatcactactttaaccgcacagtttcctctggttgaggatctgattgccctgaaagaaaccacctggcttaacccgcgcaccacgacgctggcggaaggattgccgtatgtcgggctgacgaaagccgacgtagacgacgcgcacgcgcgcctgaaacgcttcgcgccgtatctggcgaaagcgttcccggaaacggcggcaacgggcgggattatcgaatccgacctggtcgcgatcccggcgatgcaggcgcggctggagaaagaatttgcgaagcctgttacaggcccgctgctgctgaaaaaagacagccatctgccgatttccggctcgatcaaagcgcgcggcggcatctatgaggtgctgacccatgcggagaaactggcgctggaagccgggttgctgagcgttgaagacgactacagcgttctgctggagccgcgctttaaggacttcttcagccagtacagcatcgcggtgggctcaaccggcaacctggggatgtccatcggcattatgagcgcacgcattggctttaaggtgaccgtgcatatgtccgccgacgcccgcgagtggaagaaagccaaactgcgcagccacggcgtgatcgtcgtggaatatgagcaggattacggcgtggcggtggagcagggacgcaaagcggcggaaagcgatccgaactgtttcttcattgacgatgaaaactcccgtacgctgttcctgggctatgcggttgctggcgagcgcctgaaggcgcagtttgccgagcagggccgcgtggtggatgccgatcatcctctgtacgtctacctgccgtgcggcgtcggcggcggccccggcggcgtggcttttggcctgaagctggcctttggcgataacgtccactgcttctttgcggagccaacgcactcaccgtgcatgctgctgggcgtttataccgggctgcacgatgaaatcgccgtgcaggacctgggtattgataacgtgacggcggcggacggactggcggtaggacgtgcctccggcttcgtgggccgcgcgatggagcgcctgctcgacgggttctataccctctccgatcaaagcatgtacgacatgctcggctggctggcgcaggaggaaaggattcgcctggagccgtcggcgctggcggggatggccgggccgctgcgcgtcgatgccgatgagaacgttacccacctggtgtgggcgaccggcggcggcatggtgccggaagacgagatggcgaaatatttagcgaaagggaagtaa

SEQ ID NO: 3843 - DNA, 1983 bp, Enterobacter cloacae
catcttacaaggagaaaaaaagccatgagccaaatacacaaacacgacattcccgcaaacattgcggaccgttgcctgataagtccggagcagtaccaggagaaataccagcagtccgtttccagccctgacgcgttctggggtgagcagggtcacatcctcgactggatcaaaccttatcagaaggtaaagaacacctctttcgcgccgggcaacgtctccattaaatggtatgaagacggcacgctgaacctggcggcgaactgcctggaccgccatcttgccgaacgcggcaacgaaacggctatcatctgggaaggcgacgatgcctctcagagtaaacacatctcgtataaagaactgcatcgcgacgtgtgccgctttgccaacgtgctgctggcccagggcattaaaaaaggcgatgtagtggcgatctatatgccaatggtgccggaagcggcggtggcgatgctggcctgcgcgcgcatcggcgcgatccactccgttatcttcggcggcttctcgccggaggcggttgccgggcgtattgtcgactcgaattcgaagctggtgatcaccgctgacgaaggcgtgcgcgccgggcgcggtattccgctgaagaaaaacgttgatgaagcgctgaaaaacccgaacgtgaaatccatcagtaacgtcattgtcttcaaacgcacgggcggcaaaatcgactggcacgaggggcgtgacctgtggtggagcgatctgattgaaaaagcgagcgaccagcatcagccggaagagatgaacgcggaagatccgctgtttattctttatacctccggctccaccggcaagccgaaaggcgtgctgcatactaccggcggctatctggtttacgcggccaccacctttaaatacgttttcgactaccatccgggcgacatctactggtgtaccgccgacgtgggctgggtcaccggccacagctacctgctgtacggcccgctggcctgcggcgcaacgacgctgatgtttgaaggcgtaccgaactggccaacgccggcgcgtatgtgccaggtggttgataagcatcaggtcaacattctctacaccgcgccaacggcgatccgcgcattaatggcggaaggcgataaagccatcgaaggcacggaccgctcttccctgcgcatcctcggctccgtgggcgagccgatcaacccggaagcctgggagtggtactggaagaagatcggcaacgagaagtgcccggtgatggacacctggtggcagaccgaaaccggcggctttatgatcaccccgatgccgggcgccacgcagctgaaagccggttcggccacccgtccgttcttcggggtacagcctgcactagtggataacgaaggcaatccgcaggaaggcgccaccgagggcaatctggtgatcgtcgattcctggcctggccaggcgcgtaccctgttcggcgaccacgagcggttcgagcagacctacttctcgaccttcaaaaacatgtacttcagcggcgacggcgcgcgccgggatgaagacggttattactggatcaccggacgcgtggacgacgtgctgaacgtctctggccaccgtctgggcacggcggagattgagtctgcgctggtgtcgcatccgaagattgccgaagcggcggttgtcggcattccgcacaacatcaagggccaggcgatctacgcctacgtcaccctgaaccacggcgaagagccgtcgccagagctgtataccgaggtgcgcaactgggtgcgtaaagagatcggcccgcttgccacgccggacgtgctgcactggaccgactcgctgccgaaaacccgttccggcaagattatgcgccgtatcctgcgcaaaatcgcggcaggcgacaccagtaacctcggtgatacctcaacgctcgcggatcctggcgtggtggacaaactgctcgaagagaagcaggccatcgcaatgccttcataa

SEQ ID NO: 3844 - DNA, 1680 bp, Enterobacter cloacae
cagagaagttctgcgcgaggtaaaagcatcatgaagagaattctgacggcgctcgccgccacacttccctttgctgcccatgcagcagatgccattaccggcgaggtccagcgccagccaaccaactggcaggcgattatcatgttcctgattttcgtggtgctgacgctgtatatcacctactgggcgtcgaaacaggtgcgctcccgtaacgattactacaccgcgggcggcaacattaccggcttccagaacggtctggcgattgcgggagactttatgtctgccgcctcgttccttgggatctccgcgctggtgtatacctcagggtatgacggcctgatctactccctcggcttccttgtcggctggccgatcattctgttcctgattgccgagcgcctgcgtaacctggggcgctatacctttgctgacgtcgcctcctatcgcctgaagcaggggccgattcgtaccctctccgcctgcggttcgctggtggtggtggcgctgtacctgattgcgcagatggtgggcgcgggtaagctgatcgagctgctgttcggcctgaactaccacatcgcggtggtgctggtgggcgtgctgatggtgatgtatgtcctgttcggcggcatgctggccaccacctgggtacagatcatcaaggcggtactgctgctgttcggcgccagctttatggcctttatggtgatgaagcacgttgggttcagcttcaataatctgtttaccgaagccatgtcagtgcatccgaaaggggaagcgatcatgagcccgggtgggctggtgaaagatccgatatccgcgctctcgctcggtctcggcctgatgttcggtaccgcaggtctgccgcatatcctgatgcgcttcttcacggtgtcagatgcgcgtgaagcgcgtaagagcgtgttctacgccaccgggtttatgggctacttctacattctgacctttatcatcggctttggcgcgatcatgcttgtgggggcaaacccggcgtttaaagacgcggcgggcgcgcttatcggcggtaacaacatggcggcggtgcatctggccgacgcggtgggcggcaacctgttccttggctttatctctgccgtggccttcgccaccatcctcgcggtggttgcagggctgacgctggccggcgcgtcggcggtctcgcatgacctctacgccaacgttttccgtaaaggcgcgagcgagcgcgatgagctaaaagtctccaaaatcaccgtgctggtgctgggcgtcgtcgccatcctgctggggattttgttcgagaagcagaatatcgcctttatggtcgggctggccttctcgattgcggcaagctgtaacttcccgatcattctgctctccatgtactggtcaaaactgaccacccgtggggcgatgattggcggctggctggggctgctgacggcggtgatcctgatgattctgggcccaacgatttgggtgcagatcctcggtcacgaaagcgctatcttcccgtatgaatacccggcgctgttctccattgccgtggcgtttatcggtatctgggtcttctcggctaccgacaattcgccggaaggtaacctggagcgcgagaaattccgcgcccagtttattcgttcacaaaccggtcttggcgttgagcagggccgtgcgcactaa

SEQ ID NO: 3845 - DNA, 1203 bp, Enterobacter cloacae
aggatggcagatatgaagatcaagactggcgcacgcgttttcgcattgtccgccctcgcagcaatgatgatttccgcaccggctctcgccaaaattgaagaaggtaagctggttatctggattaacggcgacaagggctataacggtctggccgaagtgggcaaaaaattcgagaaagacaccggtatcaaagtcaccgtagagcacccggacaaactggaagagaagttcccgcaggttgcggcaacgggcgatggtccggacattatcttctgggcgcatgaccgtttcgggggctacgcgcagtctggcctgctggcagaagttacgccagacaaagccttccaggacaaactgttcccgttcacctgggacgccgttcgctataacggcaagctgatcgcttacccaatagcggttgaagccctgtcactgatttacaacaaagacctggtgccaaacccaccgaaaacctgggaagagatccctgctctggataaagagctgaaggcgaagggtaaatccgctctgatgttcaacctgcaagaaccgtacttcacctggccgctgattgctgccgacggcggctacgcgttcaagtttgaaaacggcaaatatgacgtgaaagacgtgggcgtggacagtgcgggcgcgaaaaaaggtctgaccttcctggttgacctgattaagaacaaacacatgaacgcggatacggactactccatcgcggaagcggctttcaacaaaggcgaaaccgcgatgaccatcaacggtccgtgggcctggaccaacatcgacaagagcaaaatcaactacggcgtgaccctgctgccaaccttcaacggcaaaccgtctaaaccgttcgtgggcgtgctgagcgcaggcatcaacgccgccagcccgaacaaagagctggcgaaagagttcctcgaaaactacctgctgaccgatcagggtctggatgaagtgaacaaggacaagccgctgggcgccgttgcgctgaaatccttccaggatcagctggcgaaagatccgcgtattgcggccaccatggataacgcccagaaaggcgaaatcatgccgaacatcccacagatggctgcgttctggtacgccacccgtaccgcggtcatcaacgctgcaagcggtcgccagactgtcgatgccgcactgaaagatgctcagggccgtattactaagtaa

SEQ ID NO: 3846 - DNA, 909 bp, Enterobacter cloacae
  unsure (744)
ctaaggagggcactgaacatggcaatggtacaacccaaatctcagaaactgcgcctcctcgcgacgcacttaggcctgctgattttcatcgcggcgatcatgttcccgctgctgatggttatcgccatctccctgcgttcggggaacttcgccaccgggagcctgatccctgacgaaatctcctgggagcactggaagctcgcgctgggcttcagcgtggaacacgcggatggccgcgtcacgccgccgccgttcccggtgctgctgtggctgtggaactcggtgaaggtggcaaccatcacagccatcggcatcgtgacgctctccaccacctgtgcttacgccttcgcccgtatgcgttttccgggcaaagcgaccctgctgaaagtgatgctgattttccagatgtttccggccgtactgtcgctggtggcgttatatgcggtctttgaccgtctgggccagtacgtgccgttcatcggcctgaacactcacggcggcgtgatcttcgcctatctcggcggtatcgccctgcacgtgtggaccattaaaggctatttcgaaaccatcgacggctcgctggaagaagcggcggcactggatggcgcgacaccgtggcaggcgttccgcctggtgctgctgccgttgtcggtgccgattctggcggtggtgtttattctgtcatttatcgcggcgatcaccgaagtaccggtcgcctctctgttactgcgcgatgtaaacagntacaccctggccgtcggtatgcagcagtatctcaacccgcaaaactacctgtggggcgactttgccgcggcggccgtcctctctgccatcccgattaccgtggtgttcctgctggcccagcgctggctggtcaacggcctgacggcgggcggtgtgaaaggttaa

SEQ ID NO: 3847 - DNA, 282 bp, Enterobacter cloacae
gcggatcttcagccaggttgttcacctcaagcaggttgtcgccgccgagcaacgttttcacgatgcgggaatgctgcgtcacgatggtggcctgatcctgcgtcacccatttctgctgcccgttttcatcgaaagcgagcaccacaaacagttgcggaccatcgtttagctgcatgtactggctggcatacggcatgttctgaagttcgtcatcggtcagatgcacgcccggcgtgccgaacatgctgtcccacagtgagtggcccagccctttggtggtag

SEQ ID NO: 3848 - DNA, 348 bp, Enterobacter cloacae
aacaaaccaaccttacttctggagatttctgtgatgaataacgatatttgtcagcagatagagaatagtgcgcactacagggagctcgtcgaaaaacggcaacggtttgccttcttgctttccatcatcatgctaattatctacgtcggctttattctgctgatcgcctttgcgccgcactggctgggcaccccgctgcatgagggtaccagcgtcacgcgcggtattccgattgggattggcgttatcatcatttcgtttgtgctcacgggtgtgtacgtctggcgtgcgaacggtgaattcgatcgtcttaacagagaagttctgcgcgaggtaaaagcatcatga

SEQ ID NO: 3849 - DNA, 897 bp, Enterobacter cloacae
tttcgaggaataatcatggacataagaacgctgcgctattttgtcgaggtggttcgccagcaaagttttactcgcgcagcggagaagttattcgtaacccagccgaccatcagcaagatgctgaaaaacctcgaagatgagctgaactgtacgctgctgatccgcgacgggcgcaagctactgctgaccgataccggtcgcgtagtgttcgagcgcgggctggccattctggcagagttccgccagctggaggccgagcttggggacatcaaccacctgacaaaagggctgctgcggctcggtattccgccgatggtcggcatgatgatggccgggccgataagcttgtttcgccagcgctaccccggcgttgagctaaaaatttctgaatttggcggcctgaccgtgcagcaggcggtgatgaacggtgaactggacgtggccatgacggcccttcccgtagaggaggaaagcggcctggcgacgctgccgctgttcagccacccgctgtgcgtgctggtgccgcgctccggcgactggctgaagatagacgcagtaaaacccgagctgctcggcgaacacccgctgctgatttacaacgaagattttgccttaagccgccagctgatggcactgtttaaccagcacaacgtaaagccgcgcattgcggtgcgcagcggccagtgggattttctggcggcgatggtacaggcgggcgtggggattgccattctgccgcagccgatctgcgagcggctggataaaaacacgctgcgctggatcccgctggagagcgacctgcactggcagctggggatgatctggcgtgaaggggtctatctgtcgcacagcgcgcaggcgtggttgcaatgctgtgaggggttttgggtgccctga

SEQ ID NO: 3850 - DNA, 240 bp, Enterobacter cloacae
aaagtcgggctattcgaaaggtatttacagagaatgttccgcaccgtaatgcatcaaacgctgggtgattacattcgccagcgcaggctcctgctggcggcgcaggcgttacgctcaacgcagcggcccatttttgatatcgcaatggatctgggctatgtgtcgcagcagaccttttcccgcgtcttccgccgcgagtttgaccgtacgccgagcgactaccgccatcagctcaattaa

SEQ ID NO: 3851 - DNA, 333 bp, Enterobacter cloacae
cgagaaacattgtttcattccagttcgtctgttttgtcgaggatgagttttatggcaaccattaccaccagcatggtgctcctgcgctggccgttgttgagcgcggttttgatgttcctggccagcacgttaaacattcagttccgaaagtccgactacgcaggtcttgctgtgattagcaccctgttagggttaggcgccgcatgctggttcgcaacaggtttgctcggtattacgctggtggatatagccgccgtctgggaaaacattaaagtggtgatggttgaagccatgagccacaccccaccagactggccgatggtgattacctga

SEQ ID NO: 3852 - DNA, 2823 bp, Enterobacter cloacae
atggataagatcgaagttcggggcgcccgcacccacaatctcaagaatatcaacctcataatccctcgcgacaaactcatcgtcgtgaccgggctttcggggtctggcaaatcctcactggctttcgacactttgtatgccgaaggacagcgtcgttacgttgaatcgctctcggcgtacgcgcgtcagttcctgtcgctgatggaaaaaccggatgtcgaccacattgaagggttgtctcctgctatctccattgagcagaaatccacgtcgcataacccgcgatccacggtcggtaccattaccgaaatccatgactacctgcgtctgctgtatgcgcgcgtgggcgagccgcgctgcccggatcacgacgttccgctggcggcccagaccgtcagccagatggtggataacgtgctgtcgcagccggaaggcaaacgcctgatgctgctggcgccgatcattaaagagcgtaagggcgaacatactaaaacgctggaaaatctggcaagccagggctatatccgcgcccgtatcgacggcgaagtgtgtgacctgtccgatccgccaaagctggagctgcaaaagaaacacaccatcgaagtggtgattgaccggtttaaggtccgtgaagatctggcgacgcgtctggcggaatcctttgaaacggcgctggaactgtcgggcggcacggcggtggtgtcagacatggacgatgcaaaagcggaagagctgctcttctccgccaactttgcctgcccgatttgcggctacagcatgcgcgagctggaaccgcgcctgttctcgttcaacaacccggcgggcgcgtgcccgacctgtgacggcttgggcgttcagcagtatttcgaccctgatcgcgtgatccagaatccggagctgtcgctggcgggtggcgccattcgcggctgggacaagcgtaacttctattacttccagatgctgaagtcgctggcggagcactacaagttcgacgttgaagccccgtgggccagcctgagcgcgaacgtacataaagtgatcctgttcggttccggcaaagagaacattgagttcaagtacatgaacgatcgcggtgacacttccgtgcgtcgccacccgttcgaaggggtgctgcacaacatggagcgccgctacaaagagaccgaatccagcgcggtgcgtgaggagctggcgaagttcatcagcaaccgctcctgcgccacctgcgagggcacgcgcctgcgccgcgaagcgcgtcacgtgtttgtcgaaaacacggcgctgccgaccatctcagacatgagcattggccacgcgatggacttcttcaacaacctgaagctctccggccagcgcgcgaaaatcgctgaaaaagtgctgaaagagatcggcgatcgcctcaagttcctcgtgaacgttggcctgaactacctgacgctttcccgctcggctgaaacgctctccggcggtgaagcccagcgtatccgtctggcgagccagattggcgcaggcttagtcggcgtgatgtacgtgctggatgagccgtctatcggcctacaccagcgcgacaacgaacgcctgctcggcacgctggttcacctgcgtaaccttggcaacactgtgattgtggttgagcacgacgaagacgccattcgcgccgctgaccacgtgatcgacatcggcccgggcgctggcgtgcacggcggacaggtggtggcagaagggacgctgaaagacattatggcggtgcccgagtcgctgaccggccagtacatgagcggcaagcgcaaaattgaagtaccaaaacagcgcgtggcggcgaacccggaaaaagtgctgaagctaaccggggcgcgcggcaacaacctgaaggacgtgaccctgacgctgcctgtcgggctgttcacctgcatcaccggcgtgtccggttccggtaaatcgacgctgatcaacgatacgctgttcccgattgcgcagacggcgctgaacggcgcgacgctggctgaacctgcaccgtaccgcgacattcaggggctggagcatttcgacaaggttatcgacatcgaccagagcccgattggccgtacgccgcgttccaacccggcgacctataccggcgtctttacgcccgtacgtgaactctttgccggcgtgccggaagcgcgttcgcgcggctatacgccaggccgtttcagctttaacgtgcgcggcggccgttgtgaagcgtgccagggcgacggcgtaatcaaggttgagatgcacttcctgccggatatctacgtgccgtgcgaccagtgcaaaggcaagcgctataaccgcgaaacgctggagataaagtacaaaggcaagaccatccacgaagtgctggatatgaccatcgaagaggcgcgcgagttctttgacgccgtccctgcgctggcgcgtaagctgcaaaccctgatggatgtgggtctgacctatatccgtctggggcagtcagcgacaacgctgtccggcggtgaagcgcagcgcgtgaagctggcgcgtgagctgtccaaacgcggtaccggtcagacgctgtacattctggatgagccgaccaccggcctgcattttgcggatatccagcagctgctggacgtgctgcaccagctgcgcgatcagggcaacaccatcgtggtgattgagcacaacctggacgtgattaaaaccgcggactggattgtcgatctcggcccggaaggcggcagcggcggcggtgaaatcctcgtctccggtacgccagagaccgttgcagagtgcgaagcctcgcacaccgcgcgcttcctcaaaccgttgctgtaa

SEQ ID NO: 3853 - DNA, 303 bp, Enterobacter cloacae
cgttttcgagacggtttcggttttggtctggctacgtccggtcacgaagtaaatgctgtcgccgcgctttacgtgcatggcgatcagcgcgcgggcaacctctttcgggatactgaactcatcccagccgttgttcatcttttcccagaattccgggtttttcagataggcttcgctgtccggggagtacgtttttttgccgcgccagaaaccggggctggagaagagaacggtatcgtcaatatcgaagcccacggccatcggcgggcgacccgtcaggctgttttcaatttgtgccactga

SEQ ID NO: 3854 - DNA, 1110 bp, Enterobacter cloacae
cccggcgacctgataatcacgctcacgaggttcagtctgtttgttgaagggtttgtttcctgccatagtgaatggagttaccgagataaagagtgggtcgaaagattaccacattctggaggaagcatggcaacacgtattgaatttcacaagcatggtggccctgacgtactcaaagcggtggaatttacccccgctgcgcctggcgagaacgaaatccaggtggaaaacaaagctatcggcattaactacatcgatacttatattcgcggcggcctctatccgcctccgtcgatgccgagcgggctgggcacagaggcggccggcatcgtcagcaaagtgggcagcgcggttaagcacattaaggaaggcgatcgcgtggtgtacgcgcagtcggcgctgggcgcttacagctccatccataacgttccggccgagaaagcggcgcttctgccaaatgcgatcggcttcgagcaggctgccgcctcattcctgaaagggctgacggtctattatctgctgcgtaaaacctacgaaattaagcctgacgagcaattcctgtttcacgcagccgcaggtggcgtggggctgattgcctgccagtgggcgaaagccctgggcgcgaagctgatcggcaccacaggcagcgcgcaaaaagcgcagcgtgcgctggacgcgggcgcatggcaggtgatcaactaccgggaagagagcatcgttgagcggctaaaagagatcactggcggcaaaaaggtccgcgtggtgtatgactcggtggggaaagacacctgggaatcttcgctggactgcctgcaacgtcgcgggctgatggtgagcttcggtaacgcctccggggctgtcaccggggtgaacctgggcattctgaatcagaaaggatcactgtacgtcactcgcccttccctgcaaggttacatcaccaaccgggaagaacttgaggaagccagcaacgagctgttctcgctgatcgccagcggggtgattaaagtggatgtggcagaggcgcagaaatatccgctgaccgatgcgcaacgtgcgcatgaggtgctggagagccgggcaacgcaggggtcgagtctgttaattccctga

SEQ ID NO: 3855 - DNA, 2502 bp, Enterobacter cloacae
cgggtaacaacagaaattttgcgcgctttctgttatccttgcgccgcaattgcattattaaccagaggctttacatcgtttatgtccggctggccacgaatttactacaaattacttaatttaccattaagcgtcctggtaaaaagtaagtctatcccagcagaacctgcgctggaattagggctcgatacgtcgcgccctattatgtacgttttgccttataactcgaaggcagacctgctgacgcttcgcgctcaatgtctggcgcacgatttacctgacccacttgaaccgctggaagtcgacggtacgctgctgccacgctacgtgttcatccatggcgggccgcgcgtgttcacctattacacgccgaaagaagagtccattaagctgttccatgattacctcgatctgcaccgcagcaaccccgatctggacgtgcagatggtgccggtgtcggtgatgtttggccgtcgtccggggcgcgaaaaaggggaagagaacccgccgctgcgtatgctcaacggcattcagaagtttttcgccgtctcctggctgggacgcgacagttttgtccgcttctcaccttccgtttcactgcgccgcatggcggatgaacacggcactgacaaaatcattgcgcaaaagctggcgcgcgttgcgcgtatgcactttgcacgtcagcgtctggcggccgttggaccacgtctcccggcacgtcaggatctgttcaacaagctgctggcttccaaagcgattgcccgtgccgtagaagatgaagcgcgcagcaagaaaatttcgcacgagaaagcgcagcagaacgcaatcgcgctgatggaagagatcgccgcgaacttctcctacgagatgattcgcctctctgaccgtatcctcggcttcacgtggaaccgcctctatcaggggattaacgtccacaacgccgaacgcgtgcgtcagttagcgcacgacggccacgagattgtctatgtgccctgccaccgcagccacatggactacttgttgctctcttacgtgctctatcaccaggggttggtgccaccgcatattgctgccggtatcaacctgaacttctggccagcaggcccgattttccgccgtctgggtgcgttcttcattcgtcgtacctttaaaggtaacaagctttactccaccgtcttcagggagtatctgggcgagctgttcagccgcggttattctgtggagtactttgttgaaggcggtcgctcgcgtaccggtcgtctgctcgatccaaagaccggcacgctgtcgatgaccattcaggccatgctgcgtggcggtacccgtcctatcacgctggtgccgatttacatcggttatgaacacgtgatggaagtgggcacctacgcgaaagagctgcgcggtgcaaccaaagagaaagagagtctgccgcagatgctgcgtgggctgagtaaattgcgcaacctcggccagggatacgtgaactttggcgagcccctgccgctgatgacatatctgaaccatcatgttccggagtggcgcgagtctatcgatcctatcgaagcggtacgtccggcctggctgacgccaacggtcaacggcattgcatccgagctgatggtacgcatcaacaatgctggtgcggcaaacgccatgaacctgtgttgtactgcgcttctggcctctcgccagcgttcactgacccgcgaacagctgaccgagcagattgactgctacctggatatcatgcgcaacgtgccgtattccgtggattcgaccgtgccgtctgccaccgccagcgagctgatcgatcacgcgttgcagatgaacaagttcgaagtcgagaaagatacgattggtgacatcatcattctgccgcgcgagcaggccgtgctgatgacctactaccgtaataacatcacgcacatgctgatgctgccgtcgctgatggcggccattattacccagcaccgccgtatttcgcgtcaggagctgctgcgccatattcaggccatctacccgatgctgaaagcggagctgttcctgcgctggagtaaggatgaactggcggcagagctcgataaaatgacggcagagatgcatcgtcaggggctgattaccatcagtgatgatgaactgcatatcaatccgtcacgttcacgtaccttgcagctcctggcttccggtgcgcgtgagacgttgcagcgctacgccattaccttctggttgctgagtgcaaatccgtccatcaaccgcggtacgctggaaaaagagagccggacgctggcccagcgcctctccgttctgcatggcattaacgccccggaattcttcgacaaagcggtattcagctccctggtgctgacgctgcgcgacgaagggtacattagcgatacgggcgatgccgagccggaagagacgatgaaggtttaccagatgctggcagagctgattaccgcggatgtgcgtttaacgattgagagttcgacgcagggcgaatga

SEQ ID NO: 3856 - DNA, 1557 bp, Enterobacter cloacae
aggaagaaccccatggatgtcattaaaaagaaacactggtggcaaagcgacgcactgaagtggtcagtgataggtctgctgtgtctgctggtgggttaccttgttgttttaatgtacgtgcaaggggaatacctattcgccatcatgacgctgattttaagctcggttggcctgtatattttcgccaaccgtaaagcgtatgcctggcgctatgtttacccgggcgttgccgggatggggctgtttgtcctctttccgttgatctgcaccatcgcgattgcctttaccaactacagcagcaccaaccagctcgcgcaggagcgtgccacccaggtgcttctggaccgttcttatcaggcgggtaaaacctttaacttcggcctgtatcctgcgggtgatgagtggaagttagcgctcactgacggtgagagcggcaaaacctatctttccgacgcgttcaaatttggcggtgagcagaagctgaccttaaaagaggctgcggccctgccggaaggtgaacgtgccaacctgcgtatcatcacccagaatcgccaggcactgacccagctcaccgccgtactgccagacgaaagcaaagtgatcatgagctcgctgcgccagttctccggcacccaaccgctctataccctggcggatgacggcacgctgaccaacaaccagagcggcgtgaagtaccgcccgaacaacgatatcggtttctatcagtcggtgaatgccgacggcagctggggggatgacaaactcagcccgggctataccgtcaccatcggctgggacaactttacccgcgtatttaccgacgaaggcattcagaaaccgttcttcgccatcttcgtctggacggtggtcttctcggtgctgaccgtgatcctgaccgtggccgtgggcatggtgctggcctgcctcgtgcagtgggagtccctgaagggcaaagcgatttaccgcgtgctgctgattctgccgtatgccgtaccgtcgtttatctcgattctgattttcaaagggctgtttaaccagagcttcggtgaaatcaacatgatgctgagcgcgctgttcggcattaaaccggcctggttcagcgacccgaccaccgctcgctcgatgattatcatcgtgaacacctggctgggctatccgtacatgatgatcctgtgcatggggctgctgaaggccatcccggacgacctgtacgaagcctcggcgatggacggcgcgggtccgttccagaacttcttcaaaattaccctgccgctgctcattaagccgctgacgccgctgatgattgccagcttcgcctttaactttaacaacttcgtgctgattcagctgttgaccaacggtggtccggaccgtctcggtacgactacgccagcaggctataccgacctgctcgtgagctacacctaccgcatcgccttcgagggcggcggcggtcaggacttcggcctggcggcggcgattgccaccctgatcttcctgctggttggcgccctggcgattgtgaacctgaaagccacacgtatgaaatttgactaa

SEQ ID NO: 3857 - DNA, 552 bp, Enterobacter cloacae
ggcgcagccgccaccgggcaagattttctgcggcctgatgccctcaccccagccctctcccacagggagagggagataataagtagtgagtacttacatcacagctgcaaacgcctgcgccacgcgctggacgttgctggcattcagacccgccacgcacatacggccgctggcgatcaggtagacaccgaactcttcacgcaggcgatcgacctgcgctgcgctcagtccggtgtagctgaacatcccgcgctgcttgagaagataatcaaagttatgcccaggcacggcctctttcaggacgttaaccagctcctgacgcatcgacaggatgcgcttacgcatcgcttccacttccgcaagccaggtggctttcagtctttcgtcaccgagaactgtcgccaccacctgcgcaccaaagttcggcgggctggagtagatacggcggaccgtcgctttcagctggccgagtacgcgtcccgcggcttcggcgtcttcacacaccacggacagaccgccaacgcgctcgccgtacagggagaagatttttga

SEQ ID NO: 3858 - DNA, 522 bp, Enterobacter cloacae
gaaggagttgctgaccagagcgggaagccccgcgctggcaatcgcgcgaatggcgtaggcgtcttcttccatgcccgcgccaaagccctgataggcgatgtcgaggaacgggatcaggttacgcgccttcagtatctcgatcaccgcatcccactgggcattggtgaggtccgcacccgtcgggttatggcagcacggatgcagcaatacgatgctgcgctccggcagggtgttcagtttttccagcagcgcatcaacgcgcacgccgttcgtttcgctgtcgaaccacggataagtttcaaccttaaagcccgcgccctcgaagatcgcaacgtggttttcccacgtcgggtcgctgacccacacgccggaatccgggaagtactttttcaggaaatctgcgcctaccttcagcgcacccgagccacccagcgtctggatagtcgctacgcgcttttgcgcgagcaccgcgtggtccgcaccaaacagcagcggcgcgatagtgttgcggtaggtgtttaa

SEQ ID NO: 3859 - DNA, 552 bp, Enterobacter cloacae
agtgagagttttcaccccttaccacatccgaggtgcccgatggacaagtccacaaaagagctgttagcgcaagctgaaaagctgtgcgcgcaacgcaatgtgcgcctgaccccgcagcgccttgaggtactgcgtctgatgagcctgcaacagggcgccatcagcgcctacgatctgctcgatctgctgcgtgaaagcgagccgcaggcaaaaccgccgaccgtttatcgggcgctggattttctgctggagcaaggatttgtgcataaagtggaatcaacaaacagctatgtgctgtgccatctttttgaccagccaactcacacgtccgccatgtttatctgcgatcgctgtggtgtggtgaaggaagagtgtgcggaaggtgtggaagatattatgcatacgctggcagccagaatgggctttgcgctgcgacataacgtgattgaagcccacggcttatgttctgcctgcgtggaggtggagtcatgccgtcatcaggatgactgtcagcacgatcactctatcctggtgaagaaaaagccgcgttaa

SEQ ID NO: 3860 - DNA, 216 bp, Enterobacter cloacae
tcgggatctggtacaacaacttcttcggcgctgaaaccgaagcgattctgccgtacgaccagtacatgcaccgctttgcggcctacttccagcagggcaacatggaatccaacggcaagtacgttgaccgtaacggcaacgcggtggattaccagactggcccaatcatctggggcgagccgggcaccaacggtcagcacgcgttctaccagctga

SEQ ID NO: 3861 - DNA, 2139 bp, Enterobacter cloacae
tgccgatatccttcgctccctgatacagcggataccggaataatgaaaaaaacctatctctacagcatgcttgcactgtgcgtgagtgccgcctgtcatgcagaaacgtatccggcacccatcggcccgtcgcagtccgattttggcggcgtgggcttactgcaaaccccaaccgcgcgtatggcccgcgagggggaaatcagccttaactatcgcgataacgatcagtaccgttactactctgcgtccgtacagctgttcccctggctggagaccacgctgcgctacaccgacgtgcgtacaaaacagtacagcagcgtagacgctttctccggcgatcagacctacaaagacaaagccttcgacgtgaagctgcgtctgtgggaagagagctactggatgccgcaggtctccgttggtgcgaaagacattggcgggaccggcctgtttgacgcggaatacatcgtggccagcaaagcctggggaccgtttgatttctcactcggtctgggatggggctatctgggtaccagcggcaacgtcaaaaatccgttctgctcctacagtgataaatactgctaccgtgataacagctaccagaaagcgggctccatcaacggcgaccagatgttccacggcccggcctcgctgtttggtggtgtagagtatcaaacgccatggcagccgctgcgcctgaagctggagtacgaaggtaataactacagcgaagattttgctggcaaaattgagcagaagagcaagtttaacgtcggcgccatttaccgcgtcaccgactgggccgacgttaacctcagctatgagcgcggtaataccctgatgtttggctttaccctgcgcactaactttaacgacatgcggccgcactataatgacaacccgcggccaaaatatcagccggagccgcaggatgcgatcattcagcactccgtggtagcgaaccagctgacgctgctgaaatataacgcgggcctggcggatccgaagatccagaccaaaggcgatacgctgtatgttaccggcgagcaggtgaaataccgcgactcccgcgaagggatcgagcgcgccaaccggatcgtcatgaacgatctgccggaggggatccgcacgatccgcgtgacggagaaccgcctgaatctgccgcaggtcaccaccgaaaccgatgttgccagccttaagcgtcatcttgaaggcgaaccgctcgggcatgaaaccgagctggtgcaaaaacgcgttgagccggtggtgccggaaaccaccgagcagggctggtatatcgataaatcgcgcttcgatttccatatcgatccggtgctgaaccagtccgtgggtgggccggaaaacttctacatgtatcagctgggcgcgatggcgacggcggatctgtgggtgaccgaccacctgttgaccaccggtagtctgttcggcaacattaccaacaactacgacaaatttaagtacaccaacccgccgaacgattcaaaactgccgcgcgtgcgtacccgcgttcgcgaatatgtgcagaacgatatctacgtgaataacctccaggccaactacttccagtatttcggcaacggcttctacggccaggtttacggtggctatctggaaaccatgttcggcggcgccggggcagaagtgctttatcgtcctgtcgacagcaactgggcgtttggggttgatgccaactacgtgaaacagcgtgactggcgcagcgcgcaggacatgatgaagttcaccgactacagcgtcaaaaccggccacctgaccgcctactggacgccgtcgttcgcgcaggacgtgctggtaaaagccagcgtcggccagtatctggcgggcgataagggcggcacgctggatatctccaaacactttgacagcggcgttgtggtgggcggctatgccaccatcaccaacgtttcgccagacgagtacggggaaggggacttcaccaaaggggtgtacgtgtcgattccgctggatctgttctcatcaggcccaacccgcagccgtgcggcagtgggctggacgccgctgacgcgcgacggcggtcagcagcttggacgtaaattccagctgtatgatatgaccagcgataagaacattaacttccgctga

SEQ ID NO: 3862 - DNA, 468 bp, Enterobacter cloacae
atccccgtcacatttttgcgttatacaggaacctcgccctggagaatgaggtgctgtatgacatccctgactcgtccgcgcgttgagtttatctcaacgatactccagaccgtactgaacctcggtctgctgagccttggcctgatcctggtcgtttttctgggtaaagagacggtgcatctggcggatgtgctctttgctcctgagcaaaccagcaaatacgcactggtggaaggcctggtggtctactttctctactttgaatttatcgccctgattgtgaagtactttcagtccggctttcacttcccgctgcgctattttgtctacattggcatcaccgccattgtgcggctgatcatcgtcgatcataaatccccgctcgacgtgctgatctactcggcggcgatcctgctgctggtgatcaccctctggctgtgcaactcaaagcggctaaaacgcgaataa

SEQ ID NO: 3863 - DNA, 570 bp, Enterobacter cloacae
attctgtttgtccgtcctcattttgtcaatctgcgatacaatgcttttacgttatgtatcggagagtctggcatgtcacaccccgcgctcacgcagctgcgtgcgctacgctatttcgaccacatccctgcgcttgacccggaacagctggactggctgctgctggaagattccatgacaaaacgttttgagcaacagggtaaaacggtcacggtgacgatgattcaggaagggtttgtctcgcctgcggagattgccagcgagctgccgctgctgccgcaggaagaacgctactggctgcgtgaaattttactctgtgcggatggcgagccgtggcttgccgggcggacggtggttcctgagtctacactttccgggccggagctggcattgcaacgcctcggcaaaacgcccctggggcgctatctgttcacctcgtctgaactgacccgtgattttattgaaattggttgcgatgccgatttgtgggggcgccgttcccgccttcgtttgagtggcaagccgttaatactgacggaactctttttgcctgcatcgccgttgtactaa

SEQ ID NO: 3864 - DNA, 882 bp, Enterobacter cloacae
gagggagagaaaatggagtggagtctgacgcagaataagctgctggcctatcaccgcctgatgcgtactgataaacccattggcgcgctgctgctgctgtggccgaccttatgggcgctgtgggttgccacgccgggtgtgccgccgctgtggatcctggcggtgtttgtggcgggcgtctggctgatgcgcgctgcgggctgtgtggttaacgactatgctgaccggaaatttgatggacatgttaagcgcaccgcgaatcgtcctctgccgagcggtcaggtgaccgggaaagaggcgcgcattctgtttgtggtgctggtgcttctctctttcatgctggtgttaacccttaacaccatgaccattctactgtccgttgcggctctggcgctggcctgggtttacccgttcatgaagcgatacacccatctgccgcaggtggtattgggtgcggcatttggctggtcgattcccatggcgtttgccgcggtcagcgagtccgttccgctcagctgctggctgatgttcctggcgaatattctctgggccgttgcgtacgatacccaatacgcgatggtcgatcgcgatgacgatctcaagattggcatcaaatcgacggcgatcctgtttggtcgtcacgacaagctgatcatcggcatattacaggtggcggtgctggcgctgatggtggcgattggtcgcctgaacgggctgaactgggagttttactggtccgtactggtggcggggctgctgtttgcgtatcagcagaagctgatcgcgaagcgcgagcgtgaagcctgctttaaagcgtttctgaataataactacgtcgggctggtgctgtttctgggcctggcgatgagttactggtcataa

SEQ ID NO: 3865 - DNA, 381 bp, Enterobacter cloacae
aaggttcttttaatggccaataataccactgggttaactcgaatcattaaagctgccggttattcatggaaaggtttccgcgctgcatgggttaatgaagccgctttccgccaggaggcggttgctgcaatcgttgccgttgtcatcgcctgcttccttgatgttgatgctatcacccgcgtactgctcatcggatctgtctttctggtgatgatagtggaaattcttaatagcgctattgaggccgttgttgaccgaatcgggtcggaattccatgaattgtctggccgggcgaaagacatgggttccgctgccgtactgctggcgattatcactgcggcgatcacctgggtcacgctgctttggtcgcatttccgatga

SEQ ID NO: 3866 - DNA, 633 bp, Enterobacter cloacae
ctgtatatacacccagggggcggtatgaaagcgttaacgaccaggcagcaagaggtgtttgatctcattcgggatcatatcggccagacgggtatgccacccacgcgtgcagaaattgcgcagcgtctgggcttccgttctcctaatgctgccgaagagcaccttaaagcgctggcgcgtaagggcgtgattgagattgtttccggcgcctcacgcggtattcgtctgctggtggaagaagagagcggtattccgctggtgggtcgcgtagcggcaggtgaacctctgctggcgcagcagcacatcgaagggcactatcaggttgatccaggcatgttcaagccgagcgccgatttcctgctgcgcgttagcggaatgtccatgaaagatatcggtattttggatggcgatctgctggcggtacacaaaacgcaggacgtgcgtaacgggcaagtcgtggtggcgcgcattgatgatgaagtgacggttaagcgcctgaaaaaacaaggcaataccgtgcagcttctgcctgaaaacaatgaattctccccgattgtggtggatctccgcgagcagagcttctctattgaagggctggcggtcggcgttatccgcaacggtgaatggctataa

SEQ ID NO: 3867 - DNA, 1380 bp, Enterobacter cloacae
ttcctctacagcctggcctgttttctgattccggtaatttccatggcattgctaacttctgccgataaggcgttgtggcgtcttgcgctaccgatgattttttccaatattaccgttcctctgcttgggctggtggatacggcggttatcgggcatctcgattcgccgatttatctcggcggcgtcgcgatcggcgcaacggcgaccagctttctcattatgctgctgctttttctgcgcatgagtacgacgggcctgacggcccaggcgtatggtgcaaaagatcccctgcgtctggcgcgtgcgctggttcagccgctcattctggcgttcggtgctggcgcgttaatcgttctgttgcgtacgccgctgattgattttgcgctccatattgtgggcggcagcgatgccgtactggaacaggcccggcggttcctcgaaattcgctggctcagcgcgcccgcttcactggcaaacctggtcctgctgggctggctgttgggcgtgcagtacgcccgcgcgccggtgatcctgctggtggtaggcaacctgcttaacattatgctcgatctgtggctggtgatggggctgcacatgaacgtccggggcgcggcgctggccacggcaattgccgagtacggtacgctgctgatcggtttggggatggtctggcgcgtgctggcgatgcgcggtatcaccctggatctgctgaaatcggcctggcgcggcaacattcgtaagctgctggcgcttaatcgcgacatcatgctccgttctctcctgctgcaactctgctttggcgccttaaccgtttttggtgcgcgtcttgggcctgagatcgttgccgtcaacgcagtgctcatgacgttactgacctttaccgcttacgcgctggatggttttgcttacgccgtcgaggcgcattcagggcaggcctatggcgcgcgtgaaagcggccagttacgtgaagtctggcgtgctgcctgtcgtcaggcgggtctggtggcgctggcctttgctctggtatacgcctgttttggtgggcatattgtcgcactactcacctcgttgcccgcgctacgtgagctggccgatcgctacatcctctggcaggtagtattaccggtggtgggtgtgtggtgctatttgctggacggcatgtttattggtgcgacgcgaggggcggagatgcgcaacagcatggccgtcgcggcggcggggtttggcctgacgctgctgaccctgccgtatctcggcaatcatggtctgtggctggcgctggcggtgtttctctcactgcgtggcctttcgctggccgttatctggcatcgtcactggcgaaacaatacctggtttccagccccgcacgatatatcgtaa

SEQ ID NO: 3868 - DNA, 1005 bp, Enterobacter cloacae
aacttcgccatgtcgtcagaattccagaccgttttccctgcacaccgtttctccattgcgccaatgctcgactggacggacagacactgccgctatttcctgcgccagctctcccgccatacgctgctgtacaccgaaatggtcactaccggcgcaattattcatggcaagggcgattatctggcgtacagcgaagaggagcatccggttgcgctgcaactgggtggcagcgatccggctgcgctggcgcagtgcgcgaagctggctgaagaacgcggctatgacgagattaacctcaacgtcggttgcccgtccgaccgtgtgcaaaacggtatgttcggcgcgtgtctgatgggtaatgcacacctggtggcggactgcatcaaagcgatgcgcgacgtcgtctctatcccggtcacggtcaaaacccgtatcggcatagacgaccaggacagctatgagtttctgtgtgatttcatcaacaccgtatcagggaagggtgaatgcgagatgtttatcatccacgcccgtaaagcctggctctctggcctcagcccgaaagaaaaccgcgagatcccgccgctggactacccgcgcgtgtaccagctgaaacgcgacttcccacacctgaccatgtcgatcaatggcggtattaagtcgctggacgaggccaaagcgcacctcgaacatatggatggcgtgatggtcggacgcgaggcgtatcagaatccgggcattctggcgacggttgaccgggaaatctttggcgttgagggtgctgacaccgatcccgtggccgtagtgcgcgccatgtatccgtacattgagcgcgagctgagtcatggtacgtatctgggccacattacccgccatatgcttggcctgttccagggcattcctggtgcgcgccagtggcgtcgttatctcagcgagaacgcgcataaagccggtgcggatattgaggtactggaacacgcgctgcgtctggttgcggataaacgttaa

SEQ ID NO: 3869 - DNA, 1089 bp, Enterobacter cloacae
ggaattcaaatgcaagcggcaactgttgttattaaccgccgcgctctgcgacacaacctgcaacgtctgcgagaactggcgcccgccagtaagctcgttgcagtcgtgaaagcgaacgcttacggacacggtcttcttgagaccgcgcgaacgctccccgatgccgacgcttttggcgtcgcccgtctcgaagaagctctccgcctgcgcgcaggtggaattacgcaaccgattctgctcctcgaaggcttttttgaagcctcggacctgccgaccattgccgatcagcacctgcacacggcggtgcataacgaagaacagctggccgcgctggaaacggccgaactgagcgagccggtcaccgtctggatgaagctcgacacgggcatgcaccgtctgggcgtgcggccggaaagcgcggaggcgttttatcagcgtttgtgtcagtgcaaaaatgtgcgtcagccggtgaacatcgtcagccactttgcccgcgccgatgagcctgaatgcggcgcaacggaacagcagcttgatatcttcaacaccttctgcgaaggcaaaccggggatgcgctcgatcgcggcatccggcggtattctgctgtggccgcagtcgcacttcgactgggcgcgtccgggcatcattctttacggcgtatcgccactggagaacaaaccctgggggccggactttggctttaagccggtgatgtcgctggtttcaaagctgattgccgtgcgtgagcacaaagcgggagagccggtaggttacggcggcacctggatcagcgagcgcgatacccgtcttggcgtggtggcgatgggctacggtgacggctatccccgcgccgcaccaacgggcacgccggtgctggtcaacggtcgtgaagtgaagattgtcggccgcgtggcgatggacatgatttgtgttgatctggggcccgacgcgcaggataaagcgggggacgatgcggtgatgtggggcgaaggcctgccggtagaacgtattgctgaaataacaaaagtgagtgcttacgaacttatcacgcgtcttacctcaagggtcgcgatgaaatacgtcgactaa

SEQ ID NO: 3870 - DNA, 447 bp, Enterobacter cloacae
aaagattcacctttcataatggagcagcacatgtggtatcaacagaccctgaccttaagcgcaaaaccacgcggatttcaccttgtgacggacgaagtcatcgggcaaatccgcgacctgtcgcgcgtcaaaacgggtttgctgcatctgctgcttcagcacacgtctgcttctctcacgctcaatgaaaattgcgatcccaccgtccggtctgatatggagcggcattttctgaaaaccgtcccggataacgccccgtatgagcatgattacgagggggcggatgatatgccctcacacatcaaatcctctttgctgggcgtctcgttgatgctgccggtccacaacggacggctacagctgggaacgtggcaggggatctggctgggagaacatcgcattcacggtggttcgcgtaaaattatcgcaacgctacaaggggaataa

SEQ ID NO: 3871 - DNA, 225 bp, Enterobacter cloacae
cgacgctgtccttcggcatacaaagtgtcgaaagccagtgaggatttgccagaccccgaaagcccggtcacgacgatgagtttgtcgcgagggattatgaggttgatattcttgagattgtgggtgcgggcgccccgaacttcgatcttatccattcacctttcccggttggaacacggattgcctgatttgtttgaaggacaaacggctgtcagaaacggctaa

SEQ ID NO: 3872 - DNA, 468 bp, Enterobacter cloacae
agaggttttatggaaaagagattaccgcgcatcaaagcactgttaacccccggtgaagtggctaagcgaagcggtgtggcggtgtcggcgctccacttctatgaaagcaaagggttaataaaaagtatccgtaacgccggaaaccagcggcgctacacgcgcgatgtgctccgctacgtggcgattatcaaaattgcgcaacgtatcggcattcctctggccaccattggtgacgcgttcggcgtattgccggaagggcactcactgagcgcgaaagagtggaagcagctgtcgtcccagtggcgagaagaactggatcgtcgtattcacacgctggtggccctgcgcgatgaactggatggctgcattggttgcgggtgtttatcacgtagcgattgcccgctgcgtaacccgggtgacaggctgggcgagcagggaacaggggcacggttgctggaggaggattga

SEQ ID NO: 3873 - DNA, 1794 bp, Enterobacter cloacae
ctttttatgcgaaaacgggtggctaaggccgcccgtttttattttcaggactcatcctgttgccttttacgttactctggagaggatagaataagaggcacgacgcctcaggtttggcttataagaaacacagcaaacagggaacgcatggaaattttcttcacaatactcatcatgacccttgtggtctcattatccggggtggttacacgcgtactgcccttccaggtccccctgcccttaatgcaaatagctatcggcgcgctgctggcgtggccgacgttcggtctgcacgtggagttcgatccggaactgtttctcgtgctgtttatcccgccgctgctgtttgccgatggctggaaaacgccgacgcgcgaatttctggagcacgggcgagagatcttcggcctggcgctggcgctggtggtcgtcaccgtggtcgggattggtttcctgatctactgggccgtaccagggatcccgctcatccccgcctttgcgctggctgccgtgctgtcgcctaccgacgccgtggcgctgtccggcattgtgggtgaagggcgcattccaaagaaaatcatgggcattttgcagggcgaggcgctgatgaacgacgcctctggcctggtcgccctgaagtttgccgtggcggttgccatgggcacgatggtctttaccgtaggcggcgcgaccctggaattcttcaaggtggcgattggcggtatcctcgcgggcttcgtagtgagctggctgtacggacgctcgctgcgcttccttagccgctggggtggtgatgaaccggcgacgcagatcgtcctgctgttcctgctgccgttcgcctcttacctgattgccgaacatatcggcgtgtcgggcattctggcggcggtagctgcggggatgaccatcacccgctccggcgtgatgcgccgcgcaccgctggcgatgcgcctgcgtgcaaacagtacctgggcgatgctcgagtttgtctttaacggcatggtgttcctgctgttgggcctgcaactgccgggcattatggaatcctcgctgattgcggccgaagcggatccaaacgttgaagtctggatgctatttaccgatatcgtgctcatctaccttgcgctgatgctggtacgtttcggctggctgtggacgatgaagaaattcagcgttcgcttcctgaccaaaaagccgatggagtttggctcgtggaccacgcgcgagctgctgattgcctctttcgcgggcgttcgcggggcgatcacccttgctggtgtgctctccattcctctgcttctgccgacgggcgacgtcttcccggcgcgctacgagctggtgttcctggcggcaggcgtgatcctcttctcgctgtttgtcggcgtgattatgctgccgattctgctgcaacatattgacgcgggtgactcctcgcaacagcacaaagaagagcggattgcccgtgcggcgacggcggaagtggcgattgtcgccatcgagaaaatggaggagcgtctggccgccgatgccgaagagaacattgataaccagctgctgaaggaagtcagttcacgcgtgattggtaatttgcgtcgccgtgctgacggacgtaacgacgtggaaagttcgttgcaggaagagaacctcgaacgccgtttccgcctggcggcgctgcgctccgagcgtgccgagctgtatcacctgcgcgcgacgcggcagatcagtaacgagacgctgcaaaagctgctgcacgatctggacctgctggaagcgttgttgatagagaatcagtag

SEQ ID NO: 3874 - DNA, 756 bp, Enterobacter cloacae
tggtgctgggcgccaccgcctgggtggtggataaggtgtatcgctttgaaatcagcaggcagaagcatgactaactttcagataagcctgctgtgcctgattgcgacagttgtcatctactttgccaacaagcgcctgtatcgccgctttcgcgcgctgccgctgatgccgttggtctttacgccgatcctgctggtgctgatgctggtcttcggccatatctcctggcagaactacattggcgaatcccactggctgctgtggctgctcggcccggcgaccatcgccttcgccgtacccgtttatgacaacctcgctattatcagacgccactggatgtcgctcagcgcgggcgtcgtcaccgcgacggtggtggcggtgtgcagctcggtctggctggcgcgcctgtttaccctgtcggatgaaatccagcgcagcctggcggtgcgttcggtgaccacgccgtttgcgctggcagccgccaaaccgctcggtggccagccggatctggtggcgctgtttgtggtggtgacgggcgtctttgggatggcggtgggcgatatgctgtttctgcggctttctattcgggaaggaatggccaaaggcgcgggatttggcgcggcgtcgcacggcgcgggcacggcacgttcctatgagctgggacagcaggagggcgttgtcgcgagcctggtgatgatgctgtcgggcgtcacgatggtgctgatcgcaccgttggtggcgtggatgatgttttaa

SEQ ID NO: 3875 - DNA, 1260 bp, Enterobacter cloacae
attaccgacaatgacactttttgcagtgaaatgccttgttctttaaggcttgcgcagcatgccgtgcaaatgatactcatacggcgcgttaaaaaatcccataaaccaacgcaacacaattcataccctttcagtatgtctccatattcatgcagttttgatggtgcggagatttcattgaggaagtcagtttctatgaaaaatttgaaagtcagcctggcctggcagatcctgctggcccttgtgctgggcatcttgctgggcagttacctccattatcatagcgacagtcgcgagtggctgattgcgaaccttctctcccctgcgggcgatatctttattcatctgatcaagatgattgttgtgccgattgtgatctcgacgctggtggtcggtatcgcgggtgttggtgatgcgaaacagttaggccgcatcggcgttaaaaccattctctatttcgaagtgatcactacggttgccatcgtacttggcatcaccctggcgaacgtgttccagcctggtgccgggatcgatatgtcgcagctggcgacggtggatatttcgaaataccaaagcacaaccgccgatgtgcagagccattcgcatgggttgatggggactattctctcgctggtaccgaccaacattatcgcgtccatggcgaagggcgagatgctgccgatcatcttcttctcggtactctttggcctggggctttcttccctgcccgcgacgcaccgtgaaccgctggtgaccgtgttccgctctatctccgaaaccatgttcaaagtcacccacatggtgatgcgttatgcgccagtcggggtattcgcgctgattgcggtgaccgtagcgaacttcggctttgcctccctgtggccgctggcgaagctggtgattctggtgcacttcgcgattctgttcttcgcgctggtggtgctgggcattgtggcgcgcctgtgcgggctcagcatctggatcctgatccgcatcctgaaggatgagctgattctggcgtactccacggcaagctccgagagcgtactgccgcgtatcattgagaagatggaggcctacggtgcgccggcgtccattaccagcttcgttgtaccgaccggttactccttcaatctggatggttcaacgctgtatcagagtattgcagcgatctttatcgcgcagctgtacggcattgacctgtcgctgtggcaggaaatcgtactggttctgacgctgatggtgacttcaaaagggatcgca

SEQ ID NO: 3876 - DNA, 840 bp, Enterobacter cloacae
ccgcttctgggtggacgaagaggggcaaatccgccagtccttacagtatctcggtgccggtttcttcccggtgaagaccaccctgatcaaggcggcgaaatcatgaaaatgttcatccacattgcgcttctcgccagcctggcctcgccgctggcgtggtctgcgggaacggtacaggtctacaccccggacagcgaaaaacctaaaaccttaaccaatgccaggcatctgctcgatctggtggggcagccgaggctggcgaaaagctggtggaccggggcggttatcagcgagcgtcaggcgacgattgtagcggaacaaaaacatcaggcgctgctcgcccgactgagcgggctggcacaacaggaagatgccgacgatgccgcggctattactagcctgcgtcagcagcttcaggcggttaaggtgacggggcgccagaaggtgaatctcgatcccgacgaagtgcgtgtcgcggaaaacggcaatccgtcgctggaaggggactataccctgtggcttccggctcagccttccaccgtcaccgtgatggggcttctcagcagccctggcaaaaagccgtttacgccgggccgggacgtggcgagctatctcgacgagcaaagtctgctcagcggagcggataaaagctatgcctgggtggtctatccggacgggcatacgcagaaagcgccggtggcttactggaataaacgccatatcgaacctatgccgggcagcatcatttttgtcggttttgccgaccatttctggacgaaagcgtatgacgggcttaatgccgatatccttcgctccctgatacagcggataccggaataa

SEQ ID NO: 3877 - DNA, 369 bp, Enterobacter cloacae
aagatggtcaaatacgccacgccctgcaacacattgcggggcgttttgctttcagaacaacaacttatttttggcatgattcttgtaacgatcgcagcatcattcgggaactcgtgggagagcaccatgcttgaactactttttgtgattggtttctttatcatgctgatggtcacgggcgtgtcgctgctcggtatcctggccgcgctcgttgtggccacggtggtgatgtttgtcggcggtttatttgccctgacgattaaactcttgccgtggttacttctggcgattgcggttgtatgggcgatacgggcgattaaatcgccaaaactgcccagttatcagcgtaataaccgcttccgttactaa

SEQ ID NO: 3878 - DNA, 1209 bp, Enterobacter cloacae
tccggagaacatcgcgtgtttcagaaagtagacgcctacgccggcgaccctatcctctccttgatggagcgtttcaaagaagatcctcgcagcgacaaagtgaacctcagcattggtctttactacaacgaagacggcatcattcctcagttgaaagccgttgctgaagctgaagcgcgtcttaacgcaaccccgcacggtgcttcgctttatctgccgatggaaggattaaacacctaccgcaacactatcgcgccgctgctgtttggtgcggaccacgcggtgctcgcgcaaaagcgcgtagcgactatccagacgctgggtggctcgggtgcgctgaaggtaggcgcagatttcctgaaaaagtacttcccggattccggcgtgtgggtcagcgacccgacgtgggaaaaccacgttgcgatcttcgagggcgcgggctttaaggttgaaacttatccgtggttcgacagcgaaacgaacggcgtgcgcgttgatgcgctgctggaaaaactgaacaccctgccggagcgcagcatcgtattgctgcatccgtgctgccataacccgacgggtgcggacctcaccaatgcccagtgggatgcggtgatcgagatactgaaggcgcgtaacctgatcccgttcctcgacatcgcctatcagggctttggcgcgggcatggaagaagacgcctacgccattcgcgcgattgccagcgcggggcttcccgctctggtcagcaactccttctcaaaaatcttctccctgtacggcgagcgcgttggcggtctgtccgtggtgtgtgaagacgccgaagccgcgggacgcgtactcggccagctgaaagcgacggtccgccgtatctactccagcccgccgaactttggtgcgcaggtggtggcgacagttctcggtgacgaaagactgaaagccacctggcttgcggaagtggaagcgatgcgtaagcgcatcctgtcgatgcgtcaggagctggttaacgtcctgaaagaggccgtgcctgggcataactttgattatcttctcaagcagcgcgggatgttcagctacaccggactgagcgcagcgcaggtcgatcgcctgcgtgaagagttcggtgtctacctgatcgccagcggccgtatgtgcgtggcgggtctgaatgccagcaacgtccagcgcgtggcgcaggcgtttgcagctgtgatgtaa

SEQ ID NO: 3879 - DNA, 549 bp, Enterobacter cloacae
gaaacgtattcaggagacacgaacatggccagcagaggcgtaaacaaggtgattctcgtcggtaatctgggccaggacccggaagtacgctacatgccgagtggtggcgcagttgccaacattacgctggctacttccgaatcctggcgtgataaagcgaccggtgaaatgaaagagcagaccgaatggcaccgtgttgtgctgtttggcaaattggctgaagtggccggtgagtatctgcgtaaaggctctcaggtttacattgaaggccaactgcgtacccgcaaatggaccgatcaatccggtcaggaaaaatacaccacggaagtggtggtgaatgttggcggcaccatgcagatgctgggtggccgtcagggcggcggcgcaccggcaggtggcggccagcagcagggcggttggggccagcctcagcagccgcagggtggcaatcagtttagcggcggcgcgcagtcccgtccgcagcagcagtctgctccggcaccgtctaacgaaccgccaatggacttcgacgacgatatcccgttctga

SEQ ID NO: 3880 - DNA, 1476 bp, Enterobacter cloacae
tttcgtggtcttattcttttattcagatatgagttattgcggttgctctctcgattaatgacctgcgaaaagataatgaaagaacaaagacgcgagattattaacgacagcatgcaggcgctgcacgccctggcgaagctgatgccgcaactcaacgcgcagtgttcgccggtggaaatgctggaaaccatcaacagcgctctgggggcaaatctctcgtgggtcagtgtcgaatccgcagacgggccgcgcgtggtttgtgccggcgacgtgacgtgtcacgccttcaacgtggcggattttcttgccagcaccctgttgcagcggcatcaccgcgcctggcgggttatctactggaaagcgcatattggccgggcggtattttcccctcagcacccgggctatgcgcggctgcaaagcggcgtcctgtgtaaactctcagcgcatggcagacagtgcagtggttatttctttttggcttttaatggaaaacttacctcgttgccgatactgaaaaatatcgtggtggtattggttgagaagctaaaagattattttgatgacatcatcgtgcgggaaaaaacggcgcaagaaatgcagcgcgtcgtcacgcaatataaaaccttatttgagcgtgcgccggtattaatgaacgcctttgacaggcataaccggtgtgtattgtggaatgccgaatgcgaaaaagtctttggctggagtatgactgaaatcgacgagcaccccgatccgctggccctgttttatccggatcccgaggagcgacagcgcgtgcaggagtcggttcgtttcgcaccacttaaggatatgtacgaatggcacccggtgcgtaaagacgggacgcagttaacgattctctggtcaaacatccttttgccggataactccattctcaatattggcctggatatcaccgaacgtaaaaaagcagaacagcagctgaccgtcaaagccaccacggacgatctgacgggctgtctgaatcgctcgacaatcttacagcagctcaaaatggcgctggcagccagttcgccgcaggatgtcagtagccacttctgtctcctgatgttcgatctcgattatttcaagcagattaacgatcggtggggacatcaggttggcgatgcggcattgattcacttttgcgaccgtattcgcgaggtgagcccggccgggtcagcgctgggacgggtggggggcgaagagtttgttcttctgctggcgcgtacggatggtatggccgctacgttgctctcttctcgcctgcgtgccgcgctgatctcaaaaccgctgcgtgtgggcgataaaacgctggtactctccttcagcgccggggtggttgaagtctgtcaggggcaacgagatacttctgccatactgatgcgtgccgataaggcattatatgacgccaagcgtacgggaagaggaaaaacggtcctggcgtctgattatttataa

SEQ ID NO: 3881 - DNA, 738 bp, Enterobacter cloacae
ccgaatttttttcgtgaagttgctcagttttctatagttaaaaagtatgaatcatcggagaacatcatgctaacggtccaccaccttaatcagtctcgttcacatcgtgtcctctgggcgctggaagagctgggtctgacgtacgacatcgtgcgctaccagcgcgaaaaaaccatgctcgcgccagactcgctcaaaaaagtgcatccgctgggaaaatccccggtactcgaagataacggactggttctggccgaatcaggtgcgattatggaatatcttcaggaaacgtacgattcggcgtcacgattcaaaccgttagatcccgcccataaagtgcagtatcgcttctggctgcattacgccgaagggtctttgatgccgctactgttaatgaagctggtgtttaacagcctcggcaaaccacccgtcccgtttggcctgcgcacgctgggtaaggcgctggggcagggggtgcaaaaagcgtatctcaaccgccagctggaaacgcatgcgcgctttattaacgatcatcttgccgaaaacagttggtttgccggcgacacgctgaccatggctgatatccagatgagttttcccctcttcgccctgctggcgagaggcggcatcgacaatctcgaccacatagcggcgtggaaacagagagtggaggcacgtccgggctggcagacaacgcttgcgaaaggcggcccgctgacgatccccggcgagggatga

SEQ ID NO: 3882 - DNA, 1419 bp, Enterobacter cloacae
cgtttagctggcagtggcgtctccacctcgcttacggacttcctaaaaaactctcaggggatgttttctatgtctacgccatctgcgcgtaccggcggttcacttgacgccatgtttaaaatttctgctcgcggcagcaccgtgcgccaggaagttgttgccggtctgaccacgtttctggcgatggtgtactccgtcatcgtggtgccgggcatgctcggcaaagcgggcttcccgccagcggcggtcttcgttgccacctgcctggttgcgggtgtgggttcgattgtgatgggcctgtgggcgaacctgcctctggcgatcgggtgcgccatctccctgaccgcatttaccgccttcagcctggtgctgggccagcagatcagcgtcccggtagcgctcggcgccgtgttcctgatgggcgtgctgttcaccgtaatttcagcaaccggcattcgtagctggattttgcgcaacctgccgcagggcgtggcgcacggcaccggcatcggtattggtctgttcctgctgctgatcgctgccaacggcgtcggcctggtcatcaagaacccgctggacggcctgccggttgcgctgggtaacttcgcgagcttcccggtgatcatgtcgctggtgggtctggcggtgatcattggcctggaaaaactgaaagtgccgggcggcattctgctgaccattatcggcgtgtccatcgtcggcctgatcttcgacccgaccgttcatttctccgggattttcgccatgccgtcgctgagcgatgacaaaggcaactccctgattggcagcctggatattatgggcgcgctgaacccggtgatcctgccaagcgtgctggcgctggtaatgaccgcggtatttgacgccaccggcaccatccgcgcggtggccggtcaggcgaacctgctggataaagacggacagattattgacggcggcaaagcgctgaccaccgactccctgagcagcgttttctctggtctggtgggtgcggcacctgcggcggtgtacatcgagtccgcagcgggtacggcggcgggcggtaaaaccggcctgacggccatcaccgttggcgtactgtttctgctgattctgttcctctctccgctctcttatctggtgccagcttacgcgaccgcacctgcgctgatgtacgttggcctgctgatgctgagcaacgtggcgaaaatcgacttcgcggattttgttgatgccatgtccggcctgatcactgcggtattcatcgtgctgacctgtaacatcgtgaccggcattatgatcggcttcgcctcgctggtgattgggcgtctggtctccggtgagtggcgcaagctgaacattgggaccgtggtcatcgccgttgcgctggtggcgttctacgcgggcggctgggccatctga

SEQ ID NO: 3883 - DNA, 1893 bp, Enterobacter cloacae
catcgcggtaccttccaggccccgggcgtgaagacaacaggcccatattttatgctccttgtttaccccttgtttgaccaacatttcgccacgccggaagggcgcgacagcagctatacttttcgggtcttttcacctgcgtttgatgcagaccagggcaatggcataaaaaccatcacaatttttatttgcaggcgctacaatcgaccgcagtcacaattctcaaatcagaagagtattgctatgaaaaacatcaacccaacgcagaccgctgcatggcaggcactacagaaacattttgatgaaatgaaagacgtcaccatcgcggatctgttcgcgaaagatgccgatcgtttcagcaagttttccgccaccttcgatgacctgatgctggtggatttctccaagaaccgtatcaccgaagagacgctggcgaagctgcaagatctggcgaaagagactgaactggcagatgccatcaaatccatgttctccggtgagaagatcaaccgcaccgaagaccgtgccgtgctgcacgtggcgctgcgcaaccgtagcaatactccaattatcgttgacggcaaagatgtgatgccggaagtgaacgcggtgctggaaaagatgaaaaccttctccgaagcgatcatctcaggtagctggaaaggctacaccggcaaagcgatcaccgacgtcgtaaacatcggtatcggcggctctgacctcggcccgttcatggtgaccgaggcgctgcgcccgtacaaaaaccacctcaacatgcacttcgtgtccaacgtcgatgggacccacatcgctgaagtgctgaaaaaggtgaacccggaaaccacgctgttcctggtggcgtctaaaaccttcaccactcaggaaaccatgaccaacgcccacagcgcgcgcgactggttcctgaaaaccgcgggcgacgaaaagcacgtggcgaaacactttgcggcgctgtccaccaacggtaaagcggtaggcgagttcggcattgatacggcgaacatgttcgagttctgggactgggttggcggccgctactctctgtggtctgcaatcggcctgtccatcattctgtccgtcggcttcgacaacttcgttgagctgctctccggtgcgcacgcgatggacaaacacttctccaccaccgcgcctgagaaaaacctgccggtgctgctggcgctgatcgggatctggtacaacaacttcttcggcgctgaaaccgaagcgattctgccgtacgaccagtacatgcaccgctttgcggcctacttccagcagggcaacatggaatccaacggcaagtacgttgaccgtaacggcaacgcggtggattaccagactggcccaatcatctggggcgagccgggcaccaacggtcagcacgcgttctaccagctgatccaccagggcaccaaaatggtaccgtgcgatttcatcgccccggcgattacgcacaacccactgtccgaccaccatccgaagctgctgtctaacttcttcgcccagaccgaagcgctggcgttcggtaaatcccgcgaggtggttgagcaggagtaccgtgatcagggtaaagatccggcaacgctggagcacgtggtgccgtttaaagtgttcgaaggcaaccgtccaactaactccattctgctgcgcgaaatcacgccgttcagcctgggggcgctgattgccctctacgagcacaaaatcttcactcagggcgctattctgaacatcttcacctttgaccagtggggcgttgagctgggcaaacagctggcaaaccgcattctgccagagctgggtgacgataaagcgatcgacagccacgacagctccaccaatggtctgattaaccgttataaagcctggcgtgcgtaa

SEQ ID NO: 3884 - DNA, 681 bp, Enterobacter cloacae
ccacacttcggtgtggttatttcgccccttcggagaagagtcgtgaagcgacctgcaatcatcctgatttgcctgctgttgcaggcgtgctcagctaccaccaaagggctgggccactcactgtgggacagcatgttcggcacgccgggcgtgcatctgaccgatgacgaacttcagaacatgccgtatgccagccagtacatgcagctaaacgatggtccgcaactgtttgtggtgctcgctttcgatgaaaacgggcagcagaaatgggtgacgcaggatcaggccaccatcgtgacgcagcattcccgcatcgtgaaaacgttgctcggcggcgacaacctgcttgaggtgaacaacctggctgaagatccgctcatcaagccgaatcagattgtcgatggcgcaagctggacgcgcacgatgggctggaccgagcacaaacaggtgcgctacgccacggcccgatccaccttccgctgggacggtacggatagtgtcaaagtgggcagcgacgaaacgcaggtgcgcgtgctggatgaagaggtgacaaccgatcaggccacctggcataaccgcttctgggtggacgaagaggggcaaatccgccagtccttacagtatctcggtgccggtttcttcccggtgaagaccaccctgatcaaggcggcgaaatcatga

SEQ ID NO: 3885 - DNA, 1125 bp, Enterobacter cloacae
cgaagggagaagggcatggcgagcgtacagctgcgtaatgtaacgaaagcctggggcgacgtagtggtgtcaaaagacatcaatctggacatccacgaaggtgaatttgtggtgttcgtgggtccatcaggctgtggtaaatcgactctgctgcgtatgattgccggtcttgaaaccatcaccaggggcgatttatttattggtgatacccgaatgaacgacatcccgccagctgaacgcggcgtgggcatggtgttccagtcttatgcgctttatccgcatctttccgttgccgagaacatgtcctttggcctgaagctggccggcgcgaaaaaagagaccattaaccagcgcgtcacccaggtggcggaagtgcttcagctggcacatctgctggagcgtaaaccgaaggcgctctccggcggtcagcgtcagcgtgtggcgatcggccgtacgctggtggccgagccgcgcgtgttcctgctcgatgaacctctctctaacctggatgccgccctgcgcgtccagatgcgtatcgaaatctcccgtctgcacaaacgccttggacgcacgatgatttacgtcacccacgatcaggtcgaagcgatgacgctggccgacaaaatcgtggtgctggatgccggtcgcgtggcgcaggtgggcaaaccgctggagctgtatcactacccggcagaccgctttgttgcgggctttattggctcgccaaagatgaacttcctgcccgtaaaagtgaccgcgacggcaatcgaacaggtacaggtggagctgccaaaccgtcagcaagtctggctgccggtcgacagcgccaacgtacaggtgggggccaatatgtccctcggtatccgtcctgagcatctactgccaagccacattgcggatgtgacgctggaaggtgaagttcaggtcgtcgaacagcttggtcacgaaacacagattcatatccagatccccgccatccgtcagaacctggtctaccgccagaatgacgtggtgttggtagaagagggtgccacattcgctatcggtttgccgccagagcgttgccatctgttccgtgaggatggcactgcatgtcgtcggttgcacaaagagccaggcgtttaa

SEQ ID NO: 3886 - DNA, 1353 bp, Enterobacter cloacae
gcattccaattacaaagaaaagcaatgatctcaggagatagaataatgattactctgcgcaaagtccctctggctgtcgccattgcggcaggcatcctgtctgcccaggcgggcgccgtagactttaaaggttatgctcgttccggcattggctggaccggaagtggcggtgaacaacaatgtttccaggcaacaggcgcacaaagtaaataccgtctcggtaacgaatgtgaaacctacgccgaactgaaactgggccaggaagtgtggaaagaaggcgacaagagcttctatttcgacaccaacgtagcgtactccgtttctcaacagaatgactgggaatccaccagcccggccttccgtgaagctaacgtgcagggtaaaaacctgattgaatggctgccaggctctaccatctgggccggtaagcgcttctatcagcgtcatgacgtacacatgatcgacttctactactgggatatctctggtcctggtgccggtattgaaaacatcgatctgggctttggcaaactctctctggcagcgacccgttcttctgagtccggcggttctgcaaccttcgccgatcgtgatgcgaacggcgaccgtatttatgacaacgtggtaccaaacgatgtcttcgacgtccgtttagccggtctggaaaccaacccgggcggtacgctggagctgggcgttgactacggtcataccaacattcctgacgactactatctgcaacctggcgcctctaaagatggctggctgttcaccgctgaacacacccagagcatgatgaaaggcttcaacaagttcgtactgcaatacggtacggattccatgacctctaacggtaaaggtattccacagggtggcagcatcgataacgacggctctatgtggcgcgtgctggaccacggtgcaatcaccctggcagaccgttgggacctgatgtacgtcggtatgtaccagaacatcgatcgtgacaacaacaacggtaccgagtggtggaccgtgggtgttcgtccaatgttcaaatggacgccgatcatgagcaccttgctggaagtgggctacgacaacgttaagtctcagaaaactgacgacaaaaacagccagtacaaaatcaccctggcacagcaatggcaggcaggcgacagcatctggtcccgtccggctatccgtgtcttcgcaacctacgcgaagtgggatgagaaatggggctatgcaaacaacgactcaggtgcaggttacacctctggcgtagcgtatagcgacacctccgcgaaaaccttcagccgtggcgacaacgatgagtggaccttcggcgcccagatggaaatctggtggtaa

SEQ ID NO: 3887 - DNA, 996 bp, Enterobacter cloacae
ggtgctgcgcgctattgcctggccaccgcagtgctcacgctatcagaggtaataacaatgaaaatgaagaaaagtctcgtcgcgctgtgcctctctgcggggctgttggcctgtgcgcctgcgctcacctatgcagatgtgaattttgttcctcaaaataccagtgctgcgccagctattccggctgcggcacttcagcaactggtgtggacgccagttgatcagtcgaaaacgcaaaccacccagcttgccgctggcggtcagtcgctgaacgtgccgggtatcagcggtccggttgcggctttcagcgtgccggcgaatatcggcgagctgaccctgacgttaaccagtgaagtcaataaacagaccagcgtcttcgcgcctaacgtgctgatcctcgatcagagcatgacgccatccgcattcttcccaagcgactatttcagctatcaggagcctggcgtcatgagtgccgatcggctggaaggcgttatgcgcctgacgccagccctgggtcagcagaagatttatgtcctggtgttcacgactgaaaaagatctgcaacagacaacgaagctggttgatccggcgaaagcctacgcaaaaggcaccggtaacgctgtcccggatatcccggatccgcatgctcgccatactaccgacggcctgatcaagctgaaagtctccaccaacagcgcctccagcgtactcgtaggcccgctgtttggctcatctggcccggggccggtaacggtgggtaatactgccgcgcctgtgtatgccgcgccagccgcaacaccggccgcggctccggccccggcgaaaaaagccgagccggtgcttaacgatactgaaacgtactttaacaacgccatcaagcaggcagttaaaaacggcgatgtcgataaagcgctgaaactgcttgatgaagccgagcgtttaggttcaaccactgcccgttccacctttatcagcagtgtaaaaggcaaggggtaa

SEQ ID NO: 3888 - DNA, 225 bp, Enterobacter cloacae
cacgaggacacgattatgaataaagacgaaatcggcggcaactggaagcaattcaaaggtaaagcgaaagaacagtggggtaagctgacagatgacgatatgaccgtcattgaaggtaagcgcgatcagctggtaggtaaaatccaggagcgctacggttacgaaaaagatcaggcggaaaacgaagtcaaagactgggaaacccgtaacgactaccgctggtaa

SEQ ID NO: 3889 - DNA, 1452 bp, Enterobacter cloacae
tctttcgacccactctttatctcggtaactccattcactatggcaggaaacaaacccttcaacaaacagactgaacctcgtgagcgtgattatcaggtcgccgggttaaaagtcccgccgcactcgattgaagcggaacagtcggtgttgggcggtttaatgctggataacgaacgctgggacgacgtcgccgagcgcgttgtcgcggaagacttctatacccgcccgcaccgccacatctttacggaaatggcgcgtttgcaggagtcgggcagcccgatcgacctgattacgctcgcagaatcgctggagcgtctgggacagctcgacagcgtcggcggatttgcctatctggcagaactgtcaaaaaacacgccaagtgccgcgaacatcagcgcttacgctgatatcgttcgtgaacgtgccgttgtccgcgagatgatctcggtggcgaatgagatcgccgaggccggtttcgatccccaggggcgcaccagcgaagatctgctcgacctggcggaatcccgcgtctttaaaatcgccgaaagccgtgcgaataaagacgaaggcccgaaaaacatcgccgatgtgctcgacgccaccgttgcacgtattgagcagcttttccagcagccgcacgatggcgtgacgggggtgaacactggttatgacgatctcaacaagaaaacggcaggtcttcagccgtcggatttgattatcgtggccgcacgtccgtcgatgggtaaaacgacatttgcaatgaacctcgtcgaaaacgcggcgatgttgcaggataagccggtgcttatcttcagtctggagatgccctctgaacagatcatgatgcgttctctggcgtccctgtcgcgcgtggatcagacccgcatccgtaccggtcagctggacgatgaggactgggcgcggatctccggcaccatggggattttgctggaaaaacggaacatctatattgatgactcctccggcctgacgccgacggaagtgcgctcccgcgcgcgccgtatcgcccgtgaacacggtggcatcggtctcatcatgatcgactaccttcagctgatgcgcgttccgtcgctttccgacaaccgtacgctggagattgccgagatttcgcgctcgctcaaggcgttagccaaagagctgcacgtgccggtggtggcgctgtcgcagcttaaccgctctctggaacaacgtgcagacaagcgcccggtcaactccgacctgcgtgaatccggctccatcgagcaggatgccgacttaatcatgttcatctaccgtgatgaggtttatcacgagaacagcgacctgaaagggatcgccgaaattattattggtaagcaacgtaacggccccatcggtacggtacgtctgacctttaacggccagtggtcgcgtttcgacaactatgccggtcctcaatatgatgatgagtaa

SEQ ID NO: 3890 - DNA, 738 bp, Enterobacter cloacae
caaactgaatattcaggggaaaatatgcgcaagatcacactggcgctcagcgccgcctgcttattgttctcgcttaatagtaccgttgttgcgcgggcttctgcacccacgccgctttacaccggcaccaccgccgccattcttgccgaacaggcccccattcactgggtttcagtggcacaaattgaaaacagcctgacgggtcgcccgccgatggccgtgggcttcgatattgacgataccgttctcttctccagccccggtttctggcgcggcaaaaaaacgtactccccggacagcgaagcctatctgaaaaacccggaattctgggaaaagatgaacaacggctgggatgagttcagtatcccgaaagaggttgcccgcgcgctgatcgccatgcacgtaaagcgcggcgacagcatttacttcgtgaccggacgtagccagaccaaaaccgaaaccgtctcgaaaacgctacaggatgattttctgatcccggcggccagcatgaatccggtcatttttgccggggaccaggaagggcaaaacaccaaaacccagtggctggaaaagaaaaatatcaaagtgttctacggggattcagataacgacatcaccgcggcgcacgacgtgggagccagaggcatcagggtgttacgcgcctcgaactccacctaccgaccgctgccgatggccggaaaatttggtgaagaggtgatcgttaactctgaatactga

SEQ ID NO: 3891 - DNA, 384 bp, Enterobacter cloacae
aattatcgcaacgctacaaggggaataaagatgacaatttcggagatacttcagtactgcatgagcaagccgggggcggaacaaagcgtacacagcgactggaaagccacgcagatcaaagtgggggatgtgttgttcgcgatggtgaaagaggtggatgcgcggccagcggcatcactgaaaaccagtcctgaactggccgacttactgcgccagcagcacgatgatgtcaggcctagcaagcatctgaataaagcacactggagtacggtgtttctcgacggctcgctgccagattcgcaaatttactacctggtggatgcgtcgtatcaacaggcggttgaactgctgccggaaacgatccgacagcagctctccgtgtaa

SEQ ID NO: 3892 - DNA, 588 bp, Enterobacter cloacae
caccaccgccgtgccgcccgacagttccagcgccgtttcaaaggattccgccagacgcgtcgccagatcttcacggaccttaaaccggtcaatcaccacttcgatggtgtgtttcttttgcagctccagctttggcggatcggacaggtcacacacttcgccgtcgatacgggcgcggatatagccctggcttgccagattttccagcgttttagtatgttcgcccttacgctctttaatgatcggcgccagcagcatcaggcgtttgccttccggctgcgacagcacgttatccaccatctggctgacggtctgggccgccagcggaacgtcgtgatccgggcagcgcggctcgcccacgcgcgcatacagcagacgcaggtagtcatggatttcggtaatggtaccgaccgtggatcgcgggttatgcgacgtggatttctgctcaatggagatagcaggagacaacccttcaatgtggtcgacatccggtttttccatcagcgacaggaactgacgcgcgtacgccgagagcgattcaacgtaacgacgctgtccttcggcatacaaagtgtcgaaagccagtga

SEQ ID NO: 3893 - DNA, 1650 bp, Enterobacter cloacae
ttcatgcaacgtaatcacctgtttatcaaagcagccggtcttcattgctacaggcgtacaacatgcagggatacagagcgggaaatgaatcgtagcgcgcggcgcaaaatgctcaaagtggtcgggattatcatggtagttatgctgccggtgatgcttgcgctatggtttgcccagcttagtgcagtgtcggaaatcagcgcccagctgcgcacgtttgctgaacttgctttaaataaaactgaacgggttattcaacaggttgacctggcccggaaagacgcggaaaaatatcagggcaaagtgtgtacgccggagcatcgtcaatatatgttgaacgtttcccgcggtcgcctttttgttgccgatttaatttatgctgatggccaggactttctctgctcgaccctttttacgccggagcatccttacatcatccccgctgccaattacacacgtaaacccgacgttgctatctattattttcgcgatacaccattttttaatggttataaaatgatatatatgcagcgcggaaattatgtcgcagtggtcaacccgctttcgtatagtgaggtgatgtcagacgatcgttccctgtcgtggggagtgtatgacaccgtcagcaatgcattcttttctgtgagccagaaagccaatatttctttattgcattcgatgcttcgacatcaggaaacgacttttcagaaagatgaccgtttttatacgatcgtaaaatcagagcagcggcccattgcggccatcgtttcaacctccagtgcccgtttttataaaacgctttatcatcaggctaccctgacgctaccgctagggataatttgcagcattattattctgctggtgtggtcgcgtacacaccgtgaattcaattcgcctggccgacttctgcaccgggcgctgaataaacgccagctgtgcgtccattatcagcccattattgatattaaaaataaccagtgcgtgggggcagaggcgttgttgcgctggcctggattcaacggtcaggttatgagcccggcggaatttattcccctggcagaaaaagaggggatgattgagcgcattacggattacgtcgtggaggaggtgttcagcgatctgggccattttcttgccgctcatcccgatctgtatgtctcgattaacctgtcggcgtcagatttccactcttcgcgtcttatcgccctgatctccgacaaagcccgcttttactcggttcgcgcgcagcagatcaaaattgaggtgacggagcgggggtttattgacgtgccgaaaaccacgccggtcattcaggcgtttcgtcaggcggggtatgaagtggcgattgatgatttcggaaccggctactctaacctgcataacctctattcgctgaacgtcgatatcctgaaaatcgacaaatcctttatcgataccttaaccaccaacagcaccagccacctgattgccgagcacatcattgagatggcgcaaagcctgcggctgaaaaccattgcggaaggggtcgagacgggggagcaggtgagctggctgctgaagcgtggcgtacagtattgccagggatggcacttcgcgaaagcgatgccgccccaggcatttatggcctggcagcagcaacccttgcgttaa

SEQ ID NO: 3894 - DNA, 477 bp, Enterobacter cloacae
ttcatttcagtcgataccgtacgctcactatactggcgcctcgtctcatttctgaggaaaacccccatggccgtggcgttaagccgtgttacgcctgccgttgtgcaacgacttcaggtaccggttcaggtactgctctacgcgggactgtttgttttcgcggaatatcttgtcgactggctgcatctgcctttacccgccaacctggtggggatggtgctgatgctgacgctgatcctctgtcgcgcgttgccccttaactgggtgcgcgccggggcgcgctggctgctggcggagatgctattgttctttgtgccggccgtggtggcggtggtgaattatgcacaactgctgatggtcgacggctggcgcatctttgcggttatcgccctgagcacgctgatggtgctgggcgccaccgcctgggtggtggataaggtgtatcgctttgaaatcagcaggcagaagcatgactaa

SEQ ID NO: 3895 - DNA, 1533 bp, Enterobacter cloacae
cgtcttaatataaatgacgcagggttagcaaaaatatcgtcatcagtgcctttagtagtctctttcttgattttaatcagcaaggactggacatttattcggcacatttcagcttcttttttattgattatttgtctctcgggcagcaaggaaacaggggaaatcatgcttacttttctcgaactcctcattggagtcgtggtcattgtcggtgtagcacgctacatcattaaaggttactcagccaccggcgtgctatttgtcggcggcctgacgctgctgatcattagcgcgctaatgggtcatcaggttttacccgccagcgaagccagtaccggatataccgctaccgatattgtggaatatataaaaattctgctgatgagccgcggcggcgatctgggcatgatgatcatgatgctctgcggatttgctgcctatatgacccatatcggcgcgaatgatatggtggtaaagctggcttctaagccgctgcaatatattaattccccctatctgctgatggtcgcggcctatttcctggcctgtctgatgtcattagccgtttcctcagcaacgggccttggcgtgctgttaatggcaacgttgttcccggtaatggttaacgtcgggatcagccgtggcgcagcggcggctatttgcgcctctccggcggcgattattctctcccctacttccggtgacgtagtgctggccgcaaaagccgcggaaatgtcgctaattgacttcgccttcaaaaccacactgccgatctccatcaccgctattctcggcatgggcgtggcgcatttcttctggcagcgctatctcgataagaaagagaacgtcagccacgaaatgatggacgtcagcgaaatcaccactaccgccccggcgttttattccatcctgcccttcatgccgattattggcgtgcttattttcgacggcaaatggggcccgcagctgcacatcatcactatcctggtgatctgtatgctgctggcggccatcctggagttcgttcgtggttttaacacccagaaagtgttcacgggtctggaagttgccttccgcggtatggcggatgccttcgcgggcgtggtgatgctgctggttgccgcgggggtgtttgcccaggggctgagcaccatcggctttattcagagcctgatctctatcgccacttcgttcggctcggccagcattatcctgatgctggtgctggtggtgctgaccatgctggcggcgatgaccaccggctccggtaacgcgccgttctacgcctttgttgagatgatccctaagctggcacactcctccggcatcaacccggcttacctgtccattccaatgcttcaggcctccaacctgggtcgtaccatttctccggtatcgggcgtggtggttgcggttgcggggatggcgaaaatctctccgtttgaagtggtaaaacgcacgtcagtgccggtgctggttggcctgattatcgttattatcgccaccgaagtgctggttcccggcgctgcctaa

SEQ ID NO: 3896 - DNA, 354 bp, Enterobacter cloacae
tcgtggcgttatctacaggaggaatttcacatggctaaaaaactgattgcactgtgcgcctgcccgatgggcctggcacataccttcatggcagcccaggcgctggaagacgcggcgacggaagccggttatgaggtaaaaattgaaacccagggcgcggacgggatccagaatcgcctgaccccgcaggatattgccgacgctgacattatcatccacgccatcgcgatcaccccggaagacaatgaacgcttcgaaatgcgcgacgtgtatgagattacgcttcaggacgccattaaaaacgcggcaggcaccctgaaagagatcgaagagatgattgcagcagaacaataa

SEQ ID NO: 3897 - DNA, 1275 bp, Enterobacter cloacae
tcttcacatccaggggttttcgtcatggctattaaaaaacgcagcgcggttcgcccggacagtcacgagggtgacactcttgccatcaaatccgcaccggttgccgccggtgcgtctttctggaaagagcttccacagcacattatgtcggggatatcccgcatggtgccaacacttatcatgggcggggttatcctcgccatttcacagcttatcgcctacgtctggctggagatcccgcctgacaccggtattctcgacgcgcttaactcaggcaaattcaccggtttcaatctctcgctattgaaatttggctatctgactgaatcgttcggcgggctgctgttcagcttcgccatcccaatgtttgccgcctttgtcgccaactctatcggcggaaaactggccttcccggccgggtttatcggtggccttgtcgccacgcagccgacgctggtgctgaactttgatgcggaaaaactgacctggcttgccaccaaacccgtgccctccacgtttattggcgcgctgattatcgccatagccgcaggctatctggtcaaatggctgaatagccgcattaacgttccacagtatctgctggcctttaaaagcacctttctgatcccaatcctctcggcgctgtttgtaatgctggcgatgtattacatcatcacgccgattggcggctggctgaatgcaggtatgcggaccgtactgctggcggcgggtcaggcgggctccatgatgtacgccatcgggatggcggcggccacggcgattgatcttggcggccccattaacaaagcggcgggatttgttggcctggggctgacaaccgatcatgtcctgcccatcacctcccgcgccgtggcgattgttattccgcccattggtctggggctggccacgctgattgaccatcgtctgaccggcaaacgcctgtttagtccgcagctttatccgcaaggcaaaacggccatgttcctcgcctttatgggcatcagtgaaggggccatcccgttcctgctggaaaatccgcttgcgacgctgccggcgtatatggcgggcgcgatcgccggtgcaatgactgccaccgcgctcggtgccgtgcagtggttccctgaatcggcgatctgggcgtggccactggtcaccaatctgggagcgtacatgctcagtattgtggtcggggcggcgatcaccgcgctgttggtagtgattattcgtaacagtctgcacaagcgcgggaaactcgctatcgacacgctgtaa

SEQ ID NO: 3898 - DNA, 1122 bp, Enterobacter cloacae
agatgtggtgctggtgacggaaacgggcgccgaggtgctttataccttcgacaaacggctattgctgacgggagaataagagtggacagagatttactgcgcgccctgagcgaagcagacgccattgcggcctcagagcaagaggtgcgcgacatcctgctcagtgaggcgcaaaagtaccataaagaggttcagtttgatgggctgggttccgtgcttatccgcgtcaaccagagccggggcccgaaggtgatggtctgcgcccatatggatgaagtcggttttatggtgcgtagcgtctcgcgcgaaggggccattgatgtcctgcccatcggcaacgtgcgcatgatggcccgtacccttcagccggtgcgcatcaccacgcgtaacggggaaaaaataccgggactgctggatggggatctgaaaggagaaaacgttgacaatttgcgtgtcgacattggcgcgacgtcggcggaggaggtgttcgccgccggtatcgacgcaggcgaccgcgtgacgttcgatacaccctttcagacccttccccacaatcgggtgatgggtaaagccttcgacgatcgtctcggctgttacctgctgattgcgctgctgcgcgagctgcaccagacgccgctcgactgcgagctttggctggtggccagctcaagtgaagaggtcggcctgcgcggcggccagaccgccacgcgcgccattcatcctgatatcgcgctggtgctggataccgcctgctggtcaaaaaatttcgattatggcagcgccaaccatcgccagatcggtgcgggcccgatgctggtgctgtacgacaaaacgctcatcgccccagccaaactgattgcgctggctgagacaatcgcgcgctcgcaggggatcccgctgcaaaaagacatgttcagcaacggcggtacggacggtggggcgatccatctctccggcactggcgtgccgactcttgtgcttggtccccctacccgacacgggcactgcgcggcatccattgccgacgaaaaagacattcatcacacccaacaactgcttgtcgcgcttgtggcaggcatgaaccgtgagaccgtggatcatctgacggacttcagatgctga

SEQ ID NO: 3899 - DNA, 984 bp, Enterobacter cloacae
cttccctctgtcgtactccaggatgggataacgacagcaaactcaactcactcaggacgaaacatggcaaacctctacgacctaaaaaaattcgatctcaatctgttagtcatcttcgaatgcatttaccaacatctcagtatcagtagggctgccgagacgctttatatcacgccatccgccgtcagccagtcgctgcaacgcctgcgcggtcagcttaatgaccccctgtttatccgttcagggaagggaattacgccaaccacggtaggtaccaacctgcatcatcatctggaaaaaaatctcaatcagcttgagcagacgatcaacatgatgcatcactcggacatcaaaaaaaagttcgttatctattgctctcaaatggtgtctcctggttcgatgctcgaaccgttgaagctgttaatatctgaagagaattatgagatagagcaaagagacatgctcatttcctccgaatcagcggaagatttgttggcctatcgtaaggccgatctcatcttctctatcgcacctatccacaatcgctctgtggtctgcacccacttcaccacggtgccgatagccttaatctgtagagcagaccacccaaggctcgctgacgcagtcacgctggaagtgctataccaggagaaattcactttttaccagagtgctcatccgggtgtaaaagagtttcagagtcgcgcaaatgacgcgtttccggaaagaaatattgcttttcgtacggactcccttagctctctcatctccatggtctgttcatctgatctgttaggcttcatccccgtgtcgatctatgaaacatataaagaaccgttgaaattaaaaaggcttgagccaccgtttgagctgcctgaattaaagatctatatgctctacagccgttcatcactgaatagcactgttttttcaacattcattgaaaaaatgcataagctctgcgtttctccgccatcggcgtaa

SEQ ID NO: 3900 - DNA, 621 bp, Enterobacter cloacae
aaggaaatgacagacaacctgcaactcacacacctggtcgaggcctgccgctggattggcgctaaaggctgggcgcctgctaccggcggcaatatgtccatgcgtcaggatgaacacctgtgctggctgagcgaatccggaaaagataaaggtagcctgaccaccgccgattttctacaggttgaaatcgccaccaaccgtgcgccgtctggccgtaaaccgtcggcagagaccgggctgcataccctcatctatcgcctgttccccgaagctaacgctgtcctgcacgttcacaccgtcaatgccacggtgctgtcgcggctggtgaacgaggccgagctgaagatcaccggtttcgagatgcaaaaatcccttaccgggcagaccacgcatcgggatacggtggccatcccggtgtttgataacgaccaggacatcgacgccctcgcctcgcgcatcgcccattacgcgcaggaacgcccgcttaattatggttttcttctgcgcggccatggcttaacctgctggggacgcgacgtggccgaagcccgccgtcatctggaaggtttagaattcttatttgaatgcgaaatgcgtttacgacaatgggagagagtatga

SEQ ID NO: 3901 - DNA, 1311 bp, Enterobacter cloacae
tgtctgcatgtcgttaattccctgttgcgttgttgtagcacattgtgtcaggatgaaatccagatgtatagacgtctacatgtcttaattagcaaaactgaggagcaggccatgtcgcaataccgtacctttaccgctcaggacgccgtggagtatgccaggcagtttggcggacttgacgatccgtcatcgctggtagaggcgcaggaagtgggcgacggcaacctcaatctggtttttaaaattttcgacagcgcgggcgtgagccgcatcgtcgttaagcaggcgctgccctacgtacgctgcgtcggcgaatcctggccgctgacgctggatcgtgcccgcctcgaggcgcaaaccctggtcgagcattaccagcacagcccgcagcacaccgtgaaaatccaccactttgatccggaactggcggtgatggtgatggaagatctctccagccatcgcatctggcgcggcgagctgatcagaaataattattacccacaggcagcgcgtcagctgggggaatatctggctcacacccttttccacaccagcgatttttatctgcatccgcacgagaaaaaagcgcaggtggcaaaattcatcaacccggagatgtgcgagatcaccgaagatctgttcttcaacgatccgtaccagatccacgcgcgcaacagctacccggccgagctggaaaacgatgttgccgccctgcgcgacgacgcgcagcttaaaatcgccgtggcctccctcaagcaccgctttttctcgcacgccgaagccctgctgcacggagacattcacagcggttcgatttttgtggccgacggcagcctgaaggccatcgacgctgagttcggctatttcgggccgattggctttgacgttggcaccgccatcggcaacctgctgctgaacttctgcggcctgccggggcacctcggcattcgcgatgccgccgccgcgcgcgagcagcgcctgaccgatattcaggaactgtggaacacctttgcggagcgcttccaggtgctggcaaacgagaaagcccgcgacgccgcactcagcgcaccgggctatgcctccgcattcctgaaaaaggtctggcacgatgccatcggattctgcggcaccgagctgattcgccgcagcgtcgggctttcccatgtggcggatatcgacaccattcaggatgaagcgatgcgtcacgaatgcctgcgccacgcgatatccctcggtaaagcgctgattgtaattgccgaccgcatcgacagcgcggaagagctggtggcgcgggtgcggcagtacagttga

SEQ ID NO: 3902 - DNA, 1113 bp, Enterobacter cloacae
cgcttgctaaaaaaggacaacttcatgagcaacaccgatatccgcgtcgtacccggcccggcgaactacttctctcatccgggaagccttgcacacctggataatttctttactccggaacaactttcccgcgcggtgtggatctacggcgagcgggcaatcgagggcgcacgcccttatctgccgcagagttttaacgcgacgggggcaaaacatctattgtttaagggccattgcagcgagcgtgacgtcacccgtctggtaaacgagtcgggaagtgaaaccagcgtggtgattggcgtgggcggcggtgcggtaatggataccgtcaaggccgtggcgcgtcgtctgggcgtgccgttcgtgggcattcccactatcgccgccacctgcgcggcgtggaccccgctctccgtgtggtacaacgatgccggtcaggcgctacagtttgagatttttgacgacgccaactttctggtgctggtggagccgcagatcatccttaacgccccggcggaatacctgctggcgggcatcggcgatacgctggcgaagtggtacgaagcggcggtgctcgcccctcaacctgagagtctgccgctgaccgtgcgtcttggcctgaacggtgcgctggcgatccgcgacgtgctgctggaacgcagcgaagaggcgcttgcagatcagcagcgcggcgaacagacgcaggcgttccgggacgtggtggatgcgattattgccggaggcggaatggtcggcggtctgggtgagcgctatacccgcgtggcggcggcgcacgcggtgcacaacggcttaaccgtgctgccgcagacggaaaaatacctgcacggcaccaaggtggcctacggcattctggtccagagcgccctgctcggccaggacgacgtgctggcgcagctggtggcggcgtaccggcgctttaacctgccaatcacgcttcgcgagctggacgtcgatattcacaaccgcgacgagctggataaggtcattggccacaccctgcgcccggtggagtcgattcactatctgccggtgacgttaacgcctgaggtgctgcgcgccgcgtttgcgaaggtggaatccttcagccgttaa

SEQ ID NO: 3903 - DNA, 801 bp, Enterobacter cloacae
ttgcgccgacgggctatacctaatgatgattctctccactcttgcaacgaggtcatcatgcagatcgatttatcaggtaagaaagcgctggttaccggcgccagccggggattgggccgtgctatcgcgctgtcgctggcgcgcgccggtgccgatgtggttatcacctatgaaaagtccgtcgataaagctcaggcggtcgccgatgagataaaagcgctggggcggcacggcgaggccattcaggctgacagcgccagcgcgcaggcgattcaggacgccgtcacccaggcggcacgctccctcggcgggctggatattctggttaataacgccgggattgcgcgcggtggcccgctggagtccatgaccctggcggacatcgacgctctgatcaacgtcaacatccgcggcgtggtgatcgccattcaggaagcgctggtgcacatgtcggacggcggacgcatcatcaacatcggcagctgtctggcgaaccgcgtggcgcagccggggatcgccgtctactcgatgaccaagtctgcccttaactctctcacccgaggtctggcccgtgatttaggcccgcgcggcattaccgtcaacctggtccaccccggcccgaccaacagcgatatgaacccggaagacggcgagcaggctgactctcagcgtcagcttattgccctgggccattacggccagccggaggatatcgcagcggcagtcaccttcctcgccagcccggctgcggggcaaatttccggcaccggtctggatgtcgacggcggtctgaacgcctga

SEQ ID NO: 3904 - DNA, 372 bp, Enterobacter cloacae
aaattcggaatttatctaatagtcttattatttccttatattttgtgtgggcgtacagtggaggtacggatgaagattgtgtggtctaaaacagcagagaagcagttttctaaaatcgatcctcgatatcagaaccgcattaaattcaggctggagaagatggacgataaaacatcacctgtcgcggatatcaagaaattatcttctcccgaaaaccactacaggttgcgattaggtgattacagggtcatttacaccttcggagacccgccgggtgatatctgctacgtagtggcagtaaaacgccggacaaccactacctaccttcatgaggagcatacggaatatgactattcagttcatcaaggatga

SEQ ID NO: 3905 - DNA, 891 bp, Enterobacter cloacae
tatccaaaaagcgcctgcgggcgctttttgtgctttaataacccccagaaattaatcgcgcccaaccaatcaggaaagcaaatgttcaggaaggatatcgttatcccgtctggcgcagtagcgcttgcactctgtgtcttctcaattcaggcagatccgcttaagccaacccagtacggcgatttcgatcgctacgttctggccctttcctggcaaaccggattttgccagagcatggtcgaacgtaaccgtgacgaaccggaagagtgtcgcctgcaaaaagagagcagcaacaaaaccgattttctgaccgtccacggcttatggccagcattgccgaaatcgattgccgctcgcggagtggatgaacgccgctggatgcgcttcggctgcgccactcgtccggttccgaatatgccggaagcaaaagccagccgcaaatgtgacgccgcagagaccggactatcgctaacgggcgcggcgaagctgaacagcgtgatgcccggcgcgggcggcaactcctgccttgaacgttatgaatacgcgaaacacggcgtctgctttggttttgatcccgacgcttacttcggcaccatggtgcgcatgaaccaggaagtgaagcacagcgcggcaggaaaatttctggcggaaaactatggcaaaagcgtccgccgcagcgacttcgatgcagccgtggccaaaagctggggaaaacagagcgtaaaagcgttcaagcttacctgccacggcaatccggcttatctgaccgaaatgcagatctcgctgaacgccagcaccatcaacaacccactctctgccggctcctttgcgccacagccgcatccgggcaactgcggcaaacagtttgtcattgataaagccggttactga

SEQ ID NO: 3906 - DNA, 447 bp, Enterobacter cloacae
tttcggcgcccaacaccaggggtattgctcggatatgacaaggacctttcttgtcgccgggcaaaacacgccgccggaggaacacctctctatgcggtgtaccagatcgttctggcggcacaacaggcagctattgatgccatccgccccggcgtttcctgtcatcagatcgatagcgccgtacgttccgtgattgaacgtgcaggttacggtccgcagttcgggcataacaccggccatgccattggtattgatgttcatgaaaatccacgtttttcccctaccgaccgcaccccgttgcagcccggcatggtgctgaccgttgagccggggatctaccttgaacacctgggcggggtacgaattgaagatgtggtgctggtgacggaaacgggcgccgaggtgctttataccttcgacaaacggctattgctgacgggagaataa

SEQ ID NO: 3907 - DNA, 2457 bp, Enterobacter cloacae
cggacttcagatgctgatctcacgcggccaggaggaagtatgctttcaattgaatttttctgcccactgcccaacggcctgcatgcgcgtccggcctgggcgttaaaagagcagtgcagcgcatggcgcagcgacatccgttttatcaacagacggcttcacactcacgcggatgccaaaagctcgctggcgctgatcagtaccggtacgctgtttaatgacagctgcgtgctggaaattaacggcagcgacgaggagcaggcccgacgcgtgctggaggcgtatctcaccggcgcgtttatcgacagcgacagtattccctccggcgacgcgccgcacgttgcgcatcccctgccccgctcgcttgtaaggcttgctccccatcttcaacacggcattacgctcgccagtggcatcggggctggcactctgcgaggctggcagagcgataacctcaaacgttattgtcagatccccgcctcgccggaagatattacccgcctggaacacagcctggcgacgctggccgaacagctcaactaccgcttgcgcgggctggacggcgagagtaaaaccattctcagcgcgcatctttcgctgatccaggatgaggagtttggcggcaccatacgccgactgatcgccgaggagcggctaagccttgcggaggcgatcattcgtaatatggagctgatctgcgacaagctgtcactctccgccagcgactacctgcgtgaacgcgtcagcgatattcgcgacatcagcgagcagcttcttaacattacctggccggagttgcagcaaacctccgcattcaccctcagcgcccccactattctggtggcggaagatctgacgcccagccagtttctcagcctcgacacgcagtacctgaaaggcatggtgcttgaaaaaacaggccggacgtcgcatacgctgatcctggcacgcgcggcctccgtgcctgtgctgagtggtttaacggtcgcctcactggcgccgttgatgggaaaagaggtcattctggacggcatctgtagcgtgctggtcgttgaacccaacgacgcggtgaatgattactacagcgtggcgcagcgccttgccgaccgacgccaccagcagcagatcaaagatgcgggtcttccagcgctcacccgcgacaacgtaccggtagagattgccgccaacatcggcagcgcgctggaagcgcccggggcgtttacctgcggcgcgcagggtatcgggctgtttcgcactgaaatgctgtatatggacagagacaccgcgccggacgagcaggagcaattcgaagcttatcagcaggtgctgctctccgcgcagggcaagccggtcatctttcgcacaatggacatcggcggcgataagcagatcccttacctgaacattccccaggaagaaaacccgttcctcggctatcgcgccgttcgcatttatcccgaatttgccgatctcttccgcacccaactgcgcgcgatcttacgcgcaggcgcaagcggcaatgcgctgttgatgatcccgatggtgcacagcctcgatcagattttatggatcaaacaggagctgcaaaacgttcgtgacgccctggcctcacaggggttacgtcacaccgcgcgcctgccgctggggatcatggttgaagtgccttcagtctgctttatcatcgatcacttctgcgaagaggtggatttcttcagtatcggctcgaacgatatgactcagtatctctacgctgtcgatcgcaacaacccgcgcgtgtcggggctgtataaccccatcacaccgtcttttttacgcatggttcgccagatcgtcaccgcagcgcatcgtcacgggaaatgggtcggcatttgcggggaacttggcggagagcagcgctacctccctcttctgcttgggctgggcttagatgagttcagcatgagcgggccgcgcatccctgcggtaaaaacccagttgcgtcagctggacatggcgacctgccgggcgctggcagataaggcctgcgacagccgcagcgcagaggagattgaagccctgctggcggatttcacaccggaagcgccgccgcgtccattgctggcgctggagactatcgtggtcaatgagccgctgacctcaaaagagcaggtgcttcaattcttatgcggaaatcttgcgattcatggcaggaccggaaacccgctcgagcttgaagaagatctctggcagcgcgaagagattgtcaccaccgccgtcgggtttggcgtggcgatccctcacaccaaatcgcaatggatacgccactccagcatcagcattgcccgtctggacaaggcgattgactgggagtcggatttgggcgacgtcgagctggtgatcatgctgacgctcggcgctcaggaagggattaatcacgtgaaggtcttttccccagctggcgcggaagctggtcaataa

SEQ ID NO: 3908 - DNA, 426 bp, Enterobacter cloacae
cgacatggagtaaaaatgtccagacctacgattatcatcaatgaactcgacgcagaacgtattgaccgactgttggagaaaccagaattcgcctcgctgccggtagccgatgcgctgaacgaagagctagaccgggcgcagatgtgtacgcctgagaccatgccgcatgatgtggtcaccatgaacagccaggtgaagttccgcaacctgaccaccggcgaggagctcacccgtacgctggtctatccggcgcagatgaccgacagcagcacgcaactgtcggtgctggcacccgtgggcgcggcgctgcttggactgcgcacaggcgatactatccactgggaactccctggcggtgcctcagctcacctggaagtgcttgagctgttctaccagcccgaagccgctggcgattacctgcgttaa

SEQ ID NO: 3909 - DNA, 684 bp, Enterobacter cloacae
acactatcagcgctacagcgacagagtgaaagcaaaacgcaaggaatgggggattttatgcaacaacgaataatcaccgaaatggaaacgtaccttcaggcactttcagaagaagagcgaatagccgctattaatgcgtttcgtcaggcattacatgaaatcagcccttttcgcgatcagcccgtcgattgcgtattgtggataaaaaagacaaacatcaccgctaacgattacaacccaaataacgtcgcgccgccggaaaagcggctgctcagcaagtcactggagctggatggattcacacaacctatcgttgtgacggaaaatgcgccacagcactacgaaattgtcgatggttttcaccgtcatgatatcggcagtaaccgggcgatcctgaagcgccagcttaaaggttacctccctgttacctgcctgcgtaaagcgcgccaggaaaagttcgatcgcatggcggcaactattcgtcacaaccgcgcgcgtggacgccaccagatcaacgccatgtcagaaatcgtgcgagaactggtgcttatgggctggagtgagcagaaaattggccaggagttaggtatggacagcgatgaagtgctgcgtctgaagcagatcaacggtctgctcgaactcttcgcagaccgtcgtttttcagaagcctggacggtgaaatag

SEQ ID NO: 3910 - DNA, 582 bp, Enterobacter cloacae
gaggcccagctgcgccagaatcgtcaccaccagcatgacgatcacaatggtcggcacctgccccagcaggctgaacgccgccggaatggtcccttccgccatgtcgccgctcggcagcaccatgttctcagtaatcgacccgccgtagctgtaggtcatcgccacgccctggatgacaaacaggctggcaagggtcgcgagcatgtccggaatgcgcaggatgacgatcagaaacgcgttaaacaggccgaccagcgtacagagcgcgagagtgattacaatcgactcggtggtgccgaagccgtgccagacgaagagcgaaatcaccagcgcgttcgccagcgacgcggtggatcccaccgagagatcgaacccgccgacggtcagggagatcgacacgccgatggcaatcaccgtcacgatggcaatcgagcgcagaatgttaatgatgttgttcggatcgaggaagctgtccgacgccaggccaaaaacggccaccagcgcgacgacggtcagcaacatgccccacttgtagagaaaatcgaaaatctgctgacggccagacgccgccgcgctcactga

SEQ ID NO: 3911 - DNA, 831 bp, Enterobacter cloacae
accatggaattactgagaaggcttcgtgcctggctggctgcggaaaaactggacggcgtgctcatctcttcgcgccagaataaacagccgcacctgggcatttcaaccggttcgggatatgtgctggtgacacaaaccgcggcacatatcctggtggatttccgttactacagcgatatcgcttcacgagcggcgggctatgagatgcatctgcttaacacggagaacccgtttgcgcaggcggtgaaccagattattgcgaaggaagctctcacccgtcttggctttgagggtgaatacgtgagctggcaaacaggcgtgctgtggcgcgatacgctgaataccgccctttgcagcacctcgcttgacgcgctgcggcagataaaaaccgctgacgaaatcgaccgtatccgtgcagcatgcggcattgccgaccgcgccgcacagcacatccggcgtttcattcagcccggtatgcgcgaacgtgaagtcgctgccgagctggagtggtttatgaagcaggagggcgcggacaagccttctttcgacaccattgtcgccagcgggccgcgcggtgcgctgccccacggcaaagcctctgacaaagtgattatgcctggcgagatgatcacccttgatttcggcgcccaacaccaggggtattgctcggatatgacaaggacctttcttgtcgccgggcaaaacacgccgccggaggaacacctctctatgcggtgtaccagatcgttctggcggcacaacaggcagctattgatgccatccgccccggcgtttcctgtcatcagatcgatagcgccgtacgttccgtga

SEQ ID NO: 3912 - DNA, 444 bp, Enterobacter cloacae
caaggagaaacggttatgtatcaaacaatcattatgccggttgatgtttttgaaatggaactgagtgataaggctatacgtcacgcggaatttctcgcgcagcaggacggaattattcatcttctgcatgttttgccgggctctgccagcctgagcctgcatcgtttcgctgctgatgtgcgtcgttttgaagagcatttacagcacgaagccgagacgcgcctgcaaaccatggtcgggcacttcagcatcgatccttcccgcatcaaaacccacgtccggttcggtagcgtgcgcgacgccgttaatgagcttgccggggaattaaatgccgacgtggtagtgattggttcacgtaacccttccatcaccactcacctgctggggtcgaacgcctccagcgtgatccgccacacccacattccggtgatggtcgtcagataa

SEQ ID NO: 3913 - DNA, 261 bp, Enterobacter cloacae
ccaccggtccacagcagcgccagaaccagggacgtaaattcgtgccccagcggagagcccgcgaaacgcggcccctggtcagaccctgggttggcgatcaggaaagaaggcttacggactgccagcgtgttgtcttctttgaaggtcactttcggcgacagctcagcaatctctgtcagcagtgctttgatttctgccgatttcgcgctgtcgtccagcgtggcaatcagctcaacaggtttggtcagtttctcaaggtag

SEQ ID NO: 3914 - DNA, 1281 bp, Enterobacter cloacae
ttccataatatcgttttgtttttttccagacatttaacacgcaggacgcgattaatcatgtcgatctataaaatccctttacaggaaaatgttttagacgcttctgcggaacgcatagactggacgcttaacaatttctccagggtctgcgtttccttttccggtggaaaagattctaccgtgatgctgcatctcgttgcccagaaagcacggcaattaaagcgaaaaatagatgtcatctttctggactgggaagcgcaattctcctcaaccattcagcatgttgacacgatgagaacgctgtatcgggatgttatccatctgttctggtgggtagcgcttccgctcacgacccagaacgccctgtcacagtttcaacctgaatggcagtgctgggaacccgggacaaactgggttcgccagccaccggaagatgccattaccgattaccactatttcgatttttatcagcagggaatgacgtttgaagccttcgtgcgcgagtttgccgaatggtatgcacaaagacgtcctgccgccgtcatggtggggatccccgccgatgaatcttacaaccgctttctggctatcgcgtcggcgcgtaagcagcgcttttctgacgataaaccctggacgaccgtcgccccgggtgggcacgcctggtatatctaccccttgtacgactggaaaaccgccgacatctggacgtggttcgcgaaatcaaaatgttgctataacccgttatacgacctgatgtacaaggcgggggtgccgccgcgttatatgcgcatctgcgaaccgtttggcccggaacagcgtcagggcttgtggctctatcatgtcattgaacccgaacgctgggcggcgatgtgtgaacgcgcctgcggcgtgcgaagcggaggtatttatgccgggcacgataaccatttttatggccaccggaagatcctgaaaccagaccatctcggctggcgcgaatacgccatgctgttactcgacagcatgccgcaaaatacggcggaacattaccgcaacaaaatcgcggtttatctccactggtatcaaaagcgaggcatgaacgatattcccgacacgcaggagggtgacattggtgcaaaagatatcccttcctggcgacgcatttgtaaggttttactcaacaatgactattggtgccgggcactttcgtttagcccaaataagcctaaacactatcagcgctacagcgacagagtgaaagcaaaacgcaaggaatgggggattttatgcaacaacgaataa

SEQ ID NO: 3915 - DNA, 723 bp, Enterobacter cloacae
atgcgaaatgcgtttacgacaatgggagagagtatgattcgcgcgattgtgacggatattgaagggaccaccagcgatatccgttttgtccatgatgttttgttcccctacgcgcgtgagcggctggcggccttcgtgaccgcgcagcagtacgccgagccggtcaaatcgattctggacaacctgcgcgatgaaatcagcgctccgcatgccagcgtcagcgatctcatcaacgtgctgtttacctttatggatgaagaccgcaaatcgacggcgctcaaagccctgcaaggcatcatctggcaggacggttacgtcaacggtgactttaccggacacctctatcctgacgtactgcccgcgctggaaaagtggaaggcacaagggattgatctctatgtttattcctctggctccgtcgccgcgcagaaactgttatttggctacagcgacgaaggtgatattactcatctgttcagcggctattttgatacccacattggcgccaagcgcgaggtgcagtcttatcaaaacattgcggcgcaaacgggcatcgccccgtcgcagatcctgtttctgtcagatattcatcaggagctggacgcagctgaacaggcgggttttcgcaccctgcaactgattcgcggtgaagatgacggcgcaagccatcaccatcagatccaccagtttgacgagattaatccggagcagatcccttcatga

SEQ ID NO: 3916 - DNA, 528 bp, Enterobacter cloacae
aattgcccgtccgcaggagattgctgcgaccgtgctgttcctggcatccgatgccgccagccatatcaccttgcaggatatcgtggtggacggcggctccacgctgggggcgtaatgatctggaaacgtcatttaacgctcgaggagctgaacgccaccagcctgaatacgatggtggggcaccttggcatcgtctatacccgcctcggggacgatacgctggaagcggagatgccggtggatgcgcgcacccatcagccgtttggcctgctgcacggcggcgcctcggcggcgctggcggaaacgctgggctcgatggccggttttctgatgacccgtgacgggcagaacgtggtgggtacggaactgaatgccacgcaccaccgcgcagtctcacacggtaaggtacgcggcgtgtgtcagccgctgcatctgggccgttccagccagagctgggagatcgtggtgttcgacgagcaggggcggcggtgctgtacctgtcggttgagtacgatggtgttggggtaa

SEQ ID NO: 3917 - DNA, 1644 bp, Enterobacter cloacae
caagcgctaacccgatgttatgtctggacatccggatggctaataatatttcgctttatcttatgccttttccgtcgttgtcagtcaaccggagctgtgaaaaattcgctaaatcagaagagtaatgaaggatttacgcggatggtttccagtcgcctagagatgcgcggtatcagcctggccttttccggctttcaggccctgtcgcgcgtggatttcaccctgaacggcgggtcggtgcatgcgctgaccggcgccaacggcgcggggaaatcgacgctgatggcggtgctgtgcgggacgcacgaccactatgaaggcgaaatctgcattaacaaccagccggtaagcatccgcgagccgctggacgccaaacggctgggcatccacctcgtgcagcaggaggtggacgtggcgctgatcccggggttaagcattgctgaaaacatcatgctcgaccagctggcgcagccagggcaccgctaccgctggcgcgacatccgccagcaggcgcggcaggcgctggcgcagctggatgtttcgctcgacgttcgccgctccatcgacggctgcacgctggctgaaaaacagcagattttgctggcgcgggcgttatctcatcactgccgttttttgattcttgatgaacccaccgcgccgcttgacgcgcacgagagcgagcgtctgtttgcggtagtaagacgtctgcaacagcagggcatcggcgtggtgtttatctctcaccgcattcacgagctaaaagctatctgcgacaccctgacggtgctgcgcgacggcaggctgattgagtctggcccgatggccgatctcagcggtgaagcgatcgttgagaagatgctcggccacgagctgagcgatatctatccgcccccgcgcccgccgcacggcgacgaaacgctgctgcgggttgaagggctgcacgacgacgcgctgctgaaagatatctcgctgcacctgcgcaagggcgaaattctcggcattgccgggctggcgggcgcgggcaaaacagaactctgtaaggcgctgtttggcgccagtaaaagccgcgtcgcgaacggcgagctgaaccatcaggactggaaaccgcgcgacccggcggactcggtgctgcgcggcctggcgctggtgccggaagagcggcgcaaagagggcatttttatcgacgagccggtgagcatgaatcttgccgtgtgcgccgataacagcttctcgcgctggagcctgttcggccatcgtcaggcgtggcgctgggcggaggaggtgatcgcccgcgtcggcgttcgcgcccgcggtcccgggcaggttttgcgacgtctctccggcggcaaccagcagaaggtcgccatcggtaaatggttgcgtaatgacgccagcgtgctgatattcgacgagccgaccaaaggcgtggacgtgaaggccaaaaccgatctgtttcagcttatcgacggcctggcgcgcgagggcaaaggggtgatttacgcctccggcgagttcgccgagctggtggggctctgcgaccgcatctgcgtcctgtgggacgggcgcatcgtggcggaaatcgccggggccgaggcccgtgaagagacactactttattattcaaccggaggaacggcgtcgtga

SEQ ID NO: 3918 - DNA, 1068 bp, Enterobacter cloacae
aaaatgaaaaagattgcactctctttggtggcattagggttattcaccgctctgcctggcttcgcggccacgcccgcaccgctcccggcggccattgccaaccatgacggccccattcgcattgcggtgatccgcaacctcggctcagacgacaacaccacgcagtttgttgccggggccattcaggaagggaaaaagctcggctttaaggtcagcacctttttgagcaacggggatgacgctaaattccaggacttcgtgaaccaggccatcagccagaaatatgacgggattatcctgtctcagggccgcgatccgtactccaccgcgctggtaaaaaaggcggtggatgccgggatcaaggtcgccgtatttgataccgccgtcaacggcgagattccgggcgtgaccgttacccaacaggacgatgcctctctgaccaatctctccttcggccagctggcgaaagatttcaacggcaaggccaatatcgtcaagctgtgggtagcgggcttcccgccgatggagcgtcgtcaggcggcgtataaagagttgcaaaagcagtacccggagattaaagagctggagtccatcggcgcggtctcctctgacgtgcagggcgacaccgccaacaaggtgggcgcgatcctggcgaaatacccgaaaggcaaaatcgacgccatctgggggacctgggatgccttcagccagggcgcgtataaggcgctgaaagagaacggccgcaccgagattaaactctacagcatcgacatctccaaccaggatttacagctgatgcgcgagccgggtagcccgtggaaggtgagcgtggcggtagatccgaagctgattggcgcgaccaacgtacgcctgatcgccaacaagattgccggtgaagccacgcctgccacctacgacttcaaagccgctgcgatcccgcaggcgctgctgaccgcgcagccgggggcggtgaacgtggcgtcgttgggcaaaatcattccgggctggggccagacggaagattttatcgcgccgtggtttgcgacgctggaagcgaaaaataaatga

SEQ ID NO: 3919 - DNA, 1083 bp, Enterobacter cloacae
acgtctatacatctggatttcatcctgacacaatgtgctacaacaacgcaacagggaattaacgacatgcagacattacagacgaccagcctgcgggtggcgaataatcagctctttattctcgaccaacaggcgcttccgcaggagaaacgctgggtggatgcctcgacggtcgaggcgctggtcgggcatatccacgctttgcgcgtacgtggcgcgccgttgattggtctctctgcaagcctgctgctggcgctgctggcggaaaacggcaaaagtcgcgacgagctggcggtggcgctggaaacgcttcgcgcatcccgcccgacggcggtaaacctgatgaacaacctcgaccgcatgaagcttgcgctgtgggaagaggatttcgttccggcgctggtggctgaggcgctgcgcctgattgacgaagacaaacggctctgcgacgcgattgcaaaagcgggcagcgcgctggtgaagcccggcagccgtctgctgacccactgcaacaccggcgggctggcgacggcgggcgtcggtaccgcgctgggggtgattgctcgcgcgcataaggaaggcaaggtaagcaacgtctgggtggatgaaacccgtccgctattgcagggcggcaggctgaccgcgtgggaactcggcgagctgggcgtgccgtatcagctaattaccgactccatggccgccagcctgatggcaaaagggcaggtggacgccgtgtgggtgggggcagaccgcattgcggccaacggcgacgtggcgaacaaaatcggcacctactctctggcggtgctggcgaaattccacggcattccgttctatgtcgccgcgccgcaaacgaccctcgacccggactgcccgaacggcgacgcgatcccgattgagcagcgcgccgccagcgaggtgacgggcgtcgccggaagctttggcgcggtgcagtgggcaccgcaaaacgcgcaggtctataacccggcgtttgacgtcacccccgcctcgctgattagcggctgggtactggatacaggcgtggtcactccggacgaggtggcggaagggaaatttgcctga

SEQ ID NO: 3920 - DNA, 621 bp, Enterobacter cloacae
ccccgatggataaagttggttaccttacatctcgacgaaaacacggaggaagtacagatgtctttgattaacactaaaattaaacctttcaaaaaccaggcgttcaaaaacggtgagttcatcgaagtaaccgagaaagatatcgaaggccgctggagcgtgttcttcttctatccggctgacttcaccttcgtttgcccgaccgaactgggcgacgtggcagaccactacgaagaactgcaaaagctgggcgtagacgtttactctgtttctaccgatacccacttcacccacaaagcgtggcacagcagctctgaaactatcgcgaaaatcaaatacgcgatgatcggcgacccgactggcgccctgacccgtaacttcgacaacatgcgtgaagatgaaggcctggcagaccgcgcgaccttcgttgttgacccgcagggcattatccaggctatcgaagttaccgctgaaggtatcggccgtgatgcatctgacctgctgcgcaaagtgaaagcggctcagtacgttgcttctcacccaggcgaagtgtgcccggcgaaatggaaagaaggcgaagcgacgctggcgccatctctggacctggtcggcaagatctaa

SEQ ID NO: 3921 - DNA, 732 bp, Enterobacter cloacae
atttttggcaataaacccggcgtcccgattcacgctgaacggaaatttcgttacgctggaaagactgaacccgggcaatgcgcgttgcagccccagcgtagagagagcgatatgtacttttaccaaccttctcaggggcacggcctgccgcacgacccgctgaacgccattatcggtccacgtccgattggctggatctcatcctgtgatagggccggtcaactgaaccttgccccgtacagcttctttaactgttttaactatcgcccaccgatcattggtttttccagcaatggctggaaggatagcgtgcggaatattaccgaaacgggggagtttgtctggaacctcgcaacgcgcgatctggccgaggcgatgaatgaaacctccgccacgctccctcatggcgaggatgaatttacctttgccggcctgacgcccgtagccagccagcttgtgagctcgccgcgcgtggcggaaagcccggtgaatttcgagtgtcgattgtcacagtgcattcagcttaccggcgcggatgggacaccgattgatacctggctggtgctcggcgaagtcgtgggcgtccatatcgccgagagtttgctggaagaggggatttaccagaccgcgaaagcgcagcccattctgcgtgcgggtggaccgacggcctactatgccatcagtgatagccatcgcttcgacctggtacgcccggatgcgcgcagggggtaa

SEQ ID NO: 3922 - DNA, 1596 bp, Enterobacter cloacae
cgatatggctggcgtgatgttcagcgtggatctgccactgttccagtcaaaacgtcaggacaaggattacgccgccgatgtttcccgctctatgcaggcggcggatcaactgacgctgctcaagcgcgaacacattgcccaggtgcaaacgctggtggcgcagtatcaggctgcgcaaacggtgtggcagcgacagcgggacgaggtactaccgttgcagcgtcaacggctggcggtactgacggcgcaatatcgctctggacagtcggcgcttccggccctgctggaggcgcgtcgtggcgtactggatacggaactggcggtgaaccaggcggagcgcgaaatggcgcgaacctgggctgccgtgaactggctgatcccgcaggagctggcgcaatgaaaaaaacaacgttaatggcgattgccatcgcgatagctgccgctggcggctattttgtcggacagaagcagacgcatcagccggctgcggctgcacaaccctctgaacgtaaggtgctttactggtacgaccccatggtacccggtcagcgcttcgataagccgggtaaatccccctttatggatatggatctggtcccgcgctacgctgatgaagcgcaggcggcgtcaggcgtggccatcagcactcaacagcagcaaaacctggggatgaaaaccgccaacgttgagatgcgccagctggtttcgccgttctcggcctttgccacggttgcaacggatgaacgtaacgtctcggtggtgtcagctccggccaatggcgtggtgtcaaaattgtttgttaatgcaccgcagcagcaggtgaaagccggagaggcgctggcgcaactgtggatcccgcaatggaccaccgcccagcaggagtatctcgcagttcgtcagcttggcgatgccgcattgacccgcgccgcacgcgagcggctggcgttgcagtttatgccggaagaggtcattcgtttgctggagcgtagcggcaagccgcagaccacgctcatcctgcgcgctgaccaggccggctatgtggtgaagctggacgtgcgggaaggggcgcaaatcaccgcaacggcgccgctgtttgagatcgccaggctcgatccggtctggctggtggtcgattacccgcaaacgcaggcgcagtctctggcagtgggcagcaacgtggtcgcaacgtcagaaagctggccgggggagcaattccacggcacggtcagcgaattgctgccgcagatggagacgaccacgcgaaccctgaaagcccgtatcgtgctggaaaattccgcacataagctgaagccgggtatgtacctctccgtcaggcgtgcggaagagatgaaaggcccgccggtgctggcggtgccggaagaggcggtgattaacagcggagagtctgcgcgtctgctgctggctaccggggacggttatttccggcctgtgacggtgacaaccggcctgacggcgcagggctggacggcgatcctgtccggggtcaaacagggcgataaggtggtgacgtccgggcaattcctcattgattccgaagccagcctgcgtagcgtgatgccggaggtgacgccatga

SEQ ID NO: 3923 - DNA, 996 bp, Enterobacter cloacae
atatcacaggctggagccagaagggggaaatacggtgctgatgcgggcgatccacgaaggtgccgtgctgcgcgtgcgtccgaaggtgatgacggtcgccactattatggcaggactgctgcccatcatgtgggggagtgggagtggctcggaggtgatgcaacgtattgccgcgccgatgattggtggcatggtaacggcaccgttattgtcgatgttagttattcccgcactctacaaattgttacatcaacgttaaatatgtcaactgcatgtgcttattcaggcatgcagtttatgtatcctcagattattcccaggaacgggatggtaattaggaataacacccatgctgttaagcgttcattcaagtattctgtgttaaggtctgcaccgaatactaaatatggtaatggcattgtgattgtacgaattaaattccccctgattttgttgtttattattgggcagttatcgtgtgcgtttgctgttaatgcagacagcaatacagcggataaaggctggttcaccaccttcacggataacgtcgcgcaaacatggaatgaacctgagcattacgatctctatattccggccattacgtggcatgcacgtttcgcctacgataaagaaaaaacagaccgttataacgaacgtccgtggggggccggcttcggtcagtctcgctgggatgaaaaaggtaactggcatggcctgtacctgatggcgtttaaggactcctacaataaatgggagcctattggcggttacggctgggaaaaaacctggcgtccgttatcagacgacaacttccgtctcgggctgggctatacggcagggtttacggcgcgtgataactggaaatacattcctgttccggtactgctgccgcttgcctccattggttacggtccggcgacgtttcagatgacctacataccgggtacctataacaacggtaacgtttactttgcctggatgcggtttcagttttaa

SEQ ID NO: 3924 - DNA, 1310 bp, Enterobacter cloacae
ctctggggttgtcttccatccggcggggaagatttgcccgacggtggacagcggggcgatgtgggattaggttagccgacgaaaatataaatgataatcattattgcttcttttatcattttaaggaggatgatatggacacgtccctggctgaggaagttcagcacaccgcgactacgctgcaagcagatagctttttctttatgtcgccttaccgcagttttaccacgtccggctgttttgcccgtttttctgaacccgccgtcggcggtgacgatccggcgggtccctttcagcagaaattagctcaggctttccggaatgcgaaaaacagcggcattgcccatccggtgatggtaggggcgatccccttcgatacccgcaaaccgtcatcgctgtttattccgcaacgctggcaaaccttctcccgcccggcgcgtcagcagtccgcacgctacgcctccggcgcgcagacgctgaacgtgcaacaacgcaccgagatcccgccgcagccgattttcgaggagatggtggcccgcgccgcgtcgctcaccgccacgccgcaggtgaataaggtggtgctgtcgcgcctgattgatattgccaccgacaaacagattgatagcagcgcgctgatggagcgtcttatcgcccagaacccggcgagctttaacttccacgtaccgctggaagacggcggcgtgctgctgggcgccagcccggaactgctgctgcgtaaagagggcgcgcactttagttcgctgccgctggcgggctctgcgcgccgtcagccggacgatgtgctggatcgcgaagcgggcactaagctgctggcctccgaaaaagaccgtcacgagcacgacctggtaacccaggcgatgaaaaccattctggaaccgcgcagccatcatttgagcatgccggcttccccgcagctcattaccaccccaacgctgtggcatctggccacgccggttgagggtgacgcgcgtgaaaacgagaacgccctgacgctggcctgcctgctgcacccgaccccggccctgagcggtttcccgcatcaggcggcaaaagaactcattgccgagctggagcccttcgaccgcgaactgttcggcggcattgttggctggtgcgacagcgaaggtaacggcgagtgggtggtaactatccgctgcgcgcggctgcatcaaaataccgttcgcctgtttgccggcgcgggcattgtgcctgcttcctccccggtgggcgagtggcgcgagacgggcgtgaagctctccaccatgctcaacgtgtttggtttgcactaa

SEQ ID NO: 3925 - DNA, 1620 bp, Enterobacter cloacae
ggaatactcatgaccatcccttttacccgctggcctgaggattttgcccggcgctaccgtgaaaaaggctactggcaggatctgccgctgacccacatcctgacggaccatgcggacagcgatgcggtcgcgataattgacggcgatcgccgcattacctaccgcgcgtttaatcaggcggtgacgaatctggcgtccgcccttcaggcgcaggggctgcatcgcggcgagaccgcgctggtgcagctcggcaacgtggccgagttctacatcaccttcttcgcgctactgcaaatcggcgtcgcgccggtcaacgcgctctttagccatcagcgcagtgaactcaacgcctacgcggagcagatcaaacccgccgtactgattgccgatcgcgaccacgcgctgttctcgggcgatgattttctcaacacctttgtggatgcgcatcgctcggtacgcgttgtgctgctacgcggcgataagggcgaacacgcgctggaggcggcgatttcacgcccggcggacaatttcatcccgaacccgacgcccgccgacgaagtggcgttcttccagctctccggcggcagcaccggcacgccgaagctgatcccgcgtacgcacaacgactacgactacagcattcgccgcagcaacgaaatctgcggtatcactgcgcacacccgctatctgaacgcgcttcccgcggcgcacaactacgccatgagttcgccgggatcgttaggcgttttcacggcgggcggctgcgtggtgctggcgaacgatccgagcgccacgctctgcttcccgctgattgagcagcatcagatcaacgtcacctcgctggtgccgcccgcggtcagcctgtggttgcaggcgattgccgacggcgcggggaacgcccagctgaaatccctcgaactgctccaggtaggcggcgcacgtctctccgccacgcttgcggcgcgcattccggcggaaattggctgccagcttcagcaggtgtttggcatggcggaagggctggtgaactacaccgccctcgacgatgcgccggagcgcatcatcaatacccagggccgcccgatgtgcccggacgacgaagtgtgggtggcggacgaggacggcaacccgctgccgcgcggggaagtcggacgcctgatgacgcgcggcccgtacaccttccgcggctatttcaacagcccggaacacaacgccagcgcctttgatgccaacggtttctactgctcgggcgatctgatcgccatcgacgagcagggttacatcaccgtgcaggggcgcgagaaagatcagatcaaccgcggtggcgagaagatcgccgccgaagagatcgaaaacctgctgctgcgccacgacgcggtgatccacgccgcgctggtgagcatggaggacagcctgctgggcgaaaaaagctgcgcgtacctggtggtgaaacagcccctgcgcgcggtggaggtgcgacgcttcctgcgcgagcagggcgttgccgaatttaagctgccggaccgcgtggagagcgtggatgcgcttccgctcacgccggtcggcaaagttgataagaaacagttgcgcctgtggcttgctgaacgcgcccggggctga

SEQ ID NO: 3926 - DNA, 822 bp, Enterobacter cloacae
tttcgtgatgctggcaaaaaatccgaccctcgatgcctggtgggcgctgctctcccgcgaggtgaagtgatggcttttgattttaccggtaaaaccgtctgggtgacgggcgcgggtaagggcattggctatgcgaccgcgctggcatttgtggaggccggggcgcaggtgaccgggttcgatctggctttccctcacggcgaatatccgtttgccaccgaaacgctggacgtggcggatgcggcgcaggcgagtgacgtctgcgggcgtttgctcagcagccttgagcggctcgacgtgctggttaacgcagcgggcattctgcgtatgggcgcgacggatcagctttcgccggaggactggcagcagacctttgcggtcaacgtcggcggcgcgttcaacctgttccagcagacgatgggccagttccgtcgtcagcagggtggggcgattgtgacggtggcctctgacgcggcgcacacgccgcgcatcggcatgagcgcctacggcgcgtcgaaagcggcgctgaaaagcctggcgctgacagtcgggctggaactggcgggcagcggcgtacgctgtaacctggtgtcgccgggttcaacggataccgacatgcagcgcaccctgtggaccagcgacgatgcggaacagcggcgcattcgcggctttggcgagcagttcaagcttggcattccgctcggtaaaattgcccgtccgcaggagattgctgcgaccgtgctgttcctggcatccgatgccgccagccatatcaccttgcaggatatcgtggtggacggcggctccacgctgggggcgtaa

SEQ ID NO: 3927 - DNA, 1098 bp, Enterobacter cloacae
atttcgagtgtcgattgtcacagtgcattcagcttaccggcgcggatgggacaccgattgatacctggctggtgctcggcgaagtcgtgggcgtccatatcgccgagagtttgctggaagaggggatttaccagaccgcgaaagcgcagcccattctgcgtgcgggtggaccgacggcctactatgccatcagtgatagccatcgcttcgacctggtacgcccggatgcgcgcagggggtaatatgcgcgcaaccctgttgcccgccgatcagcagttttttgccgatctgttgagcggcctggtgctcaacccacagcagttggggcgagtctggtttgctcatcgtggcgcgtctgacgctgtcggaagcgtgagccgcgactggccacggcttgacgtcgttcttcgcggggaatatggcaacagactggttgccgggcagcagcccctccaccagggggaaatgctgtttcttcccgcccaggccgccagcgtcccggtgtttgaacgaccggtcatgctgctgagcattcttttcgcgccgtcgtggctggggctggtgtttcatgatacccggcacgggcgatccgtgcctgcgcagcgacacgtggagcttcctcaccctgaacgaggtgagtgtgccgcgatgctgatggccctgacgcacctgagcgcttccccgcaggaccaggctattattcaaccactggtgctgagcctgctgcactggtgccgtaaagtggtgtcgtcgctgcctgaaccgggagtgtcgcgcggggatttcctctatcagagcatttgtaactgggtgcaggaaaactatgctgaacccctgtcgcgggacagcgtcgcttcgctgtttaatatttcggctaaccatctgtcacgcctgttctctcaacaggggacgatgagttttgtggattacgttcgttgggtgcgtatggcgaaggcgagaaccatcctgcaaaaataccacctgccggtgggggaagtggcgaagcgctgcggctatgccgatagcgactattttagccgtctgttccggcgccagtttggcctgacgccgggggagtatcgcgcacgctttcagtga

SEQ ID NO: 3928 - DNA, 1305 bp, Enterobacter cloacae
cggtttcaagattatctcgctgacgccagcacgctaagcgaggtcaccatgaaacaacacacactgagcctgtggctcggtggggtgttgttcggcctgttaacctccgccgcgcaggcggagccgtggacgctcgaacacaccctgaccgaagcccagcgctactcagcagaactctccgccagccgtaacgaagcgcaggcgctggatgcgatggcggtttccgccacgcaattacctgacccaaaactgaaattcggcatcgaaaacgtgccggtacagggcagcaacgatcggcggctgacgcgcgaagggatgaccatgcagaaggttggcatcatgcaaagctacgtcagctcagagaagcgggaacgtaaagcgcagaccttgcaggcgcaggcgcgaagcgtgctggcaaaatccgaagccgtccgcgccgcgcttcagcgtgataccgcccaggcctggctggatctggcgctggcccagcaggcactgaacacggccagaacgctggtccgtgaaacggaacgtcagcgcggcgtgcagaaggcgagcgtcggggcgggaagcgcaatgccggacagcgtactggccctgcaaatgatcctcagcgccatgcgcgacaaagagacgctggcgcagcgggatgtgcagctggcgcaaagccgcctgctggagctaacggggcacgctataacggaggttcgcggtccgctgccgcgttatcagcgtcttcctgccaatgaaaaaacgttgcaggaggggatcgtcaggcacccggaagtggaggccgcgcgacgtgaagcagagaccgcgaaagcgcgttcagcgcaatctgccgtggcggcgatacccgatgtggatgtggaggtctattacgcccaccgcgctgaaggctatgacgatatggctggcgtgatgttcagcgtggatctgccactgttccagtcaaaacgtcaggacaaggattacgccgccgatgtttcccgctctatgcaggcggcggatcaactgacgctgctcaagcgcgaacacattgcccaggtgcaaacgctggtggcgcagtatcaggctgcgcaaacggtgtggcagcgacagcgggacgaggtactaccgttgcagcgtcaacggctggcggtactgacggcgcaatatcgctctggacagtcggcgcttccggccctgctggaggcgcgtcgtggcgtactggatacggaactggcggtgaaccaggcggagcgcgaaatggcgcgaacctgggctgccgtgaactggctgatcccgcaggagctggcgcaatga

SEQ ID NO: 3929 - DNA, 2124 bp, Enterobacter cloacae
ggactcggtcaaaacgctgacgcacaagctgctcgaagagtttgccgtggtggtactggtgtgtgcgctgttcctgttccacctgcgctccgcgctggtggcgatggtctctctgccgctggggatcctcggggcttttgtggtgatgcactatcagggcataacgcgaatatgatgtcgctcggcgggatcgccattgccatcggggcgatggtggatgccgcaattgtgatgattgaaaacatgcacaaggtgctggagctgtggcggcatgataatccgggcaaggagcccgcgccgggggaatactggcgtctggcggaaaaggcggcggttgaagtgggaccggcgctgttttgcagcctgttaatcatcacgctgtcatttataccggttttttcgctggaagcgcaggagggcagaatgttctcgccgctggcgttcaccaaaacctggtcgatggccgtggccgccgggcttgggatcaccctggtgccggtgctaatgggctttttcattcgcgggaaaatccccgatgagaaggcaaacccgatcaaccgcctcctgatccgcctgtatgagccgctgctggacaaggtactgaccttcccgaaaacgacgctggcactggcatgtctgctactgatcgccacgctctggccgctgagccgcctgggaagcgaatttatgccgccgctggatgaaggagatttactctatatgccctccacgctgccggggatctctgctcgcgaggcatcacggctgcttcagcagacggaccgcttgatcaaaagcgtcccggaggtggcgagcgtgtttggcaaagccggtcgggcagagtcggcaaccgatcccgcgccattaaccatgctggaaacaaccatccactttaagccccgcgagcagtggcggccaggaatgacgccgcaaaagctggtggaggagctcgataaaaccgtgtcgctgccgggcattgccaatgtgtgggtgccgcctgtccgtaaccgtctggacatgctggcaaccgggatcaaaagcccggtcggcattaaggtgaacggcaataatattgccgacattgagcgtgtggcccggcagattgagcaggtggtgaaggacgttcctggcgtctcctctgcgctggcggagcgtctggaaggcggacgctacgtggatattcgtatcgatcggcaaaaagccgcgcgctacggcgtttccgtcgatgaactgcaaagcctggtctccacgctggtcgggggcgataacattggcgaggtgatccagggacgcgagcggtatcccatcaacctgcgttatccccgcgatttgcgtgataacgtcgacgcgttgcgggtgttgccggtagtgaccgccagcggtagccaggtggcgctgggggaattggccgatatcgtcgtgacggaaggcccaccgatgctaaaaagtgaaaacgcgcgcctttccagctggatctatgttgacttgcgcgggcgcgatctgaagtccgccgtggatgaaatgcaaaaacgggtggaggagaaggtggtattgccgcagggcgtgtctctctcctggtccgggcagtttgaatatctggaacgggcgaccgcgaggctcaaaatagttttacctgtcacgctgatgattatattcgtccttttatggttaaccttcaggcggatatcaaatgtcctgataataatgggggcattgccgttcgcgcttattgggggcgtgtggttattgtggctgcttgaatataatttgtcagtggcgggggccgttggctttatcgccctttccggagtggcggcagaattcggcgtaattatggttctttatttgaatcatgcgatcgataaatatcacaggctggagccagaagggggaaatacggtgctgatgcgggcgatccacgaaggtgccgtgctgcgcgtgcgtccgaaggtgatgacggtcgccactattatggcaggactgctgcccatcatgtgggggagtgggagtggctcggaggtgatgcaacgtattgccgcgccgatgattggtggcatggtaacggcaccgttattgtcgatgttagttattcccgcactctacaaattgttacatcaacgttaa

SEQ ID NO: 3930 - DNA, 1035 bp, Enterobacter cloacae
aacagcccctgcgcgcggtggaggtgcgacgcttcctgcgcgagcagggcgttgccgaatttaagctgccggaccgcgtggagagcgtggatgcgcttccgctcacgccggtcggcaaagttgataagaaacagttgcgcctgtggcttgctgaacgcgcccggggctgaggaacagagaatggccattccaaaattaaccgcatacgcgctgccaaccgccgccgaactgccgaccagtaaagtgaactgggcgtttgaaccggagcgcgccgcgctgctgatccacgatatgcaggagtacttcctgaacttctggggcgaaaatagcgacatgatgcagcaggtagtggcgaacatcgctaaactgcgcgcgtactgcaaagagcacaatattccggtgtactacaccgcgcagccgaaagatcagagcgatgaagaccgtgccctgctgaacgacatgtgggggccgggcctgacccgttcgccggagcagcagcgcatcgtcgctgagctgaccccggatgaagcggacaccgtgctggtgaagtggcgctacagcgcgtttcaccgctcgccgctggagcagatgctgaaagagaccgggcgcaaccagcttttgatcaccggcgtatacgcccacatcggctgcatgaccaccgccaccgacgcctttatgcgcgacattaaaccgttctttatcgccgacgcgctggcggatttcacccgcgacgagcacctgatgtcgctgaaatacgtggccggacgttcgggccgcgtggtgatgaccgacgagctgctgccgtccgttccggcaacgaaagccgcgctgcgtgagctgatcctgccgctgctggacgagtccgacgagccgatggatgacgaaaacctgatcgactacggtctggattcagtacggatgatggcgctcgccgcccgctggcgcaaagtgcacggcgacattgatttcgtgatgctggcaaaaaatccgaccctcgatgcctggtgggcgctgctctcccgcgaggtgaagtga

SEQ ID NO: 3931 - DNA, 2139 bp, Enterobacter cloacae
catctcactgtttcacaacaacggacaacaactatgaacaactcagggaaataccttacgtgggcggtgctctccgtggtgggagcctttgccctgggctatatcgccctcaaccggggggagcagatcaacgcgctgtggatcgtcgtcgcctccgtctgcatttatctgatcgcataccgtttttatggccgctatatcgcaaagacggtgctgggcgtagacggcacgcgcatgacgccggccgtgcgtcataacgacggtctggactacgtgccgaccgataaaaaagtgctgttcggtcaccatttcgcggcgattgccggggcaggcccgctggtggggccggtactggccgcgcagatgggctacctgccggggatgatctggatcctcgctggggtggtgctggcgggcgcggtgcaggacttcatggtgctgttcgtctccacccgtcgcgacggtcgttcgctgggtgagctggtgaaagaagagatgggggcaaccgccggggtgattgcgctggtggcgacctttatgatcatggtgatcatcctcgcggtgctggcgatgattgtggtgaaagccttgacccacagcccgtggggaacctataccgtcgccttcaccataccgctggcgctgttcatggggatctacattcgctacctgcgtccggggcgcattggtgaagtgtcagtcattggcctggtgttcctggtgtttgccattatctccggcggctgggtggcggaaagcccgacctgggcaccgttcttcgacttcaccggcgtgcagctgacctggatgctggtaggctacggcttcgtggcggcggtgctgccggtatggctgctgctggccccgcgtgactacctctctaccttcctgaaaatcggcaccatcgtcgggctggcgatcggcattttaattatgcgcccgaccctgaccatgcctgcgctgaccaaatttattgacggcaccggcccggtctggaccggcaatctgttcccgttcctgtttatcaccatcgcctgtggggcggtgtcgggcttccacgcgctgattgcctccgggaccacgccgaagatgctggcgaatgaaaatcaggcctgcctgattggctacggcggcatgctgatggagtccttcgtggcgattatggcgctggtttcggcctgtattattgacccgggcgtgtatttcgcgatgaacagcccgatggcggtcctggctccggcgggcaccgttgacgtggtcgcctctgccgcgcaggtggtgagcggctggggctttgcgattacccctgaaacgttgacgcatatcgctaatgaggtcggcgagcagtcgattatctcccgcgcaggcggggcgccaacgctggcggtgggcatggcctacatcctgcacggcgcgctgggcgggctgatggatgtctcgttctggtatcacttcgccattctgttcgaggcgctgtttattctgacggcggtggatgccggtacccgtgcggcgcgctttatgttgcaggatctgctgggggtgatctccccgaacctgaaacgtaccgattcactcccggctaacctgctggcgacagcgctgtgcgtgctggcgtggggctacttcctgcatcagggcgtggtcgacccgctgggcgggattaacaccctgtggccgctgttcggtatcgccaaccagatgctggcgggcatggccctgatgctctgcgcggtagtgctgttcaagatgaagcgccagcgttacgcatgggtggcgctggtgccaacggcgtggctgctgatctgtaccctgaccgcgggctggcagaaagccttcagcccggacaacaaggtgggcttcctggcgatcgccaataagttccaggcgatgatcgacagcggtaagatcccggcacagtacaccgaatctcagctgtcgcagctggtgtttaacaaccgtctggacgccgggctgaccatcttctttatggtggtggttgtggtgctggcgttgtattctctgaaaaccgcgctggcggcgttgaaagtcgacaaaccgacggcgaaagagacgccgtatgagccaatgcctgagaacctggacgagattgtcacccaggcgaaaggggcgcattaa

SEQ ID NO: 3932 - DNA, 312 bp, Enterobacter cloacae
cattaccaaaccccctcaccccagccctctccccaaaggggagagggtgttaaagttccctctcccctttggggagagggtcagggtgaggggaatacaaacgagaaactgattatgttcgacaccctttccaaagcaggtaaatacctgggccaggccgctaaaatgatgattggcgtgccggattacgacaactacgtcgagcatatgcgcgtcaaccacccggaccagacgcccatgacctacgaagaatttttccgcgaccgtcaggacgcccgctacggcggcaagggcggggcgaagtgctgttaa

SEQ ID NO: 3933 - DNA, 1035 bp, Enterobacter cloacae
agagacactactttattattcaaccggaggaacggcgtcgtgagcaaggccctttcagtgagcgcggcggcgtctggccgtcagcagattttcgattttctctacaagtggggcatgttgctgaccgtcgtcgcgctggtggccgtttttggcctggcgtcggacagcttcctcgatccgaacaacatcattaacattctgcgctcgattgccatcgtgacggtgattgccatcggcgtgtcgatctccctgaccgtcggcgggttcgatctctcggtgggatccaccgcgtcgctggcgaacgcgctggtgatttcgctcttcgtctggcacggcttcggcaccaccgagtcgattgtaatcactctcgcgctctgtacgctggtcggcctgtttaacgcgtttctgatcgtcatcctgcgcattccggacatgctcgcgacccttgccagcctgtttgtcatccagggcgtggcgatgacctacagctacggcgggtcgattactgagaacatggtgctgccgagcggcgacatggcggaagggaccattccggcggcgttcagcctgctggggcaggtgccgaccattgtgatcgtcatgctggtggtgacgattctggcgcagctgggcctctcattgaccacgcacggccgccggatgtacgccattggcggcaaccccgaagccgcgcgcctctcgggcattcgcaccacgcgctacaaggtggcggcctacgtgattgcctccctgctggcgggcctgggcgggattttgctggcctcgcgtattgggtcgtcgcaggtgaatgcgggcggcggttacctgatggatgcggtggcggcggcgtggatcggcttctcgctggccgggtccggcaagccgaatgccctggggaccctggtgggggcggtgatcctcggcgtgctgtcgaacgggctggtgatgctctccgtgccgtattacgccatggacataataaaagggctggtgctcgcggtagcgctggcgattacctacatacaaaaacgctga

SEQ ID NO: 3934 - DNA, 1242 bp, Enterobacter cloacae
acgtctaagcgtcttgattgccaaagactaacatcgtgttatagtgtcagcaacataagtattacaggcaggcacactacaatgagcaataacccgttgatcccgcagagtaaacttcccaatctcggcacgacgatttttacgcagatgagcgccctggcgcagcagcacaacgccattaacctctcacaaggtttcccggattttgatgggccgaaatatttgcaggagcgtctggcgtaccacgttgcgcagggagccaaccagtatgcgccgatgaccggcgtgcagacgttgcgtgaagccattgcggataaaacggcggagttatacggccataagcctgacgcgaacagcgatatcacggtgacggcaggggcgaccgaagcgctgtatgcggcgataaccgccctggtgcgtacgggtgatgaggtgatttgttttgacccgagctacgatagctacgccccggcgattgaactggccggcggcgtggtgaagcgcgtggcgctccagccaccgcattttcgccctgactggcaggcatttgctgcgctgctgagtgacaaaacccgtctggtgatcctgaatactccgcataatccgtcggcgacggtgtggcaaaaagccgattttgctgcgctgtggcaggccatcgccgaacgtgaaatatatgttctgagcgacgaggtgtatgagcatatctgcttcgccgaagaggggcatgccagcgtgctggcgcatccgcaacttcgcgagcgtgcaatcgcggtatcgtcatttgggaaaacctaccatatgaccggctggaaggtagggtactgcgtggccccggcggccattagcgctgagctgcgcaaagtgcatcagtacctgacgtttgccgtgaacacaccggcccagctggcgctggcggatatgctgcgtgcggaacccgggcattaccgcgagctgccgcacttctatcgtgaacgtcgggatctgtttgtggcggcgctgagcaaaagccgcctggaaattttgccgtctgaaggaacctatttcctgctggccgactacagcgcgatttccgatctggacgacgtgagtttctgccagttgttgacgaaagaggtgggagtggcggccattccgctgtcggtgttctgcgccgatcccttcccgcataagctgattcgtctttgctttgcgaagcaggaatcgacgctgctcgctgcggcagagcgtctggcgacgctctga

SEQ ID NO: 3935 - DNA, 1605 bp, Enterobacter cloacae
ggcggcttgcatgatgacgttttaagagagggaagaataatgctcgacactaacatgaaaacccagctcaaggcctaccttgagaaactgaccaaacctgttgagctgattgccacgctggacgacagcgcgaaatcggcagaaatcaaagcactgctgacagagattgctgagctgtcgccgaaagtgaccttcaaagaagacaacacgctggcagtccgtaagccttctttcctgatcgccaacccagggtctgaccaggggccgcgtttcgcgggctctccgctggggcacgaatttacgtccctggttctggcgctgctgtggaccggtggtcatccgtcaaaagaagcgcaggcgctgctggagcagatccgcgatatcgacggtgattttgagtttgaaacctattactcgctctcctgccacaactgcccggacgtggtgcaggcgctgaacctgatgtcagtcctcaacccacgcattaagcacacggcgattgacggcggtacgttccagaacgaaatcaccgagcgtaacgtgatgggcgttccggcggtttacctgaatggccaggagttcggccaggggcgcatgacgctgaccgaaatcgtcgccaaagtggataccggcgcagaaaaacgcgcggcggaagagctgaaccaacgcgatgcttatgacgtgctaattgttggctcaggcccggcgggcgcggcggcagcggtctactccgcacgtaaagggatccgtaccggtctgatgggcgagcgtttcggtggtcaggttctggataccgtagacattgaaaactacatttccgtgccgaaaaccgaaggccagaagctggccggtgcgttgaaagcgcacgtcagcgactacgacgtggatgtcattgacagccagagcgccagcaaactggttccggcggcggtcgagggtggtttgcaccagattgaaacggcgtccggcgcggtgctgaaggcgcgcagcgtgatcattgccaccggcgcgaaatggcgcaacatgaacgtcccgggcgaagatcagtatcgcaccaaaggcgtgacctattgcccccactgtgacggcccgctgttcaaaggtaaacgcgtcgcggtgatcggcggcggtaactccggcgtggaagcggctatcgatctggcgggaattgtggaacacgttaccctgctggagttcgctccggagatgaaagcggaccaggtgttgcaggataaggtgcgtagcctgaataacgtcgacattgtgctcaatgcccagacgacagaagtgaaaggcgacggcagcaaagtgactggtctggaataccgtgaccgcgtgagcggcgatatccacagcgtagcgctggcagggatctttgttcagattggcctgctgccaaacaccacctggctggaaggcgctattgagcgtaaccgcatgggcgagatcatcatcgatgcgaaatgcgaaaccagcgttaagggcgtatttgcggcgggcgactgcaccaccgtgccgtacaaacagatcatcatcgctaccggtgaaggtgcgaaagcgtcgctgagctcgtttgattacctgatccgcaccaaaactgcataa

SEQ ID NO: 3936 - DNA, 1266 bp, Enterobacter cloacae
gcttacccacaccctttcggaggttgcatgaaagctctcacctatcacggtccacatcatgttcgggtcgataatgtccccgatccgggcatcgaacagcctgacgatatcatcctgcgcgtaacggccacggcgatctgtggttctgatttgcatctttatcgcggaaaaattcccaaggtccagcatggcgatatctttggtcatgaatttatgggcgaggtggtggagtgcgggagcgaagtgaagaacgtgcagaaaggtgaccgggtggtgatcccgtttgtaattgcctgcggtgactgcttcttttgccagatgcaacagtacgcggcctgcgaaaacacgaatcgcgggcagggcgcggcgctgaacaaaaagcaaattcccgcccctgccgcgctgtttggctacagccatctttacggcggcgtgccgggcggacaggcggagtatgtgcgcgtcccgaaaggcaacgtggggccatttaaagtgcctcagctgctgtctgacgacaaagcgcttttcctgtcagatattctgcctaccgcctggcaggcggcgaaaaatgcgcagattcagagaggctccagcgtcgccgtattcggggccgggccggtggggctactgaccattgcctgcgcgcggcttctcggcgcagagcagatttttgtggttgatcatcatccctatcgactgcggtttgcccaggagcgctacggcgcgatcccgattaactttgatgacgataacgacgcggcggagaaaatcattgagcaaacggccggacagcgcggagtggatgcggtgattgatgccgtcgggtttgaggccaaaggcagcaccacggaaacgatcctcagtaacctgaaaattgaaggcagcagcggcaaagccctgcgccagtgcattgctgcggtgcggcgcggaggcgtggtcagcgtgccgggcgtgtatgccggttttatacacggcttcctgtttggcgatgccttcgataaagggctgagctttaagatggggcagacccacgtccatgcctggctgggagagctgctgccgcttatcgaaaaagggctgcttacaccggaagatattgtcacccactatcttccgctgtctgatgcggagcgcgcctataaaatcttcgaaaaacgggaggaggagtgccgcaaggtgatcctggtgcctggtgcagacaccccggaggcagcgcagcagaaagtgaagggactggtaaatgccttccccggcggcgttgtgtga

SEQ ID NO: 3937 - DNA, 234 bp, Enterobacter cloacae
ggcaccgccagggagttcccagtggatagtatcgcctgtgcgcagtccaagcagcgccgcgcccacgggtgccagcaccgacagttgcgtgctgctgtcggtcatctgcgccggatagaccagcgtacgggtgagctcctcgccggtggtcaggttgcggaacttcacctggctgttcatggtgaccacatcatgcggcatggtctcaggcgtacacatctgcgcccggtctag

SEQ ID NO: 3938 - DNA, 336 bp, Enterobacter cloacae
ttcgttgattttatttacttaacgtttaacaggagttttatcatgcgtaccgtattcctttccgcgctggttggcgcgtccgtctctttcgcttcttataccgcccaggcaaaccagacctggcagggccgcggcgtggttcagtcgatctctgacagcgccgtcatgctccggcacgaggccataccggaactaaaatggccagcaatgaccatgccgtttactttatctgccggcgccacgctgaatggcgccaaaccgggggatgaagtgaccttcacgcttgagcgtgcgggtgacggtttcaagattatctcgctgacgccagcacgctaa

SEQ ID NO: 3939 - DNA, 1188 bp, Enterobacter cloacae
cgtgatgccggaggtgacgccatgattgccgctgtgattcgcgcctcgttgcgtaaccgcctgctggtgatcctggccgcactgatgatggcaggctggggctggtgggcggtacaacgcgcgccgctggacgcgttgcccgatctgtctgatgtgcaggtcattatcaaagcgagttaccccgggaaagcgccgcaggtgattgaagatcaggtgacctggccgctgacaacctccatgttgtctgtgccgggcgccaaaaccgtgcgcggtttttcaatgtttggtgacgcttatgtgtatgtgctgtttgaggatggcaccgatctctactgggcgcgatcccgggtgctggaatatttaagccaggtacaggcgcagtttccgccgggcgtgaaggtgtcgctggggccggatgcgacgggcgtcggctggatctacgaatatgcactgatcgaccgtagtggaaaacacagcctggcagatctgcgggccctacaggactggacgcttaagttcgagcttaagacggtaccgaatgtatctgaggtggcaagtattggcggaatggtgcgtcagtatcagatcgtggcggacccggcgaaaatgcgcgcgctgaatattacccacagccagctatccggcgcggtgcaggccgccaataaggagagcggcggcgccctgctggagatgggcgaagcggagtatatggtgcggacaacgggctatttgcgctcgctggaggattttcgcaatgtggtgatcgctacccgcgatggcgtacctgtcctgctgaaagatgtcgccaccattggcattggcccggagatccgccggagtgtggcggagcttaacggtgaaggggaggtcgctggcggcgtgatcgtgatgcgctacgggcagaatgcgctggaaacgcttcatgcggtaaaagcgaaactgagcgagttgcaaaaaacgctgccgcagggcgtcgagattgttccggtctacgatcgttccacgctgattgaggactcggtcaaaacgctgacgcacaagctgctcgaagagtttgccgtggtggtactggtgtgtgcgctgttcctgttccacctgcgctccgcgctggtggcgatggtctctctgccgctggggatcctcggggcttttgtggtgatgcactatcagggcataacgcgaatatga

SEQ ID NO: 3940 - DNA, 1002 bp, Enterobacter cloacae
aattcatcaaggatcaccagcccgacgccggtcagctccggatcgttttgcaacatacgggtaagaataccttcggtgaccacttccagccgcgtggatggtccaacgcaggtttcggcgcgcatccggtaccctaccgtctcacccggtttttcattcagcagttccgccaggcgctgcgccacattgcgcgccgccagcctgcgcggctccagcaggataattttcccgctgatgttcccatcgcgcagaatttgcaggggcagccaggtggatttacccgctccggtgggcgcgctgagcaaaacctgtggcgcatgttctaaggctgcgagtagctcaggaaggacgacggcgacgggcaaagaggacacttacggctccagagggttaacattaatcggcgtacattgtagcatcggcgcatatcattaccgagtcttgcgcatgtctgagtctaaacggctattcttcgccattgaattacccaccacgcttcaacggcagattgttcgctggcgcgccagccacttccccgcggaagcgggccgccccgtcgtcgccgccaatatgcacctgacgttagcctttcttggtgaagtaagcgctgaaaagcagcgcgcgttaagcgcaatggccggacgcatttcgcagccggggtttacgctacatcttgacgatgccgggcaatggctgcgctctcgggtggtctggctggggacgcggcagccccctcgcggactgctacagctcgccaacatgctgcgggcgcaggccgcgcgcagcggctgttatcagagcccgcagccgtttcatccccacattaccctgctgcgcgatgcgggtcaggccgttgccatcccgccaccgggctttcactggtcctttcaggtgaatgaatttgcgctgtacgaatctgcctttgtacaaggacgcacccgctatactccgctccagcgctggacgctgggcgacacgttaaggaatcctgatgaagtttag

SEQ ID NO: 3941 - DNA, 477 bp, Enterobacter cloacae
tgcgtgttaaggagaagcaacatgcaagaagggcaaaaccgtaaaacatcgtccctgagtattctcgccatcgctggggtggagccgtatcaagagaagccgggcgaagagtatatgaacgaagcccagctgtcgcacttcaagcgtattcttgaagcatggcgtaatcaactcagggatgaagtcgatcgcaccgttacacatatgcaggacgaagctgctaacttcccggacccggtcgaccgtgccgctcaggaagaagagttcagcctcgaactgcgtaaccgtgaccgcgagcgcaaactgatcaaaaagatcgaaaaaacgctgaagaaggtcgaggacgaagattttggctactgcgaatcctgcggtgttgaaatcggtattcgtcgcctggaagcgcgtccaacagccgatctgtgcatcgactgtaaaacgctggcagaaatccgcgaaaaacagatggctggctaa

SEQ ID NO: 3942 - DNA, 903 bp, Enterobacter cloacae
gtccggcgtttatccgggcgaagaacacagtttccattaaggagtccaggtgtgctaatcatagaaactctgccgctgctgcgccagcatatccgccgtgcacgtcaggaaggtaaacgtatcgcccttgttccaaccatgggcaacctgcacgacggccatatgaagctggtcgatgaagcgagagcccgtgcagatattgtggtagtcagtatcttcgttaacccgatgcagttcgatcgcgaagacgatctggcgcgttacccacgtaccttgcaggaagattgcgagaagctcaaaaaacgtcatgcggatatcgtcttcgctccggcccccgcagatgtatatccccagggcaccactgaatcgacctacgtcgatgtgccgggtatttcgaccatgctggagggcgccagccgcccgggccatttccgtggcgtttctaccatcgtcagcaagctgtttaacctggtgcagccggacatcgcctgttttggcgagaaagatttccagcagctggcgctgatccgcaaaatggttgccgatatgggctacgacattgagataatcggcgtaccgattgtgcgtgcgaaagatggcctggcgctcagctcccgtaacggctatctgaccgccgaacagcgtaaaattgcgccgggtttaagcaaagtcatgaataccatggcagagcaactgctggcaaaagagttaaccgcagaagaaattatcgctctggctgaacaggcgctgaacgagaaaggtcttcgtgctgacgacgttcaaattcgggatgccgatacgcttctggcgcttacagagaccagcaagcgtgcggtaattctggtggcggcatggctcggtcaggcccgccttatcgataacaaagtggttgaactggcgtag

SEQ ID NO: 3943 - DNA, 615 bp, Enterobacter cloacae
aaaatgtcttttaataaattaggtctggcaactgtagtagcaatggttctgagtgcgggttctgcaatggcagctgatattccttcagatacaggcactattactttccacggtatggtttctaataacacctgtaaagtatccctggatcagaagattgaccaggatggtaatgattttgacgttaacctggataccgtgtttgtaaaagacttcgctaatgcgctgggtaccaccagcaccctgggagaaaagaaattctccctcaccctgacaggttgtgattctgctaccgtcaaacaggcatccgctcagtttgattcctgggcgggttcttcttcaacttccggcggtctgctggttccaccatcaaacactcaaggcgccgctaaaaacgtcaatctggtactgtcaaacgatggcaactccgctaccgatcagatcaaactggatcagaccaacaatacccagaaagcaacgattgataccacaggcgcaggcgcactttactaccgtgtagcgtatacccaaggtcagaactgggatgcggccaacaacccagtgtcagctggtgtggttcaggcacaagctgcattcaccatgatctacgagtaa

SEQ ID NO: 3944 - DNA, 627 bp, Enterobacter cloacae
tcaacagtgccaaatgtaatgatgttaaaacagggaatcacacccatgggaaataatatgaagaaaaatcattgcggttattcattaatcgcattagcaatgttagcgatgtcaggttctgctgcggcagccgatctcaatgttaactttactgccaatatccgcgaaaccacctgcgatatgaaactggtcggcgatacgggttcagatacgcagcaaacgctgactatcggtaataacggacaggtacgcttagatgatgtcaaagacggaacggcaaatgccaatttcaaaattgtgctcgttgaatgcccggcatcactgacctcattgaaaaccaaagtatcgggaacaagatctggatatttgtactcaggccttattaaccaaatacaaaaaatcgacggaggtgcagactactctgctgttgagattgccagagccagcgcaccggatgccccgtttatcattaactctgaggacgataacgagcgcctggtctggagtccgacagaaatccagaataaggaagttgctctggtggccaccttacgtgaaacacaggaaaacaggatgaccataggtgattttcaggccgtggcgacctttgaatttatctacgagtga

SEQ ID NO: 3945 - DNA, 1122 bp, Enterobacter cloacae
cgtcacttacgaataataatcagaacaggaaaaaggatgagaatgttcaactttataagacagggtttcaccgtgaaaggcacaatggcgtttgccatggcgagcgtgttattaaccctcagccactcctgctgggcagctgattgtcgcatgaataatggaaaaggcggcacaaccacgctgatcaattccgaatactcaggtggcaccgtacgtcttccccctccgggtaattatgccagtactctttttaacgttaacctgacaccgggcattcaggccgaatgtggtccagggaacgatggttttaacctcgtctcacaaacaaacccgaccttgctaaaggggagcagttatggcagggctatgtttgaaacaaatattccggggatttattattccgtaagggtccacaccgcagaaagtgatggaggcatgggtggctatttcgctatgaatactactgactggactaccgttgcatcctccggaaattctgatccctgggatgaaaaatggataaacacctcagttcaaatttatattgatgcaggttacagaggcaacccgaacaaagaaacctcaatcagacccaaacccggcactctgggtaaaatggctattggtaatccaaatgattctaacaaccaaccatggacatttgtggtcaacgaagactcattccagatcccgatcgttcttccaacctgcgacatggccatgctttcagatggcactaatgatgttaacctgggagaatattatgtttcagacattaaaaacaatcgggttaaggatatccctttttcaattagcttaagcaattgtaccagtgtggcaaatatcacaaccaaactcaccacctcaaagctaaccggaaaaaataatgatcttcttggaaatacgctttcgtccggagctgagggcgcaggcgtgaaaattatgtataacggaacctctcaactcctgccgaataatcctgactcatcctatgtcataacggattaccaaaccccggaatccaagcaaattaattatgttgctcaactggtagcaaacggaagcacagtgaaaccggggtcgtttaaagccaccggcgtattcaccctttcatacgactaa

SEQ ID NO: 3946 - DNA, 1803 bp, Enterobacter cloacae
cctcgcacacatcaagttccgccgcgccaagcagcagcagggcgtaaccacgcgcttccctgccctgctctatccgctggggaactgggtttgcctgctgttcatggcagctgtactggtcatcatgctcatcaccccaggcatggcgatttccgtctacctgatcccggtctggattgcgatcctcggcgtgggttatatggtgaaacagaaaaatgccaaaacggtgaaagcgcactaaatgttttctcgctgtactcgcggttgcgggtacagcgtcttgttaccttcctcacaaattcgcgccaacagcaaaatcctccatatcaccgcctttatattgcaacgcatatattcgtttgccagcgaataattctctccataccgaaacccggagagctgtcgatgaataacaacaaactgtcagtaaaagaaaagatcggctatggcatgggtgacgccggatgcaacattatctttggcgccatcatgttatttgttaactatttttatacggatatttttggtctggctcctgcactggttggcgttttactcctgtccgtgcgcgtcattgatgccgtaacggacccgatcatgggcgcgattgctgaccgtacccgcagcaaatatggccggtttcgtccatggctgctgtggattgccttcccctatgcgctgttcagcattctgatgttcaccacgccagagtggagctataacagcaaagttatctatgcctttgtcacctacttcctgctgtcgctgacctataccgccatcaatattccgtactgctcgctcggcggcgtgatcaccaacgacccgaaagagcgcgttgcctgccagtcctaccgttttgttatggttggtatcgccacgctgctgctgtcgctaacgctcctgccaatggccgactggttcggtggggataacaaagccaaaggctaccagatggcgatgaccgtgctggcgctgattggtacctgcatgttcctgttctgcttcgccacggtgcgcgagcgcgtgcgtccggcggtgcaaacccatgacgaacttaaaaacgacctgaaagacgtgtggaagaacgaccagtgggtgcggatcctgctgttaaccctgtgcaacgtctgccctggctttatccgcatggcggccaccatgtattacgttacctgggtcatggggcaaagcacccatttcgccacgctgtttatcagcctgggcgttgtcggcatgatgttcggcagtatgctggcgaaagtgctgaccgaccgctggtgcaagctgaaggtcttcttctggaccaacatcgcgctggcgattttctcctgcgccttctacttcttcgacccgaaagcgacgacaaccattgttgtgctttacgtcctgctgaacatcctgcaccagatcccatccccgctgcactggtccctgatggccgacgtggacgactacggtgaatggaaaaccgggaaacgtatcaccgggatcagcttctccggcaacatcttcttcctgaaactgggtctggcgattgccggggcaatggtcggtttcctgctctcctggtacggctacgatgcgggcgcaaaagcgcagagcgcggatgccatcaacgggatcgtgctgctctttaccgtcattcctggcattggatacttaattaccgcgggcgtagtacgtctgctgaaagtggaccgtgagaccatgaagcagatccagtccgatctggaaaagcgtcgcaccaactatcgcgagctgaacgattatcaggaactcaaagccgctgagactaaataa

SEQ ID NO: 3947 - DNA, 987 bp, Enterobacter cloacae
caacatgctggaactccttatctatggtgctgttactcggttcagagtagcatgtttcaatattatgattcgttaccaatttggagttttatcatgccgcctcgccgctataaccccgaccaccgacgtgacgcgcttctggaacgtattaatagtgatatcccggcaagcgttgcccatgccctgagagaagacctcggcggtgacgtcagcgccgataacgatattaccgcccaattgttgccaaaagagacacgctcgcatgcggtggttatcacccgtgaagcaggggttttctgcggcaaacgctgggttgaggaggtctttacccagctggcgggcgacgaggtgcaggtaacatggcacgttgaggacggcgatgcggtcacggcgaatcagccactgttcgaactggacggcccgtcccgcgtcttgctgactggtgaacgcaccgcgctcaattttgtgcaaacgctctctggcgttgccagtgaagtacgccgctacgttgacctgctggcaggcacccgcacgcagctgctggatacccgtaaaaccctgccgggcctgcgcaccgcgctgaaatacgcggtactctgcggtggcggcgccaaccatcgtctggggctatccgatgccttcctgatcaaagagaaccacattattgcctctggctcggtgcgtcaggccgtggaaaaagccttctggctgcatccggatgtgcccgtcgaagtggaagtggaaacgctggaggagctggacgaggccattaaagcgggggctgacatcatcatgctcgataacttcgacacggagcagatgcgtgaagcggtcaaacgcacaaacggccaggcgcagcttgaggtgtccggcaacgtgacgttcgacaccatccgcgaatttgctgaaaccggcgtcgattacatctccgtaggcgccctgaccaagcacgtccgcgccctcgacctctcgatgcgcttcaaataa

SEQ ID NO: 3948 - DNA, 1224 bp, Enterobacter cloacae
ctacgctcgaagagttgttgcgcgtcctgggaatgccagatggctgctaattcgctctggcgctggcgtgccctgaccaccgagggggaggtgcaaaccggcaccctctgggccatcgaccgtaacgcagcttacacggctctggtgcttaaacagctgcacccgctggcgctaaaacgctgccagcagcaccaccgatggcaagtgcagcactgctacgatatttttcgccagctcgccacgctgctacaggccggactcatgctgtcccaaagcctgcacatgctggcggaacagcatcctttgcagcactggcaggcgctgctgcacagtcttgctgatgacctgagcgaaggtttcgctctgtcagaggccatgaagaaatggccagaggtgtttagccccctttatgtctcgatggtgaagacgggtgaactgacgggtaagctcgaagcctgctgccgtcagcttgcgcagcaacaaaaatcccagcagcagctcagtgcaaaggtgaagaaagcgctgcgctatccgctgatcatcctgacgctggccgttttcgtggtgctggcgatggtcacgctggttttgcctgagtttgctgcaatctacaaaacgttcaacaccccgctccctttgctcacgcaggcagtcatggggctggcggccttggttcaggcgcatatcctcacccttttggccctgctcgtggcaatggttgtcatcgcctgtaagctgcggcggcatccgcgctggcagtacgtcctgttacatgtaccggtgatgggcacgctgatgcgtgggcaaaaactggggcaaatttttaccgtgctgtcattaacccagcaggccggaattgcctttttacaaggactggagagtgtggaggagaccgttgagtgtggctactggcaggagaaactccgtgagatacgcagcgatatcgaacaggggatgcccgtgtggtcctccttccagaaggcctctgtttttacgccactgtgtattcagctcattcgcaccggagaagtgtcgggttcactggatgtcatgctgatgaatctggcccgccatcatacggaacagacatttcagcaggcagacaatctggcggcgcttcttgagcctttgctactggtcgtgacaggtctgattattggcacgctggtggtggcaatgtatctgccgattttccatctgggggatgcaatgagcgcggggtaa

SEQ ID NO: 3949 - DNA, 639 bp, Enterobacter cloacae
ttcccaggatctgatttaatggggtatatcgtcgcattaaccggcggcatcggtagtggtaaaagcaccgttgcgcacgcgtttgctcgtctcggcatcacgattatcgacgccgatatcattgcccgtcatgtggtagaacccaatacacccgccttaaacgccatcgaagcgcattttggtcgccgtgtgatacaggctgacggcaccctgaatcgtcggcagctgcgtgagtacatattttccgatccagcggaaaaagcctggcttaatgccctgctccaccccattatccaccaggaaactcagcgtcaaattgccgcagcccgttcgccctatgtgttgtgggtcgtcccgttactggtggaaaatcagcttcagaataaagcagacagaacgctggtgattgacgtttcccgcgaaacgcaaatccagagaaccatggcgcgtgaccatgtttcacgcgaacatgctgaacaaattcttgccgcacaggccacgcgcgaagcgcgcctcgccgttgcggatgatgttattgataataacggcgcaccagatgccattgcatcggatgttgctcgtctgcacgcgcagtatctgaccttcgccgcgcaggccgttgcacaggaaaaaccataa

SEQ ID NO: 3950 - DNA, 585 bp, Enterobacter cloacae
catcaagcgccttcagggcgcgcagggagtgtacgccgctcatctgcggcaacagccactgttcaagcgtcgcgagcagcgtctcatcatccaccgctggccacccctgttccggcagccacttcgcggcgcagtgcagacgtatacgatattgttcagcctccggcgtccagttcagtacgctcagccctttttcccgaatgccattcagcatcgcctggtgtaactcttcctccgacggcttcgccagcggtttcgtcccgagcgtcagtttgccaatctggctacgacggaacgccttcagcgtgccctgggtatcatcccattccacgatgtcagattgctgaagcagctgcgggcaggcacgcgtcaggaggtcaatatccacggcaaccgcctgtaaaatacgcgcgtccggggagtggctgccctggagtaagagcggcgcgatcagccattcatgacgcgtcagggcgtcatcgctgtccagcatcgcgcccatcccatttgccagctgatagcgaccatccagcccgcgacggcgcgcgattctgtccgggaaggcctgggccagcagagggataa

SEQ ID NO: 3951 - DNA, 714 bp, Enterobacter cloacae
ggaatcctgatgaagtttagtcctgcactccagcccgccacgctgatccagcgttacaaacgctttctcgctgatgtgatcacccctgcgggcgaaacgctcacgctgcactgccctaacaccggcgccatgaccggttgcgccacgccgggtgacacggtctggtattccacatcagaaaatactaaacgcaaatatccccatacctgggaaatgaccgagacgcaaagcggggcatttatttgcgttaataccctgcgcgcaaatcagctggttaaggaagctctgacaaatggaatgcttcctgaactggtgggttacggcacgcaaaaaagcgaagtgaaatatggcgatgaaggcagcagaattgattttatgttacaggcggaagaccgccctgagtgctatattgaagtgaaatcagtgacgttagcggaacaggtaaacggcttctttccggatgcggtaacgctacgtggccagaagcatctgcgagagctaatgagtgtagcggcggcgggcaagcgcgccgtgttgctgtttgcggttctgcattcagccattgaacggttttccccggcccgtcatattgatcctaaatacgcgcaattgttgaatgaggcacaaaagcagggggtagagattttcgcttataaagcggaactttctgccgataatatgactctgagatcctctcttcccattgtcttataa

SEQ ID NO: 3952 - DNA, 489 bp, Enterobacter cloacae
aggcacggcatgacccttgcgtatatcgccatcggcagcaatctggcctctccgctggagcaggttaacgctgccgtgcaggcgctgggggagatcccgcaaagccgcatcgtcgcgctgtcctcattttaccgtacgccgccgctcggcccgcaggatcagcctgattatctgaacgccgccgtggtgctggaaacgacccttgacgcagaaacgctgctggataatacccagcgtattgagctacagcagggtcgcgtccgcaaagccgaacgctggggaccgcgcaccctcgatctcgatattatgcttttcggccacgaggtgattaacaccgaacgcctcaccgttccgcattacgacatgaaaaaccgcgggtttatgctctggccgctgtttgaagtcgcgcccgatctcaccttccctgacggcgcctcgctgcaagccgttctgcaaaatctcaacgcggataaaccggcccgctggtaa

SEQ ID NO: 3953 - DNA, 831 bp, Enterobacter cloacae
aatgcgcaaagattcgcttttgggccatcaggaaacagtatgaaaccaaccaccatctccttattgcagaaatgcaaacaggaaaaaaaacgcttcgccactatcaccgcgtatgactacagcttcgcaaaactgtttgccgaagaagggatcaacgtcatgctggtcggggactcgttagggatgacggtacaaggacatgattccactctgccggtcacggtcgaggatattgcttaccatacccgcgccgtgcgccggggtgcgcccgcctgcctgctgctttccgatctgccgtttatggcgtatgccaccccggaacaggcctttgaaaatgcggcgacagtgatgcgtgctggcgccaatatggtcaaaatcgaaggcggcgcctggctggtcgatacggtaaaaatgcttaccgaacgcgccgtgccggtttgtggtcatttggggctgacgccgcagtctgtcaacatctttggcggatataaggtgcagggccgaggcgatgcggcgcagacgctgtttgatgatgccgtggcgctggaagccgcgggcgcacagctgctggtgctggagtgtgtaccggttgagctggctaagcgtatcactgaggcgctgtcgattccggtgatcggcatcggcgcgggcaacgtcaccgatggccagattctggtcatgcacgacgccttcgggatcaccggcggccacattccaaaatttgctaaaaatttcctgacagaagcaggcgacatgcgtgctgctgtgcggcagtatattgccgaggttgagtccggcgtttatccgggcgaagaacacagtttccattaa

SEQ ID NO: 3954 - DNA, 393 bp, Enterobacter cloacae
aaggtaaacgtaatgattcgcaaaatgctacaaggtaagcttcaccgtgtgaaagtcacccaggccgacctgcactatgaaggctcctgcgcgatcgaccaggattttctcgacgcggcgggtattctcgaaaacgaagctattgatatctggaacgttaataacggcaaacgcttttcaacgtacgcgattgccgctgaacgcggatctaaaatcatctccgttaatggggcagcagcgcactgcgcggacgtaggcgatatcgtcattattgccagctttgtgatgatgtctgacgaagaagcacgtcgctggcagcctaaagtggcctactttgaaggcgataatgagatgaaacgtaccgcgaaggcgattccggtgcaggttgcctaa

SEQ ID NO: 3955 - DNA, 840 bp, Enterobacter cloacae
tctacgagtaattttaaaagcatagataaaatgctcatattatcccctgacgtacgtcaggggactattgatatcattccaacaggaagtggaaaaatgttaaacacatcattttataaaggatttaaagctgcctgctttacagttgctgctgtcgcgtcattccaggcaagcgcagatatcgttatttcgggaacacgtattgtttatcagcagtcgcaaaaagatgtcatcgtttctttagacaaccgtggcaaaaagccactattagttcaatcatggctcgatgacggtcgcgatgacaccaatccacaggaattaaaacttccttttattattactccaccagtatcccgaattgatccccaaaaaggtcaatccgttcggatctcgtacctgggtggttcattgccgcaagatcgcgaatccctattctggttcaatgtgctcgagattccaccgaagtcaaaagtgaaagacggtgaaaatcctaaccagctccagctggcattccgcacacgtattaaactctttttccgacctgacggcctgaaaggtacgccaggaaatgcagcagccagggtaacgtggtcgcaacaaaaacaaggtaatacgctaaacctgattgcacacaatgattccccttacaacgtttctatttcaaatgtaaagctgaaatcagcaaataaagagtaccaggttgagcataaatctattttaccgtttagtactcaaataatgcaggtaaaaggtttaggtagtactgccaccggcactgttgcttacgaaaccattaatgacaatggcggctctgatacttttgaaagcaaagtaaactaa

SEQ ID NO: 3956 - DNA, 2598 bp, Enterobacter cloacae
agcatgctatttcaacgatcaattttatgtctcgcaatctgtgcagcatttcctctgcatgccagcgagactgaaaaaaaagctgtagacacctcatccgaaacagaatcggccattgaatttaatgaccagttccttatcgataatggtggaggtatcaatgtcgatcgttatgcttatggcaacccagttctgccaggtacttaccgtgtaaaagtgaatttgaatggcaattcaaaatccacggtcgagatggcattcattgataacaaaacgccacgtgcctcagcatgtctgactaaactcacgctgacacaggcaggcgttgataccagcatattaggcgatgatgtcaaagacgacgaaacgtcttgcgtagatatcaaaaaatattatcccggtgcttctgaaaattttgatagtagcaagcaggaaatggatcttaatttcccgcaaatctacgtgcttaagcttccagcagggtatgtcgatccttcattatgggataatggtgttccggccggattactttcatacgatcttaatacctggcacagcgagtcaaacggcaccaattcagataccgcttatgcgggcttgcattatggcctgaacgtggggccgtggcgtttacgttctcgcggcagtctgaactgggacagtgataatggcacacattattccagccaggatatatacctccagcgagacatcacaccacttaacgcacagatggtaatgggtgattcctacacacgcggtgatgtctttgactcggtgagcctgcgtggtgcgcgtatgtataacgatgaccgcatgctcccgcaaggcacctctggctacgcgccagtaattcgtggtgtggcaaacagtaacgccaaagttagcgttatgcaaagcggcaataaaatctatgaaaccaccgttccacccggtgctttcgagatcaatgacctcagtacaacaggctatggtaatgatttgattgtcactgtagaggaagccgatggaagtaaacggacgtttaccgttccgttctcctcagttacacaaatgctccgccctggctccagccgctgggatgtgggtataggtgagctgaatgatgattcattgcatgataagccaaacgttggctacgcaacttacgcgtatggtctgaataatacctttaccggttacgtgggtgcgcaatatacggatatggatttttacgccggcctgcttggtctggctatgaatacccgtattggtgcattcgctttagatgttaccgggtcctatgccgatatcgacgggctggacacgcttaaagggcagagttatcggctgacctacagcaaaatgcttgaagccactaacacatctcttaacgtggcagcttatcgcttctcaacagaagattatctcagccttaacgatgccgcctcattgcaggacagtattcaccacgaggaatatggcaatcgatcttatgacagcaatgccgagctttatgctgattatcagcgtaccaaaaaccagatacaggtcagcctgaaccagccattgaatgttaacggtgatgaatacggctcactctatattagcggtacctggcaggattactggaatgattccagctccacttccgactacagcgtgggttacaacaatagttttgcttacggtagctatagcgtttctgtgcaacgcacgtacaacgaaacaggggaaaaggatgacagcgtttatttaaacgtcagtattccattcagcatattcaataaggataacgcgcagtcaggcggatttaataacgtcaacatgagcctgcgcactgatttaaaaggcggtaccagttttaactctacggcaagcggcaactccaaaaacagcgaagtgagctattccgttagcgcctcatcaagcgggggaaactacggcaacctgaaccaggtcagtggctatagctcatggaacagtccttacgggccgctcggtgtctcggcgtcctttggcgatgacaatagtaaacagtattccgcgagttataacggcggaatggttgttcactcgggtggcgttgtatttacatcaggcagtatcggcgaaacggattcacttgcgctggtaaaagcaagtggcgcaacgggtgctcggctgggttacggccaaagccgcattaacagttccgggtacgggattatgccgtatatgtcagcctacagagaaaaccgagtatcgctcgatatcagtactctcgaagcagacgttgaaatcaaaaatacaagcgcagttgccgtacctcgcaatggctccgttgtatttgtgaattttgaaacggatgaaggccgttcgcttgttctggaattacaacgttctgataacggctttattccgctaggtgctgacgttctgaatgagaaaaacgaatctatcggaacggtaggccaggcaggacaagcttatgtacgcggtgtggaaaacaaaggcgctctccgggtggtatggggaagcgatggttccagctcctgcacggtgcattatcagattcctgaaaatgcgaagaaagcaggcttaaccacgattctgagtaatcaacagtgccaaatgtaa

SEQ ID NO: 3957 - DNA, 651 bp, Enterobacter cloacae
tgcgccagtcacgtttactatcacttatccataataccaggaaccagcatgcaacaatcaccgtttactttataccagcccggtcttgtgttgcttatgggcttggctggtggcatcttgcctggcgtaggccaggcaagctcaggattagacgtaaatattaccgctaacattgttaatagcacttgtaagatgaccgtggaaaatgacggcgaaatttatctccccaatgtaatgcgcagctggttttataacccggatggtagcgatcgttttactgcaaccgatgatgcaggcggtacgccttttaagatccatgtagatgattgctatggagacagcagtacggctaaaaagctgagttttagcttttcgccgcagtcgggtttctggccaggacaaaatcaggttttcaaaagtgatgataccgccgcaggcgcggcaaaaaatgtcggcgtcgtcgttttctctgaaagatataaaaagaatgttttaaacaacgacggcacgtcaaaaatcacttatgacgtaagcggtcaggatactgcatttttaacggattatcagttctatgcccgatatcaaaatattggcgtagtggctggtggtgtcgttaccagtaaagtattagttgacgtcacttacgaataa

SEQ ID NO: 3958 - DNA, 897 bp, Enterobacter cloacae
tggatgttaacgaaggaggtgctccccatgaccgaaaaaacggtatggcaagaaacgctgcacgaccagtttggtcagtattttgccgtggataacgtgctctatcatgagaaaaccgatcatcaggatttgataatattcgaaaacgccgcttttggccgcgtgatggcgctggacggcgtggtgcaaaccaccgagcgcgacgagtttatctatcacgaaatgatgacccacgtcccgctgctggcccacggccacgcgaaggacgtgctgattatcggcggcggcgacggcgcgatgctgcgtgaagtctctcgccatcagaatgtcgaaaccatctccatggtggaaatcgacgccggtgtggtgtcgttctgccgccagtatctgcccaaccataatgccggcagctatgacgatccgcggtttaatctggttatcgacgatggtgtcaattttgttaaccagaccacgcaaacgtttgatgtcattatctctgactgtaccgaccctatcggtccgggcgcgtcgctgtttacctcgtcgttttacgaaggctgcaagcgctgcctgaagcctggcggaatttttgtggcgcaaaacggcgtttgcttcctgcaacaggatgaagcgcttgatagccaccgtaagctgagcacctattttgctgacgtcagcttctaccaggcggcgatccccacttactacggcgggatcatgacctttgcctgggcgacggataacgacgtcctgcgccatctctccaccgaaattatccaggcccgcttccatcaggccgggctccagtgccgatactacaacccggcgatccacaccgcagcctttgcgttgcctcaatatctgcaagacgcgctgtcctcaaaggaggtgaactaa

SEQ ID NO: 3959 - DNA, 795 bp, Enterobacter cloacae
ttgaaaaagcttaaactgcatggctttaacaatctgaccaaaagcctgagtttttgtatttacgatatctgctacgccaaaacagcagaagagcgcgatggttacatcgcctatatcgatgaactctacaacgccaaccgtctgaccgagatcctgacagagacctgctcgattatcggcgcgaacatcctcaatatcgcgcgccaggattatgagcctcagggtgcgagcgtcaccattctggtgagtgaagagccggttgacccacagcttatcgacaaaaccgaacaccccggcccgctgccggaagtggtggttgctcacctggataaaagccacatctgcgtgcacacctacccggaaagccacccggaaggcgggctgtgtaccttccgcgcggatattgaagtgtccacctgcggcgtgatttcaccgctgaatgcgttgaattatttaatccaccagctggaatcggacatcgtcaccattgattatcgcgtacgcggttttacccgtgatatcaacggcatgaagcacttcattgatcatgagatcaactccattcagaacttcatgtccgaggacatgaagtcgctgtacgacatgatggatgtgaacgtctatcaggagaatatcttccacaccaaaatgttacttaaggaattcgaccttaagcactacatgttccacacgaagccggaagatttaagtgaggaagagcgaaaggtcattaccgacctgctctggaaagagatgcgcgaaatttactacggccgtaacattccgaccgtgtaa

SEQ ID NO: 3960 - DNA, 1392 bp, Enterobacter cloacae
caaccacacacgaggtttcaaatggaagctcaacagcatggcgatcagctaaagcgcggccttaaaaaccgccatatacagctcatcgccctgggcggtgctattggtactggcctgtttctgggcagtgcatcggttatccagtcggccggtccgggcattattttggggtacgcgatagcgggtttcattgcatttctgattatgcgtcagttaggggaaatggttgttgaggagccggtcgcaggctcattcagccacttcgcctataaatactggggcagcttcgcaggtttcgcctcgggctggaactattgggttctgtacgttctggttgccatggccgagctgaccgccgtcgggaaatatattcagttctggtacccggagatccctacctgggcgtctgcggcggccttcttcgtcctgattaacgccattaacctcaccaacgtaaaagtgttcggtgagatggagttctggtttgccatcatcaaagtgattgccgttgtagcgatgatcatcttcggcggctggctgctgttcagcggcaacggcggcccgcaggccaccgtgcgcaacctttgggagcaaggcgggttcttgcctcacggcatgaccggcctggtgatgatgatggcgatcattatgttctccttcggcggtctggagctggtgggcatcaccgccgcggaagccgacaacccggaacagagcatcccgaaagccacaaatcaggttatctaccgcatcctgatcttctatgtgggctccctggcggtgctgctctcgctgctgccatggacgcgcgtcacggcggataccagcccgtttgtgctcatcttccacgagctgggcgataccttcgtggcgaacgcgctcaacgtcgtggtgctgaccgctgcgctctccgtttataacagctgcgtttactgcaacagccgtatgctgttcggcctggcgcaacagggcaacgcaccgaaagcgctgctcaccgttgataagcgtggcgtaccggttaataccatcatcgtgtcggcggtcgtgacagcgctgtgcgtgctgattaactacctggccccggaatcagccttcggtctgctgatggcgctggtggtttccgccctggtgattaactgggcaatgattagcctcgcacacatcaagttccgccgcgccaagcagcagcagggcgtaaccacgcgcttccctgccctgctctatccgctggggaactgggtttgcctgctgttcatggcagctgtactggtcatcatgctcatcaccccaggcatggcgatttccgtctacctgatcccggtctggattgcgatcctcggcgtgggttatatggtgaaacagaaaaatgccaaaacggtgaaagcgcactaa

SEQ ID NO: 3961 - DNA, 999 bp, Enterobacter cloacae
acgattatcaggaactcaaagccgctgagactaaataaggaaagccgaatgcaaacctggccaaacccgtttattgaacaacgcgccgacccgtatatcctgcgtcacgatgggcaatattactttatcgcctccgtaccggagtacgatcggctggcgatccgccgcgcggactcgctggaaggtttacgcgatgccgaagaggtggttgtctggcgcaagcccgacaccggcccgatgagccagctgatctgggcaccggaactgcatcatatcgacggcagttggtacatctattttgccgccacgcatacccaggcgctcgatcatctcgggatgttccagcatcgcatgtttgccattgaatgcgcagatcgcgatccgctcaccggtacgtgggtagaaaaagggcaaatcaaaaccccgtttgacaccttcgcgctggatgccaccacctttgttcatcagggtaaacgctggtatctgtgggcgcaaaaagccccggatatttccggtaactcgaatctttacctgtgtgaaatggaaaatccgtggacgctgaaaggcgagccggtgatgctcagtaaaccggaatatgactgggagtgccgcgggttctgggtcaatgaaggcccggcggtgctgttccatggcgataagctgtttatcagctattccgccagcgccaccgacgagaactactgcatgggattaatgtgggcagacctgaatgccgatccgcaaaacccggctaactggcataaatccccgcgcccggtgttcgtcaccagctacgaaaaccgtcagtatgggccaggccataacagctttacgcagacgccggaaggcgaagatgtgctggtctaccacgcgcgaaactacactgaaattgaaggcgatccgctttacgatcccaatcgccatactcgcctgaaactcatccgctggaacgaaaacgggatgcctgaattcggcatcccgcccgcagatacaccgtaa

SEQ ID NO: 3962 - DNA, 213 bp, Enterobacter cloacae
aatagcatgaatttctcgccgttctcttccaccacggtaccgccgctctcttcgtggcctgccagcatgccgccgagcatcacgaaatccgcgccgccgccgaaggctttcgcgacatcgcctggcatggtgcagccaccgtcgctgatgatctggccgcccagaccgtgcgcagcgtcagcgcattcaattaccgcagacagctgcggataa

SEQ ID NO: 3963 - DNA, 924 bp, Enterobacter cloacae
ggcgggagtctctcccgccttgttaccgttgatatgtctgaatctcactatatcgggcgctttgcgccatctccctccggtgaattacacttcggctcattaattgccgcgcttggcagctacctacaggctcgcgcccgtcagggtcaatggctggtccgcattgaagatatcgatcctccgcgtgaagttcccggtgcagcagaaactattctgcgtcagctggaacattacggtcttcactgggacggcgacgtactctggcagtctcaacgccatgatgcctaccgtgaacgtctggcgtggcttgctgaacagggcctttcctataactgcacctgcacgcgggcgcgaattcaaagcgtgggtggcgtttacgacggccactgtcgtacgcggcacaacggtcctgagaatgctgccgtacggctgatacagcgttctccggtgacgcagtttaccgacgttgtctcaggaaccattcaggcggatgaacgcctggcgcgtgaagattttattattcaccgtcgtgatggtttgtttgcctataacctggcggtggttgttgatgaccatttccagggcgttacggaaatcgtgcgcggggcggatctggttgagcctaccgtgcggcaaatatcgctttaccagcagtttggctggacggtgccggattacatccatctgccgctggcagtcaatgatcagggaaataagctgtcgaaacagaatcatgccccggcgctgcctgacggcgatccgcgcccggttttgatcgacgcgctgcgatttctcaaccagaatgtaacgcaggaatggcaggatctgagtctggatgaattgctgaaaacggccattgctgactgggcgcttatcgccgtgccaaaaatccagcattctcaaatgcgttgcgctgagctatga

SEQ ID NO: 3964 - DNA, 1440 bp, Enterobacter cloacae
ttagccgcttttttgataacaaaacacactacgaggtgtactatttttacccgagtcgctaatttttgccgtaaagtgctgagccgcgaagagagcatggcgaacgacgctattgcacagccacacatgtcggtcattccgcgtgagcagcacaatatttcccgcaaagatatcagtgaaaatgccctcaaggtgctctatcgtctgaataaagcaggctacgaggcctatctcgtcggcggcggggtgcgcgatttactgctgggcaaaaaaccaaaagatttcgacgtgacgaccagcgccacgcctgagcaggtgcgtaaattattccgcaactgccgtctggttggccgccgtttccgtctggcgcacgtgatgtttggaccagaaatcattgaagtggcgaccttccgcggtcaccacgaagcgggcgtcaacgatcgcacgacttcccagcgcggccaaaacggcatgctgctgcgcgacaacatcttcggctctattgaagaagatgctcagcgtcgcgatttcaccatcaacagcctttactacagcgtggcggattttaccgtgcgcgattacgtcggcggtatgcaggatctgaaagacggcctgattcgcctgatcggcacgccggaaacgcgctatcgcgaagatccggtccgaatgctgcgcgccgtgcgtttcgccgccaagctgaacatgcgtatcagtccggaaaccgcagagccgatcccgcgcctggcgacgctgattaacgacgtcccccctgcccgtctgtttgaggagtcgttaaagctgctccaggcaggctacgggtttgaaacctacaatttgctgcgtgaatacaacctgttccagccgctgttcccgaccattacccgctacttcaccgaaaacggtgacagcgcaatggagcggatgattgcacaggtgctgaagaacacagatacccgtattcataacgatatgcgcgtgaatccggcgttcctgttcgcggccatgttctggtatccgctgctggaaacggcgcagcgcatcactcaggagagtggtctcgcctattatgatgcgttcgcgctggcggcaaacgacgtgctggacgaaggctgtcgcacgctggcgatcccgaaacgtattaccacgctggtgcgtgatatctggcagcttcagctgcgtatgtcccgccgtcagggtaaacgcgcctggaagctgatggagcatcctaagttccgcgccgcgttcgatttgctctctctgcgtgctgaagtcgaaagaaaccaggagctacagcgcctggcgcagtggtggggagaatttcaggtctctgcaccaccagagcagaaagatatgcttacggatctcgatgatgagccggcaccgcgccgtcgtcaccgtcgcccgcgcaaacgcgcaccgcgtcgtgaaggcacggcatga

SEQ ID NO: 3965 - DNA, 606 bp, Enterobacter cloacae
atttatctacgagtgattagtgcaggaaaacggagcaacattatgaaattcaattctacttttatcgccctgtccgtttctgcccttctgttctcgggaatggcaagcgcagctattacaggcacccctagtgtcgaattaacgattaaatcaaaaattgtatcaggcacatgtaccgcaaaagtacttaacgatgcaggcacagcttccactgaaattgcgttcggcgacgtatacaaatccgatctggtgaacaaaacccgtgtcgagccgctcaagattagtttcaccaactgttctggagtaaccagggcaacggtgtccgctgcgaaaggcgctggtggtgaatgcagtggcgtcaacaagacgggtgattcttactccggcggcttagcaacgggctttgagatctggtcgggtgttgtcgatactggcgagcttatgagctgcaacacgcctccggctgctaaggatgtcaccattactgatggtaccggtgaattcccgatgaattcccgtatcgttatcggacaaggccaaaccattgctgaagtaggcgcgggggcggttaatgcgccagtcacgtttactatcacttatccataa

SEQ ID NO: 3966 - DNA, 768 bp, Enterobacter cloacae
attcaacttaccttaagttctgacacacgttgtgtggtttcattaaaagtcgggttaccctatagtagcgcaacgcaatcacttggttacaggtcgctaacctccatgaacgacatagatacactcatcagcaacaatgcactatggtcaaaaatgctggtggaggaagaccccggattttttggaaaactcgcgcaagcgcagaacccacgctttctctggattggatgttctgacagccgcgtccccgccgaacgtctgactggtcttgaacctggcgaactgtttgttcaccgcaatgtggctaacctggttattcataccgatctcaactgcctttcggttgttcagtatgccgtcgacgttcttgaggttgagcacatcattatttgtggtcactacggctgcggcggcgtgcaggcggcggtcgaaaatacagagctggggttaatcgataactggctgctgcacattcgtgatatctggttcaaacatagctcactgctgggcgaaatgccgcaggagcgccgtctcgacacgctgtgtgagctgaacgtgatggagcaggtgtataacctgggccattcgacgattatgcagtctgcctggaaacgcgggcagaaggtctccatccacggctgggcgtacggtattcacgacggcctgctgcgcaatctggaagtgaccgccaccaaccgcgaaacgctggaacagcgttaccgctcgggaattgccaacctcaagcttaagcacgttaaccataaataa

SEQ ID NO: 3967 - DNA, 2424 bp, Enterobacter cloacae
  unsure (1605)
caaataattaacaaaactgacgagtacttttctatggctgaaacaaaaactaaacagccgcgtctactggtgacattaacagccgcgtttgccgcattctgcgcgctgtatttgttaatcggtggcgtatggctggtcgcgattggcggctcctggtactacccgattgcgggtctggttatggttggcgtaaccgtcctgcttttacgcagaaaacaatctgctctgtggttgtacgcagcgttactgctcgcaaccatgatctggggcgtctgggaagtcgggttcgacttctgggcgctgacgccgcgcagcgacattctggtcttcttcggtatctggctgatcctgccgtttgtctggcgtcgtctgattgtcccttccagtggcgccgtggccggtctggtcgttgctctgctgattagtggcggcatcctgacctgggccggttttaacgacccgcaggagatcaatggcacgctgaacgcggaatccacgccggctgcggctatttcgcaggtggcggacggtgactggcctgcttatggtcgtaaccaggaaggtcaacgctactccccgctgaagcagatcaacgcggacaacgtgaaaaacctgaaggaagcctgggtattccgtaccggcgacctgaagatgccaaacgatccgggtgagctgaccaacgaagtgaccccgattaaagtgggcaacatgctctacctgtgtacggcgcaccagcgcctgttcgcgctcgacgcggccaccggtaaagagaaatggcactttgatccacagctgaactccaacccgtcgttccagcacatcacctgccgcggcgtctcttaccacgaagcgcgcgcagataatgccagcccggaagtcattgccgactgtcctcgccgcattatgctgccggtgaacgatggccgcctgtttgccatcaacgctgagaccggtaagctgtgcgaaaccttcgctaacaaaggcattctgaatcttcagaccaacatgccggacactacgccgggtctgtatgagccgacctccccgccaatcatcactgataaaaccatcgtgattgccggttcggtaacggataacttctctacccgcgaaacctccggcgttatccgtggtttcgacgtgaacaccggtaaactgctgtgggccttcgacccgggcgcgaaagatcctaacgcgatcccatccgatgaacacacctttacctttaactcaccgaactcctgggcaccggcagcgtatgacgcgaagctggacctggtttacctgccgatgggcgtgaccacgccggatatctggggcggtaaccgcacgccggagcaggaacgttacgccagctccatcgtggcgctgaacgcaacgaccggtaaactggcatggagctaccagaccgttcaccacgatctgtgggatatggatatgccgtcccagccgacgctggcggacattaccgttaacggtaaaaccgttccggtgatttacgccccggccaaaaccggcaacatcttcgtgctggatcgcagcaacggtaagctggttgttcctgcgccagaaaaaccggttccgcagggcgcggccaaaggcgantacgtcaccaaaacgcagccgttctctgacctgagcttccgtccgaagaaagatctcagcggtgcagacatgtggggtgccaccatgtttgaccagctggtgtgccgcgtgatgttccatcaactgcgctatgaaggcatcttcacgccgccttcagagcagggcacgctggtcttcccgggtaacctggggatgttcgagtggggtgggatctccgttgaccctaaccgtcaggtcgccatcgctaacccaatggcgctgccgttcgtttcccgtctgatcccacgcggtccgggtaacccaatggagcagccgaaagatgcgaaaggcagcggtaccgaagccggtatccagccgcagtatggcgttccttatggtgtgactctgaatccgttcctttctccgttcggtctgccgtgtaaacagcctgcctggggttatatctccggtctggatctgaagaccaataagatcgtctggaaaaaacgtattggtacgccacaggacagcatgccgttcccgatgcctgttccagtgccgttcaatatgggtatgccaatgctgggtggcccaatctccaccgccggtaacgtgctgtttatcgcggcaaccgcagataactacctgcgcgcgtacaacatgaccaacggtgaaaaactgtggcaaggccgtctgccagccggtggacaggcaacgccgatgacctatgaagtgaatggcaaacagtatgttgtcatctccgcgggtggtcacggttcgtttggcacgaagatgggcgactatattgtcgcgtatgcactgcctgacgacgctaagtaa

SEQ ID NO: 3968 - DNA, 636 bp, Enterobacter cloacae
atgcggctgcgggcatctggggcgagtaattcaggaatgggtaaagccggtctgtcggcggcaaaaacggcgcggctccagagaggtatcgcgctggcaacccccagcgcagcagaaaattttaaaaaatcacgacgttgcatgtgcatttccttatttccagcaggcgatcttttgagcataaaccctccccttaccggaaggtcaagcacggcggcaataataaagatcgtcggcctggcatcaagtatgctaacgttaattttccgtgatgcagtggtaaaggcaatgaagacgtttttcagaacaattttgttcgccagcctgatggcgatgtgtgcgaacagttacgcgctaagtgaaaacgaagcggaagatatggccgatctgacggcagtttttgtttttctgaaaaacgattgtggttaccagaatttacccaatgggcaaattcgtcgcgcactggtcttttttgcccagcagaatcaatgggacctcagcaactacgacagcttcgacatgaaggcgctcggtgaagacagctaccgtgatttaagcggtattggcattcccactgctaaaaaatgcaaagcgctggctcgcgattcactcagcctgctcgcctacgtgaagtaa

SEQ ID NO: 3969 - DNA, 1554 bp, Enterobacter cloacae
tactcgcggcaacagcaacgcctcacggcactgcattcgtctcgttggagtcaatctatgaagttgccttttaaaccacatcttcttgttctgctttgcagtgcggggctgtttgccgcctcgggcgtcatgttcgttaaaagccgcgcaacggaacccgctcccgcacctgcgccggtagccccgcagctccccgacccggcagcacagcctgccccggtggccacccctgcctataccgccgcgcagatcgatcagtggaccgcgcccattgcgctctaccccgacgcgctgctgtcgcaaattctgatggcctcaacctatccggcgagcgtgattcaggccgcccagtggtcaaaggacaaccctaaaatgcagggcgatgccgccattcaggcggtcagcgggcagccatggaatgccagcgtgaaatcgctggtcgcctttccgcagttaatgtcgctgatgggggaaaacccgtcgtgggtacaaagcctcggcgacgcctttctggcccagccaaaggatgtgatggattccgtgcagcgtctgcgcctgctggcgcagcagacaggcacattgcaatccaccccgcagcagaccgtcaccaccgtgaaaaaatctgcgccagcctccgccagtacagccgcgacgtcaacgtcggctagtccgacggtgattaaaattgagccagccgatccacaggtggtttatgtccctacctacaacccttccaccgtttacggcacgtggccaaatgccagctatccgccggtgtatctgcctccgtctcccggccagcagtttaccaatagttttgtcagaggctttggctatagcctcggcgtagccaccacctatgcgctgttcagtaacatcgactgggacgatgacgacgatcatcatcacgatcatgatgacgatcaccacggcggttattcgcataacggcgataacattaatattaatgttaataacttcaataagatcaccggcgagcaccgtaccgataatcaccaggtctggcagcataatccggcctaccgcaacggcgtgccctacgccaatagccagcttgccagccgctatcatcagacttcagtgccgggcgggttgagcgctacccggcagcagccggtcaaccgcgatagccagcggcaggccgcgatggcgcaggtacagcagtcgacgggcaaaactctcacacagctacagcatggcgacgcgcatttcccgcaacattcagcgtccgcgcagcaactgaagcagctctctcagcgcagcaactatcgcggctacgacagcgcgcggccccacgcacaacagatgaataatactcttgcgcaaaccagacgcccgacgcaggttcagcatcagccgctgcgggcaaacgccctgagcggcaacgacagccgttcggccagctggcaggcccagcaccagcgcgggctgcaaagccgccagcacgcgtcgctgaacagtgagcagcgtgccagcttccgccagcagctgtccgaacaccataccgaacaccatgaattccaccgtcgttaa

SEQ ID NO: 3970 - DNA, 447 bp, Enterobacter cloacae
ggagcagacatgaacagacaacaaggatttaccctgattgagctaatggtagtcattggcattattgccatcctgagcgcgattggcgtcccggcctatcagaactacctgcgaaaagcggcgctcaccgatatgctgcaaacgttcatcccctaccgcaccgccattgagctttgcgccctggatcgtggtggtgtggatcgctgcgacgcaggcaccaatggcatcccctccccgacaaccacacgttacgtttcagcgatgagcgtggcgaaggggatcgtatcgttaacagggcaggaaagccttaacggacttgaagtgctcatgacaccgatctggagcgacggtaacggtatgacgggctggacgcgtgactgcaaaattgcgtccgacacggcgctcagacaagcctgtgaagatgttttccgcttcgacaacaactga

SEQ ID NO: 3971 - DNA, 1392 bp, Enterobacter cloacae
caggagtggacaatgaataccgaacagcttatgacgctctgtcagcgccatcacgcactgctactcgcaagcgacaccgagatgatcagcattgcggtggtgggtaatcctgcctctgagctgatggaagcgttacgcttcgccacgcagaaacgtattgatattgagtgctggacggctgaacggatggaaaaacggcttcagtccctctcatcatcacacctgccgggcatcgtgccaaactcagccgctgacgtgctcagtacaaccttgcagcaggcagtaaaccagcgggcttctgacatccatattgaaccgacggagcacggttaccagatccgtttgcgaatcgacggtgttctctacccgcaaccgccgatctctgccgccctcgggacgacgcttgccgcacgcctgaaggtgctgggtcaactggatattgcggagcgccgcctgccgcaggacggtcagtttacggtggagctggcaagcgtccccgtctcttttcgtatcgcaacccttccctgtagcggtggagaaaaaatcgtgcttcgtctgcttcaccaggtacagcaggctctggagcttgaacagctggggatgagcgcagaccagcaggcccgttttgccgaggcgcttaacagccctcaggggttgattctggtcaccggcccgaccggtagcgggaaaacggtgacgctgtacagcgcgttacaggcgcgaaatacacctgacgttaatatttgcagcgtggaagatcccgttgaaatcccgcttgcaggcttaaaccagacgcagattaatccgcgtgcggggctgaccttccagagcgtgctgcgcgccctgctcaggcaggatcctgacatcattatggtaggtgaaattcgtgacggcgaaacggcagaaattgccattaaggcggcacaaaccgggcatctggtgctgtccaccctccatactaattcgacgactgaaacgctggtacggctgcaacagatgggtgtcgcgcgctggatgatctcttcggcgctctcgatggtgattgcccaacggctggtgcgccgtttatgcccgtactgccgacaggaagccagccgccacaccgaattaccccgcacgctgtggccccggccgcttcctcgctggcaacccaccggctgcgatcgctgctaccacggtttttatggtcgcgtagccatttttgaagtgctcgtcatcgacgacacgctgcggcaggccatcgccagcggagcaagcacggaggtgattgggtccagcgctcgtcaggcgggaatgacctcattgtttgagcatggctgcatggccgtagagcaagggctgactacgctcgaagagttgttgcgcgtcctgggaatgccagatggctgctaa

SEQ ID NO: 3972 - DNA, 837 bp, Enterobacter cloacae
cggcgcaccagatgccattgcatcggatgttgctcgtctgcacgcgcagtatctgaccttcgccgcgcaggccgttgcacaggaaaaaccataatgtcgactcatatcctttttgagcacccgcttaacgaaaaaatgcgtacctggctacgcatagaatttcttattcaacagctttcacaacatctgcctgtcaacgatcacgccaccgcgctgcattttttccgcaacgtgggcgatctgctggatgtgattgaacgcggtgacgtccgcactgagctgttgaaagagctggagcgccagcagcgtaaattacaggcctgggccgaagtaccgggcgtggatcaaagtcgaattgacgctttacgccagcagctgaaaaacagcagcacgacgctgatggccgcgccgcgcgttggccagtttttacgagaggatcgtctgattgcgctggtgcgccagcgcctgagcataccgggcggttgctgtagctttgacctgccaacgctgcatatgtggttgcacatgccgcaggaacagcgcgatcgccaggtgaacagctggctgggcagcctggagccgatgaatcagacgttatccttgatcctcgatcttgtgcgtaactctgccccgttccgcaaacaaaccagtctcaatggtttctatcaggataacggcgacgacgccgatcttctgcgcctgaatctgtctcttagcgagcagctttacccgcaaatttccggacataaaagccgtttcgcgatccgctttatgccgctggacagtgaacatggcaccgtgccggaacgcctcgattttgaactggcctgttgttaa

SEQ ID NO: 3973 - DNA, 204 bp, Enterobacter cloacae
ggagtgccgatgtctgacgtaaccaccgtaaactgcccaacctgtgggaaaactgtcgtctggggagaagtgagtccatttcgcccattctgctgcaagcgctgtcagcttatagacctgggcgaatgggcggcggaagagaaacgcattccgagcgaaggcgatctctcggatagcgatgactggagcgaaaaccagcagtaa

SEQ ID NO: 3974 - DNA, 2739 bp, Enterobacter cloacae
atgcgcggttcctttcagccccgtgtgaggcttttgctaatcaaattgttaaccagagtttttggtagtcgtaacgatcgtaccctgcgccgcatgcgcaaagctgtgaacgtcatcaacggtatggaaccggcgatggagaagctctctgatgatgagctgaaagcgaaaaccgcggagttccgtgcgcgtctggagaaaggcgaaaccttagaaagcctgatcccggaagcctttgccgtagtacgtgaggccagtaaacgcgttttcggcatgcgtcacttcgacgtacagctgctcggtggtatggtgcttaacgagcgctgcatcgcggaaatgcgtaccggtgaaggtaaaaccctgactgcaacgctgccggcttacctgaatgcgctgacgggtaagggcgttcacgttgttaccgtcaacgactatctggcgcagcgcgacgccgaaaacaaccgtccactgttcgaattcctcggcatgaccgtgggcattaacatgtccggcctgccggcacctgccaagcgtgaagcctacaacgcggacatcacctacggcaccaacaacgaatacggcttcgactacctgcgtgacaacatggcgttcagccctgaagagcgcgtccagcgtaaactgcactatgcgctggtggatgaggttgactccattctcatcgatgaagcgcgtaccccgctgatcatctccggcccggccgaagacagctccgagatgtaccgtaaagtcgacaaaatcattcctcacctgctgcgtcaggagaaagaagactccgataccttccagggtgaaggtcacttctccgtggatgaaaaagcgcgtcaggtcaacctgaccgaacgcggcctggtgaaaatcgaagagctgctggttgctgaaggcattatggaagagggcgagtctctgtactccccgagcaacatcatgctgatgcaccacgtaacggctgcactgcgcgcgcacgcgctgttcacccgcgacgttgactacatcgttaaagacggggaagtcatcatcgtcgatgaacacaccggccgtaccatgcagggacgtcgctggtccgatggcctgcaccaggccgtggaagccaaagaaggcgtggatattcagaacgaaaaccagacgctggcatccatcaccttccagaactacttccgtctgtacgagaagctggcggggatgaccggtaccgcagataccgaagcgtttgagtttagctccatctataagctggataccgtggtagtacctaccaaccgtccgatgatccgtaaggatatgccggacctggtatacatgactgaagcggaaaaaattcaggcgatcatcgaagatattcgcgaacgtaccgcgaagggccagccggtactggtggggaccatctccatcgagaagtccgaagtggtgtctaacgagctgactaaagcaggcatcaaacacaacgttctgaacgccaagttccacgctaaagaagcagatatcgttgcgcaggcgggttacccggcagccgtaaccatcgccaccaacatggcgggtcgtggtaccgatattatgctcggcggtagctggcaggccgaagtggcggagctggaaaacccaaccccagagcaaatcgcgcagatcaaagctgactggcaagtgcgtcacgacgcggtgttgccatccggtggtctgcacatcattggtaccgagcgtcacgaatctcgtcgtatcgataaccagctgcgcggtcgtgcgggtcgtcagggtgatgccggttcttcccgcttctatctgtctatggaagatgcgctgatgcgtattttcgcctctgaccgtgtgtccggcatgatgcgtaaactgggcatgaaacctggcgaagcgatcgagcacccgtgggttaccaaagcgattgccaacgcccagcgtaaagtggaaagccgcaacttcgatattcgtaagcagctgctggaatatgatgacgttgccaacgaccagcgtcgtgcgatctacacccagcgtaacgaactgctggacgtgtccgacgtgagcgaaaccatcaacagcattcgcgaagatgtgtttaaagccactatcgacgcccatattccaccgcagtctctggaagaaatgtgggatatcgaaggcttgcaggaacgtctgaaaaacgacttcgatctcgaactgccaatcaaagagtggctggacaaagagcctgagctgcacgaagagaccctgcgcgagcgtatctacgaaaccgcgctggacgtctacaagcgtaaggaagaagtggttggcgcagagatgatgcgtcacttcgagaaaggcgtaatgttgcagaccctggactccctgtggaaagagcacctggcggcaatggactacctgcgtcagggtatccacctgcgaggttatgcgcagaaagatccgaagcaggagtacaagcgtgaatccttctccatgtttgccgccatgctggagtcgctgaagtatgaagtcatcagcactctgagcaaagttcaggtgcgtatgccggaagaagtggaagcgatggagcagcagcgtcgtgaagaagctgagcgtctggcacagatgcagcagttgagccatcagaccgatgagagcgaagccgcagcagcaatcgcagcgcagacgggcgatcgtaaagttggtcgtaacgatccgtgcccatgcggttccggcaaaaaatacaaggcgtgccacggccgtctgagctaa

SEQ ID NO: 3975 - DNA, 450 bp, Enterobacter cloacae
gaacataacaaactgaaaaggcgcagatatctgcgccttttttatggaagtgacatgatgaaaacactgcaaattgctgtcgggatcattcgcaacccgcaaaaccagatcttcattacccaacgtgccgccgatgcgcacatggccaacaaatgggaattccccggcgggaaaatcgaatcaggtgaaacgccggagcaggcgctggtgcgtgagcttcaggaagaggtggggatcaccccgcttggcgcaacgctgttcgataagctggagtaccagtttccggatcgtcacatcacgctgtggttctggctggtggaaagctgggaaggtgaaccgtggggtaaagaggggcaaccggggggctgggttacgcttcacgcgagtgatgccgaaaaatttcctccggcaaatgcgcccgtcatatcccggctaacgggcaacctgtag

SEQ ID NO: 3976 - DNA, 1098 bp, Enterobacter cloacae
cgtcactggagttgtgcttttaatatatttgcctctaaccccaggaatccgcacatgcgtatcgaagaagatctgaagttaggtttcaaagacgttcttatccgccctaaacgctctacactgaaaagtcgctcagacgttgaactcgaacgtcaattcacctttaagcattccggtcagacgtggtctggcgtgccgattatcgcggccaacatggacaccgtcgggaccttcgagatggcgaccgcactggcgcaattcgacatccttactgcggtacacaaacactacagcgctgaagagtgggatgcgtttgtcgcctccgcctcggctgaagtggtgaagcatgtgatggtctcgaccggtacgtctgatgcagatttcgagaaaaccaaacagatcctgaacgccaatccggcgctgaattttgtctgcattgacgtggcaaatggttattccgaacatttcgtccagttcgtcagcaaggcgcgtgaagcctggccaaccaaaaccatcatcgcgggcaacgtggtgaccggtgaaatgtgtgaagagctgatcctctccggagccgacattgtgaaagtgggcattggcccgggctccgtttgcaccacgcgcgtgaaaaccggtgtgggttatccgcagctgtctgcggtaattgaatgcgctgacgctgcgcacggtctgggcggccagatcatcagcgacggtggctgcaccatgccaggcgatgtcgcgaaagccttcggcggcggcgcggatttcgtgatgctcggcggcatgctggcaggccacgaagagagcggcggtaccgtggtggaagagaacggcgagaaattcatgctattctacggaatgagctctgaatccgcgatgacccgtcacgtgggtggtgtcgcgaaataccgtgcggcggaaggcaaaaccgttaagctaccactgcgtggtccggtcgaaaacacggcgcgcgatatcctcggcggactgcgttctgcctgcacctacgttggggcttcccgcctgaaagagctgactaaacgcacgacgtttatccgcgttcaggagcaggaaaaccgcgttttcaatagcctctga

SEQ ID NO: 3977 - DNA, 579 bp, Enterobacter cloacae
ataaggagttccagcatgttgttagaaaacggatggctggtggacgcgcggcatgtaccgtcgccgcaccacgactgccgcccggaggatgaaaagcccacactgctggtggttcacaatattagtctcccgccgggtgagtttggcggtccgtggatcgatgcgttattcactggaacgatagatcccgatgcccaccccttctttgctgagattgcgcatctgcgcgtatcggcgcactgtctgatccgtcgtgatggcgaagtggttcagtatgttccttttgataagcgtgcctggcatgccggcgtgtcgaagtatcaggggcgcgagcggtgcaatgatttctccattggaattgaactggaaggaacggacaccacgccttacaccgatgcgcaatatgagaaactggttgctgtaacgcaaacgttaatcgggcgctatcccgccattgcagacaatattacagggcacagcgacatcgcccccgaaagaaaaaccgaccccggcccggcgtttgactggtcccggtttcacgccatgcttaccacgtcgtcagataaggagataacatga

SEQ ID NO: 3978 - DNA, 2643 bp, Enterobacter cloacae
agagaacgcccgccgcatatgacaatgagagcgaggagaaccgtcgtgctagaagaataccgtaagcacgtagcagaacgtgccgccgagggaattgtacccaaaccgttagatgcaacccaaatggccgcgctcgtcgagctgctgaagaacccgcctgagggcgaagaagaattcctgttagatctgctgatcaaccgtgtaccgcctggcgtagatgaagctgcctacgtaaaagccggattccttgccgccgttgccaaaggcgaagccacctccccactggttactcctgaaaaagcgattgaactgctcggcaccatgcagggtggctataacattcatccgctgattgacgcgctggataacgacaagctggcaccgattgccgctaaagcgctctcttcaacgctgctgatgttcgataacttctacgatgtggaagaaaaagccaaagcaggcaacgtctatgcgaagcaggtgatgcagtcctgggccgatgccgaatggttcctgaaccgccctcagcttgctgaaaaaattaccgttaccgtcttcaaagtgaccggtgaaaccaacaccgatgacctctccccggcaccggacgcgtggtctcgtcctgatatccctctgcatgccctggcgatgctgaaaaacgcccgtgaaggcattgagccggaccagccgggcagcgttggcccgatcaaacagatcgaagccctgcaacaaaaaggtttcccgctggcttacgtgggtgacgttgtgggtaccggctcttcccgtaagtccgccaccaactccgtcctgtggttcatgggcgacgacattccgcacgtgccaaacaagcgcggcggcggcctgtgcctcggcggcaaaattgcaccaatcttctttaacaccatggaagatgctggcgcgctgccgatcgaagtggatgtctctaacctgaacatgggcgacgtgattgacgtttacccgtacaaaggtgaagtgcgtaatcacgaaactaacgagctgctggcgagctttgagctgaaaaccgacgtgctgatcgacgaagtacgtgctggtggccgcattccgctgatcatcggccgtggcctgaccaccaaagcgcgtgaagcgctgggtctgccgcacagcgacgtgttccgtcaggcgaaagacgtggcggaaagcaaccgtggcttctcgctggcacaaaaaatggtcggtcgcgcctgcggcgtcgctggtatccgtcctggcgcgtactgcgagccgaagatgacctccgtcggctctcaggacaccaccggtccgatgacccgtgatgagctgaaagacctggcgtgcctgggcttctcttccgatctggtgatgcagtccttctgccacactgcggcgtatccgaagccggttgacgtgaccacgcaccacacgctgccagatttcatcatgaaccgcggtggcgtgtctctgcgtccgggcgacggcgttatccactcctggctgaaccgcatgctgctgccggataccgtcggtaccggcggtgactcccatacccgtttcccaatcggtatctccttcccggcgggctccggtctggtggcgtttgctgccgcgaccggcgtgatgccgctggatatgccggaatcggtgctggtgcgcttcaaaggtaaaatgcagccgggtattaccctgcgcgacctggttcacgcgatcccgctgtatgccatcaaacagggtctgctgaccgttgagaaaaaagggaagaaaaacatcttctctggccgcattctggaaattgaaggtctgccggatctgaaagttgagcaggctttcgagctgaccgatgcctccgccgagcgttcggctgcgggctgtaccatcaagctgaacaaagagccgattattgagtatctgaactctaacatcgtgctgctgaagtggatgattgcagaaggctacggcgaccgtcgtacgctggagcgtcgtatccagggcatggaaaaatggctggccgatccgcagctgctggaagccgatgctgacgcagagtacgcggcggtgatcgacatcgatctggcggatatcaaagagccaatcctgtgtgcaccgaacgatccggacgacgcgcgtccgctgtccgaagttcagggcgagaagatcgacgaagtgttcatcggttcgtgcatgaccaacatcggccacttccgtgcagccggcaagctgctggatacccacaaaggccagctgccaacccgtctgtgggtggcgccgccaacccgtatggacgcggctcagctgaccgaagagggctactacagcgtgtttggtaagagcggcgcgcgtatcgaaattcctggctgttccctgtgtatgggcaaccaggcgcgcgtagccgacggcgcgacggtggtctccacttcgacccgtaacttcccgaaccgtttaggtaccggtgcgaacgtcttcctggcctctgcggagctggcggcggttgcggcgctgattggcaaactgccaacgccggaagagtaccagacctttgtggctcaggtggataagacggcggtggatacctatcgctacctgaacttcgaccagctctctcagtacaccgagaaggcagacggggtgatcttccagacggcggtataa

SEQ ID NO: 3979 - DNA, 555 bp, Enterobacter cloacae
aatcatttggttagtaatatgaaacatactgttgaagtgatgatcccggaagccgagatcaaagcgcgtatcgccgaactgggtcgtcaaatcaccgaacattacaaggacagcggcagcgaaatggtgctggtcggtttgttgcgtggctctttcatgttcatggcagacctgtgtcgtgaagtgcaggtgccgcacgaggtcgattttatgaccgcctccagttacggcagcggcatgtccacaacccgtgatgtgaaaatcctgaaagatctggatgaagatattcgtggcaaagatgtgttgattgttgaggacatcatcgactccggcaacacgctctctaaagtgcgtgagatcctgagcctgcgtgaaccaaaatcactggcgatttgtaccctgctggataagcctgagcgccgtgaagtgcaggtgccggtggagttcgttggtttctccatcccggacgaattcgtggtgggttacggcattgattacgcacagcgttatcgccatctgccgtatgttgggaaagtggtgattctggacgaataa

SEQ ID NO: 3980 - DNA, 936 bp, Enterobacter cloacae
gttgaattcatggcgattgcactggagcttgaacagctcaaaaaaacctacccggggggcgttcaggcgctgcgcgggatagatcttaaagtcgaagcgggagatttctacgcgcttctggggccgaacggggcagggaaatccaccaccatcgggatcatcagttcactggtcaataaaacctcgggccgcgtcagcgtgtttggctacgatctgcaaaaagatgtggtcaacgccaagcgccagctggggctggtgccgcaggagttcaactttaacccgtttgagacggtacagcagattgttgttaaccaggcgggttactatggcgtggagcgcaaagaggcgcttgagcgcagcgaaaagtacctgaaacagcttgatctgtgggagaaacgtaacgagcgcgcgcggatgttgtccggagggatgaagcgccgcctgatgattgcccgcgcgctgatgcacgagccaaagctgcttatccttgatgagccgaccgctggtgtggatattgaactgcgtcgctccatgtggggtttcctgaaagatctgaacgacaaaggcaccaccatcattctgaccacgcactacctggaagaggcggaaatgctgtgccgcaatatcggcatcattcagcacggtgagctggtggaaaacacctcgatgaagaatctgctctccaagctcaaatcagagacctttatcctcgatctggcggcgaaaagcgcgctgccgaaactggagggctacaactatcgcctggtcgatacctcgacgctggaggtagaagtgctgcgcgagcagggtattaacagcgtgttctcacagttgagtgcgcagggcattcaggtattaagcatgcgtaacaaagcaaaccgactggaagagctgtttgtctctctggtgcacgacaaacaaggagacaaggcatga

SEQ ID NO: 3981 - DNA, 468 bp, Enterobacter cloacae
actactcgcctgctaaggagagacgttatgctgggatgggttatcacctgccacgatgaagaggcacaggaaatgctcctgaagctggaggcccgatttggccctctggcgcaatgtcgtgcggtaaattactggcgagggctgagcaccaacatgctcagccggatgatgtgcgacgcgctgcatgaaaccgacaccggtgatggcgtgatttttctcaccgacaaatcgggcgcggcgccttaccgttcagcagcgttaatgagccataagcatgataattgtgaagtgatctccggtatcagcctgcctttactcgaagcgatgtatccgctgcgcgcaacgttgagcagcgctgagtttcgccacgccattgtggcgcagggctccccgggcgtgagcagcctgtggcaccagcagcagaagaacccgcctttcgttctgcttcacgatctgtataagcattaa

SEQ ID NO: 3982 - DNA, 1311 bp, Enterobacter cloacae
acattggtattgatgtcgcttttgctacaatggcgactgattttccgtatcgatttatatcccatgctcatgcgcgttatctttatccttctggtgctggtttccggtggtgcgtctgccagcctgaccagtcagcaaggccttcctgcccaatatatgcaaaccaccgaagatgcggccatctgggcgcaggtgggaaatgccgttgtgaatgtggggaatgtccgcgccgggcagatcctcgctgtctttccggccgcggcggattactatgaatttcgtttcggattcggcacggggtttattgataaagaccaccttgaaaaagtgcagggcaaacaacgtgttgaggatagcctgggtgacttgaacaagccgctcagtaatcaaaacctcatcacctggaaagacacgccggtgtataacgcccccagcagcggaagcgcgccttttggcaccttaagcgccaatcttcgctatccgattctgaataagctgaaagaccgcctgaaccagacctggtttcaaattcgcatcggtaatcgtctggcgtggatcagcagcctcgatgcacaggaagataacgggctaccggttctgacttaccatcatattttgcgtgatgaagagaacacccgttttcgacatacctccacgacgaccagcgtacgtgcgtttaataatcagatggcctggttacgcgatcaaggctataccacgctgacgatgtaccagcttgaagggtacgtgcgtaacaagatgaacctacccgcgaaagcagtggtgatcacctttgatgatggtctcaaatcggtgagccgctacgcgtaccctgttctgaaagaatatggcttcaacgcgacggcgtttataatttcatcacgtatcaaaggccatccgcagaagtgggatccaaaatcgctacagtttatgagcgttcaggaaatcaagggcatccaggatgtgttcgacattcagtctcacacccatttcctgcatcgcgtggatggctataaacaccccatcctgttgagccgtagctatcacgtgatcctgtttgattttgaacgatcacgtcgtgcactggcgcagttcaacccgcgcgtgttgtatgtgtcgtatccgtttggcggctatgacaataaagcgataaaggcagcgaatgacgctggttttcatctggcagtgacgacgatgaaggggaaggtgaagccaggggataatccgttcctgttgaagcgtttgtatatattaagaacggactcactggagacgatgtcgcggctgatcagtaatcagccgcagggatag

SEQ ID NO: 3983 - DNA, 519 bp, Enterobacter cloacae
caaggcgggagagactcccgccttagcagagtagtgagagggcaggcgttagccagccatctgtttttcgcggatttctgccagcgttttacagtcgatgcacagatcggctgttggacgcgcttccaggcgacgaataccgatttcaacaccgcaggattcgcagtagccaaaatcttcgtcctcgaccttcttcagcgttttttcgatctttttgatcagtttgcgctcgcggtcacggttacgcagttcgaggctgaactcttcttcctgagcggcacggtcgaccgggtccgggaagttagcagcttcgtcctgcatatgtgtaacggtgcgatcgacttcatccctgagttgattacgccatgcttcaagaatacgcttgaagtgcgacagctgggcttcgttcatatactcttcgcccggcttctcttgatacggctccaccccagcgatggcgagaatactcagggacgatgttttacggttttgcccttcttgcatgttgcttctccttaa

SEQ ID NO: 3984 - DNA, 1929 bp, Enterobacter cloacae
cccgcgtctggcgtaagaggtaaaagaataatggctatcgaaatcaatgtaccggacatcggggctgatgaagttgaaatcaccgagatcctggtcaaagtgggcgacaaagttgaagctgaacagtcgctgatcaccgtagaaggcgacaaagcttctatggaagtcccgtctcctcaggctggcatcgttaaagagatcaaagtctctgttggcgataaaaccgagactggcaaactgatcatgattttcgattccgccgacggtgcagcagcagctgcacctgcgcaggaagagaagaaagaagccgctcctgctgctgctccagcagcggccgcggcagcgaaagaagtgaacgtgcctgacatcggcggtgacgaagttgaagtcactgaaatcctggtgaaagtgggcgataccgttgcggctgagcagtcactgatcaccgtagaaggcgataaagcctctatggaagtaccagcgccattcgccggtaccgttaaagagatcaagatcaacaccggtgacaaagtgtctacgggttccctgatcatgattttcgaagtggcgggctctgaaggcgctgcggctccagcgaaagcggaagctgctccggctccggctgctgcaccagcggctgctggcggcgtgaaagacgttaacgtaccagacatcggcggtgacgaagttgaagtgaccgaagtgatggtgaaagtgggcgacaaagttgccgctgaacagtcactgatcaccgttgaaggcgacaaagcttccatggaagtgcctgcgccgttcgcgggtaccgttaaagagatcaaaatcagcaccggcgacaaagtctctaccggctctctgatcatggtcttcgaagtggaaggcgctgcacctgccgccgctcctgctgctgcggctgctccggcaccggctgctgcaccggctcaggctgctaaaccggctgctgcccctgctgctaaagcagaaaaatctgagttcgctgaaaacgacgcttatgtccacgcgactccgctgatccgtcgcctggcgcgcgaattcggcgtgaacctggcgaaagtgaagggcaccggccgtaaaggtcgtatcctgcgcgaagacgttcaggcttacgtgaaagacgcggtgaaacgcgccgaagctgcacctgcggcagccgctggcggcggtatcccgggtatgctgccatggccgaaagtggacttcagcaagttcggcgaaatcgaagaagtggaactgggccgtatccagaaaatctccggtgctaacctgagccgtaactgggtgatgatcccgcacgttacccacttcgataagaccgatatcaccgatctggaagcgttccgtaaacagcagaacgccgaagctgagaagcgtaagctggacgtgaagttcaccccagtggtcttcatcatgaaagcggttgcggcggcgctggaacagatgccacgcttcaacagctccctgtccgaagacggccagaagctgacgctgaagaaatacatcaacatcggtgttgcggttgatacgccaaatggtctggttgttccggtcttcaaagacgtgaacaagaagagcgtcacagagctgtcccgtgaactgaccaccatctccaagaaagcgcgtgatggtaagctgactgccggcgaaatgcagggcggctgcttcaccatctccagcatcggcggcctgggtaccacccacttcgcgccgattgtgaacgcgccggaagtggctatcctcggtgtgtccaagtccgcgatggagccggtgtggaatggcaaagagttcgtaccgcgtctgatgatgccaatctctctgtccttcgaccaccgcgtgatcgacggggctgatggtgcgcgtttcatcaccatcattaacaacatgctgagcgacattcgccgcctggtgatgtaa

SEQ ID NO: 3985 - DNA, 483 bp, Enterobacter cloacae
gggcatcaggccgcagggtcttgctctcacctttttattttcattcctcccacctctcccgctttttttcttcctcgctgctgcgataattaccttaatggctttgcagaggaaaacgctatggattacgaatttctgcgcgacatcaccggcgtggtgaaagtgcgaatgtcgatggggcacgaagccgttggacactggtttaacgaagaggtgaaagagaacctcgcgctgctggatgaagttgagcaggcggcggaaacggtgaaaggcagtgaacgctcctggcaacgcgccgggcacgaatacaccctgtggatggatggcgaagaggtgatggtgcgcgccaaccagcttgagttatcgggtgatgaaatggaagaggggatgagctactacgacgaagagagcctgtcgctgtgcggcgtggaagacttcctgagtgtggtgaatgcctaccgcgactttatgaaacagaagtaa

SEQ ID NO: 3986 - DNA, 2430 bp, Enterobacter cloacae
gtgtcctctttgcccgtcgccgtcgtccttcctgagctactcgcagccttagaacatgcgccacaggttttgctcagcgcgcccaccggagcgggtaaatccacctggctgcccctgcaaattctgcgcgatgggaacatcagcgggaaaattatcctgctggagccgcgcaggctggcggcgcgcaatgtggcgcagcgcctggcggaactgctgaatgaaaaaccgggtgagacggtagggtaccggatgcgcgccgaaacctgcgttggaccatccacgcggctggaagtggtcaccgaaggtattcttacccgtatgttgcaaaacgatccggagctgaccggcgtcgggctggtgatccttgatgaatttcacgagcgcagcctccaggccgatctggcccttgcgctgctgctcgacgttcagcaggggctgcgcgacgaccttcggctgctgattatgtcggcgacgctggataacgagcggctccggcagacgctccctgacgcgccgatgatctcctctgaagggcgtgcgttcccggtcgagcgccgctatcagccgctgcctgcccatcagcgttttgacgaagcggttgccatcgccaccgccgaattgctccgccaggagcccggctcgctgctgctgtttttacccggcgtaggcgaaatccagcgcgtacaggagcagctggcatcccgggtggacagtgacgttatgctgtgcccgctctacggcgcgctgccgttggctgaccagcgcaaggcgatccttcccgcaccggcggggcagcgcaaagtggtgctggcaaccaatatcgcggaaaccagtttgaccatcgaaggcattcgcctggtggtggacagtacgctggagagggtggccagttttgatccgcgttccgggctgaccaggctgctgacgcagcgcatcagccaggcctcaatggtgcagcgcgcagggcgagcagggcgtcttgagccgggtatttgcctgcatttaaccagcgccgagcaggcggagcgtgcggcattccagagcacgcctgagattttacaaagcgatctctccggactggtgatggatatgatgcagtggggctgtccggaccctgaccagctcacctggcttaatcctccgcctgtcgtcaacctttccgccgcgcgcagcctgctgacccagcttggcgcgctggaaggcgagcgactgacggcgcgcggccagaaaatggcggcgctgggcaacgatccacgtctggcggcaatgctggtggcagcacagggcgacgatgaaattgccacggcggcaaaactggcggctattcttgaggagccgccgcgcggtggcggcagcgatctgggacaggccttttcacgccatcagggaaactggcaacagcgggcgcagcagctgtgtaaacgcctgaattgccggggcggttcgcctgacagcgataaagttatccctctgctggcccaggccttcccggacagaatcgcgcgccgtcgcgggctggatggtcgctatcagctggcaaatgggatgggcgcgatgctggacagcgatgacgccctgacgcgtcatgaatggctgatcgcgccgctcttactccagggcagccactccccggacgcgcgtattttacaggcggttgccgtggatattgacctcctgacgcgtgcctgcccgcagctgcttcagcaatctgacatcgtggaatgggatgatacccagggcacgctgaaggcgttccgtcgtagccagattggcaaactgacgctcgggacgaaaccgctggcgaagccgtcggaggaagagttacaccaggcgatgctgaatggcattcgggaaaaagggctgagcgtactgaactggacgccggaggctgaacaatatcgtatacgtctgcactgcgccgcgaagtggctgccggaacaggggtggccagcggtggatgatgagacgctgctcgcgacgcttgaacagtggctgttgccgcagatgagcggcgtacactccctgcgcgccctgaaggcgcttgatgttaaggcagcgttacagaatttactggactggtcgttacgtcaacgtctggatagtgaactgcctgggcattacactgtgccaaccgggagccggattgccattcgttatcatgaggataatccgccggcgctggcggttcggatgcaggagatgtttggtgaggccaccacgccgtccattgctgaaggccgtgtgccgttagtgcttgagctgctttcgcctgcgcatcgtcccttgcagatcacccgcgacttgggggcgttttgggcggggagctatcgtgaagtgcagaaagagatgaaagggcgatatcccaaacacgtctggccggacgatccggcgaataccgcgccgacacggcgcacgaaaaaatattcgtaa

SEQ ID NO: 3987 - DNA, 1956 bp, Enterobacter cloacae
atgttgcggagaaaaagcatggcggggaatgaccgcgagccaataggacgtaagggaaagccgacgcgtccggcgaaagaaaaggtaagccgtcgtcgcctcagagatgaggagtatgacgatgactatgaagacgattatgaggatgaagaaccgatgccgcgtaaagggaaaggcaaagggcgtaagcctcgtggtaagcgcggctggttctggctgctgctgaagctgttcattgtttttgttgtcctgatcgcgatttacggcgtttatctggatcagaagatccgcagccgtattgacgggaaagtctggcaattgcctgcggcagtatacggccgcatggtgaaccttgagccggacatgtccatcagcaagaacgagatggtgaagctgctgcaagccacgcagtatcgtcaggtcacgaaaatgacccgtccaggcgaatttaccgtccaggcgaaaagtattgagatgatccgccgtccgttcgacttcccggacagtaaagaagggcaggtgcgcgcgcgtctgacctttgacggcgatcgtctggaaaccattgagaacatggataacgatcgccagttcggtttcttccgtctcgatccgcgtctcatcaccatgctgtcgtccgcaaacggcgaacagcggctgttcgtggcgcgtaacggcttcccggatttgctggtggataccctgctggcaaccgaagatcgccacttctacgagcacgacggtatcagcctttactccattggtcgtgcggtactggcgaacctgaccgccgggcgtacggtgcagggggcgagtaccctgacccagcagctggtgaaaaacctgttcctctccagcgagcgctcttactggcgtaaagccaacgaagcgtacatggccgtgctgatggatgcccgctacagcaaggatcgtattcttgagctgtacatgaacgaggtgtacctcggtcagagcggcgataacgagatccgcggcttcccgctggcgagcctgtactactttggccgtccggtagaagagctgagccttgaccagcaggcgctgctggtgggcatggtgaaaggcgcgtcgatctacaacccgtggcgtaacccgaaactggcgctggagcgtcgtaacctggtgctgcgtctgctgcaacaacagcaggtgattgaccaggagctgtacgacatgctgagcgcacgtccgctgggcgttcagccgcgcggtggggtgatctctccgcagcctgcctttatgcagatggtgcgtcaggagttgcagtcgaagctcggagataaagtgaaagatctctcaggcgtgaagatctttaccacctttgattccgtggcgcaggatgcggcagaaaaagcggcggtagaaggtattccggcgctgaaaaagcagcgtaagctgagcgatctggaaaccgcgatggtagtggttgaccgtaacaccggcgaagttcgtgccatggtgggcggtgctgagccgcagtatgcgggctataaccgcgcaatgcaggcgcgtcgttcgattggttcactggcaaaaccggcgacttatctgaccgcgctgagccagccgaacctctatcgactgaacacctggattgccgatgcgccaatctccctgcgccagcctaacggccaggtatggtcaccgcagaacgatgacagacagttcagcggtcaagtgatgctggtggatgcgttaacccgctcgatgaacgtgccaacggttaacctcgggatggcgctgggcctgccagccatcaccgacacctggcagaagctgggcgtaccgaaagatcagctgcaccctgtgccagcgatgattctgggggcgcttaacctgacgccaatcgaagtggcgcaggcgttccagaccatcgccagcggcggtaaccgagcgcgtgttcagccacgggtgctagcaaggagcccgcgatctagc

SEQ ID NO: 3988 - DNA, 522 bp, Enterobacter cloacae
cagcgatcgcagccggtgggttgccagcgaggaagcggccggggccacagcgtgcggggtaattcggtgtggcggctggcttcctgtcggcagtacgggcataaacggcgcaccagccgttgggcaatcaccatcgagagcgccgaagagatcatccagcgcgcgacacccatctgttgcagccgtaccagcgtttcagtcgtcgaattagtatggagggtggacagcaccagatgcccggtttgtgccgccttaatggcaatttctgccgtttcgccgtcacgaatttcacctaccataatgatgtcaggatcctgcctgagcagggcgcgcagcacgctctggaaggtcagccccgcacgcggattaatctgcgtctggtttaagcctgcaagcgggatttcaacgggatcttccacgctgcaaatattaacgtcaggtgtatttcgcgcctgtaacgcgctgtacagcgtcaccgttttcccgctaccggtcgggccggtgaccagaatcaacccctga

SEQ ID NO: 3989 - DNA, 864 bp, Enterobacter cloacae
ggagataacatgacgttgtttaccatgctgctggttatgatcgctgaacgcctgtttaagctcggcgagcactggcatctggatcatcggctggaggtgttattccgccgcatcaggcatttttccatgctgcgcacgctgctgatggcggcaggcgtgatggccattacgttcctgttgctgcgctcgctttacggcctctttttcaacgtgccgctgctggtggtgtggatcctgctcggcgtgctgtgtattggcgcgggcaaggtgcgtttgcactatcacgcgtatctgaaagccgcttcccgggatgatgcccacgcacgcggcgcgatggcgagcgagttgacgatgatccacggcgtaccgccggactgcgatgaacgcgagtttctgcgggagctgcaaaacgcgctgctgtggattaacttccgttactacctggcgccgctgttctggttcgtggtgggcgggccctgggggccggtactgctgatgggttacgcgttcctgcgcgcctggcagacctggcttgcccgctatcttacgccgcatgaacgtctacagtccggcattgatgccatcctgcacgtgctcgactggcttccggtgcgtctggtaggcgtggtctatgccctcatcggtcacggtgaaaaggcgctgcccgcgtggtttgtctcccttgctgaccgtcatacctcgcagtatcaggttttaacccgactggcacagttctcgctggcgcgtgagccgcacacggacaaagtcgcaacgccaaaggctgccgtctcgatggcgaagaaaacgtcgtttgtggtggtggtgattgtggcgctgctgacgatttacggcacgctggtttaa

SEQ ID NO: 3990 - DNA, 795 bp, Enterobacter cloacae
ctccgggcaaaaaggcgtaagacagggaatatggcctacagcaaaattcgccaaccaaaactttccgatgtgattgagcagcagctggagtttttaattctcgaagggacactgcgcccgggcgagaagctcccgccagaacgcgagctggcaaaacagttcgacgtttcacgtccctctctgcgtgaggcgattcaacgtctcgaagcaaagggcctgttgctccgtcgccagggtggcggaacctttgtgcaaaacagcctgtggcagagcttcagcgacccgctggtagaacttctctctgaccacccagaatcccagtttgatctgcttgagacccgtcacgcgctggaaggtatcgcggcctattacgccgcccttcgcagcactgatgaagaccgcgtacgtattcgcgagctgcatcaggccattgaacgggcacagcagtccggcgatttagacgccgagtccagcgccgtcgtccagtatcaaattgccgtcaccgaagcggcgcacaacgtggtgctcctccatctgctacgctgcatggagccgatgctggcccagaacgttcgtcagaattttgaattgttgtatgcccgtcgggagatgctcccgctggtaagcaaccatcgcacccgagtattcgaggcgataatggccggggaaccggagcaggcgcgcgaagcgtcgcaccgccatctggctttcattgaggaaatcttgctggaccgcagccgtgaacaatcgcgtcgcgaacgttcattacgccgcatacagcaacgaaaggattaa

SEQ ID NO: 3991 - DNA, 2679 bp, Enterobacter cloacae
ataaggaatacccccatgtcagaacgtctccaaaatgacgtggatccgatcgaaactcgcgactggctacaggcgatcgaatcggtcatccgtgaagaaggtgttgagcgcgctcagtatctgattgatcagctgctttctgaagcacgcaaaggcggcgtgaaagtggcttcaggtgcaggggctagcaactacgtaaacacgattgccgtcgaagacgaaccggaatacccgggcaatctggatctggaacgccgtatccgttctgctatccgctggaacgccatcatgaccgttctgcgcgcatctaagaaagacctggaactgggtggccacatggcgtccttccagtcttctgcgaccatttacgaagtgtgcttcaaccacttcttccgtgcagctaacgagaaagacggcggcgatctggtgtacttccagggccacatctctccgggcatctatgcacgtgccttcctggaaggtcgtctgactgaagagcagatgaacaacttccgtcaggaagttcacggtaagggtctgtcttcttacccgcaccctaaactgatgcctgagttctggcagttcccgaccgtatctatgggtctgggtccaatcggtgcgatctatcaggctaaattcctgaagtacctggaacaccgtggtctgaaagacacctctgagcagaccgtttacgccttcctgggcgacggtgaaatggatgagccagaatctaaaggcgccatcaccatcgcgacccgtgagaagctggacaacctgtgcttcatcatcaactgtaacctgcaacgtctggatggtccggtaaccggtaacggcaagatcatcaacgaactggaaggcatcttcgcaggtgctggctggaacgtgatcaaagtgatgtggggcggtcgttgggatgaactgctgcgtaaagacaccagcggtaaactgatccagctgatgaacgaaaccgttgacggcgactaccagaccttcaaatccaaagacggtgcctacgttcgtgagcacttcttcggcaaatatcctgaaaccgcagccctggttgcagactggactgacgagcagatctgggcgctgaaccgcggtggtcacgatccgaagaaagtttacgctgcactgaaaaaagcgcgtgaaaccaaaggtaaagcgactgtgatcctggcccacaccatcaaaggttacggcatgggtgataccgcagaaggtaagaacatcgctcaccaggttaagaaaatgaacatggacggcgtgcgttatatccgcgaccgtttcaacgttccagtgaccgatgagcaggtagaaaaactgtcttacatcaccttcccggaagggtctgaagaacacaagtacctgcacgaacgtcgtcaggcgctgaaaggctacctgcctgctcgtcagcctaacttcaccgagaagctggaactgccagcgctggaagatttctctcagctgctggaagagcagaacaaagagatctctaccactatcgctttcgttcgtgccctgaacgtgatgctgaagaacaagtcgatcaaagatcgtctggttccaatcatcgccgacgaagcgcgtactttcggtatggaaggtctgttccgtcagatcggtatctacagcccgaacggccagcagtacaccccgcaggaccgtgagcaggttgcatactacaaagaagacgagaaaggccagatccttcaggaaggtatcaacgaactgggtgcaggcgcatcctggctggccgctgcgacctcttacagcaccaacaacctgccgatgatcccgttctacatttactactccatgttcgggttccagcgtatcggtgacctgtgctggcaggcaggcgaccagcaggctcgcggcttcctgatcgggggtacttccggtcgtacgaccctgaacggtgaaggtctacagcacgaagatggtcacagccacattcagtcactgactatccctaactgtatctcttacgatccgtcttacgcgtacgaagtggcagtcatcatgcatgacggcttgcagcgcatgtacggtgaagcgcaagagaatatttactactacatcaccaccctgaacgaaaactaccacatgccggcaatgccagcaggcgccgaggaaggtatccgtaaaggtatctacaaactcgaaaccatcgaaggtagcaaaggtaaagttcagctgctgggctccggttctatcctgcgtcacgttcgtgaagcagcgcagatcctggcgaaagactacggtgtgggttccgatgtgtactctgttacctccttcactgaactggcgcgtgatggccaggattgtgagcgctggaacatgcttcacccaatggaaaccccacgcgttccgtacatcgctcaggtgatgaacgacgcgccagcggtggcgtctactgactatatgaaactgttcgctgagcaggttcgtacttacgttccagctgatgattatcgcgtactgggtactgacggcttcggtcgttctgacagccgcgaaaacctgcgtcaccacttcgaagttgatgcttcctacgtggttgtagcagcactgggcgaactggctaaacgtggcgaaatcgataagaaagtggttgcagacgcaattactaaattcaacatcgatgcagataaagttaacccgcgtctggcgtaa

SEQ ID NO: 3992 - DNA, 1434 bp, Enterobacter cloacae
gaggtcatgatgagcacagaaatcaaaactcaggtcgtagtacttggggcaggcccggcaggttactccgcagcatttcgcgccgcggatttaggtctggaaaccgtcatcgtagaacgttacagcaccctcggcggtgtttgtctgaacgtcggctgtatcccttctaaagcgctgctgcacgtagcgaaagttatcgaagaagccaaagcgctggctgaacacggtatcgtcttcggcgagccgaagaccgacatcgacaaaattcgtacctggaaagagaaagttatcactcagctgaccggcggtctggcgggtatggccaaaggccgtaaagtgaaagtggtaaacggtctgggtaaattcaccggtgcgaacaccctggaagtggaaggtgaaaacggtaaaaccgtgattaacttcgacaacgcgatcatcgcggcaggctctcgcccaatcgaactgccattcattccacatgaagatccacgcgtgtgggattccaccgatgcgctggagctgaaaaccgttcctaagcgtctgctggttatgggcggcggtatcatcggtctggaaatgggtaccgtgtaccatgcgctgggttcagagatcgacgtggttgaaatgttcgaccaggttatcccggctgccgacaaagacatcgttaaagtcttcaccaaacgcatcagtaagaaattcaacctgatgctggaaaccaaagtgactgccgttgaagcgaaagaagacggtatttacgtttccatggaaggcaaaaaagccccatccgaaccacagcgttacgacgccgtactggtggctatcggccgtgtgccgaacggtaaaaacctcgacgcgggcaaagctggcgtggaagtggacgaccgtggcttcatccgcgttgacaaacagctgcgtaccaacgtgccgcacatctttgctatcggcgatatcgtcggtcagccaatgctggcgcacaaaggtgttcacgaaggtcacgttgccgctgaagttatcgccggcatgaagcactacttcgatccgaaagtgatcccatctatcgcctacaccgagccagaagttgcatgggttggtctgactgagaaagaagcgaaagagaaaggcatcagctacgaaaccgccaccttcccgtgggctgcttctggccgtgctatcgcgtccgactgcgcagacggtatgaccaaactgatcttcgacaaagaaactcaccgtgtaatcggtggtgcgattgtcggtaccaacggcggcgagctgctgggtgaaatcggtctggctatcgaaatgggctgtgacgcggaagacatcgcgctgaccatccacgctcacccgactctgcacgagtccgtgggcctggcggcagaagtgtttgaaggtagcatcaccgacctgccaaacgcgaaagcgaagaagaaataa

SEQ ID NO: 3993 - DNA, 447 bp, Enterobacter cloacae
aatcacgccgcaggtggacacttcaatatccgcgcggaaggtacacagcccgccttccgggtggctttccgggtaggtgtgcacgcagatgtggcttttatccaggtgagcaaccaccacttccggcagcgggccggggtgttcggttttgtcgataagctgtgggtcaaccggctcttcactcaccagaatggtgacgctcgcaccctgaggctcataatcctggcgcgcgatattgaggatgttcgcgccgataatcgagcaggtctctgtcaggatctcggtcagacggttggcgttgtagagttcatcgatataggcgatgtaaccatcgcgctcttctgctgttttggcgtagcagatatcgtaaatacaaaaactcaggcttttggtcagattgttaaagccatgcagtttaagctttttcaattagttcacctcctttga

SEQ ID NO: 3994 - DNA, 1764 bp, Enterobacter cloacae
ctgttcgcacacatcgccatcaggctggcgaacaaaattgttctgaaaaacgtcttcattgcctttaccactgcatcacggaaaattaacgttagcatacttgatgccaggccgacgatctttattattgccgccgtgcttgaccttccggtaaggggagggtttatgctcaaaagatcgcctgctggaaataaggaaatgcacatgcaacgtcgtgattttttaaaattttctgctgcgctgggggttgccagcgcgatacctctctggagccgcgccgtttttgccgccgacagaccggctttacccattcctgaattactcgccccagatgcccgcagccgcattcagcttgtggtgcaggccggtaaaaccacgttcggtcagcacgccgccacgacgtgggggtataacggcaatctgctcggcccggcgttgcagttacgcaaagggaaggcggtgacggtagacattcataacacgcttgcggaagagaccacgctgcactggcacgggctggaagtcccgggcgaagtggatggggggcctcagggcgtcatcaggcctggtggtaaacgcagcgtaacctttaccccggaacaacgcgcggcgacctgctggttccacccgcatcagcatggcaaaacgggccatcaggtggcgatggggctggccgggctggtgctgattgaagacgatgaaagccgcctgctgcgcctgccgaaacagtggggtatcgacgatgtcccggtgattgtgcaggacaaaaaattcagcgctgacgggcaaattgactatcagctggacgtaatgagcgcggcggtaggctggtttggcgatacgctgctgaccaacggcgcgatctacccgcagcatgccgcgccaaaaggctggctgcgcttacgtctgcttaacggctgtaacgcccgctcgctgaacttcgccaccagcgataaacgcccgctttacgtagtggcaagcgacggcggcctgctgccggagccggtgaaggtgagcgagctgccgatgctgatgggcgagcgcttcgaggtgttggtggatatcagcgatggcaaagcgtttgacctggtgaccctgccggtcagccagatggggatggccgttgcgccgtttgataagccgcatccggtcctgcgcattcagccactacagatcaccgcctccggtacgctgccggagaccctcaccactctgccagcactcccgtcgctggatgggcttacgcagcgtaaacttcagctctccatggacccgatgctcgacatgatgggcatgcaggcgctgatgaagaagtacggcaatcaggccatggcgggaatgcatcacggccagatgatgggccatatgaatatggaccacggcaatatgggcggcatgaatcacggcggccatggtttcgatttccacaatgccaaccgcatcaacggcaaagcgttcgatatgaatacgcccatgttcgccgccacgaaagggcagtttgaacgctggatgatttcaggcgaaggggacatgatgctgcacccgttccatatccacggcacgcagttccgtattctgtctgaaaatggtaaagcgccggagccgcatcgcgcgggctggaaagatacggtgagggtggaaggcggcgtcagcgaggtactggtgaagttcgaccacgaggcaccgaaagagtttgcctatatggcccactgtcatctgctggagcatgaagatacggggatgatgctcggttttaccgtataa

SEQ ID NO: 3995 - DNA, 834 bp, Enterobacter cloacae
caaagcaaaccgactggaagagctgtttgtctctctggtgcacgacaaacaaggagacaaggcatgacgcatctttactgggtcgcgctgaaaagcatctgggcgaaagagattaaccgctttatgcgtatctgggtgcaaaccctggtgccgccggtgatcaccatgacgctctacttcatcattttcggcaaccttattggctcccgcattggtgagatgcacggcttcacctatatgcagtttatcgtgccgggcctgatcatgatggcggtgatcaccaacgcctacgcgaacgtggcgtcctcattcttcagcgccaagttccagcgcaacattgaagagctgctggtagcgccagtgccgacgcacgtcattatcgccggttacgtgggcggcggcgtggcgcgcgggctgtgcgtgggtatcctggtaacggccatttcgctgttcttcgtgccgtttcaggttcactcctggcttttcgtggcgctgacgctgctgctcaccgcgattctgttctcgctggccggcttgctgaatgcggtgttcgctaaaacctttgacgacatcagcctgatcccgacctttgtgctgacgccgctgacctacctcggcggggtgttttactccctgacgctgctgccgccgttctggcaggcactctcgcacctgaacccgattgtctacatgatcagcggcttccgctttggtttcctcggcattaccgatgtcccgctgtttaccacggtggtggtgctggtggtgttcattatcgccttctacctgctgtgctggtatctgatccagcgtggacgtgggctgcgtagctaa

SEQ ID NO: 3996 - DNA, 237 bp, Enterobacter cloacae
gatgacatgaaacagagcatcgtcaaatggctgttcgaactgaacgccaaacagcgtgaggtgctggcacgtcgtttcggtttactggggtatgaagctgcgacactggaagatgtcggccgtgagattggcctgacccgtgaacgtgttcgtcagattcaggttgaaggcctacgccgcctgcgtgaaatcctgcaagggcaaggtctgaatatcgaagcgctgttccgcgagtaa

SEQ ID NO: 3997 - DNA, 603 bp, Enterobacter cloacae
atgagattgattgtgggaatgacgggcgcgacgggtgcgccattaggcgtggcgttgttacaggcgctgcgggaaatgccggaggtggaaacgcacctggtgatgtcgaagtgggcaaaaaccaccattgagctggaaacgcccttcactgcgcatgacgttgctgcactggcggatgtcgtccatagcccggccgatcaggctgccaccatctcctccggctcgtttcgcaccgacggcatgatcgtcatcccgtgcagcatgaaaacgctggcgggtatccgcgcgggctacgccgaagggctggtagggcgtgcggcagacgtagtgttgaaagaggggcgcaagctggtgctggttccccgtgagacgccgctcagcaccatccatctcgagaacatgcttgctctttcccgtatgggcgtggcgatggtgccgcctatgcctgcgtactacaaccacccgcaaaccgccgatgacattacccagcatatcgtgacccgtgttctcgaccagtttggtctggagcataaaaaagcccgacgctgggaaggtttgcaggcagcgaaacatttttcacaggagaataaagatggcatttga

SEQ ID NO: 3998 - DNA, 357 bp, Enterobacter cloacae
ggggggatgaaaatggcggggaaacgcattgcgcgcgaaaaagagacgatcgcgaaaatgatcgccctgtatgaaaaaaactgtccgcaggcggtaaaggatgagggccattatcaggcgctgaatgcctacgcggataagcgcctggataaatgcatctttggtgaggaaaaacccgcctgcaaacagtgcccggtgcactgctatcagcccgccagacgtgaggagatgaagcaggtgatgcgctgggcggggccacgaatgctatggcgtcatccgattctgactcttcgccaccttattgacgatcgccgtccggttccggaactgcctgaaaagtatcgacctaaaaaatag

SEQ ID NO: 3999 - DNA, 624 bp, Enterobacter cloacae
tttgcgttacggcgtgacgatgtcaacgctgtcgaaatgacacgtcgacaccgcggcggtgacagtacgtctcttgttaaaagctatttaaatcaacagattaaaaactggcacgaaaactgcttaacagccgctaactccattaaccggataccttttatgactatttgggaaattagcgaaaaagcggattacatcgcgcaacgtcatcagcagcttcaggatcagtggcacctctactgcaactctctgattcaggggatcaccctgtcaaaagcccgtctgcaccatgccatgagctgcgcggcgcagggggacatgcgctttgtgttgtttggtcacttcacgatttttgtcaccctggcggagagcttcaacagccacaccattgagtattacgttgagacaaaagagggtgaaaaacagtgtattgcgaaagctcaactgatggccgacggcatggtggacggtcacgtcagcaaccgcgatcgccagcaggtgctggagcactatctggagaaaatagcgccggtttataacggcctctacgccgccgttgagcacgatcagtcgatcaacctgaaacagctgatcgacggaaaatcctccgcgaacgtggcctga

SEQ ID NO: 4000 - DNA, 1827 bp, Enterobacter cloacae
cgagggggcgaaatgaacgcgatagttatgatgaccagcggcgtggcctggtttgccgccgccgctgtcctggcgctgctcctcgccttccataaaacgctgagcggcgtgatcgccggtatcggcggggcggtcggcagcctgatgacgctggcggcgggcggggttgtcctgatcgacgggcaatccgtcgacaccctcatcccgctgattcaccacgccgttgagcttacgccgctgaacgccatctggctgataacctttggcctgtgcgggctgtttatcagcctgtttaatatcgactggcaccgccatcagcacaccaaagccaacggcctgctggttaacctgttgatggccgccgcggtctgtaccgttgtcgccagcaacctcggcgcgctggtggtgatggctgaaatcatggccctgtgcggcgtgttcctgaccggatgcagcgcctccggcaagctgtggtttgcgctcggacgtctcggcacgctgctgctggcgctggcctgctggctggtgtggcagcgtttcggcacgctggatttcgccgcgcttaacggccagccgctgggcaacgacgtctggctgttgggcgtagtcggttttggcctgctggccgggataatcccgctgcacggctgggtgccgcaggcgcatgccaatgcctcagccccggccgctgcgctgttctccaccgtggtgatgaaggtcggtcttttcggcatcctgacgataaccctgacgggcgatcagccgccgctgtggtggggcgtggcgttgctgattgcggggatgatcaccgcgttcgtcggtggcctctacgcgctgatggagcacaacatccagcgtctgctggcgtaccacaccctggagaacatcgggattatcctgctcggcatgggcgcgggcgtcaccgggctagcgctcaaccagccggcgctaattgccgccgggtttattggcggtctgtatcaccttatcaaccacagcctgtttaaaagcaccctgttcctcggcgcgggcagcgtctggttccgcaccgggcaccgcgatattgagaagctcggcgggattggcaaaaaaatgcccgtcatttcgctggcgatgctggtcgggctgatggcgatggctgcgctgccgccgctgaacggctttgccggcgagtgggtgatttatcagtccttcttcgccctcggccagagcgaggcgtttatcgggcgtttactcggcccgctgctggcggtgggcctggcgatcaccggggcgctggcggtgatgtgtatggctaaagtttacggtgtcaccttcctgggcgcgccgcgcacccgagaagcggaaaacgcctgctgcgccccggtactgatgaccaccagcgtggtcgcgctggcgctgtgctgcatcgcgggcggggttgccgcgccgtggctgctgccgctgctgggccacgctattccgctgccgctggtcacggcgcataccgtcgtttcccagccgatgatggcgctgctgctgattgccgcgccgctcctgccgttcgtgctgatgctgttcttcagacgcgaccgtctcgcctcccgctcgcgcggcgcggcgtgggcctgcggctacgaacacgagcagtcgatggtcatcaccgcccacggtttcgccatgccggtgaaagagaactttgccgccgtgctgaagctgcgacactggctgaacccggtgggctgggtgccgggctggcagggggccgccgtgcccgtactgttccgccgcctggcgctgatcgagctggcggtgctggtggtgattgtcatttcacgaggagcctga

SEQ ID NO: 4001 - DNA, 807 bp, Enterobacter cloacae
ccgcatcgatttaacccgccatatgagagaggccagctgatggaaaacttactcggcccgcgcgacgctaacggcattccggtgccgctgacggtggaggagtccatcgccagcatgaaggcgtcgctgctgaaaaaaatcaaacgctcggcctacgtctatcgcgtggactgcggtggctgcaacggctgcgagattgagatcttcgctacgctgtcgccgctgtttgacgccgagcgcttcggcatcaaggtggtgccgtccccgcgccacgcggatatcctgctgttcaccggcgcggtcacccgcgcgatgcgctcgcctgcgctacgcgcctggcagtctgcaccggatccgaaaatctgcatctcctacggtgcctgcggcaacagcggcggcatcttccacgatctttactgcgtctggggcggtaccgacaaaatcgtgccggtggacgtctacattccgggctgcccgccgacgcccgccgccacgctgtacggttttgccatggcgctcggcctgctggagcagaagatccacgcccgcgagccaggcgagctggacaaccagccagccactatcctgcacccggatatggtgcaaccgctgcgggtgaagatcgaccgcacggcacgcaggctggcgggctaccgctacggacgccagattgccgacgattatctgcgtctgctcagccagggcgaccatcaggtggcgcgctggctggaggcggaaaaagatccgcgtctcaatgagatcgtggcgaacctgaacaacattgtggatgaggcgcgtatccgatga

SEQ ID NO: 4002 - DNA, 465 bp, Enterobacter cloacae
ggagattacgtgactgacgttttactgtgtgtcggcaacagcatgatgggcgacgacggcgcgggtccgctgctggcggaactgtgcgccgcaaactcgccgggcaactgggtggtgattgacggcggcagcgcgccggaaaacgacgtggtcgccatccgtgaactgcatccggacaggctgttaatcgtcgatgccaccgatatggggcttaatcccggcgagatccgcctgattgacccggacgacatcgccgagatgtttatgatgaccacccacaatatgccgctgaactacctggtggatcagatcaaaggtgacgtgggcgaggtgctgtttttgggcattcagccggatattgtcgggttttattacccgatgacgccgccggtgaaagaggcggtggacgtggtgtattcacggcttgcagggtgggttggggatggaggtttttctccgctctga

SEQ ID NO: 4003 - DNA, 1111 bp, Enterobacter cloacae
tttttggtggaaaaaggcacggatttgcgttggggaggtgcgaaccgcttccttgaggagttggggatgctttaccatactgggttcttaccgaactcgttaaatggatgccacatgttcaagcgtcgttatgcagcgctgttgcctgcgcttattctcctgtccgcctgtagtagcaaacccaagaccgaagccgttcagccaacggcgggcgcgccttccggaggattcctgctggagccgcagcacaatatgatgcagatgggaggcgacttcgcgaataaccctgcggccgaacagttcatcgataaaatggtgagcaagcacggttttgatcgccagcagctgcatgccattttgtctcaggcgaagcgtctggactacgtgctgcgcctgatggacaggcaggcgccgacggcccaggtgccgaccgggccaaacggggcgtggctgcgttatcgcaaacagtttattaccccggacaacgtgcaaaatggcgtggtgttctggaatcagtatgaagacgccctgaaccgcgcgtggcaggtctatggcgtgccgccggagatcatcgtcggtattattggggttgagacccgctggggacgcattatgggtaaaacccgcatcctcgatgcgctggcgacgctctccttcaactacccgcgtcgcgcggagtatttctcttccgagctggaaaccttcctgctgatggcgcgagacgaacaggacgatccgttagatctgaaagggtcgttcgccggtgcgatgggctacggccagtttatgccgtcctcctataagcagtacgcggtagattttaacggggatggtcacatcaacctgtgggatccagaagacgctattggcagcgtggccaactacttcaaagcgcatggctggacgccgggcggccaggtggcggtacaggcgaacggcgaagcgtttggtctggaaaacggatttaaaaccaaatacagcgtggcgcagctggcagcggcaggcttaacgccgtctcagccgctgggcaatgttgaccaggtgagcctgctgcgcctggatggtcttcaccacggggctcgaaggagccgcgctaagcgtatcaaggaac

SEQ ID NO: 4004 - DNA, 1521 bp, Enterobacter cloacae
cccgtgttctcgaccagtttggtctggagcataaaaaagcccgacgctgggaaggtttgcaggcagcgaaacatttttcacaggagaataaagatggcatttgatgatttgagaagcttcctgcaggcgctcgatgagcaagggcaactgctgaaaattgaggaagaggttaacgccgagccggatctggcggcggccgccaacgcgaccggacgcattggcgatggtgcgcctgcgctgtggttcgataatattcgcggcttcaccgatgcccgtgtggtgatgaacactatcggctcgtggcaaaaccatgctatttcgatggggctgccagcgaataccccggtgaaaaaacagatcgacgagtttattcgtcgctgggacaaattccccgtctcgccagagcgtcgtgcaaatccggcctgggcgcagaacacggtggacggggaagacatcaacctgttcgacattctgccgctgttccgcctgaacgacggtgacggaggcttttatctcgataaagcgtgcgttgtctcccgcgatccgctcgaccccgatcacttcggcaaacagaacgtcgggatctaccgtatggaagtgaagggcaagcgtaagctcggcctgcaaccggtgccgatgcatgatatcgcgctgcatctgcataaggcagaagagcgcggcgaagacctgcctattgccattacgctgggtaacgatccgatcatcaccctgatgggcgccacgccgctgaaatacgatcaatccgagtatgagatggccggtgcgctacgcgaaagcccgtatccgattgcgacggctccgctgaccggtttcgatgtgccgtgggggtcggaagtgatcctcgaaggggtgattgaaggccggaaacgtgaaattgaagggccattcggtgagtttactggacactactccggcgggcgcaacatgacggtcgtacgcattgataaagtctcttaccgcaccaaacccattttcgaatccctttacctcggcatgccgtggaccgagattgattatctgatggggcccgccacctgcgtaccgctctatcagcaactaaagtcggaattcccggaagtgcaggcggtaaacgccatgtacacccacggtctgctggcgattatctccactaaaaagcgttacggcggttttgcccgtgcggtcggcctccgcgccatgaccacgccacacggtctgggttacgtgaaaatggtgattatggtggatgaagacgtcgatccgtttaacctgccgcaggtgatgtgggcgctgtcatcaaaggtcaatccggcaggcgatctggtgcagctaccgaatatgtctgtgctcgagcttgaccccggctccagcccggcggggatcactgacaagctgatcattgatgccaccaccccggttgccccggacaaccgtggtcactacagccagccggtacaggatctccctgaaaccaaagcctgggccgaaaaactgaccgcgatgctggcggcacgtcaataa

SEQ ID NO: 4005 - DNA, 495 bp, Enterobacter cloacae
aggacatctctgatgaccaaaaaggcaaccgttctgttgtttctggtattcttcctcgctggcgcactggccgcatggctataccgtctacaccagcaaaacagtgaaaatacggaggcctgttcagcgtcaatcgtcgtctatcatgaggatattcgcgctaacctgacgatggacttcatgtacacgatgaagaagcagactggcgtcattgcgctaagcggagcctattataaaaatgataaacttgctggcgttatccgcagagatgtctcctatgtatggacagaaaataaagactcattccattttacatcggtaaatatacatgacattaatggtcagcaaaccgcaccaaatgagattatgaatgaaattctccctgacttctttctgtatccgaagaaaaatctgaattattccattacgcagcaggggccccgtgggtttatgttttctgtcggaaaacgccctattttttactgctctcgctga

SEQ ID NO: 4006 - DNA, 630 bp, Enterobacter cloacae
ccatcaccagaggatgacccggtgaaccgttttgtaattgctgactcgacggtctgtattggctgtcggacctgtgaggcggcgtgttcggaaacgcaccgcctgcacgggctacagtccatgccgcgcctgcgcgtcatgcgtaatgagaaagagtctgccccgcagctctgtcaccactgtgaagacgccccgtgcgcgggcgtttgtcctgtcaatgccatcacccgcgttgacggcgcggtacagctgaacgaaagcctgtgcgtgagctgcaaactgtgcggcatcgcctgtccgttcggcgccattgagttttccggcagccgtccgctgcatattccggcgaatgccaataccccgaaagcgccgcctgcgccgccggctccggcacgcgtgagcacgctgctggactgggtgccgggcattcgcgccgttgcggtgaagtgcgacctgtgcagcttcgatgagcagggtccggcctgcgtgcggacctgcccgacccgggcgctggtcctggtcaacatccgcgacatcgctcgcaccagcaaacgcaagcgtgagctgaccatcaataccgacgtcggcgatctttcgctgctgcgggcgcttaacgagggggcgaaatga

SEQ ID NO: 4007 - DNA, 948 bp, Enterobacter cloacae
ttgtcatttcacgaggagcctgacatgagtctgttactggcaattcttcaggcgctggtgctgttcgccgccgcgccgctgctgtcgggcatcacgcgcgtggcgcgcgcccggctgcacaaccgtcgcggacctggcgtgctccaggagtaccgcgatctcttcaaactgctctcccgtcagagcgtcgcgccggatgccgcgggctgggtgttccgcctgacgccgtttgtgatggtgggcgtgatgctgaccatcgccaccgcgttgccggtggtgacggtggcgtcgccgctgccggtgctgggcgatctgattacgctgatctatctcttcgccatcgcgcgtttcttctttgcgattgcgggcctggacaccggcagcccgtttacgggtatcggcgccagccgcgaggcgatgctcggcgtgctggttgagccaattctgctgctggggctgtgggtcgccgcgcaggttgcaggctcgacccacatcagtttcatcaccgacaccgtttaccactggccggtttcacgttcgctcccgctggtgctggcgctctgcgcctgcgcgttcgccacgtttatcgagatgggcaagctgccgttcgatctcgcggaagcggagcaggaattacaggaggggccgctcaccgagtacagcggctacggctttgcggtgctgaagtggggcatcagcctcaagcagctggtggtgttgcagatgttcgtcggcgttttcttcccgtgggggcagatgacgcacttctctgcgggcggcctgctgctggccgtggtggtggctgtgctcaagctgcttatcggcgtgctggtcattgccctgtttgaaaacagcatggcgcgcctgcgttttgtcgaaacgtcacgcattacctgggctggttttggttttgcatttttagcgttcgtctccttgctggtggcgtga

SEQ ID NO: 4008 - DNA, 1725 bp, Enterobacter cloacae
ttaaagagagtgtttatgtctgaagaaaagaaaggtcagcagtatctcgccgcgttgcatcaggctttcccgggcgtggtgctggaggagtcctggcaaaccaaagaccagatcaccgtcaccattaaggtgaactatctgccggaagtggtggagtttctctactaccagcagggcggctggctgtcggtgttgttcggtaacgacgagcgccagctgtgcggcagttacgcggtgtactacgtgatgtcgatggagcagggcgagaagtgctggatcaccgtgcgcgtcgaagtcgacccgaataaaccggaatacccgtccgtcacgccgcgcgtgcccgccgccgtctggggcgagcgcgaagtgcgcgacatgtacggcctggtgccggttggcctgcctgacgagcgtcgcctggtgctgccggacgactggccggatgaactctatccgctgcgcaaggacagcatggactaccgccagcgcccggccccaaccaccgacagcgaaacctacgagttcatcaacgagctgggcagcaagaagaataacgtggtgccgattggcccgctgcacgttacctctgacgaaccgggccacttccgcctgttcgtcgacggcgagaacattatcgacgccgactaccgcctgttctacgtccaccgcggcatggagaagctggcggagacccgcatgggctacaacgaagtcacgtttctttctgaccgcgtgtgcggcatctgcggctttgcccacagcaccgcctacaccacctcggtggaaaacggcatggggatcgtggtgccggaacgcgcgcagatgatccgcgccattctgctggaggtggagcgcctgcactcgcacctgctgaacctcggcctggcctgccatttcgtcggatttgactccgggtttatgcagttcttccgcgtgcgcgaggcatcaatgaagatggcggagatcctcaccggggcgcgtaaaacctacggcctgaatctgatcggcgggatccgccgcgacctgctgaaagacgacatgatccagacccgccagctggcgcagcagatgcgccgggacgtgcaggagctggtggatatgctgctcagcacgcccaacattgagcagcgcaccgtcgggattggtcgtcttgacccggaaatcgcccgcgacttcagtaacgttggtccgatggtgcgcgccagcggccacgcccgcgatacccgcgccgatcacccgttcgtcggctacggcctgctgccgatgaccgtgcacagcgagcagggctgcgacgtcatctcccgcctgaaggtgcgcatcaacgaggtattcaccgcgctgaacatgatcgactacggcctcgataacctgccgggcggcccgctgatggtggaaggcttcacctacattccaaatcgctttgccctcggctttgccgaagcgccgcgcggtgacgacatccactggagcatgaccggcgacaaccagaagctctaccgctggcgctgccgtgcggcgacctacgccaactggccaaccctgcgctacatgcttcgcggcaacacggtctccgacgcgccgctgatcatcggcagcctcgacccgtgttactcctgcaccgaccgcatgaccgtcgtggacgtgcgcaagaagaaaagccaggtggtgccgtacaaagagcttgagcgctacagcatcgaacgtaagaactcgccgctgaaataa

SEQ ID NO: 4009 - DNA, 552 bp, Enterobacter cloacae
ggattcgccatgtttacctttatcaaaaaagtgatcaaaaccggcgcgcagaccagcagttatccgctggagccgatcccggttgataaaaactttcgcggcaagccggagcacaacccgcagcagtgcatcggctgcgcggcctgcgtcaacgcctgcccgtcgaatgccttaacggtggaaacggacctgaaaaccggcgagctggcctggcagtttaacctcgggcgctgcatcttctgcggccgctgcgaggaggtctgcccgacggtcgccattcgcctgtctcaggagtacgagctggcggtgtggaaaaaagaggacttcctccagcaatcgcgctttgcgctgtgcaactgccgcgtctgcaagcgtccgttcgccgtgcaaaaagagatcgactacgccatcgcgctgctgaagcacaacggcgacgtccgcgcggagcatcaccgtgaaagcttcgaaacctgcccggagtgcaagcgtcagaaatgcctgctgccgtctgaccgcatcgatttaacccgccatatgagagaggccagctga

SEQ ID NO: 4010 - DNA, 2373 bp, Enterobacter cloacae
cctctgctaccaccgcgacgccggtccggcgtgtatggaagcctgtccgacgcatgcgctggtctgcgtcgatcgagacaagctcgaacagatgagtgccgaaaaacgtcgccgcgcggcgttcgacacctcgtcatcactgctgttctgaaccgtatgagcagcaacggcgttcagctgcgggtgcgcggcaaggtgcagggcgtggggtttcggcccttcgtctggcagctggcgcaccggctgaagcttgtgggcgatgtctgcaacgacggagagggtgtcctggtgcgtctcgcgggtagtgggggtgactttaccgcgagactgcgccaggactgcccaccgctggcgcgcatcgatcgcgttgaaacgcagccgtacagctggaatacgctgccggacgagtttgtcatccgccacagcgagagtggggcgatggacacgcaaatcgtcccggatgccgccacctgcccggcgtgtctggctgaaatgcgcgatccccgcgagcgccgctatcgttacccgtttatcaactgcacccactgcgggccgcggtttaccattatccgcgccatgccctatgaccgcccggccacgtcaatggcgccattcccgctctgtatgccctgtgaaacggagtaccgcaacccggctgaccggcgttttcacgcccagccggttgcctgcccggactgcgggccgcagctggagtggcgagccggggaggctaccgccacccgcgaatcggcgttaagcgcggcggtggcgatgctggaaggcggcgggattgtggcggtcaaagggctgggcggttttcacctggtctgcgacgcgcttaacccgcaggcgattcggaaattgcgggcacgcaagcagcgcccgaccaggccgctggcggtgatgatcccgcatgcgaacgatctgccgaagaccatccagacgctgttacgttcacccgctgcgccgattatgctgacgccaaaagcctgccttccagcgtttcctgaggagattgcgccggggctgaatacggttggtgtgatgttgcctgcgaacccgctccagcatttgctgatgttggactgtcagcgtccgctggtgatgacctccggcaacctaagtggctatccacccgtcataaacaaccagcaggcgctggaagaactcagtgacatcgctgacggcttcctgctgcacaaccgcgacatcctgcaacggatggatgattcagtgatggaccaggagggcacgatgctgcgtcgcgcacgcggttttgtgccggatgccatcacattgcccgccggattccgcgacatcccgcccatgttatgcaccggcgcggagatgaaaaataccttctgcctggtacgtggcaaccaggcggtgctgagccagcattttggcgatctgagcgacgagggcgtagaggcgcagtggcgcagtgcgctctcgacgatgcaggagatctacgctttccagccagagcgtgtggtgtgcgatgcccatccgggatatcacgcccgacagtgggcccggacgcaagcgctgcccgttgagaccgtgctgcatcatcatgcgcatgcggtagcgtgtctggcggagaacggctggccgctcgacggcggggatgttattgccctgacgctggacgggatcggcatgggcgagaacggcgcgctgtggggcggcgagtgcctgcgggtgaactatcgcgactgcgaacggctgggcggtctgccagccgttgcgctaccgggtggcgatctggcggcaaaacagccgtggcgcaatttgctcgcccactgtctggcgttcgtacctgactggcagcagtacccggaaactgtggtggtacagcgtcaaaactggccgctgctggcaacggcggtgtcgcgcggtatcaatgcgccgcgggcctcctcctgtggtcgtctgttcgacgccgtggcctgtgcgctgggcattgaaacgcaacgctatgagggcgaagccgcgtgccggctggaggcgctggccgaacgctgtgcaggggttgatcatccggtgacgctccagacggataaccttgcgctgttctggcagcagtggctggcctggcgggcggagcccggcgagcgcgcctgggcctttcacgatgcgctggcaaaagggctgagcgaactggcggcaacgcatgcccgccgacggtcgctctctacggtgtgcttcagcggcggcgtccttcacaaccgcctgctgcgcgcgcgccttcgtcattacctttctgatttcacgcttctttttccttcgcgcctgcccgcaggcgacggagcgatctccttcgggcaggcggtggttgctgccgcccgatcatgttcacaaaggatttaa

SEQ ID NO: 4011 - DNA, 1071 bp, Enterobacter cloacae
accaaaggcgctggcgcgtttgttacggaagcgcaggccggtcatctcttccaccagtccggcaattttcggcatcatcacgttattcatggtggaggtacccaccagcacgcctttggagcggaagacgttggtcaatacctcattcttatcgctgcgcgccacgttgaagattttcaccgccacgttcgggtcaacttcgttgatgccctgggcaatggcgtccgccatcatgcgggtgttgttggacatggtgtcgtagaagatcgtaatgcggtcttcctgatagtccgccgcccacttcaggtacagttcgacaatctgggttggattttcacgccataccacgccgtgggaggtggcaatcatatccaccggcaggttgaagccgaggatctcggtgatttttggcgtgaccagacggctgaacggggtcaggatgttggcgtagtagcgttggcactgttcgaacagctcggtctgatccacttcgtcgttgaacagacgttcgtcgcagtagtgctggccgaaggcgtcgttactgaacagcaccgcgtcaccggtcatgtaggtcatcatgctgtccggccagtgcagcattggggtttccacgaagatcagctgtttgccgttgccgatatccagcgtgtcgccggttttcacagtgtggaagttccactccggatggtggtggtggccgttgatggagtcaatggcgttagtggtgcagtagatcggggtatccggaatgtgggacatcagctcggtcagcgccccggcatgatcctcttccgcgtggttgatgataatgtagtcgatctcattcagatcgatttcgctgcgcaggttctgcacgaactcgcggctgaatttgtgatcgacggtatcgatcaggacgtttttaccttcacgaatgagatagctgttgtagctgctgccgcgcagcgttttgtattccgtcccgtgaaaatcacgtacttcccagtcacgttgacccacccaatgaatgttatttttaaccagaatagacatagcaacctcaacttaatacggcgttttcaaataagatga

SEQ ID NO: 4012 - DNA, 906 bp, Enterobacter cloacae
cagttaaccaggcaagcgatgcttaatttacagcgtacggcaatgtttatcgccgtagcggacaccggcagtttcaccgccgcggcggaggcgatggggctgacaaaagcggtggtcagctttcatattcgtcagcttgaagaggagctgggcgtcaccctgttgctgcgaaccacccgacgcctgacgctgaccgaggcggggaagctctttcatcaacgaagcgtgatgctgttacgggatgcagagcgattgcaggatgacgttcgcgccaaccacgccgggctgacgggagaactgcggatcaccaccacgcccgaatatggctcgcaggtggtggtgcctttgctggctgaatttagccagttgcacccggaccttcgcgtgcggcatgtctcgtcctctttgcatgccgatcttatcgccgagcgcttcgatgtcgctatccggctcggcacgcttgcagattcgcgctaccacgccgcgttgatgacctccttcaccatcctgcccgtggcaacgccaggctggctggcaaaccatccggttgactcgctggaacaactggcggaagcggactggatcattcacgagcgtttaacgtcgccgctgcgctggcaggtgagaggtgttgatggacatccggtttcctttgagatcaagaaagcgccgcgcctgtatgcagacagcgcccaggcgctgatggcttttgccctcgcgggatgtggagtggcgctgctgccggagtggctggtgcgtaacgcactggatgcgggggaactggtctcgctgttaccggcatacacgtttgctcagcagggcatctatgccgtttatcccgatgcccggcatgtgcccgcgaaagtgcgaacatttattgattttatgcgcgtcagggtgacttaa

SEQ ID NO: 4013 - DNA, 258 bp, Enterobacter cloacae
ccgcgatgctggcggcacgtcaataaggaggaaaaaatgatttgtccacgttgtgccgatgaacatattgaagtgatggcaacatcaccggtgaaaggtgtctggacggtatatcagtgtcagcactgtctgtatacctggcgcgataccgaaccgctgcgccgtaccagccgcgagcattacccggaagcgttccgcatgacgcagaaggatattgatgaagcaccgcaggtgccgacgatcccgccgctgctgtaa

SEQ ID NO: 4014 - DNA, 900 bp, Enterobacter cloacae
caagggttgaccgcagagtataattacacttcaccccggcagttaactattctgtttatcgtaagcgagcggcatatgttctggataattaacgataaaattaaattttgtccagagaggaatttgctgatttcgttgacccgtcctgacttaaatgtaattctgacaacccctgccagccgttgtctgaaccttcttttagaatcatttccagaagtcgttacgcagaaatacttctttgataaagtctggggcgaggacggcatgctggttccggcaaatacgctttatcagaatatctctataattcgacgcgggctccggaccacaggagagacggacgatacgctggtggcgacggtgccgagaaaaggattccagatagagaaaaatgtcagggtaacccgcgttgacacggactgtgttgatgacggaaaaaaagcgacagcgacgggagtggaaacctctccggttgaaacaaaggataaacctgtcgaaaatattcccgtaatgccgggtgggaggaaaaaacagcgtcaattacgccagtatattttcccgacagctttaatgataatcgcgttttgtgccggtttctttgcgtttcaataccttttacatgataacccggaaaaagattttttcagggattatccaattactcttacacagaacggctgtcatttttcctcgcaaaacgatgatattcgtggcgtcggcaacttcaggcgatttataaaaatcattttagacacggggcttgattgtaaaaaatatccgtgggtctatttttcctcatccagccatgctccggcgctttccgttcttgcttgcagagaaccctttgaaataaaagcaaatgccggatgtatttcgctctattttagaggacatctctga

SEQ ID NO: 4015 - DNA, 423 bp, Enterobacter cloacae
ggcgcgtatccgatgagtgaaacggtggtgttcagccagctgagccgtaagtttattgatgagaacgatgccacgccggatgcggcgcagcaggtggtctattacagcctggcgattgggcaccacctcggggtgatcgactgcctggaggcggcgttaacctgcccgtggccggaatacctggcgtggatcgtcacgctggaggaaggcagtacggcgcggcgcaagatggagggcgtgccgaagtatggcgagatcgtcatcgacgccaaccacattgcgatgctcgctaacgcctttgacgcggcgctgagcgtacaaaccccggcgcagcaggcgtggagcaaaacgctgctcggcatgctgcacgatattcatcaggagagcgccatctacctgatggtgaggagattacgtgactga

SEQ ID NO: 4016 - DNA, 1053 bp, Enterobacter cloacae
agtacactgcggctcatcggttttgaatggaataacactatgaccaccatgctggaagtggcgaagcgggcaggcgtgtcgaaagcgacggtctcccgggtgctgtcggggaacggttacgtcagccaggagacgaaagaccgcgtgtttcaggccatcgaagaaagcgggtatcgccccaatctgctggcgcgaaacctggcgaccaaacgcacccagaccctggggctggtggtgacgaacaccctgtaccatggggtctactttagcgagctgctgtttaacgccgcgcggatgacggaagagaaggggcgccagctgatcctggcggacggcaagcacagcgccgaagaggagcgcgaggcgatccagtatctgctcgacatgcgctgcgacgcggtgatcatctacccgcgttttctgagcgtggaagcgctggacgagatcattgagaaatgcgagcagccgatcatggtgctcaaccgccgtttgcggaaaaacagcagccacagcgtctggtccgatcataaagcgtcgtgtcaggacgcggtatcgcagctgatcgcgaaaggccaccgggagattgcgtttatcaccggttcgctggattcacccaccggggtggagcgtctttccggttacagggaggcgctggcgcagcacgggattgcagttcgcgacgcgctgatcgccgaagggaagtggagcccggccagcggcgcggcggcggtctctcagctgctcacccgcggcgaagcgtttaccgcgctggtggcgagtaacgacgatatggcgattggcgccatcaggcagctgcatgagagcggcgtcgccacaccgggcgcggtgtccgtcatcggctttgacgacgtggcaatcgcgccctatatcgtgccgtccctctccagcgtgcgtattccggtaacggagatgatccaggagaccatcagccgcctgattttcatgctcgacggcggtgagtttaagcttcagcaaaccttctccggcgagcttatcctgcgcgactccgttattgacggcccgcatcgctga

SEQ ID NO: 4017 - DNA, 582 bp, Enterobacter cloacae
atagcttcgcgcataacagttatgccggagaagcagatgaaccgttttattatggccgatgccagcaaatgcattggttgccgtacctgtgaagtggcgtgcgtggtgtcccatcaggcagagcaggattgcgcctctctcacccctgatacctttctgccgcgcatccacgtcattaaaggcgtgaatatttctaccgccgctatctgtcgccagtgtgaagacgcgccgtgcgccaacgtctgtccgaacggggcgattaagcgcgagaaaggcttcgtgcatgtgatgcaggagcgctgcatcgggtgcaaaacctgtgtggtggcgtgtccgtatggcgcgatggaggtggtggttcgcccggtggttcgcaacagcggtatcgggctgagcgtgcgcgcggagaaagccgaagccaataaatgtgacctctgctaccaccgcgacgccggtccggcgtgtatggaagcctgtccgacgcatgcgctggtctgcgtcgatcgagacaagctcgaacagatgagtgccgaaaaacgtcgccgcgcggcgttcgacacctcgtcatcactgctgttctga

SEQ ID NO: 4018 - DNA, 1239 bp, Enterobacter cloacae
gcgaactggcggcaacgcatgcccgccgacggtcgctctctacggtgtgcttcagcggcggcgtccttcacaaccgcctgctgcgcgcgcgccttcgtcattacctttctgatttcacgcttctttttccttcgcgcctgcccgcaggcgacggagcgatctccttcgggcaggcggtggttgctgccgcccgatcatgttcacaaaggatttaaaatgttacgactgttacgcaatgaacctcgtgcagcgtgcctgctgctggctctcgggatggctaacctgctggcctgggggctggcgtggcacacctttagcgacagtacggcgctgatggcggccagcctgctggcctggtgttacggactgcgtcatgcggtggatgccgaccatatcgccgcgattgataccgtgacgcgtaagatgatgcagcagggcaagcgcccgtccggcgtgggcgcatggttttccctcggacactccaccatcgtggtgctggcctccattgctatcgccgctaccgccacggcgtttcagaaaaacatggcatggttccacgaaaccggcagccttattggcaccgccgtctccgccaccttcctgctggcgatggcgctggtgaatatggtgatcctgcgcggcgtctggcgcagttttcaggcactgaaacacggcaggccggtgcagggcgacatcacgctgcctgcacagggtggcgtcatgaactggctgttcggcaaaaccttccgcctcgtcaataaaagctggcagatgtacctggtcggtttcctgtttggcctcggctttgacacggccaccgaaatcggcgtgctggggatctccgccgccagcgcctccagcgggatgtcggtgtggtcgatcatgatctttccggcgctcttcgccagcggcatggcgctggtggatacgctcgataacctgctgatggtgggtgcctacggctgggcgtttaacaaaccgcagcgcaagctgtactacaacatgaccatcaccggcacttcggtggtggtggcgctgtttatcggcggcctggaagcgctgggtctgctgatggacaagttctccctcagcggcggcgtgtgggatctgattggcgcggtgaacgataacctgggcgatgccggatttgtggtggtcgggctgtttgtcgcctgctggctgatctcgatggcgaactaccgctggcgcggttatgacgcgctggtggtgcgctcctga

SEQ ID NO: 4019 - DNA, 1599 bp, Enterobacter cloacae
tgctcccaaatgggtagtcattttgactatcttaaaaattgtcaatatgacactatgcattgtcaaaatgacagtgaggcagagatgagcttttccgtagatgtgctggcgaagatcgccatagaactgcaaaccggtattggtcatcaggaccgctttcagcggctgatctccacgttgcgtcacgtgctggattgcgatgcctcggcgttgctgcgttacgaagggcggcagtttattccgctggctatcgacggtctggcgaaggacgtactcgggcggcgctttaccctggagggccacccgcgtctggaaaccatcgcccgtgcgggtgacgtggtgcgtttcccggcggacagcgatctgcccgacccttacgacggcctgatccccgggcaggagagcctgaaggtgcacgcctgtatcggcctgccgctgtttgccgggcagaacctgattggtgcgttaaccctcgacggcatgtcgccggatcagttcgataccttcagcgacgaagagctacggctgattgctgcgctggcggccggggcgctgaacaacgccctgctgatagaacagctggagagccagaatattcttccgggtagcccgacggcgtttgagcaggtggcgcacaccgaaatgatcggcctttcgccaggcatggcgcagctcaaaaaagagattgagattgtcgccgcgtctgatttgaacgtgctgatcttcggggagaccggcaccggtaaagagctggtggcgaaagcgatccacgaagcctcgccccgtgcggtgaatccgctggtctatctcaactgcgcggcgctgccggaaagcgtggcggaaagtgagctgttcggacacgtcaaaggggcctttaccggggcgatcagcaaccgcagcggcaagttcgaaatggccgataacggcacgctgttcctcgatgaaattggcgaactctccctttcgctccaggccaaactgctgcgggtgttgcagtatggtgatattcaacgcgtgggagacgatcgcagcttacgcgtggatgtgcgcgtgctggcggcgacgaaccgcgatctgcgcgaagaggtgctggcggggaatttccgcgccgatctgttccaccgtctgagcgtgttcccgctcacggtgccgccgctgcgcgagcggggcgaggatgtggtgctgctggcgggctttttctgcgaacagtgtcggctcaaaatggggctttcccgcgtggtgctaagccccggtgcgaggacgcacctgctgagctacggctggccgggtaacgtgcgtgaactggaacatgcgattcaccgcgcggtggtgctggcgcgggcaacgcgttcgggggatgaagtggttattcatgcgcgccatttcgcgctgcatgaggaaacgacgccgtccgtgaagccggtgatacctgagagcgtgaacgaaaacctgcgcgaggcgacgaatgcgttccagcgtcagatgatcgcccgcgcgctggagcagaataaccgcagctgggcggcgtgcgcgcgggcgctggagatggacgtcgccaacctccacaggctggcgaaacgtctggggctgaagggttaa

SEQ ID NO: 4020 - DNA, 849 bp, Enterobacter cloacae
gggtccggttccgcaggctgtcaccccaggctgcacgttaaaatttatttcgtaataaaggagagacacatgagtcaggttgccgttgtcattggtgggggacaaaccttaggcgagttcctctgccatgggcttgccgcagagggctaccgcgtggcggtcgtggatattcagagtgagaaagccgcccgcgtagcggacgccatcaacaccgagtttggcgaagggatggcgtacggatttggtgccgacgccaccagcgagcagagcgtgatggcgctggcccgcggcgtggacgagatatttggacgtatcgacctgctggtctacagcgcggggatcgcgaaagcggcgtttatcagcgatttcgagctgggagattttgaccgctcgttgcaggtgaatctggtgggctatttcctctgcgcccgtgagttttcccggctgatgatccgcgacggtattcagggtcgcatcattcagatcaactcaaaatcggggaaagtgggcagcaagcacaactccggctacagcgcggcgaagtttggcggcgtcgggctgacgcagtctctggcgctggatctggccgaatacggcattaccgttcacgcgctgatgctgggtaacctgctgaaatccccgatgttccagtccctgctgccgcagtacgccgccaaacttggcatcaaagctgaagaagtggaacagtactacatcgacaaagtgccgctcaagcgcgggtgcgactatcaggacgtgctgaacatgctgctgttttacgccagcccgaaagcctcgtactgcaccggacagtcgattaacgtcaccggtgggcaggtgatgttctga

SEQ ID NO: 4021 - DNA, 360 bp, Enterobacter cloacae
ggaggcgtcatgcacgaaatcaccctctgccagcgggcactggaacttatcgaacagcaggctgtgcagaaccatgcgaagcgcgtgaccggcgtctggctgaaggtcggggcgttttcctgcgtcgagaccagcgccctcaccttctgttttgagctggtgtgccgcggcacgctggcggaaggttgcgcactgcatatcgaggagcagcaggcggagtgctggtgcgaacagtgtcaggagtacgtcacgctgctgtcatcgaaggtacagcgctgtccgcagtgccagagcagcgggctgcgcatcgtggcggatgacggtatgcagatccaacgcctcgaaatcgagaaggagtaa

SEQ ID NO: 4022 - DNA, 867 bp, Enterobacter cloacae
agtatgtgtagtacctgcggttgcgctgaaggcaacctgtatatcgaaggggatgaacaccgcccccactccgcgtttcgctccgcgcccttttcccctgccccgcgtcccgcggcggcactgaccggcatcaccttcgcgccgcagcgttccgacgcgggtgacctgcattacggccgcggcgaagcgggcacccacgcgccgggcatcagccagcgccagatgctggaggtggagattaacgtgctggataaaaacaaccagctcgccgtccgcaatcgcgcccgctttgccgcgcgcgaacagctggtgctgaacctggtctccagccccggctccggtaaaaccaccctgctgaccgaaaccctcaaacggctgaataaacgtgtctcctgcgccgttattgaaggcgatcagcaaaccgttaacgacgccgcgcgcatccgcgaaaccggtacgcctgcgattcaggtcaacaccgggaaagggtgccatctggacgcgcagatgattgccgacgccgccccgcgcctgccgctggcgaacaacggcatcctgttcattgaaaacgttggcaacctggtctgcccggcaagcttcgacctcggcgagcggcataaagtggcggtactctccgtgaccgaaggggaagacaagccgctgaaatatccgcatatgtttgccgccgcctccctcatgctgctgaacaaagtcgacctgctgccgtacctgaatttcgacgtggataagtgcctggcttacgcccgcgaagtgaacccggacattgagatcctgctggtttccgccacgcgcggcgacgggatggacgcctggctgaactggctggagaacgaacgatgtgcatag

SEQ ID NO: 4023 - DNA, 2109 bp, Enterobacter cloacae
atttctctttttgccagtttctattggaaagcaacaatgccgtatacaccgatgagcgatcttggacagcagggcctgtttgacatcacgcgcacacttttacaacagcccgacctcggcgcactgagcgatgccctgacgcggctggtcaggcaatctgcgctggcggacagcgccgccattgtgctctggcatagcgcaacccaccgcgcgagctatttctcaacgcgtgataacggcaaaatcttcgaatatgaagatgaaacgtttcttgcccacggcccggtgcggcgtattctctcccgcccggaagcgctgcactgtaattttgaccagtttcgccaggcctggccgaagctggcagagagcaacctttaccaccctttcggccactacagcatgctgccgctggcggtggaagggcaaatttttggcggctgcgagtttatccgcgataccgaccagccctggagcgaggcggagtacgaacgcctgcacacctttacccagattgtggccgttgtcgcggagcagatccaaagccgcgtcaccaataacgtggactacgacctgctgagccgcgagcgcgataacttccgcattctggttgccatcaccaacgccgtgctctcccgcctggacatggatgagctggtcagcgaagtatcaaaagagatccatcactattttaaaatcgatgccatcagcattgcgctacgcggcaaccggaaaggcaagctgaacatctactccacccactaccttgatgaagctaacccggcgcacgagcagagcgaagtggacgaagcgggaacgctgtccgagcgggtatttaaaagcaaagagatcctgctgctcaatctcaatgaacaggatccggtagccccctacgagcggatgctcttcaacacctggggcaacaagatccagaccctgtgcctgctgccgctgatgtccggcaacaccatgctcggcgtgctcaaactggcgcagtgcgatgaagccgtatttaccaccgccaacctgaagctgctgcgccagatcgccgagcgcatctccatcgcgctggataacgccctcgcctatcaggagatccaccgcctgaaggagcggctggtggacgaaaacctggcgctgaccgagcagctcaacaacgtggacagcgagtttggcgaaatcatctggcgcagcgatgccatgtacagcgtgctcaagcaggtggagatggtggcgcaaagcgacagcacggtgctgatcctcggtgaaaccggtaccgggaaagagctgattgcccgggcgatccacaacctgagcaaccgcaacagccgccggatggtgaagatgaactgcgcggcgatgcctgctggcttactggaaagcgacctgttcggccacgagcgcggtgcctttaccggcgccagcagccagcggctgggccgttttgagctggcggataaaagctctttgttcctcgacgaagtgggcgatatgccgctggagctccagcccaagctgctgcgcgtgctgcaggagcaggagtttgagcgcctcggcagcaacaagctgatccagaccgacgtgcgtctgattgccgccaccaaccgcgatctgaaaaaaatggtcgcagaccgtgagttcagaagcgatctctactatcgcctgaacgtattcccgatctgcctgccgccgctgcgcgagcgcccggaagatattccgctgctggtgaaagcctttaccgcgaagattgcccgccggatggggcgaaatatcgacagtattcctgccgaaacgctacgcacactctcggcgatggagtggccggggaacgtgcgcgagctggaaaacgtcatcgagcgcgcggtgctgctgacgcgcgggaacgtgcttcagctgtccctgccggaggtttctcttgcggaaacgaccgtggccgcaaccgaggttgcgaaggatggagaggatgaatatcagctcattttgcgcgtgctcagggagaccaacggcgtggtggccgggccgaaaggcgcggcgcaacggctggagctgaagcgtaccaccctgctctcgcgcatgaagcgtctgggaatcgataaagagagcctgaattaa

SEQ ID NO: 4024 - DNA, 330 bp, Enterobacter cloacae
cgcgtttttactgttattttatacaggcagtctgaacacacgttgccaacagttaccggaggatctatgcaaggaatggctatcaccaaaccgtatcgtcacttaaaagtgggttatttcagaaagcgtcatgaagatcgtaaaaccaagatcccaacgcgttacagcgtacacgcagccctgaatctgaaaggggactggctcgaaaaagcaggctttttaacccattcgcaggttcgggtggaggtcgggccgggtaaaataattatcgaactcattaaagagccggatgatggacatcccggccatgtcgttcagcgagagcagtaa

SEQ ID NO: 4025 - DNA, 990 bp, Enterobacter cloacae
acagaaagtccatctttcaggagccacagcatgaaccggatccgcattgagaaaggcacgggcggctggggcggcccgctggagttcgacgccaccgaaggcaaaaagattgtgtacatcaccgcgggcacgcgcccggcgatcgtcgacaagttgcgcgagctgaccggctgggaagcggtcgacggcttcaaggaaggcgaaccgccggaagcggaaatcggcgtggcggtgatcgactgcggcggcacgctgcgctgcggcatctatccgaagcgccgcattccgacggtaaatattcactccaccgggaaatccggcccgctggcgcagtacatcgttgaagatatttatgtgtcaggcgtgaaggaagacaacatcacgctggtgaatggcacatctgcgccgcaaaaagcggccccgcgcgagtacgacaccagcaaaaaaatcaccgagcagagcgatggcctgctggcgaaggtcgggatggggatggggtccgccgtggcggtgctgttccagtccgggcgcgacaccatcgacacggtgctgaagaccattctgccgtttatggcattcgtctcggcgctgatcggcatcatcatggcctcaggcctgggcgactggattgcccacggcctcgccccgcttgccagccacccgctcggcctggtgacgctggcgctgatctgctccttcccgctgctgtcgccgttcctcggcccgggcgcggtgattgctcaggttatcggcgtgctgattggcgtgcagattggtctggggaatattcttccgcacctcgccctgcccgccctgtttgccattaacgcccaggcagcgtgcgactttatccccgtggggctgtcgctggcggaagcacgccaggagaccgtgcgcgtgggcgtgccgtccgtgctggtcagccgcttcctgacgggcgcgccgacggtgctgattgcctggtttgtttccggctttatttatcaataa

SEQ ID NO: 4026 - DNA, 375 bp, Enterobacter cloacae
gaggtgcctgccatgactgtgatttaccagacaaccattacccgcatcggccagagcgcggcggatgcgctgagcgaccaaatgctgatcaccttccgcgaaggcgccccggcagatatcgaagagttttgctttatccactgccacggcgagctgaacggcgagctgaaggccggaagccagctggagctgggcaaggcgcgctatgcggtaaccgccgtcggtgacgtcgccgagcaaaacctgcgcgagctggggcatatcaccctgcgtttcgacggccagccgcaggcggagtatcccggcacggttcacgttgagggtccggttccgcaggctgtcaccccaggctgcacgttaaaatttatttcgtaa

SEQ ID NO: 4027 - DNA, 372 bp, Enterobacter cloacae
caaggagccgatatggtaaccgcactcatcaccgtcgccgccctcgcctggatctgccagatggcgtttggcggctggcagatctaccagtttaaccgcgcctttgatgcgttgtgtcagaagggacgcgtcggcgtcgggcgttccggggggcgctttaagccgcgcgtggtggttgccgttgcgctggatgaacacaaccgggtgagcgattccctcatcatgcgcggcgtaacggtgtttgcccgtccgaccaaaattcaggcgatcaacggcatttcgctgcatgaattacaacctgatgtgatcttcccccatgattcactctgtcagaatgcactatcattagcgcttaatctgaaacatggataa

SEQ ID NO: 4028 - DNA, 837 bp, Enterobacter cloacae
tttcgttgtgaaagttataaacttgcggaattatcatttcgcaacgtaaggaacgaagcgcctatgaaaccacgtcagcggcaggcggccatacttgagcatctgcaaaagcagggaaagtgctcggtagaggatctggcccactactttgacaccaccggcacgacaatacgcaaggacctggtgttgctcgaaaactccggcgccgtcattcgtacctacggcggcgtggtgctcaataaagacgaagccgacccgcctatcgaccacaaaacgctgatcaatactcaccagaaagcgctgattgccgaagccgccgtcaaatttatccatgacggcgattccattatcctcgacgcaggcagtactgtcctacagatgatcccgctgctcagccgctttaataacatcaccgtgatgaccaacagcctgcacatcgtcaatgccctgtcagagttcgacagcgagcagaccatcctgatgcccggtggcaccttccgtaaaaaatcagcgtcgtttcacgggcagctggcggagaatgccttcgaccacttcagcttcgataagctgtttatgggcaccgacggcatcgacctcaacgcgggcgtgactaccttcaacgaggtgttcagcgtcagcaaagcgatgtgcaacgccgcacgggaagtgtttttgatggcggactcgtcgaagtttggccgtaaaagccccaacattgtctgtagccttgaaagcgtcgataagctgattaccgacgcaggtatcgatccggcatttaaaaaagcgctggaagcgaagggcatcgacgtgatcgtaaccggagagaaaaatgagtga

SEQ ID NO: 4029 - DNA, 1152 bp, Enterobacter cloacae
actggcaacggaggcaaaatgagccacggcatcgtcattatcggctcgggctttgccgcccgccagctggtgaaaaatatccgcaaacaggatgctaacgtgccgttgacggtaatcgccgccgacagcatggatgagtacaacaagcctgatttaagccacgtcattagccagaatcagcgcgccgacgatctcacccgccagacggcgggggagtttgcagaacagtttaacctgcgtctgtttccgtacacctgggtgaccgatatcgacgccgacgcccacgtggtgaacgcgaaagataaaacctggcactacgacaagctggtgctggcgacgggggcatcggcgtttgtgccgccggttgagggccgcgaactaatggtcacgctcaacagccagcaggagtatcaggccagcgagaccctgttacgcgacgccacgcgggtgatgattgtcggcggcgggctgattggcaccgagctggcgatggacttctgccgggcgggaaaatccgtcaccctggttgaccacgcggccagcattctgtcagcgctgatgccggcagaagtaagcagtcgcttacagcatcgtctgaccgacatgggcgtgcatctgctgctgaaatcgcagttgcagagcctgagcaaaaccgaaaccggcatttgtgcgacgctcgaccgcaaccgcagcgtggaagtggatgtggtaattgcggcgacggggttgcgcccggaaaccgcgctggcgcaccgcgcgggcgcagagatcaatcgcggcgtgaaggtggacagctacctgcaaaccacccagccggatatttatgccctgggcgactgcgcggaaattaacggccaggtgctgccgttcctgcaaccgattcagttaagcgccatgttcctggcgaaaaacctgctcggcggtaacgccccggtgaaattacccgccatgctggtgaaggtaaaaacgccggaactaccgctgcatctcgcaggtgaaacgcagcgtcaggatctggactggcagattgccctttcgcctcagggcatggtggcgcgcggcaccgatactgccggtcagatgcgcgcctttgtggtcagcgaagacagaatgaaggaggccttcgcgctgctgaaatcgttacctgcttaa

SEQ ID NO: 4030 - DNA, 342 bp, Enterobacter cloacae
catccccgccgtcgagcggccagccgttctccgccagacacgctaccgcatgcgcatgatgatgcagcacggtctcaacgggcagcgcttgcgtccgggcccactgtcgggcgtgatatcccggatgggcatcgcacaccacacgctctggctggaaagcgtagatctcctgcatcgtcgagagcgcactgcgccactgcgcctctacgccctcgtcgctcagatcgccaaaatgctggctcagcaccgcctggttgccacgtaccaggcagaaggtatttttcatctccgcgccggtgcataacatgggcgggatgtcgcggaatccggcgggcaatgtga

SEQ ID NO: 4031 - DNA, 1014 bp, Enterobacter cloacae
agcatgaacacggtggaaatggcgcacggaagcggtggacaggcgatgcagcagctgattaaccggctgtttatggacgcctttgacaacccctggctcgccgagcaggaagatcaggcgcgcattgcgctctcaaccctcaccgcacacggtgacaggctggcgttctctaccgacagctacgtgattgacccgctgttcttcccgggcggcgatatcggcaagctcgccgtctgcggcacggcaaacgacgtcgccgtcagcggggcgatcccccgctacctctcctgcgggtttatcctcgaagaagggttaccgatggaaacgctcacggcggtggtcaacagcatggcgcacaccgcccgcgaggcggggatcgccatcgtcaccggggataccaaggtggtgcagcgcggcgcggcggataagctttttatcaacaccgccgggatgggggcgatccccgccgatattcactggggcgctcaacagctttgcgcaggcgacgtgctgattgtcagcggcacgctgggctgccacggggcaaccatcctgaacctgcgcgaaggcctgaggctggacggggaactgcgcagtgactgcgcggtactcacgccgctgatccagacgctgcgcgacatgccgggcgtaaaagccttgcgcgacgccacgcgaggcggcgtgaatgccgtggtgcacgaatttgccgcaagcagcggctgcggaattgagctgaccgagcgcggcctgcctgtcaaaggcgccgtgcgcgggctatgcgagctattagggctagacccgcttaactttgccaacgaaggcaagctggtgatcggcgtggaacgcacggcggcggaagccgtacttgcacagctgcgcgcgcatccattagggaaagacgcggccatcatcggcgacgtggttgagcgcaaaggggtgcgcctgaccgggctttacggcgtgaagcgtacgctggatctgccgcacgctgaaccgttaccccgaatttgctag

SEQ ID NO: 4032 - DNA, 765 bp, Enterobacter cloacae
gtaatgagcatctgcgccgagaaaatcacctggaaggtaggtaaaaagatcattgtgaatcatgtttcgctgaaggtttcccggggcgaaacggtgggcctgcttggccctaacggctgcggtaaatcctcgctgttgcgcatactggcaggtctgcgccgcccggatgccgggtgcgtgacgctggacggacaggacattgcccgcattgccaaaaagcagctggcgcggcgcgtggcgtttgttgaacagcacggaatgaccgacgccaatatgcgcgtgcgtgacgtcgtcaaactggggcgaattccgcaccattctcccttctcaaactggagcgcgcaggatgacgaaaccgtcaccgccgccctgcaacgcgtggatatgctggatcgcagcgaacagggctggctgagcttatccggcggcgagcgtcagcgggtacatatcgcccgcgcgctggcgcaaacgcccaccgagatcctgctggatgaaccgaccaaccatctggacattcatcatcagatgcagctcatgcagcttatcagtgagctgccggtaaccagcatcgtcgccattcacgatcttaaccacgcatccatgttctgcgattcgctgattgtgatgcagcaagggcagattgtggcgaccggaacgccgcaggaaatcttatccgaggaactactctgggacgtcttcagggtgaaaaccagaatcgagatctcgccgtaccacggcaaaaaacacatccattttatcgtgtag

SEQ ID NO: 4033 - DNA, 1230 bp, Enterobacter cloacae
gttaaaacgatgcctcttcgcactgccaccacgctctggccgcccgttctgctgggcagccagttcgtgtttaacattggcttttacgcggtcgttcccttcctcgcgatcttcttgcgtgacgatatgctgctctccggcgggctgattgggctggtgcttgggctgcgcaccttttcccagcaggggatgtttattgttggcggcgcgctttcagaccggtttggcgcgaagagcgtgatcctcagcggctgcatcgtccgcgtggtgggttatttactgctggcctttgggcaatccctgtggcccgtcattctgggggcctgtctgacgggcgttggcggcgcgctgttctcaccgtcgatagaggccctgctggcaaaagcgggaacgcaaagtgaggcaaagggtaaacgcagccgcgcggagtggtttgcgctgtttgcggtgtgcggtgaacttggcgccgttcttggcccggtgatgggtgcgctgctgacggggctgggtttccgccaggttgcgctcgcgggggcgggaatatttatcgttgcgctcgtggtgctctttttctgcctgcccgcggcgcaccgcagcacgaagccgctgaaaattctgccctggtggacgacgttccgccagccgcgtttcgtcgcctttatcatcgcctacagttcgtggctgttaagctataaccagctctatctggcgctgccggtggagatccaacgcgccggcgggaacgaaaaagatctggggccgctgtttatgctggcctcggtgctgattattgttctgcagctgccccttgcccgtttcgcccgaaacgtcggcgcggtccggatcttaccggtgggctttttgctgctttccgcctcgtttgcaagcgtggcgctctttgccgcgacggagccgccggagggctggctgcgcctgctgccctctgcaagccttgtcacgctgctgacgctcggacaaatgctgctggtgccgtcggctaaagatttgatcccgcgctttgccgaggagtcaacgcttggagcgcactatggcgcactctcaaccgccggcggcatcgcggtgctggtggggaatttaggtttaggcagcctgctggacaaggcgctggtgccctcgacggaggccatttacccgtggctgctgctggcggtgtttccactgtgcagcgcggtcgcgctgagcgtgatttgccgcccgctgcggcgctga

SEQ ID NO: 4034 - DNA, 2583 bp, Enterobacter cloacae
gaacatggacaccaggattttatgagcacacttgagaattttgacgcccacacgccaatgatgcagcagtacctgaagctgaaagcgcagcatccggaaatcctgctcttttaccgtatgggcgatttttatgagcttttttatgatgatgcgaaacgtgcgtctcagctgctcgacatttccctgacgaaacgtggcgcgtcggcaggcgagcccatcccgatggcgggtatcccgcatcacgcggttgaaaactatctggcgaagctggtgaaccagggcgagtctgtcgctatctgcgaacaaattggtgacccggccacatcgaaaggccctgttgagcgcaaggtcgtacgcatcgtcacgccgggaaccatcagcgatgaggccctgcttcaggagcgccaggataacctgctggcggcgatctggcaggatggtaaagggtttggctacgccacgctggatatcagctccggtcgttttcgcctgagtgaaccggctgaccgtgaaaccatggcggctgaactacagcgcactaatccggcagaactgctttatgcagaggatttcgccgagatggcgctgattgaaggtcgccgcggcctgcgtcgtcgtccactgtgggagttcgaaattgataccgcgcgccagcagttgaacctgcaatttggcacgcgcgatttgattggctttggcgtggaaaacgccccgcgcgggctgtgtgccgcaggctgcctgttgcagtacgttaaggatacgcaacgtaccgccctgccccatattcgttccatcaccatggagcgtcagcaggacagcatcatcatggatgccgccacgcgccgcaacctggagatcacgcagaacctcgctggcggcatggaaaatacgctggcgtcggttcttgacagcacggttacccccatgggcagccgtatgctcaaacgctggctgcatatgccgatccgcaataccgaaacgctgactggccgccagcaaaccattgccgcattgcaggatcgttataccgaattgcagccggtgctgcgtcaggtgggtgaccttgagcgtatccttgcgcgcctggcattgcgtaccgcgcgtccacgcgatctcgcccgtatgcgtcatgctttccagcagttgccggaactgcgcgctcagctgggagagatcgacagcgcgccagtgcaaaagctgcgcgaaaccatgggcgaatttaccgagcttcgcgaactgctggaacgtgccatcattgatgcgccgcctgttctggtgcgggatggcggggttattgctccgggttacaacgaagagctggacgaatggcgtgcgctggccgatggcgcgacggattatctggataagctggaaatccgcgagcgtgaacgtctggggctcgacaccctgaaagtcggctacaacgcggtacacggttactatatccagatcagccgtgggcagagccacctggccccgattcactacgttcgccgccagacgctgaaaaatgccgagcgctacattatacccgagctgaaagagtacgaagacaaagtgctcacgtcgaaaggtaaagcgctggcgctggagaaacagctgtatgacgagctgttcgacatcctgatgccgcacctggctgacctgcaactgagcgccgctgcgctggccgagctggatgtcctggtaaacctggctgagcgcgccgacacgctgaattacacctgtccgacctttactgacaaacccggcattcgcattaccgaaggccgccacccggtggttgagcaggtgctgaacgagccgtttattgccaacccgttgaacctgtcaccgcagcgaagaatgctgatcattaccggccccaacatgggcggtaaaagtacctatatgcgccagacagcccttatcgcgctgctcgcctacatcggcagctacgttccagcgcagaaggttgagattggccctatcgaccgtatcttcacccgtgtgggtgcggcggacgatctggcgagcggtcgctctacctttatggtcgagatgaccgaaaccgccaacattctgcataacgcgacagagaacagtctggtgttgatggacgaagtaggacgcggtacctccacctatgacggcctgtctctggcctgggcgtgcgcggaaagtctggcaaataaaatcaaggcgctgacgctgttcgcaacgcactatttcgaactgacacagctgccagagaaaatggaaggcgtggctaacgtccaccttgatgcgcttgagcacggcgacaccatcgcctttatgcacacggtgcaggacggcgcggcaagcaagagctatggcctggccgtcgccgcgctggcgggcgtgccaaaagaggtgattaagcgcgcgcgtcagaaattgcgtgagctggaaagtttgtcaccgaatgcggcagctacgcagatagatggtacgcagatgtcactgctggcggtgccggaagagacctctccggcggtagaagcgctggagaacctcgacccggattcactgacgccgcgtcaggcgctggagtggatttatcggttgaagagtctggtttag

SEQ ID NO: 4035 - DNA, 264 bp, Enterobacter cloacae
ttttctgcggtcttttgccgggtggcggcttcgccttacccggcctacaaaacccgtaggaccggtaagcgtagcgccaccgggctttttttacagcagcggcgggatcgtcggcacctgcggtgcttcatcaatatccttctgcgtcatgcggaacgcttccgggtaatgctcgcggctggtacggcgcagcggttcggtatcgcgccaggtatacagacagtgctgacactgatataccgtccagacacctttcaccggtga

SEQ ID NO: 4036 - DNA, 594 bp, Enterobacter cloacae
acaaaaacaaacgccctacaggagagaagaatgatagaaaccatcacccatggcgccgagtggttcatcgggctgtttcagaaaggcggagaagtgttcactggcatggtgaccgggatcctgcccctgctgatcagcctgctggtgatcatgaacgcgctgattaactttatcggccagcagcgcattgagcgcttcgcccagcgctgcgccggaaacccgctgtcccgctacctgatactgcccttcatcggcacctttgtgttctgcaacccgatgaccttaagcctcggccgctttatgccagagaagtacaagccgagctattacgccgccgcctcctacagctgccattccatgaacggcctgttcccgcacatcaaccccggcgaactgtttgtctatctcgggatcgccagcggccttaccacgcttggcctgccgctcggcccgctggcggtgagctacctgctggtcggtctggtcaccaacttcttccgcggctgggtgacagatctcaccaccgccatttttgagaaaaaaatgggcatccagcttgaacagaaagtccatctttcaggagccacagcatga

SEQ ID NO: 4037 - DNA, 978 bp, Enterobacter cloacae
ccggagagaaaaatgagtgattttctgttaaacgcaggccgtcagaccctgctgctggagctacaggaagccagccgcctgccggagcgtctgggtgaggattttgttcgtgcagccaacaccattatccactgcgagggtaaagtgatcgtggcgggtatcggtaaatccggtcatatcggcaagaagattgccgcgacgcttgccagcaccggcaccccggcgttctttgtgcatcctgccgaagcgctgcacggcgatctggggatgatcgaaagccgcgacgtgatgctgtttatctcctactccggttcagccaaagagctggatctcatcatccctcgcctgcaagaaaaatcggtggccctgttagcgatgaccggcaaatcccgatcgccgctggcgctggccgcgaaagcaacgctggatatttccgttgagcgcgaagcctgtccgatgcacctggcaccgacctccagcaccgtcaacaccctgatgatgggcgacgcgctggcaatggcggtgatgcaggcgcgcggttttaatgaggaagatttcgcccgctcccatcctgcgggcgcgcttggggcacgtctgctcaacaaggttcaccacctgatgcgcaccgacgatgccattcctcaggtcaaactcgacaccagcgtgatggacgccatgctggagctgagccgcaccgggctggggctggttgcggtatgcgacaatgaccgccaggtgaagggcgtcttcaccgacggcgacctgcgccgctggctggtgggcggcggcaagctggaggcgcgggtatccgaagcaatgacccagggcggactgacgctgaatgccgacagccgcgccattgaagccaaagaggtgctgatgaagcgcaaaatcaccgccgcgccggtggtggacgagcacggcaggctgtgcggcgcgatcaacctgcaagacttctaccaggcggggattatttaa

SEQ ID NO: 4038 - DNA, 1461 bp, Enterobacter cloacae
gttgaggttgctatgtctattctggttaaaaataacattcattgggtgggtcaacgtgactgggaagtacgtgattttcacgggacggaatacaaaacgctgcgcggcagcagctacaacagctatctcattcgtgaaggtaaaaacgtcctgatcgataccgtcgatcacaaattcagccgcgagttcgtgcagaacctgcgcagcgaaatcgatctgaatgagatcgactacattatcatcaaccacgcggaagaggatcatgccggggcgctgaccgagctgatgtcccacattccggataccccgatctactgcaccactaacgccattgactccatcaacggccaccaccaccatccggagtggaacttccacactgtgaaaaccggcgacacgctggatatcggcaacggcaaacagctgatcttcgtggaaaccccaatgctgcactggccggacagcatgatgacctacatgaccggtgacgcggtgctgttcagtaacgacgccttcggccagcactactgcgacgaacgtctgttcaacgacgaagtggatcagaccgagctgttcgaacagtgccaacgctactacgccaacatcctgaccccgttcagccgtctggtcacgccaaaaatcaccgagatcctcggcttcaacctgccggtggatatgattgccacctcccacggcgtggtatggcgtgaaaatccaacccagattgtcgaactgtacctgaagtgggcggcggactatcaggaagaccgcattacgatcttctacgacaccatgtccaacaacacccgcatgatggcggacgccattgcccagggcatcaacgaagttgacccgaacgtggcggtgaaaatcttcaacgtggcgcgcagcgataagaatgaggtattgaccaacgtcttccgctccaaaggcgtgctggtgggtacctccaccatgaataacgtgatgatgccgaaaattgccggactggtggaagagatgaccggcctgcgcttccgtaacaaacgcgccagcgcctttggttcacacggctggagcggcggcgcggtagaccgtctctccacccgtttacaggatgccggttttgagatgtccctgagcctgaaggcgaaatggcgtccggatctcgacgcgctggaaatctgtcgccagcacggtcgcgacattgcccgccagtgggcgcttgcgccactgccggaaaccgcacccgccgcggctgttgcgccggaagccgtagcagaagccgctcctgccgctgccgacctcggcccttgcatgcagtgcagcgtctgccagtggatttacgatcctgagctgggcgagccgttgcaggatgtcgcgccgggtacgccatggagcgaggtgccggacaacttcctctgcccggaatgttccctcgggaaagacgtctttgatgaactggcaacggaggcaaaatga

SEQ ID NO: 4039 - DNA, 1497 bp, Enterobacter cloacae
aaccggtttcctacacttctcacaacgataacaggatcacatccgatggcaaaaaattacgctgcgctggcaaacgacgttgttagcgcgctgggcggtaaagagaacatcgtcgccgtcacccactgcatgacgcgcctgcgcttcgttctgaaagacgaaagccttaccgacaccgcgcgcctgaaaagcatcagcggcgtgctcggcgtggtgcgcaacgacaaccagtgccaggtgatcatcggcaacaccgtgtcccaggcataccgtgaagtggtgagcctgctgcccgctaacctgcaacctgccgtagcggaaggtccacagaagctcacgctgcgccggattggcgccgggatcctcgacgcgctgatcggcactatgtctccgctgatcccggcgatcatcggcgagtcgatggtcaagctgctggcgatgatccttgagatgaccggcgtgctgggcaaaggtgacccgacgctgacgatcctgaccgttatcggcgacggcgcgttcttcttcctgccgctgatggtggcggcttccgcagcggtgaagttcaaaaccaacatgtccctggcaatcgccatcgcgggcgtgctggttcacccgagctttatcgagctgatggccaaggccgcgcagggcgagcacgttgagttcgcgttcattccggtgacggcggtgaaatacacctataccgttatcccggcgctggtgatgacctggtgcctgtcgtacatcgaacgctgggtggatcgcattaccccggcggtgacgaaaaacttcctcaagccgatgctgatcgtgctgattgccgccccgctcgccatcgtgctgattggcccgctggggatctggatcggcagcgccatctccgcgctggtctacaccattcacggctatctgggctggctctccgttgccattatgggcgcgctgtggccgctgctggtgatgaccgggatgcaccgcgtgtttacgccgaccatcatccagaccattgccgaaacgggcaaagaagggatggtgatgccgtcggaaatcggcgccaacctgtcgctcggcggttcatcgctggcggtagcgtggaaaaccaaaaacccggagctgcgccagacggcgctggccgcggcggcctccgccatcatggcggggatctctgaaccggccctgtacggcgtggcggtacgcctgaagcgtccgctgattgcgagtctgatcagcggctttatctgcggcgcggtggcaggaatggccggtcttgccagccattcgatggcggcgccggggctgtttaccagcgtgcagttcttcgacccggccaacccgatgaccatcgtctgggtgtttggcgtgatgggtctggcagtggtgctgtcgtttgtgctgaccctgctgttagggtttgaggatatcccggtagaagacgaagccgaaaaagcacgcgccctgcaaaccgcaccggtacagaacaaagcagcagaagcataa

SEQ ID NO: 4040 - DNA, 1443 bp, Enterobacter cloacae
actgaaagcgaggtaagaatgtctgtttttccacaaggatttttatggggcggcgcgcttgccgccaaccagagtgaaggggcttaccgtgaaggcggcaaaggactgacgacggtcgatatgatcccccacggcgcaaaccgcctggcggtaaaagtcggcaaggaaaaacggttttcgttgcgggacgacgaattctacccgagccacgaggcgattgatttttaccatcgctacaaagaagacatcgccctgatggcggagatgggctttacggtgttccgcacctcgattgcctggagccgcctctacccgaacggcgacgaaccgctgccgaatcaggaaggcattgccttctaccgcgcggtgttcgaggagtgcaaaaagtacaacatcgagccgctggtgaccctctgccacttcgacgtgccgatgcacctggtgacggagtacggctcctggcgcaaccgtaagatggtcgatttcttcgcccgctacgcccgcacctgcttcgaggcgtttaacgggctggtgaaatactggctgaccttcaacgaaatcaacatcatgctgcacagcccgttttccggcgcggggctggtgtttgaggaaggtgaaaacgaagaccaggtgaaataccaggccgcgcaccacgagctggtggcgagcgcgctggcgaccaaaatcgctcacgaggtgaacccggaaaatcaggtcggttgcatgctggcgggcggtaacttctatccctactcctgcaagccggaagacgtgtggatggcgctggagaaagaccgcgagaacctgttctttatcgacgtgcaggcgcgcggcagctatccggcctactctgcccgcgtgttccgcgaaaaaggcgtcgtgattgtgaaagacccgggcgatgacgaactgctgaaaaataccgtcgactttgtctcgttcagctactacgcctcgcgctgcgcgtcggcggacatgaacgcgggcaacaccagcgcggcgaacatcgtgaagtccctgcgcaacccgcacattcaggtgagcgagtggggctggggtatcgacccgctcggcctgcgcatcactatgaacatgatgtacgaccgctaccagaagccgctgttcctggtggaaaacggtctgggggcgaaagatgtcgttgatgaaaacggtgagattaacgacgactaccgcatcagctacctgcgcgagcacatccgcgcgatgggcgacgcgattgaggacggcgttccgctgctgggctacaccacctggggctgcattgacctggtctcggcctcaaccggggagatgagcaagcgctatggatttgtctacgtcgaccgcgacgacgccgggaacggcacgctggaacggaaacgcaagaaatcgttcggatggtataagaaggtgattgcgagtaacgggggggatctcgagtag

SEQ ID NO: 4041 - DNA, 243 bp, Enterobacter cloacae
tcatccccgcaatcagcaacgccacgccccaccacagcggcggctgatcgcccgtcagggttatcgtcaggatgccgaaaagaccgaccttcatcaccacggtggagaacagcgcagcggccggggctgaggcattggcatgcgcctgcggcacccagccgtgcagcgggattatcccggccagcaggccaaaaccgactacgcccaacagccagacgtcgttgcccagcggctggccgttaa

SEQ ID NO: 4042 - DNA, 342 bp, Enterobacter cloacae
gatcctgctggtttccgccacgcgcggcgacgggatggacgcctggctgaactggctggagaacgaacgatgtgcataggcgtccccggacaaattcattccatcgacggcaatcaggccaaagtggaggtctgcggcatcctgcgcgatgtcgacctgacgctggtaggcagccacgatgagaccggcgcatcgcgtctcggccagtgggtgctggtccacgtaggttttgccatgagcgtgattaatgaggaagaagcccgcgacacgctggacgcgctacagaatatgtttgacgtcgagccggacgtgggcgccctgctgtatggggaggaacgataa

SEQ ID NO: 4043 - DNA, 1125 bp, Enterobacter cloacae
cacatgcgttacgttgatgaatatcgcgcgcctgagcaggtgttgcagcttatcgatcgcctgaagtcccgcgcgtcgctgctggactacacgaaagaaaaaccgctgcggatcatggaggtgtgcggcggacacacccacgccatctttaaatttggcctcgaccagctgctgccggagaacatcgaatttatccacggccccggctgcccggtgtgcgtgctgccgatggggcgcatcgacagctgtctcgacatcgccagccgccccggtgtgattttttgcacctttggcgatgccatgcgtgtaccgggaaaaaatggctcgctgctccaggcgaaggcgcgcggcgcggacgtgcggatcgtctactcaccgatggatgccctgacgctggcgatggctaatcctgagcgtaaggtcgtctttttcgggctgggttttgaaaccaccatgcccgccaccgccattaccctccagcaggcgaaagcccgcaacgtcactaacttttactttttctgccagcacatcacgcttattcccacgctgcgcagcctgctggaagcgccggataacggtatcgacgcgtttctggcgccgggccacgtcagcatggtgatcggcacagaagcctacggttttatcgctgaacagtacaatcgtccgttagtggtggctggtttcgagccacttgatctactgcaaggcgtgaccatgctggttgagcagaaaatagcggccctgagtgcggtggaaaatcagtatcgccgcgtggtgcccgatgcaggtaacagacgggcacaggaggccatagccgacgtgtttagcgtcgaaggcgacagcgagtggcgcggactggggctgattgccgaatccggcgtacacctgacgcccgcgtatcgcgccttcgacgccgaagcgcatttccgaccgcagccgcagcaggtgtgcgacgatccccgcgcccgctgtggcgacgtactcaccggaaaatgcaaacctcatcactgcccgttatttggcaacgcctgtaacccgcaaaccgcgtttggcgcgctgatggtctcttcagaaggggcatgcgccgcgtggtatcactatcgcaaccaggagtgtgaagcatga

SEQ ID NO: 4044 - DNA, 1005 bp, Enterobacter cloacae
cgtttaatgaaaaaggttctctgcgcgttaggcctggcggttgcatcaatgagtacagctctggctaccacgtacccgctcacgatagaaaactgcgggtataaagaaaccttcaccaaagcgccggaacgcgttgtggccctggggcagaataccgtcgagatcctgcttctgctgggtctggaagataaggtgaaagccagcgcgttctggccgaccaaagtattgccgcagctggctgagcagaatgcaaaaatcaaaaccctgaccgtcgaaattccgacacttgaatccattcttgcgcaaaaccctgattttgttcctgcacagctgccgctgctgctcggaccggaaagtaaggtcgcaaaacgcgaagacctggccaccgttggggtaaacagctatttatctccgggcatgtgcgccaccaaaaaagccgcaggggacatgtacggcagccgccagacgctgtgggacatgacctacctttatcaagagattgaggatttcgccaagattttcaacgtggaagcgcgcggtcaggccgttatcgccgacttcaaaaaacgtgaagccgacctgcgccaggagtttggcaaaaacaacaaagacctctcctttgttttctggttctcaagctcctcaccttcggctgatgcctatgtcggtggtaaaaacagcgcctctggctttattgctaacgtgctgggcggccataacgccattacctctgagaccgaatggccgaccgtgggctgggaaagtattattgccgctaatccggacgtgattgtggtctccagcctggatcgtaaccgctgggcgctggacaacgccgaagaaaaaatcaaattcctgaaaagcgatccagccgtcagccagatggaggcggtgaagaagggtcatattgtggtgatggacggccaggccatgaacccgacgattcgcacgctttacggtgctgagcaggtcggcgaacagatcagaaaactgggactggactga

SEQ ID NO: 4045 - DNA, 747 bp, Enterobacter cloacae
agaatgcactggcggaaccttacgtgctcggcgtgtcggcgggagcgtcaaccggggcggtgtcagtcgtcgtattgggtctcggcaccgggcgcagtgtcgctttctgcgggcgcgtttgccggagccttcgccgcctttgcctttgtcgccttcctgaccaacggcgcgcgcggcggcaatgaacgcacgatcctggcgggcgtagcggcctctcagctgtttaacgccattaccgcctataccatcagcacctctgccagcgcgcaacaggcgcgcgacgtgatgttctggctgctgggcagctttagcggcgtacgctggccggaattccagctggcgctggtagtggtactggcggggctggccgtctgtctttattattcccgtgcgctggacgcctttacgttcggtgatgatgccgccgcctcgttgggcattgccgtgccctgggtgcgcctggccttgtttaccaccaccgccctgatcaccgcgaccatcgtcagcatggcgggctctattgggtttgtcgggctggtcgtgccgcacgttatgcgtttcctgttcgggccgctgcaccgcacgctgctgatagccagcgcgctggcgggggcgatcctgatggtgctggccgacatcgcctcgcggatgctgattgctccgcaaagcctgccggttggcgtcgttaccgcactggtgggcgtaccgttcttcgccgtgattatctaccgctcaaggaataagtaa

SEQ ID NO: 4046 - DNA, 435 bp, Enterobacter cloacae
agggagtatttttccgtcggagtgtccatggagttaagacaagaagctttccacctgctacgtcagctttttcaacagcataccgcccagtggcagcacgcattgcctgaactgaccaagccacaatatgcggtgatgcggtcaattgctgaaaatcctggtattgagcaggttgccctgactgaagtcgcggtgagcaccaaagcgacgctggcagaaatgctgagccgcatggaagcacgcggcctggtcaggcgcgagcacgatccggcagacaaacgccgtcggtttgtctttctgactgccgaaggagaggccctgcttgagagcagtaaaccgattggaaatgaggtggatgaggcatttctggggcgccttaacggcgcggaacgagagcaattttcagcgctcattaaaaaaatgatgcagggttaa

SEQ ID NO: 4047 - DNA, 1416 bp, Enterobacter cloacae
aagctgaccaccgcttttgtcagccccatcgcctccgccgcggcggtgaaactgccggtgtccgctacggcgataaacattgccgtacgctgtaaattaagcatcgcttgcctggttaactgtcaaaataatgttgacagtatatcgtgctttgtcgcgtttatccgtaacgtgcgggccgatacgatacgccacctcaccggaggaacttccatgacgtatcgcagcaaaatcgccgtcgtctttctgctcggctttttccttgatttgataaacatgtttattgccagcgtcgcctttccggcgatggctcgcgctttcaataccacaccttccgcgcttgcctgggtaagtaacggatacattgccgggctgacgctagtcatccctttcagcagtatcctgacgcgccgcgtcgggccgaagcgcgttatcctgctctcactgcttctctttagcgcggcctccgttgcggcgggtctctcatcttcgctggaaagtctgattgcctggcgagtcgtgcagggcgccggagggggtttactgatcccggttggtcaggcgctgacctggcaacagtttaagcctcatgagcgggccagactctcctcggcggtgatgctggtcgcactgcttgcccccgcgtgctcaccggctgtgggcggtatgctggttcaaacattcagctggcgctggatattttttgccaccctgcccgtcgtcattgtcacctttgctttggcctgcgcgtggcttaaaacagaaccgtcgccgataacccccaccaggacagtaaacctgtctttgctgacggatccgctgttgcgcttatccatgcttatctatgtgtgcgtacccggcatttttatcggcgtgaacgtaacgggcatgtattacctccagagcgaggccaatatgacacccgccgcaacgggcatgcttatgctgccgtggtctgtggcttcgtttttggctatcaccgcgacaggacgctatttcaaccgtatcggcccccggccgctggtggtcatcggttgccttttgcaggcgacgggcattctgcttttagttaacgtcggcccggcaatgctgctacctgccgttgcgtttgcgctgatgggcgcggggggaagcctttgcagcagtacggctcagagcagcgcgtttttgacgatgcgaccggaagatatgcccgatgccagcgcgctatggaatctcaatcgtcagttgagcttttttgcgggcgctctgctgctggcgcaggcgctgagcttcatgcaggcttatctctcgccgctggccgcctggcacgggatgtttgtttttgccgcagtcatcactctactgcccgtactgtacgtctaccgtcttaacaacacgcagttacttgcgcaactgcaacaggagcaaccatga

SEQ ID NO: 4048 - DNA, 1215 bp, Enterobacter cloacae
aattgctcgctaatgacgtcccgcccggtggcgttacgcttaccgggcctacggctcaggcatacaactatgaaaatcgtaatcgcgccagactcttataaagaaagcctgtctgccactgaggtggcgcaggcgatagaaaaaggatttcgggaaattttccccgacgctcattacgtgtctgttcccgttgctgacggcggagaaggtacggttgaagcgatgatcgccgctacgcagggcacctggcagcaggctgtcgtcaccggcccgttaggggaaaaggtgaaggccagctgggggatctcgggcgacggtaccaccgcgtttatcgagatggccgccgccagcggcctggtgcttgttcctcccgcgcagcgtaacccgctggtcacgacgtcgcgcgggacgggggagctgatcctccgcgcgctggataaaggcgcgcgcaacatcattatcggtatcggcgggagcgcaaccaacgatgggggcgcaggcatgatgcaggcgctgggcgcgaagtttacggatgcgaacgggacggagatcggctacggcggcggcagcctgatggcgcttaaccggattgatatttcggatctcgatccgcgtcttcaggggtgcgcaatccgtgtcgcctgtgacgtgacgaatccgctggtcggtgaaagcggcgcgtcgcgtatctttggaccgcaaaaaggcgccacggaggagatgatcctcgaactcgacgccagtcttagccactatgccgaagtgatcaaaaaaacgctgcgcattgacgtcaaccgggttccaggggcaggagcggcgggcggcatgggcgcggcgctgatggccttcctgggcgcagagctgaaaagcggcattgagattgtcactcaggcgctcaatcttgaagaacatattcacgactgcacgtgggtgctgacgggggaagggcgcatcgacagccagagcataaatggcaaagtgcccgtcggcgtggcgagcgtcgccaaaaaataccataagccagtgatagggattgccggaagtctgacgcaggatgtgggtgtggtgcatcagtacggcatcgatgcggtgttcagcgtactgacccgcatcggctcactggaagaggcgttccagggcgcgtatgacaacatttaccgcgcctcgcggaatatcgcggccacattgcaggtaggcatgcgtagccaggggtga

SEQ ID NO: 4049 - DNA, 1437 bp, Enterobacter cloacae
tctccccatatcaataactcacacctgcaccttctgactcgcaatcgctggcgatcggaatcttataaaaacaaccagttaccctacaaaataagcgagtgcccaatgaatatggcaacaaacagcagtgtgattgtgagtgattcccctgcggcaaggcgggcgggaatgagcgaaagcgaatggcgagaggcgatcaaatttgacagcaccgatacgggctgggtcatcatgagtatcgggatggctatcggcgcgggcatcgtttttcttccggtgcaggtcgggttaatggggctgtgggtgtttttactctcgtcgataattggttatccggctatgtacctgttccagcgcctgtttattaatacgctggcggaatcaccggaatgcaaagattacccgagcgtcattagcggttatttaggtaaaaactggggcatcttattgggtgcgctttatttcgtgatgctggtgatctggatgtttgtctattccacggctatcaccaacgacagcgcctcctatttgcacaccttcggcgtaaccgacggtttgctgtcggaaaatccgttctacggcttattcctgatctgcattctggtcgccatctcgtcgcgcggagaaaaactgctgtttaaagtctccagcctgatggtgctgaccaaattatttgtagtggcggcgctgggtctttcgatgattggcctctggcatttagccaacgtcggtatgctgccgccgatggggctgctgattaaaaacgccattattacgctgcctttcaccttaacctccattctgtttattcagactttaagcccgatggtgatttcctatcgttcacgggaaaaatccgtagaggtggcgcgtcataaagcgctgcgggcaatgaatatcgcctttggcgtgctgtttgtgacggtctttttctacgcggtctccttcacgctggcgatggggcacgacgaggcggtaaaagcctacgagcagaatatttccgccctggcaatcgcagcacagttcatcagcggtgacggtgcgggctgggtcaaaatcgtcagcgtgatcctcaacattttcgccgtgatgaccgcgttctttggcgtctatctcggctttcgtgaggcgacgcagggcatcgtgatgaacatcctgcgccgcaaaatgccggcggaaaaaatcaatgaaaatgccgtccagcgcggaattatgctgttcgccatcctgctggcctggagcgcgattgtattaaacgcgccggtgctgagcttcacctccatctgtagccctattttcgggatggtgggctgcttaattccggcgtggctggtctacaaagtgcccgcacttcataaatataaaggcgtatcgctggtaattatcgtaattaccgggctgctgctttgtgtttctcctttcctcgccttctcatga

SEQ ID NO: 4050 - DNA, 1515 bp, Enterobacter cloacae
actgaactaaggccgtttgaggttgatatgcaatacatcaaaatccattcgctggataacgttgccgtcgcgctggccgatttagccgaagggacggaagtgaccttcgacaaccagtcggtgacgttacgccaggccattggacgtggacataagtttgccctgatccccatcgcgaaaggggagaacgtggtgaagtacggtttgcccatcggtcatgcgctggcggatattgcgccgggtgaatacattcattcccacaatacccgcaccaatctcagcgatctggacgagtacagctatcaacctgacttccaggcagaagaaggacaggcggccgatcgtgaggtgcagatctaccgccgcgccagcggcgaggtggggatccgcaatgaactgtggatcctcccgaccgtcggctgcgtgaacgggatcgcgcgtcaaattcagacgcgtttcctgaaagagactaacaatgctgaaggcaccgacggcgtgcatctgttcagccacacctacggttgttcccagctgggcgacgaccacatcaatacccgcaccatgctgcaaaatatggtgcgccacccgaacgcgggggcggtgctggtgattggcctcggctgtgaaaacaatcaggttgacgccttccgcgatacgctgggcgagttcgatcctgagcgcgtgcactttatggtgtgtcagcaccaggacgacgaagtggaagcgggcgtcgaacaactgcaccagctgtacgaggtgatgcgtcacgacaagcgcgagccgggcaagctgagcgaactgaagtttggcctggagtgcggcgggtctgacgggctttctggcattaccgctaacccgatgctgggccgcttctcggattatgtgattgccaacggcggcaccacggtgctgaccgaagtgccggagatgttcggcgcagagcgcattctgatgagccactgtcgcgacgaagagacgtttgagaagaccgtcaccatggtgaacgacttcaaacagtacttcattgcccacaatcagccgatttacgagaacccgtcgccggggaacaaggcgggcggaatcaccacgctggaggagaaatccctcggctgcacccagaaagcgggggccagccaggtggtggacgttctgcgctacggcgaacgcctgaaaacccacggcctgaacctgctgagcgcaccgggtaacgatgcggtcgccaccagcgcgctggcgggggcgggttgtcacatggtgttgttcagcaccggtcgcggtacgccgtacggcggatttgtgccaacggtgaaaatcgccaccaacagcgaactggcggcgaagaaaaagcactggatcgatttcgacgcaggccagctgatccacggcaaagcgatgccacagctgctgacggagttcgtggatactatcgtggagtttgctaacggcaggcagacctgtaacgagaagaacgacttccgcgagctggcgatctttaagagtggtgtgacgctttaa

SEQ ID NO: 4051 - DNA, 1395 bp, Enterobacter cloacae
gatactggtttttcagatcctgcgtatactgccagagggctttgtcagtcgcgaaatcatgcgtgcccgggtagcgtttttccagcaccgcaccgagctttcccgcggcaatcaggtcacgaacctgggaaagtaaatgctccggatagccctggagataagtcagctggttcatcaaaaccccaaaatagtgtgaaaacgggtatactcacgcacccttttcagggatacgccaaattttaccattcaggagggccgatgagccacttagacaacggtttccgttcactcaaccttaaacgtttcccggaaacggacgacgtgaacccgcttcaggcgtgggaagcggcggatgaatatctgctgcaacagttggatgagactgaaatcagcggcccggttctgatcctgaatgacgcttttggcgcgctggcctgcgcgctggcggaacatgcgccttacagtatcggcgattcttacttaagcgaactggcgacgcgtgaaaacctgcgccataacgacatcgaagagtccagcgtgaagttcctcgacagcaccgcggactacccgcaggcgccgggcgtggtgctgattaaggtgccaaaaaccatggcgctgctggagcagcaactgcgcgcgctgcgtaaagtcgtcacgccagaaacccgcattatcgcgggtgccaaagcgcgtgatattcacacctcgacgctggagctgttcgagaaggtcctcggcccgaccaccacgacgcttgcctggaaaaaagcacgcctgatcaactgcaccttcagcgcaccggcgctggccgacgcgccagaaacgctgagctggaaactggaaggtaccgactggaccatccacaaccacgcgaacgtcttttcccgtaccggtctggatatcggggcgcgtttctttatggaacatctgccggaaaatcttgagggtgagattgtcgacctgggctgcggcaatggcgtgattggcctgacgctgctggcgaagaacccggaggccagcgtggtgttcagcgacgaatcgccaatggcggtggcctccagccgtctgaacgtggaaactaacctgcctgaagcgctggatcgctgcgagtttatgatcaataacgcgctgtcgggcgtagagcctttccgcttcaacgcggtattctgtaacccgccgttccaccagaagcacgccctgacggataacgtcgcgtgggagatgttccaccacgcgcgccgctgcctgaaaatcaacggcgagctgtatatcgtggcgaaccgccacctggactacttccacaagctgaagaagattttcggcaactgcgtcaccattgccaccaataacaaattcgtggtgctgaaatcggtgaagctggggcgtcgtcgctaa

SEQ ID NO: 4052 - DNA, 938 bp, Enterobacter cloacae
gtttcccggcctcgcggatcgggtgctggtaatgcatcagggcgtgctcagcggcgagctgccgcgccacgccgtcagcctcgaccggatgatggcgctggcgtttggagggcaatcatgaagatcttactgaaaaaccgcgagctgagcgcgtttctcgccattctggcgctgttcgccgtgctggtggcgctgaacccgtcgtacctgagcttacagacgctggggatgatcttcgccagcgcgcagatcctgatcctgctggctatcggcgcggcgctggtgatgctgacccgcaatattgacgtctccgtcggctccacggtcgggttgtccgccattgccgtcggcgtggcgcttaacagcggctacagcctgcccgtttccattctcttcgcgctgtcgatcggcgcgctggccggggcgttcaacggttttctggtggtgggcctgcgcattccggcgattgtcgccaccctcggcacgctggggctttatcgcggggcgatgctgctctggaccggcgggaagtggattgaagggctgccgccggggctgaaatccctctctgagcctgccgccgtcggtatttcgccgctcggcatgctggtgttgattatcgcggccacaggcgcgtggacgctgtcgcgcaccgcctttggacgtattttttacgccgtgggggataacctcgccgccgcgcgccagctgggcgtggcggtgaaccgcacccgcatgatcgcctttaccctgaacggcctgctggcggcctgcgccgggatcgtctttgccgcgcagattggattcgtgcccaaccagaccggcagcgggctggagatgaaagccatcgctgccctgcgtgctggggggcatctcgctgctgggcggcaccggcacgctgatctaattcaaccgccgggctggaaggaccaacgcat

SEQ ID NO: 4053 - DNA, 774 bp, Enterobacter cloacae
gtaatgagtaacgacatcttcccgaataaatttaaagcggccctcgcggcgcaccagattcagattggctgctggtctgcgctggccaaccccatcagcaccgaagtgctgggcctggccgggttcgactggctggtgctggacggcgaacatgcgccaaacgatatcaacacgtttattccgcagctgatggcgctgaaaggcagccacagcgcgccggtggtgcgtgtgcccaccaacgagccggtgatcatcaagcgtctgctggatatcggcttctacaactttctgatcccgtttgttgaaacggaagaagaagcggtgcaggccgtggcggcgacccgctatccaccggaagggatccgcggcgtgtccgtctcgcaccgcgccaacatgtttggcaccgtgccggactatttctcccagtccaacaagaacatcaccattctggttcagatcgagagccagcagggggtcgataacgtcgacgctattgccgcgacggagggcgtcgacggcattttcgtcggcccgagcgatctggcggccgcctttggtcatctgggtaacgccagccatccggatgtgcagcgcgcaattcagcacatttttgcccgtgccaaagcgcacggtaaaccgtgcggcattctggcgccagtggaagccgatgcccgccgttacctggaatggggcgcaacgtttgtcgccgtcggcagcgatctcggcgtattccgcgccgccacgcagaaattagcggacgcttttaaaaaataa

SEQ ID NO: 4054 - DNA, 912 bp, Enterobacter cloacae
ccatcattgaggaaacagattatgacgctgaaagtgggttttattggcctgggtatcatgggcaaaccaatgagcaaaaacctcatcaaagcaggttactcactggtggttttagatcgtaattcagacgcggtggcagaggtgattgcggctggcgcagaaacggcgacaaccgcaaaagcaattgctgagcagtgcgacgtgattatcaccatgctgccaaactccccgcacgtgaaagaggtggcgctgggtgagaacggcattatcgatggcgcgaagccgggtctggtggtgatcgacatgagttctatcgcaccgctggcaagccgcgaaatcagcgaggagctgaaagcgaagggcgtggagatgctggatgcgccggtcagcggcggcgaaccgaaagccatcgacggcaccctgtcggtgatggtagggggcgataaagccgtgttcgacaaatactacgacctgatgaaagccatggctggctccgtggtgcacaccggtgaaattggcgcaggcaacgtcaccaagctggcaaaccaggtgattgtggcgttgaacatcgcggctatgtcggaggcgctaacgctggccaccaaagcgggcgttaatccggatctggtctatcaggccattcgcggtggtctggcgggcagcaccgtgctggatgccaaggcgccgatggtgatggatcgtaacttcaggccgggcttccgcatcgatctgcacattaaggatctggcgaatgcgctggatacctcccacggcgtgggggcgcagctgccgctgactgccgccgtcatggagatgatgcaggcgctgcgtgcggatggtctgggcaccgccgatcacagcgcgttagcgtgctattacgaaaagctggcgaaggttgaaattgctcgctaa

SEQ ID NO: 4055 - DNA, 933 bp, Enterobacter cloacae
gcgcagaatattatgaatactattattctaccgaaaactcagcacctcgtggtatttcaggaagtcatcaaaagtggctccataggttctgctgcaagacaactggggctgacgcaacctgccgtcagcaaaatcatcagcgacatcgaatcctactttggggtggaagtgatggtgcgtaagaacaccggcgtaaaactcactgccgccggtcaggtgctgctgtcctacgctgagtcgatcacccgcgaaatgaaaaacatggtgagcgagatcaacagcctcagtttcagtaccgtcatggacgtctccttcggctatccgtcgctaattggcttcaccttcctgtccgggatgatcaaaaaattcaaggaagtgttcccgaaagcgcgtgtctcaatgtatgaagcgcagctctcttcattcctgcccgccattcgcgatggccggctggatttcgccatcggcacgctgagcgacgggatgcagcttcaggatcttcacgttgagccactgtttgaatccgagtttgtgctggtggcgagtaaatcacgaacgtgcaccggcccgaccagactggcatcgctcacgcacgagcagtgggtgatgccgcaaaccgatatgggctactacaacgaacttctgaccaccctgcaagacaaccacatcagcattgaaaacatcgtccagaccgattccgtcgtcaccatctataaccttgtcctcaatgccgattacctgacggtgatcccccgtgacatgattgcgccattcggctcggaccagttcattgtcctgccggtggaagatgaattacccgtggcgcgttatgccgccgtgtggtcaaaaaattacagtattaaaaaatcggcgtcagtattagttgaactggcaaaacaatattcgtcgatgaataccgaaaaacgacgatag

SEQ ID NO: 4056 - DNA, 1029 bp, Enterobacter cloacae
ctttgcctgaaaacaatgaattattataacgaggatattatgcacattacttacgatctcccggtgaccattgaagatattcaggacgccagaaaaagactggcgggaaagatctataaaaccggtatgccgcgctcaaattatctgagcgaacggtgtaagggtgagatattcctgaaatttgaaaatatgcagcgtaccggttcgtttaaaatacgtggggcgtttaataaattaagctcgctgaccgatgcggaaaaacgcaagggcgtggtggcctgttccgcagggaaccacgcgcagggggtctctctctcttgcgccatgctcggcatcgacggcaaagtagtgatgccgatgggcgcgccgaaatccaaggttgccgccacgcgcgactactctgccgaagtggtgctacacggcgagaactttaacgacaccatcgccaaagtgagcgaaatcgtcgagatggaagggcgcatttttatcccgccttacgacgatccgaaagtgatcgccggtcagggcaccatcggcctggaaatcctcgaagatttatatgacgtggataacgtgattgtccccatcggcggcggcggtttaattgccggtattgcgacagcaattaaatccatcaacccaactatcaatattatcggcgtgcagtctgaaaacgtgcacggaatggcggcatcgtatcaggccggtgaaataacgaaccaccgcattaccggcacattagcagacggttgcgatgtgtctcgcccgggtaatttaaccttcgaaattgttcgtgaattagtcgatgacattgtgctggtcagcgaagacgagattcgcaacagcatgatcgcgcttattcagcgaaataaagtggtcacggaaggtgctggcgcactggcgtgcgcggcgttattaagcggcaagctggaccactatatccagggccgtaaaaccgtctgcattatttccggcggcaatatcgatctctcccgtgtttcccaaattaccggcttcgttgacgcataa

SEQ ID NO: 4057 - DNA, 1509 bp, Enterobacter cloacae
ctcacgaaaaaaacgtcggactctggaaattggtgtgataactttgcagcatctgaacataagctttctgacgctcccgtaatgaggaagacgataatgacaccgtttatgaccgacgattttctgttagataccgaatttgctcgccgcctgtaccacgactacgcaaaagaccagccgattttcgactaccactgccatttaccgccgcagcaggttgccgaaaattaccgtttcaaaaacctgtatgatatctggctgaagggtgaccactataagtggcgcgcaatgcgcaccaacggcgtggccgagcgcctgtgtaccggcgacgcgaccgatcgcgagaagtttgacgcctgggccgctactgttccccacaccatcggtaacccgttataccactggacgcacctcgaactgcgtcgtccgtttggtatcaccggcaagctgctctctcccgccacggcggatgaaatctgggatcagtgcaacgacctgctggcgcaggatagcttctcggcgcgcggcatcatgaagcagatgaacgtgaagatggtgggcaccaccgacgatcctgtcgactctctggagcaccacgcggttgtcgcgaaggacagcacgtttgacatcaaagtgctgccaagctggcgcccggataaagccttcaacatcgagctgccgacctttaacgactatatggcgaagctggcggaagtgtctgacaccgatatccgtcgctttggcgatctgcaaaccgcgctgaccaaacgtctggatcactttgccgcacacggctgtaaagtgtctgaccacgcgctggacgtagtgctgttcgcggaatccagcgaagctgagctggacagcattctggcgcgtcgtctctccggcgaagccctgagtgagcacgaagtggcgcagttcaaaacggcggtactggtgttcctcggtgcggaatatgcccgccgcggctgggttcagcagtatcacatcggcgcgctgcgtaataacaaccagcgtcagttcaaactgctgggcgcggacgtgggctttgactccatcaacgaccgtccgatggcggaagagctgtcaaaactgctgagcaaacagaacgagcaaaatctgctgccaaaaaccatcctttactgcctgaacccacgcgataacgaagtgctgggcaccatgatcggcaacttccagggcgaagggatgccgggcaagatgcagttcggttccggctggtggtttaacgatcagaaagacggcatggagcgtcagatgacgcagctggcgcagctcggcctgttgagccgcttcgttggcatgctgaccgacagccgcagtttcctctcctatacccgccatgaatatttccgccggattctgtgccagatgattggccgctgggtgcacgcgggcgaagcgccagcagatatccagctgctgggcgaaatggtgagaaacatctgctttaacaatgcgcgtgactacttcgccattgaactgaactaa

SEQ ID NO: 4058 - DNA, 1575 bp, Enterobacter cloacae
tccctgcacggttgtaaatatagttcaccgtctacgcttttgaacattattaaatctaaaaatcatttgttcaatagcggagcgatgatgacaccacttctcgacgcgcgtgatatcagcaagcagttttcaggcgtaccggtcttaaaaggcattgatttcacgctgcttgcggggcaggtgcatgcgctgatgggcggtaacggcgcgggaaaatcgacgctgatgaagatcatcgccggggtagaaaccccggattgcggtgaactttcggtggcgggtgagtcttttacacggcttaccccggctcaggcgcacaggttaggcatttatctggtgccgcaggagccgctgctgtttcccaacctgacggtgcgggaaaacatcctgtttcgtctgccgcgagagcgcgatcgggaaaaacgtctggcggaaaaactccggcaattgcaatgccagcttaacctcgacgccaccgccagcaccctcgaggtggctgaccagcagatggtggagatcctgcgcgggctgatgcgcaacgccagaattctgatcctcgatgaacccacggcctcgctgacgccaggtgaaaccgaacggctgtttcgccagatccgcgccttgcaggatcttggcgtcggtattgtttttatctcgcataagctgccggagattcggcagctggcgagtcacgtctcggtgatgcgcgacggcgccgtggtgctcagcggcgaaaccgcgcagtttgacgataacgccctgatcgccgccatgacgccagtaagccgggagacctccctgagcgatacgcaaaagctgtggctggcgctgccgggcaaccgccgcacccaggcgcaggattttcccgtgctgcgggtggaggatcttaccggggaagggtttatcgatctcagccttgagatctacgccggggagatcgtcggcctggccgggctggtaggctccgggcgcaccgagtttgccgaaacgctctacggcctgcgtcccgtacgcggcgggcgggtgtggctggagaaccaggagatcaccaccgaaccggtgggttcacgtctggaaaaagggctggtttatctgccggaagacaggcaggtgtccggcctgtttctcgacgcgccgatccgctggaacaccgtggcgctgaacgagccgtcgctctggcagcagcgaaagcgggagtctgcggtagtggaacgctatcaccgggcgctggggatcaagctcaaccatgcggatcaaaccgtgcgcacgctctccggtggtaatcagcagaaggtgctgctggcgcgctgtctggaggccaacccgctgctgctgatcgtcgatgaaccgacgcgcggcgtggacgtctcggcgcgcgccgatatttatcagctgctgaaaagcgtggcggcgcagaacgtggcggtgctgatgatctcaagcgatctcgatgagtttcccggcctcgcggatcgggtgctggtaatgcatcagggcgtgctcagcggcgagctgccgcgccacgccgtcagcctcgaccggatgatggcgctggcgtttggagggcaatcatga

SEQ ID NO: 4059 - DNA, 813 bp, Enterobacter cloacae
ggagctcgtatgagcagcaccgattcatccgcagagaagcgcatcaccggcaccagtgaaaggcgagagcagatcattcagcggttgcgggcgcagggaagcgtgcaggttaacgatctttctcttttattcggcgtgtcgacggtgacgatccgtaatgacctggcctttctggaaaagcaggggattgccgttcgcgcttacggcggcgcgctgatttgcgaaggcaatgcccccggcgtggagccatccgttgaggacaaaagttcccttaatacggcagtgaagcgcagtatcgcgcaggcggcggttgaactggtgaagccgggtcaccgcattattctggactccggcaccacgacctttgaaattgcccgcatgctgcgccagcacaccgatgtcattgccatgaccaacgggatgaacgtggcaaacgcgctgctggaagcggaaggcgtagagctgctgatgaccggcgggcatttgcgccgtcagtcacagtccttctacggcgaccaggcggagcagtccttacagaattaccattttgacctgctgtttctgggcgtcgatgccatcgatctcgaccggggggtgagtacgcataacgaggatgaagcccgtctgaaccgcaaaatgtgcgaggtggcggagcgtattatcgttgtcacggactccagcaagtttaatcgttcaagcctgcataaaattattgatacccatcgaatcgacatgattatcgttgatgaaggcattccggcggaaagcctggaagggttacgcaaaagcgggatcgatgtggtgctggtctaa

SEQ ID NO: 4060 - DNA, 1335 bp, Enterobacter cloacae
cttatgagcaacacagaaagcattatcgttggccagacaaaaacgtcctcctggcgtaaatctgataccacctggacgctcggcctgtttggtaccgccattggcgcaggcgtgctgttcttccctatccgtgcaggctttggcggcttgatccccatcctgctgatgctggtactcgcgttcccgattgccttttactgccaccgcgcgctggcgcgtctgtgtttgtccggcagtaacgtctccggcaacatcaccgaaacggtggaggagcattttggtaagaccggcggggtggtaatcaccttcctctacttctttgccatttgcccgctgctgtggatttacggcgtcaccattaccaacacctttatgaccttctgggaaaaccagctccagatgcccgccctgaaccgcggcgtggtggcgctgttcctgctgctgctgatggcctttgttatctggttcggtaaagacctgatggtgaaagtgatgagctacctggtgttcccgttcatcgccagcctggtgttgatttctctctcgctgatcccgtactggaactcggcggtgatcgaccaggttaacctgagcgatatcgccttcaccggtcatgacggcattctggtcacggtgtggctggggatctccatcatggtcttctccttcaacttctcgcctatcgtctcctcgtttgtggtctccaagcgcgaagagtacgaaccggagttcgggaaagagtttaccgagcagaaatgttccaaaatcatcggtcgcgccagcctgctgatggtggcggtggtgatgttcttcgcctttagctgcctgtttacactctctccgcagaacatggcggacgccaaagcgcagaacattccggtgctctcttacctggcgaaccactttgcgtcgatgtcaggcagtaaatccacgttcgccaccgtgctggagtacggcgcgtccatcatcgcgctggtcgctatctttaaatccttcttcggccactatctgggcacgctggaggggctgaacggcctgatcatcaagttcggctacaagggcgacaagaagaacgtctccgtcggcaagctgaacaccatcagcatggtcttcatcatgggctccacctggattgtggcctacgccaacccgaacattctggacctcattgaagccatgggcgcgccaattatcgcctctctgctgtgcctgctgccgatgtacgccatccgcaaggcaccggcgctggcgaaatacaaaggccggaccgagaacatcttcgtaaccgtggtcggtctgctgaccattctgaacatcgtgtacaaactgttttaa

SEQ ID NO: 4061 - DNA, 1239 bp, Enterobacter cloacae
accaaagctcaggaagagcggagccataccatgattgagtttccggtagtactggtcattaactgcggatcgtcctctgttaagttctcggtgctggacgccgcaagctgcgatgccctgatgacgggcattgcggacggcatcaacacagaaaaagcctttatttccgtgaatgggggtgagccggtcagactggctcaccaggactacgaaggggcgctggccgccatcgcccttgagctggagaaacgcaacctgatgggcagcgtggctttgattggccatcgcattgcccacggcggtgacctcttcagcgagtcgaccctgatcacggaagaggtgatggcgcagatccgccaggtctccccgctggcgccgctgcataactacgccaacctgagcggcgtggaagccgccgagcgcctgttccccggcgtgcagcaggtggcggtatttgataccagcttccaccagaccatgccgccgcaggcgtatctgtacggcttgccgtaccgctattttgaagagctgggcgtgcgccgctacggtttccatggcacctctcaccgctatgtgtcggcgcaggcgcacgcgcttttcgggctctctcccgatgacagcggcctggtaattgcccatctcggcaacggggcgtccatctgcgcggtgcgtaacggcgtaagcgtggacacgtccatggggatgacgccgcttgaaggactggtgatgggcacgcgctgcggagacgtggattttggcgcgatggcgtggattgcccggcagaccggccagtcgttcgaggatctggagcgcgtggtcaacaaagagtccgggctgctggggatctccggtatctcctccgatttgcgcgcgctggagaaagcctggcatgacggcaacgagcgggcgcggctggcaataaagacctttgtccaccggattgcgcggcatatcgccggtcatgccgcgtccctgcaccgtctggatggcgtggtgtttaccggcgggatcggtgagaactccgtgcttatccgcgcgctggtggcggagcatctgaaggtgtttggcatcatcctcgacgagtccaaaaatgccctgccgggcagcgcgggcgagcgcgtgatctccaccgagtcgtcccgcgcggcctgcgcggtgatccctaccaatgaagaaaaaatgatcgcgctggacgccctccgtcttgggaaggttactccggctgcggcttacgcctga

SEQ ID NO: 4062 - DNA, 2307 bp, Enterobacter cloacae
agcgagaatctgatgaaagtaacaatcgatacgggcgtcgcgccttacagcgacgcatgggccgggtttcgtggtgaagaatggaaaaacgccatcaacgtacgcgattttattcagcataactacaccccttatgaaggcgatgaagctttcctcgcgcaggcgacgccagcaacgacggcgctgtggcagaaggtgatggtcggcattcgtcaggagaatgccacccacgctccggtggatttcgacaccaacatcgccactaccattaccgcgcacgggccgggctatattgatcaggagctggagacgatcgtcggcctgcaaaccgacaagccgctcaagcgcgccctgcatccgtacggcgggatcaacatgatccgcagctcgttcgaagcctacggtcgcgagatggatccgcagtttgaatatctctttaccgacctgcgcaaaacccacaaccagggcgtgtttgacgtttactccccggagatgatgcgctgccgcaaatcgggggtgctgaccggtctgccggacggctacgggcgcggacgcatcatcggcgactaccgccgcgtggcgctgtacggcatcagctatctggtgcgcgagcgtgaacttcagttcgccgatctccaggggaaactggagcgcggcgaagatctggaggccacgatccgcctgcgcgaagagctggcggagcacaagcgcgcgctgctgcagatccagcagatggcggcgaactatgggtttgatatatcacgtccggcgatgaacgcccaggaagcggtgcagtggctctattttgcctacctggcggcggtgaaatcccagaacggcggagccatgtcgctggggcgcacggcctcgttcctcgatatctacatcgaacgcgacatgcaggctgggcggctgaatgaggtgcaggcccaggagctgatcgaccacttcatcatgaagatccgcatggtgcgcttcctgcgtacgccggagttcgacacgctcttctccggcgatccgatctgggccacggaagtgattggcggcatggggctggacgggcgcacgctggtgactaaaaacagcttccgctacctgcataccctgcacaccatggggcctgcgccggagccaaacctgacgatcctctggtccgaaaaactgccgatcgcgttcaagaaatacgccgcacaggtgtcgatcgtcacctcctcgctgcaatacgagaacgacgatctgatgcgcaccgacttcaacagcgacgactacgccattgcctgctgcgtcagcccgatggtgatcggcaagcagatgcagttcttcggcgcacgcgccaacctggcgaaaacgctgctgtacgcaatcaacggcggggtggatgagaagctgaagatccaggtcggtccgaaaaccgagccgctgctggatgaggtactggattacgacaccgtaatggcgagcctcgatcacttcatggactggctggcggtacagtacatcagcgcgctgaatctcattcactatatgcatgataaatacagctacgaagcctcgctgatggcgctgcacgaccgggacgtctaccgcaccatggcctgcggcattgccgggctgtcggtggcggcggattccctgtcggccatcaaatacgccacggtaaaaccggtacgcgaccacactggtctggcggtcgatttcatcatcgaaggcgactatccgcagtacggcaacaacgacgatcgcgtggacagtatcgcctgcgatctggttgagcgctttatgaagaaaatccaggcgctgccgacgtaccgcaacgcggtaccgacgcagtcgatcctgaccatcacctccaatgtggtttacggccagaagaccggcaacacgccggacggacgtcgcggcggcacgccgtttgcgcctggcgccaacccgatgcacgggcgcgacagaaaaggggcggtggcgtcgttaacctcggtcgccaagctgccgttcacctatgccaaagacgggatttcctacaccttctccatcgtgccgcaggcactgggcaaggacgagccggtgcgcaaaaccaaccttgtcgggctgctggacggatacttccaccacgaagcgaccattgagggcggtcagcacctgaacgtcaacgtgatgaacagggagatgctgctggatgccatcgcccatccggagaactatccgaacctgacgatccgcgtttcaggctatgcggtgcggtttaatgctctgacgcgcgagcagcagcaggatgtgatttcgaggacgtttacgcaggcgatgtaa

SEQ ID NO: 4063 - DNA, 1398 bp, Enterobacter cloacae
aggcgtatcgctggtaattatcgtaattaccgggctgctgctttgtgtttctcctttcctcgccttctcatgaggttaaataaggtcgtaacgatgtctgagcaaattaatcctttatggaaccattttattcgcgccgtgcaggaagaggtaaagcctgcgctgggctgtaccgaacccgtctcgctggcgctggcgtgtgcgatggctgccggacagctttccggtgaggtaacgcgtatcgaggcgtgggtatcgccgaacctgatgaaaaacgggcttggcgtaacggtgcccggcaccggtatggtcggtttacccatcgcggccgcgctgggggcgacaggcggtaatgcacacgccgggctggaggtgttgaaagacgcgtcggccgaggcgctaacgcgcgccaaagcattgctgaacgcgggtctggtgcaggtaaaattgcaggagccgtgcgatgagatcctttattcacgcgcctgcgtttacgccggtgaatcctcggcgatggtgaccatcgctggcgggcacactcgcgtggtggaggtagtttgtcagggcgaaacgtgcttcaggcttgacgatcgtcagagccagaacaacgacgatccgctggcggtactctcgaccaccacgctgtcacagatccttgagtttgtggagcaggtgccgttcgacgcgatccgctttatcctcgatgcggggcggctgaacgatgcgctctcccgcgaaggtttgcgtggcaactgggggctgcatattggcgcgacgctcaataaacagcgcgcacgcggctggatggcgcaggatctgggttcagacattattatccgcaccagcgcagcctcggatgcccgcatgggaggcgcgacgctgccagcgatgagcaactcgggttccgggaatcagggcatcaccgccaccatgccggtagtggtggtggctgagcacgttcaggctgatgacgaacggctggcgcgggcgctgatgctctcgcatctgtcggctatctatatccattaccagcttccgcgcttgtccgcgttgtgcgcggcgacaaccgccggaatgggggcagcggcggggatggcgtggctgatgggcggatcttaccagaccattgccatggcgatcggcagtatgatcggcgacgtgagcgggatgatctgcgatggggcttctaacagctgtgcaatgaaggtctcgaccagcgtcaccagcgcctggaaagccgtgatgatggcgctggatgatactgccgtgacgggtaacgaggggattgtggcgcacgacgtggaacagtcgatctctaacctgtgcgccctggcgtgccgctcaatgcaggcgacggaccggcagatcattgagattatggcgagtaaggtgttgtga

SEQ ID NO: 4064 - DNA, 972 bp, Enterobacter cloacae
aggtatggacgctgcattgttagccagatattctgcctggtatgttcaaatttcctgaatgagaacgagatggctaaagagagagcattgacgcttgaggcgcttcgcgtcatggacgcgattgacaggcgcggcagttttgccgcggcggcagatgaactggggcgcgttccgtctgcgctgagctacaccatgcaaaagctggaagaggagctggatgttgtgctcttcgatcgctccggtcatcgaacaaaattcaccaacgttgggcggatgctgctggagcgcggccgcgtattgctggaagcggcggataagctgacgaccgatgccgaagcgctggcccgcggctgggaaacccatctgacgttagtgaccgaagcgctggtgcccaccgaagcgctgtttccgctggtggacagactggccgcgaaagccaatacccagctgtcgatcatcaccgaggtgctggccggggcatgggagcgtcttgagacgggcagggcggatatcgtgattgcgccagacatgcatttccgctcatcgtcagaaatcaattcgcgcaagctctacagcgtgatgaacgtctacgtcgccgcgccggatcaccctatccatcaggagccggagccgctctctgaggtcacgcgcgtgaaataccgcggcgtggcggtcgcggataccgcccgagagcgcccggtgttaacggtacagttgctggataaacagccgcgactgacggtaacgtcgctggaagataagcgacaggcgctcctggcggggctgggcgtggcgactatgccgtacccgtttgtcgaaaaggacattgcagaagggcggttgcgcgtcgtcagcccggaatacaccagcgaagtggatattattatggcgtggcgtcgcgatagcatgggcgaagccaaatcgtggtgtttgcgtgaaattcccaagctctttgcccaccacaacaaataa

SEQ ID NO: 4065 - DNA, 1611 bp, Enterobacter cloacae
cagcgaggcaagctcatgagttaccttttagcgttagatgcagggacaggcagcgttcgcgccgtgattttcgatttacagggcaaccagattgccgttggccaggccgagtggaagcacctgagcgtggagaacgtgccggggtcgatggagttcgatctcgacaccaactggcggctggcctgccggtgtattcagcaggcgctggagcgcgcacggcttagcgcggcggatattcagtccgtcgcctgctgctcgatgcgcgaagggattgtgctgtacgaccgcaacggcgaggctatctgggcctgcgccaacgtcgacgcccgcgccagccgcgaggtggctgaactcaaagagatccacgactaccggtttgaatccgaagtgtatgaggtctccggccagacgctggcgctgagcgccatgccgcgcctgctgtggctggcgcaccaccgtccggatatttaccgcaaggctgcgactatcaccatgatcagcgactggctggcggcgaagctctccggcgagctggcggtcgacccgtccaatgcgggcaccaccggtatgctggatctcttctcccgcgactggcgtccggcgctgctcgacatggccgggctgcgcgccgatatcctttccccggtgaaagagaccggcaccgtgctgggcgcgataaccagacaggccgcgcagcagtgcggcctgcgtgaaggcacgccggtggtgatgggcggcggcgacgtgcagctgggctgtctggggctgggcgtggtccgcgccggacaaacggcggtgctgggcggcaccttctggcagcaggtggttaacctgccgcaggtgcgcaccgatcctgagatgaacatccgcgtaaacccgcacgtcatccccggcatggcacaggcggagtcgatcagcttctttaccgggctaaccatgcgctggttccgcgacgccttttgcgccgaggaaaagctgattgccgagcggatggggatggacacctattccctgctggaagagatggcgagccgcgtcccggcgggctcccacggcgtaatgccaatcttctccgacgcgatgcattttaagcagtggtatcacgccgcgccgtcgtttattaacctctccatcgacccggaaaagtgcaacaaagcgacgctgttccgcgccctggaagagaacgcggcgatcgtctcggcctgcaacctggcgcagatttcgcgcttctccggcgtgacgtttgagagtctggtgtttgcgggcggcggggccaaaggcgccctgtggagtcagattttaagcgacgttaccggcctgccggtgcgcgtgccggaagttaaagaggcaacggcgctcggctgtgcccttgccgcaggagctggcgcggggctgtttgcggatatggcttcgacgggcgagcggctggtgaagtggagccgcgagttcacgccaaacccgcagcaccgggaactgtacgacggcatgatgcagaaatggcaggcggtgtacgccgaccagctcgggctggtggacagcgggctgaccacgtcgatgtggcaggcgccggggctggtgcgggcatccccctcaccccggccctctccctaa

SEQ ID NO: 4066 - DNA, 1005 bp, Enterobacter cloacae
acgtttatgatacgtttcgcagtcatcggtacgaactggatcacgcgccagttcgtcgacgccgcccacgaaaccggcaaatataagctcaccgcagtctattcccgcagccttgagcaggcgcagagttttgcgaatgactacctggttgaacatctgttcacctcgctcgatgagatggcgcaaagcgacgccattgacgcggtctatattgccagcccgaattctctgcatttcccgcaaacgaagctgttcctcagccacaaaaaacacgtgatttgcgagaagccgctggcctcgaatattgaggaagtggaagccgccattgcgcttgcccgggaaaaccaggtggtgctgtttgaagcgttcaaaaccgccagcctgccgaacttcctgctgttgcagcagtccctgccgaaaattggcaaagtgcgtaaagcctttatcaactactgccagtattcctcgcgctaccagcgctacctggacggcgaaaacccgaacacctttaacccggccttctcgaatggctcgattatggatatcggtttttactgcctggcctctgcggtcgccctgtggggtgaaccgcacggcgtaacggccaccgccagcctgctggagagcggcgtggatgcacatggcgttgtggtgctggactacggtgatttcagcgtgacgttgcagcactcgaaggtcagtgactccgtactgccaagcgaaattcagggcgaagacggctcgctggtgatcgaaaaaatctccgaatgccagaagctaagcatcgttccccgcggcggcaaagcgcaggagctgacgcagcctcagcatattaacactatgctctatgaggcagaggtcttcgcccgtctggtagaagacaacgaagtgaaccacccggggctggcaatcagccgcaccacggcgaagctgcaaacggagatccgccgacagactggcgtgattttccccgcagacggcgtgaatgtggaagccgtcgcgtaa

SEQ ID NO: 4067 - DNA, 1245 bp, Enterobacter cloacae
cgtatgagcacacaatcacgcggtctgttcgcgcgcctggcgcagggcagtcttgtaaaacaaattctggtcgggttggtactgggtattctgctggccatggtgtcgaaacctgccgcggaggccacgggactgctcgggacgctgtttgtgggcgccctgaaggccgtcgccccggtactggtgctgatgctggtgatggcgtcgattgccaaccaccagcacggacaaaaaaccaacattcgccctattctgttcctgtatctgctgggaaccttctctgctgccttaacggccgttgtgtttagcttcctgttcccgtctacgctgcacctgaccagcgcggccggtgatatcaccccgccgtccgggattgtggaagtccttcgcggcctgctgatgagcatggtctctaaccccatcaccgcactgatgagcggaaactacattggcatcctggtctgggcgattggtctgggcttcgcgctgcgtcatggcaacgagaccacgaaaaacctggtcaacgatttgtccaatgccgtgactttcatggtgaagctggtgattcgctttgcaccagtcggtatctttggtctggtttcttcgacgctggccactaccggtttcgacgcactgtggggctacgcgcagctgctggtcgtcctggtcggctgtatgctgctggtggcgctggtgatcaacccgctgctggtgttctggcagatccgccgcaacccgtatccgctggtgctgacttgcctgcgcgagagcggcgtgtatgccttctttacccgcagctcggcggcgaacattccggtcaacatggcgctggcggagaagctgaacctggatcgcgatacctattccgtgtcgatcccgctgggtgcgaccgtgaacatggcgggtgcggcgatcaccatcaccgtgctgacgctggcggcggtgcatacgctgggtattccggtggatctgccaaccgcgctgctgctgagcgtcgttgcatcactgtgtgcctgtggcgcatccggcgtggcgggcggatcgctgctgctgatcccgctggcctgtaacatgttcggtatcccgaacgagattgccatgcaggttgtcgcggtcggcttcattatcggcgtattgcaggattcctgcgagactgcgctgaactcctctaccgacgtgctgtttaccgccgcagcctgtcaggcggaagacgcgcggttagcgaagaacgccctgcgcagttaa

SEQ ID NO: 4068 - DNA, 1347 bp, Enterobacter cloacae
gttgttgccgtgtcccgacacggaaataacataacgatgaggttttacatgcgtaaaattaaagggttacgttggtacatgatcgcactggtgacgctcggcaccgtgctgggctacctgacacgtaacaccgtggcagcagcggcgccaacgttgatggaagagttacatatctccacgcagcaatactcttacatcattgcggcttactctgccgcttacaccgtaatgcagcctgttgcaggttatgttcttgatattctgggtacaaaaattggttatgccttctttgctgtagcctgggccgtcttctgtggggcgaccgcgctggccggcagctggggcggactggcgctggcgcgtggtgcggtaggtgctgccgaagcggcgatgatccccgcgggtctgaaagccagctctgaatggttcccggcaaaagagcgttctatcgctgtcggttacttcaacgtgggctcctccatcggggcgatgattgctccgccactggtggtgtgggcgattgtgatgcacagctggcagatggcgttcatcatctccggtgtgctgagctttgcctgggccatggcgtggctgattttctataaacacccgcgcgaccagaaaaagctgtctgacgaagaacgtgactacattattaatggtcaggaatcccagcatcagaccgacaacggcaaaaagatgtccgtctggcagatcctgggcacccgtcagttctggggtatcgccctgccacgcttcctggcagaaccggcctggggtacgtttaacgcctggatcccactgttcatgtttaaagtgtacggctttaacctgaaagagatcgcgatgttcgcctggatgccaatgctgtttgcagacctgggctgtatcgtcggcggctacctgccaccgctgttccagcgctggtttggcgtgaacctgattgtgtcccgtaagatggtggtcaccatgggcgccctgctgatgatcggcccgggtatgatcggcctgttcaccagcccttacgtggctatcgccctgctgtgtatcgggggctttgctcaccagtctctgtccggtgcgctgattacgctctcgtccgacgtgtttggtcgtaacgaagtcgccaccgccaacggcctgaccgggatggccgcctggaccgcaagtaccctgtttgcgctggtggtcggcgcgctggcggatacgattggtttcagcccactgttcgcggtactggctgtcttcgacctgttgggtgcggtggttatctggacggtgctgaaaagcaaatccgcagatgaacttgcgaaagagtccctcgggggaccggcgacgcagagttag

SEQ ID NO: 4069 - DNA, 414 bp, Enterobacter cloacae
ttctggaacacggcttacgccgtaacacaatggaaggtttctataatgaaataccgcatcaccctggctctggcccttttttctttaagcacagcttccttcgctatgtctctttgtcaggagaaagaacaggatatccaacgcgaaatcagttatgccgaaaagcataacaatcagcaccggatcgacggactgaaaaaagcgttgagcgaagtgaaagacaactgtacggacagcaagctgcgtgccgatcatcaggaaaaaatcgctgaacagaaggacgagatagccgagcgccgtcaagacctgcaagaagcgaaagagaaaggtgatgcggaaaaaattgccaagcgcgagaggaagttgcaagaggcgcaggacgaactgaaagcgctggaagctcgcgattattga

SEQ ID NO: 4070 - DNA, 300 bp, Enterobacter cloacae
gtcgtgagcgacaaagccgaacgtcaaaagcggaaagcgtatctgttgagccaaatccagcagcagcgactggatctgtctgccagccgtcgcgactgggttgaagccacgcatcggtttgaccgcggctggaacacggtcctgagcctgcgttcatgggcgctggtcggcagcagcgtgatggcgatctggtcggttcggcatcctaacatgctgatccgctgggcacgtcgcggctttggcgcctggagcgcctggcgtctggtgaaaaccacgctgcgacagcagcagttgcggtga

SEQ ID NO: 4071 - DNA, 717 bp, Enterobacter cloacae
agagaggtcaagtttatgattacgacaagaacagcgaaacagtgcggacaagccgatttcggttggttgcaggcccgctacaccttttcctttggacactactttgaccctaaactcctcggttacgcttcactgcgtgtattgaatcaggaagtgctcgccccgggcgcgtccttccagccgcgcacgtacccgaaagtcgatatcctgaacctgatcctggaaggcgaggcagaataccgcgatagcgagggcaatcatgtccaggcgaaggctggcgaggcgctgttaatttctactcagccaggtattagctacagtgagcataacctcagcaaagacaaaacgctgacccgcatgcagctgtggctggatgcctgtccggagcgggaaaatccgctggtgcaaaagatcgatctgaagggcgatcaacagcagctgattgcctcgccagacggcagcaaaggcagcttgcagttgcgccagcaggtgtggctgcatcatatcgaactgaaaaaaggtgaacaggcgagcttccagcttcatggcccgcgtgcctatttgcagtccattcacggaacggtgcatgcggtcacgcatacggaagagaaagaagcgctcacctgcggtgacggggcgtttattcgtgacgaagcgaatatcactctggttgccgatacgccgctgcgcgcgctgttgattgatttgccggtttaa

SEQ ID NO: 4072 - DNA, 1575 bp, Enterobacter cloacae
acaatggccgatattgaaattcgacaggcgtcgccgacggcgttctatataaaagtgcacgatactgataacgtggcgattattgtcaacgacaatggcttaaaagctggcacccgctttccggatggcctggagctgattgagcacattccgcaggggcataaagtcgcactggtggatatcccggctcacggtgaaatcgtgcgctacggcgaagtcatcggctatgcggtgcgcgctatcccgcagggtagctggattgaggagtcgctggttgagctgcccaccgccccgccgctggagacgttgccgctggctacccgcgtccctgagccgttgcctccgctggagggttataccttcgaaggttaccgcaatgcggatggcagcgtgggaaccaaaaacctgcttggcatcaccaccagcgtgcattgcgtggcgggcgtagtggattacgttgtgaaaattattgagcgcgatctgttgccgaaataccccaacgttgacggcgtggtgggtcttaaccacctgtacggctgcggcgtggcgatcaacgcgccggcagcggtcgtgccgatccgtacgattcacaatatcgcccttaacccaaactttggcggtgaggtaatggtgattggtctcggctgtgaaaaattgcagccagaacgcctgttgcagggtactgaggatgtgaaagccattccggttgacgatgccagtgttgtgcgtcttcaggatgaacaccatgtcggcttcagatcgatggtcgacgacattttacaggtggcagaacgccatctggagaagttgaacaaacgccagcgtgaaacctgcccggcctctgaactggtcgttgggacacagtgtggcggcagcgatgcgttttccggcgtcaccgctaacccggcggtaggttatgcctccgatctgttcgtgcgctgcggcgccacggtgatgttctccgaagtcaccgaagtacgtgatgctatccacctgctcacgccgcgcgccgtcaacgaagaggtgggcaaacgcctgctggaggaaatggcctggtacgataactatctcgacatgggcaaaactgaccgcagcgccaacccgtctccgggtaacaagaaaggcggcctcgcgaacgtggtggaaaaggccctcgggtcgattgccaaatccggccagagcgcgattgtggaagtgctctcacctggccagcgaccaaccaaacgcggcctgatttacgcggcaacgcctgccagtgatttcgtttgcggcacccagcaggtggcttccggcattacggtacaggtctttaccaccgggcgcggaacgccgtacggcctgatggcggtaccggtgatcaaaatggcgacccgcaccgagctggcaaaccgctggtatgacttaatggatatcaacgcgggcaccatcgccaccggggaagagagtattgaagaggtgggctggaagctgttccacttcattctggatgtggcaagcgggcggaagaaaaccttctccgatcaatggggattgcataactcgctggcggtgtttaacccggcgccggtgacgtga

SEQ ID NO: 4073 - DNA, 1326 bp, Enterobacter cloacae
atgccaacaccatccgaaatggagaggaaagtgaaacatctgacagaaatggtggaacaacataaacgggggaatacaaacgggatttatgccgtctgttccgcacatccactggtacttgaagctgcaatacgttacgcccattcacaacagacgcctctgctgattgaagccacctcaaaccaggtggatcagtttggcggctataccggtatgacgcccgccgatttttatgggtttgtctgcaagctggcgggatccctcggtttccccacctcacagctgatccttggcggcgatcatttaggtccaaaccgctggcaaaacctgccagctttgcaggcgatggcgaacgccgacgatctgatcagaagctacgtggcggccggatttaaaaaaattcacctcgattgcagcatgtcctgcgaagacgacccggttcctttaaccgatgcaatcgttgccgggcgtgccgctcggctggctaaaattgccgaaaccacctgtctcgagcaatttggcgtagccgatctggtctacgttatcggcacggaagttccggttcccggtggggcacacgagacgctgaccgagcttgaggtcaccacgccagaggcggcacgcgccacgcttgaggcacaccgccacgcattcgagaaggaagggttaagcgacatctggccgcgcattattggcctggtcgttcagcctggcgttgagttcgaccatgcgcacgtttgtgactatcaaccgcataaagccgtcgcgctgagcaagatggttgaagcctacgacacgctggtatttgaagcacactctaccgattaccagacgccgcaggcgctgcgccagttggtgaaagatcacttcgccattctgaaagtcggccctgcgctaaccttcgcgctgcgcgaagcgctgttctcactggcagcaattgaagaagagctgctgccggcaaaagcctgctcagggctgcgtcacgtcctggaaaacgtgatgctcgatcgcccggaatactggcaaagccactatcacggcgacggcaatgcccgtcgcctggcccgcggttacagctattccgaccgcgtgcgctattactggccagacagccagattgacgacgcctttgagcggctggtacgcaacctggcggatgaaccgatcccgctgccgctgatcagccagtatctgccgttgcagtacagcaaagttcgcgatggtgctctcagctccacaccacgggaactcatcctcgaccacattcaggacatactccatcagtaccatgccgcctgcgaaggcgtaacgactcaacacgcataa

SEQ ID NO: 4074 - DNA, 942 bp, Enterobacter cloacae
tcgacctgctgcgcaaatcgcctgaacccacggcgcctgcggcccagaaagaggaatttgaagatggcatctaatcacaccaccctgccgggcgtgtctgaaagtgaagagacactgctgaccggcgtgaatgaaaacgtctacgaagatcagagtattggcgctgagctaacgaaaaaggatattaaccgtgtcgcctggcgttccatgctgctacaggcctcgtttaactacgagcgtatgcaggcctccggctggctgtatgggctactgcccgcgctgaaaaagatccacaccaataagcgggacctggcgcgcgccatgaaaggccatatgggcttctttaacacccacccgtttctggtgaccttcgtcatcggcattattctggcaatggagcgttccaagcaggatgtgaacagcatccagagcactaaaattgccgttggcgcaccgctcggtggcattggtgacgccatgttctggctgaccctgctgcccatttgcggggggattggcgccagcctggcgctacagggatccattcttggcgccgttgtctttatcgttctgtttaacgtggtgcatctcggcctgcgttttggtctggcgcactatgcctaccgaatgggtgtcgccgcgatcccgctgatcaaggccaacaccaaaaaggttggtcatgctgcgtccattgtcggaatgacagtgattggcgcgctggtggcaacctatgtgcgcctgaataccacactcgagattaaagccggggacgcggtcgtcaaactgcaaaccgatgtgatcgacaaactgatgcccgcctttctgccactggtctacaccctgatcatgttctggctggtacgccgtggctggagcccactgcgcctgattggtatcaccgtggtgctgggcgttgtcggtaaattctgtcacttcctgtaa

SEQ ID NO: 4075 - DNA, 1050 bp, Enterobacter cloacae
tctgttttgtcgcgtggctcacattttcacgtcgcgccatcacgaacatatgatctaaatttttataagagttcaattatgagcgataaacgcactgcggaagaaggacggtttgccgggctggcactggcggaagaggagctggtggcgcgcgtggcctggtgctactaccacgacgggctgacccagaacgacatcggcgaacggctcgggctgccgcgcctgaagatctcccgcctgctggagaagggccgtcagtccggggtgatccgcgtgcagatcaactcccgctacgagggctgcctggcgctggaaaccgagctacagcagcgctttggcctgaagctggtgcgcgtgatgcctgccctgaataccccgccgatgaacgtgcggctgggcattggcgcggcgcagtcgctgatgggcgtactggagcccggccagctgttagcggtggggttcggtgaaaccaccatgagcagtctgcaacacttaagcggctttatcagctcgcagcagatccgcctggtgacgctctccggcggcgtcgggccgtatatgaccggtatcggccagctggatgcggcctgtagcgtcagcatgatccccgccccgcttcgcgtgtcatccgctgaagtcgccgggatcttaaagcgcgaaaccagcgtgcgggacgtgatcctcgccgccaccgcggctgacgtggcggtggtcgggattggctcggtaaaccagcgccgcgacgcaacgatcctgcgctccggctatatcagcgaaggtgaacagctgatgtacgcccgcaaaggcgcggtgggcgatatcctcggctatttcctcaatgccgaaggggaatgcgtcgaggagctggagatccacaaagaattactgggcgtcacgctcgatgaactggcgcagctgcccaccattgtcggcgtggccggaggggaagagaaagccgatgcgatttatgccgcactgaaaggtcgccgtattaatggcctggtgacggaagagacgacagcccgcgcggtgctggctctggccggataa

SEQ ID NO: 4076 - DNA, 2064 bp, Enterobacter cloacae
ctcatccgaccacataacaataattttacactggaagagactatgagccgctacccgtcgttattcgcccctctcgatctggggttcaccaccctcaaaaaccgcgtgctaatgggctcaatgcacaccgggctggaggagcgtccggacggggctgaacgtctggcagccttctatgccgaacgcgcgcgccacggagtggcgctgattgtcaccggcggcgtagcccctgccccttccggggtgacgatggagggcggcgcggtgttgaatgatgcgtcacaactgtcgcaccaccgcattgtgaccgacgcggtccaccgcgagggcggcaaaatcgccctgcaaattctgcataccgggcgctacagctatcaaccgaacctggttgccccctcggctattcaggcgccgattaaccgctttactcctcacgcccttagccacgacgagatcctggcgctgatcgacgattttgcccgctgcgccgcgctggcaagggaagcaggctacgacggcgtggaggtgatgggctctgaaggctatctgattaacgaatttctcgccgcacgcaccaaccagcgcgacgacgaatggggtggcgactatgcccgccgcatgcgttttgccgtggaggtggtgcgcgcggtgcgtgaacgtgcgggtgcggattttattatcatcttccgcctgtcgatgctcgacctggtggaaggcggcggcaccttcgacgaaaccgtgcagctggcgcaggcaattgaagccgccggtgccaccattatcaacaccgggattggctggcacgaagcgcgcatccccaccatcgccacgccggtgccgcgtgcggcgttcagctgggtaacgcgcaagctgaaaggcaaagtctccgttccgctggtgaccactaaccgcattaacgacccgcaggtggcggacgatgtgatctcacgcggcgacgccgatatggtctcgatggcgcgtccgttcctcgcggatgccgaactgctctccaaagcgcaaagcggccgtgcggatgagatcaacacctgcatcggctgtaaccaggcctgtctggatcaaatcttcgctggcaaagtcacctcctgcctcgttaacccccgcgcctgccatgaaaccaaaatgccggtggttacgacggtcaataaaaaacgcctggccgtggtgggcgcaggccccgctgggctggcgtttgcggtgaatgccgcctcgcgcgggcacggcgtgacgctgtttgatgcgcagggggagattggcgggcagtttaatatcgccaaacagatccccggcaaagatgagttctacgaaacgctgcgctactaccgccggatgatcgaggtgacgggtgtcgatctgcggcttaaccagtttgtcagcgcggcggatctgatcggtttcgacgaggtgatcctcgcgagtgggatcgccccgcgcacccctgcgatcgagggtatcgatcatccgaaggtattgagctatctggacgtgctgcgcgacaaagcaccggttggcgagaaggtggcgattatcggctgcggcgggatcggttttgataccgcgatgtatttaagccagccgggcgaagccaccagccagaacatcgctgagttctgcgtggaatggggcattgataccagtctcagtcagtccggcggtttacgcccggaagggccgcagctgccgaaaagcccgcgtcagatcgtgatgctccagcgtaaggccagcaagccgggtgaagggctgggcaaaactactggctggatccaccgcgccaccctgctctcgcgcggggtgaagatgatcccggcggtgagctaccagaagatcgacgacgacgggctgcatgtgctgatcggtggtgaaccgcagctgctgcgcgtggatcatgtgattttgtgcgccggacaggagccaaagcgcgatctggccgatccgctgcgcgaagcgggtaaaacggtgcatttgatcggcgggtgcgacgtggcgatggagctggatgcgcggcgggcgattgcgcagggcacccagcttgcactggttatttag

SEQ ID NO: 4077 - DNA, 519 bp, Enterobacter cloacae
aacgccggtctttatgaaatacgaagaccaactgatgtcttgcctgatgctgctgcccgtcgttctgctggtgtttggcctggtcgggtccctggtcgtactgtggaagaagaaatacggggccaggggttaacgatggttatctccccgctcgcgctgcgccgcttctcttacgccatcgtcgcgctgatgatgttcagcgctcttatcctgctgtggtctgcgctacagcatcaggagtcgacgctggctatccgtcctgtgagccagggaaccagcgtgccggatggtttttccatctggcatcatctcgacgcaaacgggatccgctttaagagcatcacgccgcaaaacgatgtactactgataaaatttgactccagtgcgcaaagcgccgcggcgaaagccgtgctggaccgcacgctgccgcagggttacatcattgcgcaacaggatgatgacagccacgtcgcctcctggatgtcacggttacgcgacacgtcgcatcgatttggttaa

SEQ ID NO: 4078 - DNA, 471 bp, Enterobacter cloacae
tccctggacgggtgtgggtattggcgccgcagtgggtgtggtgctgggtgtcctgctgacgcgtcgttgattatggaagatccacgtcacgcacaagggcctgctaaaaacgtcctcggcattggccagcgtattcttacgacgctggtcgggattgccgaaacgcgcgtccggcttgcggtagtggagctggaagaggagaaagccaacctcttccagatgctgctcatgcttgggcttacgatgctctttgccgcgtttggtctgatgagcctgatggtgttaatcatctgggctatcgatccacagtatcgtctgaacgcgatgattgcgactaccgtggttctgctggtggcggcgctgataggcggtatctggaccctgcataaagcgcgcacgtcgaccttcctgcgtcatacgcgccaggagctggccaacgaccgcgccctgctggaggatgataagtcgtga

SEQ ID NO: 4079 - DNA, 414 bp, Enterobacter cloacae
tgtggttccctggagagtaaaatgaaaaaattagaagatgttggtgtactggtagcgcgtattctgatgccaattctgttcatcaccgcaggctggggcaaaattaccggctatgcgggcactcagcagtatatggaagcgatgggcgtgccggggttcctgctgccactgaccattctgcttgagttcggcggcggcctggcagtgctgttcggtttcctgacccgcaccacggcgctgttcaccgcaggctttaccctgctgaccgcgttcatcttccacagcaactttgcggaaggcgtgaactccctgatgttcatgaaaaacctgaccatcgcgggtggcttcctgctgctggctatcacgggcccgggcgcctacagcatcgaccgtcttctgaataagaagtggtaa

SEQ ID NO: 4080 - DNA, 1059 bp, Enterobacter cloacae
gcaggctatactgattacattcaaagcgaggagacatctcctcgcttttgctatctgacggaggagaaaaaaatgggacaactcgtagacggcgtctggcaggatgtctggtatgacaccaaatccaccggtggacgctttaagcgctctgtttcggccttccgtaactggctgaccgccgacggcgcacccggcccgagtggcgaagggggctttgcggcggagaaagatcgttatcatctgtacgtttctctcgcctgtccgtgggcgcaccgcacgctgattgtacgcaagcttaaaggcctcgaatcgttaattccggtttcggtggtcaacccgctgatgctggaaaacggctggacgttcgacagtgacttccctgccgcgacgggtgatgagctttatcatcacgatttcctgtatcagctctatctgcgcgccgatccgcactacaccggacgcgtaacggtgccggtgctgtgggacaagaaaaaccagacgatcgtcagcaatgaatccgctgaaatcattcgcatgttcaataccgcgtttgacgcgcacggcgcccgcgccggggattactacccggttgagctgcgcgagaaaattgacgagctgaacggctggatctacgacaacgtcaacaacggcgtctataaagcgggctttgccaccagtcaggaagcgtacgacgaagcggtcggcaacgtgtttggatccctggagcgcctggagcagatcctcggccagcatcgttatttaacgggcgatcgcctcaccgaagcagacatccgcctgtggacgacgctgatccgcttcgatccggtgtatgtcacccacttcaagtgcgacaagcatcgcatcagcgattatctgaacctgcacggtttcctgcgcgacatctatcagatgccggggattgcggagacggtcaattttgaccatattcgcacccattatttccgcagtcataagaccatcaacccaacgggcattatctccattggcccgtggcaggacctggatgaaccgcacgggcgcgacgtgcgtttcggataa

SEQ ID NO: 4081 - DNA, 489 bp, Enterobacter cloacae
aaagaggaaaacgctatgccaaacattgtcttatgccgcattgatgaacgcctgatccacggtcaggtgggcgtacagtgggtggggtttgcgggggcgaacctggtgctggtggcaaatgacgaggttgcagacgatccggttcagcaaaacctgatggagatggtgcttgcggaaggcatcgccgtgcgtttctggtctctgcaaaaagtgatcgacaacattcatcgcgccgccgaccggcagaaaattctgctggtctgtaaaacaccggctgattttttaacgctggtcgagggcggcgtgcccatcacccgtattaacgtcggaaatatgcattacgccagtggcaaacagcaaattgccaaaacggtatctgtagacgcgaacgatatcgccgcgtttaacggcctgaaggcggccggagtggaatgcttcgttcagggcgttccaacagagactgctttggatctctttaaactgctctga

SEQ ID NO: 4082 - DNA, 1176 bp, Enterobacter cloacae
acttgcacgctgtcgcgaggaagcgcccgccgaggaagggatatgagccagctgctgcgcgcgcgtcgtctgcttaccgggcaaggctggctggatgaccatcagctgcgtatggatagaggcgtcatcaccgccatcgagccgattccggcaggggttaacacccgcgaggcagacctgctttgcccggcatacattgatatccacttccacggcggcgcgggtgtggatgtgatggatgatgcccccgacgtgctggaccggttagccttacataaagcgcgtgaaggcgtaggggcgtttctgcctaccaccgtcaccgcttcgctggaggcgatccatggcgcgttacggcgcattgcccggcgctgtcatgccggtggccccggcgcgcagctcctgggcagctatctggaaggcccgtactttacaccgcagaacaaaggggcgcacccgccagaactgtttcgcgagctggatctcgcggaacttgatgagctgattgcggtttcgcagaacacgctgcgggtggtggcgcttgctccggaaaaagtggatgccctgaaggcgatccatcacctcaagcaaaaagggatacgcgtcatgctgggccacagcgccgctacatacgcgcaaaccctggccgcatttgatgcaggcgcagacgggctggtgcactgctacaacggcatgacgggattacaccaccgggagccgggcatggttggcgccgggcttacggacccacgcgcgtggctggagcttattgccgacgggcatcacgttcatcctggagccatgcggctatgttgttgctgcgcgaaggatcgtacggtgctgattaccgatgccatgcaggcggcgggtatgcctgatgggggctatacgttgtgtggtgaaagtgtcgagatgcagggcggcgttgttcgcacggcctcgggcgggctggcgggcagcacgctcgcgctggatgccgccgtgcggaatatggtggagcatacgggggtcgccccagaaaacgctatccatatggcctcgctgcatcccgcccgtctgctcggtatggatcacctgctgggatcgttagcaccaggcaaacgcgccaatattattgcgctcgatgcgggtttacacctccggcagatctggatccagggtcaggctctttccctgtag

SEQ ID NO: 4083 - DNA, 1146 bp, Enterobacter cloacae
gttatgccacaaaccactaccaccaccggcacctggaccgaaaaagagatccgccagcagccagccagctggcttcgctcgctcaacaatattgataatctgcgcgcgtcgatcgacagttttctgacgccactgttgcgcaagcccgatctgcggatcgttctgaccggcgcgggtacgtctgcttttatcggcgacatcattgcgccatggcttgccagccacacgagaaaaaatatcaccgcgatacctacgaccgatctggtcaccaacccgatggattacttcagccctgcgcacccgctgctgctggtctctttcgcccgttctggcaatagcccggagagcgtcgctgccgttgagctggcgaatcagtttgttccggagtgctaccacctgtcgatcacctgtaatgaagcgggcagcctgtatcagaatgccgtcgacagcgataacgcctgcgctctgctcatgccagccgaaacgcacgatcgcgggttcgcgatgacaagcagcatcaccaccatgatggcgagctgcctggcggtattcgcaccggaaacgatcaacagcaaaacgttccgcgacgtgtccgatcgctgtcaggcgatcctcacgtcgcttggcgatttcagccccggcgtctttggtaacgaaccgtggaaacgcattgtttatctgggcagcggtggattacagggcgccgcacgggagtcagcgttgaaggtgctggagctgaccgccggcaagctggcggcattctacgattcgccaacgggtttccgtcacgggcctaagtcgctggtggacaacgaaacgctggtcgtcgtgtttgtctccagccatccgtacacgcgtcagtacgatctggatctgctcgccgagctgcgacgcgatcgtcaggctatgcgcgtggtagccattgcagccgaaacggatccggtcattgaagctggcccgcatatcctgctgccgccttcccgttcatttaacgatatggagcaggcgttctgcttcctgatgtacgcccaggttttcgcactgacccagtctctgcacgttggcaatacgccggatacgccatccgccagcggtacggttaaccgtgtggtccagggcgtcgttattcatccgtggcaggcttaa

SEQ ID NO: 4084 - DNA, 885 bp, Enterobacter cloacae
  unsure (613)
gaggacaggctcatgagtattatttctaccaaatatcttttgcaggacgcacaggcgaagggctttgccgttccggcttttaacatccataacgccgagacgatccaggcgatcctcgaagtctgtagcgaaatgcgatcgccggtgatcctcgcgggtacgccggggacgtttaaacatattgcgctggaagagatttacgccttgtgcagcgcgtattcccttacttatgacatgccgctggcgctacacctcgatcaccacgaatcgctggacgacattcgccgcaaagtccatgccggcgtacgtagcgcaatgatcgacggtagccattaccccttcgaacaaaacgtcaagctggtgaaatcggtcgtcgatttctgccacctcaacgactgtagcgtcgaggccgaactgggccgactgggtggggtggaagatgacatgagcgtcgacgccgaaagcgcgttcctgaccgacccgcaggaagcaaaacgctttgtcgaactgacaggcgtggacagcctcgccgtcgccatcggtaccgcgcacggtctctataccaaacgcccaaaaatcgacttccagcggctggccgagatccgcgaggtantgacagtgccgctggtgctgcatggtgcaagcgatgtgccggatgaggatgtgcgccgcaccattgagctgggcgtctgcaaagttaacgtcgcaacagagctgaaaatcgccttctctgacgcagtcaaagcctggtttgccgagaacccacagggcaacgatccgcgcttctacatgcgcgtcggcatggatgccatgaaagaggtggtcagaagcaaaatcaccgtttgcggctcggcgaaccggctgctgcttccggctgaagcctga

SEQ ID NO: 4085 - DNA, 546 bp, Enterobacter cloacae
aggcgcgtccttaagccggacagcgccttccattatcctaaaaatccgaggagtccctacatgacacaggaaaagtcgtttaaatcgaaagcgtgggagtttttccagagcctgggaaagacgtttatgttcccggtctcgctgttggcctttatggggttgttgttaggtatcggtagttctgtcaccagcccttccaccatcaaaagttttccctttctgggcggcgagttaacgcagctcacctttggttttatcgccatggtcggcggctttgcttttacctatctgccgctgatgtttgccatggcgatcccgatgggccttgccagacgtaataaagcggtgggcgcttttgccggattcgttggctacatgctgatgaacatgagcatcaactactacctgaccgccacccaccagcttgcggacgccgccaccatgagacaggtgggacaatccatcgtgcttggtattcaaacgctggagatgggcgtgctcggcggcattgtggtaggggtgatcacctacttcctgcacgaaaac

SEQ ID NO: 4086 - DNA, 537 bp, Enterobacter cloacae
gtatacccgttttcacactattttggggttttgatgaaccagctgacttatctccagggctatccggagcatttactttcccaggttcgtgacctgattgccgcgggaaagctcggtgcggtgctggaaaaacgctacccgggcacgcatgatttcgcgactgacaaagccctctggcagtatacgcaggatctgaaaaaccagtatcttaagagcgccccgccgatcaacaaggtgatgtacgacaataagatccatgtgctgaaaaacgcgctcggcctgcataccgccatctcccgcgtgcagggcggcaagctgaaggctaaagcggagatccgcgtcgcgaccgtctttcgcaatgcgccggaagcctttctgcggatgatcgtggtgcacgagctggcgcacctgaaagagaaagagcacgacaaagccttctattccctgtgctgccacatggagccacagtaccaccagctggagtttgatacccgtttgtggctgacgcatttatcgttaaagagtaatgcgcagtag

SEQ ID NO: 4087 - DNA, 999 bp, Enterobacter cloacae
ccgtttttgttttttatgtgtaaggaaaatagtatgcattctgtcggcactccaatgctgtggggcggattcgcggttgtcgtgctcatcatgctggcgatcgacctctttttgcagggtcgtcgcggcgaacacggcatgagcgtcaagcaagccgccgtctggtcgctggtatgggttaccctctcacttcttttctgcgccgccttctggtggtatctggcctcaaccgaaggccgcgcggtggccgatcctcaggcactcgccttcctcaccggctatctgattgaaaaagcactggcggttgataacgtcttcgtctggctgatgctgttcagttacttcgccgtgcctgcggctctgcaacgccgcgtgctggtgtacggcgttctgggcgctattgtcctgcgtaccatcatgatcttcgccggtagctggctgattacccagttcgaatggctgttgtatgtatttggtgcgttcctgctgttcaccggggtcaaaatggcgctggcgaaagaagacgataccggtatcggtgataagccgttggtgaagtggttccggggtcatctgcgcatgacggacaagatcgagagcgagcatttcttcgtgcgtaagaacggcctgctgttcgccaccccgctgctgctggtgctgattctggtcgagctgagcgacgtgattttcgcggtggacagtatcccggctatcttcgcagttaccaccgacccgttcatcgttctgacctcgaatctgttcgccatcctcggcctgcgtgcgatgtacttcctgctggcaggcgcggcagagcgcttctcaatgctgaagtacggcctgtcggtgattctggtgtttatcggtatcaagatgctgatcgtcgatttctaccatatcccgatcgccatttcgctcggcgtggtgtttggcattctgctggtgacgctgattatcaatacctgggttaaccgccagcacgataagaagcagcaggtttag

SEQ ID NO: 4088 - DNA, 810 bp, Enterobacter cloacae
caaatcattcgccgtaccctgcctggagcgcatatggaaatcaccgaatcacgtcgtttatatcaacaacttgccgccgagctgaaagatcgcatcgagcaaggggtctatcttgtcggtgataaacttcccgctgagcgtttcattgcggatgaaaaaagcgtcagccgcacggtggtccgcgaagccatcatcatgctggaagtggaagggtatgttgaggtacgcaaaggttccggcattcatgtgatttccagccaggcgaaacactcccccaccccggacgaaagtctggagtttgccagctacggtccgtttgagcttctccaggctcgccagctgattgaaagcaacattgcggaatttgctgcgacgcaggtgaccaagcaggacatcatgaagctgatggaaatccaggatcacgcgcgtaaagaaaaatgtttccgcgattctgaatgggacctgcaattccacgtccaggtcgcccttgcgactcagaacacggcgctggcggcaatcgttgaaaaaatgtggactcagcgcgttcacaacccgtactggaagaaattgcacgatcacattgattcccgcacggtagataactggtgtgacgatcacgaccagattcttaaggccctgattcgtaaagatccgcatgcggcgaaactggcaatgtggcagcatctggagaacaccaaacagatgctgtttaatgaaacaagtgatgactttgaatttaacgctgaccgctatctttttgccgataatccggtcgttcacctcgataccgcgaccaatctcgcaaaataa

SEQ ID NO: 4089 - DNA, 663 bp, Enterobacter cloacae
atggaacttttgacccaactactgaacgccctctgggctcaggatttcgaaacgctggccaacccgtccatgattggcatgctctactttgtattatttatgatcctgttccttgagaacggtctgctgcctgctgcctttttaccgggcgacagcctgctggtactggtcggggtgctttgtgcaaaaggggcgatggctttcccgcaaacggtcctgcttttaaccattgccgccagcctgggctgctgggtgagttacattcaggggcgatggctgggtaacacgcgaatcgttcagaactggctttcgcaccttccggcccattaccaccagcgagcgcaccaccttttccataagcatgggctttccgccttgctgatcggccgctttatcgcattcgtacgcaccctactgcccaccattgcgggcctgtccggcctgagcagcacgcgcttccagttctttaactggatgagcggcttgctgtgggtgctgatcctgaccacgctcggctacgcgctgggtaaaacgccggtctttatgaaatacgaagaccaactgatgtcttgcctgatgctgctgcccgtcgttctgctggtgtttggcctggtcgggtccctggtcgtactgtggaagaagaaatacggggccaggggttaa

SEQ ID NO: 4090 - DNA, 330 bp, Enterobacter cloacae
cggaaatctcaacaggagagaatcatgtcaaaagatacaacttcagaaaatctgcgcgctgaactgaaatccctggcggacaccctggaagaggtgctgaactcttctgccgataaatcgaaagaagaagtcagcaaactgcgcagcaaagcggagcaggcactgaaagagagccgttaccgtctgggtgaaaccggtgatgcgctggcgaaacagacccgcgaagcggctgcgcgcgcagacgaatatgtacgtgataatccctggacgggtgtgggtattggcgccgcagtgggtgtggtgctgggtgtcctgctgacgcgtcgttga

SEQ ID NO: 4091 - DNA, 387 bp, Enterobacter cloacae
ctgattaagaggcaaggaaaaatggactggtatttaaaggtactgcgcaactattttggttttggtggccgtgcccgccgtaaagagtactggatgttcgttctggtgaacttcgtcctgattatggtgctgggcattgtggacaagatcctcggctgggaacgcgaggggggtgaaggcattctcaccaccatttatggtgtgttagttctgctgccttcatgggccgtactgtttcgtcgtctccacgacaccgatcgttcggcgtggtggctgctgttgctgttgatcccgcttatcggctggatcgtgattttgattttcaactgtcagagcggaacgccgggcgaaaaccgctttggtccggatcctaaggcaagcgcgtaa

SEQ ID NO: 4092 - DNA, 864 bp, Enterobacter cloacae
aggcggccggagtggaatgcttcgttcagggcgttccaacagagactgctttggatctctttaaactgctctgagggattcacaatggaaatcagtctgttgcaggctttcgcgctggggcttctcgcctttatagcgggcctggatatgtttaacggcttaacacacatgcaccgtccagtggtgctcgggccactggttggcctgattctgggcgatttgcacaccggaattctgaccggcggtacattagaactggtctggatgggactcgcgccgctggcgggcgcgcagccgccaaacgtgattatcggcaccatcgttggcaccacatttgccattactacaggcgtgaagccggatgtcgccgttggggtcgccgtgccgtttgccgtggcggttcagatggggatcaccttcctcttctcggtgatgtccggcgtgatgtcccgctgcgatcgcatggcggctaacgcagacacccgtggtattgaacgggtcaactatcttgcactgctggcgctcggcgtcttctacttcctgtgcgcatttctgcccatctacttcggcgctgaacatgcgaaaaccgccattgacgtgctgccggaacgtctgatcgacggtctcggcgtcgcgggcggcatcatgccagcgatcggcttcgccgtgctactgaagatcatgatgaaaaacgtttacatcccttacttcattatcggctttgtcgccgcggcctggctgaaactcccggtgctggcgattgccgcggctgcactggcgatggcgctgatcgacctgctgcgcaaatcgcctgaacccacggcgcctgcggcccagaaagaggaatttgaagatggcatctaa

SEQ ID NO: 4093 - DNA, 471 bp, Enterobacter cloacae
attctgtcacttcctgtaaaaagcaaagaggttgcgatgttaggcattattttgacgggtcacggcggttttgccagcggcctgcaacaggcgatgaagcaaatcctcggcgaacagccgcagtttatcgccatcgattttccggaaagctccaccactgcgcggctgaccgcgcagcttgagcaggcagtgaatgaactggatgcagagcacgatatcgtgtttctcaccgatcttctcggcggtacgccgtttcgtgtggcctctaccctcgcgatgcagcgccccggcagcgaagtgattaccggcaccaatctccagcttttgctggagatggttctggagcgcgacggattaagcagtgaagcctttcgtttgcaggcgctggagtgcggccatcgcggcctgaccagcctggtggatgaacttgcacgctgtcgcgaggaagcgcccgccgaggaagggatatga

SEQ ID NO: 4094 - DNA, 1842 bp, Enterobacter cloacae
cgcgaagccaggcttaacagtcaccacggaccatttgcaatggtgaacaatatgaccgacttaaccgcgcaagaagccgcctggcagactcgggatcatctcgatgacccggtcattggcgaactgcgcaaccgttttgggccggatgcctttactgttcaggccacccgcaccggggtacccgttgtttgggtgaagcgtgagcaattactggaagttgtcgatttcctcaagaaattgccaaaaccttacgtcatgctgtttgacttacacggcatggacgaacgtctgagaacgcaccgccagggtctccctgccgcggatttttccgttttctaccacctgatctcaatagaccgcaacacggatatcatgctcaaggtggcattgtctgaaaacgacatgcatctgccgacgatcaccaaacttttcccgaacgccaactggtacgagcgtgaaacctgggaaatgttcggcatgaccttcgacggccacccgcatctgacgcgcatcatgatgccgcagacctggaccggccacccgctgcgtaaagactacccggcacgcgccaccgaattcgacccgtttgagctaaccaaagccaagcaggatctggagatggaagcgctgaccttcaagccggaagactggggcatgaagcgcggcaccgaaaacgaggacttcatgttcctcaacctcggtccgaaccacccgtctgcgcacggtgctttccgtattatccttcagcttgacggcgaagagattgtcgactgcgtgcctgacatcggctaccaccaccgtggtgccgagaagatgggcgagcgtcagtcctggcacagctacattccgtataccgaccgtatcgaatacctcggcggctgcgtgaacgaaatgccatacgtgctggccgttgagaaactggcaggcatcaccgtcccggatcgcgttaacgtgattcgcgtaatgctgtctgaactgttccgtattaacagccacctgctgtacatctccacgttcattcaggacgtcggcgcgatgacgccggtcttcttcgcctttaccgaccgtcagaaaatctacgatctggtagaagcgattaccggtttccgtatgcacccagcctggttccgcatcggtggtgtggcgcacgatctgccgcgcggttgggaccgtctgctgcgtgaattcctcgactggatgccgaaacgtctggcgtcttacgagaaagctgcgctgcgtaactccatcctgaaaggccgttcccagggcgttgctgcctacggcgcgaaagaagcgctggagtgggggactaccggtgctggcctgcgtgcgaccgggattgatttcgacgtgcgtaaagcgcgtccttactctggttacgagaacttcgactttgaagtcccggttggcggcggtgtttccgactgctacacccgcgtgatgctgaaagtggaagagctgcgccagagcctgcgcatccttgagcagtgcctcaacaacatgccggaaggcccgttcaaggcggatcacccgctgacgacgccgccaccgaaagagcgcacgctgcaacatatcgagaccctgatcacccacttcctgcaagtttcctggggcccggtcatgccggcacaggaatccttccagatgattgaagcgaccaagggtatcaacagctactacctcaccagcgacggcagcaccatgagctaccgcacccgcgtgcgtacgccaagcttcgcgcacttgcagcagatcccggccgccattcgcggcagtctggtctccgacctgattgtgtatctgggtagtatcgattttgttatgtcagatgtggaccgctaa

SEQ ID NO: 4095 - DNA, 996 bp, Enterobacter cloacae
ccttcaggaggcaaaagcatgagttggttaacgccggatcttatcgacatcctgctgagcattctgaaagcggttgtgattctgctggtggtggtcacctgcggcgcgttcatgagctttggtgaacgtcgtctgctcggtctgttccagaaccgttacggaccgaaccgcgtgggctggggtggttcactccagctggtggcggacatgatcaagatgttctttaaagaggactgggttccgcgcttctcggaccgcgtgatctttacgctggcgccgatgatcgccttcacctcgctgctgctggcgtttgctatcgttccggtcagcccgacctgggtggtcgctgacctgaacatcggcattctgttcttcctgatgatggcaggcctcgcggtttacgcggtgctgttcgcaggctggtccagtaacaacaaatactcgctgctgggtgcgatgcgtgcttccgcgcagacgctgagctacgaagtgttcctgggtctctccctgatgggcgtggtggcgcaggccggttcatttaacatgaccgacatcgtcaacaaccaggccgacatctggaacgttatcccgcagttctttgggtttattacctttgccatcgcgggcgtggcggtgtgtcaccgtcacccgtttgaccagccagaagccgaacaggaactggccgacggttaccacattgaatattccggtatgaagttcggtctgttcttcgtgggcgagtacatcggtatcgtcaccatttcggcgttgatggtaacgctgttctttggtggctggcatggcccgttcttaccgccgttcatctggttcgcgctgaaaaccgcgttcttcatgatgatgttcattttgattcgcgcagcgttaccgcgtccgcgttatgaccaggtaatgtccttcggctggaaagtgtgcctgccgctgacgctcgtcaacttgttggtaacggcggctgtcattctctggcagcagccataa

SEQ ID NO: 4096 - DNA, 693 bp, Enterobacter cloacae
tttccggtccgggcaaatacccggaatataacttctaccggatggcgggtatggcaatcgacggcaaagataagggcgaagcagagaacgaagccaagcctatcgacgtcaagagcctgttaccgtaaggagagggcaatggaattcgctttttatatctgtggccttatcgccatcctggctacgctgcgagtgatcacgcacaccaatccggtgcatgcgctgctgtatttaatcatctcgctgctggctatttccggggtgttctttgcgctgggcgcgcacttcgccggtgcgctggaaatcatcgtctacgccggggccatcatggtgctgttcgtgttcgtggtgatgatgctcaacctgggcggctctgaaattgagcaggaacgtcagtggttaaaaccgcaggtgtggattggcccggcgattctgtcggccatcatgctggcggtgattgtttacgccattctgggcgtcaacgaccagggtatcgacgggacgccaatcagcgcgaaagccgtgggtatcaccctgtttggtccgtacgttctggcggttgagctggcctcgatgctgctgctggcgggtctggttgtggccttccacgttggccgcgaagagcgtgtcggcgaggtgctgagcaaccgcactgacgaccgcgcgaaaagaaaaacggaggaacgcgcatga

SEQ ID NO: 4097 - DNA, 1311 bp, Enterobacter cloacae
cagggagaggttcgcgtgcactcgattttcctcgcgctgcaaagcctgcgcactcagcttgcgcaagcattgcctgctatacccggtttacgccatttcgatgtctctttcccgttaaacgacgccttcgatccgctggcctggctgggtgtgcagcgatgctatcctcagttttactggcaacagcgcagcggcgatgaagaacttgccgcgctcggaagcctcgcccagtttgattctctggcttcggcctcgcggtttttgcatgcccatgacgtagccaatgacacccgtatctgcggcctgaacgccttcaacccggcgcagggcaagctgtttttaccgcgccttctctggcgacggtctggcggggtcgccacgctgcgtctgcaactgtggagcgaaacgtcgctgcgggaagatgcccgtgaggcgctgaattttgtcgataacctgcgcgacgccgcgccgatccgcccgttgtccgtgcagattgtgcaggaaacccatcatccggaaaaaccggactggctggcgttgattcgtcaggcgacggatacccttgctcgcggtgattttgagaaagtggtgctcgcacgtgctacagacgttcagtgccagcagcccgtgaacgccatcgcgctgatggctgcaagccgcgcgctaaacctcaactgctatcatttttgtatggtctttgacgccagcaatgccttcctcggctcgacgcccgagcgcctgtggcggcgacgcggcacgctgctgcgcactgaagcgctggcaggcaccgtcgccagccattctgacgataagcaggcccagcgtctgggcgactggctgatgaacgacgataaaaatcagcgggaaaatatgctggtggtggaagatatctgccagcgtcttcagcaccatacccggacgctggagatcctgcctgcgcaggtgctgcgtctgcgcaaggtgcagcatttacgccgctgtatctggaccgaacttaaacagcctgacgacgaacagtgtctgcatattttgcaaccgacggcggcggtggccgggctgccgcgacaggcggcccgagaatttattgcgaaagtcgagccgtttgaccgggagtggtacgccggttcggcgggctatttatcgcgcgatcagagcgaattctgtgtggcattacgctccgcccgcgttcacaacgctgcgctgcgtctttatgcgggggcgggcatcgtcagcggctccgatcctgagcaggagtggcaggagatcgaaaacaaggccgccgggctgcgttcccttctcctaagggattaa

SEQ ID NO: 4098 - DNA, 822 bp, Enterobacter cloacae
cggcgcgcagaagctgcaacatctgcttgcgcaggtgagtcacctgtgatcctcgcaggcgtctcccagccaggaaatccaggctacccctggctggttttcctgcacggtttttccggcgactgtcgcgagtggcaggctgtcggggcgtcgctgcatgactacccccggctctacattgacctgcccgggcacggtggttcagcggatacgggcgtgacggggtttgcagaggtaagtgaattgctctcgcatacccttgttagttacaacatactaagatactggctcgtggggtactccctcggcggccgcattgcgatgttccatgcctgccagcatcctgcggggttagacggggtgattgtggaaggtggacacccgggcctgcaagacgccgatgcgcgccaggcccggctgatctctgaccgccgctgggcgtcacggtttcgcagtgagccgctggaggccgtctttgccgactggtatcaacagccggtctttgcctcacttacggatgatcagcgcagggcgctgatcgcgctgcgcagccggaacaacggcccgaggctggcagagatgctggaggccacctcgcttgccgttcagcctgatttacgtcccgcgctcatcgcgcgtgatttttcttttgactatctctatggcgaacgtgacgggaagtttgcagctatcgccactgaacttaacgccacgcgtcatgctatccctcacgccggacacaacgcccaccgggacaacccggaagctgttgccgcgagtctggctcagatactgcgttatcgaacaaaggacacgctatga

SEQ ID NO: 4099 - DNA, 1617 bp, Enterobacter cloacae
gccaacgctgaccggcagcctcgacaaggtgcgcgagcaggttgcggcggcccatgccgcagggctgacggcggtgatcagttcatccatcgaatccagcctcggcctgacgcagctggcgcgcatcgctgcatggttaacgccggacaccgttcccggtctcgatacgctaaacctgatgcaggcccagctgattcgccagtggcctggcagcaccttgccgtgcctcgacgtcggggcgctggagccattgcgatgagttttaccgactggccgtggcggcactggcgcacccggcgtgccgataaacccgcgctgcgtttagacgatgtaacgctcagttggactcagctgggcaagcgtatcgatcgtctggcagccggttttcagtctcagggcgttgctgacggtgacggcgtcatgctgctcgcccacaaccacccgcagaccctgctggcctggctggcgctgcttcagtgcggcgcccgcattttgccggtgaaccctcagcttccccgtccgctgctggacgtcctcctgccgcagatgaccctgcgttttgcgctggtgcttaacggtgagtatgacggtctgcccgcgctggcattaagagagggcgaggggcaggggggcgtgacgtggcgggcagaacgactggcctcaatgacgctcacctccggctccaccggtttgccaaaagcggcggtgcacacctgtgccgcccaccttgccagcgcaaaaggggtgctggcgctgatgccttacggcgatagcgacgactggctgctctctctgccgctgtttcacgtctccggtcaggggattttgtggcgctggttacagggcggaggccgtctcaccgtacgcgaaaaacagccgcttgagcaggcgctacagggctgtacccacgcctcgctggtgccaacgcagctgtggcggctgcttaattcacaccatcccgtcgcgctgaaagccgtgctgctcggcggggcggaaatccccgttgcgctgaccgaacaggcgcgcgagcagaggatccgtacattctgcggctacggtctgaccgagttcgcctccaccgtctgcgccaaagaggccgacggcgcgccggacgtgggcagcgcgctgccgggcagagacgttcaggtggtaaacggtgaagtctggatccgggcggaaagcatggcggcgggctactggcgagacggcgcattattgccgctggtcaatgcgcagggctggttcgccacccgcgatcgcggcgagtggcatgacggacgcctgaccattctgggccgaatggacaatctctttttcagcggcggagaagggatccagccggaagcgctggagcgcgttatcgccacgcatccgcaggtaagccaggcgtttgtcgttccgctggatgatgctgagtacgggcaacgtccggtggcggtagtggaatgcgagccgggcacggatatcacgctgctgccggagtgggttcagggcaggctggcgcgctttgagcagccggtacactggctgacgctgccgtcagaactgaaaaatggcgggattaaaatctcccgccaggcgttaaagcagtgggtcaatgccctgttgaggggctaa

SEQ ID NO: 4100 - DNA, 513 bp, Enterobacter cloacae
gacagagaacagaccaatcaccacgacgataaactgcacgccgtcggagagatgaacgctgtcgaaggtaaaacgataaaccccggtgttggcatccacgccgacggtggccagactgaggccaatcaacgcagacaaaaacgacttcagcggattctgcgccatcatgctgccgagacaggcgatggcgaacaccatcagggcaaaatactcggccggaccaaacgccagcgaccactgggccagcgccggggcgaagaggatgatgccgccaatggcgatcagggagccaaagaacgagctgacggcggaaatagagagcgccacgccgccgcgtccctgctgcgccattggatagccatccagcgcggtcataatggcggcggcatcgccgggcacgttaagcagaatcgaggaaatacgccccccgtattcgcagccgatataaaccgtcgccagcaggatcagcgccgattccgcaggcaggtgcagcgcaaaggccagcggcagtaa

SEQ ID NO: 4101 - DNA, 729 bp, Enterobacter cloacae
aacaataacctttcatttccctttcactgcgacaccaactttacaggatgtgatatgcgtctcttactggcggaagataatcgtgagctggctcactggctggaaaaagcgctggtacaaaacggatttgccgtggattgcgtcaacgatggacgggcggccgatcatcttttgcagggagaaaactatgccgtcgcgatccttgatatcggcatgcccggtttcgacgggctggaggtggtgcatcggctgagaaagcgcgggcagacgttgcccgtgctgtttcttaccgcccgcagcaacgtggcagacagggttaaggggctgaatgccggggcggatgactacctgccgaaaccgttcgagctggaggagcttgatgcccgcctgcgtgcgctgctgcgccgcagtgaagggcgaacccaggagcgccagcggctgggagagctggagtacgatgatgaaggcttttttctgctgcgcgatgaacccctttccctcacgccgcgcgaactctctttgctgaaggtgctgatgcaccgtcggacccgtcccgtctcccggcaacagcttttcgaccaggtgttcagcctgaacgacgacgtcagccccgagagcatcgatctctatattcaccgcctgcgtaagaagctgaccggcagcggcgtgcggatcaccaccctccgggggctgggctacgtgctggagtgcggcgatgaagtgggttaa

SEQ ID NO: 4102 - DNA, 366 bp, Enterobacter cloacae
cggcgtaagcagccggtaatgattgagggtgatgacgtgctgctgggtgaactctgcgccaacctgctggagaacgcgatcaaatacacgccggagcagggcatcgtgacggtgtacctgcgcacggctaacgatgccgttgagctgagcgtggaggacagcggaccgggtattgctgaagaccagatctcccaggccatgctgccgtttcatcgtctggaaaacgtgggtgatgccgccgggtccggcattggcctggcgctggctaacgatattgcccgcctgcaccgcagccatcttcagctgatgcccagtgaaaatctgggtgggctgagcgtgaaaatgcgctttctgatgctgatataa

SEQ ID NO: 4103 - DNA, 672 bp, Enterobacter cloacae
atgccgatattatcaaatcgttacaaactaattgcctgccgcacgtggagtccattgatcacacaggcaggcaggttaaaatctcgcggtttttggacatctctgaataaattgtgcgggatcacgacaatgaaaaaagtggcattaatgggcttaagcggcctgatgtttgtttcagcagcggcaaacgcaatttccttcaacggctcggcgggacaagattatacccatctgggcttcggtcttggcacggacagcgcaggcctggcaatgaccggcggctggacgcataacgacgacgacggcgatgcggcaagcctgggcctcggcttcaacgtgccgttgggtcccttcctggcgaccgtcgggggtaaaggcatttacaccaacccgaacgacggcgacgaaggctacgcggcggcagtgggcggcggcttgcagtggaaaattggcgacagctttggcctgttcggtgagtactactactctcctgattccctctccagcggcatcgacagctatcaggaagctaacgccggcgcgcgctggaccatcatgcgtccaatcaccatcgaagcgggttatcgctatctgaacctggccggtaaagacggcaaccgcgacaacgccctggcagacggcccgtacgttggcgttagcgccggtttctaa

SEQ ID NO: 4104 - DNA, 1371 bp, Enterobacter cloacae
aaggccacggaggctgttatgctcagtatcttcaaacctgcgccgcatcgggcgcgactgccagaggcagagatcgatcctctctaccgccgtctgcgttggcaaatcttcctcgggatcttcttcgggtatgcggcgtactatcttgtacgtaaaaactttgcgctcgccatgccgtatctggtggatcagggcttctctcgcggcgacctgggcttcgcgctgtcggggatctccatcgcctacggtttttccaaattcatcatgggttccgtgtcggaccgctcgaatccgcgcgtgttcctgcccgccggtctgatcctcgcggcagcggtcatgctgttcatgggctttgtgccgtgggcgacgtccagcattgccatcatgttcgtgctgctgttcctctgcggctggttccaggggatggggtggccgccgtgcggacgtaccatggtgcactggtggtcgcagaaggagcgtggcggcattgtgtcggtgtggaactgcgcgcataacgtcgggggcgggcttccacctctgctgttcctgctggggatggcctggttcaacgactggcacgcggcgctctacatgcctgcctttggtgctattctggtggcgattattgccttcgccctgatgcgcgacacgccgcagtcctgcgggctgccgccaatcgaagagtacaaaaacgactatccggatgactacagcgagaagcacgaagaagagctgaccgcgaaacagatcttcatgaagtacgtgctgccgaacaagctgctgtggtacatcgcggtggcgaacgtgttcgtatacctgctgcgctacggcatccttgactggtccccgacctacctgaaagaggtgaagcacttcgcgctggataaatcctcctgggcgtacttcctgtatgaatatgccgggatcccgggcacgctgatttgcggctggatgtcggacaaagtgtttaaaggcaaccgcggcgcaacgggcgtgttctttatgaccctggtgaccatcgcgactgtcgtttactggcttaacccgccgggtaacccatcagtagacatggcctgtatgatcattatcggcttcctgatttacggcccggtgatgctgatcggtctgcacgcgcttgagctggcgccgaaaaaagcggcgggcacggcggcaggctttaccggtctgtttggctacctcggtggttccgtcgcggcgagcgctatcgtgggctacaccgttgacttcttcggctgggacggcggctttatggtgatgatcggcggcagcgtgctggcggttctgctgctggttgttgtgatgatcggcgagaaacgtcaccacgcggaagtgctggcgcgtcgtcaataa

SEQ ID NO: 4105 - DNA, 444 bp, Enterobacter cloacae
gcaatgagtatgtcaacatccacagaagtcatcgctcatcactgggcattcgcaatctttcttattgtagccattggcctgtgctgcctgatgttagtcggcggctggttcctgggcggtcgcgcccgcgcaaggcacaaaaacacacctttcgaatcaggtattgattcagtaggtaccgctcgcttacgcctgtctgccaagttttacctggtagccatgttcttcgtcatttttgacgtggaagcgctttacctcttcgcgtggtctacctccattcgcgaaagtggttgggtgggctttgtcgaggccgcaattttcattttagtgttactggccggtctggtttatctggtgcgtatcggcgcgctggactggacacctgtgcgttcacgccgtgaacacatcaacccggaaaacagtatctctaatcgtcagcagtaa

SEQ ID NO: 4106 - DNA, 690 bp, Enterobacter cloacae
cagcgaggcaataagatggattatacgctcacccgcatagatcctaacggtgagaatgaccgttaccccctgcaaaaacaggagatcgtaaccgaccccctggagcaagaagtcaacaaaagcgtgtacatgggcaagctcgaacatgccatgcacgacatggtcaactggggtcgtaagaactccatctggccatacaactttggcctttcttgctgctacgttgaaatggtgacgtcattcactgcggtgcatgacgttgcgcgttttggggccgaggtactgcgtgcttctccgcgtcaggctgacctgatggtggtggcagggacctgctttaccaagatggcaccggttattcagcgtctttatgaccagatgctggagccaaaatgggttatctccatgggcgcatgtgcaaactccggcggtatgtacgacatttattccgttgtgcagggcgttgataagttcattccggtggatgtgtatatcccgggttgcccgccgcgtccagaggcctatatgcaggcgctgatgctgctccaggagtcaattggtaaagaacgccgcccgctttcatgggttgttggcgatcagggtgtctatcgcgcgaacatgcagtctgagcgcgagcgtaaacgtggtgaacgtattgccgtcaccaacctgcgtacgcctgacgaaatttaa

SEQ ID NO: 4107 - DNA, 1356 bp, Enterobacter cloacae
cctgctggagcagtacaaatgaaaactgtaattcgtactgctgagacgcatccgctgacctggcgtctgcgtgatgacaaacagccggtatggctcgacgaatatcagagcaaaaacggctatgccggtgcgcgtaaagcccttggcggcatggcgccggacgacatcgttaacgcggtgaaagagtctggcctgaaaggccgcggtggtgcgggcttctccaccggtctgaagtggagcctgatgccgaaagatgaatccatgaacatccgttacctgctgtgtaacgccgatgaaatggagccgggtacctataaagaccgtctgctgatggaacagctgccgcacctgctggtggaaggcatgctgatctccgcgttcgcgctgaaagcgtaccgtggctacatcttcctgcgcggcgaatacatcgaagcggcggaaaacctgcgtcgcgcgattgccgaagccaccgaagcgggactgctgggtaaaaacatcctgggcaccgggtttgacttcgagctgttcgtgcacaccggtgccgggcgttatatctgcggtgaagaaaccgcgctgattaactccctggaaggccgccgcgcgaacccgcgctccaagccaccgttccctgcaagctccggcgtgtggggtaaaccgacctgcgtcaacaacgtcgaaaccctgtgtaacgtcccggcgatccttgcgaacggcgtggagtggtatcagggcatctcctcaagcaaagatgccggtaccaagctgatgggcttctccggtcgcgtgaagaaccctggcgtctgggagctgccgttcggcaccaccgcacgcgaaattcttgaagactacgccggcggcatgcgcgatggcctgaaattcaaagcctggcagccgggtggggcagggacggacttcctgaccgaagcccaccttgacctgccaatggagttcgaaagcattggtaaagcaggtagccgtctgggtaccgcgctggcgatggccgtcgaccacgagatcggcatggtatccctggtgcgtaacctggaagagttcttcgcccgcgagtcctgcggctggtgcacaccgtgccgtgatggtctgccgtggagcgtgaagatcctgcgtgctatcgaacgtggcgaaggccagcctggcgatatcgagacacttgagcaactgtgtcgattcttaggaccgggtaaaaccttctgtgcccacgcaccgggcgccgtcgagccgctgcaaagcgcgattaaatatttccgcgacgaattcgaagcaggcatcaagcagccgttcagcaatacccattcgatcaatggtattcagccgaacctgctgaaagcgcgctggtaa

SEQ ID NO: 4108 - DNA, 2760 bp, Enterobacter cloacae
cgctcggtttcggccgagccaactggaagcatgctaatggctacgattcatgtagacggcaaagaatacgaagtcaacggggcggacaacctgctggaagcttgtctgtctcttggcctcgatattccgtacttttgctggcatccggcgctgggcagcgtcggtgcttgccgccagtgtgcggtgaagcaatatcaaaacgcggaagacacgcgtggtcgcctggtgatgtcctgtatgacgccagccgccgaaggcacctttatttcgattgatgacgaagaagccaaacagttccgtgaaagcgtggtggagtggttgatgaccaaccacccgcacgactgtccggtgtgtgaggagggcggtaactgccaccttcaggatatgaccgtcatgaccggtcacagcttccgtcgctatcgctttaccaaacgtacccaccgtaaccaggatctggggccgttcatctctcacgaaatgaaccgctgcatcgcctgctaccgctgcgtgcgttactacaaagattatgcagacggtcaggatctgggcgtgtatggcgcgcatgacaacgtctacttcggtcgtccggaagacggtacgcttgaaagtgaattctccggtaacctggtagaaatctgtccgaccggcgtattcacggataaaacccactctgaacgttacaaccgtaaatgggacatgcagtttgcgccaagcatctgccagcagtgctcccttggctgtaacaccagcccgggtgaacgttacggcgaactgcgtcgtatcgaaaaccgttacaacggtaccgttaaccactacttcctctgcgaccgcggtcgtttcggctatggctatgtgaacctgaaagaccgtccgcgtcagccggttcagcgccgtggcgatgacgtcattaccctcaacgctgagcaggcgatgcagggcgcggcagatattctgcgtcagtcgaagaaagtgatcggcattggctccccgcgtgccagcatcgaaagcaacttcgcgctgcgcgagctggttggagcggaaaacttctacaccggtatcgcccagggcgagcaggaacgtctccagctggtgctgaaagtgctgcgtgaaggcggtgttcacacgcctgcgctgcgcgaaatcgaatcctatgatgcggttctggtgctcggggaagacctgacgcagaccggcgcacgcgcggccctggcggttcgtcaggcggtgaaaggcaaagcacgtgaaatggcagcggcgcagaaagtggctgactggcagattgcggccattctcaacattggtcagcgcgcgaagcatcctctgtttgtgactaacgtcgacaacacccgtctggacgatattgcggcgtggacctactgcgcgccggttgaagatcaggcgcgtcttggctttgccattgcccacgcgctggacaacaactcaccggccgttgagctggatcgcgacctgcaaaacaaggtcgacgtgattgttcaggcgctggcgggggcgaagaaacctctgattatttccggtaccaacgccggtagcgctgaaatcattcaggccgcagcgaacgttgccaaagccctgaagggacgcggcgctgacgttggtgtgaccatgattgcccgtgcggtgaacagcatcggtctgggtatgattggcggcggctcgctggaagacgcgttaagcgaactggaatccggtgccgctgacgccgttgtggtgctggaaaatgacctgcatcgccacgcttccgccgcgcgtgttgacgccgcgctctccagagcgccgctggtgatggttatcgaccatcagcgcaccgcgatcatggacaaagcgcatctcgtactctctgcggcaagcttcgcagaaagtgacgggacggtgatcaacaacgaaggccgcgcacagcgtttcttccaggtttatgacccggcctactacgacagcaacaccgtgatgctggaaagctggcgctggctgcactctctgcacagcaccgtgcagagccgtgaagtggactggacgcagctcgaccacgttatcgacgcggttgttgagaaactgcctcagctggcgggtattaaagatgccgcgccggacgcaagcttccgcattcgcggccagaaactggcgcgtgagccgcaccgctacagcggtcgtaccgcgatgcgcgccaacatcagcgtgcacgaaccgcgtcagccgcaggataaagacaccatgttcgccttctcgatggaagggaacaaccagccgtctgcgccgcgttcgcaaatcccgtttgcatgggcaccgggctggaactccccgcaggcatggaacaaattccaggctgaagtgggcggtcacctgcgccacggcgatccaggcgtgcgtctgattgaagcctccgaaaccggtctggacttcttcaccaccgttccggcgagcttccaggcgcaggaaggtcactggcgcattgcaccgtactaccatctgttcggtagcgacgaaatgtcccagcgttctccggtattcccgcagcgtatgccgcagccgtacatcaagctcaacccggcggatgccgcgaagcttggcgttaacgcgggtgcgaacattgcctttagctacgacggccagacaatcagcctgccgctgattatttctgaacgcctgtcagcagggcaggtgggtctgccgatgggtatgcctggcatcgcgccggtcctggcgggtgcgcatcttgataaccttcaggaggcaaaagcatga

SEQ ID NO: 4109 - DNA, 1851 bp, Enterobacter cloacae
gttgcgtggatgaacatgcttgccttaaccattatttttccgctgattggcttcgtgctgctggcgttttctcgcggccgctggtctgagaatctgtctgccaccgtgggcattggctctatcggcctggctgcgctggtcacagcgtatgcgggtatcgacttctttaacaatggacgtcaggcctacagcgtaccgctgtggaactggatgtcggtcggtaacttcaacatcggtttcaacctggtgctggatggtctgtctctgaccatgctctccgtggtcaccggcgtcggcttcctgatccacatgttcgcctcctggtacatgcgcggtgaagagggatactcccgcttcttcgcctacaccaacctgtttatcgccagcatggtggttctggtgctggccgataacctgctgctgatgtatctgggctgggaaggcgtgggtctgtgctcttacctgctgatcggtttctactacaccgatccgaagaatggcgcagcggccatgaaagcgttcgtcgtgacccgcgtgggtgacgtcttcctcgctttcgcgctgttcattctctacaacgaactgggcacgctgaacttccgcgaaatggtggaactggcgccggcgcacttcgaagcaggcaacaacatgctgtggtgggcaacgctgatgctgctgggtggcgccgtgggtaaatccgcgcagctgccgttgcagacatggctggccgacgcgatggcgggtccaacccctgtctccgcgctgatccacgccgcgaccatggttaccgccggtgtctacctgattgcgcgtacccatggcctgttcctgatgaccccggaaattctgcatctggtgggtattgtcggtgcggttacgctggtgctggcaggctttgccgcgctggtgcagaccgacatcaaacgcgttctcgcgtactccaccatgagccagattggttacatgttcctggcgctgggcgttcaggcgtgggacgcagccattttccacctgatgacgcacgcgttctttaaagcgctgctgttcctctcatccggttcggtgatcctggcctgccaccacgagcagaacatcttcaaaatgggcggactgcgtaagtccatcccgctggtctatgtctgcttcctggtgggcggcgcggcgctggcggcactgccgctgattaccgcgggcttcttcagtaaggacgaaatccttgcgggcgccatggcgaatggtcatatcaatctgatggttgcgggtctggtcggtgcgttcatgacctccctgtacaccttccgtatgattttcatcgtcttccacggtaaagaacaaattcacgctcacgcagggaaggggattacccaccacctgccgctgattgttctgctggtcctgtccaccttcgttggcgcgatgattgtgccaccgttgcagggtgtactgccggcaacaaccgagcttgagcacggtcgcgttctgacgcttgaaatcacctccggcgtagtggctatagcgggcatcctgattgccgcatggctgtggctgggcaaacgcacgctggtaactgccgttgccaacagcgcgccgggccgtctgctgggcacctggtggtacaacgcgtggggcttcgactggctgtacgacatgatcttcgtgaagccgttcctgggcattgcgtggctgctgaagcgcgatccactgaacagcctgatgaatatcccggcgatcctctctcgctttgcaggtaaaggcctgctgtttagcgagaacggttatctgcgctggtatgtggcgtccatgagcatcggtgcggttgtcgtgctggcgctgctgatggtgttgcgttga

SEQ ID NO: 4110 - DNA, 1536 bp, Enterobacter cloacae
atcgccatgttactaccctggctaatattaattcccttcatcggcggcttcctgtgctggcagaccgaacgctttggcgtgaagatgccgcgctggatcgcgctgatcaccatgggattgacgctcgcgcttggcctgcaactgtggttgcagggtggctactcactgacccagtctgcgggccttccgcagtggcagtctgagtttatcctgccgtggatcccacgtttcggtatcacgatccacctcgcgattgacggtctgtcgctgctgatggtggtgctgaccggtctgctcggcgttctggcggtactttgctcctggcgagaaatcgaaaaataccagggcttcttccacctgaacctgatgtggatcctgggcggcgtgatcggcgtgttcctggccatcgacatgttcctgttcttcttcttctgggagatgatgctggtgccgatgtacttcctgatcgcgctgtggggtcacaaggcatccgacggtaaaacgcgtatcacggcggccaccaagttcttcatctatacccaggcgagtggtctggtgatgctgattgccatcctggcgctggtgtttgtgcattacaacgcgaccggtgtctggaccttcaactacgaagacctgctgaagaccccgatgtcccacggcgtggaatacctgctgatgctgggcttctttatcgccttcgcggttaaaatgccggtggttccgctgcatggctggctgccagacgcgcactctcaggcgccaacggcaggttccgttgacctggcgggcatcttgctgaaaaccgcggcttacggtctgctgcgtttctccctgccgctgttcccgaacgcctccgcagagttcgcgccgattgccatgtggctgggcgtgatcggtatcttctacggtgcatggatggccttcacgcagtacgacatcaaacgtctgattgcttacacctccgtttcccacatgggcttcgtgctgattgccatctacaccggcagccagctggcgtaccagggcgcggttatccagatgattgcgcacggcctgtccgctgccggtctcttcatcctgtgtggtcagctgtacgaacgtctccatacccgcgacatgcgtatgatgggcggtctgtggggcaaaatgaaatggctgccggcgctctccatgttcttcgcggtggcgactctgggtatgccgggtaccggtaacttcgtcggcgagtttatgatcctgttcggcagcttcaacgtggtaccgacgatcaccgtcatctccacctttggtctggtgtttgcctccgtgtactcgctggcgatgctgcaccgcgcttacttcggtaaagcgaagagtgaaattgctgcacaagaattgccggggatgtcgctgcgagagctgttcatcatcctgctgctggtcgtactgctggtgctgttgggcttctatccgcagccgattctggatacctcgcactccgcgatgggtaacatccagcagtggtttgttaattctgcttctactacaaggccgtaa

SEQ ID NO: 4111 - DNA, 1464 bp, Enterobacter cloacae
ttcgccatgacaataactccacaacaactgatcgcgctgctaccgctgctgatcgtcggattgacggtggtggttgtgatgctctccattgcgtggcgacgcaatcacttcctgaatgcgaccctgtccgttctgggtctgaacgctgcgttagtctccctctggtttgttggccaggcgggagcgatggacgtcacgccgctgatgcgcgttgacggctacgccatgctctacaccggtctggtgctgctggcgagcctggcaacctgtacctttgcgtacccgtggctcgaaggatacaacgacaacaaagaagagttttacctgctggtactgattgctgcactgggcggcattctgctggcgaacgcgaaccacatggccgcgctgttccttggtattgagttgatctcactgccgctgttcggcctgattggttacgccttccgtcagaagcgctctctggaagcggctatcaagtacaccattctgtctgctgccgcgtcgtcgttcctgctgttcggtatcgcgctgctgtatgcacagacgggtaacctctccttcctggccatcggtaagagcctcggcgacggcatgatgcatgagccgctgctgctggcgggtctgggcatgatgattgttggccttggctttaaactctctctggttccgttccacctgtggacgccagacgtctaccagggtgcgcctgcaccggtctctaccttcctggcgacggcgagtaaaatcgctatcttcggcgtggttatgcgtctgttcctgtacgccccggtgggtgacagcgaagcggttcgcgtggtgctgggcattatcgcgttcgtttctatcatcttcggtaacctgatggcgctgagccagaccaacatcaagcgtctgctgggctactcctctatctcccatctgggttacctgctggtggcgctgattgcgctgcaaagcggtgagatgtcgatggaaaccgtgggtgtgtatctggccggttacctgttcagcagcctcggcgcgttcggcgtggtgagcctgatgtccagcccgtaccgtggcccggatgcagattccctgttctcctaccgtggactgttctggcaccgtccgattctgtctgcggtaatgaccgtgatgatgctctctctggcgggtatcccgatgacgctgggctttatcggtaagttctacgtgctggccgtcggtgtgcaggcgggtctgtggtggctgacggcgggtgtcgttatcggctccgcgattggtctctactactacctgcgcgtagcggtgagcctgtacctgagcgcgcctcagcagctcaaccgcgatgcgccgtccaactggcagtacagcgccggcggtatcgtggtgctaatctccgcgctgctggtgctgatcttcggtatctatccgcagccgctgattgatatcgtgcagcgagcgatgccgctgatgtaa

SEQ ID NO: 4112 - DNA, 339 bp, Enterobacter cloacae
ttaccggactggtgtactaacatggagaaaaatatgtcatttcaatcctgggatacccgagtcgacgacgacctgacgctgctaagcgaaacgctggaagaagtgctgcgctcttcaggcgatcctgccgatcagaagtacattgagctcaaagcccgcgccgagcaggcgctgcatgacgtgaaaaaccgcgtcagtaacgcctccgacaattattactaccgcgccaaacaggcggtttatcgtgccgacgattatgtgcatgaaaaaccgtggcagggcattggggtcggtgcggccgtagggctggtgctgggtctgctgttagcccgtcgttaa

SEQ ID NO: 4113 - DNA, 1767 bp, Enterobacter cloacae
gggattaatactgattcgtgcaatcccgattcatatcaaaattctgactttttctattatttatactgtgtcgcattcttgatactggacaatctcatgtcagtaagttcttttaaccgacgctgggcggcggtgatccttgaagccctgacccgtcatggtgtcaggcatgtgtgtattgccccgggctctcgctccacgccgctcacccttgctgccgcggaaaaccgggcttttattcaccacacccattttgatgagcgtggtctgggccatctggcgctcgggctggcgaaagtcagtaaagcgcccgtggcggtgatcgtcacctccggcacggcggtggcgaacctctatccggcgctgatagaagcgggattaaccggcgaaaagctgattttactcaccgccgaccgtcccccggaacttatcgactgcggcgctaaccaggcgattcgtcagcctggcatttttgcctcgcatccttcacagacggtctcgttgccgcgccccacccaggacattcccgccagctggctggtctcaaccctcgaccacgccatgaacgcactgcgcagcggcgggctacacattaactgcccgtttgccgagccgctgtacggtgaaatgaacgatactggcctcgtctggcaacagcagctgggagactggtgggagagcgaaaaaccctggctgcgcgagcagacgcatctggaaagcgctaaacagcgcgactggttcttctggcgtcagaagcgcggcgtggtgatagccgggcggatgagtgcggcggaaggtaagcttgcggcggagtgggcacaaacgcttggctggccgctgattggtgacgtgctttcccagacgggccagccgctgccctgcgccgacctctggctggggaacgcgaaagcggtcaccgagctggcgcaggcgcagattgtcgtccagctgggatcgagcctgacggggaagcgtctgctccagtggcaggccacctgtacgcctgaagagtactggctggtggacccgctcgaaggacgccttgacccggcgcaccatcgtggccgccgcctggtgagcgatattaacagctggctggaattgcatccggcggaaaaacgcaaaccctgggcggtggagatcccggcgctgtcacgtcaggcgtgggaactcaccaaagcgcagtgcgaggcgttcagtgaagccgggctggcgcaccgtatccgcaaatatcttcccgagcagggacaactttttgtcggtaacagcctggtggtgcgcctgattgacgccttttcgcagctgccggcgggttatccggtgtacagcaaccggggcgcgagcggcattgacggcctgatctccaccgccgctggcgtacagagggccagcgcgaaatccacgctggcgattgtgggggatctctcagccctctacgatctcaacgcgctggcgctcctgcgtcaggcgtcggccccgttcgtgctgattattgtgaacaataacggcgggcagattttctcgttgctgccgacgccgcaaagcgagcgtgagcgcttctatctgatgccgcaaaacgtgcagttcgaacacgccgccgccatgttcagcctgaagtaccatcgcccggaaaactgggacgcgctggagacggcgctgaacaccgcctggcggcagcctggcgcgacgctcattgagctggtggtaaacgatgctgacggcgcgcagaagctgcaacatctgcttgcgcaggtgagtcacctgtga

SEQ ID NO: 4114 - DNA, 1068 bp, Enterobacter cloacae
cgccaccatgctgttctatatgaccgaagagggtcaggaagggcgcaacgcgttcaacgaaaaacgccagccagacttcagcaaatacaaacggaacccgtaatgcgtcgcgtgcaggtttaccgctggcagataccgatggacgcgggcgtggtgctgcgtgaacggcggttaaaaacccgtgacggctttttcgtgcacctccgggagggcgagcgggaagggtggggcgagatagccccacttccgggctttagcctggaaacgctcgacgaggcgcaggccgcgctgatggcctggacgcacgcctggcgcgagggagaagatccggcgctgccggacgttccttccgtcgcgttcggcatcagctgcgcgctggcagagctggacggcagtttgccggaggcggcgaactatcgcgccgcgccgctctgtactggcgatccggatgaacttttcgcgctcctttccgcgatgcctggcgagaaggtggcgaaaataaaggtcggcctgtacgaagcggtgcgcgacgggatggtggttaatctgttactggaagccattcccgatctgcacctgcgcctggacgccaaccgcgcctggacaccgctcagggcgcagcagtttgcgaagtacgtcaacccggcgtaccgcagccgcatcgcgtttctcgaagagccgtgcaaaacgcgcgacgactctcgcgccttcgcccgggaaaccggcatcgccatcgcctgggatgagagcctgcgcgaagccgatttcgcgtttgccgccgagccgggcgtcagggccgtggtgattaagccaacgctgaccggcagcctcgacaaggtgcgcgagcaggttgcggcggcccatgccgcagggctgacggcggtgatcagttcatccatcgaatccagcctcggcctgacgcagctggcgcgcatcgctgcatggttaacgccggacaccgttcccggtctcgatacgctaaacctgatgcaggcccagctgattcgccagtggcctggcagcaccttgccgtgcctcgacgtcggggcgctggagccattgcgatga

SEQ ID NO: 4115 - DNA, 1122 bp, Enterobacter cloacae
ccggcagcggcgtgcggatcaccaccctccgggggctgggctacgtgctggagtgcggcgatgaagtgggttaagccgcagtcgctttacctgcaacttttgctttttctgggtttgccgctgctgctgttatgggggctgtcagcctttaacagctacgttagcgcgctacaggcggcgacgcaggcctatgaccgcacgctgttatcctcggcgcgcacggtgtcagagcggctggtggtgcacaacggcaagctccaggtgaacgtgccgtgggtcgtgctcgacagcttcgagctgaacatgaacgatcgcctctactacaaggtcgtggaccctgacgggcggacgatctccggctatgacgatctgccgaatatgcccccctccacgtcgcgcacctcccactatccggcgctggcgtggttttatcataccgagtatcgcgggcaggcgatccgcgtggcgaagctgctccagccggttaacgaggacagtgtgttcggcatggcggaaatctacgtcgccgaaacgttgcagtcgcggcgctatctggccactcagctgctgttttcctcgctcgtgtcgcaggggctgctggtgctgctgacgctggtcctgaccgcgtggctgctgcgtcgcgtgctgcgcccgatgcggcagctctcttcgctgatggtgcgccgtgagcccgggctgctggctccgctgccggagctgctgccctggtcggaaacgcggctgctgattgtggcatttaaccgctatatcgacaggttacgcggcgtgctttcgcgacaggcgcgctttaatgctgacgcctcacaccagctcaaaacgccgctggcggtgctgaaaacccaggtatcggttgccctgacgcgtaacgatccggccctgtggcaggagagcttacgggcgatgaacgtcacgctggataacaccatcgtgctgacagaaaggctgttgcagctttcagcggtgaagcgaaaagagcagggggagcgacagtttgcccctgtcgatctggtgcaggtggtgcaaaactgctgcttttcccggctggcgcaggcgcgcagcaagggtatcgatctcggttatgacggcgtaagcagccggtaa

SEQ ID NO: 4116 - DNA, 1221 bp, Enterobacter cloacae
ccattgaaatgggagaacacaatgataaacgtggaaatgttatccactggcgacgaagtgcttcatgggcaaatcattgataccaatgccgcctggctcgccgatctcttctttgagcaaggattaccgttaacgcgccgcaacaccgtaggtgacaaccttgagtcgctggtcaacgttctgcgcgagcgcagcgaacgctgcgacgtgctgattgtgaacggcgggctgggacctaccagcgacgatctcagcgcgctggccgccgccacggccaaaggcgaaggcctggtcctgcacgaggcgtggctggcgcagatggagcgctttttctccgagcgtggccgcgtgatggcccccagcaaccgcaagcaggctgaaattcccgccagcgcggaactgattgataacccggtcggcaccgcctgcgggtttgccgttcagttgaaccgctgcctgatgttcttcactccgggcgtgccgtcggaatttaaagtgatggtcgagcagcagatcctgccgcgcctgcgcgcgcgctttacgctgcctgaaccgccgctgtgcctgcgtctgaccacctttggtcgctcggaaagcgatctcgctcagagcctcgatcacctgcaactgcctcccggcgtgtcgatgggctatcgctcctccatgccgattattgaactgaagctgaccggaccggcgtcagagaaagccgctatgctggcactgtggccggaagtgcggcgcgtcgccggggaaagcctgattttcgaaggcacgaaagggctgccggcgcagatcgcagcgcatttgcagtcccgccagctgagcgtgacgttaagcgagcagtttaccggtgggcttctggcgcttcagcttacccgggcgggtgcgccgctgctggccagtgaagtggtgccgttccagcaggagacgctggcgcagacggcgcgctgggcatccgagcgcagagtgaagcatttcgccggactggcgctgtttgtgggcgggctggatgaggagcacctcaactttgccctggcaacgccggaaggaacgcacgccctgcgcgtcaggatgagcattacccgccacagcctggccgtacgtcaggaggtgtgcgcgatgatggcgctgaacatgctgcgccgctggctgaacgggaaagaggtcgccagtgagcacggctggatcaacgtcgtggaatcgctgttcgtagagtga

SEQ ID NO: 4117 - DNA, 2637 bp, Enterobacter cloacae
atgagcgaccttgcgagagaaattacaccggttaacatcgaggaagagctgaaaagctcctatctggactatgcgatgtcggtcattgttggccgtgcgctgccggacgtccgcgatggcctgaagccggtacaccgtcgcgtactatacgccatgaacgtattgggcaatgactggaataaagcctacaaaaaatctgcccgtgtcgttggtgacgtaatcggtaaataccatcctcatggtgatatcgcggtgtacggcaccattgtccgtatggcgcagcccttctcgctgcgttacatgctggtagatggtcagggtaactttggttctatcgacggcgactccgccgcggcaatgcgttatacggaaatccgtctggcgaagattgcccatgagctgatggctgacctggaaaaagagacggttgatttcgttgataactacgacggcacggaaaaaattcctgacgtcatgccaacgaagatcccaaacctgctggtgaacggttcgtccggtatcgccgtcggtatggcaaccaacattccgccgcacaatatcacggaagtgatcaacggctgcctggcctacattgacgatgaagacatcagcattgaagggctgatggaacacatcccgggcccggacttcccgacggcggcaatcatcaatggccgtcgcggtattgaagaagcgtaccgtaccggtcgcggcaagatttacatccgtgcccgcgccgaagtggaagcggacgccaaaaccggccgtgaaaccattattgttcacgagatcccgtatcaggtgaacaaagcgcgactgattgaaaaaatcgccgagctggtaaaagaaaaacgcgttgaaggcatcagcgcgctgcgtgacgagtctgacaaagacggtatgcgcatcgtgattgaaatcaagcgcgacgcggtgggtgaagttgtgttgaacaacctttactcccagactcagcttcaggtctccttcggtatcaacatggttgcgctgcaccatggccagccgaagatcatgaacctgaaagagatcctgagcgcgttcgtgcgtcaccgccgtgaagtggtgactcgccgtaccatcttcgaactgcgcaaagcgcgcgaccgtgcccatatccttgaagcactggccgttgcgctggcgaacatcgacccgatcatcgagctgatccgccgtgcgccgacgccagcagaagcgaaggcgtcgctggttgcgcgttcatgggatctgggcaacgtggcggcgatgctggaacgtgccggcgatgacgctgcgcgtcctgagtggctggagccggaattcggcgtgcgtgacggtcagtactacctgactgaacagcaggcccaggcgattctggatctgcgtttgcagaaactgaccggccttgagcatgaaaaactgctcgacgagtacaaagagctgctggagcagattgccgagctgctgcatatcctgggtagcgcagagcgcctgatggaagtgatccgtgaagagctggagctggttcgcgatcagttcggcgatgagcgtcgcaccgaaatcacggccaacagctctgatatcaacattgaagatctgatcaaccgcgaagacgtggtagtgacgctgtctcaccagggctacgtgaagtatcagccgttgaccgactacgaagctcagcgtcggggcggtaaaggcaaatctgcggcgcgtattaaagaagaagacttcattgatcgtctgctggtggcgaacacccatgacacgatcctctgcttctccagccggggccgtctgtactggatgaaagtctatcagctgccggaagcaagccgtggcgcgcgtggacgtccaatcgtcaacctgctgccgctggaagcgaacgaacgtatcaccgccatactgccggtacgcgagtacgaagagggcgtgaacgtctttatggcgaccgcgagcggtaccgtgaagaaaaccgcactgaccgagttcagccgtccacgttctgccgggattatcgcggtgaacctgaacgaaggcgacgaactgatcggcgtggatctgacgtccggttctgatgaagtgatgctcttctctgccgccggtaaagtggtgcgctttaaagagaacgccgtgcgcgcaatgggtcgtacggcgaccggcgtgcgtggtatcaagctggcgggtgaagactccgttgtttccctgatcgttcctcgtggcgaaggcgcaatcctgaccgtcacccagaacggctacggtaaacgtacggcggaaagtgaatacccaaccaagtcacgcggcacgcagggcgttatctccatcaaagtgaccgagcgcaacggttccgttgttggcgcggtgcaggtggacgacgcggaccagatcatgatgatcaccgatgccggtacgctggtgcgtacccgcgtgtcagagatcagcgtggtaggtcgtaacacccagggcgttatcctcatccgcactgcggaagatgaaaacgtcgtcggtctgcaacgcgttgctgagccggtagatgacgaagagctcgactctatcgacggcagcgtcgcggaaggggatgatgaaatcgccccggaagcggacatcgatgatgaagcagcggatgacgctgacgagtaa

SEQ ID NO: 4118 - DNA, 2871 bp, Enterobacter cloacae
ccccgacggcggagcctcgcccctttgaaatacctcgtctcctttcgtaccacgttaaaagtctcccgctatctgtttcgggcgcttgcgctactgctatggttgctggtggcactgctctcggtgttttacatcgttaacgcgttacaccagaaagaagcggagatccgccaggagtttaatttgagctcggatcaggctcagcgctatatccagcgtacgtctgacgtgatgaaagagcttaagtatattgctgagaatcgactgacggcggagaacggcattcttgccatccgcggtcgggatgaaaaaaccgaagtgcctgatttcgaaccgctcttcccggattccgattgttccgccatgggcaaagcctggcgtggttcactggagtccctgtcatggtttatgcgctactggcgcgataacttctcggccgcttacgatctgaaccgcgtctatctgattagcaacgaaaatctctgcatggcagatttcggcctgcgggatatgcccgtcgaacgtgaagacgcgctgaaaagtctgcatgagcgcatagtgaaatatcgcaatgcgcctcaggaagagcgcgggaacaacatcttctggataagccaggggccgcgcatgggggtcggctatttctatgccctgactccggtttacctcggaaaccgcctgcaagcgctgctggggattgaacaaaccatccgcatggaaaacttcttcacgccgggcagtctgccgatgggcgtgaccattctggatgaaaacggccatccgctcatctcccttaccgggcctgaaaaccgcctgaaggtggaacccagctggatgcaggagcggtcatggtttggctatacctccgggttccgcgagctggtgctcaagaaaagtttaccgccatcgtcgctgagcattgtctactcgctgccggtggataaggtgctggagcgcattcgcatcctgatccttaacgccattttgttgaacatcgcggtaggtgtcgcgctgtttatgctggcgagaatgtatgagcggcggatctttattccggcggaggcggatgctcagcgtctggaggagcacgagcagtttaaccgtaaaattgtcgcctcggcaccggtagggatctgcatcctgcgtactcaggacgggacaaatatcctcagtaacgagcttgcccataactacctgaacatgctcacgcatgaagaccgccagcggttaacgcagatcatctgtgggcaacaggttaactttgtggatgtgctgaccagcacccacaccaacctgcaaatcagcttcgtccattctcgctaccgcaatgaaaacgtggccatttgcgtgctggtggacgtctctgcgcgcgtgaaaatggaagagtcgttgcaggatatggcgcaggcggcggagcaggccagtcagtcgaaatcgatgttcctcgcgaccgtcagtcatgagctgcgtacgccgctgtacggtattatcggtaacctcgatctgctccagaccaaagagctgccgaaaggggtcgaccggctggtgacggccatgaacaactcgtccagcctgctgctgaaaatcatcagcgatattctcgacttctctaaaattgaatccgagcagttgaaaatagagccgcgcgagttctccccgcgcgaggtgatgaaccatatctgcgccaactatctgccgctggtggtgcgtaaacagcttgggctgtactgctttatcgagccggatgtgcccctgacgctgcatggcgatccgatgcgtctgcaacaggtcatctcaaacctgctgagcaacgccatcaaattcaccgatatcggctgtattgtgctgcacgtctgtcgggcaggggagtacctgaccattcgcgtgcgcgacacgggggtggggattccggcgaaagaagttgttcgcctgttcgatccgttcttccaggtgggaaccggcgtccagcgtaatttccaggggaccgggcttggtctggctatttgcgagaagcttatcagcatgatggacggggatatctctgtcgatactgagccgggtatgggcagccagttcaccattcgtattccgctctattcggcgcattatccggcgaaaaccacggtcgacggcctgagcgataagcactgctggctggcggtgcacaacgcctccttacatgatttcctgacctcaatgctgaccagcagcggcgtgcgggtttcgcgctacgaaggccagacgccgggcgcggatgacatgctgatcaccgacgttgagccggagcaggcatgggcggggcgcggcgtggtgatgttctgccgccgtcatatcggtattccgcttgagcgttcgcctggggtatgggtgcacagcgtggcgacaccgcacgagctgctgggcttgctggcgcgcatttacagcgtgcagcttgaagacagcgacggcgccaccgtgctggcttcccctgatgagctggcgtcggtgaatgacgatatgatgattctggtcgtcgacgatcatccgattaaccgtcgtctgctcgcagaccagcttggctctctgggctatcagtgtaaaacggccaatgatggcgtggatgccctgaatgtcttaagtaagaaccatattgatattgtgctcagcgatgtgaacatgcctaacatggacggctaccgtctgacgcagcgtatccgacagctggggctgacgctgccggtggtgggggtgacagccaacgcgctggcggaggagaagcagcgctgtctggagtcgggaatggacagctgcctgtcgaagccggtcacgctggatgtactgaagcagacgctatccgtctatgcggagcgggtacgaaaagcgagacaataa

SEQ ID NO: 4119 - DNA, 537 bp, Enterobacter cloacae
tatcgattttgttatgtcagatgtggaccgctaattatgcacgagaatcaacaaccacaaaccgaggcttttgagctgagtgaagcagagcgtgccgccattgagcacgagatgcaccactacgaagacccgcgtgcggcgtccattgaagcgctgaaaatcgtacagaaacagcgtggttgggtgccggatggggcgatctatgcgatcgcagaagtgctgggcattccggcaagtgacgtagaaggcgtagccacgttctacagccagatcttccgtcagccggtaggccgccatgtgatccgctactgtgacagcgtggtctgccacatcaccggttatcagggcattcaggctgcgattgagaagaaactcaatattaagcctggccagaccacgttcgacggacgttttactctgctgccaacctgctgcctgggtaactgcgacaaggggccgaccatgatgattgatgaggacactcacagccatctgacgccggaagcgattcctgacctgctggagcagtacaaatga

SEQ ID NO: 4120 - DNA, 423 bp, Enterobacter cloacae
tgctggaaagctggcgctggctgcactctctgcacagcaccgtgcagagccgtgaagtggactggacgcagctcgaccacgttatcgacgcggttgttgagaaactgcctcagctggcgggtattaaagatgccgcgccggacgcaagcttccgcattcgcggccagaaactggcgcgtgagccgcaccgctacagcggtcgtaccgcgatgcgcgccaacatcagcgtgcacgaaccgcgtcagccgcaggataaagacaccatgttcgccttctcgatggaagggaacaaccagccgtctgcgccgcgttcgcaaatcccgtttgcatgggcaccgggctggaactccccgcaggcatggaacaaattccaggctgaagtgggcggtcacctgcgccacggcgatccaggcgtgcgtctga

SEQ ID NO: 4121 - DNA, 651 bp, Enterobacter cloacae
ccaggtaatgtccttcggctggaaagtgtgcctgccgctgacgctcgtcaacttgttggtaacggcggctgtcattctctggcagcagccataaggggctttgagatcatgaccttaaaagaattattggtaggtttcggcacccaggtacgcagtatctggatgatcggcctgcatgcgtttgccaaacgcgaaacccggatgtacccggaagagccggtatatctgccgccgcgctaccgtggacgtatcgtgctgacgcgcgacccggacggttccgagcgttgcgttgcctgtaacctgtgtgcggtagcgtgtccggtgggctgtatctctctgcaaaaagcagagacggtagacggccgctggtatcctgagttcttccgcatcaacttctcacgctgcattttctgcggtctgtgtgaagaagcgtgcccaaccacggcgattcagctgactccagactttgagctgggtgagtacaagcgtcaggacctggtgtacgagaaagaggatctgctgatttccggtccgggcaaatacccggaatataacttctaccggatggcgggtatggcaatcgacggcaaagataagggcgaagcagagaacgaagccaagcctatcgacgtcaagagcctgttaccgtaa

SEQ ID NO: 4122 - DNA, 336 bp, Enterobacter cloacae
cgaccgcgcgaaaagaaaaacggaggaacgcgcatgatccccttaacacatggactgatcctcgctgcgattttattcgttctgggcttaaccggtctggttatccgccgcaatctgctgtttatgctgatcggtctggaaatcatgatcaacgcttccgcgctggcctttgtggtcgccggcagctactggggccagaccgatggtcaggtgatgtacattctcgccatcagcctcgcggctgctgaagcgagtattggcctggcgctgttgctacagctccatcgtcgccgccagaacctgaacatcgattcagtaagtgagttgcgtggatga

SEQ ID NO: 4123 - DNA, 498 bp, Enterobacter cloacae
tataacgtgatgaaccccaggaaggagaaacacatgatccagtggcaagatctacaccacagcgaactgaccgtgcagtcactctacgccctgctcaaactgcgctgtgaagtcttcgtggttgaacaaacctgcccgtatcaggatatcgacggcgatgacctggtcggcgagaaccggcacatcctcggctggcgcgataacgagctggtggcgtatgcgaggattctgaaaagcgaagaggaatttgaccctgtcgtcattgggcgcgtcattatcagtggccgcgcgcgcggtgaaaagctgggctatcagctgatggaaaaaacgctggacgcatgccagaaacagtggccggacaaggcgttatacctgggcgcgcaggcgcatttgcaatcattctatggccattttggttttaccccggtcacggacatttacgacgaagacggcatcccacacatcggcatggcacgcgaagcgaaacaggcgcaatag

SEQ ID NO: 4124 - DNA, 207 bp, Enterobacter cloacae
gcgatattaacagctggctggaattgcatccggcggaaaaacgcaaaccctgggcggtggagatcccggcgctgtcacgtcaggcgtgggaactcaccaaagcgcagtgcgaggcgttcagtgaagccgggctggcgcaccgtatccgcaaatatcttcccgagcagggacaactttttgtcggtaacagcctggtggtgcgcctga

SEQ ID NO: 4125 - DNA, 969 bp, Enterobacter cloacae
cgccacgcgtcatgctatccctcacgccggacacaacgcccaccgggacaacccggaagctgttgccgcgagtctggctcagatactgcgttatcgaacaaaggacacgctatgatctatcctgatgaacacatgctttacgcgccggttgaatggcaggactgctccgaaggctacaccgacattcgttaccacaaatccgccgatggtatcgccaaaatcaccatcaaccgtccacaggtgcgcaacgcgtttcgtccgttgaccgtaaaagagatgatccaggcgctggcggatgcccgctatgacgacactgtcggcgtcatcatcctcaccggggaaggggagaaagccttctgctccggcggcgatcagaaagtccgcggtgactacggcggataccaggatgatgcgggcacgcaccacctgaacgtgctggatttccagcgccagatccgcacctgtccaaaaccggtggtcgcgatggtggcagggtattccatcggcggcggtcacgtgctgcacatgatgtgtgacctgacgatcgcggcggaaaatgccattttcggtcagactggcccgaaagtcggctctttcgacggcggctggggcgcgtcctatatggcgcgcattgtcggccagaaaaaagcccgcgaaatctggttcctgtgccgtcagtacaatgcgcaggaagcgctggatatggggctggttaacaccgtggtgccgatcgccgatctggaaaaagagaccgtgcgctggtgtcgcgaaatgctgcaaaacagcccaatggcgctgcgctgcctgaaagcggccctcaacgccgactgtgacggtcaggcgggccttcaggagctggcaggtaacgccaccatgctgttctatatgaccgaagagggtcaggaagggcgcaacgcgttcaacgaaaaacgccagccagacttcagcaaatacaaacggaacccgtaa

SEQ ID NO: 4126 - DNA, 1191 bp, Enterobacter cloacae
cttcttcggctgggacggcggctttatggtgatgatcggcggcagcgtgctggcggttctgctgctggttgttgtgatgatcggcgagaaacgtcaccacgcggaagtgctggcgcgtcgtcaataaggagcattgcgatgaaattaactccattaaccaccggcctgctgctggcaggcctgatgactggctctgccctggcggccgataaaatcgttatcgcccaccgcggtgccagcggctatctgccggagcatacgctgccggcgaaagcgatggcttatgcccagggcgcggattacctggagcaggatctggtgatgacgaaggacgaccagctggtcgtcctgcatgaccactatcttgaccgcgtcacggacgtggcggagcgtttcccggaccgcgcgcgcaaagacggtcgttactacgccatcgactttaccctggatgaaattcgctctctgaagtttaccgaaggctttgagattgaaaacggcaagaaggtgcaggtctacccgggacgcttcccgatgggcaaatctgacttccggatccataccttccaggaagagattgagtttgttcaggggctgaaccactccaccgggaaaaacatcggtatctacccggaaatcaaagcgccgtggttccaccatcaggaagggaaggacattgccgcgaagacgctggaggtgctgaaacagtacggctacaccagcaagaaggataaagtttacctgcagtgttttgacgccgccgagctgaagcgcatcaaaaccgagctggagccgaagatggggatggatctcaatctggtgcagctgattgcctacaccgactggaacgaaacccaggagaaacagccggacgggaagtgggtgaactacagctacgactggatgttcaagccgggcgcgatgaagcagattgctcagtacgctgacggcatcgggccggattatcacatgctggtggcggaaggctcaacgcctggccacgtgaagctgacggcgatggtgaaagaggcgcacgccagcaagatgcaggtgcatccgtacacggtgcgtgccgaccagctgccgccatatgccaccgatgtgaatcagctttacgaggtgttgtataagcaggcggacgtggacgggctgtttacggatttcccggataaagcggtgacgttcttaaaatag

SEQ ID NO: 4127 - DNA, 741 bp, Enterobacter cloacae
ttcgtgagaaagatgcctctggcattgaaaaatacatcagcgacattgacgcttacgtcaagagcttgctgtagcaaggtagccttatacatgaacaatatgaacgtaattattgccgatgaccatccgattgtactgttcggtattcgcaaatcacttgaacagatcgagtgggtgaatgtagtcggtgaatttgaagattccacagccctcattaacaacctgcctaaacttgatgcgcacgtgctcattaccgatctctccatgcctggagataaatacggtgatgggatcacgctcatcaaatacattaaacgccacttcccggacatttcgatcattgttctgaccatgaacaataacccggcgatcctgagcgccgttctggatctcgatattgaagggattgtgctgaaacaaggcgcacctaccgatctgccaaaagcgctggcggcgctacagaaagggaagaaattcactcctgaaagcgtctcacgcctgcttgaaaaaatcagcgcgggtggttatggcgacaagcgtctctcgcctaaagagagtgaagttctgcgtctgttcgctgaaggtttcctggtcactgaaatcgccaagaagctgaaccgcagtattaaaaccatcagtagccagaaaaaatccgcgatgatgaagctgggtgtggataacgatatcgccctgctgaactatctctcttccgtgacgctgagcgcaacggacaaagactga

SEQ ID NO: 4128 - DNA, 2328 bp, Enterobacter cloacae
ggcgggggatattttttatttcacggacaggtaaaaacccacatgaatcagagtctgctggtgacaaagcgcgacggtaccaccgagcgtatcaatctggacaaaatccatcgagttctcgactgggcagcagaaggactgaacaacgtatctatctcccaggttgaactgcgttctcacattcagttctacgacggcatcaaaacgtctgatatccacgaaaccattatcaaagcagcggcagatctgatctcccgcgacgcaccggattatcagtacctcgctgcgcgtctggcgattttccacctgcgtaaaaaagcctacggtcagtttgagccgccgaagctttacgatcacgtagtgaaaatggttgagctgggcaaatacgacacgcatctgctggaagactatacggaagaagagttcgagcagatgaacgggtttatcgatcactggcgcgacatgaacttctcctacgcggcggtgaagcagctcgaaggcaaatacctggttcagaaccgtgtaaccggtgagatctacgaaagcgcccagttcctctatattctggtggccgcctgcctgttctctaattatccacgcgaaacccgtctggactacgtgaagcgtttctacgatgcggtgtcgacgttcaagatttctctgcctacgccaatcatgtctggcgtgcgcacccctacccgtcaattcagctcctgcgtgctgatcgagtgcggtgacagcctggattccatcaacgcgacctccagcgccatcgtgaaatacgtttcccagcgtgccggtatcggcatcaacgccggtcgtatccgtgcgcttggcagcccgatccgcggcggtgaagcgttccacaccggctgtatcccgttctacaagcacttccagacggcagtaaaatcctgctctcagggcggcgtgcgcggtggcgctgcgaccctgttctacccgatgtggcacctggaagtggaaagcctgctggttctgaagaacaaccgcggcgtggaaggcaaccgcgtgcgtcacatggactacggcgtgcagatcaacaagctgatgtacacccgcctgctgaaaggggaagacatcaccctgttcagcccatccgacgtcccgggcctgtatgacgcgttcttcgccgatcaggatgagttcgagcgtctgtacaccaaatatgaaaaagacgacagcatccgtaagcagcgcgtgaaggcggtcgatctgttctccctgatgatgcaggaacgtgcttctaccggccgtatctacatccagaacgttgaccactgcaacacccacagcccgttcgatccggtggttgccccagtgcgccagtccaacctgtgcctggagatcgccctgccgaccaaaccgctggacgatgtgaacgacgaaaacggcgaaatcgcgctgtgtacgctctctgcgttcaacctgggtgcgattaagagcctggacgagctggaagagctggcggtgctggctgttcgtgccctcgacgccctgctggactaccaggattacccaatcccggcggcaaaacgcggcgcaatgggccgtcgcactttaggtatcggcgtaatcaacttcgcctactggctggcgaaaaacggcaagcgttactccgacggcagcgccaacaatctgacgcaccagacgttcgaagcgatccagtactacctgatgaaagcctctaacgagctggcgaaagagcaaggcgcgtgcccgtggttcaacgaaaccacttacgcgaaaggcattctgccgatcgacacctataaaaaagacctggatgcgatcgtcagcgagccgctgcacctcgactgggaaggcctgcgcgagtccattaaaactcacggcctgcgtaactccacgctctctgccctgatgccgtccgagacctcttcgcagatctccaacgccactaacggtattgagccaccgcgcgggcacgtcagcattaaagcgtcgaaagacggcgtgctgcgtcaggtggtaccggattacgaaacgctgggtgacaactacgagctgctgtgggaaatgccaaacaacgacggctacctccaactggtgggtatcatgcagaagtttatcgaccagtcgatctctgccaatactaactacgacccgacgcgcttcccgtccggcaaggtaccgatgcagcagctgctgaaagacctgctgaccgcctacaaatttggcgtgaaaacgctgtactatcacaacacccgtgatggtgcggaagacgcccaggacgacctggcgccgtcaattcaggacgatggctgcgaaagcggcgcatgtaagatctaa

SEQ ID NO: 4129 - DNA, 1221 bp, Enterobacter cloacae
ccctctcccacagggagagggaactctttccccctctccctgtgggagagggccggggtgaggggaaataacaccacaggactcaccgcaatggcatataccaccttttcacagacgaaaaacgaccagctcaaagagccgatgttcttcggccagccggtcaacgtggcacgctacgatcagcaaaaatatgacatcttcgaaaagctgattgaaaagcaactctccttcttctggcgtccggaagaagttgacgtttcccgcgaccgtatcgatttccaggcgctgccggaacacgaaaagcacatcttcctcagcaacctgaagtaccagacgctgctggactccattcagggacgtagtccgaacgtggcgctgctgccgctaatctcgattcctgagctggaaacctgggtagaaacctgggcgttctccgagacgatccactcccgctcttacacccacatcatccgcaacattgtgaacgatccggcggtggtgtttgacgatatcgtcaccaacgaacagatccagaagcgcgccgaaggcattgcgcactactacgacgagctgatcgagatgaccagctactggcatctgctgggcgaaggcacgcataacgtgaacggcaaaaccgttaccgtaaacctgcgggccctgaaaaagcagctctatctgtgcctgatgagcgtcaacgcgctggaagcgatccgcttctacgtgagcttcgcctgctccttcgcctttgccgagcgcaagctgatggaaggtaacgccaaaattatccgtctgatcgcccgtgacgaagccctgcacctgaccggcacccagcatatgctaaacctgctgcgcagcggtgcggacgacccggagatggcggaaatcgccgaagagtgcaaacaggagtgctacgacctgttcttgcaggccgcccagcaggagaaagagtgggcagactacctgttccgcgacggctccatgattggcctgaacaaagacattctgtgccagtacgtggagtacatcactaacatccgcatgcaggcggttggtctggacctgccgttccagacgcgctctaacccgattccgtggatcaacacctggctggtatccgataacgtgcaggttgcgccgcaggaagtggaagtgagctcttatctggtcggtcagattgattctgaagtcaacaccgacgacctgagcgacttccagctctga

SEQ ID NO: 4130 - DNA, 1530 bp, Enterobacter cloacae
ctaacggagcacgctatggatacctggatctatctctctcaggggttcgcggtagcgatgaccccggaaaacctggtgatcgccctgatcggctgtttcgtcgggaccatcgtcggcctgctgccgggccttggacctatcaacggcgtggcgattttactgccgctggcctttgcgctgcacctgcctgcggaatcggcgctgatcctgctggcgacggtttatatcggctgcgaatacggggggcgtatttcctcgattctgcttaacgtgcccggcgatgccgccgccattatgaccgcgctggatggctatccaatggcgcagcagggacgcggcggcgtggcgctctctatttccgccgtcagctcgttctttggctccctgatcgccattggcggcatcatcctcttcgccccggcgctggcccagtggtcgctggcgtttggtccggccgagtattttgccctgatggtgttcgccatcgcctgtctcggcagcatgatggcgcagaatccgctgaagtcgtttttgtctgcgttgattggcctcagtctggccaccgtcggcgtggatgccaacaccggggtttatcgttttaccttcgacagcgttcatctctccgacggcgtgcagtttatcgtcgtggtgattggtctgttctctgtctcagaaatcttactgatgctggaacataccagcagcgggcagacgctggtgcgtaaaaccggacgtatgctctttaatgccaaagagggggcgcagtgtgtgggtgccaccctgcgttcgtcggtgatcggtttcttcgtcggcattctgcccggcgcgggggctactatcgccagcgccatcacctacatgaccgagaaaaagctgagcggtaacagcgacagcttcggcaaaggcgatatccgcggcgtggcggcgccggaggcggcgaataacgcctcggcctgcggctcgtttatcccgatgctgaccctcggcgtgccgggctccggcaccacggcggtaatgatgggcgcgctgacgctctataacatcaccccgggtccggcgatgtttaccgagcagcccgatatcgtctggggtttaattgccgccctgctgatcgccaacgtgatgttgctggtaatgaacatcccgctgatcggcctgttcacccgcatgctgaccattcccctgtggttcctggtcccggccatcgccgccgtctctgcggttggggtgtacgcggtgcacagcaccaccttcgacctggtgttgatggtgctgctcggcgtgctgggctacattctgcgcaagatgcacttcccgatgtcgccgctgattttagggtttgtgctgggggaaatgctggagcagaacctgcgccgcgccctctccatcagcaacggcaacatggggatcctgtgggagagcagcgtaacgaagatcctgctggcaatggcgattatggtgattgtcgtgccgccggtgctgcgctggatccgccgacgccagcacaaaccgcagccggatatcggctga

SEQ ID NO: 4131 - DNA, 1050 bp, Enterobacter cloacae
gcagggcgtagagtgactgcacggtcagttcgctgtggtgtagatcttgccactggatcatgtgtttctccttcctggggttcatcacgttatactaaaccccttcccattcggcaaagggctgattgcgttatggaactgatttttctgggtacgtccgccggggtgccaacccgctcacgaaacgtgacggcgattctgctggatcttaagcatcctacccgcggtgggctgtggctgtttgactgcggcgagggtacgcagcatcagatgctgcatacttcataccacccggggaaagtggataaaatatttatcacccatctgcacggcgaccatctgtttggcctgccgggcctgctgtgcagccgttcgatggccggtaacgctaacccgctgaccatttatggccctgcgggtattcaggaatttgttgaaaccacgctgcgcctgagcggctcgtggaccgattatccgctggaggtggtggagatcggcgaaggtctggtgttcgacgacggagattatcaggtgcgcgcttacccgcttaaccatccggtggaatgttacggctatcgcgttgaggagcatgacaagcccggtgcgctgaacgccgccgcgttgcaggccgatggggtgaaacctggcccgctgttccagcgtctgaagcacggcgagaccgtcacgctggaagacgggcgcgtcatcaacggtcaggattacctcgccccaccgcagccgggcaaaaaactggctatttttggggataccgccccctgcccttcggcgctcaggcttgccgggggtgtggatgtgatggtgcatgaggcgacgctggaagcggcgatggaagaaaaagccaacagccgggggcacagctcaacgcgtcaggcggcgcagctggcgcgtgaggctggcgtccggaaactgattgttactcacgtcagctcacgctatgacgtccgcggcgctgaaagcctgctggcagagtgtcgggaagtatttccggcatgcgagctggcggaagattttgctcaggtcagcgtttag

SEQ ID NO: 4132 - DNA, 744 bp, Enterobacter cloacae
ggagtaaaagcgcccatgaatgccgaaaaatccccggtggctcacaacgttgaccacgaagagattgccaaatttgaagcggtggcgtcccgctggtgggatctcgaaggtgagttcaaacctctgcatcgtattaacccgctgcgtctgggctatatcgcggagcgttccggcggtctgttcggtaagaaagtgctcgacgtcggctgcggcggcggcatcctggcggaaagtatggcgcgtgaaggggccaccgtcaccggtctggacatgggcttcgaacctctacaggttgcgcgtcttcatgcgctggagtccggcatacaggtagaatacgttcaggaaaccgtggaagagcacgcggcaaaacatgcgcaccagtatgacgtggtgacctgcatggagatgctggagcacgttcccgatccgcagtcggtcgtcagcgcctgtgcaaacctggttaaaccgggtggacaggtcttcttctcgaccatcaaccgcaacggcaaagcctggctgatggccgtggtaggcgcggaatatgtgctgcgcatggtgccgaaagggacgcacgacgtgaagaagttcatcaagcctgccgaactgctgggctgggttgaccagacatggcttaaggagcagcacatgacgggcctgcactacaacccgttgaccgataaattcaaacttgccccgggcgtggatgttaactatatgttgcacacaaccgccaaaaacgactaa

SEQ ID NO: 4133 - DNA, 201 bp, Enterobacter cloacae
aagcctctaacgagctggcgaaagagcaaggcgcgtgcccgtggttcaacgaaaccacttacgcgaaaggcattctgccgatcgacacctataaaaaagacctggatgcgatcgtcagcgagccgctgcacctcgactgggaaggcctgcgcgagtccattaaaactcacggcctgcgtaactccacgctctctgccctga

SEQ ID NO: 4134 - DNA, 288 bp, Enterobacter cloacae
tgccgtccgagacctcttcgcagatctccaacgccactaacggtattgagccaccgcgcgggcacgtcagcattaaagcgtcgaaagacggcgtgctgcgtcaggtggtaccggattacgaaacgctgggtgacaactacgagctgctgtgggaaatgccaaacaacgacggctacctccaactggtgggtatcatgcagaagtttatcgaccagtcgatctctgccaatactaactacgacccgacgcgcttcccgtccggcaaggtaccgatgcagcagctgctga

SEQ ID NO: 4135 - DNA, 1659 bp, Enterobacter cloacae
atgctaaaaaacgaacatagaggaaaggcaatgacaattcacgatccacgctacagcgatgtgattatcattggcggtggcgcaaccggcgccggcatcgcacgcgactgcgcccttcgcggcttaagcgtcacgcttctggagcgccacgatattgccaccggcgcgacggggcgtaaccacggcctgctgcacagcggcgcgcggtatgcggtcaccgacggtgaatccgcgcgcgaatgtatcgctgaaaaccagatcctcaagcgtatcgcccgacactgcatagagccgaccgacggcctctttattacccttcccgaagatgacctcgcctttcagtcaacctttataaccgcctgtactgcagcgggcattcaggcggaggccatggatccggcgctggcccggcggctggagccgtcggtgaacccgacgctgatcggcgcggtaaaagtaccggacggaaccgttgatcctttccgcctgaccgccgccaatatgctcgacgcgcgggaacatggcgcccagatcctgaccgggcatcacgtcaccgggcttattcgcgaagggaataccgtgcgcggagtgcgcgtgtttgatgcgcagtacaacgaacaccgcgagctgtatgccgccgtcgtggtcaacgcggcggggatctggggccagcgcatcgcggaatacgcggacctgtcggtgcgcatgttcccggcgaaaggctcgctgctgatcctcgaccaccgcatcaataaccatgtcatcaaccgctgccgtaaaccgtctgacgccgatatcctcgtgccgggggacaccatttcgttaatcggcacgacctcaatgcatgtggactacagcgaaattgattacaaccgcgtcaccgctgaagaggtggatatcctgctgcgcgaaggggaaaagctggccccggtgatggcgcagacgcgtattctgcgtgcctacgcgggcgtgcgtcccctcgtcgccagcgataacgatccgagcgggcgtaacgtcagccgcggcatcgtactgctcgatcacgccgaacgtgacggcatggacggatttatcaccattaccggcggcaagctgatgacctaccggctgatggcccagtgggccaccgatgccgtctgccgtaagctcggcaacaccgcgccgtgcgtgacggcggaacaggccctgcccggctcgcagcaatcgacagaaaaaacgctgcacaaaatcatttcactccctgccccgcttcgcggttcggcgatttaccgccacggcgaccgcaccccgacctggctcggtgaagggcgactcagccgcagcctggtgtgcgaatgcgaagccgtgaccgcaggcgaggtgcagtatgccgtggaaaacctgacggtaaacaacctgctcgatttacgccgccgcacgcgcgtcgggatgggcacctgtcagggggagctgtgcgcctgccgtgccgccgggctgctgcaacgttttcacgccaccacgtcaacccagtcgcttgcccaactcagcgattttttaaacgagcgctggaaaggcattcagcccgtcgcctggggcgatgccctgcgcgaaagcgaatttacccgctgggtctatcaggggctttgcggtctggagaaggagcacaaccatgaaatttga

SEQ ID NO: 4136 - DNA, 1320 bp, Enterobacter cloacae
aaatctttacgccatcggctcggttctgggcgggtacgatcccgtggcgcagggctgcggtggcggcgtctgcgccgtcaccgcgctgcatgtcgcggagcagattatccagcgcagggagagagcacaatgaacgacacccgatttgaaagctgtatcaaatgcacggtctgcaccacggtttgcccggtcagcggcgtcgatccgcgctatcccggcccgaaacaggccggtcccgacggggagcgtctgcgcctgaaggatggcgcgctctacgacgaggcgctgaaatactgcatcaactgcaaacgctgcgaagttgcctgcccgtcggacgtgaaaataggcgatatcatccagcgcgcccgcgcccgctacagtacgcaaaaaccgacgctgcgtgacgcgatactgagccacaccgatctaatgggcagcctctcgacgcctttcgcgccggtcgtcaatgccgccaccgccctgaagccggtgcgcaggctgctggatgcgacgctcaaaatcgaccatcaccgcagtctgccgaaatattctcacggcaccttccgccgctggtataaatccgtggcggcagaacaggcgcagttcgctgagcaggtcgccttcttccacggctgctacgtgaactacaaccatccgcagctgggaaaagacctgctgaaagtgctgaacgccatggggacgggcgttcagctgctgagcaaagaaaagtgctgcggcgttccgctgattgccaacggtttcatcgacaaagcgcgcaagcaggcgagcagcaacgtcacctctttacgtgaggcgatcgtcgacaaagggataccggtactggcgacgtcgtcaacctgtaccttcacgctgcgcgatgaatatccgcatctgctggatgtggataacaccggcctgcgcgagcacattgagctggcgacccgttttctctggcgcaaactggacagcgggcagacgttaccgctgggcaaattgccgctgaaggtggtatatcacacgccatgtcatatggagaagatgggctggtcgatctatacgcttgagctgctgcggctgatcccggggctggagctgacggtgctggactcacgctgctgcggcatcgctggcacctacggattcaagcgtgaaaactacccaacgtcacaggccattggcgcgccgctgttccggcagattgaagagagcggcgcagatatcgtggtgacggactgtgaaacctgcaagtggcagatcgagatgtccaccagcaaacgctgtgaacatcccattaccttgctggcaaaagcgctggcgtaa

SEQ ID NO: 4137 - DNA, 1032 bp, Enterobacter cloacae
aaggccagcatttctcttgagggtagaatggataatttccagaaagatattgatgacagggcgaacctgaccctgtccaaccgttttgaactgttgctgttccgtcttggcacctctctgaacgaaaataaatccgagctgttcggcatcaacgtgttcaaattgcgcgaaattgtgccgatgccgaccttcaccaaaccggcgggaatgaagtctccgctgatggggatggtgaacattcgcgaccaggtgatcccggtgatcgatctggccgccgtcgccggctgcaagccagccaccgggctgaacatcctgctgatcaccgaatatgcccgcagcgtgcaggcgtttgctgtggaatcggtggaaaacatcatgcgtctggactggaagcaggtgcatgctgcggaaactgccgtcagcggtcgctacattaccagcattgcctgcctggacgagaagacggataccaacgatctggcgatggtgctggacgtggagcagatcctgtacgacatcaccccggcgaaccacgatctgcacgccacccatctggaaaccaccaaatttaacatcaagcctggctctgtcgcgattgttgcagaagattcgaaagtggcgcgctcaatgctggagaagggattgcaggcgatggagatcccggcccagctgcatatcaccggcaaagacgcgtgggagaaaatcactcagttggccgcgcaggctcaggctgagggcgtccccgttaccgataagattgccctggtattgaccgacctcgaaatgccggagatggacggctttacgctgacgcgcaaaatcaaaaccgacccggtactgaaagatattccggtggtgatccactcgtctctttccggcaacgcgaacgaagatcatattcgcaaagtgaaggcggacggctatgtggcgaagtttgagctaaatgagctatcgtcggtgattgaagaggtgctggaccgctcgatgaagaagattgaagggccgcttataagcaggaagcagttagcttag

SEQ ID NO: 4138 - DNA, 546 bp, Enterobacter cloacae
tacgtcagctggaataattggggtgcgtcctgcattaccccggacgaaaggttcgcgagtcaagaatttgatctatttttaactgataatccgtctaatcttactgcctcaggcttgcttttaagcgatgatgagccaggcgtgcggaaaatcggccctgggcagctgcgcgtcaattttaatatgagcaatgcaatgcaggaagctgtattacaactgattgaagagaatctggcgcaggaagagatcctggagtcaccgttaggcggcgatgaaaatgccgaactccatgccagcggatattattcgctcttcgttgatacagtaccagatgatgttaagcggttgtatactgagtccgctgcgcaggattttgcagcgctggcacagacagcacaccggcttaaaggggtgtttgccatgcttaatctggttcccggcaagcagttatgtgaaacgctggaacatctaattcgtgagaaagatgcctctggcattgaaaaatacatcagcgacattgacgcttacgtcaagagcttgctgtag

SEQ ID NO: 4139 - DNA, 1053 bp, Enterobacter cloacae
cttggttgggtattcactttccgccgtacgtttaccgtagccgttctgggtgacggtcaggattgcgccttcgccacgaggaacgatcagggaaacaacggagtcttcacccgccagcttgataccacgcacgccggtcgccgtacgacccattgcgcgcacggcgttctctttaaagcgcaccactttaccggcggcagagaagagcatcacttcatcagaaccggacgtcagatccacgccgatcagttcgtcgccttcgttcaggttcaccgcgataatcccggcagaacgtggacggctgaactcggtcagtgcggttttcttcacggtaccgctcgcggtcgccataaagacgttcacgccctcttcgtactcgcgtaccggcagtatggcggtgatacgttcgttcgcttccagcggcagcaggttgacgattggacgtccacgcgcgccacggcttgcttccggcagctgatagactttcatccagtacagacggccccggctggagaagcagaggatcgtgtcatgggtgttcgccaccagcagacgatcaatgaagtcttcttctttaatacgcgccgcagatttgcctttaccgccccgacgctgagcttcgtagtcggtcaacggctgatacttcacgtagccctggtgagacagcgtcactaccacgtcttcgcggttgatcagatcttcaatgttgatatcagagctgttggccgtgatttcggtgcgacgctcatcgccgaactgatcgcgaaccagctccagctcttcacggatcacttccatcaggcgctctgcgctacccaggatatgcagcagctcggcaatctgctccagcagctctttgtactcgtcgagcagtttttcatgctcaaggccggtcagtttctgcaaacgcagatccagaatcgcctgggcctgctgttcagtcaggtagtactgaccgtcacgcacgccgaattccggctccagccactcaggacgcgcagcgtcatcgccggcacgttccagcatcgccgccacgttgcccagatcccatga

SEQ ID NO: 4140 - DNA, 1095 bp, Enterobacter cloacae
acgcgcaaccagcgacgccttcgcttctgctggcgtcggcgcacggcggatcagctcgatgatcgggtcgatgttcgccagcgcaacggccagtgcttcaaggatatgggcacggtcgcgcgctttgcgcagttcgaagatggtacggcgagtcaccacttcacggcggtgacgcacgaacgcgctcaggatctctttcaggttcatgatcttcggctggccatggtgcagcgcaaccatgttgataccgaaggagacctgaagctgagtctgggagtaaaggttgttcaacacaacttcacccaccgcgtcgcgcttgatttcaatcacgatgcgcataccgtctttgtcagactcgtcacgcagcgcgctgatgccttcaacgcgtttttcttttaccagctcggcgattttttcaatcagtcgcgctttgttcacctgatacgggatctcgtgaacaataatggtttcacggccggttttggcgtccgcttccacttcggcgcgggcacggatgtaaatcttgccgcgaccggtacggtacgcttcttcaataccgcgacggccattgatgattgccgccgtcgggaagtccgggcccgggatgtgttccatcagcccttcaatgctgatgtcttcatcgtcaatgtaggccaggcagccgttgatcacttccgtgatattgtgcggcggaatgttggttgccataccgacggcgataccggacgaaccgttcaccagcaggtttgggatcttcgttggcatgacgtcaggaattttttccgtgccgtcgtagttatcaacgaaatcaaccgtctctttttccaggtcagccatcagctcatgggcaatcttcgccagacggatttccgtataacgcattgccgcggcggagtcgccgtcgatagaaccaaagttaccctgaccatctaccagcatgtaacgcagcgagaagggctgcgccatacggacaatggtgccgtacaccgcgatatcaccatgaggatggtatttaccgattacgtcaccaacgacacgggcagattttttgtaggctttattccagtcattgcccaatacgttcatggcgtatag

SEQ ID NO: 4141 - DNA, 291 bp, Enterobacter cloacae
agtcaacaccgacgacctgagcgacttccagctctgatgacgcgcgtaacgctgagcctttctggcaccgaagtgctgtgccaggaagagcacccttccctgctggtggcgcttgaagcgcatcaggtggaggtagagtaccagtgtcgtgaaggctattgcggctcctgccgctgccgtctggtcgcaggccaggtggactggctgaccgaaccgctggcctttatcagtgaaggggaaattttgccctgctgctgccgggcaaaaggcgatattgagatcgagatgtaa

SEQ ID NO: 4142 - DNA, 1329 bp, Enterobacter cloacae
acgagcgctggaaaggcattcagcccgtcgcctggggcgatgccctgcgcgaaagcgaatttacccgctgggtctatcaggggctttgcggtctggagaaggagcacaaccatgaaatttgataccgtgattgtgggtggggggctggcgggcctgctgtgcggcctcaaactgacgcagcggggtctgcgctgcgccattgtcactcgcggtcagagtgctctgcacttctcctccggctcgctggatttactgggcgcgctatcgttcgccgatctgccgcctgaacatccctaccgcctgacgggcgcagagaatatggcccgctttgcctgcgaaaccgaacacctgctcactgcctgcggcgcacgcatgcagggtgacgccgagcaaaaccatcagcgcgtcacgccactcggcaccctgcgcgccgcctggcttagcccggaagaggtgcctgtcgctcccatcgctgccgagcgcgtgcgggtggtggggatcagcggtttccttgatttccagccacatctggccgccgcgtctctcagacagcagggtgttcaggtggatacagcggagattgatctccccgagctcgacgtgctgcgcgaaaaccccagcgagtttcgtgcggtgaacattgcccgcctgctggataatgaaagttactggccgcagctgtacgcggcgcttcaaccgctcggcgagacctgcgacgccctgtttatgcccgcctgttttggcttaacggacaaccggctctggcgctggctctcggcgcgcctgccctgtacgctcggtttactgccgacgctccccccttccgtgcccggcattcgtctgcatacccagcttcagcgtcagtttgtcgcccagggtggcgtctggatggcaggcgacgaagtgaaaaaaatcaccctggttgagggcgcggtaagcgatatctggacccgcaaccacggcgacatcccgcttcgcgcacgctatacggtgctggcaagcggcagtttcttcagtaacggtctgctgagcagccgggatggcgtgcgtgaggcaatactcgggctggatgtccggcaaagcgcttcccgcgcggactggtatcaaagcgatttcttcaccccgcagccctggcagcagttcggcgtgatcgtcgacagccaactgcgcccgcggctgggcggggaaccggttgaaaatctttacgccatcggctcggttctgggcgggtacgatcccgtggcgcagggctgcggtggcggcgtctgcgccgtcaccgcgctgcatgtcgcggagcagattatccagcgcagggagagagcacaatga

SEQ ID NO: 4143 - DNA, 984 bp, Enterobacter cloacae
acgatgaaaaaacaattactttctacccttgctgcaagcgtattgctgttgagtgcctctgtcgtccaggcgcaggacgcgccatcccgtaccgaatgtatcgccccggccaaacccggcggcggcttcgacctgacctgtaagctgattcaggtcagcctgctggagacgaaggccattgagaaaccgatgcgcgttacctacatgcccggcggcgtgggcgcggtagcctataacgccatcgtcgcccagcgccctgccgaagcgggcaccgtggtggcgttctccggcggttcgctgctgaacctgtcacaggggaaatttggtcgttatgacgtgaatgacgtgcgctggctcgccaccgtaggcaccgattacggcatgatcgccgtgcgcgcggactctccgtggaaatccctgaaagatctgctgaccgccatggaaaaagatccgaacagcgtggtcattggcgcgggcgcctctattggcagccaggactggatgaaagccgcgctgctggcgcagcaggccaaagtggatccgcacaagatgcgttacgtggcctttgaaggcggcggcgagccggtgacggcgctgatgggcaatcacgtccaggcggtatcgggcgatctcagcgaaatggtgccctacctgagcggggataagatccgtgtgctggcggtcttctcagaaaaccgtctgccgggccagctggcagacgtcccaaccgccaaagagcagggttataacctggtctggccgatcatccgcggcttcttcgtcgggccaaaagtgaccgacgccgaataccagtggtgggtggataccttcgcaaaacttcagcaaaccgaggagttcaaaaaacagcgcgatctgcgcgggctgtttgagttcaacctgaacggcaagcagctggacgagtatgtcaaaaaacaggtgaatgactaccgcgtacaggcgaaagcctttggtctggcgaaataa

SEQ ID NO: 4144 - DNA, 768 bp, Enterobacter cloacae
cgctaccaggactctcgccagcgcagaaaaggccgagtaaagaaggttagcgaggttttacactggacacctgaccatgccgaacataaaggaaaaatgatgaaatcagattacgccaaacagattgaactgatttccgggccgctggaagcggcaatggaagcactcgcaggtacgttgtcagcgaaccaggagatagtcctgcataacctcaccacgccagagcagtccgtggtaaaaatcattaacgggcacgtcagcggcagaaaagcgggcgacaatcttttatccggtcctgaaaaagacaaaggatttgccctgttacttaaaaacaataaggacagcaccccggttacggttaaaaattataaaaccactacggcgtccggacggatcctgaacagcgcctcgacaatttactacagcgaggaaggggtaccgttgatggctttttgcatcaatatcgatacctctccttatgagcaaatgcgcaagtgcctcgacgcaataacaggcagcccgcttgccgattcagacccgcaggatatgaacctgggcggcatcattgagcagtctatccaggaaatcatcgataaacattcggttccgggcaaaaaggtacagaaagcgcagcggcttaaaatagtcgctgaaatgcacgctaaaggcattttcaaaatgcggggtggcgtccagcacgcggcgcaggccctgggcgtaacccgctatacggtgtataacgatcttgaggtgatgggtgaaaaataa

SEQ ID NO: 4145 - DNA, 348 bp, Enterobacter cloacae
gatttattaatgacgttaacgaaaagctttgctgcactcatggttgcagtatccattgaagttatcgccacaaccttattatcgctatcaaacagttttcagcgccccgttgtgggactgtcagcgataataagctatggcttaagttattattttttatcgattgcattacgccgaattcatctcggcgtggcctacgctatctggtcagcggtcggtttattcagcatgaccgttatacagacccgcttttttgactatattgtatcgcagagagcatggatgggtctgggaatggttatcgctggaacaattacgctcaatctggcgatcaagcaaaacaaataa

SEQ ID NO: 4146 - DNA, 2463 bp, Enterobacter cloacae
aaagcagcattctggaaaagatcggaattggctgcatcgtcaccgggctggcgatcatcgccttttaacaggagaaacggcatgacgacagagatgctttccttgcgcgtggtgcagcttcgtgaagcttatcttcaggcaaaacctttcgtctcggcgcatcgggccgtgagtgtaacccaggtctataaagacaatccgggaatgaacaacagcctgctcagggcactggcctttcggcgcgcctgtgagactgcgcctctgcatgtggcgcaaaatgaactgatcgtcagccatccggctggcggcgcacgcgggggagaggtttcgcctgaaatcagctggcgctggctggccgacgagctggaaacccttcccgcgcgggcgcaggacccttatcagattgatgaggaaacaaagcgtctgcttcgcgaagaagtattcccatactggcagggccgttccctcgatgaaatggcgcaaacgcagttaaagactcacgggctatggcactggtgtcatgatgatggcatctgcgatgtcacgatcaaaacacaaaacggtggcggcgattcctgtccgggatatgacaatattttactgactaaaggaataaaggggatccgtgaagaagcggcagcactgctgctcgcgcttgatcctgctacccccgagggctgtgatgccttcaatttttataccgccatgctgcatacctgtgacggagtggtgacttatgcccgacgttatgctcactatctgaatgcgcttgcggaaaaagaaggcgatccgctgcgtcgcgatgagctgctgcaactgtccgggatatgcagccgggtgcctgaacagccaccacagcatttccatgatgcgttgcaggcgatatggttcgtacattctctctttatgctggaagaaaatcagaccggcatatcactcggccgtgtcgaccaatatctttggccactgctggaacgcgatctgcacgatggcacgctcaatcttcaacaggctgaggaactcctctgctgctggctcataaaaatggccgaaaccctgtggatttgtagcgaatctaccgccatgtattttgctggctaccagccgtttattaacctggtggttggcggccagaaacgtgaaggtggcgatgcgaccaacccgctgacgctgatgataatggattgttcagcccgtttaaaaatctaccagccgggtttagcagtacgtatacataatcagtcccctcagccgtttatgcgcaaagtcgtcgacgtggtacgcagtggcatgggttttccggcctgtcatttcgacgatgcgcatatccggatgatgcttcataaaggatttagctatgaagacgcacgggactactgtctgatgggctgcgtcgaaccccaaaaatcagggaaaatgtaccagtggacgtcggtaggctataccacctttactgcggcaatcgagctggctttgcataatggtcgaacccaaaatgggaagcagtgcggccccgccactggcgatgtatctcagttcagtcgttatgaagaggttgaatccgcggtccggactcagctctctgctatcgtcagaaaagccgcagaggcgacgcttatcgtacaaaagctacatgcagaacatgcccgaaaacccctgatgtcatgcctgattgagggatgtattgccacagcaaaagatgtcacgcagggaggcgcacgcctcaatgcggggccaggcctcatctggaccgggcttgctgattgtgtaaattcgctgatggccatcaggacgctggttttcgacaccgcccgcttcacgctacggcagctcgtggaggctctcgaacataattttgtcggctatcaggaaatacttactgcctgccagcgagcaccgaaatatggcaatgatattcgtgaagtggatgatatcgcccgcgagctggtgcgttttcttgagcaggagcaccgccagtaccggatgctgtatgcgccgtttgcgttcggcaccctttctatttcaaacaacaccccgtttgggcttatcaccggtgcgctgccctctggccgactggcgggtaagccgctggctgatggcatcagcccggctcagcaaacggattacctcggacctactgcaataatcaactccgttagtcggatcaacgtcgaagagatggatattggcatggtgcataacatcaagctcatgttcggcatgcttgaaacacctgagggtcagaacagcctgatccacctgctgcgtacagcgagcattctgggaaatgctcaactccagttcagctacgtggatgatgagacgctgagaaaagcacaaaaacaccccgctgactatcgcaacctgatgatccgggtggcgggctacagtgctttcttcgttgaattaagcaaagaggtgcaggatgagattatcagcagaacgacgcagcggcatttctga

SEQ ID NO: 4147 - DNA, 234 bp, Enterobacter cloacae
ggtataggcattaagatgaaaaaattggttgcagtaataagtctggcatttgtgaccctcacggttgcggggtgctccagcgactatgtattacaaaagaaaaatggggaaatgattattacccatggaaaaccggaagtggatgatgataacggtcttataacttatgaggatgttgctggtaatgaacatgctatcaaccgcgatcaaattattcagatgatcgagaaataa

SEQ ID NO: 4148 - DNA, 1149 bp, Enterobacter cloacae
cgtgaaggggtatcagcaggggctgaacgcggatatggtctggtacgatcgcgttatgaagtagcttttcccccctctccctctcccgtgggagagggggtcgttcgtgcatattttcaggataacgattttcccatgccacatctttccacccgcgtgcttcagggtctgctgactctcctgctcacgctgttcgggctactgctggtcacgtttgcgctctctgccttttccccggtcgatcgcgtattgcagatcgtcggcgatcacgccagccagtccacttacgatcaggtacgccaccagcttgggctggatcggcccctgccggtgcagttctggcactacctgcaaaacctcgctcacggtgatttaggcaccgccagcgctaccggtcagccggtattgcaggacctgctgcacgcctttcccgccacgctggaactggcaacgctggcgctaattatcggcacagtactcggcgtaattgcgggtgtgctgtgcgcccgctacgccggttcgccactggacttagcgatcagaacgctcaccctgctcggcaattcggtgccgatattctggctcggcctgctgatgctggctctgttctacgcgaaactacagtggagcgctggccccggcaggctggacgacatctggcaattcaccgtcgagccacgaaccggatttgcgctggtggatacctggctttccggcgaccgcgaggcgttccgcaacgccatcagccacctggtgctaccggtgctgctgctggcctactactcgctggcaagcatcacccgcctgacgcgctccgcctgtctgagcgagatgaacaaagagtacatattgctcgcccgcgccaagggcgccggagagatgaccatcctgctgcgtcacgtgctgccgaacattcgcagcacgctgctgacggtgattgcgctggcctacacaagcatgctggagggcgcggtattaaccgaaaccgtcttctcgtggccgggcatcgggcgctacctcaccacggccctgttcgccggtgacaccaccgccgtgatgggcggcacgctgctgattggcgtctgctttgttctgatcaataaccttaccgacctgcttgtgcgggcgaccgatcccagggtgcgctaa

SEQ ID NO: 4149 - DNA, 966 bp, Enterobacter cloacae
ttgccgacggcatgcaggtcatttttgaccagtggtggattgccgccattccaggcggggcgattctgtttgccagcctggcctttaacctgctgggcgatggcctgcgcgacgtactggagccacagcatgactgaacaccgcgtcatcgtcgatgcgctgaatatcgactaccccgccgcgcgcgtggtcaacaacctgagctttacgttgggcaaagagcggctggcgctggtgggagaatccggctccggcaagtccatgtctgcccgcgccctgatggggctggtgcgcaagcccggcatcgtgagcgctaagcggcttaacgtgcttggcaacgacctgctgaccctgaacagccgccgctggcaggcgctgcgcggcaacggcattgcgatggttctacaggacccgcgctacgcgctaaacccggtgaaaaccgtcgccgcccagcttgatgaggcgctgaccctccatcagcgcctgccccgcgccgaacgactggcgcgcattcacgatatcatccgcgccgtggggctgaacgagcacgtgctccagcgctatcccggtgaactttccggcggcatgggccagcgcgtgatgatcgccattgcgctcgtcaacaacccgcaggtgctgatcgccgacgaaccgacttccgcgctggacgcacgcctgcgcaaccagatcctggagctgctggtacagcagtgcgaggcgcggcagatggcgatgctgttaatcagccacgacttgccgctcgtcgcggaacactgcgaccgcgtgctggtgatgtatcagggtgagaacgttgatgaaatggcggcgagccagttgccgcaggcaacccatccctacacgcgcacgctctggacctgccgcccgaacgccgggacgtttggcaagatgctgccgacgctcgaccgttcgcaaccgtggaaggaggacgacaatggcactcgttga

SEQ ID NO: 4150 - DNA, 894 bp, Enterobacter cloacae
gacgtttttgatatggaacttcgttatctgcgctattttgtcgcggtagcacgcgagcgacacttcaccagggcggccaaagcgctgggtatttcacagcctcctctgagtcagcagatcaaacggctcgaagaggaagtgggcacgccgctgttcaggcgcctgacgcggggcgtggagctgaccgaggcgggagaagccttctatgaggacgcctgtaagatcctggcgctgagcgacgccgcgctggagaaagcccggggcatcgcgcgcgggctgaacggcagcctgtcgattggcatcaccagttcagatgcttttcatcccaaaatcttcgccctgattcgccagtttcaggtacagaacatggcggtgcaggttcaccaggtggaagccaatatgtcgtcgctgacgacgatgctggcggagggtgagctggatatcgcctttgtgcgcctgccgtgcgagagcagtaaggtgttcgagctaaaaatcctcgaccgggagccgatgatggtggcgctgcatcgcgatcatcccctggcggcgtgtggcgatctggcgctggaggagctgcgggatacgccggtggtgctgtttccccaggaggtcgcgccggggctgtatgaccgcgtttacggcagctgcgagcgggccgggatcgatatgcaacacacgctgcaatcttcacaactttcctcttccctgagcatggtctccgcgggcggcgggttcgcgctggtgccgaaatccatggccgctatttctccgccgaatgtcacctaccatgcgctgcgctcgccagagctttataccgatatcgcactctgctggcggcgatttgagcgttcgcggacggtgaagcggtttctggcgatgatgagcgaggggtag

SEQ ID NO: 4151 - DNA, 495 bp, Enterobacter cloacae
gccagcgccagctcgctgatatcctcgcgcctgaacatcccggcgcggcgattggccagcaccatcagcccggcgaccgcgttttgcagcagcttgcgccaggcgacggtggggaaatcttccgagagctcaaccgcgcagcgcgtatcacgaagcgcttcgaccacccgctgcgcctgcggcacgtccggcagcgtcaggcgcggtttggcgcgcagccagacggaggcatccggctcgcgctgggcagggaaccagaccaccgagggcagtaccgttgcgccattaaccaaaggcgcaagctgggctttctgctccacgccgttttgcagcgcgcagaccacggtgttttcatcgcacagggcacgcagccacccggcgctgtcggcattttgtgtcgttttgaccgccaaaaaaacgaggtcaacggggcgcgtaatgacgctgggatcggtgagtaccggaccgggcaccacaatttcaccctcatcatga

SEQ ID NO: 4152 - DNA, 807 bp, Enterobacter cloacae
tgggtgaaaaataacagttcccggcgcattccgttttaccaggttgacgccttttctgacggtccttttacgggtaatcccgccgccgtctgcctgctggacgcctggccggaacaaaaagtactccagcgtatcgctacggaaaacaacctttccgagaccgcatttgtggttcaacaggatggcggcttcgcgcttcgctggttcacccccgcagtggaagtggatctctgcggccatgcgacgcttgccgccgcgagcgttctcttaagccgtgacgacgcctgcgaaagcgtgcattttttcacccgcagcggcgagctgaccgtgacctcgcatggtgagcaatatacgctcgatttcccgcaggcgatcccctcccgaattaccgcgccggaagggttgtttaaggctctgggtctggaggaaaacgccggagaaacctggcaagcgtccgacctcattgtcgtcatcgatgatgaagacaagctggatgctctgaagcccgatttcaccgcactggaaaggtttaacacgcgcggcgtggtggtaactgcgtcctctcgcacttttgattttcgctcccgctggttcggccctcaggtgggggtaaatgaagatccggtgacaggttcggctcatacctttctggcaccgctgtggagtcagaaactgtcgaagaaaagattacacgcgcaacagggcgggagtcgtaaaggcgaactgatttgccttattaaggataacggacgtatcgaactcttgggcaaagcgagcctgatgattgaaggagtctttattctgtaa

SEQ ID NO: 4153 - DNA, 975 bp, Enterobacter cloacae
gcaaagaggtgcaggatgagattatcagcagaacgacgcagcggcatttctgaacaggcgtatggctggatctcaaacattcagcggttttcgttacatgacgggccgggtatccgcagcatcatcttttttaaaggctgccagatgcgttgtgcctggtgcgcaaatccggaaggacaaactgccgaacgggatgtttttttccatgccgaccgctgtctgcattgtggtaactgcgccgacctgtgcccgactgggctccacagcatgaatcacaatgtgcatgttcttgaacgtgaccgcaaatgcgttggctgtcaattatgtgaagagcgttgtcctgccgccgcgctcaatattgtcggagaacatgttagcgcacaaaacgcatttgaaagggtcatggctgatgaaatctggtttcgccagtccggaggcggtgtgacgctaagtggcggcgaggtggcaatgcagcctgaatttgctcgcgttttaattgaacagctcaaagcggaggatattcacaccgccattgaaaccgctggctacgcatcctggcacgctattcatcaggcaacggcgggctgcgatctgattctgtacgatttaaagagcgcggaagatgtgctgcatacccgtttcactggtgtcagtaataaaaggattgtgcgaaatcttgcacggctattacagggtgggcaacagattattatccgtatccccgtgatcccgcattttaacgatgcaccggatcaggctgataaattactggcgctcatttctgcactcacacaaggaaaaaagaattttcagggtgtggaattactcccctatcacctttttggtacaggaaaatacaaattactcaacatggagtacgactggaacagaggttcagcaaatgtcgataacttcttaagtatggcgcatcactatcgtctgccattaaaagtgtcgggtacgctagcaggttaa

SEQ ID NO: 4154 - DNA, 1602 bp, Enterobacter cloacae
aacaatcacaatatattttcttcagggatcgctatgactaaaaaactgctgccgttactggtgctggctgcgctctcaagcgctgctcacgccgctaccccgcccaacacgctggttgtcgcccagggtctggatgatatcgtgagccttgacccggccgaagccaacgagctttccagcatccagaccgtgccaagcctgtaccagcgtctggtacagccggaccgcgataatccggaaaaaatcacgccggttctggcagaaagctgggacgcggacgcggcagcaaaaaccctgaccatcaagcttaaacccgatgcgaaattctcctccggcaacccgctgcgcccggaagacgtgatcttctcttatacccgcgccgtgacgctgaacaaatccccggcgtttatcctcaacgtactgggctgggacgccagcaacatcgccagccagctaaagaaagtggacgaccataccctcacgcttcactggacggccgacgttagcccgtcggtggcgctgaatattctctccacgccgattgcctccatcgtcgatgaaaaacaggttgcggcgaacgtgaaggatgacgacttcggcaacgcgtggttaaaaatgcactctgcgggcagcggcgcgttcaaaatgcgcgtttaccagccgcatcaggccatcgtgctggaagccaacgaatccgcgcccggcggcgcgccgaagcttaaaagcatcatcattaaaaacgtccccgatcccgcttcccgccgcctgctgatccagcagggtgatgcggacgtggcgcgcgatctgggtgcagaccagataagcgccctcagcggcaagccgggcgtgaaggtactgagcatcccttctgccgagcaaaactatctggtgtttaacaccggcaacagcgctaacccgctgctgaataatccagcgttctgggaagcctcgcgctggctggtggattatgaaggcatcaccaaagacctgctgaaaggccagtattttgttcatcagagcttcctgccggtcggcctgccgggcgcgctggaggacaatccgttcacgtttgacccggcaaaagcaaaagcgatcctcgccaaggcgggcatcaaagacgcgcatttcacgctggacgtggagaataaaccaccgttcatcaccatcgcgcaatccatgcaggcgagctttgctcagggtggcgtgaaggtggatctgctgcccgctgcgggtagccaggtgtacgcccgcgtgcgcgctaagcagcatcaggcggcgattcgcctgtggatcccggattacttcgatgcgcactccaacgccagcgccttcgcgtggaacgacgggaagtccagcaccgtggccggtctgaacggctggaaaatcccggagctgaacaaggccacgctggcggcggttgccgagccggatccggcgaaacgtctggatctgtataagaagatgcaggaacagttacagcataactcgccgtacgtgttcgttgaccagggcaaaactcagatcgtggtgcgcgataacgtgaaggggtatcagcaggggctgaacgcggatatggtctggtacgatcgcgttatgaagtag

SEQ ID NO: 4155 - DNA, 864 bp, Enterobacter cloacae
tgtatcagggtgagaacgttgatgaaatggcggcgagccagttgccgcaggcaacccatccctacacgcgcacgctctggacctgccgcccgaacgccgggacgtttggcaagatgctgccgacgctcgaccgttcgcaaccgtggaaggaggacgacaatggcactcgttgaggttaaccagctccgggtgagttttggtgaaaaaacggcggtttccgccgccagttttgccatcgaaaaaggtgaaaccttcagcctgatcggtgaatccggctgcggcaaatcgactcttctgcgcgtgctggcggggctgctgcccgagtggaatggccacatttccgtcctcggggaaaatttacggccaggacgacgttttgaaggcgcgcttcgccgcaacgtgcagatggtgttccaggatccgtgggcgtctttgcacccgaaccacaccattgcccgcaccctgtcggagccgttaaacatccacggcgaaagccaggttgccgaaaaagtggcggatgcgctgcaacaggtaggtctggctgccgatgcgggcaggcgttacccgcatcagctttccggcggacagcgtcagcgcgtggccattgcccgcgcgctgctgctgcgcccgcagcttctgctgctggatgaaccgacctcggcgctggatatgtcggtacaggcggagattctgaatctgctcaaccgcctgaaggcgcagcacggcatgacctacctgctggtgagccacgatgcggacgtgattgcgcatatgtccgaccgggcggcatttatggcgcacggggagatccagcgggtatttgaccgtgaagcaatgttgcggggcgagcacaggatggggtaa

SEQ ID NO: 4156 - DNA, 273 bp, Enterobacter cloacae
cggtcggacaggatcgacagcattaaagatctgcactgggacattcgccccagcccgcacattagcaccatgcaggtgcggtcgacggataagccgctgacgctcaacaacgcgattaatatcgcctggctgatccaggccacgtcacactggctgctgaccacgcggccttataagcatcaggaacgggattttctgcggtacctctttaccgttttcaggtgtgtcgctacggataggtggatattcagacgagccgttatgcgtttttaa

SEQ ID NO: 4157 - DNA, 537 bp, Enterobacter cloacae
accataaggtcttttcaggatttccttaaatggagttttaaacaaatggctattcccgcttatttatggcttaaagatgacggcggcgctgatataaaaggctctgtcgatatatatggacgtgaaggtagcatcgagattatcgccttaaatcacggcataatgcagcccacggacaagcataacggcaaggcgacaagtcttcgcatccattccccctattctttcgataaagagatcgacgcttccagcccctatttgtacaaggctgttagcacgggccagaagctaaaatccgcagagataaagttttaccgtatcaacgatgctggtcaggaagtggaatatttttccacccttctggaaggcgtgaagatcgccagcgtctgtccaatgatgcttgatatcaaagatcctgactatgagaagcataaccatcttgagctggtagagctgctctatgaaaaaattacctggcgctacgtggacggtaacatcatgcattcagatagctggaatgaccgtaagacggcataa

SEQ ID NO: 4158 - DNA, 753 bp, Enterobacter cloacae
caggtgtcggcggtgatgatggctttcaccgtcatctcgttcatggtcagggtgccggttttatccgagcagaccacggtcatcgcgcccagggtttcaaccgtcggcagcttgcggataatcgcccgcttgcgcgccatcgcctgtacgcccagagagaggatgatggagataattgccggcagaccttccggtacggaggcgaccgccaggctaatcagggagagtagcagctcgcccatcgggatctcgcggaacaccaggctgaagacaaacagcgcggccatcatcgccagaatgatggcgaagatcgctttgcccagcttgtccatctgcaccagcagcggggtgcggtgtttttcaatgcccgccatcatctggttgatgtggccgagttcggtctcctggcccgtggcaatgaccacgcccacgccgccgcccgcgctgaccgtcgtaccggaaaagaccaggttcgtacggtcgcccagcggtaattcgccgctcagcgggttcgtgtgtttatccaccacggtggattcaccggtcagaatagcctcttccacgcgtaaattatgcgcttcgattaagcgcatatccgccggaatacgatctcctgcgcgcaacacaataatatcgcccgggacgatttccgtcgtcgggatagtttcatggttgccgttacgaataacgcgcgcctcgctggagagcatattgcgaatactcttcagggatttttccgcgttactttcctga

SEQ ID NO: 4159 - DNA, 663 bp, Enterobacter cloacae
cattccgcgttgcagcgtatcaaggctcgtgtttcaatcagggcttttacaattgacgggaggaaaaatttagtggcacgtccgaagagtgaagataaaaaacaggccttactggaagcagcaacggctgcgtttgcgcagtcaggtattgccgcctcaacggcgttaattgcccgtaatgcgggcgtcgctgaagggacactgtttcgctactttgctaccaaagacgatctgctgaatgccctctacctgcatctgaagcaggatctctgccagaccatgctggcgaatctcgatcgcaccatcaccgagccaaaagagcatacccgcaatatctggaacagctatgtggactggggcattcgtaaccccctggcgcatgcgcctatccgtcagattggcgtcagtgaaaagctgaacgccgaaaccgagcaggcggtgaaagacatgttcccggaactgcatgaactgtgtcgtcgttcgatccgcccggtgtttatgtctgacgagtttaagaccttcggtgatgcaatgttcttatcgctggctgaaaccaccatggagtttgccgcccgcgatccgtcccgtgccgtcgattttaaagcgctgggctttgaagccatgtggcgcgggcttgctgaggaagataaccatggacagtaa

SEQ ID NO: 4160 - DNA, 1452 bp, Enterobacter cloacae
cgcaatggagtcaccatgaatacgtcagttgtttcaccgggtcgtgcgggcctgatattgctgttaaccggccagatgctgccgttgattgatacctcaatcaccaacgtggcgctggattccatcacccattcgttacacgccaccgccactgaactggagctgatcgtcgccctctacggcgtggcctttgccgtctgcctggcacccggcagcaagctgggcgataaccttggccgccgtcgcctgtttatgtggggcgtggcgtgttttggcctggcctcactgctgtgcggcatggcgggcaatatcgaacagttgcttggcgcgcgcattattcagggtgcgggcgccgcgctgatcatgccgcaaattctcgcgacgttgcatgtgacgttaaaaggaacggcacacgccaaagcgatcagtctgttcggcggtatcggcggaattgcgtttatcgtcggccagatgggtggcggctggctggtgtcggcggacatcgccgggcttggctggcgtaacgccttctttatcaacgtgccgatttgtctggtggtgctggcgttgagccgtcgctacgtaccggaaacccgccgcgacacgccgtcgcgcattgactggaccgggactgtcctgctgacggcaatactgtgctgtctgctgttcccgatggcgctcggcccgcagtggcactggtcgtggccgctgaaggccgcactgctggcgattgtgccgctggtctgtgtaatggtgctgaacgcgcgcaaaaaagagcgtgagaatgcccacccgctcatcgcgccgcgcctgttgcagctgcgcagcatccgctttggcgtgctaatcgggatactctttttcagcgtctggtccgggttcatgttctgtatggcgctgaccatgcaaagcggtctggggatggcgccgtggcagtccgggaacagctttatcgcgcttggcgtcacctattttatttctgcctggttcgccccacgcctgattgcccgctacagcaccagcgccatcctgctgaccggacttgcgattcagcttgtcggtctggtggcgttgatcgccacgttccgtcactggggaatgcagaataccgcgctgacgctggccccggccaccgggctggtgggttacgggcaggcgctgattgtaaacagcttctaccgtatcgggatgcgtgatattcagcctgacgacgcgggggccgcgagcgcgattttaagcacgctgcaacaggctgcgctggggcttggcccggccattttcggcgcgattttgctgcacgggctgcaaaatcatcacggagattacacccaggcggtcaatgtcttcctgatggtggaaacggccatgatggtggtgctggcgctggccacgctgcgtatgcgccatcgtctgtgtttaccggtcgtcaaggcctgtccggcgacaaaataa

SEQ ID NO: 4161 - DNA, 429 bp, Enterobacter cloacae
ctatattgtatcgcagagagcatggatgggtctgggaatggttatcgctggaacaattacgctcaatctggcgatcaagcaaaacaaataacaccaaaattaaacatgtatatcatactgaactgccttttctggctaattatttctgtcactatggaagtcactggcacgctattgcttcctgagaccaggaattttaaaaatattccattaacaattcattgcctgacttgctacgttatttctttttattcgttatcaatgcttatgggatatatttcaccagtcatggcttactccatctgggcgggactggggattgtactgattaccgtgatgagcagcttattttatcgattaaaaagcagcattctggaaaagatcggaattggctgcatcgtcaccgggctggcgatcatcgccttttaa

SEQ ID NO: 4162 - DNA, 879 bp, Enterobacter cloacae
ccttaccgacctgcttgtgcgggcgaccgatcccagggtgcgctaatgccgttttatctcttcttacgccgcctgcgccgctcccctgccgcgttttgcgggctgatcgccatcgcgctgctggtgcttatttccctgttcgcgccgtggcttgcgccgcaggatcccaactggcaggacgccgccgcgcgtctgcaaccgcccaacgcgcagcactggctgggtactgacagctatgggcgggatctgctctcccgattaatctacggcacccgtccggcactggggctggtggccttagtcaccgttattaccctccccgccggtctgctggtggggattttgtcaggctactacggcggctggatggagcgcatcctgatgcgcttttccgacgtggtgatgtcgatgccgcgcctgatcctcgccttcgcgtttgtggcgatgctcggcccggggctggtcaacggcgcgctggcgctggccttaacgacctggcctgcctatgcgcgccaggcgcgcagtgaaatccagcgtctgcgccacagcgattatctggccgccgcggagatgatgggcattcgcggcccgcgcctgctggtcggccatattctgcccctgtgcctgccctccgcgattgtgcgactggcgctggatctggccgggattattctggccgctgccgggctgggcttccttggtctgggcgcgcgtccaccgatggcggaatggggcgcgatgattgccgacggcatgcaggtcatttttgaccagtggtggattgccgccattccaggcggggcgattctgtttgccagcctggcctttaacctgctgggcgatggcctgcgcgacgtactggagccacagcatgactga

SEQ ID NO: 4163 - DNA, 1140 bp, Enterobacter cloacae
cagacaacggagtgcgccatgcccttacccgacttcaaatcctctgaaccttataccctcggcattgagctcgaactccaggtggttaacccgccgggttacgatctgagccaggactcctctgccctcatcgccgccgtcaaagacgacatcaaagggggcgaagtcaaacacgacattaccgaaagcatgctcgaaatcgccaccggcgtgtgccagaccatcgaccaggcagcggcgcagttctcggtgatgcagcagagcatcctgcgcgcggcggcggagcatcacatccagatctgcggcggcggaacgcacccgttccagaagtggcagcgtcaggaggtgtgtgacgacgagcgctataacgtcacgctggagcgctttggctatctgattttgcaggcgacggtgttcggccagcacgtacacgtcggctgtcggaccggggacgacgcaatttatctactgcacggcctgtcgcgctttgtgccgcactttatcgccctggccgccgcatcaccgtatatgcagggcacggacacgaagttcgcctcatcgcgtctcaacatcttctcgggcttcccggataacggacagatgccgtgggtcaacagctggcaggagttcgaggggctgttccgccgcttgagttccaccagcatgatcgacagcattaaggatctgcactgggacatccgccccagcccgcattttggcaccgtggaggtgcgggtaatggatacgccgctgacgctcggccacgcgattaacatcgccgggcttattcaggcgacgtcgcactggctgttgaccgcgcggccgtataagcatcaggaacgggattttctgctgtatcgctttaaccgttttcaggcctgtcgctacgggctggaaggcattctgacagacgtgcataccggcgagcacaaaaccgtggcggaagatatcgcctggctgctggagcaggttgcgccgtccgccgagaagctcggcgcgacaagcgcaatcaaggaaattgccctgctgttaaagcagggcaagagcgaggcgcagcgcatgcgggactttatcgccgatggcggctcgctgatttctctggtgcagaagcactgtgagctgtgggcgacgagtccgtaa

SEQ ID NO: 4164 - DNA, 267 bp, Enterobacter cloacae
ctgacgattaacattacgatgaaacacccgttagaatcgctgctcaccgcagggggcattttgctgatggccctgctctcctgcctgctgttacctgcgccgtcgctgggtctggtgctggcggagaagctggttcagacctttcatatggtcgatctgaatcagctgtacaccattctgttctgtctgtggtttttggtgctcggcgccatcgaattctttatcctgcgtttcatctggcgccgctggttttcactggcgtcgtaa

SEQ ID NO: 4165 - DNA, 2181 bp, Enterobacter cloacae
ttttatggcgatagcaaccaaggacgttcaataaaaatgtttaaaaataataagataatgcggctctggctactgagtctggcgacgaccagcgtcgcggctcaggcagaaacgaaagaagaaacgattacggtgacgcagggcgtgagtgaagagcccactgcgcccgtaaaaggcattgtggcgacgaaaacgctctccgccaccaagaccagcgcggagatcgtgaagacgccgcagtcggtatcggtgatcacccgcgatcagatgaacatgcaggacgtcacctccgtttcgcaggcgctgcgctactcggcgggcgtgtttaccgagtaccggggctcgtctaaccgtaacgacgaggtgtttgtgcgcggctttagctacgtgccgaaattcctcgacggcttaagctttggcgcaacggcctcatcacagacgggcacagttgacccgtggctgctggagcgcgtggaactggtgcgcggcccggcctcggtcctgtttggacaggtcaatcctggcgggttaatcagcatgaccagcaagcgcccgacggcggaggccattcacaacgtgcagttccgcaccggcaataacgatctcgccgaaggtgcgtttgatttcggcggcaggctgagcgacgacgggcgcgtactgtatcgcgtgaacggtatcgcccgtacgcagcataatcaggtggacgattataaagagacgcggatggcgatcgccccggcaatcacctggtacccgaacgatcagacccgctttacgctgctgaccagctaccagaaagatccggatgccggataccgcaacttcctgcccgcgtatggcacggtgaaaagtgccgacgggaagtacatcccgcgcgattttaacgtcagcgatccgaattacaatcaatcctggcgcgagcagacgatgattggctacgagctggaacaccagttcgccgacaacctcaccttccgccagaacgcccgttacgccaccatcaagcagaaatatcgttatctggtttacgccaacagcgcggccaacagcacggtgttgacccgtcgcgcccagcgtgaagcgcgcacgaccaacgaatttggccttgataaccagctggaatatcagctggagaccggaagcgtcagccacaccctgctcggcgggtttgattacaagaccagcaaggataaacagctgctggcgcgcgggagcggctcacagtatgaccttgactggacaaacccggtttacggcgtgaacgtggatgaaagtaccttcaaaacggcgtccgacgagcagcaaaatctcgaccagatgggcctgtatcttcaggatcagatgagctggaataactgggagtggctggtttccgggcgctacgactggagcgaagtgcgtaccagcgacttcaccgataacagcgttacgcagcagaacgacagcaaatttacctggcgcactggcctgctgtacgcgtttgattctggcctgtcgccgtacatcagctacagcacctcgtttgaaccgaacctgcaaaccaaccgtgcgccgggcgttgcgcccttcaggcctactaccggggagcagaccgagattggcgtgaaatatcagccggtcgacaccacgctgatgaccctggcgctgtacgatttaactcagaacaacgtcgcgacctataacagcgctgaaggctggttcgaaaatgcgggcaaggtgcgttcgaaaggcgctgaagcggaaatccacgccacgctgatggataacatcaacctgattggctcctacacttacaccgatgcaaaaaccgaaagcaccacggtggcgggaactgaaggcaaaacgcctgcgcgcattccggcacatatggcatcggcgttcgccagctataccgttccgggcggcgcgctgaagagcctgaccgctggcgtggggatgcgctacatcggcaccagctacggcgatgcgaagaataccttcaaggtgccatcggtggatctgtatgacgcgatgctgcgctacgacctgggcgagatgaaccgcagcctgaaaggggcaagcgtgcagttcaacgtcaataacgtggcagacacaaagtatgtggcgtcgtgcgcaagcgatacggcgtgcttctacgggattggccggacggtgacggcgacggtgaattacagctggtaa

SEQ ID NO: 4166 - DNA, 579 bp, Enterobacter cloacae
aagacatgttcccggaactgcatgaactgtgtcgtcgttcgatccgcccggtgtttatgtctgacgagtttaagaccttcggtgatgcaatgttcttatcgctggctgaaaccaccatggagtttgccgcccgcgatccgtcccgtgccgtcgattttaaagcgctgggctttgaagccatgtggcgcgggcttgctgaggaagataaccatggacagtaaatccttgcaggaacatgccagacgcgtcgcgctggagatgccttttaccgaacattgctggccgtttggcccggagtatgacgtgtttaaggtgggcgggaaaatttttatgctgatggcgaccgcacacggtcgggcccacgtcagcctgaaatccgatccggaaaaatcgctgctcaatcagcagatctaccgtggcgtggagcccggttaccatctgaataaaaaacactggatctccctttatggcacggacgacatcacgcctgaactggtcaccgacctgattacggattcgtggaatctggtcgttgataaactgccgaaaaaagatcagaagtggattcgcccagcctga

SEQ ID NO: 4167 - DNA, 774 bp, Enterobacter cloacae
ttgttcgtctcagacgaacagaataagcgctcgaatcgcacttatcttttcccgcttcgcgcggtaatctgctttcctttcacgcccgcccgcgggcgaatttcatcaccaggagttgttatggatattatttctgtcgccctgaaacgccactctaccaaggcgttcgacccagccaaaaaactgaccgcagaagaagcggaaaaaatcaaaacgctgctgcaatacagcccgtccagcaccaactcccagccgtggcactttattgttgccagcactgaagagggtaaagcgcgcgtggcaaaatccgcggcgggcacctatgtgtttaacgaacgcaaaatgctggatgcctctcacgtagtggtgttctgcgcgaaaaccgcgatggacgatgcctggcttgagcgcgttgtcgatcaggaagaggctgacggccgtttcgccacgccagaagcaaaagccgcgaaccacaaaggccgctgctattttgccgacatgcaccgcgtggatttgaaagatgacgaccagtggatggcgaagcaggtttacctgaacgtcggcaacttcctgctgggcgtggccgcgatgggcctggatgcggtacccatcgaagggtttgacgccgcgatcctcgacgaagagtttggcctgaaagagaaaggcttcaccagcctggtggtggtcccggtcgggcatcacagcgtggaagatttcaacgccacgctgccgaaatctcgcctgccgctgtgcacgattgtgactgagtgctaa

SEQ ID NO: 4168 - DNA, 1302 bp, Enterobacter cloacae
atttgcataatagatccgcagccgccattatggggctgcatcaatacaggagacgttatgcaggaattaattgctcaggttgaagagttagggattgaaattaatcacaccacctctttagtgattatctttggtattatttttcttacggccattatcgttcattttattctgcacaaagtggtgctgcgcgcattcgagaaacgcgcccaggccagcagccatttatggttgcagatcattacgcagaacaagttatttcaccgtctggcgtttaccctccaggggataatcgtcaacgttcaggcggttctgtggctgcaaaaaggcagcgaagcggcggaattacttaccacctgcgcgaaattgtgggtgatggtttatgccctgctctccttcttctcgttgctggacgtgattttcaatctgtcgcagaaaatggccaccgcgtcacagctgccgctgaaggggatattccagggcatcaagctggtaagcgccattctggtggggatactaattatctccctgctgatcggtcagtcacccgccattctgataagcggcctgggtgcgatggctgccgttctgatgctggtctttaaagacccgatactcggcctggtggccggtattcagctctcagccaacgacatgctcaagctcggcgactggctggagatgccgaaatacggcgccaacggcacggtgaccgacatcggcctgaccaccgttaaagtgcgcaacttcgataacaccatcaccaccatcccgacctgggcgctggtgtccgatgcgttcatcaactggagcggcatgtccgcctccggtggtcgccgcatcaagcgcagcctgaatatcgataccaccagcattcatttcctcgacgagcaggagcagcaaaaactgattcaggcgaaactgctgaagccgtatctggcggcgcgtcatgaggaaattaacctgtggaatcagcagaacggcgaaggggaatcggtattaaacctgcgcaagatgaccaatatcggcaccttccgtgcctacctgaatgaatatctgcgtaaccacccgcgtattcgtaaagatatgacgctgatggtgcgccagctcgcgccggatgctaacgggctgccgattgaaatatatgcttttaccaacacggtgatctgggcggaatacgaagatattcaggccgacatcttcgatcatattttcgcggtggtggatgaatttggcctgcgtattcaccagtcgccaaccggaaacgatattcgctccctggctggcgtcatcgcgcaataa

SEQ ID NO: 4169 - DNA, 786 bp, Enterobacter cloacae
cgcctgctgttttcctgtttacttcaccttcacactgtcctgcggtatcccggccgcctggaggctggaagtgaacaggacgacggagtgacagcgccagagcagacaggttttccctcgtgcgtgcagcacatctcacacgacattacaggcattaagcttgaacctattgtcgccctctcctcttcacgcgcggtgggagccgaagtgctcagcgtgctgtcgccgcatcagcaaagcgaaagctttttccaggactggtcagccacccgggcgcttgtgttgctggaagcacagatcgccgcgttaaaaaaccccttcccttgtgacaaccttttcataaatttgccgataaccgttctgaccataccggaaatgttccagcgtttactgcaacttaacagcccaccgctgaacattgaactcgtggaacctgcctcgttcttttcactctcagacccggtacgtcagagggtgagttgtgcgcttcagcagttgaccgcgcggggacaccggatctggctggacgatattgatgaagcgtcagggcaagcatttttatcctgtcgcctgccgttatgcggaataaaaatcgataagatcgctttctggcgtttacgtgaaacgccggcgctgacacagctggtcaccctttgttcaaaaattgctgcgaatgtgcttattgaaggcattgaaacagaacgggaccgtacatgcgcgcttcatgctggcgcgcgcttcggtcagggatattattggccatcctggagatggcaggaggactga

SEQ ID NO: 4170 - DNA, 297 bp, Enterobacter cloacae
ttaatctcaaggaaaaaggttatgaaaaaaacgactgctattttgatgggcgctgcatttctgtttaccaccaatacctttgcggctgaactgctgacgaaaaacgagtttgagaaagttgaatcacagtatgaaaaaatcggtaccgtgagcacggctaacgaagtctctgtcgacgatgcgaaaaaagagctggtcgaaaaggccgataaagaaggtgctgatgtactggtgctgacttccggtaatacaaacaacaaaattcacggcaccgccgatatttacaagaaaaaataa

SEQ ID NO: 4171 - DNA, 1986 bp, Enterobacter cloacae
caggaagccgctatgggcagacccctcaaatccgtatttaaaaaagaacatcgcgacgatatcagtaaccgcagcgctaacccggtattctccgaggttgcagaagtgttcctctcgcgccgccgttttctccagatgggggccgtagcgggggctgccgtatcattcccgtatctgatcacacccgaaaatgccattgccgcggtatcgaagccttccgcgctggcaaaagcggtttccctgggctttaccagcatcgacgtctctacggaagacacggtcagggtgccggaaggttatatcgcccgcccgttctatcgctggggcgatccgacggggatcaaggacaacatgccggcctttaagccggacgccagcaataccacagacgaacaggctgtgcaggcgggcatgcaccacgacggcatggcgtggtttagcctgccgcagggggcgcaaaacccggagcatggcctgctggcgctgaaccatgagtacatcgacaacggaatgctgtttaccgacggtacggcgaactggagtctcgacaaggcacgcaaggggcagaacgcgatgggcgtgtcggtggtggaagtgaaaaaaacgggcagcggctgggaggtagtgcgtccgtcttccttcgcccggcgtattaccgtcaatacgccgatgcagcttaccggcccggcgcggcatcaggatttaatgaaaaccgccgccgacccgcagggggaacgcgttctgggcaccatgcagaactgcgccaacggccacacgccgtggggcacctatctcacctgcgaggagaactggtcggacatttttgtcaaaaaagccgatctcaacccgctggaaaaacgctacggcatcagcgacagcgatgaatcgtaccgctggaacgaggtggatgagcggttcagcgttgataaaacccctaacgaacccaaccgtttcggctgggtggtagagatcgatccctacaacccgacctccaccccgcgcaagcacaccgcgctcggccgcttcaagcatgagggggccgccgtcacgctcgccgccgataatcgcgtggtggtctacatgggggacgaccagaagtttgagtacatctataagtttgtctccgacaaaaaatacgatcccgcgaaccgggaagccaatatgcagctgctgacgtccggcacgctgtacgtcgccaggttcaacgaggacggcagcggcgactggctgccgctgatcttcgggcaaaatggcctggataaaagcaacggttttgcaagccagggcgatctgctgattaaaacccgtctggcggccgacgtggtgggggcgacgaaaatggatcgcccggagtggatagccgtcgatccgcacgccagcggcagcgtctactgtacgctgaccaacaacagcgatcgcggtaaagagggcaaggcgccggtggatgccgccaacccgcgcgctaataacgtgtttggtcacatcatgcactggcacgaagagggtgccgatcctgccgccgcacgctttaagtgggatattctggtcatggccgggcgcaccgacggcgacgatcccaaagccaaaggctcgatgcagggcgcggcatttggcagcccggatgggttgtcgttcgatcaccagggcgtgctgtggatccagaccgacgtttcctccagcaccatcaataagaaagcctacgaggggatgggcaataaccagatggtggccaccattccgggcaccaacgagtatcgccgtttcctgaccgggccgcgcgggtgcgaaatcaccggcattgcgtttacgccggacaaccgcacgctgtttatcaacattcagcatccgggggagggcggggatgatattaccgacccggccaatccgcgcgctgtttccaactggccagacgccagcccgaacgggcgtccgcgatcgtcaacggtggtgattaccaaagcggacggcgggatcatcgggtcgtga

SEQ ID NO: 4172 - DNA, 1392 bp, Enterobacter cloacae
ggcgtgaaagacgcgtcatccgcttcaggccatggtagcgctgaagcctcgtcggatcagaatccgacgctgcaacgtggtttgcaaaatcgacatattcagttaattgcccttggcggcgcaatcggtaccgggctctttctcggcatcggccccgctattcagatggccggtccggcggtgctgctgggttacggtatcgccgggattatcgccttcctgatcatgcgccagctcggcgagatggtcgttgaagagccggtgtccggctccttcgcacactttgcctataaatactgggggccgttcgcaggtttcctctccggctggaactactgggtgatgttcgtgctggtcgggatggccgagctgaccgccgccggcatctatatgcagtactggctcccggacgtgccaacgtggatttgggccgcggccttcttcatcatcattaacgccgttaaccttgtgaacgtccgcctgtatggcgagaccgagttctggttcgcgctgatcaaggtgctggcgattatcggcatgatcggctttggcctgtggctgctgttctccggccacggcggcgagcgcgccacgatcgataacctgtggcagcacggcggctttctggcgactggatggaaagggctgatcctctcgctggcggttattatgttctccttcggcgggctggagctgattggcatcaccgcggctgaagcgcgcgatccgcacaaaagcattccgaaagcggtcaaccaggtggtgtaccgtatcctgctgttttacatcggctcgctggtggtgctgctggcgctctacccgtgggtggaagtgaaatctgacagtagcccgttcgtgatgatcttccacgatttgaacagcaacgtggtcgcttcggcgctgaacttcgtcattcttgtggcgtcgctgtcggtctacaacagcggggtttactccaacagccgcatgctgtttggcctctccgtacagggcaacgcgccgaagttcctcactcgcgtcagccgtcgcggcgtgccggtcaactcgctgttcctttctggcgctatcacctcgctggtggtgctgatcaactatctgctgccgaaagaggcgtttggcctgctgatggcgctggttgtcgccacgctgctgcttaactggatcatgatctgcctggcgcacctgcgcttccgcgcggcgatgcgccgcaaggggcgcgagacgcagttcaaagcgctgctctatccggcggggaactacctctgtatcgccttcctcggcctgattctggtgctgatgtgcaccatggatgagatgcgcctgtcagcgatgctgctgccggtgtgggtggtgttcctgtttattgcatttaagctctcgcgcaaaaagtag

SEQ ID NO: 4173 - DNA, 1296 bp, Enterobacter cloacae
tcgattactttttatttgaactgttttgtaatcgattactttttccgggtgaggcttatcatggtgtcaactgagagtagtgaaaaggcgataacgcaacaccggctgctggtgccgcgtctgtcgctgatgatgtttctgcaattttttatctggggtagctggtcggtcacgcttggcctggtgatgacccggcacaacatgtctttgctgattggcgacgcgttctctgccgggcccatcgcttccattctttcgccgttcgtgctcgggatgctggtggaccgcttcttcgcctcgcagaaggtgatggcggtgatgcacctcgcgggcgcggtgatcctctggttcgtgccgggggcgctgattgctgagaatggcgcgctgctgattggcctgctgtttggctacacgctctgctatatgccgacactggcgctgaccaacaacattgcgtttcacagcctggcgaacgtggataaaaccttcccggtagtgcgcgtgttcggcaccatcggctggatcgcggcgggcattttcatcggcgtcaccggcgtggcgtccagcgtcaccatcttccaggtggcggcggtcagctccgtgctgctggcggtctacagcctgacgctgccgcacacgccagcgccggcaaaaggcctgccggttaaggtgcgggatctcttctgcgcggacgccttcgcgctgcttaaaacccgccacttcttcgtcttctccgtctgcgcgatgctgatctctgtcccgctcggcacctattacgcctacaccgcctcgtatctggcggatgccggcattgccgacgtcagcaccgccatgtccttcgggcagatgtctgagatcgtcttcatgttggtcattcctctgctgttccgccgactgggcgtgaaagtcatgctgctgatcggcatgctggcgtggttcgtgcgttatgccatgttcgcgttgggcgtcagcgaagaggggcgcattctgctgtaccttggcattctgctgcacggcgtctgctacgatttcttctttgtcgtcggctttatctataccgaccgcgtggcgggcgaaaaggtgaaaggccaggcccagagcatgatcgtgatgttcacctacggcatcggcatgctgctcggctcgcagatttccggcgcgctctacaaccgcctggtggcaggacagaccgtgccgcaggcgtgggtcacattctggtggataccggcggtggctgccgcggcgatcgcgctgattttccttctcacgtttaagtatgacgatgacaaggcgtaa

SEQ ID NO: 4174 - DNA, 1041 bp, Enterobacter cloacae
cgttcaggaggtggtatgaggacaatgaaaggaccgggcatttttctgtcgcagtttattggcgcagaagcgccgtttaattcgctcgacgggcttgctgaatgggcggcaggtaaaggttataaggcggtgcagatcccctgcaaccatccgcacatctttgacgtcgagaaagccgcagagagccaggcctactgcgacgacatcaccgccaggctggccgcacacgggctggttatcagcgagctgtcgacccatctggaagggcagctcgtggcggtgaatccggtttacagcgaggcgtttgaccacttcgcacccgccgccgtgcgcggtaacgaggcggcgcgccgggcgtgggcgacggaaaagctgaagcaggcggcggtcgcttcggccagattagggctgaaggcgcacgcgaccttctccggctcgctggcgtggccgtttttctatccgtggccgccgcataaccagcagcgttttcaggaagcgttcgaggagctggcaacccgctggcggccaatactggataccttcgacgagcagggggtggacgtctgctttgagctgcatccgggggaagatctgcacgacggcgtgaccttcgagcgttttctggcgctggtggataaccatccgcgctgcaacattctctacgacccgagccatatgctgcttcagcagatggactatctggcctttatcgatatcttccacgcgcgcattaaagcgttccacgtgaaggacgcggagttccgccccagcgggcgcagcggcgtctacggcggctaccagccgtggatcaaccgcgccggacgctttcgctcgcccggcgacgggcaaatcgactttaagggcatcttcagcaagctgacccagtacgactacgacggctgggcggtgctggagtgggagtgctgcctgaaggatggcgataccggcgcgagtgagggcagcgaatttatccgccggcacattattcccgtttccggacgggcgtttgatgatttcgccgcagggggctgccatgattaa

SEQ ID NO: 4175 - DNA, 420 bp, Enterobacter cloacae
taccacgcaacaatttcgcgagtggtgggaataatgtttaagcgagaagcagagggggagagcagtatgacgatttccgctcaggtcattgatacgattgtcgaatggatcgatgacaacctacaccagccgttacgcatcgaagagattgcccgccatgcgggttactcaaaatggcatttacagcggctgtttatgcagtacaaaggcgaaagtctggggcgctacatccgcgaacgcaagctgctgatggcggcgcgcgatctgcgtgagtcagacgagcgcgtgtacgatatctgcctgcgctacgggtttgactcgcagcagacgtttacccgcatctttacccgcatctttacccgcaccttcaaccagccgcccggggcgtaccgcaaagaaaaccacggtcgggcgcactga

SEQ ID NO: 4176 - DNA, 2721 bp, Enterobacter cloacae
aggaaaaataccatgaccaaaaaaaatttctcgcagaatatgccacccgcaggcgggcaggcgtaccagcagaccgtagagcaggtgcttgctcaggcgcagagccaggctaatggcctggaccgcgccgaggcgcaggcacgtttgcagaaacatggcccgaacgcgctgccggagaaaaaaggcaagccgggctggctgcgttttctcgcgcattttaacgatgtcctgatttacgtcctgctggcagccgccgtattaacggcagtaatgggacactgggttgatacgctggttattctgggcgtggcggtaatcaatgccttaattggccacattcaggaaagtaacgcggaaaaatccctgaagagtattcgcaatatgctctccagcgaggcgcgcgttattcgtaacggcaaccatgaaactatcccgacgacggaaatcgtcccgggcgatattattgtgttgcgcgcaggagatcgtattccggcggatatgcgcttaatcgaagcgcataatttacgcgtggaagaggctattctgaccggtgaatccaccgtggtggataaacacacgaacccgctgagcggcgaattaccgctgggcgaccgtacgaacctggtcttttccggtacgacggtcagcgcgggcggcggcgtgggcgtggtcattgccacgggccaggagaccgaactcggccacatcaaccagatgatggcgggcattgaaaaacaccgcaccccgctgctggtgcagatggacaagctgggcaaagcgatcttcgccatcattctggcgatgatggccgcgctgtttgtcttcagcctggtgttccgcgagatcccgatgggcgagctgctactctccctgattagcctggcggtcgcctccgtaccggaaggtctgccggcaattatctccatcatcctctctctgggcgtacaggcgatggcgcgcaagcgggcgattatccgcaagctgccgacggttgaaaccctgggcgcgatgaccgtggtctgctcggataaaaccggcaccctgaccatgaacgagatgacggtgaaagccatcatcaccgccgacacctgctaccgcgtggacggcaacagctacgagccggtgggcaacatctatctcgaaggcagcgatgagccggtgcagatccagccgggcaccgtgctggagcagtacctgcgcaccatcgacctgtgtaacgacagccagctgattcaggacgagcgcggcctgtggggcatcaccggcggcccgaccgagggcgcgctgaaggtgctggcggccaaagcccacctcgagccggtcgtgaccacgctggttaacaagatcccgttcgactctcagtacaagtacatgagcacccactaccagattggcggtgaggagcagattttgatcaccggcgcgccggacgtgattttcgccctgtgtgagcagcagcagacccgcaacggtgcgcaagcctttgaccgcgcgtactgggaaacggagatggagcgctatgcgcgtcaggggctgcgcatggtcgccgcggcgttcaagccagcgaacggtgagcaggcattgactcacgacgatctgagccacggcctgatcttcctcggcatcgccgggatgatggatccgccgcgtccggaagcgattgaggcgattaacgcctgccagcaggcggggatccgcgtgaagatgatcaccggcgatcacccgcagacggcgatgagcatcggccagatgcttgggatcaccaacagcgagcaggcggttaccggctatcagctggagaaaatggacgacgccgagctggcggaagcggcggtgaagtatgacatcttcgcccgtaccagcccggagcataagctgcgcctggtgaaagcattgcaggataaaggcgaaatcgtcggtatgaccggtgacggcgtgaacgacgcgccggcgctgcgccaggcggacgtgggtatcgcgatgggcatcaaaggcacggaagtgaccaaagaggcggcggacatggtcctgacggacgataacttcgccaccatcgccagcgcggtgaaagaggggcgtcgcgtttacgacaacctgaagaagaccatcctgttcatcatgccgaccaacctggcgcaggggcttttaattgtgattgcgctgctggcggggaacatcattccgctaacgccggtgctgattctgtggatgaacatggcgacctccgccacgctctccttcggcctggcctttgaggccgccgagcgcaacatcatgcgccgcccgccgcgccagaccgggcagcacgtaatggacgcctacgccgtctggcgcgtggccttcgtcggcaccatgattgccatcgccgcctttgcgctggaagcctggctggccccgcgcgggcacagcgcggagttcatccgcaccgtgctgctccagatgctggtctgcgcccagtgggtgtacatgattaactgccgcaataccgaagggttctccctgaaccgcggcctgctggcgaacaaagggatctggctggtaacgggcgtactgttcctgctccaggcggcgatcatctacctgccatttatgcagatgctgttcggcaccgaagcgcttccgctgcgctactggttcgtgacgctggcggtggcgggggtgatgttcttcgtcgtcgaaatcgagaagcgactgacccgcaggttccgtaaggctgcataa

SEQ ID NO: 4177 - DNA, 1092 bp, Enterobacter cloacae
gggaaaacaacgccgaggtacttcttaatgaaactcccactcctgttcgcgctcctcgcctgcaccctgcaacccgcgttcgccgcagtcattcccgtgcgtgttgccaccgtggagcaaaccgcccacgccgccgagcgccaaattccgggccgcattgaagctatccacaccgttgaactgcgtgcacgtacggaaggcgtcatcaccagaatccacttccgcgatggccagtatgtgaaaaaaggcgacgtgttgttcgaactggacgacgccgagccgcgcgccgccctgcgtctggcgcaggccgaagtgagaagcgccgaagccacgctgcgtcaggcgcagcagcagctgtcccgcttcgaaagccttggcagcagtaacgccatcagccgccacgacgtggacaacgcccgcatgcagcgcgacgtcgccagcgccgcactggagcaggcgaaagcccgtctcgacacccgcagcgtcactctcgactacacgcgcattatttcaccgattgacgggcgcgtggggcacagcaactttcacgtcggcagcctggtgaatcctgccagcggtgtgctggtggaggtggtgcagctcgatccgatccgcatcgcctttgcgctggaagagggcgcgtttgccaccaaagccggacagcatgcggatatcagcgccatgaagcaggcctggcaggcgctgattgacagcaacggccagcgcatcagcggggaactcacctccgtggacaaccgcatcgacccgcgtaccgccagcgtgatgctgcgcgccgagttcgccaacccgcgccatcagctgctgcccggcggcaatgtgaacgtttacctgcgtccggcaagcgagctaccggtgctgactctgcccgccgctgccgtacagcagaatggcgacgggttcttcgcctgggtgattaacgccgaggataaagccgaaatgcgtccgctgaaggtcgccgggcagatcggccagcagttccagattgcctccggcgtgaagcccggtgagcgagcgattactgacggtgcgcagcgcgtgcagccaggcgttgccgtccagatactgaattaa

SEQ ID NO: 4178 - DNA, 3165 bp, Enterobacter cloacae
ggagccatcatgctgacgtttttcatcaaacgcccgcgctttgcgatggtgattgcgctggtcatcaccctgctgggggccatcgcgctgaggattattccggtggagcagtacccgcagatcaccccgccggtcgtgaatgtgtcagcgtcatggccgggcgccagctcggctgacgtggcggaggccatcgccacgccgctggagacgcagctgaacggggtggatcatatgctctatatggagtccaccagttctgacgaaggcacgtacagcctgaacatcacctttgcggcaggcaccgacccggatctcgccgccatcgacgtgcagaaccgcgtggcgcaggccgtggcgcagctgccgaccgaggcgcagcaaaacggcgtgcaggtgcgcaagcgcgccaccaacctgatgatgggggtaagcctttactcaccgaacaacacccacacgccgctgttcgtcagcaactacgccagcacccaggtgcgcgaggcgctgtcgcgtctgccgggcgtcgggcaggtacagatgtttggcgcacgggactacagcatgcgcatctggctgaggccggaccgcatgaacgccctgaacgtgaccagcgatgacgtggcgcaggcgctgcgcgagcagaacgtgcagggggcggcgggccaggtcggcacgccgccggtgtttaacggtcagcagcagacgctgaccattaacgggctggggcgcttaaaccaggccgacgactttgccaatatcattatccgcgccggggagatggggcagctggtgcgcctgaaggacgtcgccaccatcgagcttggctcgctcagctacagttctggcgcgcagctgaacgggcatgactccgcctatttgggtatctacccgacgccgtccgctaacgccctgcgcgtggccgatgcggtgcgcgcggagctggaacggttatccacgcgcttcccggacgatctggtctatgaagtcaaattcgacaccacctcgtttgtggccgccaccatcaaagagattggcgtctcgctggcgctgacgatgctggcggtggtggtcgtggtgtccctgttcctgcaaagctggcgcgcgacgctgattgtcgcccttgccattccggtgtcgctggtgggcaccttcgcggtgctctatacgctcggctactccgccaatacgctgagcctgttcgccatcattctggcgctgaccatggtggtggatgacgccatcgtggtggtggagagcgtcgaaacgctgatggcggaagggcagagccgcacggcggcgaccgcgctggcgctgcgccagattgccgggccagtgattgccaccacgctggtgctgctggcggtgtttgtaccggtggcgctcctgccagggatcgtgggcgagctgtaccgccagttcgcggtgacgctctcgaccgccgtcacgctctcaagcctggtggcgctgaccctgacgcccgcgctctgcgcgctgctgctgcgcccgcgaccggcacagcccgccgccgttttccgtgggttcaaccgcgggctggacgccacgcgcacgctttacacccggatcgtgagcgtgttcaacctccgtccgtggctggcgctgctggccaccgcaggcgcggcggcggtggtggtattcagctttatgtcgatgccaaagggcttcctgccccaggaggatcagggctacttcttcgccagcgtccaactgccggaggcagcctcgctggagcgcaccgaagcggtgatgaccaccgcgcgcgagctgatcgctaaaaacccggcggtagaagacgtgattcaggtctccgggtttaacatcctcaacggcaccagcgcatcgaacggcgggtttatctccatcatgctcaaagactggagcgagcgtccgccgctggatgaggtgatgggcacccttcagcgacagctgctggccctgccggaagccaccatcatgacctttgcgccgccgacgctgccggggctgggcaacgcctccggcttcgacctgcgcattcaggcgcaggcggggcaaagcccggcggagctggagcgcgtgacgcgtgaggtgctggcgaaagccaaccagcacccgcagctgagccgcgtgttcaccacctggagcagcaacgtgccgcagatgacgctcaccgttgaccgcgagcgcgcggcccgcctcgacgtgccggtgtcacgcatcttcagcagcctgcaaaccgcctttggcggcacgcgcgccggggatttcagcgtcaacaaccgcgtctaccacgtagtgatgcagaacgagatgcagtggcgcgagcgcgcggagcaaatcagcgagcttttcgtgcgcagcaacagcggcgagcgggtgcgtctgagcaacctcgtcaccatcacgccgaccgtcggcgcgccatttattcagcagtacaaccagttcccgtcggtatcggtgagcggctcggcagcggaaggggtgagcagcagcaccgcaatggcggcgatgggcgagattctggcggaaaacctgccagccgggtacgactacgcctggagcggcatgtcgtatcaggagcagcagaccggcaatcaggcgatatggatcgtgctggcggcggtggtgatggcgtggctgttcctcgtcgcccagtatgagagctggacgctgccggcgagcgtgatgctctcggtgctgttcgccatcggcggggcgctggtctggctgtggctggcgggctatgccaacgacgtgtacgtgcagattggtctggtgctactgatagccctcgccgccaagaacgcaattcttatcgtggagtttgcccgcgcccggcgcatggacggaatggcgattgtcgatgccgcacgggagggggcatcgcgccgcttccgcgcggtaatgatgaccgccgtgtcgttcattatcggcgtcctgccgatgatgctggcgaccggggcgggcgcccagagccgccgcatcatcggcactacggtcttcagcggcatgctggtggcgaccgtggtggggatagtgttcatcccggcgctgttcgtgctgttccagcgcctgcgcgagtggggccacggccttacggactcgtcgcccacagctcacagtgcttctgcaccagagaaatcagcgagccgccatcggcgataa

SEQ ID NO: 4179 - DNA, 306 bp, Enterobacter cloacae
ggccgcgtggtcagcagccagtgtgacgtggcctggatcagccaggcgatattaatcgcgttgttgagcgtcagcggcttatccgtcgaccgcacctgcatggtgctaatgtgcgggctggggcgaatgtcccagtgcagatctttaatgctgtcgatcctgtccgaccgtcaggcggatcgcctgatggagtgggacatacgcaacggcgtgatccagcgctatggccgcaggcacgggattgcggtgcccgtcagcgatgtggtggtgccgctgctggcggcggggagcgaggggccggggtga

SEQ ID NO: 4180 - DNA, 723 bp, Enterobacter cloacae
cacagctctgatgctacactgttttcagtcctcattacctcatcaaataaatttatgactaccgctgatttcaaacgccctaaactagaactcccaaacggggctgataaactgctgctgcactcctgttgcgctccgtgttctggtgaggtaatggaggcgatccaggcctcagggatcgactacaccatcttcttctacaatccgaacattcatccgcagaaagagtatctgattcgtaaggatgagaatattcgctttgccgaacagcacggcgtaccgtttatcgatgcggattacgatacagataactggtttgagcgcgccaaaggcatggaatgggaacccgagcgcggcattcgctgcaccatgtgttttgacatgcgctttgagcggactgcgctttacgccgctgaaaatggcttcaacgtgattagcagctcactgggcatctctcgctggaaaaatatgcagcaaatcaacgactgcggtcagcgagccgccgcccactatccgggtatggtctattgggactataactggcggaaacagggcggttcgtcgcgcatgattgaaatcagcaagcgcgagcagttctaccagcaggaatactgcggctgcgtttattcactgcgtgacagcaacctgcaccgcaaatcccagggccgtcctctcattcagatcggtaagctttactacggtaaagaagacgaccaggcctga

SEQ ID NO: 4181 - DNA, 804 bp, Enterobacter cloacae
ataaagttgaagaggacgggcatgatgatgcattcatctgcatgcgactgtgaggcgagtttatgcgagaccctgcgtgggttctcggctcagcatcctgacagcgtgatctatcagacatcgctaatgagcgccctgctaagcggcgtctacgaaggggagacgaccatcgccgacctgctggcacacggtgattttggtctcggtacctttaacgagctggacggtgaaatgattgccttcagcagccaggtgtaccagctgcgcgccgacggcagcgcccgcgccgcgaagccggagcaaaaaacgccgttcgcggtgatgacctggttccagccgcagtaccgcaaaaccttcgacgggccggtcagccgtcagcagatccacgacgtgatcgaccagcaggtcccctccgataacctgttctgcgcgctgcgcatcgacggcaatttccgccacgcgcacacccgcaccgtaccgcgccagacgccaccgtaccgggcgatgaccgacgtgctggatgaccagccggtgttccgctttaaccagcgcgagggcgtgctggtcgggttccgcaccccgcagcatatgcaggggataaacgtggcgggctatcacgagcactttatcaccgacgaccgtcagggcgggggccacctgctcgactatcagctggagaacggcgtgctcaccttcggcgaaatccacaagctgatgattgacctgcccgccgacagcgcgtttttacaggccaatctgcaccccagcaaccttgatgcggctatccgcgccgtcgaaaactaa

SEQ ID NO: 4182 - DNA, 834 bp, Enterobacter cloacae
cccgctgctgatgggccagctccatctcagccagattttgtgaatcaatataaggacagagaaatgcaaaaagtggctctcgtaaccggctccggccaggggattggcaaagcgattgcgcttcgcctggtgaaggatggttttgccgttgctattgcggattataacgaagagacggcgaaagcggtcgcggatgagatcacccgcaacggcgggaaggccgtcgccgtgaaggtggacgtctctgaccgcgagcaggtgttcgcggcggtggaaaaagcccgcaccgcgctgggcggttttaacgtcatcgtcaataacgccggggtggcgccgtccacgcccatcgaatccatcacgccggagattgtcgacaaggtctacaacatcaacgtgaaaggggtgatctggggcattcaggccgcaattgacgccttccgcaaagaggggcacggcggcaaaatcatcaacgcctgctcccaggcgggccataccggcaacccggaactggcggtctacagctccagcaagttcgcggtgcgtggcttaacccagaccgccgcgcgggatctcgcgccgctggggatcaccgttaacgcctattgcccgggcatcgtcaaaacgccgatgtgggcggaaatcgaccgtcaagtctccgaggcggcgggtaaaccgcttggctacgggacggaaacctttgccaaacgcattacgcttggccgtttgtccgagccggaagacgtggccgcctgcgtctcttacctcgccgggccggattccgactacatgaccggtcagtcgctgctgattgatggtgggatggtgttcaactaa

SEQ ID NO: 4183 - DNA, 258 bp, Enterobacter cloacae
aaaccgccgccgacccgcagggggaacgcgttctgggcaccatgcagaactgcgccaacggccacacgccgtggggcacctatctcacctgcgaggagaactggtcggacatttttgtcaaaaaagccgatctcaacccgctggaaaaacgctacggcatcagcgacagcgatgaatcgtaccgctggaacgaggtggatgagcggttcagcgttgataaaacccctaacgaacccaaccgtttcggctgggtggtag

SEQ ID NO: 4184 - DNA, 1245 bp, Enterobacter cloacae
aggatggcgataccggcgcgagtgagggcagcgaatttatccgccggcacattattcccgtttccggacgggcgtttgatgatttcgccgcagggggctgccatgattaacgtcgggattatcggcagcgggtttattggcccggcacacatcgaggcgctcaggcgtctcgggtttgtgcaggtggtcgcgctctgcgacggttcgctcgttaaggcgcaggaaaaggcgcgccagctaaatgtcccgcatgcttacgccagcgtggaagaactgctcgcgcaccccaatctgcatgcggtgcacaactgcacgccgaaccacctgcacgcggagattaaccgccagatcctgcgcgcgggcaagcacgtgttttccgaaaagccgctgtgcatgacgccggacgaggcgcgcgagctggtggcgctggcagagcaggcgggcgtggtgcatggcgtgagctttgtctatcgtcagtttgcgatggtgcgccaggcggcgagcatgatgcgcgcgggcaccgtcgggcggctgttcgcctcgcacggcagctatttgcaggactggatgctgctggaaaccgactacaactggcgggtggaggccgcgctcggcggcgcgtcgcgggcggtggcggatatcggttcccactggtgcgatacggtacagtatgtgacaggcaggcgcattaccgaggtgatggctgatttatccatcgtctggccgaggcgcaaggccagcgcgggtggttatcagaccttctcccatgacgagcaggcggagtatgaagtcaaaccggtcaccaccgaagattttggctcggtgctgttccgctttgacgacggcagcaagggcagctttagcgtctcgcaggtgagcgcggggcgaaaaaaccgcctgacctttgaaattaacggcagcgagcagtcggtggcgtgggatcaggaaatcccgcagcagctgtggatcggccatcgcgcgcgggcaaaccagacgctcaccgacgatccaggcctgatgaaccctgacgtggccgacagcgcccacttccccggcggacatatcgaaggctggccggacgccttcaaaaatatgatggcgcagttctaccgcgccgtgcaggcgggcgcgatgccggatacgccgcagtttgcgacgtttcacgatggcgcaaacgtgatgtatatcattgatgccattgtgaaaagccatcagcagcagcgctgggtgcgcgtggaacaataa

SEQ ID NO: 4185 - DNA, 1020 bp, Enterobacter cloacae
atttatggtagcctgcacaaaacgctaaccgcaggatgtgtcgtcgctatgtcaattcagaaaatcgctcagctggccggggtctccgtggcgacggtctcccgcgtgctgaataacagcgacaccgtgaaggcgaaaaaccgcgagcgcgttctgcgggcgattcaggagagcaactaccagccaaacctgctcgcccgtcagctgcgcaccgcccgcagctatatgatcctggtgatggtgtccaacattgccaacccgttctgcgccgaagtggtgaagggcatcgaagccgaggcggaaaagaacggctatcgcattctgctgtgcaactccggctcggatattgagcgctcccgctcgggcttaagcctgctctccggcaaaatcgtcgacggcattatcaccatggatgcattctcgaaactgccggaactggccgcgctgattggcaacgcgccgtgggtacagtgcgctgaatacgccgatgcgggcgcggtctcctgcgtcggcatcaatgatgtggacgcttcacagcatgccgtcagccagctggccgacggcggccgcaagcgtatcgcgatgatcaaccacgatctcagctacaaatatgcccgcctgcgcgaacgcggctacaagagcgtgatccacctgcgggatctggactatcaggcggtggagtatgccagcgatctcagctccggggcgggcatggcggcgatgcaaaacctgttaaaagataatccgccggatgcggtatttgccgtttccgatacgctggcggcgggcgcgctgcgcgccattcagcaggcaggtcttcgggtgccggaggatattgccgtggtcggctttgacggtacggagctggcggacatgatttcgctcaccaccatcgaacagccgtcgcgggatatcgggcgcaaggcggtcgatctgctcttaaataagatcgacaacccggacgcgcccacggaaagggtgatgatggactggcgctttatttcccgcgccagcacctga

SEQ ID NO: 4186 - DNA, 309 bp, Enterobacter cloacae
aacgacaacaggagatgttggatgagcaaaaagattattgactgggacgaactcagagctgaactgttaagcgattcagaagttcaggcttcctttgatgcagaagagcgcaaggaacgcctgcgggagatgctggcgcaatggcgcaatcatgctggtctgacgcgcgcccaggtggcggagcggatgggcgtcagcgcaccgacggtatcacgaatggaagcaaatattacccgggcgagtctcgatacattaacgcgttatgcgctggtgtgcggggtaaagcatccgcagataacgctttactga

SEQ ID NO: 4187 - DNA, 1632 bp, Enterobacter cloacae
tattgcaaattattaccatttgcattagcgttgttaacaaatttcgttggggaacaagcggtaatgaagagggtatggagtgggttgctgttggggatcggcgcgctgcccgccgtggcggcaacgtgcgagcagacgtcccggcagggcgatattcagggaaagtttgatgccagcggcgaagtctgcttctccctgcctgaactgggtgaaaactacgtttccgccacgctgaatggcgtgacggatgcgcgcctgcttgatgggcaaaaccgccgcatccgcacgctgatcgaaaatggtcctgcggacggggaacacacgctgctgtttgccctgccggtgaaacagaacacctcgctggtgctacacggagaagccggtaagccgtggcgttttcagtggcggatgaaagagacctctccgttaccacgcgtgcagatgctggcgcctgaaagcccgacgctgaaggcgctggcaagcgtcatttctgccggtggaagtaccgaggcgttctggcaggcgcagcgtcgacagggaacgccgatggtggagccggtagatgcgagccataagcgcgtgacctttctgtggcgcggcgcgcgggataacgtcttcattctcggctctccggcgggggatcacgatccgctgttccgcctgggcaacagcgacgtctggttccgcagctatgtagtccccgctgatacggtaatgcagtacaagctcgcgcccgatgtgccgatcgtcgagggttccacacgcgatcaacgccgcgccatcctggtaagcgcgcaggccgatccgcttaacccgaataccttcggggagcagaagaccgatcgctggaatcgcttttctctgctcgatctcagcccggcgcgctattgctccgttcaggccacggcaaagccgctggtgcacgggacgttgagccgtcagagtttttccagccacatccttggcaacgcccgcgacgtgatgatctaccaaccgcgcggcgcacagcctgcacgctggacgctcatccttttcgacggacaggtttatcaggacgaataccattttgccaacgtgctggacggtctgattgccaggcatcacctgccgccgattaacgtggtgtttatcgacagcctcgatcacgcgcgccgcggcaacgagctgccgccgaacccggattttgctgactttatggcgcacgagctgctgccgtggctgcgggggaagggcatcggcatgcagcggcagaaaaccgtactggcaggatccagctacgggggaattgcctcttcatgggtggcgctgcgctatccgcgcctgtttggcaacgtgctgagcctttccggttcttactggtgggcgccggaaggtgacgccccaggctggctgacgcgtcagtaccaacagtctccaccgtatccggtgcgcttctggttacaggccgggaagtttgaaaccgcggggccgggcggcggcatctatcgcaccacgcaggattttgaacaggtgctgaggaaaaaaggctaccgcgtcagcttccacccctcatccagcggccacgactacgcggcctggtgtgaagcgctgatccacgggatgcgcgatctcactggcttacgacgccagtga

SEQ ID NO: 4188 - DNA, 894 bp, Enterobacter cloacae
cccatgtctgactatccaaccattgcgctgacaggacccggtgcgattgggaccaccatcgccgcggtgctgcatgaagcgggccgcacgccgctgctgtgtggtcgcaccgcgcatccggaactgcgcctgcgtcatgatgagggtgaaattgtggtgcccggtccggtactcaccgatcccagcgtcattacgcgccccgttgacctcgtttttttggcggtcaaaacgacacaaaatgccgacagcgccgggtggctgcgtgccctgtgcgatgaaaacaccgtggtctgcgcgctgcaaaacggcgtggagcagaaagcccagcttgcgcctttggttaatggcgcaacggtactgccctcggtggtctggttccctgcccagcgcgagccggatgcctccgtctggctgcgcgccaaaccgcgcctgacgctgccggacgtgccgcaggcgcagcgggtggtcgaagcgcttcgtgatacgcgctgcgcggttgagctctcggaagatttccccaccgtcgcctggcgcaagctgctgcaaaacgcggtcgccgggctgatggtgctggccaatcgccgcgccgggatgttcaggcgcgaggatatcagcgagctggcgctggcctacctgcgcgaggggcttaccgtctcccgcgccgaaggggcgaagctggacgatgcggtggcggaggagatcctggcgaacttccaacgcgcgcccgtggatttaggtacgtcgattctcgctgaccgccaggcggatcgcccgatggagtgggacatccgcaacggcgtgatccagcgctatggccgcaggcacgggattgcggtgcccgtcagcgacgtggtggtgccgctgctggcggcggggagtgaggggccggggtga

SEQ ID NO: 4189 - DNA, 1779 bp, Enterobacter cloacae
ttgacctgcccgccgacagcgcgtttttacaggccaatctgcaccccagcaaccttgatgcggctatccgcgccgtcgaaaactaacaggagaactaccgtgaacagtgagaaacagtcacgtcagtgggcgcacggcgccgatatggttgtcggccagctggaagcgcagggtgtgaagcaggtgttcggcataccgggcgcaaaaatcgacaaggtctttgactccctgctggactcctccatcgagattatcccggtgcgtcacgaggcgaacgcggcgtttatggcggcagcggtagggcggctaaccggcaaggccggggtcgcgctggtcacatccgggccgggctgctccaacctgatcaccggcatcgccaccgccaacagcgaaggtgacccggtggtcgcgctgggcggggcggtgaagcgggcagataaagcgaagctggtgcaccagagcatggataccgtcgccatgttcagcccggtgaccaaatacgccgtggaggtcaattcgcctgacgcgattgccgaggtggtgtcgaacgcgtttcgcgctgccgagcagggcaggccgggcggggcgtttgtcagcctgccgcaggatattgtcgaccagcccaccacgggggcgattttacccgccagcaccgcggcgctgatgggcccggcgccggagtcagccatcaacgaggtggcgaagcttatcgcgaaggccaaaaacccggtcatcttactcggcctgatggccagccagcccgccaacagcgccgcgctgcataagctgctggagagaagccgtattccggtcaccagcacctatcaggccgccggggcggtgaatcaggaacacttcacccgcttcgccggacgcgtcggtctgtttaacaaccaggcgggcgatcggctcctgcatctggcggatctgatcatctgtatcggttacagcccggtggaatacgagccgtccatgtggaacagcggtgacgccaccctggtgcacattgacgtgctgcccgcctatgaggagcgcaagtatgttcccgatctggaactggttggggatattgccgccacgctgaatctgcttgccagccgaatcgagcacaagcttgaactcagccagcgcgcctcggaaattcttgtcgatcgccagcatcagcgggacctcctcgaccgtcgcggcgcatcgcttaaccagtttgccctgcatccgctgcgcatcgtgcgcgccatgcaggacatcgtgaacaacgacgtgacgctcaccgtcgacatgggcagcttccacatctggatcgcccgctacctctacagcttccgcgcgcgtcaggtgatgatctccaacggtcagcagaccatgggcgtggcgctgccgtgggcgattggcgcgtggctggttaacccggggcgcaaggtggtgtcggtctccggggacggcggctttttgcagtcgagcatggagctggaaaccgccgtacgcctcaacgccaatattctgcacatcatctgggtggataacgcctacaacatggtggccatccaggaagagaaaaaataccagcgtctctccggcgtggagttcggcccggtcgatttcaaagcctatgccgacgcgttcggcgcaaaaggttttgccgtcgagagtgccgacgcgctcgaaccgacgctgcgtgccgcaatggatgtcgatggcccggccgtggtggccattcccgtcgactacagcgataacccgctgctgatgggccagctccatctcagccagattttgtga

SEQ ID NO: 4190 - DNA, 240 bp, Enterobacter cloacae
cccagaccgccgcgcgggatctcgcgccgctggggatcaccgttaacgcctattgcccgggcatcgtcaaaacgccgatgtgggcggaaatcgaccgtcaagtctccgaggcggcgggtaaaccgcttggctacgggacggaaacctttgccaaacgcattacgcttggccgtttgtccgagccggaagacgtggccgcctgcgtctcttacctcgccgggccggattccgactacatga

SEQ ID NO: 4191 - DNA, 765 bp, Enterobacter cloacae
gtcacctctcttttcgttcgctttttaacctgctataacaaactccttacctttcagggagtcaccgccgtgcccgaaatcaatcaacatggtcaaaccgttaacgatattgtcccggactggaaatgcgcccgcgcgttaacccgtactctgctcaccggccagtattgccgcctggagccgctggatgctgaccgccattcggctgatttgtttgaagcctatgcgctgggtgacgacagcgactggacgtggcttgccagcacccagcctgtgagcgttgaggccactgcgcactgggtgctgggaaaggtgctggatgacgacctggtgccctttgccattatcgatctgcgcaccgaaaaggcggtagggctggtcagctatatggcgatagaacgctttcagggctcggttgagatcggccacgtcacctggtcgcgcagaatgaagggcacccgcgtgggtaccgaagcggtgtggctgctgctgaaaaatgcctttgagcatcaatatcgccggctggagtggaagtgcgattcgatgaacatcgcctcacgcaacgcggcggagcggctggggtttgtctgggaagggcgactgcgccagaagctggtgcgcaaaggccgcaaccgcgacagcgatatgctttcgattattgacggcgaatggccgcagcgcgatgcagagctgcgcgcctggctggcggcggagaattttgacggggaagggcggcaggtcaggcggcttgaggaatttcgctag

SEQ ID NO: 4192 - DNA, 2193 bp, Enterobacter cloacae
gagctcattatgaacaacaccacaatgcacaaaacgctgctggcgattgccatcggcgcggtaacccactccgcttttgcggcggatgagaaaaaagaggacaccatcgtcgtccagtccacggcggggagtgatttcaaacccggcggcgaccagctggtgcccgccttccttgacgggcaggtggcgaacggcgggcgcatgggtatgctcggtcagcagaacgccatggacgtgccgttcaacatcatcagctacacctcgaagctggtggaagatcagcaggcaaaaaccattgctgacgtggttgccaacgacgcgggcgtgcagttcgttcagggttacggcaacagcgcggaaaccttccgcattcgcggcctgaagtttgacggcgacgacatgacctttggcggattgtccggggtgctgccgcgtcaggtggtggatgcccagatggtcgaccgcatcgagatcttcaaaggggccaactccctgatgaacggtgccgcaagctcgggcgtgggcgggatgatcaaccttgagcctaaacacgcgggcgacaccccgcaggcgaaagtgggtgtggactacacctcggattcccagattggcaccacgctggatgcgggccgccgctttggcgataacgaccagtttggcgcgcgggtgaacctcgtgcatcgcgaaggggaaaccggcgtgccgaacgaccgccgccgcaccacgctgctctccaccggcctggattacaagggcgaccgtttccgcacctcgctggacctgggctaccagaaaaaaaccttccacggcagcccgaccagcgtcaacatctcggcggtggattttgtgcctgaaccgccgaagaacgatcgcaacttctcgcagaagtgggcctacagcgatatcgaaaacgagttcgggatgtggcgcagcgagtatgacatcaccgatagctggacggcgtataccggtctcggcgcgcagcacgcgcacgaagaagggatctacagcgcgccgaagctcctcgataagagcggtaatgcggtggtcagccgtcttgataccaaccgcatcagcgattctgtcagcggcatggcgggcattcgcggtaacttcactaccggattcgtctcgcacaaggtcaatgttggctattcggcgatgaccaaaaacgaaaagatcgcgtggaaaatgtcggcgacgaaggataatccgaccaccaacatctaccacaacaccggcgtcgatatgccggacagctccaacctcaacggctcaggcggcaaatacagcgatccgctgaccagcgggcgcacccgcacgcagggttggctgctgagcgataccctgggcgtgctggacgacaagctgctgttcaccgcaggcgcgcggcatcagaaagtggtgattcgcgggtacaacaaaatcaccggtgcggaaaacgacgcggacggtttcgacggcagccgctggatgcccacctacggcgtagtctataaaccgtgggaggaaatttccctctacgccaaccacaccgaggcgttacagcccggtgaaaccgcgcctcgctcagcaaacaactacggccagagcaccggtatcgttcactctaagcagaacgaagtgggcgtaaaggcggactttggccgcgtgggcggctccctggcgctgtttgagatcaaaatgccgtcggcgatccttgacgacagcggtcactacggcctggatgcagaacagcgtaaccgcggcgtggagctgaacgtcttcggcgagccaatgctcgggatgcgtctgaacgccagcgccacctggttgcaggccgagctgaccaaaaccaaaaacggcgtcaatcagggcaacgatgcgatcggtattccgagcttctacgccgtgctgggcgcagagtacgatatcaagccgattgaaggcctgacggcgactgcgcgcgttaaccactccggcacgcagtatgccgatcttgcgaacagcaaaaagctggacagctacaccacgctggatctgggcatgcgctatcgcttcgcggtgaaccacaatgaaaatcagatgaccgtacgggcaggtatcgacaacgtgaccaacgagaactactggtcaagcgtggacgattccggtacttacattactcagggcgagccgcgtacctttaaggtctcggttggctacgagttctaa

SEQ ID NO: 4193 - DNA, 489 bp, Enterobacter cloacae
caggcggtaacagcgatgaacggtacaatcacaacgtggtttaaagataaaggctttggatttatcaaagatgaaaacggcgacaaccgctactttcatgtgattaaggtcgccaaccctgatctgattaagaaagatgcggcggtgaccttcgagccaaccaccaacagcaaaggcctttccgcgtatgcggtgaaggtgatccccgaaagtaagcacctctatattgcaggcgagcgcgtgaagcttacctcaattaaatccttcgtggtgttcagcgaagaagagcccgttgatactaaaatcgacaaagagaacgcggtgctgtcggtggggctgctgatgaacagcatcaaaccaaaaaccgagaaaaagccgggcgaaatgcgcacggtgaagaagctggcgatcactaccttccagaacacgacgctgatcttcactgaagatgagatcgacatcgatgccacggtgaagctgctgaagtaa

SEQ ID NO: 4194 - DNA, 930 bp, Enterobacter cloacae
tgcagattaagcaaaattaaggagtcagccagagcaatgaaacgtccggactacagaacactacaggcacttgatgcagttattcgtgaacgcggttttgagcgcgcggcgcaaaagctgtgcatcacccagtccgccgtatcacagcgtatcaaacagcttgaaaacatgttcgggcagccgctgctggtgcgtaccgtaccgccgcgtccgacagagcaaggacaaaagctcctcgccctgctgcgtcaggttgaactgctggaagatgaatggctgggcgatgaacaaaccggctccacgccgctgctgctgtcgctggcggtgaacgccgacagtctggcaacctggctgctgccggcccttgcgccggtgctggccgactccccaatccgcctgaaccttcaggttgaagacgagacccgcactcaggaacgcctgcgccgtggcgaagtggttggggcggtcagtattcagccgcaggcgctgccaagctgtctggtggatcagctgggcgcgctggattacctgtttgtcggttcaaaagcctttgccgagcgctacttcccgaacggcgtgactcgcgccgcgctgctgaaagcccctgccgtcgcgttcgaccatctggacgatatgcatcaggccttcctgcaacaaaacttcgatttgccgccgggcagcgtgccgtgtcatatcgttaactcgtccgaagccttcgtacagctcgcgcgtcagggcacgacctgctgcatgatcccgcatttgcagattgagaaagagttgaaaagtggtgagctgattgatttaaccccggggctgtatcagcgccggatgctctactggcaccgttttgccccggaaagccgcatgatgcgcaacgtcaccgacgcgctgctggcgtttgggcataaggtgttgagacaggattaa

SEQ ID NO: 4195 - DNA, 237 bp, Enterobacter cloacae
cgcgccagcgcatcgccaatcaccgagcctttgcccggcaggacactcagcagcccggcgggcagcccggcctgtttaaaaatccgcgccagctccagcgccatcagcggcgtggcttcggcgggcttgaggatcaccgcgttcccggcggcaatcgccggtgcgaccttctgcatttcgctggcaatcggcgagttccacggcgtgatggccgccaccacgccaaggggctcgtag

SEQ ID NO: 4196 - DNA, 369 bp, Enterobacter cloacae
tgtcgcgcccgtcgcggatcgccagatggctgctgcactggctcacgtcgcgcagttgctcgatcaccggctggccgacctgcgccacgtccagcgaggcgatgtactcaaagccaagacgcagcacgttcatgcccagcgaaaaggtattggtgcgcgtgttgcgctccagaaagcccatgtactccagcgtctgcaccacgcgataggcggtcgccttcggcatatccaccagccggtgcagctcggcaaaagtcagatcgcgatgctgctcgccaaaggccaacagcagctgtaaaccgcgctccagccccggcaccagatacttcacttcctgatcgtttgccatcatcgccctaccttagttaa

SEQ ID NO: 4197 - DNA, 765 bp, Enterobacter cloacae
ttgcatacgggaacaacattcgttacgttgcgggctcgttttgacacggagtgtaagatgtcccgtaatgtttctctcgcggtcgcttttctggcgacagcgctctccggccatgctctggccgacggtattcacagtttctctcaggcgaaaaccgcaggcgtaaagattaacgccgacgtaccgggtgatttctactgcggctgtaaaattaactggcagggtaagaaaggggtcgtggatctgggatcctgcggctataaggtgcgcaagaacgagaaccgcgccagccgaatcgaatgggaacatgtcgttccggcctggcagtttggccaccagcgccagtgctggcaggacggtggacgtaaaaattgcgcaaaagatccggtctaccgccagatggaaagcgatatgcacaacctgcaacccgccgtgggtgaggtcaatggcgaccgcggaaacttcatgtacagccagtggaacggtggcgaaggccagtacggtcagtgcgccatgaaggtcgatttcaaagagaaagtcgccgaaccgcctgcccgcgcgcgcggtagcatcgcccgcacttacttctatatgcgcgaccgctacgatctcaatctttcccgccagcagacgcagctcttcaatgcctgggacaagctctacccggtgacggactgggaatgccagcgcgacgaacgtatcgccaaagtccaggggaatcacaacccttacgtccagcgggcttgccaggcgcaaaagagctaa

SEQ ID NO: 4198 - DNA, 750 bp, Enterobacter cloacae
cacatggaatttctgactatgcgcatccctcgcatctatcaccctgaactgattaccccaggcggcgaaatcgccctgtctgatgatgctgcaaaccatgtaggtcgcgtgctgcgcatgggtgcaggccaggcgattcagctctttgacggctctaatcaggttttcgacgctgaaattacgcgcgccgataaaaaaagcgtgcacgtgaaggtgctgcgtggcgacgtggacgaccgggaatccccgctgcacattcacctgggccaggtgatgtcgcgtggggaaaagatggagttcaccattcagaaatccattgaactgggtgtaagcctcattacgccacttttttctgagcgctgcggcgttaaactggatgcggaacgtctgaacaaaaagatccagcagtggcaaaaaattgccattgcggcctgcgaacagagcggccgcaatcgtatcccggagattcgcccggcgatggatctggaggactggtgtgcagaagaggaaagcgggcttaagcttaatcttcatccgcgcgccagcgccagcatcaatacgctgccgctgcccgttgagcgtgtacgcctgctgattggcccggaaggcggcctgtcggctgacgaaattgccatgacggcgcgttaccagtttactgatattctgttgggacctcgcgttctgcgcactgagacaacggcactcaccgccattaccgcgctacaggtgcgatttggcgatctgggttga

SEQ ID NO: 4199 - DNA, 960 bp, Enterobacter cloacae
ccggagaagaagatgattaagctcggcatcgtgatggaccccatcgcaaacattaacatcaagaaagactccagcttcgctatgctgctggaagcgcagcgtcgcggctatgaactccactacatggagatgaacgatctttacctgatcaacggtgaagcccgcgcacgcacccgcatcgttaacgtcgagcagaactacgaaaaatggtacgaattcggtaccgagcaggatattgccctggccgacctcaacgtcatcctgatgcgtaaagatccgccgttcgacaccgaatacatttattccacctatatccttgagcgtgccgaagagaaaggcacgctgatcgtcaacaagccgcagagcctgcgcgactgcaacgagaagctctataccgcatggttctctgacctgacgccggaaacgctcgtcacccgcagcaaaacgcagctgaaagaattctggcagaagcacggcgacatcatcatgaaaccgctggacggcatgggcggcgcgtcgatcttccgggtgaaagaaggcgatccgaacattggcgtgattgccgaaacgctgaccgagctgggaacccgctactgtatggcacagaactatctgccagccattaaagacggcgacaagcgtgtgctggtcgtagacggcgagccggtgccttactgcctggcgcgtatcccgcagggaggggaaacccgtggcaacctggcggctggcggccgtggcgaaccgcgtccgttaagcgaaagcgactgggaaattgcccgccgcgtcggccctacgcttaaagccaaaggcctgatcttcgttggcctcgatatcatcggcgatcgtctgaccgaagtgaacgtcaccagcccaacctgcattcgtgaaatcgaagcggaattcccgatctcgatcaccggaatgctgatggacgctatcgaaaaacgtttacagaaataa

SEQ ID NO: 4200 - DNA, 318 bp, Enterobacter cloacae
ttacgcaccggatctttctcctgcgccggaaaggtatcgaccaggcgctcgatcgcctgcgccgcaccgcgcgtgtgcagcgtggccaacaccagatggccggtttccgccgccgtcagcgccaggcgtatcgtctcgctgtcgcgcagctcaccaagcagaatcacatccggatcttcacgcagcgcgctgcgcagggcctcggcaaaggacgggctgtgcaggcctatctcccgctgctggatcaggcaacgttcactctggtacataaactccaccggatcttcaagggtcagaatatgcccgtccgtctggtga

SEQ ID NO: 4201 - DNA, 327 bp, Enterobacter cloacae
tatgctgctgccggggctgtggatggcgttatgagtgcagttagcccctgcgccgacgggctggttttacggctgtacattcagccgaaagccagccgcgacagtattgttgggctgcatggcgacgagctaaaagtcgccatcacggccccgccggttgacggccaggcgaatgcgcatctgaccaaatatctggttaaacagtttcgcgtcgctaaaagccaggtcatcattgagaaaggtgaacttggccggcataaacaggtaaaaatccttaacccgcaatctatcccgacggaagtcgcggctctgacagaacaggactaa

SEQ ID NO: 4202 - DNA, 597 bp, Enterobacter cloacae
accatgcagaaagttgttctcgccaccggtaacgccggtaaagtgcgcgagctggcctcgctattaaatgattttgggctggacgtggtggctcagaccgagctgggcgtggactccgccgaagagaccggcctgacgtttatcgaaaacgccattctgaaagcgcgccatgcggcgcaggtaaccggactgcccgcgattgccgatgattccggtctggccgtggattttctgggcggtgcgccggggatttactccgcccgctattccgggccggacgccaccgaccagcagaacctggaaaagctgcttgtggccctgaaagacgttcctgacgaacagcgtaccgcgcagttccactgcgtgttggtctacatgcgtcacgcggaagatcccacgccgattgtctgtcacggcagctggccgggcgtgatcacccgtgaagcggcgggcaacggcggctttggttacgacccgattttctttgtcccgaccgagggcaaaaccgctgcggaactcacccgcgaagagaaaagcgcgatctcccaccgtggacgcgccctgaaactgttactggaagcactgcgtaatggctaa

SEQ ID NO: 4203 - DNA, 387 bp, Enterobacter cloacae
gggaaaggctggcagagtgtggggatgcaaacaatacgttcatacgcaaagcagctcagacgcgagctgacacaggaagaaagacggctttggtatttactgcgcagccgccgtttcgaaaattataaatttcgccgacagcacccggtaggtaactacattctggatttcgcctgttgcgcggctcggctggccgttgagctggatggcggacaacatgatgaaaatcaggaatacgatcgacaaaggacattgtggttaaaccataaggactggcacgtcattcgattctggaacaacgaactctggaataacgaagaggcggtgttagaaaggatccttgaaacgctgcaagcgctgcaaccctcaccccggccctctccctga

SEQ ID NO: 4204 - DNA, 1071 bp, Enterobacter cloacae
ttaagcgaatcgatgaccatgcaagcctctcaattttcagcccaggtgctggactggtacgacaaatacgggcgtaaaaccctgccctggcaaattgaaaaaacgccgtacaaagtatggctctccgaggtgatgttgcaacaaacgcaggtcgcgacggtcattccttacttcgagcgttttatggcgcgcttcccgacagtcaccgatctggcgaacgccccgttggacgaggtgctgcacctgtggaccgggcttggctattacgcccgcgcgcgcaacctgcacaaggccgcacagcaggtcgcgacgcgccacaacggtaaattcccggaaaccttcgacgaggtggcggatttgcccggcgtcgggcgttcgaccgcaggcgcaatcctctccctctctttaggcaaacatttccctattctcgacggcaacgtcaagcgcgtgctcgcacgctgctacgccgtagatggctggccgggtaagaaagaggttgagaaacgcctgtgggagatcagtgaagcggtcactccggcgaaaggggtggagcgttttaaccaggcgatgatggatctgggcgcgatggtctgtacccgttcaaaaccgaagtgcgaactctgcccggtaaacaacctctgcgtggcctatgcgaaccacacctgggcgcagtatccggggaaaaaaccgaagcagacgctgcctgaacgcaccgggtacatgctgctgatgcagcatggcgacgaggtgtttctcgctcagcgcccgccgagtggcctgtggggtggtctatactgcttcccacagtttgaggatgaagcctcgcttcgggcatggcttgaacagcgcggcattgcggccgaaaccctgacgcaactcaacgcgttccgtcataccttcagccatttccatctggacattgtgccgatgtggcttcccgtgtcctcattcacgtcgtgcatggatgaaggcaccgctctctggtataacttagcgcaaccgccatcagtcgggctggcggctcccgtggagcgcctgttacagcaattacgtgtcggtgcaatggtttag

SEQ ID NO: 4205 - DNA, 1260 bp, Enterobacter cloacae
acttcctgttcgagggtaaagacgtccacatcgaaggctatacgccaccggaaaaataataacgcgcagctgctgcccggctgcgctgcgcttgcacgggcgtacggttttgtaggtcgggtaagcgcagcgccacccggcaacagcaaccccaaagcaaacacaacacgcactcccggaatgatgaaaaaacttttagcgctagcccttgttgcgccgttgcttgtgtcttgttcttccaaaaaaggcgatgaatacaacgaagcctgggtcaaggacaccaacggttttgacattttgatggggcagtttgcccacaacatcgagaacatatggggatttaacgaagttcttattgccggaccgaaggactacgttaagtacaccgacgcctatcagacccgtagccacatcaactttgatgacggtacgattacggttgaaaccatcgcggggactgaacctgcggcgcatttacgtcaggccatcattaaaaccctgctgatgggcgacgatccggggtctatcgacctctactctgatgccgatgacatcaccatctccaaagagccgttcctgtatggccaggtcgttgaccagaccggtcagccgatccgctgggaaggccgcgccacgaaatttgccgactatctgctgcaaacgcgcctgaaaagccgtaccaacggcctgaaagtgatctacagcgtcaccatcaacctggtgccaaaccacctcgacaagcgtgcgcataagtatctgggcatggtgcgtcaggcgtcgcgtaagtatggcgtggatgagtcgctgatcctggcgattatgcagaccgagtcctcgttcaacccctacgcggtaagccgttccgacgcgctggggctgatgcaggttgtgcagcacagcgccggtaaagacgtgttccgcgcgcaggggaaatccggcacgccgagccgcaggtacctgtttgacccgcagagcaacattgataccggcacggcctatctggcgatgctgaacaatgtctatctcggcgggattgataacccaacctcacgtcgctatgcggtgatcaccgcgtacaacggcggggcgagtagcgtgatgcgcgtcttgtcgaatgacaaagtgcaggccgcgaacatcatcaacagcatggcgccgggggatgtgtacgataccctcaccacccgccacccgtgtgcggaatcccgccgctatatgtataaggtgaatacggcgcagaagaactatcgtcgccgttaa

SEQ ID NO: 4206 - DNA, 1683 bp, Enterobacter cloacae
aagatgatatattcagccgacctgttgatatctcgcgtgatagttatgaaagtatcgtttcagatcaagctgtttatttcgctggtcgcctttttctcagtgctgttcgcattactgggcggatattattatgtcgatgtcggcaggcagctttatcaggaaatgagcgcacgcgcaaaaatacaggctgaagaaattgcgcttattccaaccctgcgaaaagaagtcgaacaaaaggatatccagggcatccatgactttatgcagaaaatagccgcccgcagcgacgccagttttattgtgattggtgacaataaggggctgcatcttttccactccgtgtttgccgaccgggtaggcaaaacgctggttggcggagataacgacgaggtattacacggcaaaagtaccatcaccatccgcaagggcgggttaggcatttcactgcgcagcaaagcgcccatttttaatgatgccggtcaggtggtggggattgtttcggtaggctatctcacaagctatctggacaccatcaccgtcagcaaggtggttaatatcctgattgccgccgtgctgctgcttatcgccctgtttattttctcctggttcttcacccgcagcatcaagaagcagatattctctctggagccgcgcgaaatcggcctgctggtgcgccagcaaaaggcgatgatggaatccatttatgaaggggtgattgccatcgatgacgatctccgcattgaggtgatcaaccaggcggcgcgtaaattattaggcttacgccagcccgcccgcgaactgcggggtcaactcatcagccaggtgatcgcgcccgtcccgttcttcaacgcgcaaaccatgcttgcgaaagacacccacgatgagatctgtcgctttaacgatctcacggtcattgccagccgggtgcggataatgctggaagatgcattgcagggctgggtgatcacctttcgcgatcgcaacgagatcgactcgctcagcgcccagctcagccaggtgaagcgctacgttgataacctgcgcatcatgcgccatgaacagctgaaccgcatgactacgctgtccggcctgctgcatatgggccgttatgacgaggcaattcgctacatacaggcgcagtcggaacacgctcaggagctgctggactttatctcgtcccgctttagctctccgacgctgtgtggtttgctgcttggaaaggccgcccgcgcgcgtgaaaaaggcgttgagctgagtttcgatccggcctgccgggtggataaaccgttcctgccgctgctcgaatcggaacttatctcgatcatcgggaacttgctggataacgccattgaagcgacccagcgtgcaccgctcccgcatgccccggtggacgtgctgataaagctgaacgagcaggaactgattattgaagtcgccgaccagggcgtcggcatcacaccggagatccgcgaccggatctttgagcgcggcatcaccaccaaaacgcgcggcgatcatggtattggcctgtatctgattgaaagctatgtcacacaggctggcggtgcaattgaagttgccgataacaccccacgcggtgccattttctcactgtttattcccgccacgggaacggcccggcaccccgtacaggaactggaagataccgactatgcaacatga

SEQ ID NO: 4207 - DNA, 639 bp, Enterobacter cloacae
gagatcttgtcagcgataccgaacaggtcgattgctgccagggtgtcaccaccgcctgcgatagagaacgcttcgctgtctgcgattgcgttagccacgatctcagtccctttgcggaagttcgggaattcgaacacgccgacaggaccgttccacaggatagtttttgcgtttttaaggatttcagccagtttctgtgcagaaacgtcgcccaggtccagaatctgctcttcatctttgatgtcgttaacagatttcagggttgcggtagcagtttcggagaactcggttgccacgcgaacgtcagttggaaccgggatatcacaggtacccagcagacgtttggcttcgtcaaccagatccgcttcgtacagggatttacccacgttgtggccttgcgcagcaacgaaggtgttcgcgataccaccgccaacgatcagctggtcagcgattttggacagagaatccagtacggtcagtttggtagaaactttagaaccaccaacgatagcgaccattggacgagcaggttctttcagtgctttacccagcgcttccagttcgtcagccagcagcggacctgcacaggcgacgtctgcgaatttaccgataccgtgggtagatgcctgcgcacggtga

SEQ ID NO: 4208 - DNA, 846 bp, Enterobacter cloacae
atattccttatacttagcccgacaccggcttcgttgacggtgcatttttcggaattaattcagattaacgagtacggaagcaacatcatgaaaatgcgtgcaatcgggctggctgtgggaacaacgctcctgctaagcggctgtcagaatatggattctaacggcctgatgacctcaggcgcagaagcttttcaggcctactcactgagcgatgcgcaggtgaaagcgctgagcgacgaggcctgtaaggatatggatggaaaagctacgcttgccccggcaaacagcacctacacgcagcgtctgaacaagattgcttccgcgctgggcgacaacattaacggtcagccggtgaactacaaggtgtatatggcgaaagacgtgaacgccttcgcgatggctaacggctgtatccgcgtatacagcggcctgatggacatgatgaccgacaacgaagtggaagcggtgatcggccatgaaatgggtcacgttgctctgggtcacgtgaagaaagggatgcaggttgcgctgggcaccaatgccgtgcgtgcagcggcggcctctgcgggcggcattgtcggcagcctgtcccagtcgcagctgggcgacgtgggtgagaaactggttaactcccagttctcccagcgtcaggagtcggaagcggatgactactcttacgatctgttgcgcaaacgcggcatcaatccatcaggtttagccaccagcttcgaaaaactggcgaaactggaggaaggccgtcaaagctccatgtttgacgatcacccggcctccgttgaacgcgcgcagcatatccgtgaccgcatggcggcagacggtattaaataa

SEQ ID NO: 4209 - DNA, 1314 bp, Enterobacter cloacae
tttatctttactaaacaaagagtttcacaggtgaaccattttagctccgtgacaatcacattgatgaaaaatataagttacaaaaaacgtaaggcggacatgatgacggcaagatggcaaggcacgattgcgcttttattactcattattatttcgtacgtcgatcgggtaaatatctcggtaatgattttaaacccggaatttgccgaacattttcagttaaatgaaaacagaatgttacagggtatgctcatgacctgctttcttctgggttatggtttttccgctctattattaacgccggttattgaaagcaaacttcattatcggcagggattattaagcagcattgcgatttgggccgcggtctgcgcggtttcgcctttgctcggctcgctgacgggaatgctcatcgcccgcgtgattctggggatcgcggagggtccgctattttcgctgaaaacgcgctttatcagcgataactttagcgcgcaagagatcggtaaacccaacgccgtgaccgcgctgggcgtctcgctcgggctggccgtgggctttccgctggtgacctggctgatgtcgcatctgggctgggccggatcgttttatacactggcggcaatcaaccttctcctcgggggcagcttaatctggcgttttctgcccgcgccgcgcaagctcccgaccgcgaaaaaaccggggtttgtccacaccttcacgctggcctggcagacgccgctgctgggctggatcatggtggttgaaatcgccaccctgagctatctctgggggagcagcgcctggctgcccgcgtggctgcgcgacgagcatcatttctcgctgcatgccacgggctggcttgcggcgatccccttcctgctcagcctggggtcaaagtttctgggcggcgtgctgctcgacaaaatgcgtccggaacaggcaccgatgctgtttgtggtgggcggggcgatgacggcgctgtccgtggtcgcgctgatgctcagccatcagcctgcctggctggcgctgtttatgctttcggctaatgtcttctgggggctacagggggcggctattccggcggtgatccagcatcacgccgcgcgggaagcggtgggcagcgcttacggcataatcaatgggatcggcaatatctgcgcggcgtttattccgctgctgatggggatggtgatgagatcggtggggtcggtcagttcaggcttttcggtgctggtcgtctcgcaggttgtcaccctgcttgccgggggaatgttgctgctgcgcatgcggcgcgcagcagcaatcagcgcgtaa

SEQ ID NO: 4210 - DNA, 696 bp, Enterobacter cloacae
tgtcaggccgccgatcaccggcgtaccggtacccggtgcgaatgccggatccaggcagtcgatgtcgaaggtcagatagacaggcatgtcgccgacgatctgcttaacctgagccagaatatcgtccacgccgcgatcgttcacctggcccgcgtcgagtacggtgaagccgttgtctttgtcgaactcggtgcggatgccgatctgcacggagtggttcggatcgatcaggccttccttcggcgccgtgtagaacatggtgccgtggtcgaactcacagccgttcgcgtaggtgtcggtgtgcgcatcgaagtgcaccagcgccattttaccgaagtgcttcgcgtgggcgcgcagcagcggcagggtcacgaagtggtcaccgccgaaggagagcatgcgtttaccggccgccagcagcttctcggcgtgcgcctgcaatttttcgctcatctcacgcgcgtcgccgaaggcgtacaccagatcgccgcagtccaccacgttcagacgctcgcgcatgtcgaagttccacgggaagcggttgtgctcccaggccaggttagtggaaacctgacggatcgccgccgggccatgacgaccacccgcgcgaccggacgttgccatgtcgaacggtacgccggtgatcacccagtccgcatcgctgtcgtacggctggaagttcatcggaaggcgtaa

SEQ ID NO: 4211 - DNA, 1425 bp, Enterobacter cloacae
aaactgataacccaactggagggcataatgcctgacaataataaacaggggcgtacgtccaataaggcaatgacgttcttcgtctgcttcctcgccgctctggcaggattactctttggcctggatattggcgtaattgccggtgcattacctttcatcaccgatgagttccagattagcgcacatactcaggaatgggtggttagctccatgatgttcggtgccgccgtcggcgcggtcggcagcggctggctctcctttaagctcgggcgtaaaaagagcctgatgattggcgcgatcctgttcgttgccggctcactgttctctgccgctgcgcctaatgttgaagtgctgatcatctcccgcgtgctgctcggtctggcagtgggcgtggcgtcttatactgccccgctgtacctgtctgaaatcgctccggaaaaaatccgcggcagcatgatttccatgtatcagctgatgatcaccatcggtattctgggggcttatctctccgataccgccttcagctacagcggcgcatggcgctggatgctgggcgtcatcatcattcctgccatcctgctgctgattggcgtcttcttcctgccggacagtccgcgctggtttgccgccaaacgccgcttccatgatgccgaacgcgtgctcttacgcctgcgtgataccagcgccgaagccaaaaacgagctggaagagatccgcgaaagcctgaaggtcaaacagtccggctgggcgctgttcaaagagaacagcaacttccgccgcgcggtgttcctcggcgtgctgttacagatcatgcaacagttcaccgggatgaacgtcatcatgtattacgcgccgaaaatcttcgaactggcgggctacaccaacaccaccgagcagatgtggggcaccgtgatcgtcggcctgaccaacgtgctggcgacctttatcgctatcggcctggtggaccgctggggacgtaagccaaccctgacgctgggcttcctggtgatggccgtcgggatgggcgtgctgggtaccatgatgcacatgggcattcactccccaacggcacagtacttcgccgtggcgatgctgctgatgtttatcattgggtttgcgatgagcgccggtccgctgatttgggtgctgtgctctgagatccagccgctgaaaggacgtgattttggcatcacctgctctaccgcgaccaactggattgccaacatgatcgtcggcgcaacgttcctgaccatgcttaatactctgggtaatgccaacaccttctgggtctacgccggtctgaacctgttctttattgttctcactatctggctggttcctgaaaccaaacatgtttcactggaacacattgaacgtaacctgatgaaaggtcgtcctctgcgcgaaataggcgcacacgactga

SEQ ID NO: 4212 - DNA, 453 bp, Enterobacter cloacae
tattctgaccatgcctggcgttgcggggcacgcgtaatgagcggcacccttctcgccttcgacttcggcaccaaaagcatcggcgtcgctgtgggtcaacggatcaccggcaccgctcgcccgctcactgcgctgaaagctaacgacggcacgccggactggaaccttattgagcgcttgctcaaagagtggcagccggacgacgtgattgtcggtctgccgctgaacatggacggcaccgagcagccgcttaccgcccgcgcgcgcaagttcgcgaacaaaatccatggccgctttggtgtctccgttaagctgcacgatgaacgtttgagcaccgtcgaggcacgcgctggcctgttcgagcacggtggcttccgggcgttgaacaaaggcagcgtggattcagcttcagccgtcattatcctcgaaagctatttcgaccagggttactga

SEQ ID NO: 4213 - DNA, 420 bp, Enterobacter cloacae
tgcccggcagttgccaggttttgccttcgcggatcaggtttgccgccgccgacgtattcaccagtagctcatacagcgccacgcgcccgccctggacatcctgacgcagcttctgcgccagaaccgcacgcaggcttcccgccagttgattacgcaccggatctttctcctgcgccggaaaggtatcgaccaggcgctcgatcgcctgcgccgcaccgcgcgtgtgcagcgtggccaacaccagatggccggtttccgccgccgtcagcgccaggcgtatcgtctcgctgtcgcgcagctcaccaagcagaatcacatccggatcttcacgcagcgcgctgcgcagggcctcggcaaaggacgggctgtgcaggcctatctcccgctgctggatcaggcaacgttcactctggtacataa

SEQ ID NO: 4214 - DNA, 717 bp, Enterobacter cloacae
actactcctcggaaaatgaacgacattgcgcataacctggcacaggtccgggacaaaatctcagccgcggcaacacgttgcggccgtgctccagaagaaattacgttgcttgcagtcagcaaaaccaagcctgcgagcgccatcgcagaagcgatagccgccggtcatcgtgcctttggtgaaaactatgtgcaggaaggcgtagataagattctcgctttccgggaacggggaaatgcagacctgcaatggcactttatcggtccgctacagtcgaacaaaagccgtctggtagcagagcacttcgactggtgtcacaccatcgatcgtctgcgtatcgctacccgtttgagcgaccagcgccctattgagattccagcgcttaacgtgctaattcaaatcaacatcagcgatgaaaacagcaagtccggcattacgctgagcgaactggatgcgctggcggcggacgtggcggcgctgccgcgcttaaccctgcgcgggctgatggctatcccggcgccagagtcaagttatgaaaggcagtttgccgtagcacagcaaatggctgtagcatttgaggcgcttaaagcgcgctatgacacggtagacacgctttctctgggcatgtcggatgatatggaagccgccatcgcggcaggcagcaccatggtgcgcatcggcacagcaattttcggtgcgcgcgattacccccaataa

SEQ ID NO: 4215 - DNA, 585 bp, Enterobacter cloacae
ggaaacctgaggaacgccatgaagacgttgactttcctgctttcaacggtcattgaactgtatacgatggcgctgctgttgcgcgtctggatgcagtgggcccgttgtgatttttacaatccattctcacaatttatcgtgaaaatcacgcagcccattgtggggccgcttcgccgcatcattccggcaatggggccgattgacagttcatctctgctgatggcgtttattctgagcgttatcaaagcgatcgtgctgtttatggtcatcactttccagccgattatctggatttcagccgttctgatcctggttaaaaccgtcggctcgctgatcttctgggtcctgctggtgatggcgatcatgagctgggtaagccggggccgtagcccggtggagtacgcgttgattcagctgacagaaccgttgctgcgtccaattcgtagcctgctgcctgcgatgggcggaatcgacttctcaccgatgcttctcgttctgctgctgtacgtgctgaatatgggtatcgcggaactgttacaggcgacgggtaatatgctgctgccggggctgtggatggcgttatga

SEQ ID NO: 4216 - DNA, 1173 bp, Enterobacter cloacae
aactgttactggaagcactgcgtaatggctaatttgccgcctctgagtctttatattcacatcccatggtgcgtgcagaaatgtccgtactgtgatttcaactcgcacgcgctgaagggtgaagtgccgcacgatgattacgtcgcgcatctgctggccgatctggatgccgatgtaccgtacgcacagggacgtgaagtgaagaccatttttattggtggcggtacgccgagcctgctttcaggcccggcgatgcagacgctgctggacggtgtgcgcgcacgcctgaacctggcagcggatgctgaaattacgatggaagccaaccccggcaccgttgaggccgaccgttttgtcgagtaccagcgtgcgggcgtgaaccgtatctctatcggcgtgcagagctttagcgagccaaagctgaagcgtctggggcgcattcacggcccggaagaggcaaagcgcgcggcaaacctggcaacggggcttgggctgcgcagctttaacctcgacctgatgcacggcctgccggatcagtcgctcgaagaagcgctggacgatttgcgtcaggcgattgaactgaacccgccgcatctgtcgtggtatcagttgaccattgaaccgaacaccctgtttggttcgcgcccgccggtgctgccggacgacgacgcgctgtgggatatcttcgagcagggccaccagcttttgaccgcggcgggatatcagcaatacgaaacgtcggcgtatgcgaagccgggctatcagtgtcagcacaatctgaactactggcgttttggcgactatctcggaattggctgcggtgcgcacggcaaggtgaccttcccggacggacgcattctgcgtaccgccaaaacgcgtcatccacgcgggtatatggaaggccgctacctggagcgtcagcacgacgtcgaggcggtggataagccgtttgagttctttatgaaccgcttccgtctgctggaagccgctccgcgcgcggaatttacgcgttataccgggctgccggagtcagtgattcgcccgcagattgacgaggcgctggcgcaggggtatctgaccgagtgtgatgtgtcctggcagatcaccgagcacggcaagctgttcctgaactcccttcttgagttgttcctcgctgaaaatcctgaaggctga

SEQ ID NO: 4217 - DNA, 1344 bp, Enterobacter cloacae
cgttgccaactgatagaattgcatcaaataacaaccctgaatgttcctataacaacatatctcccgctcacttgtgaggaaagtaacatgaaccttaagctgcagcttaaaatcttgtcgtttctgcagttctgcctgtggggtagctggctgactacactcggctcctatatgtttgtgacgctcaagttcgatggtgcgtcgatcggtgccgtttacagctcgctgggcattgcggctgttttcatgccaacgctgctcggtatcgtggcggataaatggttaagtgcgaaatggctatacatgctttgccatctggtgggtgcggggacgctgtttatggcggccgaagtgaccacgccgggggcgatgtttatggtgatcctgcttaactcgctggcgtatatgccaacgcttggcctgatcaacaccatctcctactaccgcctgaaatctgccggactggatatcgtcaccgacttcccgcctatccgtatctggggcaccatcggctttatcatggcgatgtggggcgtgagcttcgcgggcttcgagctgagccatatgcagctgtatattggtgccgcgctctccgtgctgctggcgctgttcaccctgacgctgcccaccattccggtgtctaaccagcagaaaaaccagagctggagcaccatgcttggcctggacgctttcgcactgttcaaaaacaagcgcatggcgatcttctttatcttctccatgctgctgggcgcggaactgcaaatcaccaacatgttcggtaataccttcctgcacagcttcgataacgatccgctgtttgccgggagctttatcgtcgaacacgcgtcggtgatgatgtccatctcgcagatctccgagacgctgttcatcctgaccatcccgttcttcctgagccgctacggcatcaagaacgtcatgctgatcagtatcgccgcctggatgttgcgcttcggtctgttcgcctatggcgacccaagcgcgttcggcaccgtgctgctggttctgtcgatgattgtttacggctgtgccttcgacttcttcaacatctccggctcggtgtttgtggaaaaagaggtgaagcctgaaatccgcgccagtgcgcagggcatgttcctgatgatgaccaacggcttcggttgtattctgggcggcgtggtaagcggtaaagtggttgagatgtacaccaccaacggcattacagactggcagccggtgtggctgatcttcgccgggtactcgctggtgctgttcttcgcgttcatcgcgctgttcaagtacaagcatgttcgcgtgccgaatggtgcgcagccgatcgcgcattga

SEQ ID NO: 4218 - DNA, 828 bp, Enterobacter cloacae
ttgaaagctatgtcacacaggctggcggtgcaattgaagttgccgataacaccccacgcggtgccattttctcactgtttattcccgccacgggaacggcccggcaccccgtacaggaactggaagataccgactatgcaacatgaacttatcgacgtactgattgttgaagacgagaacgaactggcgcaactgcacgcggagcttatcggtaaacatccgcgtctgaggctggtggggattgccgcgtcgctggccgacgcgcaggtacaactggagagcaaacagccgaagctgatgctgctggataactacctgccggacggcaaaggcatcacccttatcagcaacccgatgctcacccgcgccaactgctcggtgattttcatcaccgccgccagcgatatggacacctgtagccaggccattcgtaacggcgcgtttgactatatccttaagccggtctcctggaagcggctcagccagtcgctggagcgttttgtgcagtttgccgaacagcagcgcgtctggaagattgtcgaccagcagaacgtggattcactctatcagttacaggcgaaaaactatcgtctggacaacggcagcaaagggatagaggagaacacgctggcgcgggtgcaaatgctgtttaacaacaaggcggcgcactgttttacggtggatgaggtggtgagcgagacgggcctgagtaaaaccaccacccggcgctatctggaacactgcgtggaggtgggttttctgacggtggagatgctgtacggtaagattggacatccgagaaggatgtacaggcgtagtgcgacttaa

SEQ ID NO: 4219 - DNA, 396 bp, Enterobacter cloacae
tgtcgccccttcgcagcccccggggcagtaagcgaaggcagcgcagtcaatcagcaggaaggtggcatgtctgcacaacccgtcgatctccagatttttggccgttcactgcgagtgaattgtccgcctgaacaaagggatgccttgaatcaggctgcggacgatttgaatcagcggttgcaagatctaaaagaacgcactagagtcacaaatactgagcagctggttttcatcgccgcgttgaacatcagctatgaactgactcaggaaaaagcgaagacccgcgattacgcggcaagcatggagcagcgcattaaaatgctccagcagaccatagaacaggcattgcttgatcaaggtcgcagtcccgaaagaccgggaccaaagtttgaataa

SEQ ID NO: 4220 - DNA, 693 bp, Enterobacter cloacae
aactatgacgacacattcaccttgaaccaagggttcaagggttacagcctgcggcggcatctcggagattccctctcttttcttctaccgactaccatgactcaattccctgaagtttctgcttcacgccaggacatccgtcagcttattcgccagcgtcgtcgcgccttaagcgccgagcaacaggcacattttgcccagcaggccgccgcccgcatgatggcctatccgcctgtggtgatggcaaacaccgtcgccctgtttctctcgtttgatggtgagctggatacccaaccgcttatcgaccagctctggcgcgccgggaaaaaagtttatctgccggtgctacatccctttagccgaggcaatctgctgtttctgcactaccatccgcacagcgagctggtggtaaatcgtctgaaaatcaccgaacccaaactcgacgtgcgcgacgtgctgccgctatctgaactggatgtgctgattacgccgctggtggcgtttgacgagcagggccagcgattaggcatgggcggggggttctatgacaggacgctgcaaaactggcagcagtacggattgcagccggtggggtatgcgcatgattgccagggcgtggaggtattacccgtagagaaatgggatgtgccgttgccggcggtggtgacgcccagtaaaacctggacctggtag

SEQ ID NO: 4221 - DNA, 1041 bp, Enterobacter cloacae
ttccagcagcctcgccatcagcggggcgtaaatactctcgtggataaacagccgcgacccggcgatacacgcctgccccgccgagctgaaaatgccgtagcagatcccgcgcgcggcctgttcgatatcggcatcctccagcacgatggtcggcgatttgccgcccagttccagcgaggccgggatcagtttttccgccgccacgtgcgccagatgacggcccgtggtggtgccgccggtaaaggaaattttccgcacgcgaggatgacgcgccagcgcatcgccaatcaccgagcctttgcccggcaggacactcagcagcccggcgggcagcccggcctgtttaaaaatccgcgccagctccagcgccatcagcggcgtggcttcggcgggcttgaggatcaccgcgttcccggcggcaatcgccggtgcgaccttctgcatttcgctggcaatcggcgagttccacggcgtgatggccgccaccacgccaaggggctcgtagcagctcagcgtcagcagatccggctggcgcggcgtcggaagttccccttccagcagctcgcaggcggcggcaaagtagcgcgccgttcccgccgcgctcatcaccagcccgcgcgcttccgccagcggcttgccgttatcacggctctgcatctgcgccagcgcatcgacgcgggattcaataagatcggcaactttatgcaggatcttcgcgcgcatgtgcggcagactgttacgccatgcgggatcgcgccaggcgcgctctccggcggctaccgcctcctccaggtcatccagactggcggcattcagcgtcgcgttgagcgacccgtctgccggaaagtggctctgcatcgggttgccgccgccgcgtcgccactggccgccgataaaaatcttcagatcgtccatcgtcactcctcagctcagggccagctcgcggcaggcgcgcaccgcgctcagtgccgccagggtggaggttttaggattagaagccagcggcagtccgctcagttccagatggaactcgccgaataa

SEQ ID NO: 4222 - DNA, 1158 bp, Enterobacter cloacae
aacatggcaaaacacctgtttacgtccgagtccgtatcagaaggacatcctgataaaattgctgaccaaatctccgatgcggtgctggatgcgatcctcgcgcaggatccaaaggcgcgcgtagcgtgtgaaacctatgtcaaaaccggcatggttctggttggcggtgagatcaccaccagcgcatgggttgatatcgaagagatcacccgtaacacggtgcgtgagatcggttatgtacattctgatatgggctttgatgccaactcctgcgccgtactgagcgcgattggcaaacagtctccggacatcaaccagggcgttgaccgtgccgatccgctggaacagggcgcgggcgaccagggcctgatgttcggctacgcaaccaacgaaaccgacgtgctgatgccagcgccggtgacctacgcacaccgtctggtgcagcgtcaggctgaagtacgtaaaaacggcaccctgccgtggctgcgtccggatgcgaaaagccaggtgaccttccagtatgacgacgggaaaatcgtcggtatcgatgccgtggttctttccacgcagcatgctgaagagattgaccagaaatccctgcaagaagcggtgatggaagagatcatcaagccggttctgccaactgaatggctgagctctgcgaccaaattcttcatcaacccaaccggacgctttgttatcggcggcccaatgggtgactgcggtctgaccggtcgtaaaatcatcgtagatacctacggcggcatggcacgtcacggcggcggcgcattctccggtaaagatccgtctaaagttgaccgttctgccgcgtacgctgcacgttatgtggcgaaaaacatcgttgctgccggtctggctgaccgctgtgaaattcaggtttcctacgccatcggcgtggctgagccaacctccatcatggtggaaaccttcggtactgaaaaagtgccttctgaacagctgaccctgctggtgcgtgagttcttcgacctgcgtccatacggtctgattcagatgctggatctgctgcacccaatctaccaggaaactgcagcgtacggtcactttggtcgcgaacatttcccatgggaaaaaaccgacaaagccgccctgctgcgtgatgctgccggtctgaaataa

SEQ ID NO: 4223 - DNA, 570 bp, Enterobacter cloacae
gcgcacacgactgatcctcctgcgggaggcgcctcttgcgcctccccgcttcccgctttatgctctgcccctatgaaagcaccccgtctccccatcgccattcagcaagccgttatgcgcagcctgcgggaaaaactcgcccaggccaacctgaagctcggccgcaattatcctgaaccgaagctggtctatcagcagcgtggcaccgcggcaggtaccgcctggctggaatcgtatgagatccgcctcaacccggtgttgatgatggaaaatcagcaggcgtttatcgaagaagtggtgccgcacgagctggcgcatctgctggtgtggaagcactttggccgcgtcgcgccgcacggcaaagagtggaagtggatgatggaggcggtgctcggcgttccggcccgtcgcacccatcagttcgagctggaatcggtacgccgcaataccttcccctaccgctgccagtgccagcagcaccagcttaccgtccgccgccataaccgcgtagtgcggggcgaggcgacctaccgctgcgttaaatgcggcgaaccgctggttgcggaataa

SEQ ID NO: 4224 - DNA, 708 bp, Enterobacter cloacae
aatcgaagcggaattcccgatctcgatcaccggaatgctgatggacgctatcgaaaaacgtttacagaaataacctgtgacagcgcctgtgtttatccccatactgggcgctgtcgctttttaaaccaggaaacagtacctctgacaatgaatttacagcatcactttcttattgccatgcctgctctccaggatccgattttccgccgcgccgtggtctatatttgtgaatacaacgaagacggcgcgatggggattatcatcaataagccgctggaaaaccttcaggttgaagggattctggacaagctgaaaatccctgctgaagcgcggctgccggaaatccgtctcgataaaccggtgatgctcggcggtccgcttgcagaagatcgtggttttatcctgcataccccgccggttttctcgtccagcattcgtatctccgataacaccgtcgtcaccacctctcgcgatgtgcttgaaacgctgggcactgccagtcagccttctgaggtgctggttgcgctcggttacgcctcctgggaaaaagggcagctggaacaagaaattctggacaacgcctggctgacggcccctgcggatatgaatatcctgtttaaaacccctatcgccgatcgctggcgtgacgcggcaaaactgattggcattgatattctgaccatgcctggcgttgcggggcacgcgtaa

SEQ ID NO: 4225 - DNA, 381 bp, Enterobacter cloacae
cttagcgcaaccgccatcagtcgggctggcggctcccgtggagcgcctgttacagcaattacgtgtcggtgcaatggtttagcatcggcaagacaaagaggaatgagtatggccagaaccattttttgtactttcctacagcgcgacgctgaaggccaggatttccagctctacccgggcgacctgggtaagcgcatttacaacgagatctccaaagaagcctggggacagtggcagaaaaaacagaccatgctgatcaacgagaaaaagctcagcatgatgaacccggaacaccgcaaactgctggagcaggagatggtgaacttcctgttcgagggtaaagacgtccacatcgaaggctatacgccaccggaaaaataa

SEQ ID NO: 4226 - DNA, 1389 bp, Enterobacter cloacae
acacacaaaataactaaggggcttattatgagcacaactgacgattcattctctgttacccacgacccgattgatattcagcggccatcgctcaaagagcgctggtggcatattatggatacctggaaaatcggcattatacctctgccgctgttcgttctggcgggcgcgctgattgcgattgattgcctgggcggaaaactaccgagcgacattgtggtcatggtggccacgctggccttcttcggctttgcctgcggtgaattcggtaaacgcctgccgattgtcggcaagctcggcgcggcggcaatttgcgccacctttatcccttccgcgctggtctattacggcctgctgccggatgtggtggtcgagtccaccaccaagttctacaaatccaccaacattctctacctctatatctgctgcattatcgtcggcagcatcatgagtatgaaccgcaccgtgctgatccagggcttcctgcgcatcttcttcccgatgctgtgcggtgaaatcgtcggcatgattgtcggcatgggtgttgggctggcgctgggcctcgagccgttccagatcttcttctttatcattctgccgatcatggcgggcggcgtcggggaaggggcgatcccgctctctatcggctatgccaccctgttgcatatggatcagggcgtggcgctcggccgcgtactgccgatggtgatgctcggcggcctgacggcgatcattatctccggttgcctcaaccagctcgggaaacgctacccgcacctgaccggtgaaggccagctgatgccgaatcgcgccaatgccgatgccaccgtctctcagcctgcgttctccggcaaagcggacgtgacgacgatcgcctccggcgcgctgctggcggtgctgctgtacatgctgggcatgctcggtcacaagctgattggtctgccagcgccggtgggcatgctgtttatggcggtgctggtgaagctctgcaacggtgcctctccgcgtctgctggagggctctcaggtggtgtacaaattcttccagacctccgtgacctacccgattctctttgccgttggcgtggccatcaccccatggcatgaactggtggccgccttcacgctgaccaacctgctggtgattatcagcaccgtctccgcgctggtggcaaccgggttcttcgtcggcaaaaagattggtatgcacccgattgatgtcgccatcgtctcctgctgccagagcggccagggcggtactggtgacgtggcgatcctgaccgcaggcaaccgcatgagcctgatgccgttcgcccagattgctacccgtatcggcggggcgattaacgtctccatctctctgctgattctgggcaacttcctcgtttaa

SEQ ID NO: 4227 - DNA, 1032 bp, Enterobacter cloacae
ggcggcagcatgcaatcgcaacccattgattttcggcacaccgttgtggcgaaacacccggaacgcttaagccagatccgctacctgctggcagacagcggccttggcctggacaacgacatcacgctgtttgtcgaagcctggtccggcgcgcagctggtgggttgcgccgggctggctgccaacgtcatcaaatgcgtggcggtcaacgagcagcttcgtggggaaaacctcagcgcgcgtctgctggcagaggtggaaaatgcggcgctggagcgcggccattttcacctcttcctctgcacccgtccgtgcaataaggagcgctttggccgcagcggtttctggccgattgcccagagcgggaacaacgcggtgctaatggagaacaccccgcaggggatcgcgcgctactgccgtaccttaagccggatgcgaaggggcggggaaaaaattggtgccattgtgatgaacgccaacccattcaccctcggccaccgtcatctggtggagcaggcggcggcgcagtgcgatgccctgcatctgtttgtggtgcgtgaagacgcctcgttcttcccgttcagcgcgcgccttgaaatggtgcgcgcgggcgtggcgcatctgccgaacgtggtggtgcatgaaggctcgcagtacatcatctcccgcgccacgtttccggcctacttcctgaaggagaccggcaaagtgcagcaggcgtggagcgagatcgacgtgctgatcttccgggactttatcgccccggcgctgggcatcactcaccgcttcatcggctcggagccgttctgcgatatcacccgccagtacaaccagacgctgcacgacctgctggcctcgcatattgacgtggtggagatgccgcgcatcaaggccaccggcaacgccatttcggcctcggaagtgcgccgtttactcaagacacagcagttttcccggatccgggagattgtcccggactccaccttcgcgcacctcgaagcacattatcgtgcgagtgcggaagtcgcataa

SEQ ID NO: 4228 - DNA, 903 bp, Enterobacter cloacae
acaggccatcaactggggggcgctgaaatgagcaaactccgccgcagtatgctgttcctgccgggcgccaatgccgccatgctctctaccgcctttatctaccgtcccgactccatcatgtttgaccttgaggacgccgtggccctgcgcgagaaagacaccgcacgcatgctggtgttccacgcgttgcagcacccgatgtatcaggatatcgaaaccgtggtgcgtattaacccgctgagcacgccgtttggcctgctggatctggaggccgccgtgcgcgcgggcgtggacgtgatacgcctgccgaaaaccgacaccccggacgatatttacgagctggaaggccacctcgagcgtatcgagcaggcgtgcggccgcgaggtgggttccacccgcgtgatggcggcgattgaatcggccattggcgtcatcaacgccgtggcgattgcccgcagctccccgcgcctgatcggcattgcgctggccgcctttgactacgtgatggacatgcagaccgagcgcggcgacggcaccgagctgttctacgcccgctgcgccgtgctgcacgccgcccgcgcggcaggcatcgacgccttcgacgtggtgtggtcagacgttaacgatgaggccgggttcctgcgcgaagtcgatctgatccgcaagatgggctttaacggcaaatcgctgattaacccgcgccagatagacctgctgcacaacgcctacgccccgacacgggaagaagtggaacacgcgaaacgggtgattgaggcggcagaagagggcgagcgtaacggcctgggcgtggtgtcgctcaacggcaaaatggtggatgcaccgattattaaccacgcgcaggtggtgctggagcgcgcggcggcctccggcgtgcgtcggtaa

SEQ ID NO: 4229 - DNA, 621 bp, Enterobacter cloacae
gttcaccgacaaaatcgtcggggtgatccgctaccgcgacggcagcgtgatcgacactgtgcgacaggtgaaggaggaagtatgactttagcgacacccgtgcgggcgggtgtcagcctggaggaactgctggcggcgaaagagcgccgcgcagcccgccaggctgactggcttacgcactatcaacaaccggtgatctccctcacgctggtcacgcccggggaaatcaaagacagcctgcgctaccgcaacaccatgggggtggcgttacagatgtgcgaccagctgctgtgggaaaaccgctggcaggtgctggaccgcctggtgctctggctacccaccggacctgaagcattgtggtgcgtcgcgcatccggcggcggaaatcaaagcgcactgtgcagaactggagcagacgcacccgctcggcagactgtgggatctggacgtgatctgccctgaaaacggcctcgtgggccgtcagtcgctgggttcacacctcagacgctgtctgatttgcgacgagcccgcccacgcgtgttcccgttcgcgccaccatcccgttgagcaggtggtttcccgcgtggagaagatgatcgatgactggtttgctcgcgactaa

SEQ ID NO: 4230 - DNA, 771 bp, Enterobacter cloacae
ctttggataatgcccgtttcccgaacattctcacaagcagacaactcttttatgaaaaacgacgtcatttcaccggaatttgatgaaaacggtcgcccgctgcgccgtattcgcagctttgtccgccgtcagggacgcctgacaaaagggcagcaacacgcgctggacaactactggccggtgatgggcgttgagttcagcgagcaaccgctcgacttcaccgacctgtttggccgcgacgcgccagtgaccctggagatcggctttggtatgggcacctcgctggtcactatggcgaaagcgcgcccggagcagaacttcctcggtattgaagtacattcgccgggcgtcggcgcgtgcctggcaacggcccatgaagagggcgttgagaacctgcgcgtcatgtgtcacgacgcggtggaagtgctgcacaaaatgattcctgacaattctttgaacatggttcagctctttttccctgacccatggcacaaagcgcgtcataataaacgccgtatcgttcaggcaccgtttgccgagctggtgaaaagtaagctcaagctgggcggcgttttccacatggcaaccgactgggaaccttatgcggaacatatgctggaagtgatgtcgtccctggacgggtataaaaatcagtctgaaagcaacgactacgtaccgcgtccggattcacgtccggtgacaaaatttgaacagcgtggccatcgtcttggtcacggcgtatgggacttaatgttcgagagggtgaaataa

SEQ ID NO: 4231 - DNA, 1998 bp, Enterobacter cloacae
tacaaagagttgaggttcgctatgtctgacgacatgtcttcgctttcgccttcgtcagcaggcgaacagggtgtactacgttctatgcaggaggttgcgatgagctcccaggaagccagcaagatgctgcgcacttacaatattgcctggtggggcaataactactacgacgttaacgagctgggccacatcagtgtctgcccggatccggacgtcccggaagcgcgcgtggatctcgctaaactggtgaaaacccgtgaagcgcagggtcagcgcttgcctgcactgttctgcttcccgcagatcctgcaacatcgcctgcgttctattaacgccgcgttcaaacgcgcgcgggaatcgtatggttataacggcgactatttcctcgtttacccgatcaaggtcaaccagcaccgtcgcgtgattgagtccctgatccactccggcgagccgctgggcctggaagcaggctctaaagcggagctgatggcggttctggcgcacgcgggcatgacccggtcggtgatcgtctgtaacggctataaagatcgcgaatacattcgtctggcattaattggcgagaagatgggccacaaggtctatctggtgatcgagaagatgaccgaaatcgcgatcgtgctggaagaggccgagcgtctgaacgtgatcccacgccttggcgtgcgtgcgcgactggcgtcgcagggttccggtaaatggcagtcttccggcggtgaaaaatccaagttcggcctcgcggcgaaccaggtgcttcagctggtggaaattctacgcgagcgcggtcgtctggacagcattcagctgctgcacttccacctcggctcgcagatggccaacattcgcgacatcgccaccggcgtgcgtgaatcggcacgtttctacgttgagctgcataagctcggcgtgaatattcagtgctttgacgtgggcggcggcctgggcgtggactacgaagggacccgctcgcagtctgactgttcggtaaactatggcctgaacgaatatgccaacaacatcatctgggcgattggcgatgcctgcgaagagcacggcctgccgcacccgacggtgatcaccgaatccggccgcgcggtcacggcgcaccatacggtactggtctctaacatcattggcgttgagcgtagcgaaatcaccgaagccacgcctccggcagacgatgccccacgttccctgcaaagcatgtgggaaacctggcaggagatgcacgagccgggcacgcgtcgttccctgcgcgaatggctgcacgacagccagatggacctgcacgatattcacgtcggctactcgtcaggcacattcagcctgcaagagcgcgcgtgggccgagcagctctacctgaatatgtgccacgaagtgcagaaacagctcgacccgagcaaccgcgcgcaccgtccgattatcgacgagttgcaggagcgtatggcggacaaaatgtacgtcaacttctccctgttccagtcgatgccggatgcctggggtatcgaccagctgttcccggttctgccgctggaagggctgaaccacgccccggaacgccgcgccgtgctgctggacatcacctgtgactctgacggcgcgattgaccattacgttgacggtgacggtatcgcaacgacgatgccaatgccggagtacgatccggagaacccgccaatgctgggcttctttatggtgggggcgtatcaggagatcctcggcaacatgcacaacctgttcggtgataccgaagcggttgacgtgtttgtcttccctgacggcagcgtggaggttgagctgtccgacgaaggggacaccgtggcggacatgctcgaatacgttcagctggatccgaaaaaactgctcacccagttccgcgatcaggtaaaaaacaccggtctggacgatgccttgcagcagcagttcctggaagagtttgaagcgggtctgtacgggtacacctacctggaagatgagtag

SEQ ID NO: 4232 - DNA, 438 bp, Enterobacter cloacae
tcgattaacaaattcgtcacattgtcgcttgacgaaacattcatcgcttttatattgaccgtattaaataagaaacagagtttcatatatgaaacaaaagcctggaggatcgtgatgagctggataggcgtatgtgacgcagagcaagtacaggaagatttcccttttagcggcaacgtcgacggtaaagagatcggcgtttacctgatcgacggtgaatattacgcgctggaggacgtatgcccgcacgcctatgccctgctgagtcaggggttcgtggaagacggcaaggtggaatgcccgctgcacgaggcggtgttcgacgtcaaaaccggccagtgtctgcacggccccggaggacgcaacctcaaccgatacccggttcgggtctttgaaaaccagattcagattaccttcgttgaggagaccgtggcatga

SEQ ID NO: 4233 - DNA, 1116 bp, Enterobacter cloacae
acgcggtgcgcatgcacgaccagcagggcgagccgtggagcgacgccagcttccgggcattcttacaggttaacggctactgagggcaacgcgatgacgacgaccgtacaacattatctggataaaggcctgcgtggcctctggtatccggtgctggcgagctgggaagtgcagtctgcgccggtgggcatcacccgcctgggcgagcagattgtggtctggcgcaataaagatggccaggtgcaggcgctggaggaccgctgcccgcaccgcggcgcgcgcctgtcgatgggctggaacctcggggaccgcattgcctgctggtatcacggcgtagaggtggcgggcaacggcgaggtgaaagacgtacccgccgtggataaatgtccgctggtcggccagcagtgcgtgcgcagctatagcgtgcaggaagcgcacggcgccatcttcctctggtttggcgtcaccgcggaccagcagccggacgaactgaccttcccggacgagctcgccgatacggacagcttcagcaacttcctctgcaccgccgcgtggaaatgcaattaccagtacgcgctggaaaacgtgatggacccgatgcacggcacctatctgcactcctcgtcgcactcgatggcggaaggggatcgcaaggccgacatggtgctccagccgaccaaaaccggttttattttcgagaagaaagggcagagcggcgtcaattttgactgggtggagctgggcaacagcggcacctgctggatgcgcctctccattccgtacaagaagcgcttcgggccgggcggccacttctttatcgtcggcatggtggtgccggaagataacgacaactgccgcgtcttcttctggcgcattcgccgggtgcagggctggcagcgcgatatgtggcgtttcatgtaccgcaaccgtctggaaaaactgcactgggaagtgctggagcaggaccgcgtggtgctggaaagcctggcgccaaacgcgcgcgatcatgagtacctgtatcagcacgacgtcggtctttcgcgcctgcgccgcatgatgcaaaaggccgccaaagagcagctggcgatgcgtgaagcacagcagggagccgcctga

SEQ ID NO: 4234 - DNA, 552 bp, Enterobacter cloacae
gacgttactgaggagagtgtcatgactgattcaatcgtaaccaacaaaacaggcatcaaacctgaccatctgacgatggaagagtgggtcgagtcgcgcatcgcgcgcttcgaaggccgtaaatacgactggaacgcgctgaagttccaggccgattttgatccgaaatatcgccgggcgcagatgcgctacatcggcaccggcgcaaccggcgtggcgaacgacaccaataccgtgcaggcggaccattttaccttctccaccatggtgctgccgtcgaagtgcgaaggaccgctgcacctgcacgacgacgtggaagaggtgttcttcatgctcaaggggcagatcacgctgatgatccaggacggcgacaactacaccgaaaccgtgctgcgcgagcgtgacctgatctccgttccgccgggcatctatcgcggcctgtttaaccacggtgaagaagaggcgctgatgtgcgtcatgctggggaccaataagccggaaatcccgacctatccgtccgatcatccgctttccaaagtgaagcggaactaa

SEQ ID NO: 4235 - DNA, 780 bp, Enterobacter cloacae
gggggcatgatgacgggttttcgtgaacagggaagcggcattccgctgatgctgctgcacgggatcagctccggcgccgcctcctggcacaagcagatggcgctgaacggttttcgcgtgctggcgtgggacatgccgggctatggcgaaagcccgatgctggccgtagcgcgggcaaacgcgggggattacgccgacgcgctggcggccatgctggatcgcgccggtgtctggcaggcagtgctggtcggccattccctgggggcgctggtggccagcgcctttgcggcaaagttcccggatcgcgtcattcatctggtgctggccgacgcggcgcaggggtacggcaatgccgcgccggagcagcgggagcaggtctggcgcaaccgagagcagcagatggcgctggggggcgaaatcctcgcccagacccgcgccccgaagctgctgcgccccggcgcgcgcgcggaagatatcgccaccgtcgcggcgggcatgcgggtgctgcgcccggaaggctaccttgccgcctcgtggatgctggcgcatgacgacatccacggctggctgaagcgttattccggcagttttgaagtctggtgcggcgagcaggatgccatcacccagccggagctggttcagggtctggcgctgcgctacggcatgccgtttatcgccattccgcaggccgggcacgccagctatctcgataacgacgcgtttttcaaccaacagcttttacgcattaacgaagaggtgcgcgatgaatgcacaaattga

SEQ ID NO: 4236 - DNA, 1185 bp, Enterobacter cloacae
gaatcaacgagaggattcaccatgtctgtaattaagatgaccgatctggatctggcaggtaaacgcgttttcatccgtgccgatctgaacgtaccggttaaagatggcaaagtgaccagcgacgcgcgtatccgtgcatctctgccaaccattgaactggctctgaagcagggcgctaaagtgatggtcacctcccacctgggccgtccaactgaaggcgagtacaacgaagagttctctctgctgccggttgttaattacctgaaagacaaactgtccagcccggttcgcctggtgaaagattacctggacggcgtggaagttgccgaaggtgagctggttgttctggaaaacgttcggttcaacaaaggcgaaaagaaagacgacgaaaccctgtccaaaaaatacgctgcgctgtgcgacgtattcgtgatggatgcattcggtacggctcaccgtgcgcaggcatctacccacggtatcggtaaattcgcagacgtcgcctgtgcaggtccgctgctggctgacgaactggaagcgctgggtaaagcactgaaagaacctgctcgtccaatggtcgctatcgttggtggttctaaagtttctaccaaactgaccgtactggattctctgtccaaaatcgctgaccagctgatcgttggcggtggtatcgcgaacaccttcgttgctgcgcaaggccacaacgtgggtaaatccctgtacgaagcggatctggttgacgaagccaaacgtctgctgggtacctgtgatatcccggttccaactgacgttcgcgtggcaaccgagttctccgaaactgctaccgcaaccctgaaatctgttaacgacatcaaagatgaagagcagattctggacctgggcgacgtttctgcacagaaactggctgaaatccttaaaaacgcaaaaactatcctgtggaacggtcctgtcggcgtgttcgaattcccgaacttccgcaaagggactgagatcgtggctaacgcaatcgcagacagcgaagcgttctctatcgcaggcggtggtgacaccctggcagcaatcgacctgttcggtatcgctgacaagatctcctacatctccactggtggcggcgcattcctcgaattcgtggaaggcaaagttctgccagcagtagcaatgctcgaagagcgcgctaagaagtaa

SEQ ID NO: 4237 - DNA, 855 bp, Enterobacter cloacae
atggaacaacttgatgttgtagacagcatcaataacgcgggtaactggctggtgcgcaaccaggcgctactgctgagctacgccgtgaatattgttgccgctattgccatcatcattgtcgggatgatcgtggcgcgtatcgtttcgaacgctgtcaaccgggtgatggtcgcacgacacattgatgccacagtcgccgatttcctctccgcgctggtccgttacggcattatcgcctttacgctgattgcggcgctggggcgtgtcggcgtgcagacggcatccgtcatcgctgtgctcggtgctgccggtctggccattggtctggcattgcagggttcgctgtctaacctggcggcgggcgtattgctggtgaccttccgtccgttccgttccggtgagtatgtggatctgggcggtattgccggtaccgtgttgcaggttcagattttctccacgaccctgcgtaccgtggatggtcgcattgtggtagtcccgaacgggaaaatcattgcgggcaatatcattaacttctcccgcgagccggtgcgtcgtaacgagctgatcatcagcgtggcgtacgactccgatatcgatcaggttaagtctctgattaccaacatcattgcttcagatgaccgtattctgaaggaccgcgagcagaccgttcgtctgaatgagctgggcgcgtcatctattaattttgtggtgcgcatctggagcaaaagcagcgatcttcaaaacgtttactgggatgtgctggagcgcatcaagcgtgatttcgatgctaacggcatcagcttcccgtacccgcagatggacgtaaacgtcaaaaaagtcaaagaagcagagtaa

SEQ ID NO: 4238 - DNA, 783 bp, Enterobacter cloacae
gccctgttaacagggcactcttcgcaacatggaggaatgacagtgaagtttaaggtgatggccctggcggcattagtaagtttaggtgcggtgtcggtgcaggcgaatgaactgccgaacggcccgcacattgtcacttcaggcacggcaagcgtggatgcggtaccggatgttgcaaccctggcaattgaagtgaacgtggcggcgaaagatgctgcttccgccaagaaacaggcagacgatcgtgttgcgcaatacctctctttcctggaacagaacggtgtcgcgaaaaaagacatcagctctgcgaacctgcgtacccaaccggattatgactaccagaacggcaaaagcatcctgaaaggctatcgcgccgtgcgtactgtagaagtgaccgtgcgccagcttgataagctcaacggattgctggatggtgcgctgaaggcagggctgaacgaaattcgttccgtctcgctgggcgttgcgcaaccggagaaatataaagacgaagcgcgtaaagcggctattgatgatgccattcatcaggcgcagcagctggcatccggctttaaaagcaagctcggtccggtttacagcgtgcgataccacgtttcaaactaccagccaagcccgatggtgcggatgatgaaggcggacgccgcgccggtttctgctcaggaaacctacgagcagccaaccattcagttcgacgatcaggttgatgtggtgttccagctggagccaactcaaactcagcaaactgaggcggctaaggcgcagtag

SEQ ID NO: 4239 - DNA, 384 bp, Enterobacter cloacae
cgaatgcgtatgtctatacagaacgaaatgcctggttacaaggatttaaaccagttactgaaccagcagggagtcggtctgacccctgccgaaatgcacggtctgatcagcggcatactgtgcggcggaaacagcgacagctcatggcagccgctgatccacgacctcaccaacgaaaggctggcgtttggccacgaactggcggaagcgctgcgtaaaatgcacgccgcaaccagcgattccctggaagacgatggctttctttttcagctttatctgcctgaaggcgacgatgtcagcgtcttcgatcgcgccgatgcgctcgcgggttgggtaaaccactatcttcttggcctgggcgtaacccaacctaaactggaataa

SEQ ID NO: 4240 - DNA, 600 bp, Enterobacter cloacae
tcttccgggactttatcgccccggcgctgggcatcactcaccgcttcatcggctcggagccgttctgcgatatcacccgccagtacaaccagacgctgcacgacctgctggcctcgcatattgacgtggtggagatgccgcgcatcaaggccaccggcaacgccatttcggcctcggaagtgcgccgtttactcaagacacagcagttttcccggatccgggagattgtcccggactccaccttcgcgcacctcgaagcacattatcgtgcgagtgcggaagtcgcataactatcaggaatttatcatgaatattgtaagggaggcgctggccggaacgcaggagtccagcgacctgatggtgaaaattgcccccgctcacggtgagctggagatcgtcatccacagcgaagtgattaagcagtttggcgagcagattcgccaggtggtcaacgacacattgcgcgccatgaacgtgcaccagggattaatcattattgaagacaaaggggcgctggactgtgtgatccgcgctcgcctgcaaagcgcgcttctgcgtgccgccaatgaacaggccatcaactggggggcgctgaaatga

SEQ ID NO: 4241 - DNA, 1668 bp, Enterobacter cloacae
ttgaggcggcagaagagggcgagcgtaacggcctgggcgtggtgtcgctcaacggcaaaatggtggatgcaccgattattaaccacgcgcaggtggtgctggagcgcgcggcggcctccggcgtgcgtcggtaaggatgacataatgaatcagacagaacttctccatatgaatttcccccatctgcgggatctgaaaccctttgataccgcccacagcgcgacgccgtggctggcggacagcgaggcgaagcacagccgcaagctctgcgcctctattgaagaggcggttaagcgctgcggcttgcaggacgggatgaccatctccttccaccacgcctttcgcgaaggcgaccgggtgatcaacaccgtcgtggcgctgctggcgcggatgggcttcaaaaatctgaccctggcttccagctcgctgatgacctgcaacgacgcgctgatcgagcatatcgaaagcggcgtcatcacccggatttacacctccggcatgcgcggcaggctggcggatgccatctctcacgggctgatggaggagccggtacaaattcactcccacggcgggcgcgtgaagctactccaggacggcgaactgaacatcgacgtggcgtttctcggcgtgccgtgcagcgatgagtttggcaacgccaacggcacgcacggtaaatcatgctgcggctcgctgggctacgcgatggtggacgcgcagtttgcccgtaaggtggtgctgctgaccgaagcgctggtgccgttccccaatatgcccgccagcctggtgcaggatcaggtggactacatcgtgcaggtggagagcgtgggcgacccggcgaaaatcagcgtcggcgcagcgcgcgtcaccagcaacccgcgcgagctgatgatcgcccgctatgcggcggacgtgattgaacactccggctacttcaaaccgggcttctcgatgcagaccggctccggcgcggcggccacggcctgcactcgctttatggaagagaagatggagcgcagcggcgtgaaggcgcgctttgcgctcggcggcatcaccggcagcctggtggatctgcacgagaaggggctcatcgaaaagctgctcgacacccagtgctttgacggccaggcagcggcctcgctggcgcgcaacccgaaccacgtggagatctccaccaacgtctacgccaaccccggcagcaaggcggcaagctgcgaccagctcgacgtggtgatcctcagcgccctggaaatcgacgtcgactttaacgtcaatgtcatcaccggctccgatggcgtgatgcgtggcgcatccggcggacactgcgacgtggcggcggcagccaacctgaccattgtggtcgcgccgctgctgcgaagccgcatcccgaccgtcgtgaagcgcgttaccactcgcctcacgccgggggagagcattgacgtgctggtcaccgaccacggtattgcggtcaacccggcgcgcccggagatccgcgaacgactcatggaagcagggatgaaggttgtagatatcaacgcgctgtatgagcgagcgatttcgttgacaggcgtaccgaaaccgattgagttcaccgacaaaatcgtcggggtgatccgctaccgcgacggcagcgtgatcgacactgtgcgacaggtgaaggaggaagtatga

SEQ ID NO: 4242 - DNA, 807 bp, Enterobacter cloacae
tcgatgactggtttgctcgcgactaaaccgcgcccggttgacgtgcctgcgcttgccgaagcggcgctgtggcaggagctggagctgacgcccaagccggggctggtggacaggctcaataacggctcgcatcgggatatggaccatgccttgtttgtccgcagcattatggcgattacgccgtggtttgcccggtttgcggaactgggtgaagcacatgcggccaaacctgccgatcggcagttgcggattctccgcccaatgggaatggcctgcgagcaggcaatgtacgccgccacgggcggggtaaatacccacaagggcggtatttttgctcttggtttgctctgcttcgccgccggtcgtgtgaaaaatatctctgcggatagcctctgttgtgaggtaagtcacatctgtcgcgggctggtggcgcgggagctggccgggcgcagcgggcaggcaacggcgggggagcggcagtttcagcattacggcttaaccggggcgcgaggcgaggcggagagcggctttgcgacggtgcgtaaggcgctggggcagtggaacggacagttgcttcacgacctgctgttgcgcctgatggcggtcaatcaggacagtaatctcgtgtcacgcggcggcattcaggggctgcgctatgttcagggctacgcgcgggaactgctggctaactgctgggatcgcgaggcgttgcttaagatggataaggcactgattgaacgaaacctgagtccgggcggcagcgcggatttgctgtcggtggggtgggtgctgtctgctataaaatag

SEQ ID NO: 4243 - DNA, 984 bp, Enterobacter cloacae
tctatggatgtggaagaaattgtggcccttagtgtaaagcataacgtctccgatctacacctgtgcagtgattcacctccgcgctggcgcaggtcaggccgtcttgaacctgcgccgtttccgcccccggatgtggaggcgttattaaaagcgtggctcaacgatgaacagcagggcgcctggtgggcaaatgggcaggttgattttgccgttaccctcgcagaccgtcagcgcctgcgcggcagtgcgtttaagcatatgcacggcgtttcgatcgcgctgcgcctgttgccgctgacgtgcccgcagctctctgcgttaggcgtgccgcgcgcgatcccggagcttttgtccaatgacaatggcctgattctggtcaccggcgccaccggcagtgggaaatcgaccaccctggccgcgatggtcgatttcctcaatcaccagacggacgggcatattctgacccttgaagatccggtggagtttatgtaccagagtgaacgttgcctgatccagcagcgggagataggcctgcacagcccgtcctttgccgaggccctgcgcagcgcgctgcgtgaagatccggatgtgattctgcttggtgagctgcgcgacagcgagacgatacgcctggcgctgacggcggcggaaaccggccatctggtgttggccacgctgcacacgcgcggtgcggcgcaggcgatcgagcgcctggtcgatacctttccggcgcaggagaaagatccggtgcgtaatcaactggcgggaagcctgcgtgcggttctggcgcagaagctgcgtcaggatgtccagggcgggcgcgtggcgctgtatgagctactggtgaatacgtcggcggcggcaaacctgatccgcgaaggcaaaacctggcaactgccgggcattattcaaacggggcagcaggcggggatgcagaactttgagcagagtctggcggagcgacgggcgcaggggcggctgtag

SEQ ID NO: 4244 - DNA, 243 bp, Enterobacter cloacae
ttctaccaaggcctacaggattttgacactggcagtctgagtgttaatcggtatggatggattaacatctggacgtctattttaggtcacttcttcacccgatttccagttttttttgactcacctctcattgcgttgaaaacgctgctggaaatttttcctgacgacgctggcaacctgcgcatttttgttttgctttttagcgaccttctcggtataaaacgcggcgcgcggctcatataa

SEQ ID NO: 4245 - DNA, 219 bp, Enterobacter cloacae
acaagggcgctcttgttaatacaggagttttctcgtggtttcgccgaaccttgtcatacagagttcggatacgtgttttacaatgatatgaataagaaaccggtcgcacggtctggatttcagcatactctgctgggaaatggagccgttaatgggttgttatcgccgtataacgctgcgatagtagtcaactgttttacacttaatacaaagagttga

SEQ ID NO: 4246 - DNA, 1227 bp, Enterobacter cloacae
ccacgacacgcgccgtcagcagaaaaagccggaggcggtatgacatcgcgcattgtcattatcggcggcggccagtcaggcggctgggcggcgaaaaccctgcgtgacgagggcttcgacggcgagatttgcgtggtagcggaagaggaatgggatttctatgagcgcccgccgctgtcaaaagcgtctctgctggaaccggacgcggcgcttccaaggctgtttaccgacgaggtgcagcaggcgctgaacctgacctggtaccgaccgctgcgcgcagaatctgtcgatcgcgttgaaaaaaaagtccttcttagcaacggcgagcagcttagttacaacatccttttaatcgctaccggcggtcgggcgcgcctgccttcgcaggcgtgggccagccatccgcaggtctataccctgcgccactggcaggacgcgcagcgcctgaaaagtcgcctgtcggaaagtcacaaactcgcgattatcggcggcggctggattggccttgagattgccgcttccgcgcggaaaagcggcgtggcggtcacgctgttcgagcagcagcctgcgctgtgcatgcgctcggtgagcggcgaggtgtcgcagcgcctggaggccatccaccgcgagcagggggtggagatccgtaccggctgcggcgcgctggagctggaggacgacggcggcctgccggtcgtccactgcgacggcaaccgtgaaacctttgatgcagtggtggtggggatcggcgtcgatctcaatctggagctggcgcgtgacgcggggctgaaaaccgggcgcgggatcgtggtggatgcccagggacgcacctcggatccgttcatctttgccgcaggagatgtcgcccagcaccatcactacggcttgtgcatccagtcctgggccttcgcccagaatcaggcggtggcgacggcgaaagcgatgctcaatcccgatgcgccaggttatgacgacgcgccgtggctgtggtcggatcaataccagcacaacattcagatcctcggcattccgcaggcaggctgccgaacgatattgcgtgaagaggcgctgtacttctcgctggacgacaacgggcggctaacgcagcttgtggcgttcaacgatgcgcgcaccgtcaagctggcgaagcgctggatggcggcagggcgggatctgtcggacgtaccgcttgccgacccgacattttcactgatgtcactgcgatag

SEQ ID NO: 4247 - DNA, 987 bp, Enterobacter cloacae
agcgttattccggcagttttgaagtctggtgcggcgagcaggatgccatcacccagccggagctggttcagggtctggcgctgcgctacggcatgccgtttatcgccattccgcaggccgggcacgccagctatctcgataacgacgcgtttttcaaccaacagcttttacgcattaacgaagaggtgcgcgatgaatgcacaaattgacgggcgcgtagcggtagtcaccggcggttcttccggcattggctttgaaacgctgcgcctgctgctgggggaaggggcgaaagtcgccttctgcggccgtgacgaggaccggctcgccagcgcccatgcgacgctgcaaaacgaatttccccacggggagattttcgctttccgctgcgacgtgctgaatgccgacgaagttcaggccttcgcggatgcggtgcaggcgcgttttggcgcggcggatatgctgatcaacaacgccgggcagggctacgtggcgcacttccatgacaccccgcgcgaggcgtggctgcacgaagccgaactcaaactgttcggggtgattaacccggtgcaggcgtttcagccgctgctggaacggtccgacatcgcctccatcacctgcgtgaactccctgctggcgcttcagccggaagagcacatgatcgccacgtcggcagcccgcgccgcgctgttgaacatgacgctgacgctctcgaaagagctggtgggcaaagggattcgcgtcaattccatactgctcggtatggtcgagtccggccagtggcagcgccgctttgaaagccgggcggataaaagccagagctggccggagtggacggcggagatcgcgcgcaagcgcggcattccgatggcgcgcctcggcaagccgcaggagcccgcgcaggcgctgctgttcctcgcctcgccgctggcctcgtttaccaccggcgcggcgctggacgtttccggcggcttctgccgccatctgtaa

SEQ ID NO: 4248 - DNA, 780 bp, Enterobacter cloacae
ggacacatcatgaaaaaggtaatgttgattggtttaggcgccatggcgcaggcggtgattgagcgcctgcccgccggtgtggctatcggctggatcgtggcgcgcgcgtctcaccatcccgccattcacgaccagtttggcgatgcggttgaggcgctgacgtcgccgatggcgtgcgcacaaacgccggatctggtgctggaatgcgccagccaggaggcggtggcccagtacggggaagagatcctgcgtcgcggctggcatctggccatcatttccaccggcgcgctggcggacagcgcgctggagcagcgtctgctcgccgcgggcggaaaactgaccctgctttccggtgcggtggccggtatcgacgggctggcggcggcgaaagagggcgggcttgagcgcgtcacctatcagtcgcgcaaaagcccggccagctggcgcggcagctatgccgagcagcttatcgatctgaatgcggtgtcagaggcaaaggttttcttcgagggcagcgcccgcgaggcggcgcgcctgttcccggcgaacgccaacgtggcggcgaccgtggcgctcggcggcgtcgggatggaggacacccgcgtgcaactgatggttgacccggcaacgaaacgtaacacccacacgctgcatgtcgaaggattattcggcgagttccatctggaactgagcggactgccgctggcttctaatcctaaaacctccaccctggcggcactgagcgcggtgcgcgcctgccgcgagctggccctgagctga

SEQ ID NO: 4249 - DNA, 1479 bp, Enterobacter cloacae
ggagtgacgatggacgatctgaagatttttatcggcggccagtggcgacgcggcggcggcaacccgatgcagagccactttccggcagacgggtcgctcaacgcgacgctgaatgccgccagtctggatgacctggaggaggcggtagccgccggagagcgcgcctggcgcgatcccgcatggcgtaacagtctgccgcacatgcgcgcgaagatcctgcataaagttgccgatcttattgaatcccgcgtcgatgcgctggcgcagatgcagagccgtgataacggcaagccgctggcggaagcgcgcgggctggtgatgagcgcggcgggaacggcgcgctactttgccgccgcctgcgagctgctggaaggggaacttccgacgccgcgccagccggatctgctgacgctgagctgctacgagccccttggcgtggtggcggccatcacgccgtggaactcgccgattgccagcgaaatgcagaaggtcgcaccggcgattgccgccgggaacgcggtgatcctcaagcccgccgaagccacgccgctgatggcgctggagctggcgcggatttttaaacaggccgggctgcccgccgggctgctgagtgtcctgccgggcaaaggctcggtgattggcgatgcgctggcgcgtcatcctcgcgtgcggaaaatttcctttaccggcggcaccaccacgggccgtcatctggcgcacgtggcggcggaaaaactgatcccggcctcgctggaactgggcggcaaatcgccgaccatcgtgctggaggatgccgatatcgaacaggccgcgcgcgggatctgctacggcattttcagctcggcggggcaggcgtgtatcgccgggtcgcggctgtttatccacgagagtatttacgccccgctgatggcgaggctgctggaattaacacgcgggctgcgcgtcggacatccgtttaccgacggcgtccatgtaggaccgctgatcaacgaaaaacatcgccagagcgtgatccagtacgtcgaactggcgaagcgtgaagggggccgcgtgctgtgcggcggcgagatccccgccgatcccgctctggtaaacggcagcttctttctgccaaccattatcgaagggctgagcaacagcgcccgcgcctgtcaggaagagatcttcggcccggtgctggtggcgatgccgtttggcgatgaagccacgcttatccacgaggcgaacgactcggtgtacggcctggcggcggggatctggacgcgcgataccggtcgcgccctgcgtctcagcgagcagctggaggcaggcacggtgtggatcaacacctacaaggtttttgcgatttcgaccccgttcgggggctttaaagagagcggtctgggccgcgagaagggtatccaggggctgaaagcctggatgcaacaaaagagcatttatctggcgacgggtaacagcgtcaaccactggtgcgactga

SEQ ID NO: 4250 - DNA, 2184 bp, Enterobacter cloacae
ggaatatctacaggggcgggcgagcagattgcgcaacatgcgagcatgatccagagatttcttaagcagcaaaagaatgctccatgtacatgccctgcggcttgggttacattgttggcacttttttccggcgtagcccaaaacgcgctgtcgtcaagggcatggcctttaacagtccgatctggagttaaaatgtcctcacgtaaagagcttgctaatgctattcgtgcgctgagcatggacgcagtacagaaagccaaatccggccacccgggcgcccctatgggcatggctgacatcgccgaagtcctgtggcgtgatttcctgaaccataacccgcagaacccggcatgggcagaccgcgaccgtttcgtgctgtctaacggccacggctctatgctgatctacagcctgctgcacctcaccggctacgatctgccaatcgaagagctgaaaaacttccgtcagctgcactccaaaactccaggtcacccggaagtgggctacaccgctggcgttgaaaccactaccggtccgctgggtcagggcatcgctaacgccgtaggtatggcgattgcagagaagaccctggcggcgcagtttaaccgtcctggccacgacatcgttgaccacttcacctacgccttcctgggcgacggctgcatgatggaaggcatttctcacgaagtgtgctccctggcaggcaccctgaagctgggtaaactggttgcgttctacgacgacaacggtatctccatcgacggtcatgttgaaggctggttcactgacgacaccgcagcacgtttcgaagcctacggctggcacgttgtgcgcggcgttgatggccacgatgctgactcgattaaacgtgccgtagaagaagcgcgcgccgtgaccgacaaaccgtccctgctgatgtgcaaaaccatcatcggcttcggttctccgaacaaagcgggcactcacgactcccacggcgcaccgctgggcgacgcggaaattgcactgacccgtgaagcgctgggctggaaacaccctgccttcgaaatcccgtctgaaatctacgctcagtgggatgcgaaagaagtgggtcaggcgaaagaagcggcctggaacgagaagttcgcggcttacgcgaaagccttcccacaggaagcggctgagttcacccgtcgtatgaaaggtgacatgccgtctgacttcgacgccaaagcgaacgagttcatcgcgaagttgcaggcgaacccagccaagatcgccagccgtaaagcatctcagaatgcgatcgaagcgtttggccctctgcttccagaattcctcggcggctccgctgacctggcgccatcaaacctgaccctgtggtccggatctaagccaatcaacgaagatactgccggtaactacatccattacggtgtacgtgagttcggtatgactgcgattgccaacggtatcgctctgcacggtggtttcctgccgtacacttctaccttcctgatgtttgtggaatatgcacgtaacgccgtgcgtatggctgcgctgatgaaacagcgtcaggtgatggtctacacccacgactccatcggtctgggcgaagatggtccaactcaccagcccgtagagcaggtggcttccctgcgcgtgaccccgaacatgagcacatggcgtccatgtgaccaggttgaatctgcggtggcgtggaaatacggcgttgagcgtcaggacggtccaaccgcgctgatcctctcccgtcagaacctggcgcagcaggagcgtactccagagcagctggcgaacatcgcacgcggtggttacgtgctgaaagattgcgcgggccagcctgagctgatcttcatcgccaccggttcagaagttgaactggctgtagcagcatgggaaaaactgactgccgaaggcgtgaaggcgcgtgtggtttccatgccgtctaccgatgcgttcgacaagcaggatgccgcgtaccgcgaatccgtactgcctaaagcggtctccgctcgcgtggcagtggaagcgggtatcgcagactactggttcaaatacgtgggtctgaacggcgctatcgtcgggatgaccacgtttggtgagtctgcgccagctgaacagctgtttgaagagttcggcttcaccgttgaaaacgttgtcgctaaggcgaaagaactgctgtaa

SEQ ID NO: 4251 - DNA, 708 bp, Enterobacter cloacae
tattatccatttcctctaatgacgttcccgcagtatagtctgcctccaggacaactctgcgagaattacgtcatgttatcttattattttcaggggcttgtgttaggtgcggccatgatccttccccttggtccacaaaatgcgttcgtgatgaaccagggcattcgccgccagtatcatttgatgattgccctgctgtgtgcggtgagcgatctgctgctgatttgcgccgggatttttggcggcagcgccctgttgatgcagtcgccgtggctgctggcgctggttacctggggcggcgtagcgtttctgctgtggtacgggtttggtgccctgaaaacggccatgagcagcaatcttgagctggcgagcgccgaagtgatgaagcaggggcgctggaagattatcgtcaccatgctcgccgtaacgtggcttaacccgcacgtctaccttgatacctttgtggtgctgggcagcctgggcggacagctggacgttgagccgaaacgctggtttgcgctcggtacggtcagcgcctccttcctctggttcttcggtcttgcgatcctggcggcgtggctggcgccacgactgcgtaccgccaaagcacagcgcattatcaataccctggtggggctggtgatgtggtttattgccttccagctggcgaaagaggacattcatcacgtacagggattgttcaactaa

SEQ ID NO: 4252 - DNA, 696 bp, Enterobacter cloacae
tgcgccctgagttttcacaccacaggcaaaacgatcatgacgcaggatgaactgaaaaaagcagtaggatgggccgctctccagtacgtacagccgggtaccattgtcggtgttggtacggggtccacggcggcacactttatcgatgcgctgggcacgatgaaggggcagatcgagggtgcggtttccagctccgatgcttccacggaaaagctgaaaagcctcggcatcaccgttttcgacctcaacgaagtggaccgtctgggcatttacgttgatggcgcggatgaaatcaacggccacatgcagatgatcaaaggcggtggcgcggcgctgacccgcgaaaaaatcatcgcttccgtggcggataagttcatctgcatcgcggacgcctccaagcaggtcgacattctggggaatttcccgctgccggtcgaagtgatcccgatggcgcgcagcgcggttgcccgtcaacttgtgaagctgggcggtcgtccggaataccgtcagggcgtagtgaccgacaacggcaacgtgatcctcgacgttcacggtctggaaattcttgacgcgattgcgctggaaaacgccatcaacggcattccaggcgtagtgaccgtagggctattcgccaaccgtggcgcggatgtggcgctgatcggcaccgctgacggcgtgaaaaccatcgtaaaatga

SEQ ID NO: 4253 - DNA, 1233 bp, Enterobacter cloacae
atggcaaaggtatcactggagaaagacaagattaaattcctgctggttgaaggcgtgcaccagaaagcgctcgatagccttcgcgcagcaggctacaccaacatcgaatttcacaaaggcgcgctggacactgaagagctgaaagcgtccatccgtgatgcccatttcattggcctgcgatcccgtacccaactgactgaagacgttattgctgcggcggaaaagctggtggcgattggctgtttctgcatcggcaccaaccaggttgatctgaatgccgccgcaaaacgcggtatcccggtctttaacgcgccgttctctaacacccgttccgtggcggagctggtaattggcgagctgctgctgctgcttcgcggcattccggaggctaacgccaaagcgcaccgcggcgtgtggaataagctggctgcgggctcctacgaagcccgtgggaaaaagctcgggattatcggttacggccatatcggtacgcagctcggtattctggcggaatctctcggcatgcacgtgtttttctacgatatcgaaagcaagctgccgctgggtaacgcgacgcaggtgcagcatctttctgacctgctgaacatgagcgacgtggtaagcctgcacgtgccggaaaatgcgtccaccaaaaacatgatgggcgcagaagagctggcgctgatgaagccgggctctctgctgatcaacgccgcgcgcggtaccgtggttgacattcctgcactgtgcgacgcgctgaagcgtaaacatctggcgggcgcggcgattgacgtgttcccgacggaaccggccactaacagcgatccgttcacctctccgctgtgcgagttcgacaacgtgattctgacgccgcacattggcggttctactcaggaagcgcaggagaatatcggcctggaagtggcgggtaaactgagcaaatattccgataacggttcaacgctctctgcggtgaacttcccggaggtgtctctgccgctgcacggtgggcgtcgtctgctgcacatccacgaaaaccgtcctggcgtgctgaccgccatcaaccagatctttgccgagcagggcgttaacattgctgcgcagtatctgcaaactaactcgcagatgggttatgtggttattgatattgaagcggatgaagacatcgccgagaaagcattgcagagcatgaaggccattccggggacgattcgcgcgcgtctgctgtactga

SEQ ID NO: 4254 - DNA, 1122 bp, Enterobacter cloacae
tttccggggcgggagcatatatcttcctgccggtggctgataacacaaacgtcgcggatgcataaaaaggataaccatattcgcggtcagtcgcgcttctgcccgcacaagcggctgaacaacgcgttcatgctgcatgcctccaccagcccgttttacccgctgtttgcggcgctggacgtgaacgccaagatccacgagggcgaaagcggacgcaggctgtgggcggagtgtgtcgagttgggcattgaagcgcgcaaggccatcatcgctaactgccatatgatcaaaccgtttatcccaccggtggtggcggggcggccatggcaggatcaccccacgcaggctatcgccagcgagcgtcgcttctttagttttgaaccgggtgcaaaatggcacggttttgaaggctatgcccgcgagcagtatttcgtcgatccgtgcaagctgctgctgaccacgccgggcattgatgctgaaacagggcactataccgatttcggcattccggcgaccattctcgcccactacctgcgcgagaacggcattgtgccggagaagtgcgatctcaactccatcctgttcctgctgacgccagccgagagcgcggagaagctgatgcagctggtggcgatgctggggcagtttgaacagcatattgaagacgacacaccgctcgcggatgtgcttccgaccatctatcagaaatacccggtgcgttaccgcgactatacgatccgccagctatgccaggagatgcacgatctctacgtcagctttaacgtgaaggatttacagaaggcgatgttccgtcaggagagcctgcctgccgtggtgatgaacccccaggatgccaaccaggagtacattcgcgggaacgtcgaactggtgcgtattcgtgacgccgaaggacgcattgccgccgaaggtgcgctgccatacccgccgggcgtgctgtgcgtggtgccgggggaagtctggggtggagcagtacagcgctacttcctggcactggaagagggcattaatatgctgccgggtttctccccagagttgcagggcgtttacagcgagaaggatgcggacgggatcaagcggctgtatgggtacgtattaaagtag

SEQ ID NO: 4255 - DNA, 924 bp, Enterobacter cloacae
cgtctccatctctctgctgattctgggcaacttcctcgtttaagttttcaggaaagaacaatgaaactcgcaagctttttataccagggaaaacgcagctacggcatcgttcaggccgacggcgtgattgatttaggccgccgcctcggcgaccgctatggcgaccttaaagcgctgttgcaggggaacgggctggcgcaggccacccgattcctgaacgacgcggtggacgtgccgctgaacgccatcaccttcttaccggtgattgtccagccggaaaaaatcctctgcgtgggcatgaactatgccgacaagcgcaaggagtttgaccagcacaacccggccccgacgctgtttgtccgcttcccggactcacagaccggccacaacgagccggtgctgaagccgcgccactccagcgaattcgactacgaaggcgagctggcggtgatcatcggcaaaggcggggagaacatcagccgcgacgacgccctgcgccacgtggcgggctacagctgttacatggacggctccgcccgcgactggcagcacacctggttcaccgccgggaaaaactggcggcagaccggggcgttcggcccgtggatggcgacggcggatgagatccccgatccgcaccaacttgcaatccgcacctggctgaacggccgcatggtgcaggaagacaacaccagcagcatgatccacaaggtggcggagctgatcgagtacatcagcaccttcacccgcttaagtcctggcgatgtgatcatcaccggatccccaggtggggtgggtaaaaagcgtaacccgccgctgtttatgaaagagggggatcgcattgaggtggagatcgagcatatcggtcatctcagcaacgtgatcgtggaagcgccagccgtcgggctcgcggcagcgcactga

SEQ ID NO: 4256 - DNA, 387 bp, Enterobacter cloacae
acagcgtggccatcgtcttggtcacggcgtatgggacttaatgttcgagagggtgaaataatggcaaagaatcgtagccgtcgtctgcgtaaaaagatgcacatcgaagaattccaggaagtgggtttctccgttgcctggcgtttcccggaaggcaccagcgttgagcagatcgatcaggacgttgatgcgttcatcaacgaggtgatcgagccaaacaagctggccttcgacggtagcggctatctggcgtgggaaggtctgatttgcacccaggaagtggggaaatgcaccgaagagcatcaggcgctggtacgcaaatggcttgaagaccacaaactggaagatgtccgcgttagcgaacttttcgacgtttggtgggactaa

SEQ ID NO: 4257 - DNA, 771 bp, Enterobacter cloacae
agcaagaacggggccagcattagctggcccattttgtctgagggagtgtttaagatgcgcaaaacgttgctggctgttgctttactggcaatcggatccaccgcccatgcggagtataaatgtagcgtcaccccgcgtgatgacgtggtgctgagtccgcaaaccgtgcaggttaagggcgagaatggcaatctggtgattacgccggatggcaacgtgacctttaacggcaaaccgcaaaacctgacggccgcacagcgcgagcaggcgatggactaccaggccgagttgcgtaccgcgctgccctggatcaacgatggcgcgctgacccgcgttgaaaagagccgcgtggcgctggataaaatcatcaccaaagaggtgggggagagcagcaatatgcgcacccgcctgacgaagctggataagcagctgaaagagcagatgaaccgtattatcgagacgcgctctgatggcctgacgttccattataaggcgatcgatcaggtgcgtgccgacggtcagcagctggtgaaccaggcgatgggcggcattctccaggacagcatcaacgagatgggcgccaaagcggtgctgaagggtggcggtaatcctttgcagggtgtactgggtagtctgggcggactgcaaacctcgattcagaacgagtggaagaatcaggaagccgatttccagcagttcggcaaagacgtgtgtaagcgcgtggtgtcgctggaagacagccggaaggcgctggtggggacgctgaagtaa

SEQ ID NO: 4258 - DNA, 948 bp, Enterobacter cloacae
tgtatcgactttataagaggtcaggacatgagcactttaggtcatcagtacgataactctctggtatctaacgcgtttggttttttacgccttccgatgaacttccagccgtacgacagcgatgcggactgggtgatcaccggcgtaccgttcgacatggcaacgtccggtcgcgcgggtggtcgtcatggcccggcggcgatccgtcaggtttccactaacctggcctgggagcacaaccgcttcccgtggaacttcgacatgcgcgagcgtctgaacgtggtggactgcggcgatctggtgtacgccttcggcgacgcgcgtgagatgagcgaaaaattgcaggcgcacgccgagaagctgctggcggccggtaaacgcatgctctccttcggcggtgaccacttcgtgaccctgccgctgctgcgcgcccacgcgaagcacttcggtaaaatggcgctggtgcacttcgatgcgcacaccgacacctacgcgaacggctgtgagttcgaccacggcaccatgttctacacggcgccgaaggaaggcctgatcgatccgaaccactccgtgcagatcggcatccgcaccgagttcgacaaagacaacggcttcaccgtactcgacgcgggccaggtgaacgatcgcggcgtggacgatattctggctcaggttaagcagatcgtcggcgacatgcctgtctatctgaccttcgacatcgactgcctggatccggcattcgcaccgggtaccggtacgccggtgatcggcggcctgacatcagaccgcgccatcaagctggtgcgcggcctgaaggatctgaacattgtcgggatggacgtggtggaagtggctccggcctatgaccagtccgagatcaccgcgctggccgcggcgaccctggcgctggaaatgctctatatccaggcggcgaaaaaaggcgaataa

SEQ ID NO: 4259 - DNA, 771 bp, Enterobacter cloacae
agcacagcagggagccgcctgatgaacgggctgctgagcggcaagcgcatcgtcataaccggcgccgcgcgcgggctgggctttcactttgccaaagcctgcgcggagcagggcgcggcggtggtgatgtgcgacatcctgaagggcgagctggccgaaagcgcccacgccctgagcgagcggggctatgcgatcgaaccgcacgttatcgatctggccgatccacagtccattgagcaggtgttcagcgccattggcgagcagggtcagatcgatggcctggtgaacaacgcggcgatggcgacgggcgtcggcggcaaaaacatgctcgattacgatccggatctctgggatcgggtgatgagcgtcaatgtcaaaggcacctggctggtgacgcgcgccgccgtgccgctgctgcgtgaaggggcgggcattgtgaacgtggcgtccgacaccgcgctgtggggcgcgccgcgcctgatggcctacgtcgccagcaagggggccgtcattgccatgacccgatcaatggcgcgcgaactgggtgaaaagcgtatacgcattaatgccatcgcgccggggttaacccgcgtcgaggcgacggaatatgtccccgccgaacggcatcagctctacgaaaacggacgcgcgttaaccggcgcgcagcagccggaagatgtcaccggcagcgtggtctggctgctaagcgatctgtctcggttcatcaccggacagctgatcccggtcaacggcggttttgtctttaactaa

SEQ ID NO: 4260 - DNA, 801 bp, Enterobacter cloacae
ggtagggcgatgatggcaaacgatcaggaagtgaagtatctggtgccggggctggagcgcggtttacagctgctgttggcctttggcgagcagcatcgcgatctgacttttgccgagctgcaccggctggtggatatgccgaaggcgaccgcctatcgcgtggtgcagacgctggagtacatgggctttctggagcgcaacacgcgcaccaataccttttcgctgggcatgaacgtgctgcgtcttggctttgagtacatcgcctcgctggacgtggcgcaggtcggccagccggtgatcgagcaactgcgcgacgtgagccagtgcagcagccatctggcgatccgcgacgggcgcgacattatatacatcgcccgcgtcagcgccgccgggtcgcgtatcaaccaggtcagcattggtacccgtctgccggtgcactgtacctcgctgggccgcatgctgttgaccgatatttcccgcgctgatttcgaacagctgttcccgcatgagcgtctgccgggcaacacgccggggcagcttcacgaccgtgaagccctgtggcagatggtgcagcaggacaaagcccgcgggtatgtcatcggcgaatccttcttccgccacggcatctcttccatcgtctacccggtgtatgaccgaagcggccgcgtggcggcggtagtcagcattctggtgccgtcggaggagatcccgcagagcgaccgcgagcgcctgcaaaacgaggttcgccttgcggcggataaaatttctggcttcttagggtatctatcacaggccagttaa

SEQ ID NO: 4261 - DNA, 978 bp, Enterobacter cloacae
ctgcgtcgggcatgttttacgcccaatctgggccagatgaggcaacgaacgatgagtgtaaccggaattgaaaagctggaatttggtgtggaagacctgacgcactgcgccaaatttatgcgtgattttggcctgacgggcgatgccagcggccagcgtttcaccaccctgagcggcgcgcgcgtggagcttaacccgatcgacagccccgacctgccgcccgcgtttgaagcgggcaacaccctgcgccgcatgacctgggcggttgccgcacagtccgatctcgacgcgctgcgcccgaagctggcgcagcagcccggctttcgcgaagtgggcgacgcgctggaatgcctcgatccgaacggcatgacgctgcgcgtgcaggtgacccagcagaccgacgtggagcttaacgtcgagccaataaaccagtggggcgacgcccgccgtatcgacacgcccagcccggtttacgatcgcgcccagccgatcaacgtggggcatgtggtgttcttcgtggaggagctggcggcggtggaaaaattctaccgcgaggtgctcggcttccaggtctcggatcgctatatcaaccgcgccgtgttcctgcgctgcggcgtgcgtggcggccatcacaacctgttcctgctgcaactgccgaaccgcaagcgcggccttaaccacgtggccttcaccgtgcgcgatatccacgaggtgatcggcggcggtatcgcgatgaataaacatgactggagcacctttatcggaccgggacgtcatccggtgtcgtcggcgtacttctggtacgtcaacagcccgaccggcggcgcgtttgagtattacaccaacgatgattacctgacggaaaactggcagccgcgcgagctggagcattccctggtctccttcaccgagtgggcggtggaaggcgggattgaccacgacacgcgccgtcagcagaaaaagccggaggcggtatga

SEQ ID NO: 4262 - DNA, 1278 bp, Enterobacter cloacae
cccgcacccgtagggggagaaatgaccacactagagactaacaccgcgccggttgaggcgagcggtgaggggacccgcacgcccgaaaaagcggtgcgctgggccatcccgctgtcgctgctggcctgcgtgctgctggcgtttttcgacaaaatcagcatcgcggcgctcttttcagatacccatttccagcaggcgatgggcattgatttcgacaccacgcgcctcggcattctgatgagcgctttcctgctgagctacggcttctcatcggtgtttttaagcggtttaggcgacaaaatcgcgccgctgcgcctgctcaccgggatgatggcagtgtggtgcgtgctgatggtggcgatgggctttacccataactacacgctgatgatcgtcctgcgtattctgctgggcgtggcggaaggaccgctgttcccgctggccttcgccattgtacgccacaacttcccgcagcatttgcaggcacgcgccaccatgctgtggctgctgggcaccccggtgggcgcggcgattggtttcccgctctccctctggctgctaaacacctttggctggcagagcactttctttgtgatggccatgcttaccgtgccggtgcttatcttggtgcgcattggtctgcgcgggatccgcctggaggcaaaacccggtacctcgcaggcatcacaggacgagcggcgcgccgcacggcgcgagctgtttgtcagcccgcacttctggatcatctgcatctttaacatcgctttcctgacctacctgtggggcatcaacggctggttgcctggctacttaattaagggcaaaggcatccacctggagcatgcgggctggctgtcgtcgatgccgttcatcgccatgctggcaggggaagtgattggcgcgtggctctctgaccgggtcgataagcgcgcggcggcctgctttatctcgatggcgggggcggcggtaggcctggcggcggtgatgcacctcgacaccccgcttgccatcattgcggcgatgagcttcagcacctttatgtggggcaccggcgcacccaacattttcgccctgctggcgaaggccacccatccccgggtgagcgccacggcgggcggtatcttcaacgggctgggaaactttgcgggcgcgctgtcgccggcggtgatgggcgcgctgatcgcctttacccacagcatggattccgggctgatttttctggcggtgatggcggcggtgggctgcgtcctgttactgccgctgctgagacgttactga

SEQ ID NO: 4263 - DNA, 1644 bp, Enterobacter cloacae
gcaatgagcgaaatgataaccgtcggcgacgccatcgccagaacgctggagcagtatcaggttgaggccatctacggcgtcatctccattcacaacctgccgatcgcggatgcggttgggcagcggggcaatatccgctttgtgcccgcgcgcggtgaagccggttccgtcaccatggccgatgctcacgggcgcttttccggcctcggcgtggcgctgaccagcaccggcgcgggggccgggaacgcggtaggcgcgctggtggaagccatgaatgcctgcacgccgctgctgcatttaaccgggcaggttgagaaagcctggctggacgccgacaccgggtttatccatgaaacccgtgaccagctgaccttcctgaaggccagctcaaaacgggcgtaccgcatcagcaatgcgaatcaggcgatagcgattctgcataaagccatccaggacgcgcagaccccgccgtgcggaccggtctcggtggaaatcccgattgatattcagagcgccaaaattccgctgtcgctggtaaccgctccgatcaaaccggtatcggcaccggccgtggataccggaatggttgacgcgctgtgggcgcagctcaaacaggcgaaacagccgctgctgtggctgggcggcggggcgctgggtagcgctgaggcagtgaaaaaactggcggatgcgggcatcaccgtgatttccagcacccacgcgcgcggcgtgctgccggacaaccaccgcgccagccttcgcgcgttccataattcgccgtcggttgaggcgctgattgcgcagtgtgattttacgttggtggccggttctcgcctgcgcagcaacgaaacccgatcctggacgcttgagctgccttccccgcgggtgcagctcgatatcgacccggcggcagcaagccgtaactatctgatggatagcacgttgatagccgattgttccgcgctgcttggcgcgctggctgaaaaagtgcagggccgcgagtggggcaacgcccagtgggatacgcaggtacagcaggctgtcgggcaagctgagcaggggctgcgcgagcagtgcggcgcctatgcgaagcttaacgacgccattgagaaagccctgccgaaagacggcctgctggtgcgcgatatcaccgtgtccggcagcctgtggggtagccgcctgttcagggctaacggtccgctgatgaatattcactccctcgccggggcgattggcatgggcctgccgatggctatcggcaccgcgattgccaacccacagcgcaaggtggtggggctggtgggcgacggcggcctgagcctcaatttaggcgaactggcgacgctggcgcaggagaaagccaacgtgacgctgctgatcatgaacgacgggggctacggcgtaatgcgtggtattcaggataaatattttggcgggcgtcagtattataacgcgctgcatacgccggattttaccctgctggcgcaggcgattggtctacaggcctggagcgttgagcaggccgaggattttgacgcggtgatgatggaagcgttagcgatgccggggccgtcggtggtagaggtgcggatggggcagattggcgcccttaagtttgccgggccgccacagaaaacgctgtactga

SEQ ID NO: 4264 - DNA, 1035 bp, Enterobacter cloacae
ctttgcaggagatctatgaccgtacgcgtagcgattaatggcttcggtcgcatcgggcgcaacgtggttcgtgctttatatgaatccgggcgtcgtgcggaaatcaccgtggtggcaatcaatgaactggcggatgctgcgggcatggcacatttgttgaaatatgacaccagccacggtcgctttgcctgggatgttcgccaggaaagggaacagctgttcgtcggtgacgatgccatccgcgtgctgcatgagaacagtattgaagggctgccctggcgcgaactgggtgtggatgtggtgctggactgtaccggcgtgtacggtaaccgtgaacatggcgaagcgcatctgaatgctggcgcgaaaaaagtgctgttctcccatcccggcagtaacgacctcgacgccaccgtcgtgtttggtgttaaccagcacgagctgcacgctgaacaccgcattgtctccaacgcctcctgcaccaccaactgcattattccggtcattaaactgttagacgatgcttatggcattgaatccggcaccgtgaccacgattcactccgccatgcacgatcagcaggtaatcgacgcctaccatccggatttacgacgcactcgcgcggcgagccagtcaatcattccggtggatacgaaactggctgccgggatcacccgtattttcccgcagtttaacgaccgttttgaagcgattgccgtgcgcgttccgacgataaacgtcaccgcaatcgatcttagcgtgacggtgaaaaaaccggtaaaagcctgtgaagtcaacctgttgctgcaaaaagcggcacagggagcatttcatggtatagttgactatacggaattaccgttggtctcagtagattttaaccacgacccgcatagcgccatcgtggatggcacgcagacgcgagtcagtggtgcgcacctcatcaagacgctggtctggtgtgataacgaatggggctttgctaaccgaatgctcgacaccacgttagccatggccgcgaaaggtttcaggtag

SEQ ID NO: 4265 - DNA, 1179 bp, Enterobacter cloacae
gaagtaagccattcaggggcagggaaacctgcccaattttcagcgcgcttatcagagctcgcaccatttctaacggccgaagatacaggactaagcaacatgtctaaaatttttgatttcgtaaaacctggcgttatcactggtgatgacgtacagaaagtgttccaggtagctaaagaaaacaacttcgctctgccagcagttaactgcgtgggtaccgactccatcaacgccgtactggaaactgctgctaaagttaaagctccagttatcgttcagttctctaacggcggcgctgcgttcatcgcaggtaaaggcgtgaaaactgacattcctcagggtgctgcaatcctgggcgctatctctggcgcacatcacgttcaccagatggctgagcactacggtgttccggttatcctgcacactgaccactgcgcgaaaaaactgctgccatggatcgacggtctgctggacgcaggtgaaaaacacttcgcagcaaccggtaagccactgttctcttctcacatgatcgacctgtccgaagagtctctggaagaaaacatcgagatctgctctaagtacctggcgcgtatgtccaaaatgggcatgaccctggaaatcgaactgggttgcaccggcggtgaagaagatggtgtggacaacagccacatggacgcttctgcactgtacactcagccagaagacgttgattacgcttacaccgagctgagcaaaatcagcccacgcttcactatcgcagcgtccttcggtaacgtacacggcgtatacaaaccaggtaacgtggttctgaccccgaccatcctgcgtgattctcaggaatacgtgtccaaaaaacacaacctgccgcacaacagcctgaacttcgtcttccacggcggttccggttcttctgctcaggaaatcaaagattccgtaagctacggcgtagtgaaaatgaatatcgataccgacacccaatgggcaacctgggacggtatcctgcaatactacaaaaccaacgaagcttacctgcaaggtcagctgggcaacccgaaaggcgaagaccagccgaacaagaaatactacgatccacgcgtatggctgcgcgctgcccagacttctatgattactcgtctggagcaggcattcaaagaactgaacgcggttgacgttctgtaa

SEQ ID NO: 4266 - DNA, 1932 bp, Enterobacter cloacae
attccacactccgtttcatctggtatgaccagatccaattgctggattcaggagaccgacatgctctacaaaggcgacaccctgtacgtagactggctggaagatggcattgccgaactggtgttcgatgcccccggctcagtgaataagcttgataccgcgacggtggccagtcttggccaggcgctggatgtacttgaaaagcaatcagatttaaaagggctgctgctgcgctccaacaaagcggcctttatcgttggcgcggatatcaccgaattcctgtcgctgttcctggtgcccgaagaacagctgagccagtggctgcacttcgcgaacagcgtctttaatcgtctggaagatctgcctgtcccgaccctttctgccgtcaacggttacgcgctgggcggcggctgcgaatgcgtgttagccactgattaccgtctggcgaccccggacctgcgtatcggcctgccggaaaccaagctgggcatcatgccgggctttggcggctccgtccgtatgccgcgcatgctgggcgccgacagcgcgctggagatcattgccgcgggtaaagacgtcggcgcagaacaggcgcagaaaattggcctggtcgacggcgttgtaaaacctgagaagcttgttgaaggcgcactcgccattctgcgtcaggccattaacggcgacctcgactggaaagccaaacgtcagccgaagctggagccgttgaagctcagcaaaattgaagccaccatgagcttcaccatcgccaaaggcatggtgatgcagacggcgggtaaacactacccggcgccgatcacggcggtgaaaaccattgaagcggcagcccgtctgggccgtgatgacgccctgaagctggaaaaccagagctttgtcccgctggcgcacaccaacgaagcccgcgcgctggttggtatcttccttaacgatcagtttgtgaagggcaaagccaaacaactcaccaaaaacgttgaaacgccaaaacacgcggcggtactcggcgcgggcattatggggggcggcatcgcctaccagtctgcctggaaaggcgtgccggtggtgatgaaggacatcaacgagaaatccctgacgctgggcatgaccgaagcgtccaagctgctgaataaacagcttgagcgcggcaaaattgatggtctgaagcttgcaggcgtgatctccaccatccagccagtgctggaatacagcggtttcgaccgtgtggacgtggtggttgaagcggtcgtcgagaacccgaaagtgaaaaaagcggtgctggccgaaaccgaagacaaggtgcgtccggaaaccgtgctggcctctaacacctccaccattcctatcagcgaactggcgagcgtgctgaagcgtccggaaaacttctgcgggatgcacttctttaacccggtgcaccgcatgccgctggtcgaagtgatccgtggggagaaaacctccgacgaaaccatcgccaaagtggtggcgtgggcgagcaagatgggcaaaacgccgatcgtcgttaacgactgcccgggcttcttcgttaaccgcgtgttgttcccttacttcgccggcttcagccagctgctgcgcgacggcgcagacttccgcaaaatcgataaagtgatggaaaaacagttcggctggccgatgggcccggcgtatctgctggacgttgtcggcatcgatactgcccatcacgctcaggcggtgatggcggcgggcttcccgcagcgcatgcagaaagactatcgcgacgccattgacgccctgttcgacgccaaccgctttggtcagaaaaacggtctgggcttctggcgctataaagaagacagcaaaggcaaaccgaaaaaagaagaagatgcggcggtggatggccctgctggccgacgtcagtcagccgaaacgcgacttcactga

SEQ ID NO: 4267 - DNA, 1044 bp, Enterobacter cloacae
atgtttcttttatctcagctacacatacccctacaaaaaggcctaataattatgaagataaagaacctgaccctaacgctctgcactactctcctgcttgcaagttttgccggccacgccaaagaggtcaaaatcggcatggcgattgatgacttacgcctggaacgctggcaaaaagatcgcgatatctttgttaaaaaagcggaatctctcggcgcggaggtgttcgttcagtccgctaacggcaacgaagagacgcaaatgtcgcaaatcgagaatatgatcaaccgtggcgtcgatgtgctggtcattatcccgtataacggccaggtattaagcaacgtggtgaaagaagcgaaacaggaaggcataaaagtcctggcttatgaccgcatgattaataatgccgacattgattattatatttcgttcgacaatgaaaaggtgggcgaattacaggctaaaagcctggtcgcaaaagtgcctcaggggaattatttcctgatgggcggctcgcccgtggataacaacgccaaactgttccgccagggacaaatgaaagtgctgaagccgtatatcgacgagggcaaaattaaagtcgtcggcgaccagtgggctgacggctggttaccggaaaacgcgctgaaaattatggaaaacgcgttgactgcaaataacaacaaaatcgatgcggtggtggcctctaacgatgccactgcgggtggcgccattcaggcgctgagcgcgcagggtctggccgggaaagtcgctatttccggacaggacgccgaccttgcgggtgtaaaacgcatcatcgcgggtacccagaccatgacggtgtataagcccattaccgagcttgccaatacggccgccgaaattgccgttgagctgggcaatggccagcaacctaaagcagacgcgacgttaaataacggcctgaaagacgtacctgctcgcctgcttacccctatcgaagtcaacaaagagaatattgacgccaccgtggtgaaagacggtttccataagaagagtgaactgtaa

SEQ ID NO: 4268 - DNA, 1614 bp, Enterobacter cloacae
tccagcgcagcccctgcccggcaggggcgcatcgacctgccctgtacatctgtcgggccatgcggagcagttatgtcttatttacttgaaatgaaaagcatcaccaaagccttcggggcggtgaaagcagtcgataacgtaagcctgcggctgaatcccggcgaagtgatgtcgctgtgcggcgaaaatggctcgggaaaatccacgctgatgaaagtgttgtgcgggatctatccgcacggcagctacgagggcgaaatcgtctttgccggcgaggtgctccaagccacgcacattcgcgataccgaacgtaaaggcatcgctattattcaccaggagctggcgctggtgaagcaccttaccgtgctggaaaatatttttctcggcgccgaactctcacgccacggcgtactggattacgacaccatgacgctgcgctgcgaaaaactgctggcccaggtgagcctggctatctcaccggatacgcgcgtgggcgacttaggtttgggccagcagcagctggtggagatcgccaaggcgctgaacaagcaggtacgcctgctgatcctcgacgagccaaccgcctcgctcaccgaacaggaaaccgccgttctgctcaatatcatccgcgacctgcaaaaccacggtatcgcctgcatctatatttcgcacaagctcaatgaggtgaaagctatttccgacaccatctgcgtcatccgcgacgggcagcacattggcacgcgtgaagcagaaggcatgagcgaagatgacatcatcaccatgatggtgggtcgcgaactcaccgcactgtatcccaacgaaccacacaccataggcgaagaactcctgcgcgtggaaaacctgacggcgtggcatcccgttaaccgccacatcaagcgcgtggataacctctccttctcgctgcaccgcggcgaaattctcggtattgcgggtttagtgggtgccggaagaaccgaggccgtgcagtgtctgtttggcgtctggccggggcgctgggaaggcaaaatttatatcgacggtcagccggtaaaaatcgacaactgccagcaggccattgccaaaggcattgctatggtgcccgaagaccgcaaaaaagacggcatcgtgccggtcatggcggtgggaaaaaatatcacgctggcggcgctcagccagttttccggcgcgctgagcagcctggatgatgccgcagaacagcagtgtattcttcagtcacttgccaggctcaaggtgaaaacctcctcgccggaactggcgataggtcgcctgagcggcggcaaccagcagaaagcgattctggcgcgctgcctgttgcttaatccgcgcattttaattctggacgaacccacgcgcgggatcgatatcggcgcgaagtatgaaatctacaagctgatcaaccagcttgtgcagcaagggattgccgtcattgttatctcgtccgaattgcctgaagtgctggggcttagcgaccgcgtgctggtcatgcatgaagggaaactcaaagccaacctgaacaaccagaacctgacgcaagagcaggtgatggaagctgccttaaggagcgaacgccatgtcgaaaagcaacccgtctga

SEQ ID NO: 4269 - DNA, 1584 bp, Enterobacter cloacae
ccctctcccacggggagagggagaaaaccgaaccgtaggccgggtaagcgaagcacccggcaattaagcgagaagaagatgagtgaaaaagagcccttctggttgggtatcgattgtggcggtacttatctgaaagccggtttatacaacagccagggaaaagaagtctgtattgaacgccgctcagtggccacgctcagcccacgcgccggctacgccgagcgggatatgcaccagctctggcagcactgccacataacggtcgccctgctgctcaaaaattcaggcgctgacggcggtcagatcaaaggcgttggcatttcagcccagggcaaggggctgtttctgctcgataaacaggatcgccccttgggtaacgccatactctcctccgatcgccgtgcgctggagatcgtgcaacgctggcagcaggacggtatacccgaaaagctctatccacatactcgccagacgctgtggacggggcatccggcctcgctcctgcgctgggttaaagagaacgagccgcagcggtatcagcaaattggcagcgtgatgatggcgcacgattacctgcgctggtgtctgaccggggtcaaaggctgcgaagagagcaacatctcggaatccaatctctacaacatgaataccgggcagtacgatccgcagctcacgcgctggctcggcatcagcgacattgacggtgccctgccgtccattatcggttcagcagaaatttgcggggaaatcaccgctcaggcagccgcactaaccggtctcacggcgggtactcccgtcgttggtggactgtttgatgtggtttccaccgcgatctgcgccgggctgcatgacgaacatacgctgaatgccgtaatggggacctgggccgtgaccagtgggattgcccacggcatccgcgacaacgagccgttcccctacgtctatggccgctacgtccatccgcagcagttcatcgttcatgaagccagccccacgtcgtccggcaacctggaatggctgacggcccaatggggcgatatgtcattcgatgagattaaccacgccgtggccagcctgccaaaagctgaaagcgatgtgttcttcctgcctttcctctacggcagcaacgccgggctggagatgaccagcggcttctatggcttgcaggcgctgcatacccgcgcgcacctcctccaggcggtttatgaaggggtggtattcagccacatgacccacctcaaccgtatgctcgaacgctttccccacgtgcaggccctgcgcgtgacgggcggcccaacccattcggacgtgtggatgcagatgctcgccgacgtcagcggcctggcgattgaactcccgcaggtggaagagaccggctgttccggtgcggcgctggccgcgctcgtcggtacaggcctttatcccgatttttacgccgctcagcgcgccctcaggcatgacatccggatgattgaacctgacatgcgtgcccatgccgcctaccagcgcaaatatcaccgttaccagctactgatttcagcattacagggctatcacgcccgtgttaaggagtacgacctatga

SEQ ID NO: 4270 - DNA, 723 bp, Enterobacter cloacae
agcccgaatgcaggaaggaggcatgacatgttagaacaactcaaagccgaggtgctggcggcaaatctcgccctgcccgcccaccagctggtgacgttcacctggggcaacgtcagcgcggttgaccgtgccagcggcatgatggtgatcaaaccatccggcgtggagtacgacgtgatgaccgcagaagatatggtggtggtaaatatcgccacgggtaaagtggtcgaggggagtaaaaagccctcctccgacaccccgacccatctcgcgctgtatcgtcgttacccggaaattggcggcattgtgcatacccattcccgccacgccaccatctggtcgcaggcggggcaggatttacccgcgtggggaacgacgcacgcggactatttttacggtgcgatcccctgcacgcggctgatgaccacggctgaaatcgcgggtgaatatgaataccagacgggggtagtcattatcaaaaccttcgaggagcgcgacataagcccgatgcaggtcccggcggtgctggttcattctcacggcccgtttgcctggggcaaagacgctgccgatgcggtacacaatgccgtggtgctggaagagtgcgcctatatggggcttttctcgcgccagcttgcacctcagcttccggttatgcagcaggaattgctggagaagcattacctgcgcaagcatggcgcaaatgcctattacggccagtga

SEQ ID NO: 4271 - DNA, 1953 bp, Enterobacter cloacae
acctcgggccacaagcctaagcgtaaacataagaaggggtgttttatgtcatccgatttcaagatcaaagtgcaaagctttggtcgtttcctcagcaacatggtgatgccaaatatcggcgcgtttatcgcgtggggtattatcaccgcattatttattccgacagggtggttgcctaacgaaacgctggcgaaacttgttggcccaatgattacgtacctgttgccgctgctcatcggttataccggtggtcgtctggtgggcggtgaccgtggtggcgtcgtgggtgccatcacaaccatgggggtgatcgtcggtgcggatatgccgatgttcctcggtgcgatgattgccggtcctctgggcggctgggcgattaagaaatttgacgtctgggttgatggcaagatcaaatccggcttcgaaatgctggtgaacaacttctctgcgggcatcatcgggatgatcctcgcgattctggcgttcctcggcattggccctgcggttgaagtgctctccaagctgctggcggcgggcgttaacttcatggtggcgcatgacatgctgccgctggcgtcaatcttcgttgaaccggcgaaaatcctgttcctgaacaacgccatcaaccatggtatcttctcaccgctggggattcagcagtcacacgatctcggcaagtccatcttcttcctgattgaagcgaacccgggtccgggtatgggcgttctgctggcatacatgttctttggtcgcggcagcgcgaaacagtctgctggcggcgcggcgatcattcacttcctgggcggtattcacgaaatttacttcccgtatgtactgatgaacccacgtctgatcctggccgttatcctcggcggtatgaccggcgtgttcaccctgagcgtactgggcggcggtctggtctctccggcttctccaggctctatcctggcggtgctggcgatgaccccgaaaggcgcctacttcgcgaacatcgcggcgatctgtgcggccatggcggtctccttcgtggcctccgctatcctgctgaaaaccagcaaggtgaaagaagacgacgatatcgaagcggcaacccgtcgtatgcatgacatgaaagccgaatccaaaggcgcaacgccgctggcggcaggcgatgtctctaacgacctgagccacgttcgtaaaatcatcgttgcctgcgatgccggtatgggctccagcgcaatgggtgcgggcgtgctgcgtaagaaagtgcaggatgcgggtctgaccaacatctccgtcaccaacagcgcgattaacagcctgccgccggacgttgacctggtgatcacgcaccgcgatctgaccgaacgcgccatgcgtcaggtaccgcaggcgcagcacatttccctgaccaacttcctcgacagcggcctgtacacgagcctgaccgaacgtctggtggcggcgcagcgccatgaagataacgaagtgaaagtacgtaccagcctgcaagacagcttcgacgagagcaacgcgcatctgttcaaactgggcgcagaaaacatcttccttggccgcacggcgaccaataaagaagaggccattcgcttcgccggtgagcagctggtgaaaggtggctacgttcagccggaatacgttgaggcgatgctggagcgtgaaaagctgaccccaacctacctgggtgaatccatcgcggttccacacggtacggtggaagccaaagaccgcgtgctgaaaaccggcgtggtgttctgtcagtatcctgatggcgtgcgcttcggtgaagaagaggacgacatcgcccgtctggtgattggtatcgccgctcgcaacaacgagcatatccaggtgattaccagcctgaccaacgcgctggatgacgaaacggttattgagcgtctggccaacaccaccagcgttgaagaagttctggccctgcttaacaaataa

SEQ ID NO: 4272 - DNA, 1776 bp, Enterobacter cloacae
ccatttattgccattaaccctacatcacaatattggaaggaccacttttacactaagtgtgacgctgagatgagcagagactcacccgacgaacacccgtgtggtcctcaggagacctgcatgagcctctggcaacaaaactacgatccggccgggaatatctggctgtcgagcctgatcgcatcgctaccgatcctgttcttcttctttgcgctgataaagctcaagctgaagggctaccttgccgcaacgtacaccgttgccatcgccctgctggtggcgctgttcttctataaaatgccggtcgatcgcgcgctggcctccgtggtgtatggtttcttctacggcctgtggccgattgcgtggatcattatcgccgccgtctttgtctacaaaatctcggtgaaaaccgggcagttcgacattattcgctcgtcgattctctctattacaccggaccagcgtttacagatgctgattgtcggtttctccttcggggcgttccttgaaggggcggcaggatttggcgcgccggtggcgatcaccgccgctctgctggtcgggctgggctttaatccgctgtatgccgctggcctgtgcctgattgtgaacaccgccccggtggcgtttggcgcgatgggcattccgattctggtggcgggtcaggtgaccgggctggacagcttcgagatcggccagatggtgggccgccagctgccgttcctgaccattatcgtgctgttctggatcatggcgattatggacggctggcgcggcgtgaaggaaacctggcctgcggtgatggtagcgggcggttcgttcgccattgcccagtatctcagctccaacttcctcggccaggaactgccggacatcatctcttccctggtgtcgctagtctgcctgacgctgttcctgaaacgctggcagccggtacgtatcttccgctttgctgacatgggcgcatcgcacgtggatcagacgctggcgcgcaccggctataccgccggacagattgtgcgtgcgtggtcaccgttcctgttcctgaccgccaccgtgacgctgtggagcattccgccgtttaaagccctgttcgccccgggcggcgcgctgtacgacatggtgattaatatctccgtgccgttcctcgacaaaatggtcgcccgtatgccgccggtggtgcacgacgccacgccgtatgcggcagtgtttaagttcgactggttctcagccaccggcacggccatcctgtttgccgctatcctttccgttgtgtggctgcgcatgaagcctgccgccgcggtacagacctttgcggcgacgattaaagagctgatgctgccgatttactccatcggcatggtgctggcgttcgcgtttatttcgaattactccggcctgtcgtcgacgctggcgttagcgctggcgcataccggccacgcgtttaccttcttctcgccgttcctcggctggctgggggtgttcctgaccggttcagatacgtcatctaacgccctgtttgctgccctacaggccacggccgcgcagcagattggcgtctcggacgtgctgctggtcgctgcgaacaccaccggcggcgtgaccgggaagatgatctcaccgcagtccatcgccattgcctgtgctgcggtggggctggtaggcaaagagtcggatctgttccgctttaccgttaaacacagcctgatatttacctgcatggtgggcgtgatcaccacattgcaggcctatgtcttaacctggatgattccatga

SEQ ID NO: 4273 - DNA, 525 bp, Enterobacter cloacae
tggcggcgggcttcccgcagcgcatgcagaaagactatcgcgacgccattgacgccctgttcgacgccaaccgctttggtcagaaaaacggtctgggcttctggcgctataaagaagacagcaaaggcaaaccgaaaaaagaagaagatgcggcggtggatggccctgctggccgacgtcagtcagccgaaacgcgacttcactgacgacgagatcatcgcccggatgatgatcccgatgatcaacgaagtggtgcgctgcctcgaagaaggcattatcgccagcccggcagaagcggatatggcgctggtgtacggcctcggcttccctccgttccacggcggcgcgttccgctggctggatacgctcggcagcgctcgctatctcgatatggctcagcagtaccagcacctcggcccgctttatgaggtgccggaaggtctgcgtaacaaagcgcgtcataacgaaccctactacccagcagttgagccagcccgtccggttggcgcgctgaaaacggcttaa

SEQ ID NO: 4274 - DNA, 1173 bp, Enterobacter cloacae
ggagtcacaatggaaaaggttgtcattgttgatgcgattcgcaccccgatgggccgttcaaaaggcggtgcgttccgtaacgtgcgtgcggaagacctctccgcgcacctgatgcgtagcctgctggcgcgtaacccggcgctggaccctgctgcgctggacgatatctactggggctgcgtccagcagacgctggagcagggcttcaacattgcccgtaacgcgtccctgctggcggagatcccgcactcggttccggccgtcaccgtcaaccgtctttgcggttcgtcgatgcaggcgctgcacgacgcgacgcggatgatcatgaccggcgatgcgcaggcctgtctggtgggcggcgtggagcacatgggccacgtgccgatgagccacggggtcgatttccatccaggtatgagccgcaacgtggcgaaagccgccggtatgatgggcctgaccgccgagatgctctcccgtctgcacggcatcagccgtgagatgcaggatgcctttgccgctcgctcgcatgcccgcgcctgggccgccacgcagtctggtgcctttaagaatgagatcatcccgaccggcggtcacgacgcagacggcgtactgaagcagttcagctatgacgaagtcatccgcccggaaaccaccgttgaagcgctttctaccctgcgtccggtgtttgatccggtcaccggtacggtaacggcgggcacctcgtctgccctgtccgacggtgccgccgcgatgctggtgatgagcgaaagccgcgcccgcgaattaggcctgacgccacgcgcccgcgtgcgttcgatggcggtcgtgggctgcgatccatccatcatgggctacggtccggttccggcgtcaaaactggcgctgaaaaaagcggggctgagcgcaagtgatatcgacctctttgagatgaacgaagcgttcgccgcgcagatcctgccgtgcattaaggatctggggctgatggatcagatcgacgagaagattaacctcaacggcggcgcgatcgccctcggacacccgctgggctgttccggggcgcgtatcagtaccacgctgattaacctgatggaacgcaaagatgcccagtttggtctggcaacgatgtgtatcgggttgggtcaggggatcgcgacagtgtttgagagggtgtaa

SEQ ID NO: 4275 - DNA, 1140 bp, Enterobacter cloacae
caacacgtttatagattaaagtccgtcattctgcgaatctcgccagctccctacaagttagcctggctaaactcagaattttccaagggaaaagttttacgcaatcgcagtcacactttctttatcaggaatacagaggaactgatgcagtcaaaaattaactggattgataacctgcggggaatagcctgtctgatggtggtgatgatccacacaacgacctggtatgtcacgaacgcgcacagtatcagccctgttaactgggatgtcgccaatgttctgaactcggcctcccgcgtgagcgtcccgctgttctttatgatttccggttttctcttttttggcgagcgtagcgcacagccgagacatttcatccgtattgtctcctgtctgctgttttacagcgcgatttcgctgctctatatcgtcctgttcacttcaattaacgctgaacgttccctgctcaacttgttgcaaaaaccggtgttctatcatctatggtttttcttcgcgataatcgttatttatcttgtttcaccgttaattcaggtaaaaaacgtcaacggtaaaatgctgctggcgctgatggtggtcatcgggatcgtggccaacccgaataccgtctcacagaaaattgatggctttgaatggctgcccgttaacctctatatcaccggggatacgttttattacgtgctgtacggcatgctggggcgcgccattggcatgatggagacgcaaaagcgaggaataaactggctatgcgcggccgcgtttctcgtcggtgtgtttattatctctcgcgggacgctgcatgagctgcaatggcgcggcaactttgccgatacctggtatctgtactgcggcccgatggtctttatctgcgcaatctctctgctgacgctggttaaaaacaccctgaatgcccgcccgcttccggtgctggggtttatctctcgccactcgctgggcatttacggttttcacgcgctggtgatccacgccctgcgcacccgaggcgttgagcttaaaagctggccggtgctggatattgtctggatatttaccgttacgctggttgtcagcctgctgctgtcaatgttgctgcaaagaatcgatacgcgccggtttgtgagctaa

SEQ ID NO: 4276 - DNA, 1194 bp, Enterobacter cloacae
ggagcgaacgccatgtcgaaaagcaacccgtctgatatcaaagtcgctgttccgacgcccggtgcgttcgcaggacttaaatcgctgaatctgcaagtttttgtaatgattgccgccattatcgtgatcatgttgttctttacctggatgaccgatggctcctatttgagcgcacgtaacgtttctaacctgctgcgtcagaccgccatcaccgggatcctggcggtggggatggtctttgtgattatctcagcggaaattgacctgtcagtagggtcgatgatgggtctgctcggcggcgtggcggcaatttttgacgtctggctcggctggccgctgccgctgacgattgcggtcacgctggtactgggtctgctgctgggggcgtggaatggctggtgggtggcctaccgtaaggtcccgtcgtttatcgtcaccttagcggggatgctggccttccgcggcattctgattgggatcaccaacggcactaccgtctccccgaccagcgcctcgatgtcccagattggccaaagctacctctctgatggcgtcggttttacgatcggcgtggttgggctgatggcgtttgtcgcgtggcaatggcgaggacgcatgcgtcgccaggcgctggggctggcctcgcctgcttcaacctcggttgtcggccgtcaggcgcttactgcggtgattgtactgggcgccatctggctgttaaacgattatcgcggcgtcccaacgcccgttctgctgctggcgctgttgctgttaggtgggatgtttatggccacgcgtaccgcattcggtcgccgtatttatgccatcggtggcaatctcgaagccgcgcgtttgtccggcattaacgtagaacgcaccaaactcgccgtctttgccatcaacggcctgatggtggccatcgcggggctgatcctcagctcacgtttgggggcgggctccccctctgccggtaatattgccgagctggacgccatcgccgcctgcgtgattggcgggaccagcctcgccgggggcattggcagcgtggcgggggcggtgatgggcgcatttattatggcttcgctggataacgggatgagtatgatggacgtgccgacgttttggcagtatatcgtcaagggtgccattcttttgctggcagtctggatggactctgccaccaagcggcgcgcctga

SEQ ID NO: 4277 - DNA, 1182 bp, Enterobacter cloacae
gccatgtttgaaaagcgtcaccgcattacgttgttattcaatgccaacaaagcctatgaccggcaggtggttgaaggggttggcgaatatttgcaggcgtcgcaatccgaatgggatattttcatcgaagaagatttccgtacccgtctggagaacatcaaagactggctgggcgacggggtcatcgctgactttgacgaccccgtgattgaacagttgctgagtggcgttgacgtgcctatcgtgggcgttggcggctcttatcatacaccggaacattatcctcccgttcactacatcgccacggataaccatgctctggtcgagactgccttcctccatttaaaggagaaaggcgtccatcgttttgcgttttacggattgcccgccacgagcggaaagcgctgggcgatggagcgtgagtatgccttctgccagctggttgcccaggagaagtatcgcggcgtcgtttatcaggggctggaaaccgcgccagaaaactggcagcacgcacaaaatcgtctggctgactggctgcaaacgctgccgccccagacagggattatcgccgtgacggacgcccgcgcccgccacgtattacaggtgtgcgaacatttgcatattccggtgcctgaaaagctgtgcgtgattggtattgataacgaagagcttacgcgctatctgtcgcgcgtggcgctctcatccgtggctcagggtacccgtcagatgggctatcaggccgcaaagctgctgcacagactgttagacaacgaatccctgccgctccagcgtctgctggttcctcccgttcgcgtggtcgaacgtcgctcaactgactaccgctcattaaacgatccggccgtgattcaggcgatgcactacattcgcaatcatgcctgcaaagggattaaggtcgatcaggtgctcgattcggtcggcatatcacgttcgaatctggagaagcggtttaaagaggaagtgggtgagacgatccacgccgtgatccatgcggaaaagctggagaaagcgcgcagtctgctgatctccacctcgctgtcgatcaacgagatttcacagatgtgtggctatccgtcgcttcagtatttctattcggtgttcaggaaagagtatgacaccacgccgaaggagtaccgtgaacggtacagtgaagtcctgctctag

SEQ ID NO: 4278 - DNA, 1398 bp, Enterobacter cloacae
ggggcattcaccagaacaattcaccacacaaatacaaacccgccacataaaacaacaaatccgaccacatccgccgatttgcaccaacacggtgctggcgttatggttactgcctttcatattaagcccgacagatcacctgctatgacgttttcacttttcggcgacaaatttacccgccattcaggcattacccgcctgatggaggacctcaacgacgggctgcgcaccccaggcgctatcatgcttggcggcggaaacccggctcaaattccggagatgaacacctacttccagacgctgctggcagagatgctggaaaacggtaaagcaaccgatgcgctatgtaattacgacggccctcagggtaaaacagaactactgacgcttctggcggcaatgctgcgggaagcgctgggttgggatatcgaaccacagaatattgcactgacaaacggcagtcagagcgcgtttttctacttattcaatctgttcgccggacgccgcgccgacggcaccacgaaaaaagtgctgttcccgctggcaccggagtatattggctatgccgatgccggcctcgaagaagacctgtttgtttccgcacgtccgaatatcgagttgctgccagagggccagttcaaatatcacgtcgattttgaacatctgcatatcggtgaagagacgggcatgatctgcgtatctcgtcccaccaacccgacggggaacgtgatcaccgacgacgagctgatgaagctggatgcgctggcgaatcagcacggcatcccgctggtgatcgataacgcctatggcgtaccgttcccggggatcatcttcagcgaagcgcgtccgctatggaacccgaatatcatcctctgcatgagcctctccaagctgggcctgccgggcagccgttgcggcattatcattgctaacgagaaaatcatcaccgccattaccaacatgaacggcattatcagcctttcgcctggcggcatcggcccggcgatgatgtgcgagatgatcaggcgtaacgacctgctgcgcctgtcgaatgaggtgattaagccgttttactctcagcgcgttcaggaaactatagccatccttcgccgctacttaccggaagaacgctgcctgatccataaaccggaaggggcaattttcctgtggctgtggtttaaggatctgcccattacgacagagctgctttatcagcgtctgaaaaaacgtggcgtactgatggtgccaggggattacttcttcccggggctggataagccgtggccgcacacgcaccagtgcatgcgtatgaactacgtcccggacccggaaaaaatcgaagcgggtgtgaaaattctcgccgaagagattgagaacgcctggcgcgaggccggttaa

SEQ ID NO: 4279 - DNA, 1017 bp, Enterobacter cloacae
aaaaacaggagaacagggatgaaagtgaccttcgaagagttgaaagcggcgttcaatcgggttctgctcgatcgcggtgtaaaagcggataccgctgacgcctgcgccgagatgttcgcccgcaccacggagtccggcgtttattcacacggcgtcaaccgcttcccgcgatttattcagcagcttgacgcaggcgacatcatccctgacgcccagccgaaacgcgtaacgacattaggcgccatcgaacagtgggatgcgcagcgttccatcggcaacctgacggcgaagaagatgatggaccgtgctactgagctggcgtccgatcacgggatcggcctggtggcgctgcgtaacgcgaaccactggatgcgcggcggcagctacggctggcaggcggcggagaaaggctatatcggcatctgctggaccaactctattgccgtgatgcccgcgtggggatcaaaagaatgctgcatcggcacaaacccgctgatcgtcgctatcccgtcgaatccaatcaccatggtcgatatgtcgatgtcgatgttctcctacggcatgctggaggtgaatcgcctggccggacgcgaattaccggtcgacggcggctttgacgatgaaggcaatctgaccagagagccgggcgtgattgagaaaaaccgtcgcattctgcccatgggctactggaaaggttctggcttatcgattgtgctcgacatgatcgccaccctgctctctgacggcgcgtccgttgcggaagtgacccaggacaacagcgacgaatacggcgtatcgcagatctttatcgccgtcgaagtggatcgcctgatcgacggtccaacccgcgatgccaaactacagcgcatcatggacttcatcaccaccgcagaacgcgctgatgaaaatgtcgccgtccgtctgcctggacatgaatttactcgcctgctggaagaaaaccgccgggacggcatcaccatcgacgacagcgtgtgggcgaaaatccagtctctgtaa

SEQ ID NO: 4280 - DNA, 1359 bp, Enterobacter cloacae
agaatacattttccggttaccttcactgagatattaactatgaatatttcttctaatgctctacacgcggacattccgcgtcaacgctggctaaggatcattccccctattcttatcgcctgcattatttcctatatggaccgcgtaaatatagcttttgcgatgcccggcggtatggatgaagagctgggcatttccgccacgatggcgggcctggcgggggggatcttttttatcggctatttgttcctgcaagttcccggcggcaaaattgccgtgcacggcagcggtaagaagtttatcggctggtcgctggttgcctgggcggtgatctcggttctgaccgggcttgtgaccaaccagtatcagctgctggtgctgcgcttcttactcggtgtggcggaaggcgggatgctgtccgttgtgctcacgatgatcagtaactggttcccggatgccgagcgcggccgcgccaacgcgattgtgatcatgttcgtgcccatcgccgggatcatcaccgccccgctgtcgggctggattattaccgctctcgactggcgctggctgttcattattgaaggtctgatgtccgttgttgtgctggtgctgtgggcgttcaccgtctacgaccggccgcaggaagcgcgctggatctctgaggccgagaaaaactacctggtacaaacgctggcggcagagcagcaggccattgcgggtaaagaggtgaaaaacgcctcgctcagcgcggtgctgtctgacaaaaccatgtggcagctgatcgccctcaacttcttctaccagactggcatatacggttacaccctctggctgcccaccattctgaaagaactgacgcacaccagcatcggccaggtgggaatgctcgctattctgccttacatcggcgccattgccggtatgttcctgttctcttcactctctgaccgcaccggcaagcgcaagctgtttgtctccctgccattgattggctttgcgctctgcatgttcctctccgtggcgctgaaagagcacacctggctggcctatgccgcgctggtgggctgtggcttcttcctgcaatccgcagcgggcgtgttctggactatcccggcgcgtctgttcagcgctgagatggcgggtggcgctcgcggcgtgatcaatgccctgggcaacctcggcgggttctgcggtccttatgcggtaggcgtactgatcaccctgtacagcaaagacgcaggcgtttactgcctggcggtttcgctggcgctggcatcgctgctggccctgctgttaccggcgaaatgcgatgccggagcagagcctaatcccacggtgactccacataaacgtgcggcctga

SEQ ID NO: 4281 - DNA, 921 bp, Enterobacter cloacae
tccgccgcaggtggcacaggcattccattcgcaaatccgcgacatctggggagagtaaccatgcgtcagcatccgttaggcatttacgaaaaagcgctgccaaaagatctctcctggccggagcgcctggttctggcaaaaagctgcggcttcgattttgtggagatgtcggtggatgagaccgacgagcgtttatcgcgccttgaatggagtaccacgcagcgcgcctctcttgtggaagcgatgctggagaccggcgtggccatcccgtcgatgtgcttatctgcccatcgtcgcttcccgtttggcagccgcgatgaaatcgtgcgcgaacgcgcccgcgagatcatgaccaaagccatccggctggcccgtgatttgggtattcgcaccatccagcttgcgggttatgacgtgtactacgaggagcacgacgagggcacgcaacagcgctttgccgaagggctggcgtgggccgtagagcaggctgccgccgcgcaggtaatgctggcggtagagatcatggacactgcgtttatgaactccatcagcaagtggaaaaagtgggacgacatgctcgcctcgccgtggttcagcgtttacccggacgtcggcaacctgagcgcgtggggcaacgacgtcaccgccgagctgacgctgggcattgaccgcatcgccgctatccacctgaaagatacccggcccgttaccgagcaaagccccggacagttccgcgacgtgccgtttggcgagggctgcgtcgatttcgttggcgtgtttaacacgctgaatcaacttaattatcgcggcgcatttctgattgaaatgtggaccgagaaagccaaagagccggtgctggagatcatccaggcgcgccgctggattgaagcccgaatgcaggaaggaggcatgacatgttag

SEQ ID NO: 4282 - DNA, 1428 bp, Enterobacter cloacae
aaaaatcgtttatcgaggagttaccccatgacttccacaccgattacagacgcagaagttgcaaaacaggcagccgatgaacggctgtcagtccgcgagaaaattggctacggcctgggcgacgcgggcggcacggtaattacctgcctgatcatgaacttcctgacctttttctataccgatgtatttggcctgacgcccgcgctggtgggcacgctgtttattgcccttcgggtatttgacgcgatttccgatccggtgatgggcgtgattgccgaccgcacgcagagccgctgggggcgttttcgtccgtggcagctgtgggtcgcgcttcctatcgggatcgtcggcgtgctgaccttcaccgtcccggacgccagcatgggcgtgaaaatcgcctgggcgttcggcacctatctgttgctttcagtgggctataccgccatcaacgtgccgtattgcgcgctgatcaacaccatgaccacccgccacaacgaggttatatcctgccagtcctggcgcttcgtactgtgcggcgtggcgggctttctggtctccgttggcctgccgtggctggtgtcagagctgggacagggcaataccgcccggggttatcagttgggcgttggcgtgctgtgcgccatcgccgtggtgatgttcctgtgctgcttcttctgggtgcgcgagcgcgtcccgcttgcgctgatgggtaaattcaccctgcgcgagcacctggctggcctgcggaaaaacgatcagctgctgctgatgctggtgatgtcgtttctgctgatcaacgtcttcaacattcgcggcggcggatacatgtatttcatcacctacgtgcttcagggcagcacggcgtacacctcgctgtttttcaccatggtgacctttgctgccattctgggcgcggtgatcgtcagcccgctgtcgcggcggattgataccgtcaaactctactactacaccaacctggtacttgctgcgcttgcggtgggaatgtggttcctgccgggtggcccggcgcaccagacgctctggctgatcgtgattttaagtaacggcgtgatcctgggcttcaccctgccgctgcacttctcactgatggcctttgccgatgattacggcgaatggaaaaccggcgtgcgctcctcggggatgaacttcgccttcaatctgtttttcatcaagctcgcgtgggcatccagcgccgggatcatcagcctggtgtttattgccgtggcctatcagccaggcgcgggtaaccagacgcccgcctcattgcagggcatcaccgccatggagacgctgctccctgcccttttccacctgctgctggcggtcgctatccgctggtgcaggcttaacaatcccgtgatgtcgcgcattgccaccgatttgcgccagcgtcatgtacagtcctga

SEQ ID NO: 4283 - DNA, 630 bp, Enterobacter cloacae
cgtagttgcggaggcggtcagcgcatacaacgcaaccaaatgatgcagagtccggcgcaggtgagcctgcgcccgaataacagattgtcagatatgcaggcaataatggaacaaacccaggcctttgaaaatcgtgtgcttgagcgtctgaatgctggcaaaaccgtacgaagtttcctgattgccgccgtcgagctgttaaccgaggcggtaaacattctggtgcttcaggtgtttcgcaaagacgactacgcggtaaagtacgctgtagaaccgttactggacggagacggaccgctgggcgatttatcggtacggctgaagctgatttacggtctcggcgtgctgaaccgtcaggagtatgaagacgccgagctgttaatggcgctgcgcgaagagctcaatcatgacggcaatgagtacacctttaccgatgatgagatactggggcccttcggcgaactgcactgcgtatccgcgctccctcccgcacctcagtttgataacagcgacccagagctgtacgcgatgcaaaagctgcgttatcaacaggttgtccgctccaccatggtgctttccctgactgagctgatttctaaaatcagcttaaaaaaagcgtttcagaagtaa

SEQ ID NO: 4284 - DNA, 951 bp, Enterobacter cloacae
  unsure (878)
tatttccagggagaacaaagcatgattatttcagcagccagtgactatcgcgccgcggcgcagcgcattttgcccccgttcctgttccactatatcgacggcggggcgtatgccgaatataccctgcgccgcaacgtggaggatctgtcggaagtggccctgcgccagcgcgtgctgaaaaatatgtctgacctgagccttgagacgaagctgtttaacgagacgctctccatgccggtagcgctcgcacctgtcggtttatgtggcatgtatgcccgtcgcggtgaagtgcaggccgccgccgccgcagatgccaaaggcattccgtttaccctttccaccgtgtccgtctgcccgattgaagaagtcgccccgaccatcaagcgcccgatgtggttccagctgtacgtcctgcgcgatcgcggttttatgcgtaacgcccttgagcgcgccaaagcggcgggctgctcaacgctggtctttaccgtggacatgccgacccccggcgcgcgctaccgcgacgcccactccggcatgagcggccctaacgcggccctgcgccgttactggcaggcggtgacgcacccgcagtgggcgtgggatgtcgggttgaacggccgtccgcacgatctgggcaatatttcggcctacctgggtaaaccgaccgggctggaggactacattggctggctggcgaacaatttcgatccgtcgatctcctggaaagacctggagtggatccgcgaattctgggacggcccgatggtgatcaaagggatcctcgacccgggaagatgcccgcgacgcggtgccgttttggcgcccaatgggatcgtggtctctaaccaatgggggccgcccagcttggatgggggtgntctcctccgccccgcgcccttgcgggccattgccgatgccggtgaaaggggaattttgggaacctgggccgaa

SEQ ID NO: 4285 - DNA, 2154 bp, Enterobacter cloacae
ctgcctaattttgcgcgggatcactcatcccttcgcgtcctccttgcagaaagccgtagaggaggagtttttcccctgagccgaatggcacactggtcaaaaatgccgcgacaggaaaatggaatgaaacgcactgcattagctgttctgatgttacccgcattcgcgcatgccgactggtcatcgccgggatttaacgcgtttagcgctgaaggtaccggcgtctttaccagccaggcaacgcttgcgaagggtacccgcccgctgacgttgagtcttgacaacgcgtgctggcagccgacaggtgccattaagctcaacgagatgctgtcgctcaaaccgtgcgaaggcaccccaccgcagtggcggttattccgtgacggcgtttatcagatgcgtattgatacgcgctcgggaacgccgacgctgatgttgacggtgcaaagtgcggcgccacagcctgtcgcaaacgtcacccgccagtgcccgaagtgggacggcaaaccgctcacgatcgatgtcgttaacacctttccggaaggcacggtggtccgtgatttttacagtaaacagaccgcgaccgttcaaaatggcaaagtgactcttcagccagccgccaacagcaatggcctgctgctgcttgagcgcgccgagacggacaaacccgcgccgttcagctggcaaaacgccaccgtctatttcgtgctgaccgatcgcttcgtgaatggcgaccccaccaacgacaacagctatggccgtcataaagacggtatgcaggagattggtactttccatggcggcgatctgaaagggcttaccagcaaactggattaccttcagcagctgggcgtgaatgcgctctggataagctcgccgctggagcagatccacggctgggttggcggcggcaccaaaggggatttcccccactacgcctatcacggctattacactcaggactggacgaaactcgacgccaacatgggcaacgaagatgatttacgccagcttgtcgacgacgcgcacaggcgcggtatccgcgtcctgtttgacattgtcatgaaccacgcgggttatgcgacgcttgcagatatgcaggagtatcagtttggcgcgctctatttgcagggcgatgagctgaaaaaaaccctcggcgagcgctggactgactggaagccaggagcggggcaaagctggcacagcttcaacgattacatcaacttcagtgacaaagccgcatgggaaaaatggtggggtaaaaaatggatccgtaccgatatcggtgattacgacaacccgggctttgacgatctgaccatgtcgctggccttcctgcctgatctgaaaacggaatctaagatcccgtcaggtttgccgaacttttatcaacacaagcccgacaccaacgcgaaagtgatgacgaatttcaccccgcgagattacctgactcactggcttagccagtgggtacgtgactacggcatcgacggtttccgggtcgataccgctaagcacgttgagcctgaagcctggctgcaactgaaaaaccaggccagccaggcgctggccgcgtggaaagccgccaacccggacaaaaaactcgacgatgcgccattctggatgaccggtgaatcctggggccacggcgtgatgcagagcgattattaccgccacggcttcgatgcgatgatcaattttgactatcaggagcaggcggcaaaagcggtggactgcctggccgatatggatttgacctggcagcaaatggcagaaaagctgcaaagttttaatgtgctgagctatctctcctcccatgatacgcgtctgttccgtgaaggaggccagcgcgccgctgagttactgctgctggcaccgggaagcgtgcagatctattacggcgatgaatcagagcgtccattcggccctacgggctccgatccgctacaggggacccgttcggatatgaactggcaggacgtcacgggtaaacaggcgttaactgtcgcccactggcagcttctggggcagttccgcgcccgtcatccggcggtgggtgaaggcaagcaaacaacgctgtcgatgaaagaaggctacggctttgtgcgcgagcacaagggcgataaggtgatggtggtgtgggcgggtaatcaatag

SEQ ID NO: 4286 - DNA, 315 bp, Enterobacter cloacae
gctggcggggtctatgcagcgcagcgcgtgggtgggacaggcttcgacgcaggcgggaccgccctcgcgatgcgcgcacaaatcacatttcagcgcctgaacgcgatcttccacgacccgaacctgcattgccccgaacgggcacgccaccatacagcttttgcagccgatacagcgcgattgcttaacgagccaggctcccgcagcgcggtgaatggcccccgtcgggcagacattcgcgcagggcgcatcttcacactggtggcagcccactgccgtggtgaaggtttcccccttaaccacgcggatccgtga

SEQ ID NO: 4287 - DNA, 663 bp, Enterobacter cloacae
tcgacggtccaacccgcgatgccaaactacagcgcatcatggacttcatcaccaccgcagaacgcgctgatgaaaatgtcgccgtccgtctgcctggacatgaatttactcgcctgctggaagaaaaccgccgggacggcatcaccatcgacgacagcgtgtgggcgaaaatccagtctctgtaaggagtgggtcatgatattcggacatattgcacagccaaatccatgtcgcctgccactggcgatagaaaaggcgcttaattttctgcgtaccacggatttcaccaccctggcaccgggcgtgatcgaaattgaaggccgcaacatttttgcccaggttctcgacctcaccacaaaggagcagcacgagaaccgccctgaagtccatcgccgctatctggatatccagtttctggcctggggtgaagaaaaaatcggtattgctattgataccgggaataacaaaatcagcgaatcattgctggagcaacgggatattattttttatcacgacagtgaacacgagtcgtttatcgaaatgatacctggcagttacgccatatttttcccgcaggatgttcaccgtcctgcctgtattaaaaacaagggatccgcaattcgtaaaattgtggtgaaagtggccatcagcgaattagattaa

SEQ ID NO: 4288 - DNA, 666 bp, Enterobacter cloacae
ggagtacgacctatgagccgaccattattgcagctggcgctcgaccacacctcgcttcaggccgcgcagcgcgatgtcgcgacgctttccgatcacgtcgacatcgtcgaagccggcaccattctatgcctgaccgaagggctaaacgccgttcgcgccctgcgtgcgcagtgtccggataaaattatcgtggcggactggaaagtcgccgatgccggagaaacgctggctgagcaggcgtttggcgcaggcgcaaactggatgaccatcatctgtgccgccccgctggccaccgttgaacgtggccacgaggtcgcactgcgcggcggcggcgagatccagatggagctgtttggcaactggacgctggacgacgcgcgcgcgtggcatcgcatcggggtgaagcaggcgatttaccaccgcgggcgcgacgcacaggccagcggccagcagtggggtgaggcggatctcagcaaaatgaaggcgctgtccgatatcggtttgcagctttctataactggcggtatcacccccgctgacctgtcgctgtttaagcagatcaacgtcaaagccttcattgccgggcgcgcgctggcaggcgccgataatccgccgcaggtggcacaggcattccattcgcaaatccgcgacatctggggagagtaa

SEQ ID NO: 4289 - DNA, 2007 bp, Enterobacter cloacae
tgtcgcgcattgccaccgatttgcgccagcgtcatgtacagtcctgaggagaacgatatgaccataatggaagccgacctgcatcagctgaaaatcaacgacccgtttcttggtcagtaccaacggctggtccgcgatgtggtgatcccctaccagtgggatgcgcttaacgatcgcgtggcagaggccgaacccagccacgccatcgccaacttccgcatcgcggccggtctggaacagggggagttctacgggatggtctttcaggacagcgacgtggcgaaatggctcgaagccgtggcgtggtcgctgtgccagaagccggatgctgaactggaaaaaaccgccgacgaggtgatcgagctggtcgcagcggcgcagtgtgaagatggctatctcaatacctatttcacggtgaaagcaccggccgagcgctggaccaatctggccgaatgccacgaactgtactgcgccgggcatatgattgaagcgggtgtggcgtatttccagggaaccggaaagcgccgcctgctggacgtggtgtgcaggctggcggatcatatcgacagcgtgtttggcccgggcgaaaaccagctgcacggctatccgggccacccggaaatcgagctggcgctgatgcggctgtacgacgtcacgcaggagccacgctatctcaatctggtgaaatactttattgaggaacgcggcgcgcagcctcacttctacgatatcgaatacgagaagcacggcagaacgtcatactggaacacctatggcccggcgtggatggtcaaggacaaagcctacagccaggcgcatctgccccttgccgcacaacaaacggccatcggccacgccgtgcgttttgtctatctgatggcgggcatggcacatctggcgcgcctgagcaacgacgaggggaaacgtcaggattgcctgcggctgtggaacaacatggcacagcgccagctgtacatcaccggcgggattggctcccaaagcagcggcgaggcgttcagcagcgattacgatctgcccaacgatacggtctacgccgaaagctgcgcctccatcggcctgatgatgtttgcccgccggatgctggagatggaggcggacggccactacgccgacgtgatggagcgcgcgctgtacaacacggtgctgggcggcatggcgctggacggtaagcatttcttttatgtgaatccgctggaagtgcacccgaaaaccctgtcctttaaccatatctatgaccacgtcaaaccggtgcgccagcgctggttcggctgtgcctgttgcccgccgaatattgcgcgcgtgctgacctcgctggggcactacatttataccgttcgcccggacgcgctgttgatcaacctgtacgtggggaacgacgtcgccattccggttggggataacatcctccagctgcggattagcgggaactatccgtggcatgagcaggtgaaaatcgagattacctcaccagttccggtgactcacacgctggccctgaggctgccggactggtgtgcggaaccggctgtttcgctcaatggtcaggccattacaggcgaggtctcccgtggatacttatacctcaaccgcagctggcaggaaggcgacacgctgacgctgacgttaccgatgccggtccgccgcgtgtacggcaacccgcaggtgcgccagcaggcggggaaagtcgcattgcagcgtgggccgctaatttactgcctggaagaagccgataacggcgcaaatctgcataacctttctttgcgccaggacagcgcgtttcgggtatttgaaggcaaaggcattttcgcgcacaagatgctgatacaggcagaagggatcgggtgtcaggcgaaggacactgatgccctgtggcagtacgaccactcaccggtagaacgtcagccccggacgctgacctttattccgtggttcagctgggcaaaccggggagaaggggaaatgcggatatgggtggatgaaagctga

SEQ ID NO: 4290 - DNA, 492 bp, Enterobacter cloacae
atggattcctgcaccagcgcgcggctcggacaggtgcagacttcgccctggttaaacgcgaacagcgcaaacccttccagcgctttgtcgaagaaggcgtcctcttcgtccatcacgtcggcaaagaagatgttcggcgatttgccgcccagctcgagcgtgaccggaatgatgttctgggtcgcgtactgcatgatctgctggcccacttccgttgagccggtgaacgccactttggcgatacgttttgaggtagccagatattcgccgatctctcccccggccccgttgaccacgttaatgacccccggcggcaacaggtcgccaatcacctccatcagcagcagtaccgaaagcggcgttaagcgagcgggtttcagcacaacgcagttacccgccgccagcgcgggcgccattttccagctagccatcagcagcgggaagttccacggaataatttgccccaccacgccgagcggctcgtggaagtga

SEQ ID NO: 4291 - DNA, 1032 bp, Enterobacter cloacae
gtgtacaacaagggtagttccggctggtggttttctcgccagtcggtaacgggtttacgagccgtatcacggattaccgtactttacgtttcgtttctgccgccagagccatacttaatagctcaggggctcatgaggaacgatgcaatgcagctatttatcggctttgacgtgggcggaacccacatcaaacacggcgtgattaacgaaaacggcgaagaactgacatccgatgaatatgatacgcctgacgatgaaagcaccttcaaacagaagtggaaagcggtggtggataagtaccgccaggagcatgagatcgtcggcatcggcgtgagttttccgggccacatcaatcaccataccggcgaagcggccaaggccggggcgctggattaccttgacggtgaaaacctgtgcgagcttttcgcacagctgaccgatcttcccgtaacaaccgaaaatgacgccaactgcgcggcgctgggcgaacgctggcagggcgccggtaaggactatgagcattttgtctgcatcaccataggcaccggcatcggcggcggtatcgtcatggagggcgatctctaccgtggatcgcactaccgggcgggtgagtttggcgtgctgcccgttggcaacaacggcgagccgatgcacgaagtggcgtcagccagcggcctgatgaaagcctgccgccgcgcgctggccgtgtcggaagatgagatgcctgatggtgaggagctgtttagacgcatggacagcgacgtgcatctgcgtgaggccatagaagagtgggcgcatttcctctcgcgcggcatctacagcgtgatctccatgtttgatccgcaggcggtgctgattggcggcggcattagcgagcaggagaaaatctatctcctgctggataaatacctacagcgattcgaggagtgggaggcgctccgggtgcccatccttccctgcgagctgggtaaccaggcgggaaggctgggcgcggtctggctggctaagcagaagcaggcgcgcagcgcttaa

SEQ ID NO: 4292 - DNA, 1257 bp, Enterobacter cloacae
caaataacggtactcctccctctcccccccggggagagggctagggtgaggggaaaacgttcctcaccccagccctctcgggtaaaaacattgatgaaggttaacactatgaaagcattacattttggcgcaggtaatattggtcgtggctttatcggtaaactgctggcagacgcgggcattaccctgacattcgccgatgtgaatcaggtggttctggatgccctgaatgcccgtcatagctatcaggttcacgtggtgggtgaaaacgaacaggttgaaacggtttctggcgtcaacgcggtaagcagcattggcgacgatgttatcgatcttattgccagcgttgatctggtcaccacagccgtgggtccggtggtgcttgagcgtatcgccccggcggtcgcgaaaggcctggcgaagcgtaaagcacagggcgttgaaacgccgctgaacatcatcgcctgtgaaaacatggtgcgcggcaccacgcagctgaaaggccacgttcttacggccgtcgccgacgaagataaagcctgggttgaagcgcacgtaggttttgttgattccgccgtggatcgcatcgttccgccgtcagcatccgccaccaacgacccgctggaagtgaccgtggaaaccttcagcgagtggatcgttgataaaacacagtttaagggcgcgctgccgaccattccgggaatggaattaaccgataacctgatggcatttgtcgaacgtaaactcttcacgctgaacaccgggcatgctataaccgcgtacctcggaaaattggccggtcatcagaccattcgtgacgcgatcctcgatgagaacatccgtgcggtggtcaaaggggcaatggaagagagcggcgcggtgctgatcaaacgctacggttttgatgctgataaacacgcagcatacatccagaaaatcctcggtcgttttgaaaacccgtatctgaaagatgacgttgagcgcgtgggtcgtcagccgctgcgtaaactgagcgcgggcgatcgcctgattaaaccgctgctgggcacgctggaatacggcctgccgcacgctaacctggtgaagggaatcgctgccgcaatgcactaccgcagcgagcaggacccgcaggcgattgagctggctcagctgattgatgacaaaggcgcgcaggctgcgctggcgcagatctccggtctggatgccaacagtgacgtagttgcggaggcggtcagcgcatacaacgcaaccaaatga

SEQ ID NO: 4293 - DNA, 441 bp, Enterobacter cloacae
aaaaagcgtttcagaagtaagcccgcacacattggtgtatccttccctgtaaattccccgttttcagagttatttgtcatgaaagaagtcgaaaagaacgaaattaaacgcctgagcgaccgtctggatatgatccgccatcagatggccggcctctcccttgttgattccgccgagaaatatgccgagctggaaaaagagtccgtgaagctggaggcggaaattgaacgcctgcgcgaagtgaaaggccagaagctgagtaaagaagcgcagaagctgatgaacatgccgcatcgccgcgcgatcaccaaaaaagagcaggccgacatgggcaagctgaagaaaagcgtccgtggcctggtggtggtgcacccgatgactgagcttggtcgcgaaatgggcctgaaagagatgacgggtttttgtaagaccgcgttctga

SEQ ID NO: 4294 - DNA, 849 bp, Enterobacter cloacae
acacagcctgatatttacctgcatggtgggcgtgatcaccacattgcaggcctatgtcttaacctggatgattccatgatagtgatgcccagacgcctgtccgaagagattgccactcgcgtacgggcgctgatagaagaacaacagctggaagcgggcatgagattgcccgccgagcgtcagcttgccgctcagcttggcgtgtcgcgcaactcactgcgcgaggcgctggcgacgctggtcagcgaaggggtgctgctgagccgtcgcggtggcggcaccttcgtgcgctggcagcatgacgactggtccgaacaaaacatcgtgcagccgctgaagacgctgatggaaaacgacccggactacagcttcgacatcctcgaagcgcgtcacgccatcgaaaccagcaccgcgtggcacgcggcgatgcgggcaaccgacgccgacaaagagaagctcaaagcctgttttgaagccacgcaaagcagcgacccggacatcgcctcccaggcggacgtgcggttccatctggcgattgccgaggcctcgcacaacgtggtgctgctgcaaaccatgcgcgggttcttcgacctgctgcaatcctccgtgaagcagagccgccagcgcatgtatctggtgccgccggtgtttgcccagctgaccgaacagcacgaggcggtgctcaacgccattctggccggagatgccgaggccgcgcgcaaggcgatgatggcgcatctcggcttcgtgcataccaccattaaacgattcgatgaagatcaggcccgacaggcgcgtattacccgtctgcctggcgagagtgatatttccagggagaacaaagcatga

SEQ ID NO: 4295 - DNA, 825 bp, Enterobacter cloacae
atatccatgcttgaattatccatagcacttccgatcagggttcaaaatggcgggttatttatctcccggggcgtgggccgtcatcccgcacgaaaattatcttcatgggaaataatttttgtcgaaaaagggacattaacgatccaggaggaaaatacgctgtttgaggtaaacgctggcgagagtttattactttggccgaagcggcggcatgtcggcgtggaagattttccgggcgatctcaaattttactggctgcattttgaggtggatgaacgcttgccggtgttgccaggcgcgacgccgctgtcgattgagcaacactgtagcgtgcgggatccgcaatatgttattgcgttattccgtcagtttttaagcgagcaggaaaaattacagcgtagccaggcgctggagataatcttgctgttaattttgcagcagatatcgctctcgccgggatatgaagataaagcggatgatgcgggcgcagcaatggcgtggaaggccaagcagcttatccgcacgcactttcatttgcccctgtccacttcgcagctggcaaaagagctgcactgcaacgcagattacctggggcgggtatttcgtcggacgtttcatttaaccctgacggaggcaattcaccgccagcgcgtcagggccgctgaaaaactgctgctgaacgatgcggcctcattaactgaagtggccgcccggtgcggttttaatgacgtgggttatttccggcaaatattctcaaaacataccgggttaacgcccgccgtctggaaacggcggtactgtaaagagcatattaattccggatga

SEQ ID NO: 4296 - DNA, 267 bp, Enterobacter cloacae
aacggcttaatcacctcattcgacaggcgcagcaggtcgttacgcctgatcatctcgcacatcatcgccgggccgatgccgccaggcgaaaggctgataatgccgttcatgttggtaatggcggtgatgattttctcgttagcaatgataatgccgcaacggctgcccggcaggcccagcttggagaggctcatgcagaggatgatattcgggttccatagcggacgcgcttcgctgaagatgatccccgggaacggtacgccatag

SEQ ID NO: 4297 - DNA, 891 bp, Enterobacter cloacae
gattccgctctcaaatttttgaagaaaataaggtgttggaatgtttatatccgaccaggagacctaatgatatcgactcccattcgacgatatggggccgcgatactcatgttactcaccatggcattttcaggtgaggtgcttgcaaagacgcacacggatacaacgagtaagaaagcccacgtaataaagacgacaagcagtaaggttagcagtaaacaagagtattctcgcaatagtgcaaagagtagttcacttcctgatttgcgaaaatacccttccgggacaccaaggaaaaaagcgtttctccggacggtaatgccttacattaaaagccaaaatgccgcgattactgcggatcgtaactggctgatctccaaacagtacgacagccgctggtcgccgtctgagcgcactcgcctgaaagatatcgccaaacgctataaagtgaagtggagcgggaacacgcgtcgcgtgccttggaactcactgttagaacgtgtggacatcattccaggcagtatggtcgcgacaatggccgccgccgaaagcggttggggcacctcgaagctggcgcgcaacaacaacaatctgtttggcatgaaatgcgtaaaaggtcgttgtactaacgcgcccggcaaggtgaagggctattcacagtttgaatcggtgaaagattccgtgaatgcctacgtggtgaacctgaacactcacccggcctattcctcgttccgtaagtcacgcgctcagctgcgtaaggcggatcaggaagtgacggccacggcgatgatccataagctgaaaggttattccactcagggacagcgttataacaattacctgttctccatgtaccaggataaccagcgtctgattgccgcacatatgtaa

SEQ ID NO: 4298 - DNA, 645 bp, Enterobacter cloacae
gaacatgacgcgagatttgaagctggcctgatggaaagctggctgataccggccgagccggtcacctttgttgaggaaatcaaaaaaagccgctttatcacgctgttggcgcataccgacggcgtggaggcggcgaaggcgttcgtcgagtccgtccgcgcgcagcacccggatgcccgccatcactgtgtggcgtgggtcgcagggccgccagacgactcacagcagctcggattttctgacgacggtgaaccggcgggtacggccggaaaaccgatgctctcccagttgatgggcagcggcgtgggtgaaatcaccgccgtcgtggtccgctactacgggggcattttgttaggcaccggagggctggttaaagcctacggaggtggtgtccagcaggcgcttaatcttctgataacaacccgcaaaacgccacttacggaatatactttgttatgcgattacgcccagctatcgggtatcgaagcactgcttaaacagtttaacggtgtcatcgcacagagtgattatcaggcaatggtgcaattacgcgtggcgcttcctcaggcggaactggctgctttttcagcaaaactcgctgattttagtcgcggttcattgcaattactgccgattgaagaataa

SEQ ID NO: 4299 - DNA, 663 bp, Enterobacter cloacae
tcgccaatatgctgtttgggcgtcttgaggtctttacgctgctggtgctgtttaccccaacattctggcgtgagtaaggagacattggtgaaaacgttaattcttttctcaacgcgtgacggacaaacgcgtgagattgcttcatatctggcttctgaactcaaagagctgggcatttattctgatgtggtgaacctgaatcgcacagagcagattgcctggcaggattacgaccgcgtggtcattggcgcttcaattcgttacggccatttccatccggcgctggatcgctttgtgaaaaagcatacggcggaactcgctcagctgcctggcgcgttttactcggtcaacctggttgcccgtaaagcagagaagcgtacgccgcagactaacagctatacgcgtaagtttttgctgagttcgccatggcagcccgatatctgttctgtctttgctggcgcgctgcgttacccgcgttaccgctggtacgaccgctttatgatccgcctgatcatgaaaatgacgggcggggaaacggatacgcgtaaagaagtggtttataccgactgggctcaggtcgccagttttgcccgtgaaattgcgcatttaacggacgatgcgcgggtcgtcttcacacgagtgccagtgccgcgctatgttaag

SEQ ID NO: 4300 - DNA, 606 bp, Enterobacter cloacae
tttacagaggggaaagtgttccaaatgaaaatcaaaaatgtggcgctggcgattgccgcggcggggctgctgttatcttctcaatcggtactggcaagcagtgattctggcgttaatgcttctctggataccggtgcgggttcgcaaagtacgggcggggtgatcaattttaccgggaagattacccttatttcctgtgatattactccggcctctaaaaacaaaacggtagaccttggggcgtgggcaaaaagctactttgacgatcacaacgaaacgacgccgcgcgagttcaaaatcaacgtggaaaactgcccggagacggttgaatcggttgcggtactgtttgacggaaccaaagatacggtgaatgacacactgcttcaggttacgccatgtgaaggtatggcgacgggtgtccgcgtgaagctttataacagcgatcgcagcaccgcgattaaaccgggtacggtatctgaaacaaccgcaccggatgatgaaggcaatgctgaattaactttttatgccgcacttgacaaagatggcacagaaatctacgccggcgatgttaacgccgtttctaacttcctgatggtttataactga

SEQ ID NO: 4301 - DNA, 705 bp, Enterobacter cloacae
tttcactgtcagccacctccagagataataatgatgaaacgtttatcgtatattatgctcactgcattaatggttagttctgcgtcagtttccgctggcgttgtaatggggggaacacggatcgtatacccacaacacagcaaggaggtggcattttctgtttctaatatggaaagtgcggttccctatcttattcagtcgtgggttgaaggggatgggcagggtaaaaataacgctgcgccatttattgtcacgccacctctgttcagacttgatccggagcagaccaatacgctgcgtattcaatataccggcgctccgctgcccacagatcgtgaatctgtattctggctcgatattaaagcgattgcgccaaagccaaaagagagcagcaacgaattacaagttaacgttaaatcgaaatttaaaattttctaccgcccggacaatctaaaaggggacgctgcaactgcctggcagaaaataacgttttcgcggacgggaaaagggcttaaggccgctaacccgacgccatactacgtctctttttatcggctgaccgttggcgggcataaaattgagcagccgggcatgatcggtccaggggaaacccgtgaatggcctgtgtccgcctccgggggcgtaagctggtcggctattaatgattttggtgccatcaccgccacccacacccagcctctttaa

SEQ ID NO: 4302 - DNA, 612 bp, Enterobacter cloacae
gcaatgaaactcatcggcagttatacaagtcctttcgtgcgtaagatttcgattctcctgctggagaaagggattgaatttgaattcgtaaatgaacaaccctacaacgcagagaacggcgttgcgcagtacaacccgctggggaaagtcccggcgctggtaacggacgagggcgactactggtttgattccccgatcattgcggagtacatcgagctgcttggcgttgcgccagccatgctgccggcggatccaaaagcagcgctggcgatgaagcaaattgaagccctggcggatggcattatggatgcggcattaacgtccgtacgcgagcaggcaaggcccgccgcccagcagtcagaaaatgagctgctgcgccagcgcgaaaaaatcagccgcagcctggatatgtgcgaacagctgatccgcgacgggaaaattcagagcgatagcctgaatctggcgacgatcgccatcgcctgcgccatcggctacctcaatttccgccgcgtctcgccgggctggtgcgtggatcgtccgctgctggtcaaactggcggagacgctcttccagcgcgaaagtttcgcccggactgaaccaccaaaggcttga

SEQ ID NO: 4303 - DNA, 1866 bp, Enterobacter cloacae
agtgcggtttctggagatgatgttgaaatgattattgccaccgccggtcacgttgaccacggcaaaaccacgttattgcaggccattacgggcgtgaatgccgatcgcctgccggaagagaaaaagcgcggcatgaccattgacctgggttacgcctactggccgcagcccgacggtcgcgtgctgggctttatcgacgtgcccggccacgagaagtttctttccaatatgctcgcgggcgtgggcgggatcgatcacgctctgctggtggtcgcgtgcgatgacggggtgatggcgcaaacgcgcgagcatctggcgatcctccagctgacgggaaacccgcagttgaccgtcgccctcaccaaagcggaccgtgtggatgaggcgcgtatcgacgaggtgcgtcaagaggtgctggcggcgctgagtgaatacggttttaaggatgtcgcactgtttgtcaccgtagcgacagaaggccgcggtatcgatgctcttcgcaaccatttgcagcagatcccgtctcgtgaacaggccagccatcaccgcttccgtctggcgatcgacagggcgtttaccgtgaaaggggctgggctggtggtgaccggtaccgcgctgagcggggaagtgaacgtgggcgataccctgtggctcacgggcgtgaacaaaccgatgcgcgtgcgcgggcttcatgcgcaaaaccagccggtggaacaggcccacgccgggcagcgtatcgcgctgaatgttgccggtgatgccgaaaaggaccagcttaaccgcggcgactggctgctggccgacgcgccgccggagccttctgaacgggtcatcgtttctctccagacccatacgccgctgacccagtggcagccgctgcatatccaccacgcggccagccacatcaccggacgcgtgtcgctgctggaaaacgatctcgccgaactggtgttcgactccccgctctggctggcggataacgaccgcctggttctgcgcgatatttcggcgcgggaaacgctggcgggcgcgcgcgtggtcatgctggatccgccccgtcgcggcaagcgtaagcccgagtatttacagtggctggccgcgctggcccagacccgcgatgataagtctgcgttagatatccaccttgagcgtggcgcggtggatctggcggcgttcgcctgggcgcgccagctcagcggcgaaggattgcgtcttctgacgcaggagccaggttttattcaggccggaaacagcctgctgaacgcgccggtggcggcgcgctggcagcgcaaagtgctgagcacgctggcgacctaccatgaacagcatcaggatgagcccggtccgggtcgtgaacgtctgcggcgcatggcgttgcccatggaagacgacgcgctggtgctgttgctgattgaaaacatgcgtgaaagcggcgtgattgcaagtcatcacggctggctacacctgccggaacacaaggccggttttaccgctgagcaggacgcggtctggcaaaaagtggcggcgctgtttggcgatgaaccgtggtgggtgcgcgatctggcgcgtgaaaccaataccgatgagcagctgatgcgtcaggtactgcgccatgcggcacagcaggggatgattgtggcgatcgtgaaagatcgttattaccgcaacgatcggatcgtggcgtttgcgaacctgatccgggagctggatcaggcgcgcggatcaacctgcgccgcagacttccgcgatcggctgaatgtgggacgcaaactggcgattcagatcctggagtatttcaaccgcatcgggtttacgcgtcgtcgtggcaatgaccatgtgctacgcgacgcgcagttatttccgtaa

SEQ ID NO: 4304 - DNA, 879 bp, Enterobacter cloacae
gatcgtgaactaaaacacactttgcgctaccatcagggcgcaataaacaggagctatttgatgagcataaaagagagcgaaatgacgcaagaaaaagagaggccagcaggtagccagagcttgtttcgcggcctgatgctgattgaaatcctcagtaactatccgaacgggtgtccgcttgcgcatttatcagaactggcggggctgaataaaagtaccgtgcaccggttattgcaggggttgcagtcatgcgggtacgtgacgccagcgccggcggcagggagctatcgtttgaccaccaaatttatcgccgtcgggcaaaaggcgctttcatctctcaatattattcacgtggcggcgccgcacctcgaggcgctgaacattgccaccggcgaaacggtcaacttctccagccgtgaagatgatcacgcgatcctgatttataagcttgagccgacaaccggtatgctgcgcacgcgcgcatatatcggccagcatatgccgctctattgttctgcaatgggcaaaatctatatggcgtttggtcatcaggattacgtggcgagctactgggaaagccaccaggaacagatccaacctttgacccgcaacaccatcaccgaactgagcgcgatgtatgatgagctggcggaaattcgcgatcacagtatggcgatggataaagaagagaacgagctgggtgtgtcatgtatcgccgtgccggtctttgatattcacgggcgcgtaccctatgccatctccatttcgctgtcgacgtcgcgcatgaagcaggtgggtgagaaaaacttgctaaaaccgctgcgtgacacggcggaagctatctcgaaagaactggggtttaacgtgcgcgaggcgtaa

SEQ ID NO: 4305 - DNA, 459 bp, Enterobacter cloacae
ctgatgaaccaatttatcctggcggatcctgaaaaatgtatcgggtgtcgtacctgtgaggtagcgtgcatgatgtcgcatcaaagcagcgccacgccagtagcgtttacgtcacggatccgcgtggttaagggggaaaccttcaccacggcagtgggctgccaccagtgtgaagatgcgccctgcgcgaatgtctgcccgacgggggccattcaccgcgctgcgggagcctggctcgttaagcaatcgcgctgtatcggctgcaaaagctgtatggtggcgtgcccgttcggggcaatgcaggttcgggtcgtggaagatcgcgttcaggcgctgaaatgtgatttgtgcgcgcatcgcgagggcggtcccgcctgcgtcgaagcctgtcccacccacgcgctgcgctgcatagaccccgccagcttacgcgcggaacggctgcgtaatatggcctga

SEQ ID NO: 4306 - DNA, 1518 bp, Enterobacter cloacae
ataacagcattcatgcccggtaagcgctgcgccaccgggcatttctgtcaaaggagtcaccacatgtatatcgggatcgatcttggcacgtcgggggtgaaagccatcctgttaagcgagcagggcgatgtgttagccacgcagactgaaaagttgcaggtttcacgcccgcatccgctttggtcggaacaagatccggagcagtggtggcaggcgacggaccgcgcgatgacagccttaggcgagcagcacagcctgcgcgacgttaaagcgctgggcatcgccggacaaatgcatggcgcaacgttgctggatagccagcatcgcgttctgcgcccggctattctctggaacgatggccgctgtgcggaagagtgcgcgatccttgaggaacgtgtgcctgcgtcccgcgagattacgggcaacctgatgatgcccggttttaccgcgccaaaactcctgtgggtgcagcgccatgagcctgatatttttcgccaggtggcgaaggttctgttgccgaaagactacctgcgttttcgcatgacgggggattttgccagcgacatgtctgacgccgcgggcacgatgtggctcgacgtggcgaaacgggactggagcgaggcgatgctggatgcctgccagctgacgcgcgatcatatgcctgcgctgtttgaaggcagcgaaatcacgggcgctttgcagccttctgttgctgaacgttggaatatgccagccgtacctgtcatcgccggcggcggcgataatgcggcgggggcggtcggcgtggggatggtcgaggcaggacaggccatgctctcgctcggcacttccggcgtctattttgccgtcagtgacgggtatcgtagcaatcctggaagcgccgtacacagcttctgccacgcgttgccgggtaaatggcatttaatgtcggtgatgctgagcgcggcttcctgcctcgactgggcggcaaaactaaccggaatggcggacgtcccggcgcttatcgcagcggcacagcaggcggatgataatgccggtgcggtctggtttttaccgtacctttccggcgagcggacgcctcataacaacccggaagcgaaaggggtgttcttcggtcttacccatcagcacggcccggcagagctggcgcgcgcggtgcttgaaggcgttggctatgctctggcggacggaatggatgtcgtgcatgactgtggactgacgccatccagcattacgttaattggcggcggtgcgcgaagcagctactggcggcaaatgctttccgatatcagcgggttgcagctggactatcgtacgggaggcgatgtcggcccggcgctcggtgcggcacggctggcgcaaattgcgctgaacccggataaaccactgcaccagcttttgccccagctgtcgcttgaacagcagcatcgtcctgatgcgaaaaatcatgctcgctatgctgaaagacgagacgtgttccgcaaaatttatcggcagcttttgccgctaatgtcataa

SEQ ID NO: 4307 - DNA, 939 bp, Enterobacter cloacae
aaccacacgtatccagcacgaaatactatgcaaaagtttgataccaagaccttccagggcctgatcctgaccttacaggattactgggctagtcagggctgcaccattgttcaacctttggacatggaagttggcgcaggcacctcacacccgatgaccagcctgcgcgcgttagggccagagccaatggcgaccgcctatgtgcagccatcccgtcgtccgaccgatggccgttatggcgaaaacccgaaccgtttgcagcactactatcagttccaggtggtgattaagccatcacccgacaacattcaggaactgtacctcgggtcactgaaagagctgggtatggatccaaccattcacgacattcgtttcgtggaagataactgggaaaacccaacgctgggtgcctggggtctgggttgggaagtgtggctgaacggcatggaagtgacccagttcacatacttccagcaggttggtggtctggaatgtaaaccgattaccggcgaaatcacctatggtctggaacgtctggccatgtacattcagggcgtagacagcgtttacgacctggtctggagcgacggcccgctgggtaaaaccacctacggcgacgtgttccatcagaacgaagtggagcaatccacctataacttcgaatacgcggacgtggacttcctgttcacctgcttcgagcagtacgagaaagaagcccagcagctgctggcgctggagactccgctgccgctgcctgcctacgagcgtattctgaaggctgcccacagcttcaacctgctggatgcccgcaaagcgatctccgtgactgaacgtcagcgctacattctgcgtattcgtaccctgaccaaagccgttgcagaagcttactacgcgtcccgtgaagcccttggcttcccgatgtgcaaccgaaacaaataa

SEQ ID NO: 4308 - DNA, 2079 bp, Enterobacter cloacae
gaggcggccatgtctgagaaaactttcctggtggaaatcggcactgaagagctgccaccaaaagccctgcgcagcctggctgaatcttttgctgcgaacgtcactgctgagctggataacgctggcctggcgcacggtaaaattgagtggtttgctgcgccgcgtcgtctggcgctgaaagtggcaaacctggcggcgtcccagccggatcgcgaagttgaaaaacgtggcccggccattgctcaggcgttcgacgcggaaggcaagccgagcaaagcggcagaaggctgggcgcgcggctgcggcatcaccgttgatcaggccgagcgtctgaccaccgacaaaggtgaatggctgctgtatcgtgcccatgtgaaaggcgaaagcgccgaagcgctgctgcctgacatgatcgcgacctcgctggcaaaattgccaatccctaagctgatgcgctggggcgcgtccgacgttcactttgtgcgtccggttcacaccgtgaccctgctgctgggcgataccgttatcccggcgaccattctgggcgtggcgtccgatcgcgtgatccgcggccatcgctttatgggcgagccggagttcaccatcgacaatgccgaccagtatccacagatcctgctggaacgcggtaaagtgattgccgactacgaacagcgtaaagccaaaattaaagcggacgcagaagaagcggcgcgcaagattggcggaaacgctgacctgagcgacagcctgctggaagaggtgacctcgctggtcgaatggccggttgtactgaccgcgaaattcgaagagaaattcctggccgttccggcagaagcgctggtttacaccatgaagggtgaccagaagtacttcccggtttacgccaacgacggcaagctgctgccaaacttcatcttcgtggcgaacatcgaatcgaaagatccgagccagattatctccggtaacgagaaagtggtgcgtccgcgtctggcggatgccgagttcttcttcaacacagaccgtaaaaaacgtctggaagataacctgccgcgtctgcaaactgtactgttccagcagcagctgggtacgctgcgcgacaaaaccgaccgtatcgcggagctgtccggctggattgcccgtgaaattggcgccgacgttaaccacgctacccgtgcgggcctgctctccaagtgcgacctgatgaccaacatggtgttcgaatttaccgacacccagggcgtgatgggtatgcactacgcgcgtcacgatggcgaagcggaagacgtggcggtagccctgaacgagcagtatcagccgcgctttgccggtgacgatctgccgtccaatccggttgcctgcgccgtggcgattgccgataagatggacaccctggcgggtatcttcggtatcggccagcatccaaaaggcgacaaagacccgtttgcgctgcgtcgtgctgcgctgggcgtgctgcgaatcatcgttgagaagaacctgaacctcgatctgcaaacgctaaccgaagaagcggtgcgtctgtacggcgataagctgaccaacgcgaaggttgtggatgatgttatcgactttatgctcggtcgtttccgcgcgtggtatcaggacgaaggttactccgttgataccattcaggcggtgctggcgcgtcgtccgacccgtccggcagatttcgatgcgcgtatgaaagcggtatcccacttccgtacgctggaagcggcgtctgcgctggccgcggctaacaagcgcgtatccaacatcctcgcgaaatccgacgagacgctgaacgatcgcgtaaacgctgcaaccctgaaagagccggaagagatttctctggcgatgcaggttgtggtgctacgcgacaagctggagccgtatttcgcggaaggtcgctaccaggaagcgctggtggagctggcggagctgcgtgacgtcatcgacgccttcttcgagaaggtgatggtgaacgtggaagataaagagctgcggattaaccgtctctcgatgcttgagaaactgcgtgagctgttcctgcgcgtggcggatatttcgctgctgcaataa

SEQ ID NO: 4309 - DNA, 1362 bp, Enterobacter cloacae
cttgaggtcaaaaaaacgaaaggaagaatgatggactcactggcttcgctttataaaaatcatatcgttaccctacaggaacgtacccgcgatgtactggcccgcttcaagctggatgccctgctgatccactccggcgagctgatgaatacttttcttgatgaccatgcttatcccttcaaggttaacccgcagtttaaagcctgggtgcctgtcacgcaggttccaaattgctggctgctggtggatggcgtgaacaagccgaaactgtggttctacctgccggtcgattactggcacaacgtggagccgctgccgacctcattctggaccgaagaaattgacgtgattgcgctgccaaaagcagacggcataggcagccagctgccagcggcgcgcggcaacatcggctacattggtccggttcctgagcgcgcgctgggtctggatattccggcagataaactcaacccgaaaggcgtgctggattatctgcactactatcgcgcctacaagaccgactacgaactttactgcatgcgtgaagcgcaaaaaacggcggtgaatggccaccgtgcggcgcacgaagcgttccagtccggtatgagcgagttcgatatcaatcaggcttacctgacggcgaccggccaccgcgataccgacgtgccgtacagcaacatcgtggcgctgaatgaacatgcctcggttctgcactacaccaaactggatcatcaggttccggctgagatgcgtagcttcctgctggacgcgggggctgagtacaatggttatgcggcagacctgacccgtacctgggcggcgaatgcggataccgattttgcgcaattgattaaagacgtgaacgacgaacagctggcgctgattggcaccatgaaggccggaaccagctacgtggattatcacatccagttccatcagcgcatcgctaaactgctgcgtaagcatcagattatcaaagacatgagcgaagaggcgatggttgagaacgatttgaccgggccatttatgccgcatggtatcggccacccgctgggtttgcaggttcatgacgtcgcgggctttatgcaggatgataccggcacgcacctggcggcaccgtctaaatatccttatctgcgctgcacccgcgttctggcgccgcgtatggtattgaccatcgagccgggcatctactttattgaatccctgctggcgccgtggcgcgaagggcaattcagcaagcacttcaactgggagaaaattgaagcgctgaagccttatggcggcattcgtatcgaggataacgtggttattcacgagaacagcattgagaacatgacgcgagatttgaagctggcctga

SEQ ID NO: 4310 - DNA, 2544 bp, Enterobacter cloacae
gctggtcggctattaatgattttggtgccatcaccgccacccacacccagcctctttaagatcatgccttttcgcctgtttcgttacgcgccgctttcagtgttgctgcttagcttcagccgtgcggggatggccgaggattactttgatcccgccgcgctggagctttcctctactgaacagaaaacggcggatctgcactatttctctgaaaagggcgggcagatgccaggcacctggctcgtgacgctggagattaacggacgcgaggagcggcatcaggagatcaccttcgtcaatgagaaaggcagcctgcaacccgtttttagcgtatcgctgctggaagcgcttagcgtaaatgtaggggccattcctgcattctcccggttgcaggagggagaaacgttcacgcacctcgaggattttattccggcagcgcgaacctcctatgatttcaaccaacagcgcctttttctcaacctgccgcaggcggcgatgaaacaccgcagccgtggctatgtgccgcagtcgcagtgggacgatggtatcccggcggcatttactgattacagtctgtcgggcggtcaggcccgtcatcagagcggggtcacgacatccagctatctgagcctgcgtaacggcatcaatctgggggcgtggcggttgcgcaacacttcggcctggagccacagcgacgcgggcggcaaccattttcagtcgcaaagtagctggctgagccgggatattcgccgtcttaacagccagctacggatcggcgatgcctggaccgcaggcgacgtcttcgatagcgtggcgtttcgcggggttcagctctcgtccagcgagagcatgttacccgacagccagcgcggcttcgcaccaaccatccgcggcgttgcacacagcttcgctaaagtctccgtttcgcaaaatggctatgtgatctatgaaacctgggtggccgccgggccatttatcattaacgatctgttccccggcgcgcaaagcggcgatctacaggttacggtcacggaaagtgacggctcaacgcgcgtctttacccaaccctattctgcggtgccgtttatgcgacgccagggcagcctgaaatacagtctcaacgccggacgatttcactccggctccggcgatgcgcgttcgcctgagtttgttgaaggcgcttttttctacggtctgctctccaggatgacggtgtatggcggctttcgtacggcgagcaactaccaggccggtgcaattggcataggcagagggtttggcgcatttggctcgctgggcattgacgatacgctggcaaaaagccatttacccgacggcaaaaacgcgatagggcaggcgtggcgcattcagtatcagaaagatttcagcgctaccggcaccgccttcaacctggcgagttatcgctatgcctcgcgcaattactatgaatttagtgaactgaatcagtctgacagccaacagctgcaactcaataatcgccgtagccgctcgcaggtcaccttttcacagacgctgggtcagttcggcagcctcagcgtctcggcatggatgcaggattactggcatacgtccgggcaggataaaaccatccacattggctggtacaccagctggcggggcatttcctggggcgcgggatatgactacaccgactcagcgcgtgagcagcatcccgatcgcaccgtgtcgtttaacgtcaatgttccgcttggccactggttaccggacagctcggtcagttacttcatcaaccacaacaatcgtggaatgaccacgcagcagatgtctctcaacggcagcgcgctggcgaatcgcaaccttaattacagcgttcagcagagtaaggccagcgagggacaagccgacagtaccagcctggcgctgcaatacaacggtggctacggcaacgtcagcctcggttatgaccacagccgaagcggtagcaacgcgagcctcggactcgccggaggcgttatcgccacgcagtatggcgtcacgcttagcgagccgctgggcgataccgtcgccctgctgcgcgtgcccggtgcggcgaacgttgagccggagggttacaacgggatccataccgacagccgcggctatgcggtcatgccaacgctctcggcgtatcgcaaaaataccgtcagccttgatacggcgacgctgggtgagaacgtcgacgttgagcagagcggtctgacgctcattcccaccagcggcgcggtggtgctggccaattacaaaacccacattggttatcgcgttctgttttccctgcgctaccacggtgaaccgttgccgtttggcgcgcaggctgaagtggtggagcagaaccgccattctgcaaaccgaagcatggtcgctgacggcggtcaggcctacctgagcggagtacccgagcgcggcaccctgcgcgtcacctggtatgaaaacggggagcagcagcaatgccagacacctttcagattggggaaagctcatatggcccccggcatcgctacgctgtctcttgagtgccactag

SEQ ID NO: 4311 - DNA, 1104 bp, Enterobacter cloacae
aggaatatcatgcgtcgttttattcactggtttttctatctcagtctgctttcgctttttggcatgctgagttttcatgcccatgcccagacttcaacctgccgcaccacgcgcgatcagtgggtcgttcaggtgccttatgccattgggtatgcgcccggcacgtctgactggacgccgatatctgcgccgatacagtctaccggggcggatttctacagctgtgatggcgggaatgacccctggcgtagtatcggatttgtcgagctggataaccccgtcggcaccgtggtgggggaagacggtgcgtcgcggcacgtctacaaaacccaaattgacggcatcggctacgcgctcgggttccgcgagcagcagtactgtggtgcggatgccgtacggtatattgacggcaccagcccggtagacggcaacgagtcccggcgtatctgcgatgcctcacagaatcctgcctttgccagcgccccaacgtataaattgcagttctgggtggtgttttacaaaatcccgacgaccagccccatgcctgacgataacgccaactcccaggagcaaaatgtcggatcgctgatattgcaggcgggagaaaatcaagccagcgccaccaacgtggcgacaccagtacagattcatctcgccagcttcaccgtcaggcgtaccagctgttcagtgggctctcgcagcattcttgttcccatggggagcgtgagccagcgtgaatttcacggcatcggcttccgcgccgggggcggacgcttcagcattccggtgacttgcgaaaataacacggcggttaagatgggtttctttggcgataccacgccgggcaacgatcgggcgctggcgttgacgaagcaggaggatagcgccagcggtgtcgggatcgaactgctttacggtgacaataccggttcggttcaggggcaggtggtaccgtggaacaccccgcaggtgtcagcgcttgggcaagtaggggataaccagacgcaaaccttctggtttgatgcgcattacattcagacggaagcgaacgtgacggcgggaaaagcggatgcgatggccacgtttaacctgatttacaactga

SEQ ID NO: 4312 - DNA, 1644 bp, Enterobacter cloacae
atctggcgacgatcgccatcgcctgcgccatcggctacctcaatttccgccgcgtctcgccgggctggtgcgtggatcgtccgctgctggtcaaactggcggagacgctcttccagcgcgaaagtttcgcccggactgaaccaccaaaggcttgatgcgggttataacacttcctggcgggaggcggtacaatccccccacatgttaactccctctcccgtcgggaggggggaagatatttactcgccaggcgcattcatgactactcatcattccctctacagccagatccccgctaccgatcgtctgcttcgtgacccgcgcatcactgcggtgctggagcagtttggccatactgcaacggtcgacatgctacgccagcttcaggacgatgcgcgtcgccatattcaggctgagaacgcgctacccggctggtgcgaggcatgggcgcaggaagttgaaaggaggttgagcaagcacgcgcaaagcgcgttgcgcccggttattaacctgacaggcacggttttgcacaccaatctgggccgggcacagcaggcagaagaggcaatagatgccgtcacccgggccatgcgctcgccggtgacgctggagtacgatctggacggcgccgggcgcggacatcgcgatcgcgcgctggcggatcttctctgccagatcaccggcgcggaagatgcctgcattgtgaataacaacgcggcggcggtgctattaatgctggcggccaccgcgagcggaaaagaggttgtcgtctctcgcggcgagctggtggagatcggcggggcgtttcgtattccggacgtcatgcggcaggcgggctgcacgctgcatgaagtgggcacaaccaaccgtacccatgcaaaagattatcgcgcggcggtgaatgaaaacaccgccctgctgatgaaagtgcataccagcaattaccacattgagggtttcaccaaaacggtggaagaggctgaactggccgccatcgggcgcgagctaaacgtgccggtgattgccgatcttggcagtgggtcgctggtggatatgcgccagtatggtctgccaaaagagccaatggtgcaggaaatggttgccgcgggcgtaagcctggtcagtttctctggcgataaactgctgggcgggccgcaggcgggtattatcgtcggcaggcgcgagctgattgcgcagctacagcagcatccgctgaagcgcgccctgcgtgccgataaaatgacgctggccgcgctggaagccacgctgcggctctatctccacccggagaaactggctgaccgcctgcccacgttgcgtttgctgagccgtgatgcggcctctgttcgcgcgcaggcggaagcgctactgccgcaggttgctcctcattaccctgagtttgaagttcgtatcgagccttgcctgtcgcaaattggcagcggctcgctgccggtggacaggttaccgagcgaagcgctgacgttcaccccgcgcgacggacgcggaagccagcttgaggcgctgtcggcgcgctggcgcgcattaccgacgccggtgattggccggatcggtgacgggcgcatgtggctggatttacgctgtctggaagatgaagtgcggtttctggagatgatgttgaaatga

SEQ ID NO: 4313 - DNA, 1641 bp, Enterobacter cloacae
agtacggtaatccgtgatacggctcgtaaacccgttaccgactggcgagaaaaccaccagccggaactacccttgttgtacacctactgcaaggagacggtcatgacaaacaatcctccctcatcgcgtatccagccaggcgagtatggttttccccttaagctgaagccccgctatgacaactttatcggcggcgactgggtggcgcccgtcgacggtgaatactattccaacctgacgcccgttaccggccagccgctgtgtgaaattgccagttcgggcaagcgggatatagatttagcgctggatgcggcgcataaggcgaaagataagtggggacaaacgtccgttcaggacagagcggccattttgttcaaaatcgccgatcggatagagcagaatctggagctgctggcgaccgcagaaacgtgggacaacggcaagccgatccgggaaaccatggcggcggacgtgccgctggcgattgaccatttccgctattttgcgtcctgcattcgtgcccaggaggggggaataagtgaagttgacaaagataccgtggcgtatcacttccacgagccgctcggcgtggtggggcaaattattccgtggaacttcccgctgctgatggctagctggaaaatggcgcccgcgctggcggcgggtaactgcgttgtgctgaaacccgctcgcttaacgccgctttcggtactgctgctgatggaggtgattggcgacctgttgccgccgggggtcattaacgtggtcaacggggccgggggagagatcggcgaatatctggctacctcaaaacgtatcgccaaagtggcgttcaccggctcaacggaagtgggccagcagatcatgcagtacgcgacccagaacatcattccggtcacgctcgagctgggcggcaaatcgccgaacatcttctttgccgacgtgatggacgaagaggacgccttcttcgacaaagcgctggaagggtttgcgctgttcgcgtttaaccagggcgaagtctgcacctgtccgagccgcgcgctggtgcaggaatccatttatgagcgctttatggagcgggcgatccggcgcgtggagtcgattcgcagcggtaatccgctggataacgttacccagatgggggcgcaggtatcgcatggccagctggaaaccatcctcaactatattgatatcggtaaaaaagagggggccgatgtgttgaccggcggtcgtcgtaaggtgctgggcggcgatttgcaggagggctactaccttgagccgaccatcctgttcggtaagaacaatatgcgcgttttccaggaggaaatttttggaccggtgctggccgtcaccacgtttaaaaccatggacgaagcgctggagctcgccaacgacacgcagtatggcctgggggcgggcgtctggagccgtaacggtaatctggcctataaaatgggccggggcattcaggccggacgcgtatggacaaactgctatcacgcctatccggctcatgcggcgtttggcggctacaagcagtcgggcatcgggcgtgaaacccataagatgatgctggagcactaccagcaaacgaaatgtctgttggtcagctactccgataaaccgctggggttgttttaa

SEQ ID NO: 4314 - DNA, 267 bp, Enterobacter cloacae
gtagcggcgaaggatggctatagtttcctgaacgcgctgagagtaaaacggcttaatcacctcattcgacaggcgcagcaggtcgttacgcctgatcatctcgcacatcatcgccgggccgatgccgccaggcgaaaggctgataatgccgttcatgttggtaatggcggtgatgattttctcgttagcaatgataatgccgcaacggctgcccggcaggcccagcttggagaggctcatgcagaggatgatattcgggttccatag

SEQ ID NO: 4315 - DNA, 369 bp, Enterobacter cloacae
cggacgcgcttcgctgaagatgatccccgggaacggtacgccataggcgttatcgatcaccagcgggatgccgtgctgattcgccagcgcatccagcttcatcagctcgtcgtcggtgatcacgttccccgtcgggttggtgggacgagatacgcagatcatgcccgtctcttcaccgatatgcagatgttcaaaatcgacgtgatatttgaactggccctctggcagcaactcgatattcggacgtgcggaaacaaacaggtcttcttcgaggccggcatcggcatagccaatatactccggtgccagcgggaacagcacttttttcgtggtgccgtcggcgcggcgtccggcgaacagattgaataa

SEQ ID NO: 4316 - DNA, 1410 bp, Enterobacter cloacae
aataacgtaattgagcaacctccaatgtctattcactattactccagaagcaagaccacgccgcataccctgattatggagctcaatatgcaagcttatttcgaccaactcgatcgcgttcgtttcgaaggcacgaaaacgaccaatcctttagcatttcgtcactacaacccggatgagctggtgctgggtaagcgcatggaagatcacttgcgctttgccgcctgctactggcacaccttctgctggaacggtgccgatatgttcggcgtgggctcttttgaccgtccatggcaacagccgggcgaggccattgagctggcgaagcgtaaagccgacgtcgcgttcgagttcttccataagctgaacgtgccgtactactgtttccacgatgtggacgtgtcgccggaaggggcgtcgctgaaagagtatctgaacaacttcgcgcagatggtcgacgtactggctgaaaaacagcagcaaagtggcgtcaagctgctctggggtacggctaactgctttaccaaccctcgctatggcgcgggcgcggcaaccaacccggatccggaagtcttcagctgggcggcaacccaggtcgtgacggcgatgaacgccacgcatcagctgggcggtgagaactatgtactctggggcggtcgtgaaggatatgaaacgctgctgaataccgacctgcgtcaggagcgtgagcagattggtcgctttatgcagatggtggtggaccacaaacacaaaatcggtttccgcggcacgctgctgattgagccaaaaccacaggagccaaccaagcatcagtatgattatgatgtcgccaccgtgtatggcttcctgaagcagtttggtctggaaaaagagatcaaagtgaatatcgaggctaaccacgctaccctggcgggccactcgttccatcacgaaattgcctctgcgattgcgctgggcatcttcggctctgtcgatgctaaccgtggcgatccacagctgggctgggataccgaccagttcccgaacagcgtggaagagaatgcgctggtgatgtacgagatcatcaaagcgggcggtttcaccaccggcggcctgaacttcgacgccaaagtgcgtcgccagagcaccgacaaatacgatctgttctacgggcatattggcgcgatggacaccatggcgctggcgctgaaagtggcggcccgtatgattgaagacggtgagctggataagcgcgtggcgaagcgctacagcggctggaacagtgagctgggccagcaaattttgaaaggtcagttatcgcttgcggagatcgcgaagtacgctgaacagcatcagcttgcgccgcagcatcagagcggccatcaggagctgctggaaaacctggtcaatcactacctgttcgataaataa

SEQ ID NO: 4317 - DNA, 1473 bp, Enterobacter cloacae
atacctaaggaagcggcagagatgcattttcgtgccattacccgaatcgttggattgctggtcatacttttctccgggacaatgatcattcccggactggtggcgctcatctaccgggacggcgcggggcgtgcatttacgcaaaccttttttgtcgcgctgacgattggctccctgctgtggtggccaaaccgccgtgagaaaggtgaactgaaatcccgggaggggtttctgattgtggtcctgttctggacggtactgggaagcgtgggtgcgctgccgtttatcttctccgaacaaccgaatctcaccgtcacggatgcgttttttgaatcgttctccggattaacgaccaccggggccaccacgcttgtggggctggattcgctcccgcatgcgattctcttttaccggcagatgcttcagtggttcggcggtatggggatcattgtcctggcggtggctatcctgccgattctgggcgtcggggggatgcagctttaccgggcggagatgcccggcccgctgaaagataacaaaatgcgcccgcgtattgcggagacggcgaaaaccctgtggcttatctatgtcctgctgacggtggcctgcgcgctggcgctgtggtttgccgggatgcctgcgtttgatgccatcgggcacagctttgcgactattgctatcggcgggttctccacccacgatgccagcgtcggctacttcgacagcccgacaatcaataccatcattgccatctttttgctgatctcaggctgtaactacggtctacacttctcgttgcttagcggacggagcctgaaggtgtactggcgcgacccggaattccggatgtttattggcgtccagctgactctggtgatcatctgtaccctggtactgtggttccacgatgtctataactcggcggtcacgaccctgaaccaggccttcttccaggtggtatcgatggcaacaaccgccggtttcaccacggacagtattgcgcgttggccgctgttcctgccggtgctgctgttgtgctctgcgtttatcggcggctgtgccgggtcaacgggcggcggtctgaaggtgatccgtattctgctgctgttcaagcaggggaaccgtgagctgaaacgtctggtccacccgaatgcggtttacagtattaagctggggaaccgcgcgctgccggaacgcatcctcgaagcggtgtggggattcttctccgcttatgcactggtctttattgtcagtatgctggcgattatcgccacgggcgtggatgatttctctgccttcgcctctgtggtggcaacgttaaacaacctggggccggggctgggcgtcgtggcggataacttcgccagtatgaacccggtggcgaagtggatcttaatcgccaatatgctgtttgggcgtcttgaggtctttacgctgctggtgctgtttaccccaacattctggcgtgagtaa

SEQ ID NO: 4318 - DNA, 297 bp, Enterobacter cloacae
ggtggtgaaatgggtgagttactgaattcggggctgctgagcattgcatccctggtaatgtctttggtggtgttggtcgttgggctggtactgtggttcttcgttaaccgcgccagctcccgcacaaacgagcagattgaactgctggaagcattgctcgatcagcagaaacggcagaatgcgttgctgcgtcgtctgtgcgaagccaacgagccggaggagaaagcggtacctaaggacgctgttgctcaacaacaggacgaggaagacttcattcgcctggtagccgaacgatag

SEQ ID NO: 4319 - DNA, 516 bp, Enterobacter cloacae
acacattcgcagcaacagagcgttaaacctatgaaatacgatacctccgagctttgtgacatctaccaggaagatgtcaacgtcgttgaacccctgttctccaactttggtggacggtcgtcctttggcggacaaatcatcacggtgaaatgtttcgaggacaacgggttgctgtacgatctgctcgaagagaacggtcgtggccgcgttctgctggtggatggtggcggttcagtgcgccgtgcactgatcgatgcggacctcgcccgccttgcggtgcaaaacgagtgggaagggattgtggtctacggctccgtgcgccaggtggacgatctggaagatctggatatcggtattcaggccattgccgccattccggttggcgcagcgggtgaaggcatcggcgaaagcgacgtgcgcgttaacttcggcggcgtgaccttcttctcgggtgaccacctttatgctgacaataccggcattatcctttctgaggatgcgctggatattgagtag

SEQ ID NO: 4320 - DNA, 702 bp, Enterobacter cloacae
acaatgaataaaatcctgttagttgatgatgaccgagagctcacatctcttttaaaggagttgctcgacatggaaggtttcaacgtcctggttgcccatgatggcgagcaggcgctgagtctccttgacgacagcatcgatttacttttgctcgacgtcatgatgccgaagaaaaacggtattgatacgttgaaagagcttcgccagacacaccagacccccgtcattatgctgaccgcacgcggcagcgagcttgaccgcgtactcggccttgagctgggtgcggatgactatttacctaagccgttcaacgaccgtgaactggtggcccgtattcgcgcgatcctgcgccgctctcactggagcgagcagcagcagaataccgacaacagctcacctacgctggaagtggactccctgagcctgaacccgggccgacaggaagcgagcttcgacggtgaaacgctggagctaaccggcaccgagttcaccctgctgtatctgctggcgcagcatctcggccaggtggtgtcgcgtgaacacttaagccaggaagtgctgggcaaacgcctcaccccgtttgaccgcgccatcgacatgcatatctcgaacctgcgccgtaagctgccggagcgtaaagacggtcatccctggttcaaaaccctgcgtggtcgtggttatctgatggtttccgcttcatga

SEQ ID NO: 4321 - DNA, 1020 bp, Enterobacter cloacae
gagattttcgccaaacgcgggggcgacgaagaggtcagcctgttcaggaaattcggttttccagtgctgatagtgctcgcgcggatagtggcacagcgcgcgatcgggcccgccgtggattttcttttcagcctgctggtcacccgcaagcccgagatcggtcaacgtcagctcaccgtcgacctgcactttggcgatggcactcgggcggctgccttcgtactcccttaccttgcctgtaaacacattcaccgggtaatgcatctccactccttcagatacaaaaaaagcgagtcatcagactcgcttctcacaggcgtcaatgcaaccttattttttagcggcgaaacgcgctgctgcttcgtcccagttcaccacgtcccagaaggctttgatgtagtcagggcgacggttctggaacttcaggtagtaagcgtgttcccacacgtccagacccagaattgggaagccggatgcgccagagatagcttcacccataagcggggaatcctggttagcggtagaaacgaccgccagtttgtcacctttcagaaccagccacgcccagccagagccgaaacgggttgcagcggctttttcgaattccgctttgaagttgtcaacggaaccgaagtcacgctcgatagccgctttcaggtcgccctgaagggtggtgccggttttcaggcctttccagaacaggctgtggttagcgtgaccgcccgcgttgttgcgcagcacggttttcttgtctgctggcagctggtccagtttggtgatcagctcttcaacaggcagattagcgaactctggcaggctttccagcgcagcattcgcgttgttcacgtaggtctggtggtgtttagtgtgatggatttccatcgtctgcttgtcgaaatgcggttccagtgcgtcgtaggcatacggcagggatggcagtgtataactcataatcctctccattattgtcgggcggcacagctgttaatgccgcgtaagcagttggttcattatagttaa

SEQ ID NO: 4322 - DNA, 1149 bp, Enterobacter cloacae
ttgccattcaaaacaaaagtgcggcaaccttctgaaggttcccaaaccgcctcatttttacactcatcaagtcggcgggaagcctccggctataaaaacgatgaggatgtaaaaatgaatcatgcgattacgatgggtatcttctggcatttgataggcgcggccagtgcagcctgtttctatgccccgtttaaaaaggtgaaaggctggtcatgggaaaccatgtggtccgttggcggtaccgtgtcctggctgattttgccgtggacaatcagcgccatgctgctgcccgatttctggggctacttctcctccttcaacgcctccaccctgctgccggtattcctgttcggcgcgatgtggggcatcggtaatatcaactacggcctcaccatgcgctacctcggcatgtcgatggggattggcatcgcgattggcataacgttgattgttggcaccctgatgacgccaatcctcaacggcaacttcgatgtgctgatcaacacccagggagggcgaatgaccctgctgggcgtgctggtggcggtgatcggcgtgggcatcgtcacccgcgcgggccagctgaaagaacgcaagatgggcatcaaagccgaagagttcaacctgaagaaagggctgctgctggcggtgatgtgcggcatcttctcggcgggcatgtcgttcgccatgaatgccgccaaaccgatgcacgacgccgctgcggcgctgggcgtcgatccgctgtacgttgccctgccaagctacgtggtgatcatgggcggcggcgcgctggtaaacctcggcttctgctttattcgtctggcaaaagtgaacaacctgtcggtaaaagccgacttctcgctggcaaaaccgctgatcgtcaccaacgtcctgctctccgcccttggcggcctgatgtggtatctgcaattcttcttctacgcctggggtcacgccagtattccggcgcagtatgactacatgagctggatgctgcacatgagcttctacgtgctgtgcggcgggctggttgggctggtgctgaaagagtggaacaacgccgggcgtcgtccggttggcgtgctgagcctgggctgcgtggtgattatcattgcggccaatatcgtcggcctcggcatggcgaactga

SEQ ID NO: 4323 - DNA, 591 bp, Enterobacter cloacae
cccatgcaggtcagcagaaggcagttctttaagatctgcgctggcggtatggcaggcaccacggcggcggcactgggctttgcgcccggtgtagcgctggcggaaacacggcagtataaactgctgcgcacccgcgaaacccgtaacacctgtacgtactgctccgtcggctgtgggctgttaatgtatagcctcggcgacggtgcgaaaaacgccaaagcatctattttccacatcgaaggcgatccggatcacccggtaaaccgtggtgcactctgtccgaaaggggccggtctggtagattttatccactccgaaagccgcctgaagtttcctgagtatcgcgctcccggctctgacaaatggcagcaaatcagctgggaagaagcgttcgatcgcatcgctaagctgatgaaagaagaccgcgatgccaactttatcgcgaagaatgccgaaggcaccaccgttaaccgttggctctccaccggcatgctgtgtgcttcagcgtccagtaacgaaaccggctatttaacccagaaatttacgcgcgcactcggtatgctcgcggtcgacaaccaggcgcgtgtctga

SEQ ID NO: 4324 - DNA, 2463 bp, Enterobacter cloacae
cacggaccaacggtagcaagtcttgctccaacatttggtcgcggtgcgatgaccaaccactgggtcgacatcaagaacgccaaccttattgtggtgatgggcggtaacgccgctgaagcgcaccctgtcgggttccgctgggcgatggaagccaaaatccacaacggcgcgaagctgattgtgatcgatccccgctttacgcgtacagcgtcagtggcggatttctacacccctattcgttcaggtactgacatcactttcctgtcaggcgtactgctgtacctgatgaccaacgaaaaatataaccgcgagtacaccgaagcctataccaacgccagcctgatcgtgcgtgaggattaccacttcgaagatggcctgttcagcggttacgacgccgaaaaacgcaagtacgacaaaaccagctggaactacgagctggacgaaaacggctttgcgaagcgcgacaccaccctgcaacacccgcgctgcgtgtggaacctgctgaaagagcacgtttcccgctacacgccggaggttgtcgaaaacatctgtgggacgccgaaagcggatttcctgaaggtgtgcgagttgattgcggaaaccagcgcgaaagataaaaccgcgtcgttcctgtatgcgctcggctggacgcagcactccatcggcgcgcagaacatccgcaccatggcgatggttcagctgctcctcggcaacatggggatggcaggcggcggcgtgaacgccctgcgcggtcactccaacattcagggtctgaccgacctcggcctgctgtctcagagcctgacgggttacatgaacctgccgagcgagaaacagactgacctgcaaacctacctgacggccagcacgccaaaaccgctgctcgaaggccaggtgaactactggggcaactatccgaagttcttcgtctcgctgatgaaagccttctacggcgacaaggcgacggcggaaaacagctggggctttgactggctgccgaagtgggacaaaggttacgacgtacttcagtacttcgaaatgatgcaccagggccaggtcaacggctatatctgccagggctttaacccggtggcatcgttcccgaacaagaacaaggttgtcgagtctctgtcgaagctgaagttcctggtgacgattgacccgctcaataccgaaacgtcgacgttctggcagaaccacggtgagtcgaacgacgtcgatccgtcgaagattcagaccgaagtgttccgtctgccgtccacctgcttcgcggaagagaacgggtctatcgtcaactccggccgctggttgcagtggcactggaaaggcgcagacgccccgggcatcgccctgaacgacggcgagatcctggccggcatcttcttacgcctgcgtaagatgtacgcctctgagggcggcgcaacgcctgagccggtactgaacatgacctggaactactcgacgccggaaaacccagcgccggaagaagtggccatggagagcaacggtaaagcgctggcggacgttatcgacccggcgaccggtgcggtgctggcgaagaaaggcgatcagctcagcaccttcgcgcacctgcgcgatgacggtacgacgtcaagcggctgctggatctttgccgggagctggacgccgaaaggcaaccagatggccaaccgcgataacgccgacccgtcgggcctcggtaatacgctgggctgggcatgggcgtggccgcttaaccgccgcatcctctataaccgtgcctccgctgatccgcagggcaacccgtgggatccgaagcgtcagcttctgaagtgggacggcgcgaaatggggcggcgtggatattccggactacagcactgccgcaccaggcagcgatgtcgggccgtttatcatgcagcctgaagggatgggccgtctgtttgctatcgataagatggcggaagggccattcccggaacactacgagccgtttgagacgccgctgggtactaacccgctgcacccgaacgtggtctctaacccggcagcccgtatcttcaagggcgattttgaagcgctgggtaaaaaggacaagttcccgtatgtcggcaccacttaccgtctgaccgagcacttccactactggaccaagcacgcgctgctgaatgccatcgcgcagccggaacagtttgtggagatcggcgagaagctggcgaacaaactcggcattgcccatggcgataccgtgaaggtctcctctaaccgcggctacatcaaagccaaggcggtggtgaccaagcgtattcgcacgctgaacgttcacggtcagcaggtggataccatcggcatcccgattcactggggttatgagggcgtggcgaagaaagggttcattgcgaacaccctgacgccgttcgtcggtgatgcgaacacgcagacgccggagtttaaggccttcctcgtgaacgtggaaaaggtgtaa

SEQ ID NO: 4325 - DNA, 915 bp, Enterobacter cloacae
cggagacgacttatggcttatcaatctcaagacattatccgtcgttccgcgactaacggtttcacgcccgcgcctcaggcgcgggaccaccagcaggaagtggcgaagcttatcgacgtgaccacctgtatcggctgtaaagcctgtcaggtggcctgctctgagtggaacgacatccgtgacgaagtgggtcacaacgtcggggtgtacgacaacccggcagacctgaccgccaagtcctggacggtaatgcgtttctcggaagtggagcagaacgacaagctggaatggcttattcgcaaagacggctgtatgcactgtgcggatccgggctgcctgaaggcgtgtccgtcagaaggggctatcattcagtatgccaacggcatcgtcgacttccagtccgagcagtgcattggctgcggctactgcatcgcgggctgtccgttcgacgtgccgcgcatgaacccggaagacaaccgcgtctacaaatgtacgctgtgcgttgaccgcgtgaatgtcggccaggagccagcgtgcgtgaagacctgtccaaccggcgctatccactttggctctaaagaggatatgaaaacgctggcggcagagcgcgtgggcgagctgaaaactcgtggttacgataacgcgggcctctacgatccggccggggttggcggtacgcacgtcatgtacgtactgcaccacgccgacaagccgaacctgtatcacggcctgccggagaacccggaaatcagcgccaccgtgaagttctggaaaggtatctggaaaccgctggccgcggtcggttttgcggccaccttcgcagcgagcatcttccactacgtcggcgttggtccgaaccgcgcggaagaggaagacgacaacctgcatgaagagaaagacgaggtgcgcaaatga

SEQ ID NO: 4326 - DNA, 879 bp, Enterobacter cloacae
ggaatgacgatgtacaccctgaaagatatcacccgaccttccggcggttttgcgatgctggccgtggatcagcgcgaagcgatgcgcctgatgtttgcggcggcaggcgcgccggtaccggtaaccgaccagcacctgacggattttaaagtcaacgcggcaaaaattctgtcgccgtacgcctctgcgatccttgtcgaccagcagttctgctatcgccagattgtcgggcagcaggccgtggcaaaaagctgcgcgatgattgttgcagccgacgagtttattccggggaacggtattccggtcgacagcgtggcgatcgacaagaacgtcgacgcgcaggcggtcaaacgcgatggcggcaaagcactgaagctgctggtgctgtggcgcagcgatgaagatccgcagcagcgcctggagatggtgaaagcgttcaatacgctgtgccacgataacggtctgctgagcattatcgagccggtggtgcgtccaccgcgtcgcggtgccgcgtttaaccgcgaacaggcgattatcgacgcggccaaagagctgggcgacagcggtgccgacctctacaaagtggagatgccactgtttggcaagggcacgcagcaagagctgctggcggcctcgcaaaagcttaacgagaacatcgccatgccgtgggtgatcctctcgtccggcgttgacgataagttattcccgcgcgcggtgagcgtggcgatgcaggcgggggcatcgggctttttagccggtcgcgccgtctggtcctctgtgattggcctgccggacaccgagctgatgctgcgtgatatttccgtaccaaaacttcagcgtctgggtgagatcgtcgacgaaatgatggctcgccgttaa

SEQ ID NO: 4327 - DNA, 2037 bp, Enterobacter cloacae
gacggagtttttatgcgtaccctacacaatattgacctgaaaaataacgaaagtggcttcaccctgcgctggcaggaccgtctgattttatcccacaccgcggatgccccttgcctgtggattggcgcaggtgaggcggatatcgagatgtttcgcggcaacttcagcatcaaagacaagctcaacgaaaagattgccctgacgaacgcgaccgttacgcagcaaagcgcgggctgggcaatccgctttacccgcggcgatgcggtaagcgccacgctgctggtgggcgtggatgcggaaggccgtctagagctgaaactgaaaaatgatgctcccggccataaccgcatctggctgcggctggcggcgcagccagaagatcatatttacggctgcggcgagcagttctcgtacttcgatctgcgcggcaagccgttcccgctgtggaccagcgagcagggcgtgggccgcaacaagcagacctatgtcacctggcaggccgactgcaaagagaacgcaggcggtgactactactggaccttcttcccgcagcccaccttcgtgagcacccagaagtactactgccacgtggataacagctgctacatgaactttgacttcagcgcccctgacttccacgagctggcgttctgggaagataacgccacgctgcgcttcgaatgtgcggaaacgtacgtcgatctgctggaaaaactgaccggcctgctgggacgccagccggagctgccggactgggtgtacgacggcgtgacgctgggcatccagggcggcaccgaggtgtgccagcagaagctcgacaccatgcgtaacggcggcgtaaaggtgaacggcatctgggcgcaggactggtccggcatccgcatgacctccttcggcaaacgcgtaatgtggaactggaagtggaacagcgcgctctatccgcagcttgatacgcggattgcgcagtggaaagaagaaggcgtgcagttcctctcctatatcaacccgtacgtcgccagcgataaagatctctgcgaagaggccgcgaaacgcggctatctgaccaaaaacgccgacggcaaggactaccacgtcgagttcggcgagttctacgcgggcgttatcgacctgaccaacccggcagcctacgactggtacaaagaggtcattaaaaagaacctgatcgaactgggctgcggcggctggatggccgatttcggggagtacctgccgaccgataccttcctgcacaacggcgtgagcgcggagatcatgcataacgcctggcctgccctgtgggcgaaatgtaactacgaagcgctggaggagaccggcaagctcggggagatcctgttcttcatgcgcgcaggctacaccggtagccagaagcactcggtgatgatgtgggcgggggatcagaacgtcgactggagcctggacgacggtctggcttccgtcgtaccggcggcgctgtcgctggcgatgaccgggcacggcctgcaccacagcgacattggcggctatacgacgctcttcgagatgaagcgcagcaaagagctgctgctgcgctggtgcgacttcagcgcctttacgccgatgatgcgtacccacgagggcaaccgccctggcgataactggcagttcgacggcgacgcggaaaccatcgcccacttcgcgcgcatgaccaccgtcttcaccaccctgaagccgtataccaaagctgctgttgcgcagaacgcgaaaagcggcctgccggtgatgcgtccgcttttcctgcactacgaggacgacgcgcgcgcctacacgctgaaataccagtatctgtttggccgcgatctgctggtggcgccggttcatgaaaagggacgccgcgactggtcgctctatctgccgcaggacacctgggtcaatgcgtggaccggagaaacctgccagggcggtgacatcaccgttgatgccccgctcggcaaaccgccggtcttctatcgccagcaaagcgaatgggccgatctgtttagcaccttacgtcatatctga

SEQ ID NO: 4328 - DNA, 1425 bp, Enterobacter cloacae
ggctcgcccgcgggaaaacctgcgggcagacggagaacaataatgagtcaacatacttctgatccggcaaccctgcgcctgccgtttaaagaaaaactcgcctacgggatgggcgatctcggctctaacatcctgcttgatatcggcacgctgtatctgctgaagttctacaccgacgtgctggggctgccgggcacctacggcgggattatcttcctgattgcgaagttttttaccgccttcaccgatatgggcaccgggatcatgctcgattcccggcgcaagatcggcccgaaagggaaattccgcccgttcgtgctgtatgcagccttcccggtaacgttgctggcgattgccaacttcgtcggcacaccgtttgaaatcaccggtaaaacggtgatggcgacggtgctgttcatgctgtacggcctgttcttcagcatgatgaactgctcttacggcgcgatggtgcccgccatcaccaaaaacccggacgagcgcgcctcgctggcggcctggcgtcagggcggcgccacgctcggcctgctgctctgtacggtgggctttgtcccggtgatgaacctgattgagggtaacgaccagcttggctacatctttgccgccaccctcttctcgctgttcgggctgttctttatgtggtggtgctataagggcgttaccgagcgttacgtcgagacgcagcctgctaacccggcgcagaaaccggggctgttgcagtcgtttcgcgccatcgccgggaaccgtccgctgtttatcctgtgcatcgctaacctgtgcacgctgggcgcctttaacgtcaaactcgccattcaggtctactacacgcagtacgtgctgaacgacccgatcctgctgtcgtatatgggcttcttcagcatgggctgtatttttatcggcgtctttatgatgcccggcgcggtgcggcgcttcggcaagaaaaaggtctacatcagcgggctgatgatttgggtggcgggcgatctgcttaactacttcttcggcggcggctcggtgagctttgtggcgttctcctgcctggcgttcttcggttccgcgttcgtgaacagcctgaactgggcgctggtgtccgataccgtggaatacggcgagtggcgcaccggcgtgcgctccgagggaacggtctacaccggctttaccttcttcaggaaggtctcgcaggcgctggcgggcttcttcccggggatcatgctcacccagatcggctatgtgccgaacgtggtgcagtccgccgggacggttgaagggctgcggcagctgatatttatctacccgagcctgctggcggtcatcaccatcgtggcgatgggctgcttctacaacctcaacgagaagatgtatgtgcgcatagtggaagagatcgaactgcgcaaacgtacggcataa

SEQ ID NO: 4329 - DNA, 783 bp, Enterobacter cloacae
agcgtcagcagtcactttataacaataaatccggccactatgtccttcctgtttatcaggagggaggcctttctgtacctgatacatggacaaattatgaaaagaatcatcaccgtactgatcgtgtcgtctgtgtcctgcccggtatttgccggggcctacgtcgaaacgcgcgaagcctacaacaccgcctcagagctgcacgaagtgatcctgcgtgcgggctataacttcgatatgggcgcggggctgatgttcaccaacgcttataacgtggggaaatgggacgaactgaaacacagctataacgaaatcgaggggtggtatccgctcttcaaaccgaccgacaaactgaccttccagcccggcggcttaattaatgacagcagcgcaggatcaggtggcgcggtttatttagataccaattacaaatttacggactggtttaatctgacgttccgctatcgctataaccataacaattacgatacgccggactataacgggcagatggataagaacgacacgcatgaattcgccaactactggaatttcaaagtgacggatgcgtttttctacacctttgagccgcactttttccagcgggtgaatgattaccacagcaaaaatggcaaagatcatcactgggaaattactaacaagttcagctataaaatcgacagaaactggctgccgtatcttgagctacagtggctggaccgatggaatgattacaaccgggagcagtaccggatccgtttagggttacggtattcgttctaa

SEQ ID NO: 4330 - DNA, 1455 bp, Enterobacter cloacae
agacctcgttaccacgacgacaatgaccaatctggagagttaagtatgtccgctgaacacgttttgacgatgctgaacgaacatgaagtgaagtttgttgatctgcgcttcaccgatactaaaggtaaagaacagcacgtcacgatccctgctcatcaggtgaacgccgaattctttgaagaaggcaaaatgtttgacggctcctccattggcggctggaaaggcattaacgaatccgacatggttctgatgccagatgcaaccactgcgctcattgacccgttctacgaagaacctacgctgatcatccgctgcgatattctggaacctggcacgctgcaaggctatgaccgtgacccacgctccatcgcaaaacgcgctgaagagtacctgcgctctaccggcatcgcagacaccgttctgttcgggccagagccagagttcttcctgttcgacgacatccgttttggtgcttccatttctggctcccacgtcgctatcgatgacatcgaaggcgcatggaactcttccaccaagtacgaaggtggtaacaaaggtcaccgtccaggcgtgaaaggcggttacttcccggttcctccggtcgattcttcacaggacatccgttctaccatgtgtctgatcatggaagagatgggcctggttgttgaagcgcaccaccacgaagtggcaacggctggccagaacgagatcgctacccgcttcaacaccatgaccaaaaaagcggatgagattcagatctacaaatacgttgtacacaacgttgcgcaccgtttcggtaaaaccgcgaccttcatgccaaaaccaatgtttggcgacaacggttccggcatgcactgccacatgtccctgtccaagaacggcaccaacctgttctctggtgacaagtatgcgggtctgtctgagcaggcgctgcactacatcggcggtgttatcaaacacgctaaagcgatcaacgccctggcgaacccgaccacgaactcctacaagcgtctggttccaggctacgaagcacccgtgatgctggcgtactctgcccgtaaccgttctgcttctatccgtatcccggtggttgcgtctccgaaagcgcgtcgtatcgaagtgcgcttcccggacccggcggctaacccatacctgtgcttcgcagcactgctgatggccggtctggacggtatcaagaacaagatccacccgggcgaagccatggacaaaaacctgtacgacctgccgccagaagaagcgaaagagatcccacaggttgccggctctctggaagaagccctgcaagcgctggacgcagaccgcgagttcctgaccgctggcggcgtgttcaccgatgaagctatcgacgcttacatcgcgctgcgtactgaagaaaacgaccgcgttcgcatgacgccgcacccggttgagttcgaactgtactacagcgtttaa

SEQ ID NO: 4331 - DNA, 927 bp, Enterobacter cloacae
ataactatgactgatatcagccgtacacaggcgtggctcgaaagtctgcgccctaaaacgcttcctctggcttttgccgccattattgtcggtaccacgcttgcctggtggcagggtcatttcgatccgctggtagcaggcctggcgcttgtcaccgccgggctgctgcaaatcctctctaatctcgccaatgattacggcgatgcggtaaagggcagcgacaagcctgaccgtatcgggccgctgcgcgggatgcaaaaaggggtgattacccaggcacagatgaaacgggcgctgattatcaccgtggtattgatttgcctgtccgggctggcgctggtgacggtcgcgtcgaaaaccaccagtgatttcattggcttcctggtgctgggcttgcttgccattattgcagccattacctataccgtcgggacgcgtccttacgggtatattggtctgggcgacatctccgtgctggtgttcttcggctggctgagcgtgatgggaagctggtacttgcaggcgcatacggtgatacctgccctgttcctgccggcgaccgcctgcggtctgctggcgacggcggtgctgaatatcaataacctgcgcgacatcgacagcgaccgcgagaacggtaaaaacacgctggccgtgcgtctgggtcctgtgaatgcacgccgctatcacgccttcctgctcatcggcgcgctggtctgcctggcactgttcaatctgatctctctgcacggcctgtggggctggctgtttgtgctcgccgcaccgctgctgattaagcaggcccgctatgtcatgcgtgaactcagcccggccgctatgccaccgatgctggaacgtacggtaaaaggcgcgttactgactaacctgctgttcgtcatcgggattgtcttaagccagacgctgagttag

SEQ ID NO: 4332 - DNA, 873 bp, Enterobacter cloacae
acattactcttttgcaggattccgattatgagtcagacatcaaccttaaaaggccagtgcattgccgagttcctgggtaccgggttgttgatattcttcggagtaggctgtgtcgctgcactgaaagtggcgggtgccagttttggtcagtgggaaatcagtattatctggggtctgggcgtggcgatggccatctacctgaccgcaggggtttccggcgcacatcttaacccggcggtgaccatcgcgttgtggctattcgcgtgctttgacggacgcaaagttgttcctttcatcatttcgcaatttgccggcgccttttgcgcagcggcgttagtttacgggctttattacaatcttttcatcgacttcgaacagacgcatcatatggtgcgtggcagtgtcgaaagtctggatctggcaggcattttctcaacgtatccgaatccgcatatcaattttgtgcaggcgttcgcagttgaaatggtgattaccgctattctgatgggcgtcattatggcgctgggcgacgacggaaacggcattccgcgcggcccgctggcaccacttctgattggccttctgattgcggtgattggcgcatccatgggtccgctgaccggttttgcgatgaatccggcgcgtgacctgggtccaaaaaccttcgccttctttgcgggatggggcgatgtcgccttcacgggcggcaaagacattccttacttcctggttccgctgttcgggccaattgtaggggcggcgctgggcgcattcggctatcgcaaattaattggtcgccacttaccgtgcgacacctgtgtggaagaggaaaaagagacaacttccaccacacaacaaaaagcttcgctgtaa

SEQ ID NO: 4333 - DNA, 1530 bp, Enterobacter cloacae
tctgactacgggacacataccatgaccgaaaaaaaatatatcgttgcgctcgaccagggcactaccagctcccgcgctgtcgtaatggatcatgacgcgaacattgtcagcgtgtctcaacgcgaatttgagcaaatttatccgcgtccaggctgggttgaacacgacccgatggagatctgggcgtcacaaagctccacgctggtggaagtgctggcgaaagccgacatcagttctgaccagattgccgctatcggtatcaccaaccagcgtgaaacgactgtggtctgggagcgcgaaaccggtaagcccatctacaacgccatcgtctggcagtgccgccgtacgtcagagatctgcgaacagctgaagcgcgacgggatggaagagtacgtgcgcagcgccaccggcctggtggttgacccctatttctccggcaccaaagtgaagtggatcctcgaccacgtggaaggttcacgcgagcgcgcacgtcgtggcgagctgctcttcggtaccgtcgatacctggcttatctggaagatgactcagggacgcgttcacgtcaccgactacaccaacgcctcgcgcaccatgctgttcaacatcaacactctggagtgggatgacaagatgctggacgcgctggacattccgcgagcgatgctgccagacgtgcgtaaatcttcagaagtgtacggccagaccaacattggcggtaaaggcggcacgcgtattcctatcgccggtatcgccggtgaccagcaggcagccctgttcggccagctgtgcgtaaaagaagggatggcgaagaacacctacggcaccggctgctttatgctgatgaacacgggcgagaaagcggtgaaatcagaaaacggtctgctgaccaccatcgcctgcggcccgcgcggcgaagtgaactatgctctggaaggcgcggtattcatggcgggtgcctccattcagtggctgcgcgacgagatgaagctgattagcgacgcgtttgactccgaatacttcgcgaccaaagtgaaagacaccaacggcgtgtacgtggtgccagcgttcaccggtctgggcgcaccgtactgggatccgtacgcccgcggcgcgattttcggcctgacgcgcggcgtgaactcaaaccacatcattcgcgcgacgctggaatccatcgcctaccagacgcgcgacgtgctggaagcgatgcaggctgactctggcattcgtctgcacgccctgcgcgtggacggcggtgcagtagccaacaactttctgatgcagttccagtccgacattctgggcactcgcgttgaacgtcctgaggtgcgagaagtgacggcgctgggcgcggcgtatctggcaggtctggcggttggcttctggcaaaacctcgacgagcttcaggaaaaagcggttatcgaacgcgaattccgtcctggcatcgaaaccaccgagcgcaactaccgctacagcggctggaagaaagcggtgaaacgtgccctggcgtgggaagagcacgacgagtaa

SEQ ID NO: 4334 - DNA, 1026 bp, Enterobacter cloacae
ttgtacgagtacctcatgaaacgtgaacttgctatcgagttttcccgcgtcaccgaagctgccgccctcgcaggctacaagtggctgggccgtggcgacaaaaataccgcagacggcgcagccgtccacgccatgcgcattgtgcttaatcaggttaacatcgacggcactatcgtcatcggtgaaggcgagatcgacgaagcgccgatgctctacatcggtgaaaaggtcgggaccggcaaaggcgatgcggtggatatcgcggtcgacccgatcgaaggcacgcgcatgacggcgatgggccaggccaacgcgctggcggtactggcggtgggcgataagggctgcttcctcaacgcgcccgatatgtacatggaaaagctgatcgtcggtcctggcgctaaaggcgctatcgaccttagtctgccgctggacgccaacctgcgcaatatcgctgcggcgctgggtaaagcgctcagcgaactcaccgtgaccattctggcaaaaccgcgccacgacgccaccatcgcgtacctgcaaacgcttggcgtgcgcgtatttgctattccggatggcgacgttgccgcctctattctgacctgcatgcctgacagcgaagtcgacgtgctttacggcatcggcggcgcgccggagggtgtggtctctgcggcagtgatccgcgcgctggacggcgatatgcaggcgcgtctgctgccacgccatgaggtcaaaggcgacagcgacgagaaccttcgcattggtgcagacgaactggcgcgctgcgcggcgatgggcatcgaggccaataaagtgctcgcgctaaacgagatggcccgcagcgataacgtggtcttctccgcaaccggcatcaccaaaggcgatctgctggacggcatcacccgcaagggcaacatggccaccactgaaaccctgctgatccgcggtaaatcccgcactattcgccgcattaagtccattcattatctcgatcgtaaagatccggacgtacagacgcacattctgtaa

SEQ ID NO: 4335 - DNA, 774 bp, Enterobacter cloacae
aagagagaaacagcacaggagaagatcatggcggactgggtaacaggtaaagtcacaaaggtacagttctggaccgatgcgctatttagcctcacgctgcacgctcccgttcatccgtttactgccgggcagtttgccaaactcgggctggatatcgacggtgaacgcgtacagcgcgcctactcttacgttaatgcgcctgataacccggaccttgagttctatctggtcaccgtcccggacggtaagctcagcccgcgcctcgccgcgctgaagccaggcgatgaagtgcagattgtctccgacgcggcggggttcttcgtgctggatgaaatccccgactgtgacacgctctggatgctggcgaccggcacggccatcggcccgtatctttccattctgcaatacggcaaagatctggagcgctttaaaaatatcgtgctggttcacgccgcgcgctacgccgcagacctgagctatttgccgcagatgcaggcgctggaacagcgatatggcggaaagttaaaaattcagacggtggtcagccgcgaaaccgcagctggctcgttaaccggtcgcgttccggcgttgattgaaagcggcgcgctggaagaggcggtgggtttaccgatgaataccgaaaccagccatgtgatgctgtgcggtaacccgcagatggtacgcgatacgcagcagttgctgaaggatacccggcagatgacgaagcaccttcgccgtcggccgggccacatgaccgccgaacactactggtga

SEQ ID NO: 4336 - DNA, 1272 bp, Enterobacter cloacae
ggagctttgcgcatgaccactcaacttgaacaagcctgggatctggctaaacagcgtttcgccgccgtcggcgtggatgtcgaagaggcgctgcgccagctcgatcgtctgcccgtctccatgcactgctggcagggtgatgatgtcgccggtttcgagaacccgggcggttccctgacggggggtattcaggccacgggtaactatcctggcaaagcgcgcaacgccaccgaactgcgtgcggatctggagctggcgctgagcctgatccccgggccaaagcgcctgaacctgcacgccatttatctcgaatccgatgagccggtcgcgcgtaacgaaatcaaaccggaacactttacgaactgggtggcgtgggcgaaagccaaccggctgggtctggattttaacccgtcctgcttctcgcacccgctgagcgcggacgggtttacccttgcgcatgccaacgatgaaatccgccagttctggatcgaccatgtcaaagccagccgccgcgtctcggcttattttggcgagcagcttggcacgccatcggtaatgaatatctggatcccggacggcatgaaggacatcaccgtagaccgactggccccgcgtcagcgcctgctggccgcgctggatgaagccatcagcgagaagctggacccggcgcaccacatcgacgccgtcgagagcaagctgttcggcattggcgcagagagctacaccgtgggctcaaacgagttctacatgggttatgccaccagccgccagaccgcgctgtgcctggatgccggccacttccacccaacggaagtcatctccgacaagatctccgccgccatgctctacgtgccgcgcctgctgctgcacgtcagccgcccggtgcgctgggacagcgaccacgtggtgctgctggatgacgaaacccaggccattgccagcgaaatcatccgccacaacctctttgaccgcgtacatatcggcctcgacttcttcgacgcctccatcaaccgcatcgcggcgtgggttatcggcacccgtaacatgaagaaagccctgctgcgcgcgctgctggagcctgtcgccgccctgaaacagctggaagaaaacggcgactacaccgcgcgcctggcgctgctggaagagcagaaatccctgccgtggcaggcggtgtgggagatgtactgccagcgtcacgatgcacctgcgggcagccagtggctggataacgtgcgggcgtatgagaaagaggttcttgccgctcgtcagtaa

SEQ ID NO: 4337 - DNA, 927 bp, Enterobacter cloacae
aaaacatcgcccggcggcgcgttgcttgccgggcctacagataagaccaggccgggtaagcgtaacgccacccggcattttcaaaggaactacagtatgcagaccatcaccacctcctggttcgtccagggcatgatcaaagccacctccgacgcctggctgaagggctgggatgagcgcaacggcggcaacctgacgctacgcctggacgacgcggatatcgagccatttgcctccgatttccaccagaagccgcgctatatcgccctgagccagccgatgccgctgctcgccaacacgccgtttatcgtcaccggttccgggaagtttttccgcaacgtacagctggacccggaagccaacctcggcgtggtgaaggtggacagcgacggcgcgggttaccacattctctggggactgacggacgacgcggtacccacatccgaactgccggcgcacttcctctcccactgcgagcgcattaaggcgaccaatggcaaggaccgcgtaatcatgcactgccacgccaccaacctgatcgccctgacctacgtgctggaaaataattctgatttcttcacccgcaaactgtgggaaggcagcaccgagtgtctggtggtgttcccggacggcgtcggcattctgccgtggatggtgccgggtaccgacgaaatcggccaggcgaccgcgacggacatgcagaagcactcactggtgctgtggccgttccacggcgtcttcggcagcggcccgacactggatgaaaccttcggcctgatcgacaccgccgagaaatccgcggaggtgctggtgaaggtctattccatgggcggcatgaagcagaccatcacccgggaagagctgattgccctgggcaaacgctttggcgtcaccccgatgcagtcggcgttagatctgtaccaataa

SEQ ID NO: 4338 - DNA, 1272 bp, Enterobacter cloacae
attgcaggtggtggcagcctgcgtgattggcgggatcagcaccatgggcggcaccggccgcgtgctcggctgtctgttcggggcgctgttccttggcgtcatcaacaacgccctgccggtgatcggcgtctccccgttctggcagatggcgatttccggctcggtcattgtcatcgctgtgctgctgaacgagcgcggcaacaagcgcaaaggcaggctgatcctgcgcgacgcggcgctggcacgtcagaaactggcggtgaaaccatgagtaaaatgatgacatctgaagagttcaaacccacttctgcgccgggcatcttccagcgtctgctgtgctgggagggcttcctgctggcggtgacgctggcggtatttgtggtgaacgcgctcgcctcgccctacttcctcaatatctggaacctctccgacgcgacgttcaacttcacggaaaaagcgatcattgtgttgccgatggcgatgctgattatcgcccgggaaattgacctgtcggtggcctccaccatcgcgctcagctcgacggtgatgggcttttgcgcggcggcgggcgtcgatacgccactgctggtgtgcgtgggattaggcgtcgggctactgtgcgggttgttcaacggcattctggtgacgcgctttaacctgtcgtccatcgtcatcaccatcggcaccatgagcctataccgcgggatcacctacatcctgctcggggaccaggcgctgaacagctacccggagagctttgcctggttcggccagggctacgtctggggcgcgttgtcgtttgagttcgcgctgtttatcgtcctggccgctctgtttgcctttgtgctgcaccgtaccaactttggccgccgcacctacgccatcggcaacaacccgaccggcgcgtggtactccggcatcaacgtgaagcgccacaacctgatcctcttcgcgctggtggggctgatgtccggcctggcgtcggtgctgctcacctcgcgtctgggcagcacccgtccgaccatcgcgatgggctgggagctggcggtggtgacgatggcggtgctcggcggcgtcaatattctcggtgggtccggcagcatggtgggcgtgattatcgccgccttcctgatggggctggtgaccttcggcctgagcctgctcaacgtgcccggcattgtgatgtcggtgattatcggcgcgatgctgatcgtggtgatttcgctgccgattattacccgccggattatgcagcgaagacggatctcatag

SEQ ID NO: 4339 - DNA, 342 bp, Enterobacter cloacae
ggtccgcgagctgtacctggaggctttatgatccgcaaagcgtttgtgatgcaggtaaacccggacgcgcacgaggagtacgcgcgtcgccacaacccgatctggcctgagctggaggcggtactgaaagcccacggcgcgcaccactacgccatttacctcgacaaagcccgcaacctgctgtttgcgacggtggagattgaatcggaggagcgctggaatgcggtggcaaacaccgatgtctgccagcgctggtggaaacatatggctgacgttatgccgtctaaccctgacaacagcccggtgagtgcggcgctgaacgaggtgttttacctggactga

SEQ ID NO: 4340 - DNA, 930 bp, Enterobacter cloacae
atgagtattcgcataatcccgcaagatgagctggggtcgagcgagaaacgtacggcggagtatattccgccgttgttattccccagactcaagaacctctacaaccgccgcgcagagcgtctgcgcgagctggcagagaacaacccgctgggcgattttctgcgttttgccgcgctggtcgcccatgcgcaggaagtggtgctgtacgaccatccgctgcaaatggacctgaccgcacgcatcaaagaagccaacgaacagggcaagccgccgctggacattcacgtcctgccgcgcgacaagcactggcataagctgctgcattcgctgattgccgagctgaagcccgagatgagcggcacggcgctggcggtcattgagaacctggaaaaagcctcagagcaagagctggaagagatggcgagcgcgctgtttgcttccgacttctcgctggtgagcagcgataaagcgccgttcatctgggctgcgctgtcgctctactgggcgcaaatggcgagcctgatcccaggcaaagcccgcgccgaatacggcgaagcgcgccagttctgtccggtgtgtggttcaatgccggtctccagcatggtacagattggtacgacacaggggctgcgctacctgcactgcaacctgtgtgaaaccgagtggcacgtggtgcgcgtgaagtgcagcaactgcgagcagacccgcgatctgaactactggtcgctggaaaacgaagacgcagcggtgaaagccgaaagctgcggcgactgcgggacttacctgaagattctgtatcaggaaaaagacccgaaagtcgaagcggtggccgacgatctcgcctcgctgattctggacgccaaaatggagcaggagggctttgcccgcagctctatcaacccgttcctgttcccgggtgaaggggagtaa

SEQ ID NO: 4341 - DNA, 954 bp, Enterobacter cloacae
agctgtacattcatacagttaaaaggtgttttcatggcactggaaaagggtattgaacggctggttcaaggatttatcgctgcaggtcgcccctcatcgcgtcgccagacaattgaggtacgacgagcaggctatattgccagcacggagcttgccgggaagaccgaaacgcgcgttcagctggagacgcttgttcttgagggtcttaccattcgggtattttcacctctcaatgcgcctgaaatattgcctgctgccatctactaccacggcggatgttttatcagcggcggctttgatacccatgacaaccagctccgtcagttagcctactacggcaattgccgggtgattgcgattcagtacagactggcgccggagcataccttccccgccgcacatgacgatgctgaaagaggtgcgaatctggtctggcagtatgcagacgaattaggcgtggataagaaccgactcaccctctgtggagacagcgcaggagggcatttggcgctggtaacgtcattgcggcttaaggcaaaagggctctgggatcccgcgcagctcattcttatctatcccatgctcgacgctacggccagtcttgaaagctataccctcaatggcatggattacgtgattactcgcgatacccttttgagcggctatgaaatgtatctggctggagccgaccgtcagcatcctgaagtcagtccactgtggcgcaacgactttagcggtctgccgaaggtccatattgttaccgctgagtatgatccgttacgtgacgaaggcgaggcgctttatcagcgcctcacggcgcaaggcgtgaagtgtaccgctcaacaatggcggggtgtaattcacggcttcttccagttgggtggaattagccagtcagcgcgagacattatgcgagatattgcctggcgcattaaccatgccgggcgagagtga

SEQ ID NO: 4342 - DNA, 903 bp, Enterobacter cloacae
caggagagaggcatgtcagcaatcgcatttatcggcttaggacagatgggcgcgcccatggcgaagaatctgttgaaacagggccaccagcttaacgtctttgacgtaaacccgcaggcgattcaggcgctggttgaaagcggcgctcgggcggcggcaacgcccgcgcaggcagcaacggacgccgaattcgtgatcaccatgctgccaaacggcgacctggtacgcagcgtcctgttcggcgagcacggcgtgtgcgaagggttatcccgcgacgcgctggtcattgatatgtccaccattcacccgctgcaaaccgacgcgctgatacgcgacatggctgagcaaggcttcagcctgatggacgtgcctgtcgggcgcacctctgaccatgccatcgccggcacgctgctcctgctggcaggcggcacggcccagcaggttgagcgcgccaccccggtcttaatggcgatgggcaatgagctgattaacgccggcgggccaggcatgggcatccgcgtgaagcttatcaataactacatgagcattgccctgaacgccctttccgccgaggccgccgtgctgtgcgaagcgcttggcctctcctttgacgtggcgctcaaggtcatgagcggtacgcctgcgggtaaaggccacttcacgacatcctggccgaacaaggtgctgaaaggggatctttctcccgccttcatgatcgaccttgcgcataaagacctggggatcgccctcgacgtggccaaccagctccacgttccgatgccgctgggcgcggcctcccgcgaagtttacaaccaggcacgcgccgccgggcgcgggcgcgaggactggacggccattcttgaacaggttcgcgcatctgccgggctgaaaaaatcacactga

SEQ ID NO: 4343 - DNA, 1434 bp, Enterobacter cloacae
ggatcgaccatgacacataatactgatccgttaaccctgaaattgagcctgcgagagaagtgcgcctatgggatgggcgattttggctcgaatctgatgctgtgtattggcacgctgtacctgctgaagttttacaccgatgaactgggcatgccggcgttctatggcggcattattttcctcgtcgcgaagtttttcaccgcgtttaccgacatgctgaccggggtgctgctggactcccggcgtaacatcggcgcgcgggggaaattccggccattcattctctacgcctccgttcctgtggcgctggtggccacggcgcagtttatggccaacgactttagcctgacggtgaaaacggccctcgccaccgtgctcttcatgatgtttggcctctgctacagcctgatgaactgtgcctacggtgcaatggttccggccatcaccaaaaacccgaacgagcgcgcgcagcttgcggcgtggcgtcagggcggcgcaacggtagggctgttgctctgcaccgtcggctttatgccgatccaggcgctgttcgtcagccagccctcactcggctatctggtggccgcgctggtgtttgtcaccggggggctgttctgcatgtggtggtgctacagcggggtgaaagagcgctacgtcgagcttacgcccgatcaccataagcccggcattctgaaatcgttctgcgcgattttccgtaacccgccgctgctggtgctgtgcatcgccaacctatgtaccctcgccgcgtttaacatcaagctggcgattcaggtctattacacccagtacgtgctgaacgatgtgcatctcctgtcgtggatgggctttttcagcatgggctgcattctgattggcgtgtttctggtgcctggcgcggtgaagcgctttggcaagaaaccggtctatctgggcgggctgacgctgtgggcggtgggcgacgtgctgaacttcgtctgggggaccagttccctgctgttcgtgctcttttcctgcatggccttcttcggcacggcgtttgttaatagcctgaactgggcgctggtgccggataccgttgattacggcgagtggaaaaccggcattcgcgccgaagggtcggtgtataccggctataccttctcgcgcaaaatctccgccgcgctcgccggtttcctgcccggcatcatgctgacccagattggctacgtaccccatgccgtgcagagcgcgggcacgctgcttgggttgcgtcagcttattttcctctggccgtgcggcctggcgattgttgccgccgtgaccatggggctattttataaactcaacgaagcgcgcttcgcctttattatcgaggagattggaaaacggaagaaacagacagcaaatacccctgagataaccaccaacaataaagcgtcagcagtcactttataa

SEQ ID NO: 4344 - DNA, 1431 bp, Enterobacter cloacae
aaaataaaggtgacgtttatgcaacgagggatagtctgggtagtcgatgacgatagctccatccgttgggtgcttgaacgcgcgctcacaggagcgggattaagctgcacgacgtttgagagcggcagcgaggtgctcgacgcactcaccaccaaaacgccggacgttctgctctcggatattcgcatgccgggcatggacggactggcgctcttaaagcagatcaaacagcgccaccccatgcttccggtcatcataatgaccgcccactccgacctggatgccgccgttagcgcctaccagcagggggcgtttgattatctgccaaaaccgtttgatatcgacgaagccgttgccctggtcgaacgcgccatcagccactatcaggagcaacagcagccccgccacgcgccggatttcgggcctacgacggacatcatcggtgaagcgccggccatgcaggacgtgtttcgcatcatcgggcgtctgtcgcgctcgtctatcagcgtcttgattaacggtgaatcagggaccggtaaagagctggttgcacacgccctgcatcgccacagcccgcgggcgaaagccccctttatcgccctgaacatggcagcgatccctaaggatttaattgaatctgagctgttcggccacgaaaaaggggcgtttaccggagccaataccattcgtcagggacgctttgaacaggctgacggcggcacgcttttcctggatgaaatcggcgatatgccgctggatgttcagacccgactgctgcgcgtgctggcagatggccagttttaccgcgtgggcgggtatgcgccggtgaaggtggacgtgcgtattattgccgcgacgcaccagaacctggagctgcgcgtgcaggaggggaaattccgtgaggatttattccatcgtctgaacgtgatccgtgtccacctgccgccgctgcgcgagcgtcgggaagatatcccgcgtctggcgcgccatttcctgcaagtggcggcccgcgagctgggcgtggaagccaagcagcttcatcaggaaacggatgccgccctcacccgtctggcgtggcctggcaacgtgcgtcagctggaaaacacctgtcgctggctgaccgtgatggccgccggacaggaagtgttgattcaggatctccccgccgagctgtttgaagccaccgtgcccgaaagcaccgccggacatgcgctgccggacagctgggcgacgctgctggcgcagtgggcagatcgcgcgctgcgttccggtcatcaaaatctgctctccgaagcgcagcctgagatggagcgcacgctgttaactaccgcgcttcgtcatacccagggccacaaacaggaagcggctcgcctgttgggatggggtcgaaacaccctgacgcgcaagctgaaagagctgggaatggagtga

SEQ ID NO: 4345 - DNA, 303 bp, Enterobacter cloacae
tgcgcggatctttccagctctcgtggtggaagacacaaagcgctgatggcgaccgaaggcgtgaacattgaatttaccgatgacggtatcaagcgcatcgcccaggccgcgtggcaggtcaacgaaaccaccgagaacatcggtgcgcgtcgtctgcacaccgtgctggaacgcctgatggaagacatctcttatgatgcgagcgaccttaacggtcaaagcattaccattgacgcagactatgtgggcaaacacctggatgcgttagtggcagatgaagatctgagccgttttattctataa

SEQ ID NO: 4346 - DNA, 615 bp, Enterobacter cloacae
cggccaggggcaatgttgatgaaaagttcggcacactctctttatttgtgtttagcgatgctgagcgccagtttttccctgtacgccacggaaacggcttccccggtcaccgccccctatcttctggcgggcgctccctctttcgatcaatctatcagccagttccgcgaagccttcaacaaagaaaacccctcacttccgttgggagagttccgagcgattgacagcgcccgcgatacgccgaccctgacccgcgcggccagcaaaattaacgagaatctgtatgcctctaccgcccttgagcgcggaacgttaaaaatcaaaagcatgcagatcacctggctgccgattcagggcccagagcagaaagcggcgaaagcgaaagcgctggagtacatgagcgctattctgcgcgcctttacccccaccttcacgaaagcacaaagccagcaaaagctgcaaaaactacttaccgcggggaaaaacaaacgctattacgccgatacggaaggtgccgttcgctatgtcgtcgcagataacggcgaaaaggggctgaccttcgcggttgaaccgattaagctggccctatcagacgcactcgagggggcgaattaa

SEQ ID NO: 4347 - DNA, 783 bp, Enterobacter cloacae
gcgtggagaattgaaatgcgacatcctttagtgatgggtaactggaaactgaacggcagccgccacatggtaaacgaactggttgctaacctgcgtaaagagctggctggcgtgaccggctgcgcggttgctatcgctccgccggatatgtacctggatctggctaaacgtgccgctgacggcagccacatcattctgggcgcgcagaacgttgacgttaacctgtctggcgcgtttaccggtgaaacctccgctgaaatgctgaaagacatcggcgcgaaatacatcatcatcggccactctgagcgtcgcacctaccacaaagaatctgacgagttcatcgcgaagaaattcgctgtgctgaaagagcagggtctgatcccggttctgtgcatcggtgaaaccgaagcagaaaacgaagcgggtaaaaccgaagaagtgtgcgcacgtcagatcgacgctgtgctgaaaacccagggcgcggcagcgttcgaaggcgcggttatcgcttacgagccagtctgggcgatcggtacaggcaaatctgcaacccctgcgcaggcacaggcggtgcacaagttcattcgtgaccacattgcaaaagcagacgcgaaagtggcggagcaggtcatcatccagtacggcggttccgttaacgcatcaaacgcagctgagctgttcacccagccagacatcgatggcgcgctggttggcggcgcatccctgaaagcagacgctttcgcggtgatcgttaaagcggcagaagcggctaagcaggcgtaa

SEQ ID NO: 4348 - DNA, 1434 bp, Enterobacter cloacae
agacggtcatccctggttcaaaaccctgcgtggtcgtggttatctgatggtttccgcttcatgataggcagcttaaccgcccgcatcttcgccatcttctggctgacgctggcactggttttaatgctcgttttgatgttgccaaaactcgactcacgccagatgacggagctactcgacagcgagcaacgtcagggcgtgatgatcgagcagcacgtggaagcggagctggcaaacgatccgccgaacgatttaatgtggtggcgcaggttgtttcgcgctatcgacaagtgggcgccccccggacaacgtcttttactggtcaccagtgaaggccgcgtgattggggccgatcgcaatgaaatgcagattatccgcaactttattggccaggcggataacgccgatcacccacagaaaaagaaatatggtcgggtagagatggttggtcctttctcggttcgggacggggaagacaattatcagctctacctgattcgccctgcgagcagttcccagtccgacttcatcaacctgctgtttgaccgtccgcttttgctgttgattgtcacgatgctggtcagttccccgctgctgttatggctggcgtggagcctggcgaaaccggcgcgtaagctgaaaaatgcggcggacgaagtggcgcagggcaacctgaggcagcatccggagctggaatccgggccgcaggagttcctggccgccgggaccagttttaaccagatggtgagcgcgctcgatcgcatgatgacggcccagcagcgcctgctgtcggatatctcgcacgaactgcgtaccccgctcacgcgcttacagctgggtaccgccctgctgcgtcgccgcagcggagaaagcaaagagctggagcgcatcgaaaccgaagcgcatcgtctggacagcatgatcaacgatctgctggtcatgtcgcgcaatcagcagaaaaacgcgctggtgagcgaaacggtgaaagccaatcatctgtggcatgaggtgctggacaacgcggcgtttgaagcggagcagatgggcaaatccttcaccgttaacttcccgccggggccatggccgctgtacggtaaccccaacgcgctggaaagcgcgctggaaaatatcgtgcgtaacgccctgcgctactcgcacacgaagattgaggtggcgttctcggtggataaagacgggatcaccgtcatcgtcgacgacgacggtcctggcgtcagcccagaagaccgcgagcagatattccgtccgttctaccgcaccgacgaggcgcgcgaccgggaatcgggcggtacgggactggggctggcgattgtggaaaccgccatgcaacagcaccgtggctgggtgaaagccgatgacagcccgctgggcgggctcaggttaacgctgtggctgccgctgtataagcgttcgtaa

SEQ ID NO: 4349 - DNA, 1707 bp, Enterobacter cloacae
atttttgacagcaaaccgcgcaaaagctgtcggtttttcaagaaacaggcggaaagatcgggaaatgcggtcagcgtcacactgcctgcaaaccccgccattactggaaactgtgaactccctcacgttcatctttgctttcttgccagcgcgagatttgggctgtcagtggcgagaaggtggctatttcttccctttcttacactcctcgctaatgacttaagaaaggacccgaccatgacttttcgccattgtgtggctgtcgatttaggcgcatccagcggccgtgtaatgctcgccacctgggactgcgacctgcacacccttacgcttcgcgaaatgcaccgtttcgccaattgtctgcaaaaacaggacggttttgttacctgggatatcgacgccctggaagcagagatccgcaccggacttcacaacgtctgcgaagacggtattcgcatcgacagtatcggcattgatacctggggtgtggattacgtactgctggaccgtcacggcgaacgcgtcggcctgcccgtctcctaccgcgacagccgcaccgatgggctaatggcgcacgccatcgcccagcttggcaaggagaacatctatggtcgcagcggcattcagtttctgccgtttaacacgctgtatcagctgcgcgcgctggttgagcaacagccagagctggtcgaaaaggtggcgcatgcgctgctgatcccggactacttaagctaccgtctgaccggcaacatgaactgggaatacaccaacgccaccaccacgcagctggtcaacatcaacaccgataactgggatgaacatctgctggcctggacgggcgcctcgccgtcctggtttggcgcgccaacccatccgggcaatgtgatcggccactggctttgcccgcaggggaataaaatccccgttgtcgccgtcgccagccacgacaccgcgagcgcggtcattgcctcgccgctcgccggcaaagatgcggcctacctctcatccggcacctggtcgctgatgggctttgagagcaaaacgccctacaccagcgatgccgcgctggccgcgaacatcaccaacgaaggcggtgccgaagggcgctaccgggtgctgaagaacatcatgggcctgtggctgctccagcgggtgctgaaagagcagaacatcaccgacctgcccgagcttatcgccgaaaccgaaacgctgaaggcctgtaccttcctgattaacccgaacgatgaccgctttatcaacccggcgcacatgagcgccgaaatccaggccgcctgttttgaagcggggcagccggtaccttcccgccccgccgagctggcacgctgcatttttgacagtctcgccctgctgtatgccgacatcctgagcgagctggctgaccttcgcggcaaaccgttcacacaactgcatatcgtgggcggcggctgccagaaccagctgctgaaccagctctgcgcggatgcatgcggcattaccgtggtggcaggtccgattgaagcctccacgctcggcaatatcggcattcagctgatgaccctggacgaactgtccaacgtcgacgatttccgttcggtggtgacggcgaataacagcctgaccaccttcaccccccatccctgccatgaaattgcccgctaccgggcgcagtttcagcaaaaacgactgactaaggagctttgcgcatga

SEQ ID NO: 4350 - DNA, 1083 bp, Enterobacter cloacae
atctgtaccaataacaacatcgcgccccgctcaccgagacggggcgaaaaccacctgcaatccctacaactaactcaagtcagtggagtaaaagcaatgaaaataaaagcaagcttgatcctcaccgttgccgctctggcgttgtccggttccgctttagcagaagtgaaaatcgccctggtggcgaagtccttagggaatggattcttcgaggcagcgaacgtcggcgcgcaggaggcggccaaagagttaggcgatgtaaaagtgatttataccggcccgaccaccaccacggcggaagcgcagatcgaggtgctgaacgggctgatcgcccagggcgtggatgcgatcgcaatttccgcgaacgatccggacgccgtcgtgccggtgctgaaaaaagcgatgcagcgcggcattaaggttgtgtcgtgggattccggggtggcgaaagccgggcgtcagatccatctcaacccgtccaataacgccctgattggcgaaaccaacgtcaagctcgccgccgatgccctgaaagcgctgaacgtggagaagggcgaagtagcggtgctgagcgccacgccaacctccaccaaccagaacacctggattgcggagatgaaaaaggtgctgccgaagtacccgtccgtcaatctggtgaccgtggcctacggagacgatctctctgacaaaagctaccgcgaagcggtcggcctgctgaaaacctacccggagctgaaagtcatcgtctcgccgtcgtccgtgggcattgtggctgccgcgcaggcggtgaaggaccagggcaagattggcaaagtgtacgtcaccggtttaggcctgccgtctgagatggcgggcgcggtgaaatccggcgcgagcaagagctttgccatctggaacccgattgacctgggctatgccgcgacttacttagcggacgatctggtgaaaggcacggccacgaaaggtgaggccagcatgggcaaactgggcaaagtgaagctggatgcggacggcaacggcgcgatggccgagccgttcgtctacgatgccagcaatattgataagttctcgaaaatcttttga

SEQ ID NO: 4351 - DNA, 1521 bp, Enterobacter cloacae
accaaacggagaactatcatgaccccattgctacagctttctggcatcaccaaggtgttccccggcgtacgtgctcttgagaacgtgcagcttgcgctgtggcccggcaaagtgacggcgcttatcggcgaaaacggcgcgggcaagtcgacgctggtcaaagtgatgaccggcatataccagcccgacgagggcgaaattctctacaaggcgatccccgttcaccttccaacgccggagtcggcgcataaaatgggtatcaccgccatacaccaggaaaccgtcctgtttgatgaactctcggtcaccgaaaatatctttgttggtcagtaccttcacaaaggcttcctgaaaaagctcgactggccggaaatgcaccgccgggcgcaggctattctcgcccgccttgaggtgcaaatcgacccgcgcgcaacgctgaaaaccctaagcatcgcccagcgtcacatggtggcgattgcccgcgcgctgtcgtttgaggcgcaggtggtgatcctcgacgaacccacggcggcgttgtcgcagcatgaaatcctcgagttttaccagattgtggagcgcttaaagcaggagggaaaagccatcctgtttatctcccacaagttcgacgagatttttgagctggccgatcactacaccattttgcgcgacggcgtgttcgtcggtgcaggggcaataaatgagatcaccgaggagcggatggtgtcgatgatggtcgggcgcgccattacccaaaccttcccgaaaatcgactgcgaaaaaggcgagacggtgctggaggtgcaaaacctctgccatccgaccgagtttgcgcatatctcgttctccctgcgtaaaggggaaatcctcggcttttacgggctggtgggtgccgggcgtaccgaattgatgcaggcgctttccggcgtcacgcggccatcgtccggggaaattatcctcaacggacagccccggcgcttccgccagcctgcggatgcgatcaaagccggtattgtctgcgtgccggaagaaaggcagaaacagggggcgattatcgccctgccgattgcccagaacatcagcctgcctcagcttagcacgctcaatccgaacggcgtgctgcatgacgaccgtgaatggaaactggcgaacgagtacgccaaacgcctgcaagtgaaagccttcagctggaagcaggcggtggagaccctctctggcggcaaccagcaaaaggtggtgatcggcaaatggctggcgacgcaccctgacgtgatcatcctcgatgagccaacaaaaggcatcgatatcggctcaaaggcagccgttcatcagtttatgtccgagctggtcagtcaggggctggcggtgattatggtctcgtccgaactaccggaagtgatgggcatggcggatcgcattatcgtcatgcacgaggggctgatggtggccgaataccaggcgggagacgcgacggcggaaaccatcgtcagcgccgccagcggtgcaaaacaggaggcggcataa

SEQ ID NO: 4352 - DNA, 1005 bp, Enterobacter cloacae
atgcttagctcactcttaaaacaccgcgaagccctgctgggcgcggtgattatcctgatgatcgtcgccattggcagccgcgtgccatcgtttatcgcgccgggcaacctggtggagatgtttaacgacaccgccattctgatcgtcctcgcgctcgggcagatgatggtgctgctcactaaaggcatcgacctgtcgatggcggccaatctggccctgaccgggatgattgtcgccctgattaacttccattacccggacgtgcccgtctgggcgctgctgatcctcgccagcgcgcttgggctgctgatgggcgcgataaacggcctgcttgtgtggaagctgggcattccggcgattgtggtaacactcggcaccatgagcatctaccgcggaatgatctttttgctctccggcggcggctgggtgaactccaaccagatgggtgcagacttcctcggcctgccgcgtgcgtcagtgctgggcctgccggtgctgagctggtgcgccatcgccgtactgctgctggtgggctacttcctgcgctacagccgcaccggacgggcgctctacaccgcaggcggtaacgccacggcagcgtactacaccgggatcaacgccgggaaaatgcagttcatcagcttctgcctttccggtctgctggccgggttctgcggctacctgtggatatcgcgctttgccgttgcgtatgttgacgtcgctaacggttttgaattgcaggtggtggcagcctgcgtgattggcgggatcagcaccatgggcggcaccggccgcgtgctcggctgtctgttcggggcgctgttccttggcgtcatcaacaacgccctgccggtgatcggcgtctccccgttctggcagatggcgatttccggctcggtcattgtcatcgctgtgctgctgaacgagcgcggcaacaagcgcaaaggcaggctgatcctgcgcgacgcggcgctggcacgtcagaaactggcggtgaaaccatga

SEQ ID NO: 4353 - DNA, 1164 bp, Enterobacter cloacae
ttaaggagaattatcatgagctttatgttggcactccccaaaatcagcctgcacggcgcgggcgcgatcggcgatatggtcaatctggtggcaaacaaacagtggggaaaagcgctgattgtcaccgacggtcagctggtgaagctgggcctgctcgacagcctgtttaccgcgctcgacgcccatcagatgtcgtatcacctgttcgatgaggtattcccgaatccgacggaagcgctggtgcaaaaaggctatgcggcatatcaggatgcggagtgtgattacctgattgcctttggcggcggcagcccgattgataccgccaaggcaatcaaaatcctcaccgccaaccccggtccgtcaaccgattactctggcgtcggcaaggtgaaaaacgcgggcgtgccgctggtggcgatcaacaccaccgcaggcacggcagcggagatgaccagcaacgcggtgatcattgacgccgcacgacaggtgaaagaggtgattatcgacccgaacatcatcccggatatcgccgtggacgatgccagcgtgatgcttgatattccggcctccgtgaccgccgcaaccggcatggatgccttgactcacgccattgaagcttacgtgtccgtcggcgcgcacccgctgaccgatgccaacgcgctggaggcgattcgcctgatcaacctctggctgccgaaagcggtcgacgacggtcacaacctggaagcgcgcgagcagatggcttttggtcagtatctggcgggcatggcgtttaacagcgccggtctggggctggtgcatgccctggcgcaccagccgggcgcgacgcacaacctgccgcacggcgtgtgcaacgccattctgctgccgatcatcgaaaactttaaccgcccgaacgcggttgcccgatttgcccgcgtggcgcaggcgatgggcgttgacacgcgcggcatgagcgatgaagcggccagcatgtcagccattcaggcgattcgcgacctgagcgcccgggtcggcattccgtccggatttagccagctcggcgtgaccaaagccgatattgaaggctggctggataaagctctcgccgacccgtgcgcgccgtgtaacccgcgcaccgccagccgcgatgaggtccgcgagctgtacctggaggctttatga

SEQ ID NO: 4354 - DNA, 666 bp, Enterobacter cloacae
aatggtatgaagaatcacctctcttgcctgaaaggcgacacgataaaagcgatcgtcctggtctgcctcgcggtgggcgtggtcggcatgtcttatggctcactggcgatggcctacggtttcccgctgtgggtgccgtttgtcctctccctcacggtgctggcaggcgcatccgagtttatgtttattggcatcgtggcaagcggcggcaatccgctggcagcggccgcggccggtttactggtaaacgcacgccatgtgccgttcggcgtaacggtgcgtgacctggtgggcaagcgcggcctgagctttctgggctgtcatattatgaacgatgaaagcgtggtgttcggcctttcgcaaaaaaccgccgagcagcgtaaagcggcctactggctgtgcggcctgggcgtggcaattatctggccgctgggggcggtactgggggcgatggtcggcaagctgctgccagacccggaaaccatcgggctggacgcggtgttcccggcgatcctgctggcgttagtggtgccggcatttaaaaaccgtaccacgctgatccgcgcctgtagcggcgcagtgttgtcgctggccgccgtaccgtttgcgccggtgggtctgccggtactgctctctttgctcggccttgccgcgaggaaaaaataa

SEQ ID NO: 4355 - DNA, 657 bp, Enterobacter cloacae
agagaaagacgaggtgcgcaaatgagaaaacgtgacaccatcgtgcgctacaccgcgccggaacgtatcaaccactgggtcaccgccttctgcttcatgctggcggcgataagcgggctggggttcttcttcccgtccttcaactggctgatgcagatcatggggacaccacagctggcgcgtatactgcacccgtttgtgggcgtcatcatgttcgcgtcgttcatcatcatgtttttccgttactggcaccataacctaatcaatcgggatgatatcttttgggcgaagaatattcgtaagatcgtcgtcaacgaggaagtaggtgatactgggcgttataacttcggccagaaatgcgtattctgggcggcgattatcttcctggtcctgttgctggtgagcggcgtgatcatctggcgtccgtactttgcgcctgctttctcaatcccggtgatccgatttgcgctaatgctgcattcatttgccgcagtggcgttaattgtggttatcatggtgcatatttacgccgccctttgggtgaaaggcaccattaccgcgatggtggaaggctgggtcaccaaaacgtgggcgaagaaacatcacccgcgctggtaccgtgaagtccgccagaaacaggaaaagtcatctgaatga

SEQ ID NO: 4356 - DNA, 1287 bp, Enterobacter cloacae
gatcgtcgacgaaatgatggctcgccgttaagaaaggatccgaacatgaaatggtttaacaccctgagccataaccgctggctcgaacaagagaccgaccgcattctcgatttcggtaaaaacgccgccgtaccgaccggctttggctggctgggcaataacgggcaggtgcgtagcgatatgggcacacatctgtggatcaccgcccgcatgctgcatgtgtacgcggtggcggcgaacatggggcgccccggcgcgtacgccctggttgagcacggcattaatgccctgaacggtccgctgcgcgacaagcagcacggcggctggtacgcctgcgtaaacgatgaaggcgtgattgatgcgtccaagcagggctatcagcatttcttcgttctgctgggcgcggcgagcgccgtcaccaccggccatccgcaggcacgcaagttgctggacgacgccatcgaggtgattgagcgctacttctggagcgaacaggagcagatgtgcctggagtcctgggacgaagccttcagcaaaacggaagactatcgcggcggtaacgccaacatgcacgccgtggaagctttcctcatcgtttatgacgtgacccacgaccgcaaatggctcgaccgcgccctgcgcatcgcctcggtgattattcacgacgtggcgcgcaaaggggagtaccgcgttaacgagcattttgacaccaactggaacccgatccgcgactataacatcgataaccccgcccaccgcttccgcgcctatggcggcacgcctgggcactggattgagtggggccgcctgatgctgcacctgcgcgccgccctggaagcgcgctttgaaaccccgccggagtggctgctggaagatgcgaaaggactgttccacgccaccatccgcgacgcctgggcacccgacggggcggacggctttgtctactccgtgggctgggacggcaagccaatcgtgcgcgaacgcgtgcgctggccaatcgtcgaggcgatgggcacggcctatgccctctataccgtgaccggcgaggcgcagtacgaagcctggtatcagaaatggtgggattactgcatcaagtatctgatggattacgaaaacggatcctggtggcaggagctggacaccaacaacgaagtgaccaccaaagtctgggacggcaagcaggatatttaccatctgctgcactgcctggtgatcccccgcctgccgctggcaccgggcttagcgcctgccgtcgccgccggattactggatagccaggccaaataa

SEQ ID NO: 4357 - DNA, 1050 bp, Enterobacter cloacae
atggcaactggcacgctgcccgatgctgggcagatcctcaattctttgattaacagtattttgctggtcgacgacgagctggcggtgcattacgccaacccggcggcgcaacagctgctcgcccaaagcgccagaaaactgtttggcacgccgctgccggaactgctgagctatttctcgctgaatattggtctgatgcaggagagtttgcaggcgggtcagggcttcaccgataacgaagtgacgctggtgattgacggacgctcgcatattttgtccctcaccgcacagcgcctgccagatggcatgattctgctggaaatggcgccgatggataaccaacgtcgtctcagccaggagcagcttcagcatgcgcagcagattgcggcgcgcgacctggtgcgcgggctggcccatgagatcaaaaacccgctgggcggcttacgcggtgcggcacagcttttgaccaaagcgctgcctgaccctgccctggcggagtataccaacgtcattattgagcaggcggaccgtctgcgtaatctggtcgatcgcctgctcgggccacagcagccggggatgcatgtttcagaaagcattcacaaggtcgcggagcgggtggtgaaactcgtctctatggagctgccggataacgtcacgctggtgcgtgattacgacccaagcctgccggagctggcgcacgatccggaccagattgaacaggtgctgttgaacattgtgcgtaacgcgttgcaggcgctgggcccggagggtggcgaaattattctgcgtacccgcaccgcgttccagctgacgctgcacggcgtgcgttatcgtctggcggcacgtattgatgtggaagataacgggccggggatcccgccgcatctccaggacactctgttctacccgatggtcagcggtcgcgaaggcggcaccgggctggggttatccatagcccgaaatttgattgaccaacactccggcaaaattgaatttaccagttggccgggacataccgagttttcggttttcctgccgattaaaaaataa

SEQ ID NO: 4358 - DNA, 1485 bp, Enterobacter cloacae
actacggcggttgtcgcggcgacagaagtggctgcgcacccgaatgatggcccgcaacgggaccagaacgggccgccgtatacgaacgcgacaccaacggaaggagtgagcatgtctgtaccatctatcgactgggatttggccctgatccagaaatataactattccgggccgcgttatacctcataccccaccgcgctggagttttctgacgctttcggcgaggcggattttcagcatgctgtggcgcgctatcccgagcgcccgctgtcgctctacgtccatattccattctgccataagctctgctacttctgcggctgcaataaaatcgttacccgccagcagcacaaagccgatcaatacctcgatgcgctcgaacaggaaattctgcaccgcgcaccgctgtttaaagggcgtcacgttagccagcttcactggggcggtggtacgccaacctatctcaataaagcgcagatcagccgcctgatggcgctgctgcgcgacaatttcagttttaacgacgacgccgaaatttcgatcgaggtcgatccacgtgaaatcgagctggatgtgctggatcatttacgcgctgaaggcttcaaccgcctgagtatgggcgtacaggacttcaataaagaagtacagcgcctggtaaaccgcgagcaggacgaagcgtttatctttgccttactcaaccatgcgcgtgaaatcggctttacctcaacgaatatagacctgatttacggcctgccgaagcagacgccggagagcttcgcctacacgcttaaacgcgtggctgagcttaacccggaccgtctgagcgtctttaattacgcgcacctgccgacgctgttcgccgctcagcgcaaaatcaaagatgcggatctgccttccgcccagcagaagctggacattttgcaggagaccatcgcctcgctgaccgaaaccggctatcaatttatcgggatggatcactttgcccgccctgacgacgaactggcaattgcccagcgcgaaggtgttctccaccgtaacttccagggttacaccacccagggcgataccgatctgctcggaatgggcgtctccgccattagcatgattggcgactgctacgctcagaaccagaaagagctgaagctgtactaccagcaggttgatgaaacgggtaacgcattgtggcgcggcattgcgttaacgcgtgacgactgcatccgtcgtgatgtgattaaggcgcttatctgcaacttccgtctcgaattccgcgaggtggagtcgcaatgggatctgcaattcagcgattactttgccgaagacctgaaactccttgcgccgctggcgaaggacgggctggtggatgtgtcggaaagcgcggtggtcgtcacgccgaaaggacgtctgttgattcgtaatatctgcatgtgcttcgatgcctatctacgtcagaaggcgcgtttacagcagttctcgcgggtgatttaa

SEQ ID NO: 4359 - DNA, 969 bp, Enterobacter cloacae
cgttttagaggtaaaaagcgcgtgagatcaggttgttggtggagaaaaaagcccatccgaagatgggctaaagtttccacggcaactactcccgacgcgtatgcgccgggtaaaacaaatcaattaaacgctgtagtacagttcgaactcaaccgggtgcggcgtcatgcgaacgcggtcgttttcttcagtacgcagcgcgatgtaagcgtcgatagcttcatcggtgaacacgccgccagcggtcaggaactcgcggtctgcgtccagcgcttgcagggcttcttccagagagccggcaacctgtgggatctctttcgcttcttctggcggcaggtcgtacaggtttttgtccatggcttcgcccgggtggatcttgttcttgataccgtccagaccggccatcagcagtgctgcgaagcacaggtatgggttagccgccgggtccgggaagcgcacttcgatacgacgcgctttcggagacgcaaccaccgggatacggatagaagcagaacggttacgggcagagtacgccagcatcacgggtgcttcgtagcctggaaccagacgcttgtaggagttcgtggtcgggttcgccagggcgttgatcgctttagcgtgtttgataacaccgccgatgtagtgcagcgcctgctcagacagacccgcatacttgtcaccagagaacaggttggtgccgttcttggacagggacatgtggcagtgcatgccggaaccgttgtcgccaaacattggttttggcatgaaggtcgcggttttaccgaaacggtgcgcaacgttgtgtacaacgtatttgtagatctgaatctcatccgcttttttggtcatggtgttgaagcgggtagcgatctcgttctggccagccgttgccacttcgtggtggtgcgcttcaacaaccaggcccatctcttccatgatcagacacatggtagaacggatgtcctgtga

SEQ ID NO: 4360 - DNA, 570 bp, Enterobacter cloacae
agaatcgaccggaggaaccgggaagtaaccgcctttcacgcctggacggtgacctttgttaccaccttcgtacttggtggaagagttccatgcgccttcgatgtcatcgatagcgacgtgggagccagaaatggaagcaccaaaacggatgtcgtcgaacaggaagaactctggctctggcccgaacagaacggtgtctgcgatgccggtagagcgcaggtactcttcagcgcgttttgcgatggagcgtgggtcacggtcatagccttgcagcgtgccaggttccagaatatcgcagcggatgatcagcgtaggttcttcgtagaacgggtcaatgagcgcagtggttgcatctggcatcagaaccatgtcggattcgttaatgcctttccagccgccaatggaggagccgtcaaacattttgccttcttcaaagaattcggcgttcacctgatgagcagggatcgtgacgtgctgttctttacctttagtatcggtgaagcgcagatcaacaaacttcacttcatgttcgttcagcatcgtcaaaacgtgttcagcggacatacttaa

SEQ ID NO: 4361 - DNA, 654 bp, Enterobacter cloacae
ctaaagtttctctttcccgctacagttacttctccacggcgaaaggagataaacatgctttatatctttgacttaggaaatgtaatcgtcgatatcgattttaaccgggtgttgggcgcatggagcgattttagccgtgttccgctggcgacgttaaagcagaatttcgcgatgggtgagactttccatctgcacgagcgcggtgagatcagcgatgaagcgttcgcagagcgtttctgtcaggaaatgggtctttcgttaagctacgagcagttttcccacggctggcaggccatatttgtcgcgatccgcccggaagtgatcgacatcatgcacaagctgcgcgagcaggagcatcgtgttgtcgtgctgtctaatactaaccgcctgcataccaccttctggccggatgaatacccggaaattcacgcggcggcagataaagtgtatctctcccaggagatggggatgcgtaaacctgaggcgcgcatctatcaggcagtattgcaggaagaaggattcacggcagcggatgcggtcttttttgacgacaacgccgataatatagaaggggctaatcagttaggtatcacctccattctggtgaccggaaaagagacgataccgaactactttgcgaagcagttatgctaa

SEQ ID NO: 4362 - DNA, 1092 bp, Enterobacter cloacae
gcgctgtcgccaacaggacatgaatacacaaaccggacgattcgctgcggatatgcaggtttcgctggtgaacgatggccccgtcacattctggctccaggtatgagccaactggcggtatggccgcgggtaacaagagagagtacagctatgtatcaccttcgagtaccgcaaacggaagaagaattagacgcttattaccatttccgctgggaaatgctgcgcaaaccactgcatcaaccgaaaggctctgaacgcgacgcctgggacgcgatggcgcaccaccagatggtggttgatgaagagggcaacctcgttgccgtgggacgtctgtacatcaatgccgacaacgaagcttcaatccgctttatggccgttcatccctccgtgcaggacaaaggccttggaacgctgatggcaatgacgctggaatccgttgcccgtcaggaaggggtcaagcgcgtcacctgtagcgcccgcgaagatgccgttgagttctttgccaagcttggtttcgtgaatcagggggaaatcaccgccccgcaaactacgccgattcgtcactttttgatgatcaaacccatcgccacgctggacgatattctccatcgcgccgactggtgcgggcagctccagcaggcgtggtatcagcacataccgctcagtgaaaaaatgggcgtgcgtattcagcagtataccggacaaaaatttatcaccaccatgccggaaaccggcaaccagaacccgcaccataccctgtttgccggcagcctgttttcactcgccacgctcaccggatggggactgatctggctgatgctgcgcgaacgtcatctcggcggcaccattattctggccgatgcccatatccgctacagcgcgccgatcagcggcaagccgagcgcggtagctgacctgggcgcactgggcggcgatctcgaccgtctggcgcgtggacgtaaagcacgcgtacagatgcaggttgagctgttcggcgatgaaacgccaggcgcggtgtttgaaggcacctatatcgttctgcctgcgaagccgtatggcgcgtatgaagagggtgggaacgaggaggagtag

SEQ ID NO: 4363 - DNA, 1401 bp, Enterobacter cloacae
atggctgatgcaggcgggtattgcgctgccgattctggatccggaaaccaccattctgattggtgtggaacgcgtgtaagggtgacgggccgggcaaccggccctccgttgaggataaaaataatgaacacaacaacctgtacccacaaagacaaccctaacttctgggtcttcgggctgttcttctttctctacttcttcatcatggccacctgttttccgttcctgccgatctggctgtcggacatcatcggcctgaacaaaacccatacggggattgttttctcctgcatctcgctgtcggccattgccttccagccggtgctgggggtcatttcggacaagctggggctgaaaaaacatttgctttggatcatttcggtgctgctgttcctgttcgcgccgttcttcctgtacgtcttcgccccgctgctgaaaaccaatatctggctgggggcgctgagcggtgggttgtatatcggctttgtcttctcagcgggttcgggggcgattgaggcctacattgaacgcgtgagccgcaacagcttttttgagtacggcaaggcgcgcatgttcggctgtctcggctgggggctgtgcgcctcaacgggcggcatcctgttcggcatcgatccgtcgtatgttttctggatgggatcggcggcggcgctgttgctaatgctgctgctggtggtcgcgaaaccgaagcccaaccagacggcgcaggtcatgaacgccctgggcgcgaaccagcggcagatcactgctaaaaccgtgttcaacctgttccgccagcgcagaatgtggatgttcatcctgtacgtgattggcgtggcctgcgtatatgacgtcttcgaccagcagtttgctaccttcttcaaaaccttcttcgccacgccgcaggaggggacccgcgcctttggtttcgccaccacagcgggggaaatctgtaacgcgatcatcatgttctgctcgccgtggatcattaaccgcatcggtgcgaaaaacacgctgctgattgccggggtgatcatggcgacgcgcattatcggatcgtcgtttgccaccaccgccgtggaggtgattgccctgaagatgctgcacgcgctggaagtcccgttcctgctggtgggggcattcaagtacatcaccggggtgtttgatacgcgcctgtcggccaccatctacctgattggcttccagtttgccaaacagtcggcggcgatcttcctctccgcctttgccggaaatatgtatgaccgggtcggcttccaggagacgtatctgatactgggctgtttcgtgctggcgatcacggtggtgtcggcgtttacgctgagtggcaggcgggagattgctgctaccgctggggcagcagcgttaacacatcagtccaggtaa

SEQ ID NO: 4364 - DNA, 879 bp, Enterobacter cloacae
tgtccggttattcgccgtagaggttgtggtgtggctgctcagctcattcttcgcaaagatgatttttttgcctccgcgagtcaggccgtcgcggtggccgaccgctacccgcaaaacgtcttcgccgagcacacccacgagttttgcgagctggtgctggtgtggcggggcaatggcctgcacgtcctcaacgaccgtccctaccgcatcacgcgcggagacctgttctacatccgcgctgaagacaaacactcctacgcctcggttaacgatctggtgttgcagaacgtcatctattgccccgacagacttaaactgaatgtcgactgggcgggcaatatccccggttttcataatgccagaggcgaaccgcactggcgcttaagcagcaacggcatggctcaggtgcgccagacgatttcccagctggagcaggagagccagaagagcgatccggcggctaaccagatgtcggagctgcttttcgcccagctggtgatgaccctgaagcgccatcgttacgctacggataatccctctgccaccatgcaggaagcgctgctggataagctcatcacccggcttgcgggcagtctgaacaagagtttcgtgctggacaaattctgcgagcaggagcagtgcagcgagcgcgcgctgcgccagcagttccgcacccagacggggatgacggtaaaccactatctgcgccagctgcgcatctgccacgcccagtacctgttacagcatacggagctgatggtgagtgaagtggcgatgcgctgcggctttgaggacagtaactacttctcggtggtgtttaaccgtgaggtggggatgacgccggttcagtggcgtcatcgcagtcgaaaggcagcgtaa

SEQ ID NO: 4365 - DNA, 654 bp, Enterobacter cloacae
cagctgtgccgcccgacaataatggagaggattatgagttatacactgccatccctgccgtatgcctacgacgcactggaaccgcatttcgacaagcagacgatggaaatccatcacactaaacaccaccagacctacgtgaacaacgcgaatgctgcgctggaaagcctgccagagttcgctaatctgcctgttgaagagctgatcaccaaactggaccagctgccagcagacaagaaaaccgtgctgcgcaacaacgcgggcggtcacgctaaccacagcctgttctggaaaggcctgaaaaccggcaccacccttcagggcgacctgaaagcggctatcgagcgtgacttcggttccgttgacaacttcaaagcggaattcgaaaaagccgctgcaacccgtttcggctctggctgggcgtggctggttctgaaaggtgacaaactggcggtcgtttctaccgctaaccaggattccccgcttatgggtgaagctatctctggcgcatccggcttcccaattctgggtctggacgtgtgggaacacgcttactacctgaagttccagaaccgtcgccctgactacatcaaagccttctgggacgtggtgaactgggacgaagcagcagcgcgtttcgccgctaaaaaataa

SEQ ID NO: 4366 - DNA, 705 bp, Enterobacter cloacae
ctcgctttttttgtatctgaaggagtggagatgcattacccggtgaatgtgtttacaggcaaggtaagggagtacgaaggcagccgcccgagtgccatcgccaaagtgcaggtcgacggtgagctgacgttgaccgatctcgggcttgcgggtgaccagcaggctgaaaagaaaatccacggcgggcccgatcgcgcgctgtgccactatccgcgcgagcactatcagcactggaaaaccgaatttcctgaacaggctgacctcttcgtcgcccccgcgtttggcgaaaatctctcaacggaggggctgacggagaagaacgtctttatcggcgatatttaccgctggggcgatgctttgattcaggtcacccagccgcgctcaccgtgctttaagcttaattaccatttcggcattcaggatatgtcggcccagttgcaaaacgcgggtaaaaccggctggctgtatcgcgttgtgcaggcgggacaggtttcggcggatgcgccgcttgagctggcttcgcgtttgagtgaggtgtcggtgtacgaggcctgcgcaattgcctggcatatgccgtttgatgacgatcagtatcaccgtctgctgtcagcggcgggattatccaccagctggaccagaacgatgcagaagcggcggataagcggcaagatcgagagcagttcgcggagattatgggggaaatag

SEQ ID NO: 4367 - DNA, 603 bp, Enterobacter cloacae
ctttacgttgttttacaccccctgacgcatgtttgcagcctgaatcgtagactgtctctcgttgaatcgcgacacgaaagattttgggagcaagtgatgcgcaaagttaccgctgccgtcatggcctcaacgctggccttcagtgcgtttagccaggctgctgtagctatcatcagcgataacggttcctcagcagagggcgcaacgcagcacagcagccaaagccatatgtttgacggcataagtttaaccgaacatcagcgtcaacagatgcgagatctgatgcagagggcaagacacgaccagccccctgttaatgttagcgaaatggagacaatgcatcgccttgtcaccgcagaaaattttgacgaaagcgctgtacgcgctcaggccgaaaacctggcgcaggaacaggttgcccgccaggtaaagatggcgaaggttcgcaaccagatgttccacctgctaacgcccgagcagcaagcggttttgaataccaaacatcagcaacgtatgaaccagttgcgtgaggttgcacggatgcagcgaagctcagatatgacgcttttcagtagcaatagcagtacccgtagtaaccagtaa

SEQ ID NO: 4368 - DNA, 909 bp, Enterobacter cloacae
cgccatggcatgacaggagtgtttatgaatcaatcctatggacggctggtaagccgggccgcaatagccgcgacggtgatggcgtcgtgtttactgatcattaaaattttcgcgtggtggtacaccggatcggtcagtattctggcggcgctggtggactcactggtggatattgccgcctcgctgaccaacctgctggtggtgcgctactcgctgcaaccggcggatgaagagcatacgtttggccacggcaaagcggaatcgctggccgcgctggcacaaagcatgtttatttcgggctctgcgcttttcctgtttttgaccggcattcagcatcttgtttcgccgtcaccgatgaacgatccgggcgttggcgtggtcgtaacggtagttgcacttataagcacacttgttcttgtaactttccagcgctgggttgtacgcaaaacacaaagccaggctgtacgggccgatatgcttcattatcagtctgatgttatgatgaatggggctattcttattgcgcttggtctggcctggtatggctggcatcgggccgatgcgttgtttgcgttagggatagggatctatattttatacagcgccttgcggatggggtatgacgcggtacagtcgcttcttgaccgtgcgcttccggatgcagaacgtgatgaaatttatgccatcgtgaccaactggcccggcgtcagtggtgctcacgatcttcgtacgcggcagtcagggccgacccgctttattcagattcatttggaaatggaagacaacctgccactggttcaggcgcatatggtcgctgaacaggtggagcaggcgattttgcagcgtttccctgggtcagacgtcattattcaccaggacccatgctctgtcgtacccagggcgttttga

SEQ ID NO: 4369 - DNA, 282 bp, Enterobacter cloacae
aagacggtcacgaagcagcacaaaccaaagagcgagaaacctatgctttcaccgcaggctgagctggatttgctggagaacgatgagcgcctggacgcgctgctggaacgtcttgaagagggtgaaaccttgaccgccgaagagcagtcatgggtggatgccaaactggatcgcatcgacgagctgatgcagaagctgggtctgtcttacgatgacgaagacgacgaagaagaagacgaaaagcaggaagatatgatgcgtcttctgaagggtggaaactaa

SEQ ID NO: 4370 - DNA, 948 bp, Enterobacter cloacae
acatttggtgaaattaaaatgaaggcatcagaaatcgcagaaggaatcaccatgactcgcatcgtttgtgtcggcattaccgtgctggatcgcatctggtatctcgatgatttaccgaaagaaggtgggaaatatgtcgcaaaagactatacggaagtgggcggcggcccggcggcaacggcggcagtggcagccgcgaaactgggcgcggaagtggattttattggccgggtgggggacgacgataccggcagacggctgctcgcggagctggaatccctgggggtgaatacccgctacacgcgcgtagttaagggagcccgatcgtcgcaatcggcggtgctggtggacggcagcggggagcgtgttatagcgaactattccagccccgatctccctgcggtggcagactggctgcaagaaatcgacttctcgcagtgggatattgtcttagccgatgtgcgctggcatgacggggcaaaacaggcatttaccctggcccgtcagcagggcgtaccgacgttgcttgatgcggatgtcaccccgcaggacatcgcggagctgatcgccctaagcgaccacgcggccttctccgcgccgggattgcggcgtttaacgcagcgggatgacaccgaagacgcgctgaaaaaagcacaaacgctcacaaatggacatgtgtatgttacgcaggggcgagacggctgcttctggctggaaaacggcgcattgtgtcatcagcccggctttgaggtgaacgtggtggataccaccggggcgggcgacgtgttccacggtgcgctggcggtcagcctggggcagaaattacccgccgcagacgccgtgcgttttgccagcgccgtcgcagcactgaaatgcacaaagcccggcgggcgcgcgggtatacccgactgtgatcaaacccgctcttttttgtcactttttgtataa

SEQ ID NO: 4371 - DNA, 462 bp, Enterobacter cloacae
aaaacaacaagaagcagaccaaccatgattgcattgattcagcgcgtaacccgtgccagcgtcaccgtggcggatgaggtgacgggtgaaattggcccaggacttttggtgctcctgggtgtcgaaaaagatgacgacgaacaaaaagctaaccgcttatgtgagcgcgtgctgggctaccgcattttcagcgatgcggaaggcaagatgaacctgaacgttcagcaggcgggcggcagcgtgctggtggtttcccagtttacgttggctgcggataccgaacgcggcatgcggccgagtttttcgaagggcgcggcaccggagcgcgcagaagctctatacgagtactttgttgagcgctgtcgccaacaggacatgaatacacaaaccggacgattcgctgcggatatgcaggtttcgctggtgaacgatggccccgtcacattctggctccaggtatga

SEQ ID NO: 4372 - DNA, 1062 bp, Enterobacter cloacae
ggcgctggagcccgatacgcacgcgctgctggtggcggaacaaaactaaagaagatacggaaaatcatgtcgcttaaagccattgccaaagaactggggctgtctgttaccaccgtcagccgcgccctcaacggatatgacgacgtttctgctgagacgcgcgcccgcgtggaagcggaggcccagcgccgtggctaccgaccaaatacctttgcccgtcgcctgaagatgggcaaaatcgacgccgtcgggctggtatttccggtgcatcctgttccgctcaataacagcgtttttatggacatggtcggcgaaattagccacgaactggcgcgacatgagattgacctgctgctcatcgctgacgacgatctggcggacaaacacagctatatgcgcatggtgcagagccgacgcgtggatgcgctgatagtggcgcatacgctggatcacgatccgcgtcttgagcagcttcaggccgccgggtttccgtttctggcgctaggccgcagccagctcccgcagccgtacgcgtggttcgatttcgacaactatgccggtacgtatcaggccacccgctggctgatcgagaaaggccatcagcgcattgcgctgctgggcgaaagcaacaaccaggcattcatcacccagcgccgccagggctacctggacgcgctgcgggaagccggactttccagcgaatggctgcgcgccatgcctccttcgcgccgcgtgggttatgccaccacgcaagaacttctctccctgccgcagccgcccacggccatcattaccgactgcaacacccacggcgacggcgcagcgatggccctggcgcagatgggacgcttaaccggtgaaaatgccgtctcgctggtggtctatgacggcttaccgcaggacagcattgtcgatatcgacgtcgcggcggtgatccagtctacccgtcagggcgtcgggaaacagattgccgatatggtgcgccagctgattaacggcgacgacattgacacccttcaggtgctctggcagccagaattctccccaggccagacggcctaa

SEQ ID NO: 4373 - DNA, 2229 bp, Enterobacter cloacae
tcacacgaaaaattccaaacccgatcacagatccgaaacgttttggtttgtatccgaaacgtttcggatcaaaactcaggacatcccgatgacaggagatgtccgatgcaagatgccatttttcgacttgaaagcaatacggttgacgtggtgctaaaaacccacccgttcgccgaaattctctactgggggccgcaccttcagcacttctcgccgcaggatgtcctgagtattgcgcgcccggttgctaacggcaggctggacgtcgactcccccgtcacgctgatggcagagctggggcatgggctgtttggctcgccgggcatcgaggggcatcgccaggggctggacggatcgccggtatttaaaaccacgcaggtgcagcaggcgttaaacgccctgacaatcactgctgaagacgagcatgcaggcttgcgcctgaccagtgaaataacgctggatgccagcggcgtactggtggtgcgccatgggttaaccaacctgaaaacgctggcgtggcaggtggatcgctttgccgtgacgctgccggtggccgaacgcgcgcaggaggtgatggccttccacggacgctggatcagggagtttcagccgcaccgcgttacgcttgagcacgacagcttcgtgattgaaaaccgccggggtaaaacctcccacgaacatttcccggcactgatttcaggtacgccgtcattcagtgaaatgcacggccacgtctggggtgtgcatctgggctggagcggcaaccaccgcctgcgcgcagaggcgaaaaccgatggccgccgttatatgcaggccgaagcgctctacctgccgggtgaaatggcgattgaagagggggaaacgctctggacgccacgcctgtatgccagccactccccgcacgggctgaatggcatgagccagcagttccaccgctacctgcgcgataacgttatccgcttcccggaagataaaccgcgcccggtgcatctcaacacctgggaggggatttacttcgaccacgatccggactacatcatgcgcatggccgacgaggccgcagcgctgggcgtggagcgctttatcattgacgacggctggttcaaaggccgcaacgacgaccacgccgcgctgggcgactggtatctggacgagaaaaaatacccgaacggccttaagccggtgatcgatcacgttaaacagctcggcatggagtttggtatctgggttgagccggagatgattaacccggattccgatctgtaccgcgcgcaccctgactgggtgctggcgctgccgggctacgcccaggcgaccgggcgacaccagctggtgctcaatcttaatattcctcaggcctttgattatctggtcgagcgcatgagttggctgctgggcgaacacgcggtcgactacgtgaaatgggacatgaaccgcgagctggtgcagccagggcacaagggcaaagccgccgccgacgcccagacgcgccagttttatcgcctgctggacgtgctgggcgagcgtttcccgcacattgagtttgaatcctgctcctccggcggcgggcgaatcgattatgaagtgctgacccgctgccaccgcttctgggcgtccgacaataacgacgcgctggagcgcaacactatccagcgcggcatgagctacttcttcccgccggaggtgatgggggcgcatatcggtcatcataaatgtcacgctaccttccgccagcacagcattcagttccgcgggctgacggcgctgtttggtcacatggggctggagctggatccgctcaccgtcgacgcgcaggagcgtgaaggctatcgacattacgccgcgctgtataagcggtggcgcggggtcattcatcacggcacccagtggcgcgtggatatgccggacgccaccaccctggcgcagggtatagtgagcgaagacaagacgcaggggctgtttttggtcagccagctcgcgatgccggattacaccctgatgatgccgctgcgcatgccggggttagacgccagcgcgcagtaccgcatcacgctgctcgatcacccgaacattcagattacgggcgagggcgggcacaccatgcgcaagctgccggcgtggatggacgcgccgcaaacggtaagcggtgaatggctgatgcaggcgggtattgcgctgccgattctggatccggaaaccaccattctgattggtgtggaacgcgtgtaa

SEQ ID NO: 4374 - DNA, 1095 bp, Enterobacter cloacae
attaccaccatatggcctgacctgaatcaattcagctggaagggattgatatactatttgcagtattcgacggttgaacagtttcttccggcagcagatttcaattttgcattcctaagttcagaggtagtcatgattaagaaaatcggtgtgttgacaagcggcggtgatgcgccgggcatgaacgcggcaatccgtggggttgtccgtgcagcgctgacggaaggtctggaagtttttggtatctatgacggttacctgggtctgtatgaagaccgcatggttcagctcgaccgctacagcgtgtctgacatgatcaaccgtggcggtactttcctcggttctgcacgcttcccggaattccgtgacgaacacatccgtgaagtggctatcgaaaacatgaaaaaacggggtctggatgcgctggtggttatcggcggcgacggctcctacatgggtgcaaaacgtctgactgaaatgggcttcccgtgcatcggcctgcctggcaccatcgacaacgacattaaaggcaccgactacaccatcggttacttcaccgcgctgggtaccgttgtggaagcgattgaccgcctgcgtgacacctcttcctctcaccagcgtatttccattgttgaagtgatgggccgttactgcggtgacctgactctggcagcggcaattgccggtggctgtgagttcgtggtggtgccggaagtggaatttagccgtgaagatctggtcgctgaaatcaaagccggtatcgcgaaaggtaagaaacacgccatcgttgctatcaccgagcacatctgtgacgttgacgagctggcgaagtacatcgaaaccgaaaccaaacgcgaaacccgcgcgaccgttctgggtcacattcagcgtggtggttccccaggcccgtacgaccgtatcctggcgtcccgcatgggcgcgtacgcgatcgagctactgcttcagggacacggcggccgctgcgtcggtatccagaacgagaaactggttcaccatgacatcatcgatgccattgaaaacatgaagcgtccgttcaaaggtgactggctggactgcgcgaaaaaactgtactga

SEQ ID NO: 4375 - DNA, 1050 bp, Enterobacter cloacae
tcatcggttagctttctggcacgctgcattcatcaaaacactacacaagagagctgggcgatgaataaatggggcgtggggttaacattattgctggcatcaaccagcgttctggcaaaggacattcagttactgaatgtgtcgtacgatccgacgcgtgaactgtacgaccagtacaacaaagctttcgcggcgcactggaaacaggaaaccggcgataacgtggtggttcgccagtctcacggcggttccggtaagcaggcgacatcggtgatcaacggtatcgaagccgacgtggtgaccctggcgctggcttatgacgtggatgcgatcgcggagcgtggccgtatcgacaaaaactggatcaagcgcctgccggacaactctgcgccatacacctcgaccatcgtcttcctggtgcgcaaaggcaacccgaaacagattaaagactggaacgacctgattaagccgggcgtgtctgtcatcaccccgaacccgaaaagctccggcggcgcacgctggaactacctggcggcctggggctacgcgctgcaccacaacaacggcgatcaggccaaagcacaggacttcgtcaaagcactgtttaaaaacgtcgaagtgctggactccggcgcgcgcggcgcaaccaacaccttcgtcgagcgcggcatcggcgacgtgctgatcgcctgggaaaacgaagccctgctggcgaccaacgagctgggtaaagacaagttcgagatcgtcaccccgagcgaatccatcctcgctgagccgaccgtctccgtcgtcgataaggttgttgataagaagggcaccaaagcggtggcggaagcctacctgaagtacctctactcaccggaagggcaggaaattgcggcgaaaaacttctaccgcccacgcgatgaggccgtcgcgaagaaatacgaaaacgccttcccgaaactgaagctgtttactatcgatgatgtttttggcggctggaccaaagcgcagaaagagcacttctctaacggcggcaccttcgaccagatcagcaagcgctaa

SEQ ID NO: 4376 - DNA, 819 bp, Enterobacter cloacae
gaaatccgccgggttttttatttggtcatcattttgcgttactcttttgcctctattgaaaacagggaacgcgttgtgaaaaaaattatcttactgattctgatcgttatcgcccttgccgcaggcggcgtgtactggatgaaagcgggtaatccgaatgcgttgcgtcatatcgttctcgaccagtgtgtgcccaaccagctgcataaccgtaacccggcaccgtgcgcgcaggtgaagccagatgcgggctacgtggtgttcaaagaccgcaacggaccgttgcaatacctgctgatgcccacgtaccgtatcaacggcactgaaagcccgctgctgacagagccgcagacaccgaatttcttctggctggcatggcagtctcgtcattttatgagcatgaaacgaggggccgacgtgcctgacagcgccgtttcgctaaccatcaactccccgaccgggcgcacgcaaaaccattttcatatccacatctcctgtctgcgcccagacgtgcgcgagaagctgaacgcgtcgcaggggcaaatcagcacccagtggttaccgcttccgggcgggctggaagggcatgaataccttgcccgtcgggtgacggagaacgaactggtgcagcgcagcccgtttatgatgctggcggaagagctgccagaagcgcgcgaccatatgggacgcttcgcgctggcgatggcgcagcagtcagacggctcgtttgtattgctggcgacagagcgtaatttgcttacctttaaccgcgcgtcagctgaggaattgcaggatcatcaatgcgatatcctgaagtga

SEQ ID NO: 4377 - DNA, 1833 bp, Enterobacter cloacae
ggcaaagttgtgatcgaaaaattgcgtaatatcgccatcatcgcgcacgtcgaccatggtaaaactaccctggttgataagctgctacagcagtccggtacgtttgatgctcgtgccgaaactcaagagcgtgtgatggactccaacgatttggagaaagagcgtgggattaccatcctcgccaaaaataccgctatcaaatggaatgactaccgtatcaacatcgttgataccccagggcacgccgacttcggtggtgaagttgagcgcgtgatgtccatggtggattccgtgctgctggtggttgacgcatttgatggccctatgccgcaaacgcgcttcgtgaccaaaaaagcatttgcccacggcctgaaacctatcgttgtgatcaacaaggttgaccgtcctggcgcgcgtcctgactgggttgttgaccaggtcttcgacctgttcgttaacctcgacgcgaccgatgaacagctggacttccctatcgtttatgcgtctgcgctgaacggtatcgccggtctggatcacgaagacatggcggaagacatgactccgctgtaccagacgattgttgaccgcgttcctgcgccaaacgttgacctggaaggcaccctgcaaatgcagatctctcagctcgactacaacaactatgttggcgtaatcggcattggtcgtatcaagcgcggtaaagtgaagcctaaccagcaggtcactatcatcgatagcgaagggaaaacccgtaacggtaaagtcggtaaagtgctgactcacctgggtcttgagcgtatcgagagcgacatcgctgaagcgggcgacatcatcgctatcaccggtctgggtgaactgaacatctccgacaccatctgcgatccgcagaacgtcgaagcgctgccagccctgtccgttgatgaaccaaccgtatccatgttcttcaacgtcaacacctctccgttctgtggtaaagaaggtaagttcgttacctctcgtcagatccttgaccgcctgaacaaagagctggtgcacaacgttgcgctgcgcgttgaagaaaccgaagacgctgatgcattccgcgtttcgggtcgtggtgagctgcacctgtctgttctgattgagaacatgcgtcgtgaaggtttcgagatggcggtttcccgtccgaaagttatcttccgcgaaatcgatggccgtaaacaagagccgttcgaaaacgtaacgctggacgttgaagagcagcaccaaggttctgtgatgcaggcactgggtgagcgtaaaggcgacctgaaaaacatgaatccagatggcaaaggccgcgtacgtctcgactacgtgatcccaagccgtggcctgatcggcttccgttctgagttcatgaccatgacttccggtaccggtctgctgtactccaccttcagccactacgacgacgttcgtccgggcgaagtgggccagcgtaacaacggcgtgctgatctccaacggtcagggtaaagcggttgcgtttgcgctgttcggtttgcaggatcgcggtaagctgttcctgggtcacggtgctgaagtttacgaaggccagatcatcggtattcacagccgttctaacgacctgacggtaaactgtctgaccggtaagaaactgaccaacatgcgtgcgtccggtactgacgaagcaacggttctggttccaccgatcaagatgaccctggagcaggcgctggaattcatcgatgatgacgaactggtcgaagtgacgcctcagtcaattcgtatccgtaaacgtcacctgactgagaacgatcgtaaacgtgcaatgcgcggtgcgaaagaagactaa

SEQ ID NO: 4378 - DNA, 912 bp, Enterobacter cloacae
aatgcacaaagcccggcgggcgcgcgggtatacccgactgtgatcaaacccgctcttttttgtcactttttgtataaaatgcggggcgtgatggttttcagaggacagcccatgagccttaccgaactgaccggcaacccgcgtcacgatcagctgctgacgctgattgccgatcgcggctatatgaacattgatgaactggcgcagctgctggatgtctccacgcaaaccgtgcgccgggatatccgtaagctcagcgagcaggggctgatcacccgtcatcacggcggcgcgggcagggcatccagcgtggtcaacacggcgttcgaacagcgtgaagtctcgcttaccgaagagaaacgggcgattgccgaagcgattgcggactatattcccgacggttcgaccatttttatcaccatcgggacgaccgtggagcacgttgcccgggcgctgcttaaccataatcatctgcgcatcatcactaacagcctgcgggtggcgcacattctttataagaatccgcgctttgaggtgatggtgcccggcggtacgctgcgcccgcataacggcggcattatcggtcctgcggcaacggcgttcgtgtcaggatttcgcgcagattacctggtcaccagcgtcggggcgatagagcacgacggcgcgatgatggaatttgacgttaacgaagccagcgtggtgaaaaccatgatcgctcactcccgtcacattttactggcggccgatcatacgaaataccacgcctccgcggcggttgaaattggcaacgtggcgcaggcgacggcgctgttcaccgatgagctgcccggcccggcgctgcaaaatcacctcaaatccagcaaggttgaggttgtcgaagtcaattccggagaagagcagcaggctggctga

SEQ ID NO: 4379 - DNA, 951 bp, Enterobacter cloacae
tcagttaggtatcacctccattctggtgaccggaaaagagacgataccgaactactttgcgaagcagttatgctaaaaaccgttcatcaaaaagccaatcaccacacgcgcccgctgagggcgtggttgaaactcctctggcatcgcattgatgaggacaacatgaccacgctggcgggcaatctcgcttacgtgtcgttgctctcgctggtgccgctggtggcggtgatttttgcgcttttttcggcatttccaatgtttgccgatgtgagcatgcagcttcgccattttgttttcgcaaactttattcctgccaccggcgatgtgatccagaactacattgagcagtttgtcgcaaactccagcaagatgacggcggtgggggcgtgtgggcttattgttaccgcgctgctgctgatgtactccatcgacagtgcgctcaacaccatctggcggagcaaaaaagtccgcccgaaggtttactcctttgccgtctactggatgattttaacccttggcccattgctggcgggggcaagcctggcgatcagctcctaccttctttcgctgcgctgggcgaccgacttaaacagcgtgatcgataacgtgctgcgtatcttcccgctgattttatcgtggctttcgttctggctgctctacagcgtggtaccaaccacgcgcgtacccaaccgggatgccgtggtgggtgctctggtcgcggcgttgctctttgagctgggcaagaaaggattcgcgctttatatcaccatgttcccctcttatcagctgatttacggtgtgctggcggtgatccccattttgtttgtctgggtctactggacgtggtgtatcgtcttgcttggcgccgaaataactgtcactctcggggtctaccgcgaactcaaaaaagcagcagaagctgaaaaacaacaagaagcagaccaaccatga

SEQ ID NO: 4380 - DNA, 912 bp, Enterobacter cloacae
tccatactatgcgtaaggcctgccgtttgtgttgcaatagcaggctcacttccgtggttgttcaggaataccgttgtgtctaaacaaaaccgtgttgcccacgcgtcgccactgcctgcgggtattgtggaactgtcggtacacagaccgcctcacatttcacatgccacgccggattttctggcggaagaggtccccgttgccctgatttacaacggtatttcgcatgtggtgatgatggcctcgccgaaagatctggagctgttcgccataggtttttccctctcggaaggcatcattgcgcatccgcaggagatctacggcatggatgtggttcatgcctgtaatggtcttgaagtgcaaatcgaactctccagccgccgctttatggggctgaaagagcgccgccgggcgctggccggacgtaccggctgcggcgtgtgcggcgttgaacagcttaacgatatcggcaaacccattatcccgctgccgttcacccagacgttcaatctggcgcaccttgatcgggcgcttgagcacctgaacgacgtgcaacccatcggtcagctcagcggctgtacccacgcggcggcatggatattgccgtcaggcaacattgccggcggtcatgaagatgtgggccgccacgtcgcgctggataagctgttaggtcgccgcgctcgggaaagcaacgtctggcagcagggcgcggcgttagtctccagccgcgccagctatgagatggtgcaaaagtccgccatgtgcggcgtggaaattctgtttgcggtgtcagcggcaaccacgctggcggtggaagtggcggagcgctgcaacctgacgctggtggggttctgcaagccgggtagagcaactatttacacccatccgcagcgattgatagttgatcagtaa

SEQ ID NO: 4381 - DNA, 279 bp, Enterobacter cloacae
ggtctaatatttatctcatcaaggcacggcgccttatctaaacaacttaacgaaagggtttatctcatgaaaagcatcaaaacttttgtcgcagtaatcgctctggctacctcttttggttctttcgctgcgcagacagtgaccgcatccgcctctaccctggatggtgcagaagctaaaatcgctgcacaggctcaggaagcgggcgcgtcatcctacaaaattacccaggcattcaccggtaaccgcgtacacatgaccgctgaactgaacaaataa

SEQ ID NO: 4382 - DNA, 642 bp, Enterobacter cloacae
ccatatcgaacgtatttccattataatgaacgcatcagaaacgttttacaagacgaacgattcgttcgttatagagagaaagaggccgttattatgacgcagccaatcagcgtgatcgccaaaagcctggtacgagaacgcctgcgaaccgggctctcactggcggaaattgcccgccgtgccgggatcgccaaatccacgctttcacaactggagtctggcaacggcaatcctagcctggaaacgctgtggtcgctttgcgtggcgctggatattccgtttgcccggttactggagccgcagcaacccgtcacgcaggtgatccgccgcggcgagggcacaaaagtcgtcgccgggcaggcgaactacgaggcgattttgctcgcggcgtgtccgccgggcgcgcgtcgtgatatctatctgctgctgactcagccgggggcagaccgtatttcccagccccatccgcctggttcggttgagcatattatcgtgacccaggggcgggcgatggtcggtctgatcgacgcggcggaagaactcggcccgggagattacatttgctaccctgctgaccagccgcatatctttaaggcgctggagcccgatacgcacgcgctgctggtggcggaacaaaactaa

SEQ ID NO: 4383 - DNA, 864 bp, Enterobacter cloacae
gaacttttctcattggtgggggccgttatgaccgtactgcacagcgtcgatttttttcctacgggggcttcgccggtcgcgattgagccacggctgcctcaggctgcgttcccggagcatcatcatgattttcatgaaattgtgattgttgagcacggaacgggcatccacgtgtttaacggtcagccgtataccatcagcggcggtacggtgtgcttcgtgcgcgatcacgacaggcacctgtatgaacataccgacaacctgtgcctgaccaatgtgctctatcgttctccggatgcgttccagtttctttccgggctgaatcagctgttgccgcaggagaaggacggccattatccgtcgcactggcgggtgaatcagtccacgttgcagcaggtgcgtcagctggtgagccagatggagcagagcgaggatggacaggagacgcacgccattgctacccgcgagctgctgtttatgcagctgctggtgctgctgcggcgcagcagcctggtggaagggctggaaaataacgacgcgcgcctgaatcagctgatggcatggctggaagatcatttcgccgaagatgtctgctgggaaacgctggcggatgacttttcgctctcgctgcgcacgctgcatcgtcagctcaagcagcataccggcctgacgccgcagcgttaccttaaccgtctgcgcctgatcaaagcgcgtcaccttttacgtcataccgacgaaagcgtcaccgatatcgcctatcgctgcggtttcggcgacagtaaccacttttcgacgctgtttcgccgggagtttagctggtcgccgcgcgatattcgtcaggggaaagacgcgttgcttcagtaa

SEQ ID NO: 4384 - DNA, 1326 bp, Enterobacter cloacae
aaaattctacaggagacaggtatgtcgctctggttaacgcatcctctgctgcttccctcgctgatcgtcggcgtcaccatcgtgctgtgggcgacgtcgctgttgcccgaatttatcaccgcgctgctgtttttcacggcggcgatggccgccagaatcgccccgccggaagtaatcttcggcggcttcgcctcgtctgccttctggctggtgttcagcggctttgtgctgggtgtggcgattcggaaaaccggcctggcggacagggccgcccgggcgctgtcggcaaagcttaccgactcctgggtgctgatggtggcaagcgttgtgctactgagctatgccctggcattcgtgatgccgtcgaacatgggacgtattgctctgctgatgccgattgtcgccgcgatggcgaagcgggccggcattcctgatggctcgcgggcctggtttggcctggcgctggcggtcgggtttggcaccttccagctctcggccactattttgcccgccaacgtgcccaacctggtgatgagcggcgcggcggaaggctcatacggtatccacctcaactatgtcccgtatctgctgctgcacacgccggtgctgggtattctcaaaggcctgattctgattggcctgatctgctggctgttccccggcaacccgaaaccggcgaaggatctcgcgccatcggaaccgatggggcgtgacgaaaaacggctcgcctggctgctggcggtggtgttgacgatgtgggtgacggagagctggcacggcgtgggcccagcgtggacagggctggcggcctcggtcgtcgttatgctgccgcgtataggttttatcaccggggaggagttctcggcgggggtgaatatgcgcacctgtatttacgtcgcgggtatactcgggctggccattacggtgacgcagaccggtatcggtgcggccgtaggcgagacgttgctccatatcatgccgctggatgcagaccgtccgtttaccagcttcctggcgctgacggggatcaccacggcgctcaacttcattatgaccgccaatggcgttccggcgctgtacaccacgctggcgcagagcttctcggacgcgaccggcttcccgctgctgtcggtgatcatgattcaggtgctggggtattccacgccgctgctgccgtatcaggcgtcgccaattgtggtggcgatgggcttagggaaagtgcctgcgaaggcggggatgctgctctgtctggcgctggcgattgcgacgtatctggtgctgctgccgctggattatttgtggtttagcgtattaggacgtttgtag

SEQ ID NO: 4385 - DNA, 501 bp, Enterobacter cloacae
ttaaaacgatatctggtcggcttgtcaaaaggtcacaactccagggtaaaatgcgggctaaacaataataaggaaccttacatgaccatacagcagtggctgttttcattcaaagggcgtattgggcgccgtgacttctggatctggattgcaacgtgggttgtcgccatgctgcttctgttttttgttgcctacaacgcatggctgagcacgcaaaccgcggcatttgcgctggtctgtttactgtggccaaccgccgccgtggtggtgaaacgtctgcacgatcgtggccgctccggcgcatgggctttcctgattatcctggcgtggatgctggtggcggggaactggtcattgctgccctcaatcctcccatgggtggtgggcagactgctgccgacggttatctttgtaatgatggttgtcgaactgggcgcgtttatcggcacccagagcgagaacaaatatggaaaagatacccttgaggtgaagtaccgctga

SEQ ID NO: 4386 - DNA, 273 bp, Enterobacter cloacae
agcgtcgccttgcaattcaggagaggtaggatcatgtctttagaagtgtttgagaaactggaatcgaaagtacagcaggcgattgacaccatcacgctgctgcaaatggaaattgaagaactgaaagagaagaacaactccctgtctcaggaagttcagaacgctcagcacagccgcgaagaaatggagcgcgaaaacaaccagctgcgcgaacagcataacggctggcaagaacgcttgcaggcgctgctgggacgtatggaaaaagtctga

SEQ ID NO: 4387 - DNA, 3219 bp, Enterobacter cloacae
tgcaaaaaccgttgccatgaccgccagcgccgccctcaactgatcccttacctgagaatccaatccatggacttttcccgttttttcatcgacaggccgatttttgccgccgtactgtcgattctgatttttatcacaggattaatcgccatcccgctgctgccggtgagcgaataccctgacgtcgtgccgccaagcgtgcaggtgcgcgccgagtatccgggcgccaacccgaaagtgattgctgagaccgtggcaacaccgctggaagaggcgatcaacggcgttgaaaacatgatgtacatgaaatccgtcgcgggctccgacggcgtgctggtgactaccgtcaccttccgcccgggcaccgatccggatcaggcgcaggttcaggtgcaaaaccgcgtcgcgcaggccgaggcgcgtctgccggaagacgtgcggcgtttgggcatcacgactcagaaacagtcgccaacgctgacgctggtggtgcatctgttttcgcctggtggtaagtacgattcactgtatatgcgtaactacgccacgctgaaggtgaaggacgagctggcgcgtctgcccggcgtgggtcagatccagatttttggctcgggtgaatacgcgatgcgcgtctggctggatccgaacaaggtggctgcccgcggtctgaccgcttcggacgtagtgacggcgatgcaggagcagaacgtgcaggtctccgccggtcagcttggcgccgagccgctgccgaaagagagcgacttcctgatctccattaacgcccagggccgcctgcataccgaagaagagtttggcaatattgtcctgaaaacaacgcaggatggtacggtcgtccgcctgcgcgacgtggcgcggattgaaatgggctccgggagctatgccctgcgttcccagctgaacaataaagacgcggtcgggattggtatcttccagtcgccgggggcgaacgccatcgatctgtctaacgcggtgcgcgcgaaaatggacgaactgtccacgcgcttcccggcagacatgaagtgggcggcaccttacgatccgacggtcttcgtgcgtgattcaatccgtgcggtggtgcaaacgctgctggaagccgtggtgctggtggtgctggtggtcattctgttcctgcaaacctggcgcgcgtcgatcattccgctgatcgcggtgccggtgtcggtggtgggtactttcagcattctctacctgctgggcttctcgctgaataccctcagcctgttcggcttggtgctcgccatcggtatcgtggtggacgacgccatcgtggtggtggaaaacgtcgagcgaaatatcgaagaggggcttgcgccgcttgcggccgcgcaccaggcgatgcgtgaagtgtccgggccgattatcgcgattgcgctggtgttgtgcgcggtgtttgtgccgatggcgtttctgtcgggcgttaccggccagttctacaagcagtttgcggtgacgatcgcgatatcgacggtgatttcagcgattaactcgctgacgctctctccggcgctggcggcactgctgttaaagccccacggcgcgccgaaagatttcccgacccggcttatcgaccgtctgttcggctggattttccgtccgtttaaccgctttttcctccgcagttcaaacggctatcaggggctggtgggcaaaacgctgggacggcgcggtgcggtattcgtggtttacctgctgctgctctgtgccgcaggcgtcatgtttaaagcggtgcccggcgggtttattcccacgcaggacaagctgtacctgattggcggcgtgaaaatgccggaaggctcctcgctggcccgcaccgatgcggtgatccgcaaaatgagcgaaatcgggatgaataccgaaggcgtggattatgcggtcgcgtttccggggctgaacgcgctgcagttcaccaatacgccgaataccggaacggtcttttttggcctgaagccgttcgaccagcgtaaacattccgcggcggaaattaacgcggagatcaacgcgaaaatcgcgcaaatccagcagggctttggcttctcgattctgccgccgccgattttagggctgggtcaggggtcgggctattcgctgtacatacaggatcgcgctggtctgggctatggcgcgctgcaaaacgcggtgaacaccatgtccggggcgattatgcagacgccggggatgcatttccccatctcaacctaccaggctaacgtgccgcagttggacgtccaggttgaccgcgataaggcgaaagcgcagggcgtgtcgctgaccgatctcttcgggacgctgcaaacctatctgggctcgtcgtacgtcaatgatttcaaccagttcgggcgcacctggcgcgtgatggcgcaggccgacgggcagttccgcgacagcgtggaagatattgcgaatctgcgtacccgcaacagccagggcgaaatggtgccgattggcagtatggtgaacatcacgaccacctacggtccggacccggtgatccgctacaacggctacccggcggcggatctgattggtgatgccgacccgcgcgtgctctcttccgcgcaggcgatgacgcagctggacgctatgtctaagcagatcctgccgaacgggatgaatattgaatggacggacctgagcttccagcaggccacccagggcaacacggcgctgatcgtcttcccggtcgcagtgctgctggcgttcctggtgctggcggcgctgtatgaaagctggacgctgccgctggcggtgatcctcatcgtgccgatgacgatgctctccgcgctgttcggcgtctggctgaccgggggcgataacaacgtctttgtgcaggtagggctggttgtgctgatggggctggcctgtaaaaacgcgattcttatcgttgagtttgcccgcgaactggaaattcagggcaaaggcatcatggaggctgcgctggaggcgtgccgcctgcgtttacgcccgattgtaatgacttctatcgcctttattgccgggactattccactgatccttggtcacggggcaggggcagaagtgcgcggcgtcaccgggatcaccgtcttttccgggatgctgggcgtgacgctgtttggtctgttcctgacgccggtcttttacgtgacgctgcgtaagttcgtgacgcgcggcaaagcggaaagagaggtgttgcctgcgtag

SEQ ID NO: 4388 - DNA, 855 bp, Enterobacter cloacae
atccaaagggcttctttaatgagaaacatcacactgcgtcatagtttcccccgttcacgcatcggtcgcagcatgaaaagcatcttgccgggggccgtcctggcgttactggctaccacggccctggcggcagatcagcgccagggcaacgtgttaaccctgggaggcggcgtggatgttgcgccacgctattccggttcggacaagagccgggtctctgcggctcaggtggttgattacgcgatggcaaatggtttttttgtcagcaccacgcgggggatcggctacggcaacagctttggtaacctggactacaacgcagcgctgagctatcgcgctggacgtaaggatcgcgacgtaagcagcgattcgatcgcctccggcagcgacgacctgcggggaatgggtgacattaaaggctcagctatcgttgtgccagggctggggtacagggtgactgactggctgaccgtgcagttgcaggcagaggttccggtttctgagagagacaatggtgaggctgtgcatttcggcattgccagcccgttctatacatctccgaaaaatgcgttaacgctggcgctgaccggtagctggggatccagtaagtacgtgcaaacctattacggggtgaatgccgcccagtcggccgcatcgggttttgcccgacacgatgccggatcgggactatatgcgtattcgctgaacctggactggactcataagctcacctcccgctggagcctgcttgccgcagctggcgttacgcagctgacgggagaggctggcgatagcccaattgttcagcgaaaaacgtctcctgtgggaagtttgaaggtgacgtacagcttctga

SEQ ID NO: 4389 - DNA, 903 bp, Enterobacter cloacae
gagaaactttgcatgacgacgctcaatctgggacacctcgccacttttcgtctggtcgttcaacgcggcagcttttctgcggcagcagatgtaatgggtatttcccagcccgccgtcagcctgcaaatacgccagctggagcagtttcttcagacgcggctgatcgaacgtacggggcgtggaatcaaagccactgctgccggtgaggcgctacgggtgcacggtgaacgtcttgaactggcggttgaggagacaattcgttcggttagcgcattcaatcaggaagtgagcggcaccatcacgcttggcacgggcgcgacggcctgtattcatctgcttccagcgctgttgcagcagcttcgtgaggagtatcccctgttacggatcggagtgacgacgggaaatacgccagatatcgtcagggcgattgaggagaatcggctggatatggggctggtcacgctaccggcgagcggtcgtacgttggcgattatgcacgcgatggaggaagagtttgtctggattggcgcgcaggttcagccggaagaaggggagcagtttacgccagactctttatacgctcagccgctcattgcgtttgagtcgggcagcggtacgcgaacgttgattgacggctggtttgaagcccgcggactagccgtctcaccggttatgcagcttggcagtattgaggccatcaaacgcatggtacgtgcagggctgggctacagtattgtgccgcgaatggcggtggagcatgccgacgaccgggagggattacgcgttcaatcgttaacgcccgttctgcgccggcaactggcgatagtgatgcgtcaggataagatcctcagcaaagggatgacggtaattattcggctgttacagcgtgaacatggacgttag

SEQ ID NO: 4390 - DNA, 1308 bp, Enterobacter cloacae
  unsure (672)
cactcagaggaaaacactatgacgcgccgtgctatcggggtgagtgaaagaccgccgcttttacagacaatcccgcttagtttgcagcacctgttcgccatgtttggcgcaaccgtgctggtgccaatcctgtttcacattaacccggctaccgtgttgctgtttaacggcatcggtacgctgctttacctcttcatctgtaaaggcaaaatcccggcctatctcgggtcgagcttcgcgtttatctccccggtactgctgttgctgccgctgggttatgaggtcgcgctgggcggcttcatcatgtgcggcgtgctgttctgcctggtctccttcatcgtgaagaaagccggtaccggctggctggacgtgatgttcccgcctgcggcaatgggggccatcgttgccgtcatcggcctggagctggcgggtgtcgcggcgaacatggctgggctgctgcctgcggacggtcagtcaccggattctaaaaccattattatttcgctggtgacgctgggcgtgacggtattcggttccgtcctcttccgcggctttatggcgattatcccaatcctgatcggcgtgctggcgggttacgcgctctccttcgtgatgggcgttgtggataccaccccgattgccgaggcgcactggttcgcgctgccaaccttntacaccccgcgctttgaatggttcgccattttcaccattctgcctgccgcgctggtggtgattgctgagcacgtcggccacctggtggtgacggcgaacatcgtgaagcgcgacctgatccgcgacccgggcctgcatcgctccatgtttgccaacggtttctccaccatcatctctggtttcttcggctccacgccaaacacgacttacggtgagaatatcggcgtaatggcgatcacccgcgtctacagcacctgggttatcggcggcgcggcgatcatcgccattctgctctcctgcgttggtaaactggcggcagcgatccagattatcccggtgccggtgatgggcggcgtttctctgctgctgtacggggtgatcggtgcctccggtattcgcgtgctgattgaatccaaagtggattacagcaaggcgcagaacctgatcctgacctccgttatcctcattatcggcgtgagcggcgcgaaggtgcacatcggcgcggcagagctgaagggtatggcgctggcgaccatcgtcggcgtcggcctgagcctgattttcaagctgatctcggtgatccgcccggaagaggtggtgctggacgcggacgacagcgaaaaagcgccacattga

SEQ ID NO: 4391 - DNA, 744 bp, Enterobacter cloacae
actccattccgattttatgtaagatctctggttgaggtatttctgaacggaccggcacagctctctctgccactttatctccctgacgatgaaactttcgcgagtttctggccgggtgataacccctctttactggctgcactgcaaaacgtgctgcgccaggaacacagcggatacatctatatctggtcacgcgaaggcgcgggacgcagccacctgctgcatgccgcctgtgcggagctttcggcgcgcggtgacgcggtaggctatgtgccgctggataaacgcacctggtttgtgcctgaggtgctggagggcatggaacatctctccctggtctgcatcgataatatcgaatgcgtggcgggggacgaaccgtgggaaatggcgatctttaacctctacaaccgcattctggagtcgggcaaaacccggctgctgatcaccggcgatcgtccgccgcgccagctcaatctggggctgccggatctggcgtctcgtctggattgggggcaaatctacaagctgcaaccgctgtcggatgaagacaaactccaggcacttcagttgcgcgccagactgcgcggatttgaactgccggaagacgtagggcgcttcctgctcaagcgtctggatcgggagatgcgcacgctctttgatacgctcgatcagctcgatcgcgcctccatcaccgcccagcgcaagctgaccattccgtttgtgaaagatattcttaagctttga

SEQ ID NO: 4392 - DNA, 744 bp, Enterobacter cloacae
atacaaatcatcacaccaggagtaatgaagatgcagaagcaagctgagttgtatcgtggcaaagcgaaaaccgtatacagcacggaaaacccggatctgttggtgctcgaattccgcaatgatacgtcagcaggagacggcgcacgcattgagcagttcgatcgtaagggcatggtgaataacaagttcaaccacttcattatgaccaaactggccgaagccggtatcccgactcagatggaagcgttgttgtccgatacggaatgtctggtaaaaaaactggatatggtgccggttgagtgcgtgatccgtaaccgtgccgcaggctccctggtgaagcgtctgggcattgaagaaggtatcgaactgaatccaccgctgttcgatctgttcctgaaaaacgacgccatgcatgacccgatggtcaacgaatcctactgtgaaaccttcggctgggtaagcaaagagaacctggcgcgcatgcaggaactgacctacaaagccaacgacgtgctgaaaaagctgtttgatgacgcgggcctgatcctggtcgacttcaagctggagttcggtctgtacaaaggcgaagtggtgctgggcgacgaattctctccggacggcagccgcctgtgggacaaagagacgctggataaaatggacaaagaccgtttccgccagagtctgggtggcgtggtcgaagcgtacgaagcggttgctcaccgtttaggcgttaagctcgactaa

SEQ ID NO: 4393 - DNA, 882 bp, Enterobacter cloacae
ttcgaggtgtttatgcgctggcaagggcgtcgtgaaagtgacaacgtagaagacagacgcagcagtggtggcggtggtccgtctatgggcgggccaggtttccggttacccagcggcaagggcggtattattctgctggtcgtcgtgctggtggcgggctactacggtgtcgacctgaccggtttgatgaccggtgaaaccgggcaacagcagcagtattctcagcgctccatcagcccgaatgaagatgaagcggcgaaatttacttccgttattctcgcgacgaccgaagatacctggggtcagcagttcgaaaaaatggggcggacttatcagcctccaaaactggtgatgtaccggggcgcaacccgcaccggctgtggcaccgggcagtccgttatggggccgttctactgcccggcggacagcaccgtctatatcgatctctccttctatgacgacatgaaaagcaagctgggcgccgacggcgattttgcccagggctacgtgatcgcgcatgaagtcggccaccatgtgcagaagctcctcggcattgagcctaaagtgcgtcagatgcagcagaatgcgtctcaggcggagatgaatcgtctttccgtacgcatggagcttcaggccgactgcttcgctggcgtctggggacacagcatgcagcagcagggcgtgctggaaacaggcgatctggaagaggccctgaatgccgcacaggcgattggtgacgatcgcttgcagcagcagagccaggggcgcgttgtgccggacagctttacccatggcacctcagagcagcgctacagctggtttaagcgtggcttcgacagcggcaacccgtcgcagtgtaataccttcggcaaagctatgtga

SEQ ID NO: 4394 - DNA, 804 bp, Enterobacter cloacae
aagccgacattttgcaatggcaattttttcaatgacttcttcagtaaagtggcatggtcattaccccgcagaggcgtaaaatcctgcttatcaattaaggagatcgccatgaaacatgaccattttgttgtgcaaagcccggatacgcctgctaaacagctcctgcttctgtttcatggcgtgggcgacaatgccgtcaatatgggacagattggcagctggtttgcacccgttttcccacacgcgctgatcgtcagcatcggcggcgtggagccgtgcggtccggacggtcggcagtggttttccgtcgagggcgtgacggaggagaatcgtcaggcgcgtattgatgccgttatgccagcctttatcgataccgtgcgttactggcagcagcagagcggcgtaggcgccgacgcaacggcgctgattggcttctctcagggctcaatcatgtcgctggaaagcgtaaaagcgcagcccggactggtgtcccgcgtgattgcctttaacgggcgttttgcgacgttaccgcaaagcgcgaccacgcagaccacgatccatctcattcatgggggggaagaccgggtaattgagctttcgcatgcagtagctgcccaggagacgctgatgcgcgagggtggagatgtgacgctggatattgtagacgatctggggcatgccattgacgatcgcagcatgcagttcgcgctcgatcatctgcgttataccgtaccgaagcactactttgatgaagcgctcagcggcgcgaagccgaatgacgatgatatcgtcgagtttatgtga

SEQ ID NO: 4395 - DNA, 2058 bp, Enterobacter cloacae
acattgcgtcgccatgctgctgtgggtaaatacgataacaatagaaagaataaggttattgaaccaaaaacaggtgttgttatgaatcgttttattatggccaacgctcaacagtgtatcggttgtcgcgcctgcgaagttgcctgtgtgatggcgcacaacggggagcagcacgcgctgagcgagcgccattttcatccccgcattacggtccttacctcaggcttgcgaaaaagccccgtgacctgccaccactgtgaaaatgcgccctgcgcgcaaagctgcccgaacggagccatcacgcaacacagcgacagcgtacaggtcaatcaacaaaaatgcattggctgtaaagcctgcgtggtggcctgtccgtttggcacgatggacatgctgatcgccccgctggaaaacgacagcgtaaaggcctcggcgcacaaatgcgacctctgcctggaaaggccgcaaggcccggcctgcgttgaaaactgcccggcagaggtgcttacgctcgccaccccagccgtgctggataagctggttaaacagcgccgacagcgcagcgcaaggctggacgcgctgccgtggcacagcgaggcggttcagtcagtccctccgcaaaccaaacggcaacagatgcaaaacaccccggcgcgcggtgagccggataagctcagccccgacgcgcgcgcaggtcattttaacgagatctacttgccgtttcgcccggaacaggcgcagcgcgaagcatcccggtgcctgaaatgtggcgaccacagcatttgcgagtggacctgcccgctgcataaccatattccacagtggattgagcggatcagggcgggggatatcatcggtgcggctgagctttctcaccagactaactgtttaccggaaattaccggccgcgtctgtccacaggatcgattatgtgaaggcgcctgcaccctgcgggatgcgtcaggggcggtaaccatcgggaatatcgaacggtatatctcggatcgggcgctggcgatgggctggacgccggacgtcagccacgttaaaccggtcggtaagcgcgtcgccatcatcggtgccggtccggcagggctggcctgcgccgacgtattggtgcgcagcggcgtcggtgtgacggtctacgatcgccatccggaaatcggcggattgctgacctttggtattccggccttcaagctggataagtccctgttagcgcggcgcagagagatattcagcgcgatgggcatccgcttcgagctgaactgcgaggtgggaaaagacgtatcgatggcccaactgcaaaacgactacgatgccctgttcatcggcgtagggacctatcgttccatgaaagcgggtatccctcacgaagacgcgccgggcgtgtacgacgcgctgccgtttttagtggcgaacacgaggaacgtgatgggccttgaccctgccgcagacgagccgtttatcgacacgcaggggttaaacgtggtggtgctgggcgggggcgatacggcgatggactgcgtgcgcaccgcgctgcgacatggcgcggcgaaagtcacctgcgcctatcggcgggacgaggccaacatgccgggctcaaagaaagaggttaaaaacgcgaaagaagagggcgcggcctttgaatttaatgtccagccggttgagctcacgctggataccgacgggaaggtcaacggtatccggatgctgcgcacccgtctgggcgagccggatgcgcaggggcggcgtcgtcctgtcccggtggcgggcagtgagtttgtcatgccagcggatgcggtgatcatggcgtttgggtttaatccgcacgccatgccgtggcttcaggcgcagggcgtcgacaccgacgactgggggcgcatcaaggcctccgtggagagccgttatcgctaccagacctcgaatccgcagatttttgctggcggtgatgcggtacgcggtgcggatctggtggtcaccgcgatggcggaagggcgccatgccgcgcaggggatcatggactggcttggcgtgccgccgcgcaacatgcattaa

SEQ ID NO: 4396 - DNA, 2304 bp, Enterobacter cloacae
ccgaaacgtgaaaggaataacaagatggatgatcagttaaaacaaagcgctctcgattttcacgagtttcctgttccgggtaaaatccaggtatccccgaccaaaccgctggcgacccagcgcgatctggcgctggcctactcgccaggcgtggctgctccgtgcctggaaatcgaaaaagatccgctggcagcgtacaaatacaccgcccgtggcaacctggtggccgttatctctaacggtacggcggtgctggggttagggaacatcggtgcgctggccggtaagccggtgatggaagggaagggcgttctgtttaagaaatttgccggtatcgacgtcttcgatatcgaagtggacgaactggatccggataaattcatcaacgtggtggcggcgctggagccgaccttcggcggcatcaacctggaagacatcaaagcgccggaatgtttctatatcgagcagaagctgcgcgagcgtatgaacattcccgtgttccatgacgaccagcacggcacggcgattatcagtaccgccgccattctgaacggcctgcgcgtggtagagaaaaatctctccgacgtgcgcatggtggtctccggcgcaggcgccgcggccatcgcctgtatgaacctgctggtggcgctgggcatgcagaagcacaatattgtggtctgcgactccaagggcgtgatctacaaagaccgcgagccaaacatggcggaaaccaaggcggcctatgcggtggaagacgacggcaagcgcacgctagaagacgtcattgaaggtgccgacattttcctcggctgttcaggcccgaaagtactgacccaggagatggtgcagaagatggcgcgcgcgccaatgatcctggccctggcgaacccggagccggaaattctgccgccgctggcgaaggcggtgcgtgaagacgcgatcatctgtaccggacgttcggactacccgaaccaggtgaacaacgtgctctgcttcccgttcatcttccgcggtgcgctggacgtcggcgctacggcaatcaacgaagagatgaagctcgccgccgttcatgctatcgcagagctggcgcacgccgagcagagcgaagtggtggcctccgcctacggcgatcaggatctgagcttcggccccgactacattatccctaaaccatttgacccgcgtctgatcgtgaagatcgcgccagcggtggctaaagcggcgatggactccggcgtggcgacgcggccgattgaagatttcgatgcctacgtcgataaactcaccgagttcgtctacaaaaccaacctgtttatgaagccgatcttctcccaggcgcgcgctgacgcgaagcgcgtggtgctggcggaaggggaagaggcgcgcgtgctgcatgccacgcaggagctgatcaccttagggctggcgaaaccgatcctgattggtcgtccgagcgtgatcgagatgcgtattcagaagctgggcctgcaaattaagccgggcgtcgactttgagatcgtcaataacgaatccgatccgcgcttcaaagagtactggaacgaatactattcgatcatgaagcgtcgcgggatcacccaggagcaggcgcagcgggcggtgatcagcaataccacggtgatcggcgcgatcatggttcatcgcggtgaggcggatgcgctgatctgcggcaccatcggcgagtaccatgagcatttcagcgtggtgcaggagatcttcggctatcgcgagggcgtccatactgccggcgcaatgaacgcgctgctgctgccaagcggtaacacctttatcgccgatacctacgtcaacgacgatccttccccggaggaactggcggaaatcaccgtgatggcggcggaaaccgtgcgccgctttggtatcgagccgaaagtggcgctgctgtcgcactctaacttcgggtcatccaaatccgcggcggcgtgcaaaatgcgccagacgctggacctggtgcgcgagcgtgcgccggagctgatgatcgacggcgagatgcacggcgacgccgcgctggtggagagcatccgtaacgaacgcatgccggacagcccgctgaaaggctcggcgaacgtgctgattatgccaaacgtggaagcggcgcgtatcagctataacctgctgcgcgtgtcgagttctgaaggggtgaccgtagggccagtgctgatgggggtgtcaaaaccggtgcatgtgttaacgccgattgcctccgtgcgtcgtatcgtcaacatggtggcgctggcggtggttgaggcacagacgcagccgctgtaa

SEQ ID NO: 4397 - DNA, 525 bp, Enterobacter cloacae
cattatgccaaattttggcgagtttttccccggttattggctaaatgccctgttcacgccataatcactgtttttaaacccgaaaaggcggttaataccatggagatacgcgtttttcgccaggaagatttcgaagaggtgatcaccctttgggagcgctgcgatctgctgcgtccatggaacgatccggagatggacatcgaacggaaggtgaatcacgatgtcagtctgtttctggtcgctgaggtcaacggcgaagtagtcgggacggtgatgggcgggtacgacggccaccgcggctcggcctactatctgggcgtgcacccggaataccgcgcgcgcggcatcgccaacgcgctgcttaaccgtctggaaaagaagctgatcgcccgtggctgcccgaaaatccagattatggtccgggaagataacgacgtggtgctgggcatgtatgaacgtctgggctacgagcatgcggatgtactgacgctgggtaagcgcctgatcgaagatgaagagtactga

SEQ ID NO: 4398 - DNA, 948 bp, Enterobacter cloacae
ccgccatcaatgccacgcagtcgtggcatctttttttcaggaggagcgatgtctcaggttcagagtggcattttgccagaacattgccgcgcggcgatttggattgaagccaacgtcaaaggggatgtggatgccctgcgtgcggccagcaaagttttcgttgataaactggccaccttccaggccaaattccccgaagcccatctgggcgcggtggttgcctttggcaataccgtctggcgtcagctgagcggcggcgaaggcgcaaaagagctgaaagattttattccttatggcaaaggtcttgcgcccgccacccagtatgacgtcctgatccatatcctctccctgcgccatgacgtgaacttctccatcgctcaggcagcgattgaggcctttggtgacagcatcgacgtgcaggaagagatccacggtttccgctgggtggaagagcgcgatttgagcggcttcgtcgacggcaccgaaaacccggccggggaagagacgcgtcgcgaggtggctgtaatcaaggatggcgtggacgcgggcggcagctatgtgttcgtccagcgctgggagcataacctcaggcagcttaaccgcatgagcgtgcatgaccaggagatgatgattggccgtaccaaagatgccaatgaagagattgacggcgatgcgcgtccggtcacgtcccacctgtcccgcgttgaccttaaagaagacggtaaggggctgaagattgttcgccagagcctgccgtacggcaccgcgagcggtacgcacggcctgtacttctgcgcttactgcgcgcgcctctacaacattgaacagcagctgctgagcatgtttggcgataccgacggcaagcgtgacgccatgctgcgcttcacccgtccggtgactggcggctactactttgcgccgtccgttgagcgcctgctggcgctgtaa

SEQ ID NO: 4399 - DNA, 837 bp, Enterobacter cloacae
gtaatgtttgcaggatcaacaagacgtgtgctgccgggttttaccttaagcctcgggaccagcctgctgttcgtctgtctgattttattgttaccgctcagcgctctggtgatgcagctcgctgagatgagctggtcccagtactgggaagtggtcaccaaccctcaggtggtggcggcctataaggtaacgctgctgtctgcgttcgtggcctcgatttttaacggcgtgtttggcctgctgatggcgtggatcttaacccgctatcgcttcccgggccgcacgctcctcgacgcgttgatggatctgccctttgccctgccgacggcagtggccggtttgacgctggcgtcgctgttttccgtgaacggcttttacggtgagtggctggcgaagtttgatatcaaagtgacctatacctggctcggtatcgcggtggcgatggcctttaccagcatcccgtttgtggtgcgtaccgtgcagccggtgctggaagagttaggacccgaatacgaagaggccgcggaaaccctgggcgccacgcgctggcagagtttccgtaaggttgttctgccggaactttctccggccttgctggcgggggtggcgctctcctttacccgcagcctcggtgaatttggcgcggtcatttttatcgccgggaacatcgcgtggaaaaccgaagtgacctcgctgatgatttttgtccgtttgcaggagtttgattatccggccgcgagcgcgattgcctcggtgatccttgccgcgtcgctgctgctactgttttcgattaacactctgcaaagtcgctttggtcgacgtgtggtaggtcactga

SEQ ID NO: 4400 - DNA, 1131 bp, Enterobacter cloacae
agaatcaggaaaaacgtcagcatcaggagggaaatcatgagcattgagattgccaatattaagaagtcttttggtcgcacccaggtgctgaatgatatctcgctggatatcccttccggacaaatggtggcgctgctggggccgtctggctccggtaaaaccacgctgctgcgtattatcgccgggcttgagcaccagaccagcggacatatccgcttccacggtacggacgtgagccgcctgcatgcccgcgaccgtaaagtgggctttgtattccagcattacgcgctgttccgccacatgacggtattcgacaacattgcgtttggcctgaccgtgctgccgcgtcgtgaacgtccagatgccgccgccatcaaagcgaaagtgaccaaactgctggagatggtgcagcttgcacatctggcggaccgcttcccggctcagctttccggcgggcagaagcagcgcgtggcgctggcgcgtgcgttagccgttgaaccgcaaatcctgctactggacgaaccgtttggcgcgctggatgcgcaggtgcgaaaagagctgcgtcgttggctgcgtcagctgcatgaggaactccagttcaccagcgttttcgtgacccacgatcaggaagaggcgatggaagtggccgaccgcgtggtggtaatgagtcagggcaacattgagcaggttgacgagccagagcagctctggcgtgaaccggcgacccgctttgtgctggagtttatgggagaagtaaaccgccttcagggcaccattcgcggcggtcagttccacgttggcgcgcaccgctggccgctggggtatacctccgcgcatcaggggccggtggatctattcctgcgtccgtgggaagtggacgtcagccgccgtaccagcctggattcaccgcttccggtgcaggtgctggaagctagccctaaaggtcactacacccaattagtggtacagcccctgggctggtacaccgagccgctgaccgtggttatgcgtgacgacgagccgccgcaccggggggaacgcctgtttgtggggctgcaacacgcgcgcatttatcacggcaacgagcgcatcgagacgcgcgaggatattgctctggcggagtcagcctga

SEQ ID NO: 4401 - DNA, 873 bp, Enterobacter cloacae
agagagttattcgcagggggcggggatttaagcgtcatggagatgattttattccgggataacacccgggcgcagcaaaccgatattgtcgccgtacagtcgcaggtggtgtacggcagcgtgggaaacagcatcgcggtgccgaatattcgcacccaccggctgaacgttaccgccgtgccgacggtgctgttcagcaatacgccacactacgacaccttttacggcggggtgatcccggacgagtggttcagcggctacctgaaggcgctggaagagcgtgagattttacgcgagttaaaagcggtgacaaccgggtatatgggcagtgccagccagatcgtgctgctggcgcagtggctgaaggcgatcaaagtgcaacatcccgatctgctggtgctggttgacccggtaatcggggatatcgacagcgggatgtacgtgaagccggatattcctgaagcctaccgtgaacatctgctcccgctggcccagggcattacgcccaacgtgtatgaactggaagtgctgagcggcaaaccgtgccgtacgccggagagcgccattgccgccgcgcaggggctgctgtccaactcgctgaaatgggtggctatcactagtgcgccagtggctgacgatccgcagaatatccacgtcgtgctggtgagcgaaggaggtgttaccgttagcgcgcacccgcgcgtagagacggatctgaaagggacgggggatctgttctgttcggagctggtgagcggtatcgtcgggggtaaaaccgtggccgacgccattcgcatggcgggcgacagggtgactgacgtgatgatctatacgcagtcgaaaggatatgacgagcttatcctgcctgcataa

SEQ ID NO: 4402 - DNA, 282 bp, Enterobacter cloacae
acgaacagttcgataccgctatcggattcgatagagaacgcatggttggtttcaaaaattttaccgatggtgccgtcaactggagcaaccattttgttgccagttggtttgatagcaatgccatcaccaacgattttctcagcaaacactacatccggcacgtcttcgatgttgacgatctcgccggagagcggagcaacaatctcaatagttccggagtctttcttgtcatcagaaaccagagatttcagtttatcgaacaaacccatgatcttctcctaa

SEQ ID NO: 4403 - DNA, 1275 bp, Enterobacter cloacae
acgacacaaatggccttaagccagctaccggacaaaggaagtggcgcggcgtctcccgctgcgtcttgcccggcggctacaataaccggaataaaaataatgagcctgcaaaaaacctggggtaactttcatctgagcgcgatgggggtggttttactctccgtgcttctcgtcgggtgcgatgacagcgtcgcgcaaaatgccgcgccgcaagcgcccgttgtcagcgctgctgacgtggtggtgaaatccattagccagtgggacagctttaacggtcgcattgaagcggtggaaagcgttcagctgcgtccgcgcgtgtccggctacattgagaaagtgaattacaccgacggccaggaagtgaagaagggcgaggtgctgttcaccatcgatgaccgaacctatcgcgccgcgctggaacaggcgcaggcgaacctggcaagagccaaaacgcaggccagcctcgcgcaaagtgaagccaaccgtaccgataagctgatcaatacccatctggtctcacgggaagagtgggagcagcgtcgctcggctgccgttcaggcgcaggccgacattcgcgccgcgcaggcggcggttgacgcagcccagctcaacctggacttcaccaaagtgactgcgcctatcgatggtcgcgccagccgggcgctgatcaccagcggtaacctggtgacggcgggcgacagcgccagcgtgctcaccaccctggtctcgcagaagacggtttatgtctacttcgacgtggacgagtcaacctaccttcactatcagaaactggcccgcagcgggcagggggcgtccagcaatcacacggcgctgccggtggagattggcctgacgggcgaagagggctatccccatcagggcaaagtggatttcctggataaccagcttacgccgggtacggggaccatccgcatgcgcgcgctgctggataactcacagcgtcagttcacgccgggactgtttgcccgcgtacgcctgccgggcagtgcggaatttaaagccacgcttgttgacgataaggcggtgctgaccgatcaggatcgtaaatacgtctatatcgtggataaagacggaaaagcgcagcgccgcgacatcacgcccgggcgtctggccgacggtttacgtatcgtacagcaggggctgaatcccggggataaagtcatcgtcgatggtttacaaaaagtgtttatgccgggtatgccggttaatgcaaaaaccgttgccatgaccgccagcgccgccctcaactga

SEQ ID NO: 4404 - DNA, 2379 bp, Enterobacter cloacae
gtcaaccgcatcccgtcgttgatatttaaaatccctcctccactgtgcttgccaggaattttccgggcaacgtgtacgtcaggttggatgcctgtcttcctttaccctctggagcgcaagggttgtaaacgagcatctatgaatattcaccacatcctgaagcaaaataaagaccgctggtgggcacttcctcttattttacccgtcgtgttactcccggtactaagtgtggctaataccttaacgcagctgggcgacggtatcgttgcgctctattatctcccgctctcttttctgctggcgctgatgttgttctttggcctggaagccctccccggggtggtggtatcgctatttttacgttattacccctccgttgggttatttgaaaccgtggctggcattctgcattttatcgttcctctggtgctcagctggggcggttatcgcgtatttgcgccccggcgtaatatgaccgcttacggtgacatacgcctgatggggcagcgtattttctggcaggtattttgtccggcaacgctttttctggtgctgtttcagtttgcggtttatctcggcatttatgagagccgccagagcctcgcgggactaaatcccctcaatattcggacacttattaactatcaggggctactggtgagcgggctgacgggcgtgccgctaagctacctgctgatccgcctgatacggcatccgcgctatatcaagggactgatgtcccagctccgcgcgcaaatagacaaaaaggtgacggccgttgagtttgtggtgtggtttttagccctgggcgggttgctggtcatgctgctgctgcccatgaatgcaaacagttccattttcagtaccaactacaccttgtccctgctgatgcccgtgatgctctggggggcgatgcgctttggctacaagctgatgtcactcatctggacgccggtcctgctggtgtcgattcactttttttatcactacattccggtgcaagaggggtatggcattcagctggcgatcacctcatccagctatctggtcttttccttcgttgtgacgtacatgtcgatgctggcgacacgccagcgcgccatcaatattcgctcccgcagtcaggcttttctcgatccggtggtgcatatgcccaacctgcgggcgctgtcgcgcgagctggccagtcatccgtggtcagcgctctgtttactgcgcgtgcccgagctggaggtactgggacgcaattacggcgtgatgctgcggatccagtataaacagcagctggcgcaatggataaacggcactctacagcccaatgagcgagtctatcacctcaccgggtatgacatggcggtgcgtctggatgcggagtcgcatcaacagcgcattgagacgctggacgagcatatcaagcagttcgtttttgtctgggatggtatgccggtacagcctcaggtcggcataagctattgctatgtgcgctcacccgtcaatcacctctatctggtgctgggggagctgggcatcgtggccgatctctccctttctaccaaccacccggaaaatcttcagcagcgcggggctgttcacttgcagcgtagcctgaaagataaggtcgcgatgatgagccgtttacaggccgcgctggagcaggacgcttttaccctgctggttcaacccgttcgcgggctgcgcggcgattgttatcacgaggtgctgctgcgaatgcgtgatgataatggggcgctgatctttcccgaacagttcctgcccatagcacaggagtttggtttatcgtcgcgtgtcgatttatgggtactggagcgtacgttgagtttcctggcacagcaccgccagcggttgccgggccagcgctttgcgatcaacctcgcaccttctaccgtctaccgggcgcagttcccgcttgaagtgagccgcctgttagccaaatacgccgttgaagcatggcagttgatctttgaagtgaccgaaagcagcgcctttggtcatgcggatctggcggcgtctaccctcaggaaattacaaaaaatgggcatccggatcgccattgatgattttggcaccggctacgccagctatgcgcggttaaaaagcgtggacgccgacatcctcaaaatcgacggcggttttattcgcaatattgtcagcaacagcctggattaccagattgtggcttctatttgccatctggcccggatgaagaaaatgctggtggtggcggaatatgtggaaacagaagagatacgtagcgcggtgcacgcgctaggtatcgattatgtgcagggttatttgattgggttgccggctgagcttgatacgttgctcgacacggagccttctcaggagagcgcctga

SEQ ID NO: 4405 - DNA, 1434 bp, Enterobacter cloacae
cgaatgtcaggatttaaagcaggttttctgtgggggggggccgttgcggcgcaccagcttgaaggcggctggaaagagggcggcaagggcgtgagcgttgccgatgtcatgacggcaggtgcccatggggtaccgcgtgaaatcaccaacggcgtgatggaggggaaaaattacccaaaccacgaagccatcgacttctatcaccgctataaagaagacatcaaactctttgccgaaatggggttcaaatgctttcgcacctccatcgcctggacgcgtatcttcccgaaaggcgacgagctggagccgaacgaagcgggactccaattctatgacgatctgttcgacgagtgcctgaagcacggcatcgagccggtgatcacgctttcccacttcgagatgcctttccacctggtgacggaatacggcggctggcgcaaccgtaagctgatcgacttctttgtccgcttcgcgaaggtcgtttttgagcgctaccagcataaagtgaagtactggatgacctttaacgagatcaacaaccaggccaacttccacgaagactttgcgccgtttaccaactccgggctgaaatatgcgccgggagaagatcgcgagccggtgatgttccaggcggcgcactatgagttggtggccagtgctctggcggtgaaggcggggcgcgagatcaacccgtcactgcaaattggctgcatgattgccatgtgccccatctatccgctgacctgtgccccggacgacatgatgatggcgatgaacgccatgcatcgccgctactggttcaccgacgttcacgtgcgcggcaagtatccgcagcatctgctcaactactttgaacgtcgcggcttcgcgctggatattaccgaagaagataaagtggcgctgacgcagggctgcgtggattacatcgggttcagctactacatgtctttcgctaccaaagcgacggcggataatccgacgctggattacgacgagagcaagagcctggtttctaacccgtacgtgcagaaatcggactggggctggcagatcgatcctgtcgggctgcgctactccctgaactggttctgggatcactatcagctgccgctgtttattgtggaaaacggctttggcgcgatcgacgtgcaggagagcgacggcacggtgaacgaccagtaccgcattgactacctttccgcccacatccgcgagatgaaaaaagcggtggtggaagacggcgtggatctgatgggctacacgccgtggggctgtatcgacctggtctctgccggcaccggcgagatgaagaaacgctacggctttatctttgtcgataaagataacgaaggtaacggtacgctgaaccgcagcaagaagaaatcgttcgactggtataagcaggtgattgccagcaacggagagcagctataa

SEQ ID NO: 4406 - DNA, 891 bp, Enterobacter cloacae
aatcggtcacaaagcattcgctgctctgatataaatctcataagattagttgcggagagagacgcgatggaaatcaaactgcatgccaacgccaccaccacaccgcgtatccgtcgttatcttcagcagtcagataaaagcgacagagagcttgccgttgagttgggtatctcggtcaccaccgtcaggcgctggcgcaaccgcgaccaggtttcggataaccacaccacgccaaaagtgatacataaagcgttgagacaagagcaggcagcactcataaatgctctgcgtgatatcaccggtgcaccgctggatgaactgctgctgctggtgaatgacggactcgggatcgccgtttcccgcgcgaccctgaaccgctacctcaaaccggcttcggtaagacaaaagggggcgtcgttgcagggcaaaaaggcgctgaaggccggtatcatgccgcagaagctacttctgcatcatcagccgctatcgctgcatatggacgacggtggggagcaacacctgctctgggcgcgtgaacccgttagcggctggtgctacgcccggctttatgccggtgtctcgccgcagttgctgacccgctggacgaacgaggtgctggctgcctgtccggctgatattcaatctgttgagacttttgggctggcagtgaacttgccggagcataacgtcaccgtaaaagtgcattcacagtattatctcgcccttcaggtcaccgtgccgttacgcgaaatcattccgcgggtgaacagtgaaccggcgggagcgctgttgatccaactgtgtgagttttacaaccggggaaaagcgcagaaaaagctgggagagcgtacgccgcaggcgtttctgaaagcgctgcggcgtaacgattag

SEQ ID NO: 4407 - DNA, 906 bp, Enterobacter cloacae
ggctcttgttcgcacagaggatggctcatgttcacgggaagtattgtcgcgcttgttacaccgatggatgaaaaaggtaatgtctgccggtcaagcatgaagaagctcattgattaccatgtcgccaatggaacctcggcgatcgtttcggtagggactaccggtgaatccgctacgctgagccacgaagagcacggcgacgttgtgatgctgaccctggaactggcggacgggcgtattccggtcatcgcggggacgggcgcaaacgcaaccgcagaagctatcagtctgacccaacgttttaacgacagcggcattgtcggctgtctgacggtgaccccttattacaaccgtcctactcaggaaggtttgttccagcatttcaaagccatcgctgaacatactgacttgccacaaattctgtataatgtgccgtcccgtaccggttgcgatatgctgccggaaaccgttggccgtctctcgaaagtaaaaaatattatcgggattaaagaggcgacagggaacttaagccgcgttcatcagatcaaagagctggtttcagacgactttatcctgttgagcggtgatgatgcgaccgcgctggactttatgcagctcggtggtaacggcgtgatttccgtgacggcgaacgtggcggcgcgcgatatggctgacatgtgcaaactggccgcagccggtcactttgatgaagctcgcgtgattaatcagcgtctgatgccgttgcacaataaattatttgtcgaacccaatccgatcccagtgaaatgggcatgtaaggagttggggcttgtagcaaccgacacgctgcgtctgccaatgacaccgattaccgaccacggtcgtgaaattgtcgctggcgcgctgaagcatgccggtttgctgtaa

SEQ ID NO: 4408 - DNA, 291 bp, Enterobacter cloacae
tcatggcgtttgggtttaatccgcacgccatgccgtggcttcaggcgcagggcgtcgacaccgacgactgggggcgcatcaaggcctccgtggagagccgttatcgctaccagacctcgaatccgcagatttttgctggcggtgatgcggtacgcggtgcggatctggtggtcaccgcgatggcggaagggcgccatgccgcgcaggggatcatggactggcttggcgtgccgccgcgcaacatgcattaacgcagacgggcgacaaagcgggcttcacggcgtagtataa

SEQ ID NO: 4409 - DNA, 621 bp, Enterobacter cloacae
acagactcattttgccgtggagcccgtatgtccccgaacattagcgttattaaagacaaaatcctttctgaaaattactttgtcctgcgtaacatcacttacgatctcacccgtaagaacggggacgtcattcgccataaacgcgaagtctacgaccggggcaatggtgcaaccattctgctgtataaccgtgaaaagcaaagcgtagtgctgatccgccagtttcgcatcgcgacatgggtcaatggcaacgcggacggacgtctgattgaaacctgtgcaggtctgctggacgacgatgagccggaagtgtgtatccgcaaagaagccattgaagagacgggttttgaggtggggacggtgcagaaagtctttgagctgtttatgtcccctggcggggtcaccgagctgatccacttcttcattgcggaatataccgatgcccagcgcacgcaccggggcggtggcgtggacgatgaagacattgaagtgctggaaatgcctttcgctaaggctgttgacatggtgaaacgcggcgagatccgcgacggtaaagcggtgatcctgttgcaatatctgcaaaccagcgggctgatgaatgccgcggcggaagcgcgataa

SEQ ID NO: 4410 - DNA, 456 bp, Enterobacter cloacae
tcgaagatgaagagtactgagttccaccctggcgactacgacgttcacggtcgtctgcgtctgccttttttgttctggtgcgttttgctgttgcaggcccgcacctgggtgctgttcgtgatggctggcgcgtcgcgcgggcagggcgatacgctactgaatctcttttatcccgatcacgatgcgttctggctggggttactgcccggtgtaccggcggtgctggcgttcctgtgcagcggacggcggcagttcctcccgcgcttctggcgcgcacttcgctggctattgattctggcgcaggttgtgctcctggtctggcagcccgtgctctggctgtacggcgagccgctatcaggtatcgggattgcgctggtggtggcggatattgtcgcgctgctgtggctggtcacgaatccccgtttacgcgcctgttttatgcaagagtcagattaa

SEQ ID NO: 4411 - DNA, 639 bp, Enterobacter cloacae
aacggcactttttgccgatactgcactccaacaagcgttgatttactacgtaaggacgtctcaatgaaatcgctgcgtttacttttatgcgctctcccgctggcgttaaccggctgttccacgctctcatccatcaactggtctgcggcctatccgtggaactggtttggttcctcaacggaagtgaccgagcagggcgtgggcaaaattaccgcctcgacggcactggatcaggatgccattcaggatgccatcggcagtgattatcgcctgcgcagcggcatgaaaaccgagaacggcaacatcgtgcgctatttcgaagcgttgaaagacgacaaggtggcgatggtcatcaacggcgataaaggtacggtcaaccgcattgcggtgatggatgaagagattccgacctcaggtggcgtgaaggtaggtacgccgtttggcgagctctaccagaaagcgtttggccactgcgccagtgtgccgtcggaggagagcgtggcggtcgagtgtaaggccgacggcagccagcacattagctatgtattcagcggcacctggaacggtccggaagggttaatgccgtctgacgacaccctgaaaaagtggaaagtgagcaaaattatctggaagcagtaa

SEQ ID NO: 4412 - DNA, 1023 bp, Enterobacter cloacae
gggtgcgcaatggccgttactgtactgaaaaaaggatcgctggcactggcaggtttactgctggtggcgcaggcgcaggcaaccgagttgctgaacagttcttatgatgtttcgcgcgagctgtttgccgcccttaatcccgcatttgaacagcagtgggcgaaagagaacaacggcgacaagctgaccatcaaacagtcgcacgctggctcatccaagcaggcgctggccattttgcaggggctgaaagcggacgtggtgacctacaaccaggtcacggacgtgcagatcctgcacgacaaaggcaaactgatcccggcgaactggcaaagccgcctgccgaacaacagttcgccattttactccaccatgggcttcctggtgcgcaagggcaacccgaagaacatccacgactggaacgacctggtgcgttcagacgtaaagctgatcttcccgaatccgaaaacctccggcaacgcacgttacacctatctggcggcgtggggcgcggcggacaaagctgacggtaacgataaagcgaaaaccgaacagtttatgacccagttcctgaaaaacgtcgaggtgtttgataccggcggtcgtggcgcaaccactaccttcgccgaacgcgggctgggcgacgtgctgatcagctttgaatccgaggtgaacaatattcgtaaacagtacgaagcgcagggcttcgaagtggttatcccgaaaaccaacattctggccgagttcccggtggcgtgggtggataaaaacgttaaggctaacggcacagaaaaggcggcgaaagcctacctgaactatctgtacagcccgcaggcgcagaccgttatcaccgactactactaccgtgtcaacaacccggacgtgatgagcaagctgaaagacaaattcccgcagaccgagctgttccgcgtggaagatcatttcggcgcctggcctgaggtgatgaaaacgcattttgccagcggcggtgagttagacaaattgctggcggcggggcgtaagtaa

SEQ ID NO: 4413 - DNA, 921 bp, Enterobacter cloacae
gtaaaaatcgtgaatacactcgaacacaccatcggcaacacccctttggtcaaacttcagcgcatggggtgtgacaacggcagcgaaatctgggtcaaacttgaaggcaataacccggcggggtcggtgaaagaccgggcggcgctgtcgatgattgttcaggccgaaaagcgcggcgagataaagcccggcgatgtgctgatcgaagccaccagtggtaacaccggtatcgcactggcgatgatagccgccctgaaaggctatcgtatgaagctgctgatgccggataacatgagccaggagcgccgtgccgccatgcgcgcctatggagccgagctgattctggtgagcaaagagcaggggatggaaggggcgcgagatttagcgttagcgatggcggagcgcggggaaggcaagctgctcgaccagtttaataacccggacaacccgtacgcgcactacaccaccaccggcccggaaatctggcagcaaaccgccgggcgcatcacccactttgtctccagcatggggaccacgggcacgatcaccggtgtgtcacgctttctgcgtgaacaggataagccagtgacgattgtcggcctgcaaccggaagaggggagcagtattccgggcatccgccgctggccggcggagtatatgccgggcatctttaatgcgcagcttgtggaccaggtgctggatattcatcagcgcgaggcggaaaataccatgcgtgagctggccgtacgtgaaggcatcttctgcggcgtcagctctggcggtgccgtagcgggcgcgatccgggtggctgagtccacgccgggagcggtggtcgtagcgattatttgcgatcgcggcgaccgttacctgtctaccggcgtctttggtgaagagagttattcgcagggggcggggatttaa

SEQ ID NO: 4414 - DNA, 723 bp, Enterobacter cloacae
ttgatgtatgtcaagcaagatgggtatggcgcaatccgaaaaaaacggtataatcccgcgatttttttgcggatgccacctcagaggagaaagagaatgaagattgtggaagtgaaacacccactcgttaaacacaagttgggcctgatgcgtgagcatgacatcagcacgaagcgttttcgcgaactggcttctgaagtgggtagcctgctgacctacgaagcgacctctgatctggaaacggaaaaagtgaccatcgaaggctggaacggcccggtacaggttgagcagatcaaaggtaaaaaaattaccgtggtgccaatcctgcgtgcgggtctgggcatgatggaaggcgtgctggagcacgtcccaagcgcgcgtatcagcgtggtgggtatctaccgtaacgaagagacgcttgagccggtcccgtacttccagaagctggtctctaacattgatgagcgtatggcgctggtggttgacccgatgctcgcgaccggcggttcgatgatcgccaccatcgacctgctgaaaaaagcgggatgcagcagcatcaaagtgctggtgctggttgcggcgccggaaggtatcgcggcgctggaaaaagcgcacccggacgttgaactctataccgcgtctgtcgaccagggactgaacgagcacgggtacatcatcccggggctcggcgatgccggcgataagatttttggtactaaataa

SEQ ID NO: 4415 - DNA, 1113 bp, Enterobacter cloacae
atacaattcaccgtctcactcccgccattcgattcagggaagggttgtatgctcgaaatgttaatgcagtggtatcggcgtcggtttagcgacccggaagccattgctttgctggtcattctggttgccggattcggtatcctgttcttctttagtggcctgctggcaccgctactggtggcgattgtactggcgtatctgttggagtggcccaccgcgcgtctggaacatatcggctgttcccgccgctgggcgaccagcattgtcctggtgctgtttgtcggtattctgctgctgatgtccttcgtggtgatgcccatcgcctggcaacaggggatctacctgatccgtgatatgcccggcatgctgaataaactgtctgattttgccgccacgctgccgcgccgctatcctgcgctgatggacgccgggattatcgatgcgatggccgaaaacatgcgcgcccgcatcatgaccatgggtgattcggtggtgaaatactctctggcctcgctggtggggttgctgacgctggcggtttaccttgttctcgtgccgctaatggtgtttttcctggtcaaagataaagagcagatgctgaacgcggtgcgccgcgtgctgccgcgcaatcgcggtctcgccggtcaggtctggcaggagatgaaccagcagatcaccaactacattcgcggcaaagtgctggagatgattgtggtgggcgtggcgacctggattggcttcgtgatcttcgggctgaactactcgttgctgctggcggtgctggtcggattctcggttctgatcccgtatatcggcgcgtttgtggtgaccattccggttgtgggggtggcgctgttccagtttggtctgggtacggagttctggagctgtttcgccgtatacctgattattcagggactggacggaaatctgctggtaccggtgctgttctcagaagccgttaacctgcatccgctggtgattatcctgtcagtggtgattttcggcgggctgtggggattctggggggtattcttcgccattccgctggcgacgctgattaaagccgtggtccacgcgtggccggatgtgccggcggtggaagataagtag

SEQ ID NO: 4416 - DNA, 1044 bp, Enterobacter cloacae
ggagatttgatggcttattcagtacagaagtcgcgcctggcgaaggttgcgggtgtttcgcttgttatgctcctcgctgcctgtagttcagactcgcgctacaagcgccaggtgagcggtgatgaatcctatctggatgcgccgccgcttgctgaacttcacgcgcctgccggcatgatcctgccgatccagaacggtgattataatattccggttaccaacggcagcggcctggtgggtaaagcgctcgatattcgtccgccagctcagcctctggcgctcgtgagcggcgcgcgcacgcagttcaccggtgatacagcttctctgctggtggaaagcgcacgcggtacaacgctgtggccgcaggttgtaagcgtcattcagtcgaaaaactatacgattgataaacgcgacgacgccagccaagctttaaccaccgactggattgagtggaaccgtctcgatgaagaccagcagtaccgtggtcgttatcaagtctccgttaagccgcagggttatcagcaggcggttaccgttaagctgttgaatcttgatcaggcaggtaaaccggttgccgatccgtccgccatgcagcgctacagcactgaaatgctgaacgtgattgcagcgggtctggataagaacgctaccgatgccgcaaacgccgcgcagaaccgtaacggctcaacctttgacgtgcagagcggtgcagacgataccggtctgccgatgctggtggtgcgtgcgccgtttaaccagacctggcagcgtctgccagcaacgcttgaaaaagtgggcatgaaggtgactgacagcacccgttcaacgggcagtatcacagcgacctataagccgctgtctgatagcgcctggcaggagttgggggcaagcgatccacagctgccttccggtgactacaaaatccaggtcggcgacctcgataaccgcagcagcctgcaatttatcgatccgaaaggacacacgctgacccaggcgcagaacgatgcgctggtcgctgccttccaggccgcattcagcaaataa

SEQ ID NO: 4417 - DNA, 1968 bp, Enterobacter cloacae
taccttcggcaaagctatgtgatgttggggtttgaacagctggttaaccagcttcagcgtaccgggcaccgccggctggtggtgctcagcggcgatgaagcgtggacgttgagccaggtgacccatctgcgcgatacgttaccaggagactggctgtggctggaggaaaacccctctaaggccatcagcggcctgctgggacgtgaatacctgcacgccgtttttgacgcgcgagacgggtttgacgtctcggccttcgccgccctcagcgggaccctgcgcgccggaagccttctggtgctgctggtgccgccgttctccgtctgggccgacaggcccgacagggattctctgcgctggagcgacagcgcagagccgatcgccaccccgcactttgttcaccacttttgtcggatgcttgccgccgattcagatgccatcgtctggcatcaacatcgtcctctgtgccttcccgttgcgccagatttacccgcctggcagcccgccagcggtgaaccgcagcgcgagcaggctgaaatcctcgacgctcttctgaccatgtctgcgggcgtggccgccgtgacggcgccgcgcggacgcggaaagtccgccctggcgggcatgttgctgagcggcattcaggggagtgcagtagtgacggcaccggcaaaaggggcgacggatgtcatcgcgcgtttcgccggggaacgttttcactttatggccccggatgcgctgctggcctccaccacagaagctgactggctgattgtcgatgaggcagccgctatccccggcccgctgctggagaagctggcgtcgcgctttccccgcgtgttgctgaccaccacggtgcagggttatgaaggcacgggcaggggattcctgctgaagttctgcgcccggttcagcgggctgcggcgttataccttatccacgccagttcgctgggctaccggatgcccccttgagcggatagtggcgaacgcgctgctgttcgacgatgcgcttatcgatcgcaaaccggcaggggaggtacgtttaacgtcgctggagcccgggatatgggagagcgatccggcgcgcggggcaggcgtgtatgaactgctttgtgccgcgcactaccgaacgtcccccctcgatttacgccggatgatggacgcccccggccagcactttgctgttgctcaggcgggcgcggagatcgctggcgcgctctggctggtggaggaggggggattaccccctgaacttagccgcgcagtatgggcggggtttcgtcggccgcgtggaaatctggtggcgcagtcgctggcggcgcacggcggttcgccgctcgcggcgacgctgaaaggccgacgcgtcagccgcattgcggttcatccccatcgccagcgggaaggcatcggccagcggctgatccgcagtgccagcggagaagattatctctcggtcagctttggctataccgacgagctgtggcgtttctggcggcagtgcgggtttgtgctggtgcggatgggcagccaccgggaagccagcagcgggtgctatacggcgatggcgttgctgccgctgagcgaggcggggcatcagctctgcgaacaggcgcatcagcgtttatgtcgtgatatgcgcgtcctgtcggcctggaatggcgaaaagatcccggtgacggatgcatgggaagctacccttaatagtgatgactggctggagctggcggggtttgcctttgctcaccgggcgttttcaacctcggttgcggcgttaacgcgattggtgttagccgtggacatcccactcccggcgctgcgcgggaaaatggaagggaatacgcacgatttcgggcgcaaagcgttgctggcgaagctacgcgaggaaaccgcacacgcgcttgaaaggcttgattactcccgtagccagcagctgaaagccgacattttgcaatggcaattttttcaatga

SEQ ID NO: 4418 - DNA, 1134 bp, Enterobacter cloacae
atctatccgataaatccgattgagccagcccgcccagggcacgaagatacgccccagattgacctattcgtttccggggctgtgccgttcatgcgctactgcgtttttcttctcttcttcatttgcgtgcttcccgcgcctcgggtgtgggctgcacctgcgcagcagtctttttcagactggcaggtgacctgcaataaccagaacttctgcgtagcgcgcaacactggcgagcatcgcggtctggtcatgtcgctgagccgcagtgcgggggcaaaaacggacgccagcctgcgcattgatctcggtgggctttcggcgcctccggtgaaagagcctgacatcgccccgcggctgctgctcgacaatgtgccgcttaaactcacgtcgcaacactggcagttaaccccctggcatcttaaaacagacgatacgggcaccatcaccacgtttctgaaaactattcaggaaggtcaggcgctgactctgcgcggggggaagcagacaatctctctggccgggctgaaagcggcgctgctgtttatcgatgcccagcaaaaacgcgtcggaagtgaaacggcatggattaaaaaaggggatagtccaccgctgagcgtgccgcctgcgccggcattaaaaaaggtggcggtggtgaaccccacgccaacgccgctgacgcataacgaattgaacgatctgctggattacggtaactggcgcatgaaccacagccagtgctctctcgatccgaaccggcgtgaggtgcgcgtgaccgcgctgaccgatgacaaagcgctgatgatcatcagctgtgaggcgggggcgtacaacaccgtcgacctggcgtggctggtgtcgcgtaaaaaaccgtttgcggccaggagcgtgagattgcgtctgccgtttaccccttccagccagagtagcgacatggagctgatgaatgccagcttcgatgaaaaaaagcgcgagctgaccacgctggcgctgggacgcgggattggcgactgtgggatccagacccgctggcgttttaacggccagcgcttccgtctggtacgctacgcggaagagccaagctgtgataactggaatgggccagatgcctggcccacgctgtggatcacaaggtag

SEQ ID NO: 4419 - DNA, 918 bp, Enterobacter cloacae
cactctgcaaagtcgctttggtcgacgtgtggtaggtcactgatggcggaagttacgcaattgaagcgctatgacgcgccccgcatcaactggggcaaatggtttctgattggtaccggcgtgctggtctccgcattcattctcgtcgtgccgatggtgtacatcttcgtacaggccttcagcaaagggattatgcccgcgctgcaaaatctggccgatccggacatgctccacgccatctggctgacggtgatgattgccctgatcactgtcccggtgaatctggtgtttggcgtattgctggcctggctggtaacgcgctttaacttcccggggcgtcagctgctgctgaccctgctggatatcccgtttgcggtgtctcctgtggtggcgggtctggtttatctgctcttctacggctccaatggcccgctgggcggctggctggatgaacacgacctgcaaatcatgttcgcctggccggggatggtgctggtgaccgtctttgtcacctgtccgttcgtggtgcgcgagctggtgccagtgatgctcagccagggcagccatgaagatgaagccgcggtgctgctcggcgcttccggctggcagatgttccgccgcgtcacgctgccgaatatccgctgggcactgctttacggcgtggtgctgaccaacgcccgtgcgatcggtgagtttggcgcggtgtcggtagtatccggctcgattcgcggcgaaaccctgtcgctgccgttacagattgaattactggaacaggactacaacactgtcggttcctttactgccgcagcgttgctgacgctgatggccattttgaccctgtttttgaagagtgtggtgcagtggcgtttagagaatcaggaaaaacgtcagcatcaggagggaaatcatgagcattga

SEQ ID NO: 4420 - DNA, 456 bp, Enterobacter cloacae
agatcggcgtggatggtggaaacaccggcagcggggaccattggggttcatttagccaaagaagttgatttctttagtatcggtaccaatgatttaacgcagtacaccttggcagttgacggtggtaatgatatgatttcacatctctaccagccaatgtcaccgtccgtactgaatttgatcaagcaagttattgatgcttctcatgcagaaggtaaatggactggcatgtgtggtgagcttgcaggcgacgaacgtgctacacttctgttgctgggtatgggtctggacgaattctctatgagcgccatttccatcccgcgcattaagaagattatccgtaacacgaacttcgaagatgcgaaggtgttagcagagcaggctcttgctcaaccgacaacggacgagttaatgacgctggttaacaagttcattgaagaaaaaacaatctgctaa

SEQ ID NO: 4421 - DNA, 387 bp, Enterobacter cloacae
ctgaaccgcctcgctgtgccacggcagcgcgtccagccttgcgctgcgctgtcggcgctgtttaaccagcttatccagcacggctggggtggcgagcgtaagcacctctgccgggcagttttcaacgcaggccgggccttgcggcctttccaggcagaggtcgcatttgtgcgccgaggcctttacgctgtcgttttccagcggggcgatcagcatgtccatcgtgccaaacggacaggccaccacgcaggctttacagccaatgcatttttgttgattgacctgtacgctgtcgctgtgttgcgtgatggctccgttcgggcagctttgcgcgcagggcgcattttcacagtggtggcaggtcacggggctttttcgcaagcctga

SEQ ID NO: 4422 - DNA, 591 bp, Enterobacter cloacae
ccacgcaaaggaagaacaggtttgacaacctcatcacaacattacctggttatcactgcgctgggtgctgacaggccgggtatcgtgaataccatcactcgccacgtgagcagctgcggctgcaacatcgaagacagccggctggctatgcttggcgaagagttcacgttcatcatgctgctttccggaacatggaatgccattaccctcatcgaatctaccctgccgctgaaaggcgcagagctggatttactgattgtgatgaagcgcaccaccgcgcgcccgcgtccggctctgcctgccacggtctgggtacaggttgaagtgcctgattcacctcatctgattgaacgttttacggcgctgtttgacagccatcagatgaacattgccgaactggtttcccgcacacagccgggcgatgaaaacgcaatcccgacgctgtttattcaaattaccgcacacagccctgcctcgcaggatgcgtcaaatatcgagcaagcgttcaaagccctctgtacagaattacacgcgcaaggcagtataagcgtcgtcgattattcgcagcacgaacaggatggagttgagtaa

SEQ ID NO: 4423 - DNA, 462 bp, Enterobacter cloacae
agcttggcagcctgcaacaggcccgctacgatgcgcgaatcgaccagctgcgcggcctgcaacaacgctttaagccgtacgagaagatgtaataaaggagaagtcatgacagacgcggtaaaaatttaccataaccctcgctgctccaagagccgcgagacgctgaatctgctgaagtctaacggcatcgatccggaagtggtgttgtatctggagacgccgccggatgcgcagacgatccgccagctgctgaagatgcttaacatgggcagcgcacgcgacctgatgcgtcagaaagaagatctgtataagtcgctcaatctgaacgataccagtctcactgaagatcggctgattcaggcgatggtcgacaatcctaagctgattgagcgcccgattgtggtggcgaacggcaaggcgcgtatcggccgtccgccggaagacgtactcgggatcgtctaa

SEQ ID NO: 4424 - DNA, 696 bp, Enterobacter cloacae
atgaaaaacatcgtggtgctcatttccggcaacggaagcaatttgcaggcaatcatagacgcctgcaaacagaagaaaatcaatggcaccattcgggcagtattcagcaacaaggccgatgcattcggccttgagcgcgcgcgggaagcgaacattcctgcgcacgcgctggaagccagccagttcgccgggcgtgaagcctttgaccgtgagctggtgcaggagattgacgcctacgcgcctgacgtggtggtgctggcaggctacatgcgcatcctgagcccggcttttgttgcacactacgccggacgactgctcaatatccacccttccctgctaccaaaataccccggtctgcacacccatcgtcaggtgctggagaacggcgatgaggagcatggtacctccgtgcatttcgttaccgacgagctggacggcggtccggtcattttgcaggcaaaagtaccggtctttgacggtgacaacgaagacgacgtgaccgaacgtgtacaggctcaggaacacgccatttatccgctggtggtaagctggtttgttgacggccgtcttgagatgcgcgacggcgcagcctggctggacggagtgaagttgcccccgcagggttatgctgccgaaggagtagtctgtttgaattgcccggcggcgcttcgcttgcacgggcctacggtcccgtag

SEQ ID NO: 4425 - DNA, 537 bp, Enterobacter cloacae
ttattcacctctgcggtgccaaaaagaacaagattcaccgcaacccaggacagaaaaatgttagattaccgcttcccgacagctttgcagatggttctcagcgtagcgatggcggagcaatcgggtgaacgttcgacgagtgcaatcctggcctacggcctggaggcgaatccgagctttatccgcaagttaatggttccgctcgcccgcgacggcattatcgtctccacgcttggccgcaacggctctattcatcttggccgcccggcggaagagattaccctgcgtgatatctacctttccgtcactgaagataaaaagctgtgggcgtcccgtcctgacgtcccggcccgctgcgtggtcagcgccaacgcctgctggtacttcaaatcaatcgctgatgaagcggagcaggcttcgttagcggttttagcgcgccataccgtcgccagcgcgctggaagaggtgaaaaaagccgataccagcgggtgcgatccggtgccggaactctgtacgcagcataaaaaagcgccttaa

SEQ ID NO: 4426 - DNA, 519 bp, Enterobacter cloacae
gagaagatcatgggtttgttcgataaactgaaatctctggtttctgatgacaagaaagactccggaactattgagattgttgctccgctctccggcgagatcgtcaacatcgaagacgtgccggatgtagtgtttgctgagaaaatcgttggtgatggcattgctatcaaaccaactggcaacaaaatggttgctccagttgacggcaccatcggtaaaatttttgaaaccaaccatgcgttctctatcgaatccgatagcggtatcgaactgttcgttcacttcggtatcgacaccgttgaactgaaaggcgaaggcttcaaacgtatcgcggaagaaggccagcgtgttaaagttggcgacccggtaattgaattcgatctgccactgctggaagaaaaagccaagtctaccctgacgccggttgttatctccaacatggacgaaattaaagaactgatcaaactgtctggcagcgttaccgtgggtgaaaccccggttatccgcatcaagaagtaa

SEQ ID NO: 4427 - DNA, 927 bp, Enterobacter cloacae
tcaaaaagcgcactccaggaaacgttgatgaaaccgaatgcacagctggtcaaaactttcctgatgcagctacaggacgcgatttgccagaaactttccgccgcagacggcggtgaattccaggaagacgcctggcagcgcgaagcgggcggcggcgggcgcagccgcgtgctgcgtaacggcggtatttttgaacaggccggggtcaacttctcccacgtccacggtgatgcaatgccagcgtccgccacggcgcatcggcctgaactggcgggccgcagcttcgaggcgatgggcgtctcgctggtggcgcatccgcataacccgtttgtgccaaccagccacgccaacgtgcgctttttcatcgcggaaaaaccgggggccgatccggtctggtggtttggcggcggtttcgacttaacgccttactatggcttcgaagaggatgccgtgcactggcacaccaccgcgcgcgacctctgcctgccgtttggcgaagacgtttacccgaaatacaaaaagtggtgcgatgactatttctatctgaagcaccgcgacgagcagcgcggcatcggcgggctgttctttgacgatctcaacacgccggattttgataccgcattcagctttatgcgcgcggtgggtgaaggctttaccgatgcctatctgccgattgtcgaacgccgcaaaaacaccgactacggcgtgcgcgagcgtgagttccagctttaccgccgcgggcgctacgtggagtttaacctggtatgggatcgcgggacgctgtttggcctgcaaaccggtgggcgcacggagtccattctgatgtcgatgccgccgctggtgcgctgggaatacagctacgcgccaaaagaaggcagcccggaggctgccttgagtgagtttattcgggttcgggactgggtgtaa

SEQ ID NO: 4428 - DNA, 975 bp, Enterobacter cloacae
ctcttttatttccaaggagtaattatgaaccagctagacggcatcaaacaatttaccaccgtggttgcagacagcggcgacatcgagtcgattcgtcactaccagccggaagacgcgaccaccaacccctcgctgctgctcaaggcggccggtcttgcgcactttagtcatctgattgatgacgcccttgcctatggcaaacagcgcgggcaaacgcaggagcagcaggtcgccgaggccagcgacaagctggcggtcaatatcggtgcggaaattcttaaaagcataccgggacgcgtctccaccgaagtggacgcccgcctctcgtttgaccaggaaaagagcatcaacaaggctcgccgcctggtggaactctaccaggagcaggggatcgataagtcacgcatcctgatcaagcttgcgtctacctgggaaggcatccgcgcggcggaagtgctggagaaagatgggatccactgcaacctgacgctgctgttctccttcgcccaggcgcgtgcctgcgccgaagcgggcgtgttcctgatttcaccgtttgtcggacgtatctacgactggtatcaggcgaaacagccaatggatccgtacgtggtggaagaagatcctggcgtgaaatcggtgcgtaatatctacgattattacaagcagcaccgctacgaaaccatcgtgatgggggccagcttccgccgcaccgagcagatcctggcgctcgcgggctgcgaccggctgaccatctcccctgagctgctgaaaaagcttcaggagagtgaagagacggtgatccgcaagcttgtgccgacctctaccgttctgccaaaaccaaaacccatgaccgaagcggaattccgctgggagcacaatcaggacccaatggccgtggaaaaactggcggacggcatccgtcagttcgccgtcgaccagcgcaaactcgaagatcttctcgctgccaaactttaa

SEQ ID NO: 4429 - DNA, 384 bp, Enterobacter cloacae
atccacaaaagaacaaaaggattcactatggttgtgatgtacggcattaagaattgcgacacgattaaaaaagcccgccgctggctggaagcacacaacatcgactatcgcttccacgattaccgtgccgacgggcttgaccccgcgtttctccattccgccatcaacgaactgggatgggaagcgctgctgaatacccgcgggaccacctggcgaaaactggatgaatctctccgggccacgatcaacgacgccgacagcgcagccaaattgatgcttgaaatgccggcaatcatcaaacgcccattgctctgcaagccaggtcagcctatgctgctgggtttcagtgaaaccctttattcagatttattcgttgaggtgtag

SEQ ID NO: 4430 - DNA, 1131 bp, Enterobacter cloacae
tctatgtcatgcccggtcattgagctgactcagcagcttattcgccgtccttcccttagcccggacgacgcaggttgtcaggcattaatgattgagcgcctgcgtgccatcggttttaccgtggagcacatggattttggcgatacgcagaacttctgggcatggcgcggtcagggggagacgctggcgtttgccggacatactgacgtagttcccgcgggcgacgcagaccgctggatcaacccgccttttgagccgaccatccgcgacggcatgcttttcggacgcggcgctgcggacatgaaaggttccctggctgcgatggtcgtggcggcagagcgtttcgtcgcccagcatccgaaccataaaaaccgtcttgcgtttttgattacctccgacgaagaagccagcgcccataacggcaccgtgaaggtcgttgaggcgctgatggcgcgcaatgaacgtctggactactgtctggtgggcgaaccgtccagcaccgaagtggtgggcgatgttgtgaaaaatggccgccgtggatccctgacctgcaatttgactattcatggcgtgcagggccacgttgcctatccgcacctggcggataacccggtacaccgcgccgcgccgatgctgaacgaacttgtgagcattgaatgggataaaggcaatgaatttttcccgccaaccagcatgcagatagccaacatcaaggctggcaccggcagcaacaacgtcattcccggcgatctcttcgtccagtttaacttccgcttcagcaccgaactgactgacgagatgatcaaagcgcgagtgattgcgctgctcgagaaatatcagctgcgctataccctcgactggtggctgtctggccagccgttcctgacgcagcgcggtaaactggtggatgcggtagtgaacgccattgcgcactataatgaaattaagccacaactgctgacaacgggcggcacgtctgacggacgctttatcgcccgcatgggcgcacaggttgtcgaactgggtccggttaacgcgacgattcacaaaatcaatgaatgcgtgaacgctgccgatttacaactgctggcccgcatgtatcaacgtattatggagcaactcgtcgcctga

SEQ ID NO: 4431 - DNA, 201 bp, Enterobacter cloacae
cgaatggactggctttcaaagtactggtggattctggtgttggtatttctggtaggcgtgctgcttaacgtgattaaagatctcaagcgcgttgaccacaaaaagttccttgccaacaaaccggatcttccgccgcaccgtgattttaacgacaagtgggacgatgaagacgactggccgaagaaggaccagaagaagtaa

SEQ ID NO: 4432 - DNA, 1428 bp, Enterobacter cloacae
ggagttatgatgatcacgtaccagtttatcaacgcgctttcagacgcgaagccgcagagccatttgattgcgcgcgctgacagttccctgttaccggatagcgctcttatcgctgaaatgcgccagcagagcaccgtcgcggacgcgcgctttggctgcgcgccgtttgcccgcatcactctgttgccggatgcgctctggcatgacgccctgaccgaagggttgatcacggccctgcgaccgctgcttaccgcccccgccagcgccgaactcgtgctggacgtgacggatatcgacgatgtggtgctggcgcaggtactgcgttttctctttaatcaggcgcacatgctcagtgacctgaagctgaagaagacggacgaagcgctgcgccttacctgcatcactgccctctgcctgccggaacagcaggcgaagctggagacaaccttccgccagcagcaggccattgcgctcggcatggttgcggcacgacgtctggcggatatgccatccgaccgctgtacgccgcagtttgtggtggaagaggcgcaaaaactgtgtgccgccagccctgctctgcgctgcgaggtgttggatgaaaagcaaattgttgagcaggggctggggctactgcacgccgttggcaaaggggcgacctgcccgcctcgcctgctggctattcactataacggcgtgtctgatggcccggtgcgctgctacgtgggaaaaggcattacctttgacaccggcggcctgtggctgaaggaaggcgcgggcatgtacaccatgaaatatgacatgtgcggcgcggctaacgtgctcgggctgatgctgaccgttgcggagcagaaattacccgtgcgcatcatgggcgtgctggcgctggcggaaaacgccatcggccccgacgccatgcagcccggcacggtggcaacagcctgcaacggcattacggtggaaatcaacaacaccgatgccgagggccggctggtgctggcagacgctatcgcctgggcgagtcagcgccatccgcaggcgcattatattattgatatggcgaccttaaccggagcggtggtgaaagcgctggggtatgagctgagcgggctgatgacccaggatgagccgttgcgtcaggcactgacgctcgcgggcaaacggagcggcgacgaggtgtggtccctgccgctggatgcgaggctgagaaagcaaaccgacagcgcgattgccgatctgtgcaacacgccgaccaacaatgcggcgatcagcgcctcggcggcgtggctgctgcaccatttctgcccgccgactattccgtgggcgcatctggatatcagcgggacggcgctgtggcgagaaaacggacggagcgtggcgtcgggaagaccgattccgctgctggtggagcacttgttgggggatctttag

SEQ ID NO: 4433 - DNA, 1041 bp, Enterobacter cloacae
gccgtgaccaacaaaacttctctcagctacaaagatgccggtgttgatattgacgcaggtaatgcgctggttgaccgaatcaaaggtgtggtgaaaaaaacccgccgcccggaagtgatgggtggcctgggtggattcggcgcactgtgcgcgctgccgcaaaaatatcgtgaacctgtgctggtctcgggtacggatggtgtcggtacaaaactgcgcctggcgatggatcttaagcgtcacgatacgattggtatcgatctggtggcgatgtgcgtcaacgacctggtggtacagggcgctgagccgctgttcttcctggattactacgcgaccggcaagctggacgtggataccgcagccagcgtcattaacggtatcgccgaaggctgcctgcaatccggctgtgcgctggtcggcggtgaaaccgcagaaatgcctggcatgtatcacggtgaagattatgacgtcgcaggcttctgcgtcggcgtggtagaaaaatcagaaattatcgacggcagcaaagtggctgacggcgatgtgctggttgcgctggcctccagcggtccgcactccaacggctactctctggtgcgtaagatcctcgaagtgagcggttgcgacccgctgaccaccgagctggacggcaaaccgctggccgatcacctgcttgccccgacccgcatctacgtgaaaaacgtgctggagctgattgagaacgttgacgtgcacgccatcgctcaccttaccggcggcggcttctgggaaaacattccgcgcgtgctgccggataatacccaggcggtgatcgacgcctcctcatggcagtggccgtccgtcttcaactggctgcaaaccgcaggcaacgtgagcgagcatgaaatgtaccgcacctttaactgcggcgtgggcatggttatcgccctgcccgccagcgaagcggataaagcgattaagctgctgacagaaaaaggtgaaaacgcgtggaaaatcggtacgattaaagcttcagattccgaacagcgtgtggtcattgaatga

SEQ ID NO: 4434 - DNA, 2067 bp, Enterobacter cloacae
gctgtaatgggtcaggaaaagttatacatcgagaaagagctaagctggttagcattcaacgaacgtgtacttcaggaagcggccgataaaaccaacccgctgattgaacgtatgcgttttttaggcatctattccaacaatctggatgagttctacaaggttcgcttcgccgaactgaaacgccgaatcatcatcagcgaagaacagggcttaaactcccactcgcgacatctgcttggaaaaatccagtctcgcgtcatgaaagccgatcaggaatttgatggcctctataacgagctgctgctggaaatggcacgcaaccaaatcttcctgatcaacgaacgccagctctccgcgaatcagcaaaactggctgcgccactattttaaacattatctgcgccagcatatcaccccgattctgatcaaccgtgaaaccgatctggtgcagttcctgaaagatgactacacctatctggcggtagaaatcattcgtggtgagaccattaactacgcgctgctggaaataccgtctgataaagtcccacgctttgtaaacctgccgccggaaaccccgcgccgacgtaagccgatgatcctgctggataacatcctgcgctactgcctggacgatatcttcaaaggcttcttcgattacgacgcgctcaacgcctactcgatgaagatgacccgtgacgccgagtacgatctggtgcatgagatggaggccagcctgatggagctgatgtcttccagcctcaagcagcgcctgacggcggagccagtgcggtttgtctatcagcgtgatatgccggacgcaatggtggagatgctgcgcgataagctgaccatctcccgctacgactccattattcccggcgggcgttaccacaactttaaagatttcattggcttcccgaacgtcggcaaagccaatctggtgaacaaaccgctgccgcgcctgcgccatatctggttcgataagttccgcaacgggttcgacgccatccgcgaacgggatgtactgctctactatccgtatcatacctttgagcacgtgctggaattgctgcgtcaggcctcattcgatccgaacgtgctggcgattaaaatcaatatttatcgcgtggcgaaagattcccgcatcatcgatgcgatgatccacgcggcgcacaacggcaagaaagtgaccgtggtagttgagctccaggctcgcttcgacgaagaggccaacatccactgggcacgccgactgacggaagcgggcgtgcacgtcatcttctccgcgccggggctgaaaattcacgccaagctgttcctgatctcccgtaaagagggtgacgaggtggtgcgctacgcccatattggtaccgggaactttaacgagaaaaccgcgagaatctacaccgactattcgctgctgactgccgatgcccgcatcaccaacgaagtgcgtcgggtgttcaacttcattgagaacccgtaccgcccggtgagcttcgattatctgctggtgtcaccgcagaactcacggcgcctgctgtacgatatgatcgacaaagagattgccaatgcgcagaacggcttgtcgtccggcattacgctgaagctcaacaatctggtggacaaagggctggtggaccgcctgtacgcggcctccagttctggcgttccggtaaatctgctcattcgcggcatgtgctcgctcattccggaactggaaggcattagcgataacatccgcgtgatcagcattgtggatcgctatcttgaacacgatcgcgtctatattttcgataacgccggtgataagcgcgtatacctctcgtccgccgactggatgacgcgtaacattgattaccgtattgaagtagcggcaccgctgctggatcctcgcctgaagcagcgtatcctggacattatcgagatcctgttcagcgatacggtgaaagcacgttatatcgacaaagaactcagtaatcgctatgtaccgcgcggcaatcgccgtaaagtgcgctcgcagctggcgatttacgattacattaaatcacttgagcaacccgattaa

SEQ ID NO: 4435 - DNA, 1542 bp, Enterobacter cloacae
cctatgccaataaacgataataccccacgcccgcaggagttcgctgcggtcgatcttggctcaaacagtttccatatggtcatcgcccgcgaggtggatggcgcgatgcagatcatcggtcgtctgaagcagcgtgtgcatctggccgatggtctcgacgcgcgtaacatgctgagcgaagaggctatggagcgcgggctgaactgcctgtcgctgttcgcagaacgtctgcaaggcttttcaccgtccagcgtctgcatcgttggaacgcatacgctacgccaggcgctgaacgcgccggaatttcttaagcgcgcggaaaaggttatcccctacccgattgagatcatctccggtaacgaagaagcgcgcctgatttttatgggcgtggagcatacgcagccggaaaaaggccgcaagctggtgattgatatcggcggtggctccacggaactggtgattggcgaagacttcgagccgcgtctggtggaaagccgccgtatgggctgcgtcagcttcgcgcagatgtatttcccgggcggcgtcatcacccgcgaaaacttccagcgcgcgcgcatggccgccgttcaaaaactggaaaatctggcctggcaataccgtattcagggctggaacgtggcgctgggcgcatcagggtcgattaaagcggcccatgaagtgctgctggcgatgggtgaaaaagacgggtttattacgcctgagcgcctggtgaaactcaccgaagaggtgcttaagcataagagcttcgacgccctgagtttgccgggtctgtccgacgaacgtaaagccgtgttcgtaccggggctggcgatcctctgcggcgtgtttgacgcgctggcgatcaaagagctgcgcctctctgacggcgccctgcgtgaaggcgtgctgtatgagatggaaggacgtttccgtcatcaggatattcgcagccgtaccgcgcagagcctggccaaccagtacaacatcgaccgtgaacaggcgaagcgtgttctcgaaaccacggtgcagatgtacgagcagtgggaggagcaaaatcctaagctggcgcatccgcagctggccgcactgttaaaatgggccgccatgctgcacgaggtggggctgaacattaaccacagcggaatgcatcgccattcagcctatattctgcaaaacagcgatctgcctggcttcaaccaggagcagcaaaccatgatggcgacgctggtccgctatcaccgcaaagccatcaagctcgacgatctgccgcgctttacgttgtttaagaaaaagcagttcctgccgctcattcagctgttgcgcctgggcgtattgctcaataatcagcgacaggcgaccaccacgccgccgacgctgaagctaaaaacggatgactatcactggacgctgagcttcccgcacgactggttcagccagaacgcgctggtactgctggatctggaaaaagagcagcagtactgggaagcggtcaccggctggctgttgaagattgaagaagagagttctgaggcggcagcgtaa

SEQ ID NO: 4436 - DNA, 225 bp, Enterobacter cloacae
ccgtatcgcccaaaagggtatactcaggaaaagaaagtgagtcaggctacgcgtatgcgaaaacgacatcgatttaacacccggatgacccgcatcatactgctcatcagtttcctgtttttctttggccgctttgtttattcctccattggcgcctggtatcaccatcaggacaaaattcagtcgcagcaatcaggcctcgttgtggattcgcccgagcgctaa

SEQ ID NO: 4437 - DNA, 1236 bp, Enterobacter cloacae
aaaataatggaaacacctgcactccctcgccgtcttgcgctcactgcgggatgtaatcaactcattaactgggggatctccttttacatgccgggaacctttgctcatgccattacagcagaccgaagctggtcgtcccccgaaatctatctcggcctgacgctggccatgctggttatggctattgtctcgccgtttgtcgctcctctgctggcgcgttttggtggacaaagggtggtaatgagcgggaccttgctgatcgccgtaagctgtctgtcaatggcctttacgcccacactttcaggctggtatggcgcctggttgctgaccggcatcgggatgcgcctgtcgctgtatgatgcgcttttctccgctcttgtggacctatacggaccgcaggcacgcaggacaatctctcgtgtcaccctggcgggcgggctggcgtccgctgtcttttggccgctgggagacgccttactgaacgtgatgggttggcaggatgcgctgaagatctacgccctgttcggtctgctcagtgccctgcttcttcggcgcttcccgcgccagcgctttacggtcaagcccaaagcatgtacgcaggtttcccctcatgacaggcgtaacggctggctttatgcaaccttcattgctctcatcaccttcgtctctaacggcacctctacccaccttcccgaatttatcgccagcttcggcctgccggtcgccgtcggcatgctgtggggaatggggcagaccggtgcacgccttatggaggtgctggcaggggcgcgcctcactccgctaaaactgacgcttttcactgcgctcgccatgccgctttgttttctcatcggactgagcagcgacatgctggcctggtgtgccgccggatttgtgttcggctttggtgccattaacgggctggtgactatcgtcaaagcgacgctacccctggaactgtttagtacagagcgctatgccagccgcacggggctgctgcttattccaggccaactgatggcagccgcctctccgtttgcgtatgcgtggctgaataagtcgctgggtataacaggcggaatgtgggtttccgcaggactgacgctggtcattgcggggttcgcagtggcgctcgtgcgcagcccaggcaaacaaactgtatcgcactgtatcccgagcgctacgctgacaaaccggtacaaaacgcccgcagaagcaaacatccccgatacataa

SEQ ID NO: 4438 - DNA, 1407 bp, Enterobacter cloacae
taccgtacccgttcagaaggcggcaggttgatgcgtaatttttggcaccacctcaggcttcccacactggtcaggcgaatgctggtcgcccagatgctgctgcttacgttgctctggtgtctctttttaaccttcattttgctggaagacctgcgtagccctcccatactgacgggcagtgagacttacgaaaccgttttttccctggtagagagcatggacgatcgcccgcaggcgcgtgatgccgtgctggcagcgttcagcaaggcgctgcgggagggctatggcggcggtgaatacccggagctgtccatcaacctcattgttcgcaagaataacgagattattttttcttcggatggtgcgccaacgggggtaaaaaatagccgtctgggggtcatgcagcatgtccagagtgaggaccatacatggacaagccgtaccctcaaatccgcgcactccgacgtggaggtcaccctttttacccctgccggtagctggaatttctttatctatctgaactcgcgcggctactacgtcatgccgctgatgatatgcatcccttttcttctgttccccgcgtggctgtccatccgcatcgcgatgcgcccctggaacaaggtggtagatgaaatttcattgcgcacgccggacgatctctcgcctttaaaagccgtccccagacacagagagcttcgccagacggtcgacgcgattaatgactttctggccagggtgcaggaaagcgccgaaagggaaaaaatgtttattgccgatgccgctcacgaactgcgtacgcctctggccgcgatgcggatcaacgtcgaggcattgcagtcctgggtcatcagcgaaagccagcaggaactgcttgcgggcattgttcgcagcaatagccgtgctgcgcgtctcatcaatcagcttctgctgatgatgcacagcgaagcacacatcagccctgtgccgctgacaacgcttattcaggagcgaatggctgccctggaaccgctggcgtccggacgcagaattgagtttgaattcttcgccgacgatgaaatccatgtcgcaggcattcgggaacgtctggtgtcgctgatcgacaatttaattgagaatgccgtgaagtacagccctgagggtggacgcattgaggtacaactgcaatcgcgtgataaatgcgctcagctgcgcgtctcagacgcgggccccggtatcccgattgaactgcgggagcgcgtgttcgacagatttttccgcgatcctaatcagacccaaagcgggagtggactggggcttgccatcgtcaaagccgttacgcagcaacacaacggcagggtcaatctgagtacgtcagccgaaggtggtcttatggtgaccgttgatttcccgaatccggcgttcgcatga

SEQ ID NO: 4439 - DNA, 321 bp, Enterobacter cloacae
aaacgggtcacctttaagtgcaacaaacaaagatgctttttaatgcgtggcgtagggggaagcaagatgaacacgggtgcattcattcacgatttactcgactggatcgacaacaacctcgatagccgtctggacattgaaaccgtctccaggcgagccggctattcgaaatggcacctccagcggcttttcaaagaacataccggctcccctctcgccgaatatattcgcgcgcaaaagctgcaaaaatcggttgagcgcttagcccacagccatgaaccgattctgtacgtggacttgaccacgggcaagagatccgcg

SEQ ID NO: 4440 - DNA, 909 bp, Enterobacter cloacae
caccaggaccccaatttttacaattcaggccgcatgagcacattcaaaccattaaaagcactcacatcgcgtcgtcaggttctcaaagcggggctggcggccttaacgttaacgggcatcgcaaagcaggctcaggcaaaagacgagagcacgcttaaaaccagtaacggacacagcaaaccgaaaaccaaaaaagccggcgcaaagcgtctggtcatgctcgatccaggccacggcgggatcgacaccggcgccattggccgaaacggttcgaaagaaaaacacgtcgtgctggcaattgcaaaaaatgtgcgcgcaattttacgcagcaacggtattgacgcccgcctgacgcgcacgggcgacacgtttatcccactgtacgatcgcgtggagattgcccacaagcacggcgcagacctgtttatgtccattcacgcggatggcttcacaaacccttccgccgcaggcgcctcggtgttcgctctctccaaccgtggcgccagtagcgccatggcgaaatacctctccgatcgtgaaaaccgggcggatgaagtggccgggaaaaaagctaccgacaaagaccatctgttacagcaggttctgtttgatctcgtgcagaccgataccatcaaaaacagcctgacgctcggctcgcatatccttaaacggattaagcccgtgcaccgtctgcacagcaaaagcaccgagcaggccgcgtttgtggtgctgaagtccccgtccataccgtccgtgctggtggaaacctcgttcattaccaacccggaagaagagcgtttactcggcaccacggcgtttcgtcagaagatcgcgaacgccatcgcctccggggtcatcagttatttcaactggttcgataatcaaaaagcgcactccaggaaacgttga

SEQ ID NO: 4441 - DNA, 1992 bp, Enterobacter cloacae
actatgtcccgtaaagagctcgccaacgccattcgcgccctcagcatggatgccgtacaaaaagccaattccggccaccctggcgcccccatgggtatggctgatattgccgaagtgctgtggaacgacttcctcaagcacaacccgaccgatccgacctggtacgatcgcgaccgttttattctctccaacggtcacgcatcgatgctgctctacagcctgctgcacctctccggctacgatctgccgcttgaggagttaaaaaacttccgccagctgcactccaaaacgccgggccacccggagatcggctatacgccgggtgttgaaaccactaccggcccactgggccaggggctggcgaatgccgtcggcctggcgattgcagagcgtacgctggccgcgcagttcaaccagcccgaccacgagattgtcgatcactacacctatgtctttatgggtgatggctgcctgatggaggggatctcccacgaggtctgctcgctggcgggcaccctgggcctgggcaagctgattggcttctacgatcacaacggtatctccattgacggggaaaccgagggctggtttaccgacgacacggcaaaacgctttgaagcctatcactggcacgtggtgcacgagatcgacggtcacgatcctgaggcggtgaaaaaagcgattcaggaagcgcagagcgtgaaggacaaaccgtccctgatcatctgccgcaccaccatcggcttcggctcgccgaacaaagcgggcaaagaagaggcgcacggcgcggcgctgggtgaagaggaagtggcgctgacccgccagaaactgggctggaaacacccggcctttgagatcccaaaagagatctacaaggcctgggatgctcgcgaaacaggtgaaaaagcgcagcaggcctggaacgagaagtttgccgcttacaaaaaagcgtatccggatctggcggctgagtttacccgccgcatgagcggcggcctgccggaagactgggaagagaaaacccaggcgctgattgaaaacctgcaatccaacccggcgaaaattgccacccgtaaggcatcacaaaacaccctgaacgcaattggcccaatcctgcccgaactgctgggcggatcggcggatctggcgccaagtaaccttaccatctggtccggctctaaatccctgaaggaggacattgccgggaactacatccactacggcgtgcgcgagttcgggatgaccgccattgccaacggcatcgcccaccatggcggcttcgtgccgtacaccgctaccttcctgatgtttgtcgaatatgcccgtaacgcggcgcgtatggcggctctgatgaaggcgcggcaaatcatggtgtacacccacgactccatcggactgggtgaagatgggccgacgcaccaggcggtagagcagctggcgagcctgcgcctgacgccaaacttcagtacctggcgtccgtgcgatcaggttgaagcggcagtgggctggaagctggccgtagagcgtcataacggacccacggcgctgatcctgtcgcgccagaacctggcgcagatcgagcgcacgccggagcaggtgaaaaatatcgcccgcggcgggtacatcctgaaagacagcggcggcaagccagacgtgatcctgattgccaccggttcagaggtggaaatcacggtaaaagcggcggagaaactaaccgccgagggtcacgcggtgcgcgtggtttccctgccttcaacggatatctttgatgcccaggatgaggcgtaccgcgaatcggtgctgccttcaaacgtcgcggcgcgcgtggcggttgaagctggcattgccgactactggtacaaatatgtgggtctgaaaggggcgattgtcggcatgaagggttacggtgaatccgccccggccgataagctgttcccgtacttcggctttaccgttgagaacgtagtggagaaggcgctgagcgtgctgtag

SEQ ID NO: 4442 - DNA, 1695 bp, Enterobacter cloacae
gtgaccgttaaacgccccgtatcgggaagcctggctcgggctttcttttcgatgattgtcttgtccgttctgatcagcgccattgcgctggttacactcgccagcagccagcgcgacgccgaggcgattaacatcgccggatcgctgcgcatgcagagctaccgcctgggctacgaaatgcagcgcgccagcccgtcgctggcggagcaccgcgcggtctggcagaaaacgctgagcgcgcctgcgttgcagaagctaaaccgctggtatgtgcctgaggacgtcaaacagcgttaccagcagttgcaccttggctggcaggagatggacacgcgtatcgccagcggcgataccgggtggtatcagaaccacatagaggatttcgtgggcaggatagatgcctttgtgctggcgcttcagcactacaccgaacataaaattcagctggtgatttgcatgtcgctgacgggcggcctgggcatcctgctgctggcggtggtgaccctgcggcgcatccgccgtcaggttgtgctgccgctgaataatctggtggcggcgagcgagcgtatcgaacagggccagttcgacactcccgcgccggatactacgctgcccaacgagctgggccagctttcccgcgccttcaaccatatgtcggcggaattacacaccctgtaccgttcccttgagcactccgttgccgaaaaaacccgccacctgaatgaagcccatcagcagctcgaaatgctgttcaaatgctcacaggcgttgaataccgggcagatagacagccactgcttccggcatattttgcagattgtgcatgactatacgcagatgaattacctgcaattgcgcaccagtgacgactggcagctttacgaaggactggagaccccgggcgagaaaatgcacaatttaccggtgttaatgcaggataccctgtacggcgaactgcgctggcaaagcgcgaccggggatgttccgctgccgctcatggaaagcgtggcgacgatgctgggccgggggctctatttcaatcaggcgcagaaacattatcagcagttgctgctgatggaggagcgcgccaccatcgcgcgcgagctgcatgattcgctggcgcaggtgctctcctatttgcgtattcagcttacgctgctgaagcatgccgtgccgggcgacaatgccccggcgcaggctatcatcacggacttctctcgcgagctgaataacgcctggcatcagctacgcgagctgctcaccaccttccgcctgacgctcaatcacgccaatcttcctgccgcgctacaggagtctcttgacgggttgcaaagccagaccagcgcgaagttggtgctcgactgccgtctctcatcgctggcgctggacgcgcaaaaacaggtgcacctcttacagattgtgcgtgaggcagtgctgaatgcgattaaacatgccgacgcgagcgagattgtggtcagctgcgtcaccaccgcggacggcactcacacagtcacgatccgcgacaacggtattggtatcggcgacgccagtgaaccgccggggcattacgggctgaatatcatgcgcgaacgcgcgggacggctcggcgggacattacacttttctcagccgccacagggtgggacacaggtcagcgtaacgttccggacgcctgcggcgcaggctgaaaaatag

SEQ ID NO: 4443 - DNA, 3141 bp, Enterobacter cloacae
cgtgcagcaaaacgaggtcacactttaatggcgaattttttcatcgatcgccccatttttgcctgggtgcttgcaatcctgttgtgtctgacgggtgtcctggcgattacttcccttcctgttgagcaataccccgacctcgcgccccccaacgtgcgtatcacggcgaactatcctggcgcctcggcacagacgctggaaaataccgtcacgcaggttatcgagcagaacatgacgggtcttgataacctgatgtacatgtcctcgcagagcagtgccacgggccaggcgacggtaaccctgagctttacggcgggcacggatccggatgaagcggtgcagcaggtgcaaaaccagctgcaatcggccctgcgtaaactgcctcaggcggtgcagaaccagggggtgaccgtgcgtaaaaccggtgacaccaatattttgaccatcgcgtttgtttcaaccgatggctcgatggataagcaggacatcgcggactacgtcgccagtaatattcaggacccgctcagccgtatcaacggcgtgggtgatatcgacgcctacggctcgcagtactccatgcgtatctggctggatcccaacaagctgaacagcgtgcagatgaccgctaaagatgtcaccgacgctatcgaatcgcagaacgcccagattgccgtggggcagctcggcggtacgccgtccgtggacaaccaggcgcttaacgccaccatcaactcccagtcgctgctccagacacctgaccagttccgcaatattactctgcgcgtgaatcaggacggttcggaagtgcgtctgggggatgtcgccaccgtggaaatgggggcggaaaaatatgactacctgagtcgctttaacggcaatgccgcgtccggactgggggtaaaactggcctccggcgccaacgaaatggcgaccgcgcagcgggtgttagagcgtctggatgaactgtcgcattacttcccgcacggactggagtacaaagtcgcctacgaaaccacctcattcgtaaaagcctccatcgaagatgtggtgaaaaccctgctcgaagctatcgcgctggtgttcctcgtgatgtacctgttcctgcaaaacttccgcgccacgctgatccccaccattgcggtgccggtggtgctgctgggaacctttgcggtgctgtatgccttcggttacagcatcaacaccctgaccatgttcgccatggtgctggccatcggcctgctggtggatgatgccatcgtggtggtggaaaacgtcgagcgcattatgagcgaggaagggctttcgccccgcgaggccacgcgcaaatcgatgggacaaattcagggcgcgctggtcggtatcgccatggtgctgtcggcggtatttatcccgatggcattttttggcggcaccacgggcgcgatttatcgccagttctcgatcaccatcgtctctgcaatggtgctctccgtactcgtggcaatgatccttacccctgccctgtgcgcgacgctgctcaaaccgctgcataagggcgaacaccacggtcaaaaaggcttcttcggctggtttaaccgcatgtttaaccgcaatgcggcgcgctatgaagcgggcgtgggtaaagtactgcaccgcagcgtgcgctggatggtggtttatgtcctgctgctcggcggcatggtcttcctgttcctgcggctgccaacctcgttcctgccgctggaagatcgcggcatgtttattacttccgtacagttaccgagcggctcgacccagcagcagaccctgaaagtggtgcagaaggttgagaactacttccatactcaggagaaagataacgtggtctcggtcttctccaccgtcggctctggccccggcggtaacgggcagaacgtggcgcgtatgtttgtgcgcctgaaagactgggaccagcgcgacagcgataccggctcctcctttgccatcattgagcgtgcaaccaaagcgttcaacaaaatcaaggaagcgcgcgttttcgccagcagcccgcccgccatcagcggcttgggcagctcagccgggtttgatatggagcttcaggatcacgcgggtgccgggcatgacgcgttgatggctgctcgcgataaactgctcgagctggccgggaaagatccgcagcttacccgcgttcgtcataacggtctggatgacagccctcagctacaggtagatattgaccagcgtaaagcgcaggcgctgggcgtctccatcgacgacattaacgacaccctgcaaacggcatggggctcaagctacgtaaatgactttatggatcgcggccgcgtgaagaaggtctacgttcagtctgccgccaaataccgcatgctgccggacgatatcaaccgctggtatgtgcgcaataacaccggcggcatggtgccgttctcggcgtttgcgacgtcacgctgggagaccggttcgccgcgtctggagcgttacaacggctattcggcgctggagattgtcggtgaagccgcgccgggcgtcagtaccggtaccgcaatggacattatggaaaaactggttcagcagttaccgaccggctttggcctggagtggacggcgatgtcctaccaggaacggctttccggcgctcaggcgcctgccctgtatgctctttcgctgctggtggtattcctctgcctggcggcgctgtatgaaagctggtcagtgccgttctcggtgatgctggtggtgcctctcggggtcatcggcgcgctgctggcaacctggatgcgcggcctggaaaatgatgtctatttccaggtcggactcctcaccgtgatcggattgtcggcaaaaaacgccattctgatcgtcgaatttgccaatgagatgaatgccaaaggtcacgaactgatggccgccacgctgcacgcctgtcgtcagcgcctgcgtccgatcctgatgacctctctggcgtttgtgtttggcgtcctgccgatggccaccagctccggcgcaggctccagcagccagcacgcagtgggtacgggcgttatggggggaatgatatccgcgacgatactggctatctatttcgtaccgctgttctttgtgctgatacgtcgtcgtttcccgctgaaggataagccggaataa

SEQ ID NO: 4444 - DNA, 474 bp, Enterobacter cloacae
gtaatgaacccactgaaagccggtgatatcgcaccgaaatttagcttaccggatcaagacggcgagcaagtaaatttgaccgacttccagggacagcgtgttctggtctatttctacccgaaagccatgaccccgggctgtaccgtacaggcctgcggtctacgcgacaacatggatgagttgaaaaaggtcggtgtggaagtgctgggcatcagcaccgataagccagagaagctgtcacgttttgcggaaaaagagctgctgaacttcacgctgctttccgatgaagaccaccaggtttgcgagcagtttggcgtctggggtgagaagtcctttatgggcaaaacgtacgacggtattcaccgtatcagcttcctgattggcgctgacggtaaagttgagcacgtgtttgatgatttcaaaaccagcaaccaccacgacgtggtgttgaagtggctgaaagagaacgcgtga

SEQ ID NO: 4445 - DNA, 1632 bp, Enterobacter cloacae
ctgtcacaaaaaagactttcctttttgtttcactgtcaggtttcgcaaaaccctgatgaatgggattttcttcatctcttaacacggctacactcgcagagcagcggagatgaacgttatgcgggttcatcggtcaaattagcacatccaaaatacaggacagtggttatgttcaggcagttgagaaaaacactggttgcgacactgattgccgccgtgacggtgggtcaggtgttgcccgctttcgctgactcgtccgattcattgccggacatgggcaccacggcaggaagcacgctctccatcgggcaggagatgcagatgggtgattattacgtacgccagctgcgcggcagtgctccgctgattaacgaccctttgctggtgcagtacatcaacggtctggggatgcggctggtggcgcacgccgactcggtaaaaacgcccttccatttctatttaatcaataacgacgaaatcaacgccttcgccttctttggcgggaacgtggtgctgcattcggcgctgttccgttattccgataacgaaagccagctggcgtccgtcatggcgcacgaaatttcgcacgtcacccagcgccatctggcgcgtgcgatggaagatcagaagcgtaacgcccccctgacctgggtgggcgcgctgggttccattttgctggcgatggccagcccgcaggccgggatggcggcgcttaccgggacgctggcggggacgcgtcaggggatgatcagctttacccagcagaacgagcaggaagcagaccgcatcggcattcaggttttacagcgttccggctttgacccgcaggccatgccgagcttcctggaaaaactgctcgaccaggcacgctactcgtcgcgcccgcctgaaattctgttgacccacccgctgccggaaagccgactctcggatgcccgtaaccgtgccaaccagatgcgtccggtcgtggtgcagtcttcgcaggatttctacatggccaaagtgagaacgcttggcatgtacaactccggacgtaatcagctcaccagcgatctgctggacgcgctggcgaaaggcaacgtgcgcgagaagaacgcggcgcagtatggtcaggcgctccaggcgatggaggccagcaagtacgatgaagcgcgtaaagcgctacagccgctgctggcgtcggcgcctgacaatccgtggtatcttgacctcgccaccgatatcgatctggggcagaaaaaagcgaccgatgcgattaatcgtctgaaaggggcgaaagacattcgcaacaatccggtattgcagcttaacctggcgaacgcctacctacagggcggccagcccggcgaggcggtgaccattctgaaccgctacacctttaacaataaagatgaccagaacggctgggaactgctcgcccaggcccaggggcaactgggtaaccgcgatcaggagctggccgcgcgtgcggaaggcctggcgctggcgggtcgcctcgaacaggccatttccctgttgagcagcgccagctcacaggtgaagcttggcagcctgcaacaggcccgctacgatgcgcgaatcgaccagctgcgcggcctgcaacaacgctttaagccgtacgagaagatgtaa

SEQ ID NO: 4446 - DNA, 1407 bp, Enterobacter cloacae
ccgatttcacctttcgctcgccgcgcttcactgataatccacagacataacataaacaacacctctcaatcttgtacggagttcacaatgaacaatgttctgggatttcttgaagcaaaactgatgccgctggcggcgaaaacggcccagcagcgtcatcttggggccattcgtggggcctacgtttcattcatgccgtttatcatcgtcggctccatcctgctggtgatctcctccttcccgaatcaggcctatcagcagtttatgtctcaggcctttggtgagagctggagtgcgattatagagatcccgtttaacgcggtgttctcaaccatgtcgctgtttatcagcttcctggtggcctaccgcctggctgagcattatggcgaggaccgcatctcctgcggcatcctggcgctggtcgcgtttctgatcctgacgccctttatcaaagtggcggaaaacggcggcattaccgtgatgccggtggagtggattggcagcaaagggctgttcgtggcgatgatcggttccctgctgtggacggaactgttctgctggctgaagcgcaaaaagctggtcatcaaaatgccggacggcgtgcctcctgcggtgcaggagtcgttcgcggccctgatcccggccctgctggtgatgattctggtgctgcttatccgcatcatctttgaaaacacccactaccacaccatccaccagtttatttatgaagtggttgccaccccggtgcgccactacggcacctcttatttcggggcgctgatgaccgtattcagcatcaccattctgtggtcagtgggcattaactcaggttcgatgatcaacgggattattcgtccgctgtggatggagaaccagaccgacaacatcgccgcgattcaggcgggaacgacgccgccgcacatcatcaccgaacagttttttgacatgatctggatgggcggcgcgggcgccacgctgtcgctggtgattgcgatgctgattttcgcccgcagcaaaaacatgcgcgaagtggcgcgcctcggtgcgggtgcctcggtgtttaacatcaacgaaccgattctctttggcctgccggtgatcatgaacccaatcatgctcatcccgttcaatctggtgccgctggtgctggtcaccgtgcagtatgcggcgatgaaaattggtgcggtcgccgtcaccaccggggtgtttatcccctggacgctgccgccggttattagcggctttatcgtcaccgggcacctgagcggcagcgtgatgcagctgatcaacctgctgattggcgccatgctgtacctgcctttcatgcgtatcctggataaacagtaccgcgcggcggaaatagccagcgttacgcaaaccgacaccacccttgcaaaacaggagtaa

SEQ ID NO: 4447 - DNA, 960 bp, Enterobacter cloacae
agcatgtggggaattatcgcaacctggcgaatggcgcttgaaggcgtcacggaatctgcgtctgcgctggctgcgggcaaaccggtcgctgcggcggtagtggatgccgtcgccgccgtcgaggactttccgctgtataaatccgtcggctacggcgggctgccgacagagaacggcgaggtggagctggacgcggcctatatggacggcgacacgctggcgttcggcgccgtggggaatctggtggatatcgccaacccggtgcgcgtggcgcacgcgctcagccgccagcgctataacagcctgctggtcggccagggcgcgcgcgaatgggcgctgagtcagggctttgccgataaaaccatgctcacggatcgcgccatgcaacactaccgtaagcgctgccgcgaaacgctggataaggggttaagcccctacgacggacatgacaccgtcggcatcatcggcctcgataaacagggctcgatgagcgtcgccacttccaccagcggcctgtttatgaaaaaacgcggtcgcctcggtgactcacccatcatcggctccggcttttactgcgacagcgaaaccggcgcggccaccgccacgggcgtcggtgaagatctgatgaagggctgtaccagctacgaaatcgttcgccggatggcgcaaggcatgacgccgcagcaggcggcggattcggtcgtgttcgaactggaagacaaactgatgtcgcgcttcggtcgcgcgggcgatctctccgtggtgtgcatgaacagcaaaggagaatttggcgccgcgaccaacatcaaaaccttctcgttcgtggtggcgacggctcgccagcccctcaccgttttccgtactgaacgcctgcgggagaaaacgcactatcacgcggtagatgatgagtggatgcaggcctatgccgcgcggatccgcgcaccgattgaggagttatga

SEQ ID NO: 4448 - DNA, 729 bp, Enterobacter cloacae
taccgttttttcttcagttgttcttcatgcactgttgatacagttaccaatgtgaaaattctactaattgaagacgacctggatctcggcaatggcgtacgtatcgcccttgcagatcaaggatttgatgtcatatgggtacgccgcaaagaggatgcgctgcatcagcttgggatctgcgtgccggaacttattttgctagacctggggctgcccgatggcgatggcatgagcctgatgacgcgcctgcgtcaacagcttaagggcgtccccgtcatcatcctgacggcgcgaggcacgctacaggaccgcctgtgcggtctggatgcaggcgcagacgattatctggtcaaaccttttgttctcgccgaactgctggcgcgcgtgagagcccttgcgcggcgcagttacggttttgaaaatgaggcaatagaaattcgcggtttgtcgcttcatattccgacgcgtcgcgtaacggtgagcgcacgccacgttgagctgacggcaagcgaatatgcgctgcttgaaacgttaatgctgcgcgccgatcgcgtgcttacgcgacggtatctggaagaaaggttatttggcacgaaagaaaacctcagcaacgcacttgatgtgcatatgggtaacctgcggcgaaaaattggcgatggctttgtgcgaacggtgagaggcgttgggtatgtcattgataccgtacccgttcagaaggcggcaggttga

SEQ ID NO: 4449 - DNA, 999 bp, Enterobacter cloacae
atttctccgcgtttttctgcattcatctcgctaacttcgcttattatggggatcagtttcctggattcaagggaacaaggcagattgtcatcattcatcaggcacaaggacctccagaaaatgaataatcatttcaggtgtattgggatcgtcggccatccgcgtcaccctaccgcattgacgacacatgaaatgttgtatcgctggctgtgtggtaaaggctatgaagtgatggtcgagcagcagattgcccaggagttgcagcttaaaagcgtcagaaccggcacgctggcggaaattggccagcaggcggatctcgccgtggtggtcggtggcgacggcaatatgctgggcgcggcgcgaacgctggctcgctatgatattaaggttattggtgttaaccgtggcaatctcggtttccttaccgacctcgacccggacaatgcgcagcagcagctggcggacgtgctggaaggtcactatatcagtgaaaaacggtttttactggaagcccaggtctgccagcaggactgccagaagcgcatcagcaccgccattaacgaggtggttctccatcctggtaaagtggcgcacatgatcgaattcgaagtctatatcgacgaaatcttcgctttctcgcagcggtctgacgggctgattatttcaaccccgacggggtccaccgcctactcgctttcagccggaggtccaatccttacgccatcgctggatgccattactctggtgccgatgttcccgcatacgctctcggcgcgtccgctggtgatcaacggcgacagcaccatccgcctgcgtttttctcatcgccgcagcgatctggagatcagctgcgacagtcagattgcgctccccattcaggaaggtgaagatgtcctcattcgccgctgcgattaccacctgaacctcattcacccaaaagattacagctatttcaacacattaagctccaagctcggctggtcaaaaaaattgttctga

SEQ ID NO: 4450 - DNA, 1290 bp, Enterobacter cloacae
acgtcgtccctgactggttataacccattaattctcaagaggttcaaaaccatgtttcaagcactgttacgccgtcgggaagcccggctcttttttatcatcagcatcctgttctttatctgcatccatagcattgatgcattcctggcccccatgatgatcaaccagggcattgagccacagatcatgggcatcattatgggcgcgtctggtctggcaacccttctgatacgcttcccgttaggcattatttccgacgtggttaaaagccgcaggatcttcatccagattggcctgctgctgccaattatcgcctggccgattgcctggcttgaacccaatgccattacgctgtatctggcgaaagcggcagacggcgtcacggcggcgacctgggtgctatacaacatcctgttcatgcgttacttcggtcgcaacgaagcccctgccgccgtcgcgctgctggcgcttgcagggcccatcggcgtgtttctcggcaactgtattggcgcggtgctgattcactatttcgccaataacatcgccttttttgtctcctgcatctccgccctggtggcgttgatcctgacgacccgcattcaggacgtgcacgacccggttcaggcccccacgcttaaagcctgcattaccggcgcgcgccagcagctggccgaccgttccgtctggctgattggcattctggcgaccgtcgtcattctggtgcccttcgccacccgcgacacgctgacgccggtctatgccgagcagcttggcgcccgggcggggatcctcgcgctgctgggtaacattcaccttcttttttacgggctggccatcgccctgtgcagctcggtgttttatcagcgacttgggctggtaaaaaccgccgtgctcggcatcgttttacaggtgatatccactttcggcattcccttcaccagcaatatgtatgttatttacctgtggcaggcgctggcggggttctcgttcggtatggcctttgcggcattcatgtcgctcagcgtagtgaatacatcgtctgatgaacaatccacgcgaatggggctattccagaccatttattcctgcggcatgtttgtcgggccggtaatgatgggcgtaatgatgcaacatattaacctgtcgtccggttatatattgattgccgccctttccgttgtggccgctattgccacgccgctgtccgctcgatgggtatatgcccgtaaaacgcaaacctcagcccaattattaaaaaacggtgcgtacgctgccgcgccggatcaataa

SEQ ID NO: 4451 - DNA, 1383 bp, Enterobacter cloacae
ataccctttcccggctcgccgggaggacaactgacatctgaaaaaagtaaggagaagcgagtgtcctggaaattaaaaaccggtaaatctaccgaagagcgccagcaagccaaccagcaaataagagaaacggttgaacaaatacttgcggatattgaaaaacgcggaaataaagccattcgcgaattatccattaaattcgatcgttatgaccgtcaggattatcgtctgacgtccgcggagattgaccgctgcataaaacagttaagccgtcaggatattcaggatattgaattcgcccaacagcaggtcgcgaattttgcccgcgcgcagaaagaatgtctgcgggacctggaaattgaaacgcgtcccggcgttattctcgggcataaaaatattccgattaacgccgtgggatgttacgtgcctggcggaaaatatcccctgctcgcctccgcgcacatgtcgatcattaccgccagcgtggcggggtgctcaagaattatcagctgtgccccgccgtttaacggtcagcccgccccggcgatcgtcgcggcgcaaaaaatggctggcgcaacggaaatctatgcccttggcggcattcaggcgataggcgccatggcgctgggcacggactcgctggcaccggtcgatatgctggtcggccccggtaacgccttcgtcgcggaggccaaacgacagctgttcggccgggtaggtatcgatctgtttgccggtccgacggaaacgctggtgattgccgatgacacggttgacgcggaaatgtgcgcaacggatctgctgggccaggccgaacacggcgtcaccacccctgccatcctgctgacgaactcgctccagcttgccaaagagacgctcagcgaagtggaacggctgctggaaaagcttcctaccgccgacattgcccgccagtcgtggcaggactacggggaaatcatcgtctgcgacagccacgaagagatgctgctggaggcagatcgtatcgcttccgaacatgttcaggtgatgaccgaccgggacgactggttcctggctaacctgaccaattacggcgcgctgttccttggaccacgtactaacgtggcctacggcgataaggtgatcggcaccaaccacaccctgcccacgcaaaaagccgcacgttataccggcggcctgtgggtgggcaagttcatgaaaacctgcaccttccagaaagtcctcagcgacgaagccaccgccgaaatcggcagctattgttcgcgtctgtcgctcctggaggggttcgccggacatgccgagcaggccaatattcgcgtgcgccgttatggccagacggaagttccctacgccacaccggccccggtcagggaaaaggtgtaa

SEQ ID NO: 4452 - DNA, 768 bp, Enterobacter cloacae
gccatgacgcttttgcaaacgccctctttcaccctgcacggcaaacgcgcgctggtgaccggcgggtcaagagggattggcttcgctgccgccgtcgccctcgcacaggcaggggcagaggtctggattgccgcccggggccgcgaggcgctggcgcatgccgcaggtctggcagcggaacacagcctcgcatttcacccgctggaactggatattaccgacgctcaggaggtggagcgtgtgctggcgacgttgcccacgcccgacattctggtgaacagtgccgggctggcccgccaccagccgtttcttgaggtaaacgaggaaaatttcgatgcggtgatggcgcttaacctgcgcgccaccttttttatcagccagcacgtggcccgcagaatgcgggcgggcggtaaggggggatcgattattcacatctcatcgcaaatgggacacgttggtggccccgagcgtagcgtgtactgtgcctccaaattcgcgcttgaagggttaacccgaacgatggcgctggagctgggcgatgcggggatccgcgtcaatacgctgtgcccgaccttcattgaaaccgacctgacgcgttcgtcactcgccgacccggcatttcgccgctatgtgctggacaacatcaaactgcgccggccaggcaggctggaggacattatggggccggtggtgttcctcgcctcagacgccgccgggctgatcaccggcagtgccctgatggttgacggcggctggacggctacgtga

SEQ ID NO: 4453 - DNA, 921 bp, Enterobacter cloacae
acaatgaaaattgatcttaatttgttaccgctttttctggcggtcgccgaggagcgcagcttcagcgctgccgccgggcggctgggcatcacccgttccgctgtcagccaggggataagacgtctcgaagatgggtttcagaccctgctggtgatgcgcaccacgcgctcggtaaggctcaccgaagcgggtgaacggttgcataaatcgttgctggggcccatcgccaacattgaggcggcctttgacgatgtcacctcggacagcatgccgcgcggacagctcaggatcgctgtcacctcaatagcggaagcgtttctttcgggcccactgctcgcctcgtttacggccgcgcatcctgcggtatcgcttgatgtcttcgtgtcagatgaggaattcgatatcgtggcagcgggctatgacgctggggtgagactgggcgaagttatcgaaaaagacatgatcgcgattccccttacgggccagcagcgtgaacgggtggtggcttcaccttcctatctggcgacacacagcgcaccggcgcatccccgtgagctggtcgctcatcggtgtatcggctggcgcccttccccggacgttgccccctatcgctgggagtttgaggaagcaggcgtccctttcgatgtggcaattgaaccacaaataaccactaacgatctgcgtcttatgctcagcctcgcgctggccggcggtggcataacctttgccaccgaggacaccttcacaccgtacattgaatcaggacagctggtttccttactggatgcgtttcttccatcttttcctggtttttatctctattttccccagcgccacaatatggcccccaagctcagagccctgatcgagcacatccgccagtggcgacagctccccgccacgcaacccacacagcgttga

SEQ ID NO: 4454 - DNA, 309 bp, Enterobacter cloacae
acgggcagcatacgttcaccgtcgtcgcgagcgatgcggccggtaacgccagcgcaccatcagccggctttacccttaccgtcgataccaccccgccaccagcggccaccattgacaccgtctccgataacgtggggcccgtgcagcttccgcttaacagcggggacaccaccgacgacacgctgccgcagttgcagggaaccgcaccggacggcaccaccatcacgatctatgacggaaccaccctgctcggcacggcggtgctcgacggcagcggcggctggagctttacgccaaccacgccgctga

SEQ ID NO: 4455 - DNA, 237 bp, Enterobacter cloacae
ccggtagcgccgaagcgggcagcaccgtcaccatccgtctggcggacaattcaacggtcaccgccacggcagacagcaacggatcctggagctacaccttcctcaataaacagacggaaggccagacgctgcaaatcaccgccaccgatgcggcagggaacgtctcgctgcccggctcagcccttgcgccggtggtgccgctctctgccagcaccaacgttgaagagctggcgctga

SEQ ID NO: 4456 - DNA, 1413 bp, Enterobacter cloacae
ggacaagacatgggaaagaagatgccttactggtggctctcgtgctgcctgatatctgtgcccgctatcgcggcaaaccctgcggcgatgattaataccggacaattaagcgaaacgcaggaactcccctctttaaatggccgcgtggcgcccgtagccagcaaagccgcccccggcacgctacagctgaatgaagcggttaaccgcgccgtgacctggcatccggctatcagtgaagccgtcggcaaactttatcagcagagcgaaaatgtggacgtcgctaaatcgaaatattatccgcaaattaacgctggcatggataacggctatagccacgacggcgacgataatggctttaccccctcgctggtgctttctctttcgcaaatgctgtacgacttcggcaaagtcgcaagccaggtgcgcgccgaaaacgcgggcgtcgcccagcagcaggccaacgtgctggtgagcatcgacaccatcgcccacgataccgccatcgccatggtgcaggtgcagacctggcagcagatggtcgagaccgccaaagaacagctggatgccctgtcctccatcggcaccctgacgaaacaacgtaatgatgaaggcgcaacgtcactctctgacgtggtccagaccgatgcccgtatcgaaggggcgcgtgcgcagctgatgcagtatcaggcgagcctcgacagctcgcgcgccacgctgatgagcttgctgggctgggacagcctgaacgcggtcagcaatgactttccgcaaagcctggcccgcagctgcgacatcgccgagccggacgatcgtctggtgccctcggtattagcggcctgggcgcaggccaacgtcgcgcaggcaaatctcgattatgccaacgcgcaaatgacccctaccgtttctctggagccggaagttcgtcactacctgaacgaccgctacgcgggcaacgaaacgcgggaccgcacccagtactccgcgtgggttaaagtgcaaatgccgctctatcagggtggcggcctcaccgcccggcgtaacgccgccggacacgcggtggaatccgcccagtccaccatccagcgcacccgtcttgaggtgcggcaaaaactgctggaagcgcgcagccaggtgatgagcctgatgagcacgcttcagatccagggccgtcaggaagcgctcagcgcccgcacccgcgagctgtatcagcagcagtatctcgatcttggttcccgcccactgctcgacgtgctcaacgccgagcaggaggtgtatcaggcgcgctttacccaacagcaaaccgccggacagctgcatcagcttcagctcaactgtctgtacaacaccgggcgcctgcgtcacgcgttcgatcttgaaaaccgcaccatccagaccgtggagatccagccatga

SEQ ID NO: 4457 - DNA, 342 bp, Enterobacter cloacae
aggcggccaaagaggggctggacagcattatgcagctgccgaccgagaaccagcgcgaagagacaccgatccgccaggacgtgctgcgcggccactatcttttcgagcaggcgcagttccgctatcacccggaagatccccgcatggcgctgcgcattaaccgcctggagatcaaagcgggcgaaaaagtggcgatcctcgggcgcaacggcgcgggcaaatcaaccctgttgcaggcgatggcgggcgggatggatctggcgggcggtgaactgcggctcgacaacctcagcctgccgcatctggacgtggctgacgtgcggagaaacgtcggctttatga

SEQ ID NO: 4458 - DNA, 1251 bp, Enterobacter cloacae
acaacagccgtatgcagcaacagcagcaggcaaccggacgggagtggaaaaatgaaaatcagtcagcgtgacgttgccgcagtagaagatctggataacgcgctcgactccgaaagcggttataccggcgcccggcgcattgttttcttctccctggtgatgtttgtggtgctcggcgtctgggcgtggttcggcgtgctggacgaagtctcaaccggcaccggaaaagtgatccccagctcacgcgagcaggtgttgcagtcgctggatggggggatcctcaccgagctgaacgtgcacgaaggggatcaggtgcaggccggacaggtgctggcgcggctggatcctacccgctcggaatctaacgtcggcgaaagcgcggcgcgttaccgcgcgtcgctggcctccagcgcgcgtctgtatgccgaggtgaacgatctgccgctcaaattcccgccgtccctggagaaatggaccgacctgaccgccgccgaaacgcggctctacaactcgcggcgcgcgcagctggaggacacgcagcgtgagctgcgctccgccctggcgctcgccaataaagagctggcgatcacccagcggctggtgaaaaccggggccgccagccacgtggaagtgctgcgcctgcaacggcagaaaagcgacctggagctgaagctcaccgacgtccgttcccagtattacgtgcaggcccgtgaagcgctgtcgaaggccaacgccgaggtggatatggtgtcagcgatcctgaaaggccgcgaggattccgttacccgcctgacggtgaagtctccggtgcgcgggatcgtgaaaaacatcaaggtgaccaccatcggcggcgtgatcccgcccaacggcgagctgatggaaattgtgccggtggacgatcatctgctgattgaaacccgcctctcgccgcgggatatcgcctttatccaccctaatcaggaggcgctggtgaaaatcactgcctacgattacgcgatttacggtgggctgcacggggtggtggagaccatttcgccggacaccattcaggacgaagcgaagccggaggtgttctattaccgggtatttatccgtaccagccaggattatctggtgaataaggcgggcaggcacttctcgatcgtgccggggatgatagcgacggtggatattaagaccggagagaaaacggtgctggattatatgatcaaaccgtttaaccgggcgaaggaggcgctgagggagcggtag

SEQ ID NO: 4459 - DNA, 1782 bp, Enterobacter cloacae
gctccaagctcggctggtcaaaaaaattgttctgattttgcatccagcactttactgtatataaaaccagtttatactgtatacaaacacagttatggtttttcatacaggaaaacaattatgctggcacaactgaccatcagcaactttgccattgttcgtgagcttgagatcgacttccatagcggaatgacggcgattaccggtgaaaccggtgcaggtaaatccattgccattgatgccctcggcttgtgcctcggtggtcgtgcagagggggatatggtgcgcacaggcgccgcccgtgccgatctctgcgcccgcttctcgttaaaagacacacctgccgccctgcgctggctggaagcaaaccagctcgaagacggacgtgagtgtttacttcgccgcgtcatcagcagcgatggccgctcccgcggttttatcaatggtacagcggttcccctctcccagcttcgcgagctgggccagctgctcatccagatccatggtcagcatgcgcaccagcagttaatcaaacccgaacaacaaaaagccctgcttgatggctacgcaggtgagtacgcgcttactcaactcatggcggagcactatcgtcagtggcatcaaagctgccgcgaacttgcgcagcatcagcagcaaagccaggagcgtaccgcgcgcgccgagctgctggaatatcaactgaaagagctgaacgaatttaacccgcaggcgggtgaatttgagcaaatcgacgaagagtacaagcgtctggccaacagcggtcagctgctctccaccagccagaatgcccttaacatgctggcggatggcgaagacgtgaatttgcagagccagctgtacaacgtgcgtcagcttgtgaccgagctgaccggcatggacaataagctttctggcgtactggaaatgctggaagaggccgcgattcagatttcagaagccggggatgagctgcgccactactgtgaacgtctggatctcgatccgaaccgcctgttcgagcttgagcaacgcatctcccgtcagatttcactggcgcgtaagcatcacgttaccccggaagagctgccgaattactatcagtctctgctggaggaacagcagcagttggacgatcaggccgattcccttgaaaccttgtctctggcggttaatctgcatcatcagcaggcgctggaaacggcgaaacggctgcacgacgtgcggcaacactatgcgcaggagcttagccagcacattaccgacagcatgcatacgctggcgatgccgcatggggtgttcaccatagatgttcgctttgaagagaatcacctgacggcggaaggcgcagaccgcgtagaattccgcgtcaccaccaacccgggccagcctttgcaggcaatttcgaaagtggcttccggtggtgaactgtcgcgtatcgccctggccattcaggtgattaccgcccgtaaaatggaaaccccggcgttgattttcgatgaagtggatgtgggtatcagcggcccgaccgcggccgttgtcggcaaactgctgcgtcagttgggtgaatcgacgcaggtcatgtgtgtgactcacctgccgcaggtcgccggatgtggtcatcaccactttatcgtcagcaaggaaaccgatggcgaaatgacggaaacgcacatgaagccgctggataaacgctcacgcttgcaggagctggcacgcttgctcggcggcagtgaagtcactcgcaataccctcgcgaatgcgaaagaactgctggcggcataa

SEQ ID NO: 4460 - DNA, 378 bp, Enterobacter cloacae
gccgcgtactgctcgggcccgaaaaggaatcaaatcactatgcgctgtaaaacgctgaccgctgccgcagcggttcttctgatgttgaccgcaggctgttccactctggagaaagtggtttaccgtcctgacatcaaccaggggaactaccttacccctaacgatgtgtccaaaatccgcgtgggtatgacacaacagcaggtcgcttatgccctgggaaccccgatgatgtccgatccgttcggcacaaacacctggttctatgtattccgccagcagcctggtcatgaagatgtaacccagcaaaccctgacgctgaccttcagcagtgccggcgtgctgaccaacatcgacaacaagcctgccctgaccaaataa

SEQ ID NO: 4461 - DNA, 834 bp, Enterobacter cloacae
gatcgcgccgctgctgcgtcagtggataacggagtgcatacagtgcgcaaaaacagtttaaagaccgcatttctggaaaataccccgatcgttaacggctggctggcaatcccctccgggtatagcgcggaaattatgggccatcagggttacgacgccgtcaccgtcgatttgcagcacggcatgattgattttgccagcgcgttgtcgatgctacaggcgctatcggccacgcctgccgtgccgctggtgcgggtggcagataacgatccggcgcaaatcatgcgcgtattagacgcaggagcctacggcgtaatctgcccgatgatctccagcgcggaacaggctcgccgttttgtcgcggcctgtcgctatccaccgctgggggttcgctcctttggtccggccagaggtctactctatggcggcagcgattatccacagcacgccaacgacgagatcctgacgctggcaatgatcgaaacccgccaagggctggcggatcttgacgccatccttgataccgaagggctggacggtgtgtttattggccccaacgatctctcgctgacgctgaccggcagtgccagcgccgaatcccaacatcccgaaatgcttgctgctattgagcgggtgattcactgctgccgccagcagcaaaagattgccggtattttctgcacttccggcgcggccgcggcagcgcgtattgctcagggtttccagtttgttacccctgcaaacgacgttatgcagctgggtcgcgcctcacgtgaagccattgccctcgcccgcggcaacgccatccctaccaccggtgcatccggttattaa

SEQ ID NO: 4462 - DNA, 1950 bp, Enterobacter cloacae
cctctctggaattatttcctccgccatctacacttactttactttttgtttacggacgttattttccgttttgcgctccctgtcagtaacgggtctgtaattaataactatcgtggaaacaggatatccttctctatggatttttattttacccgttttgaacatcgccagccgcctgaaccgcttaagacaccgcgatgggtcatgttaacatggcaggtattggcggttgcctcgctgattttaggcgctaattatatttactggcgctggacagcttccttaaataccgacgcgctgtggtatgccattccattggtgctggctgaaaccctggcctggatcggcacagtgctattcaccataaacctgtggaaagaagacgatccgccgcaaaatccgcccccgattgagatcaatgattgcctgcgctccgaagacgcggaagcctcaagacccatcaaggtcgatctttttatcgcaacctattcagaagatgttgagctggtcaggctttcaattcgggacgccatgaagatggattaccccggcccgctggactacaaggtgcacgtgctcgatgatggccggcgtccggagatgaaagccgtctgcgatcaggaaggcgcaaactacatctcccgccagaccaatattggctttaaggccggtaacttgcgaaacggacttgagcaaaccgacggtgatttcctgatcatttgcgatgccgatacccgggtcttccccactctgctcagccacacgctgggctactttcgtgaccctgacgtggcctgggttcagacaccgcagtggttcttcgacctgccggagggggaaaacctcgcgcgctggcttgggcgaaaagcgggcaaaacgggatacgggctcggatggctcgcccagaagttcatcgggccagtaaccatcggccgcgatcccttttttaacgatccgcgcatgttttatgacgtcattctgcgacggcgaaactgggccaacgccgccttctgctgcggtgcggcctctatacacaggcgcgaagcggtaatgcaggcagcgctgcgcagctacgtctggacgacagaagaagagatcgatcgccacacgcgggatatacgcgatcccgtcatgcgtgaaacccttcaggacgccatgcgtcctcacgtggccttcgacacagaacttacgccctataagtttcacgtttcagaagatatttatacctccatcctgctccacggcgatgccgcccgccgctggcgctcggtaatgcacccgcggattgaatcgaaaatgctctcaccgcaggatatgctgacgtggatgatccagcgcttcaaatatgccgcgggttcactggatattctgttccatgacaatattttcagccgccgccgttttaagctctctttgccgcaaacgctgatgtacgccaccaccttctggtcctatctggcctgcgtgtggaacactgttttcctgatatcgcccattgtgtacctgtttaccggcattccgcctgtatcagcctggtctgaacccttttatcttcattttttgcccttttttattgtttcggagctggcgtttatgttcggcacctggggaatatcagcctgggatggcagagcatcgtatctctcattcttctccatgaatttgcgcgcgctcaacacagtcctgcgcggagagcagatcaaattccacgttacccccaaagagaggcagacgggacggtttctatacctggtgaaaccgcaaatcgccatcgtcgtgctcacgctggcggggctgatttggggcggtattcaggttgcacgtgggcaggttgacgatccgtccggctacgttatcaatatcttctggggtgcagtcaacattgccgccatgctgccgctgatcttcgccgccatgtggaccccggctgaagaagaggtgagcgaatga

SEQ ID NO: 4463 - DNA, 2727 bp, Enterobacter cloacae
gtaaccatgcgagccacatcccgtttcgatctcaacgcgctgcctgtgggggtgatgatttacgatcccgccgagcatctgctggcctggaatgaccagatatcgcgcttttacccggtgatcgccccctggctgatcgccggcgcttccctcgagagcctggcggagaaatttattgatgcgggttataacatcgactccacccgccgccggaccctgcgtgaagcgatcgttcgcaactgccgtcagtcaagccatcgagaggtgcggcagtcgggaaaccggcggctctacgtgcagcaccagcgtctcgccgatggcggcattctcagcctgcataccgatattaccgagcttgacgacgcccagcgctcgcgccagcagctgcacgatgattttttactgaccgcagagtccattcagatcggcatctggaactggcaggtctctcacgacagcctggaggtgaacgatacgttgctggcgatggtgggtcagtcgcgtacgcagctgcactacccgctgcgctttttactgaatctggtccatgaagaggatcgtgccgtcctgcgcaacgcgatgatcgcctccaggcaggagcacatgccggtgtttgaaagtgagattcgcgtgcaacacgcgacgcagggctggcgctggatgctggtttcgggacaggtggtcaccctcagtatgcagcagcaggccgaacgggtgatcggcaccctacaggacatcacccgccgcaaggaggccgagttgttagccattgaagcggcgaaagtggcccgggaggccaacgaggcgaagagtgcatttctcgccaacatgagccacgaaattcgcaccccgatgaacggcattctgggcatgactcagctctgcctcgatacacagctcacccccgaacagcgtgaatatctttctctggtgatgagttcagcgcagtcactactgcatatcatcaatgacattctcgatttctcacgcattgagtcaggtaagatgaccgtcgatacagagccgctggaaatccgcccctttgtgcagtcgctcatccgcccgcatatgccctccgccagcgaaaaaggcattgaactgctggtggatatcgctccgggggtgccggaagtgctcatcgttgatggtccccgactacgtcaaattctgactaatctcctgggcaacgcgctgaagttcacccatcacggtgaggttatgctggcaatagagcctacagaaagtgaagggcactggcgttttcgcatacgcgacagcggcattggcatcccgatggagaaacaaaaagccattttcgaggcgttcagccaggccgatagctctaccacccgccgctacggcggtactggcctcgggctgaccatttctgcccgcctggtaagtctgatgggcggagagctaacggttcagagcgagccgggtgaaggcagcgaatttgcttttacgttgccactggaaggtcagttggctgtctcagcaaccgatgctcctgtagcacgctttaacggcgaatcggtactggtggtagacgacaacagtaccaacctgcggctgctggacaccatgcttcgccagatgggtctgacaccgacctgtgttaacaacgccggggaagcgttaagcctgaccgcaaaaaggggatactggccgctgatcctgctggatgcccagatgccggatatggacggtgtatcgctggccattgagctctctgttatgccgcaggccgagcaaagccacatcattatgctcagttccatgagccgccatttcgatgccaatatgctcaagcgcatcggggttgcccactatttgcataagccggttgcccaacgtgaactctatcaaaccatagccagcgtcctggcacccgctccccttgcctctcccacggctgtgcccgcttctgcgctcgttactgcgcccgttactgcgcccgttactgcgcaggccagtctgcgtatcctgctggccgaggacaacctggtgaatcagaaagtcgccagacgcctgctggagcagctcggccaccgttgcgaagtggtatccaatggccgggaggcactcgaacgctggcgtgaacagtcctgggatttgatgttggttgacttgcaaatgccagaaatggacggtgaaacggccattcgcctgcttcgtgaggagacactaacgcgggggcgtagccaccagcccgccatcgcgatgaccgcccatgccatgcagggtgacaaggcgcgctgtctggcaatgggcttcgacggctatattgccaagccggtaagtcaggaggcgctcagggaggagatagcccatgttctcgccggagaagataagggtctgccggatgaggcacagctgttaaaacagtgcgcggacgatcctgaactggttaatgaattgctggcgctgttcggcaacggtcttgacgaggcggtggcagccatggcgctgaacattgcgcataatgaccgcgatgccctacggcgggccgctcataagcttcgcggcgaagccgtcaccctcggtttcattcgtctttcagaagtgctccagcaattggagagtcaggcggtctcgctgaaccagacggggctgagcgttttacatggcgagcttatcgaggaggccagacgctctgcggcctggctgcgccgcagagcacaggaggttaaagatgatcaggcttcttctgctgctggcaattag

SEQ ID NO: 4464 - DNA, 468 bp, Enterobacter cloacae
gcaatgaatgctggctacccaacgatgctattgatacccggcatgtcagcctttcagcgtgttaacgaaccagcacctggcctggccgggcggatgttcttccaggtgcactgcccgcatggaaaaaccggtcccaacgtcgggctgcatctgcacgttcagcgtaacccgttttcccgctgcgaaatcttcctcgaccattggcagcggcatataacccccccgtccgtggagctggcgcctcagttcaacattcgcgtcacctcgcttcagccgggtgccgttgaaagtgaattattcgagcatatcagtgacaaaaattatcgtgcacagatggaacagctgaaggaaaagatgacgttcctgaaagccgatgatgtcgccgactcgattccttacgtgttgcaggcaccggaacatgtgaacgtggcagagctgtttattatgccgcccgaacagccgtggtaa

SEQ ID NO: 4465 - DNA, 387 bp, Enterobacter cloacae
tattactcgcagacaaaacgcacttgcgcacagtgcaggagtgcattactatccactcagcttcaaggactggagcttaccagcattatgattaatcattttcgggatcaatggcttgaggatttttttctctacgggagatcgagcaatgttattcctttgaatctggaaacagcgcttgcaagaaagctcgacatcatcaatgcggccatgtcgcacctggatttacgatcgccaccgggcaatatgtatgaagcattgagtcctccgttgaagggatactcctctatccgggtaaacagacaatacaggcttgtatttcgctggtcagagggaaaagcagacgatctctatctctctccacacaagtacacgcaacacaagtga

SEQ ID NO: 4466 - DNA, 276 bp, Enterobacter cloacae
cgacccatgccgcgctctgcttgcgcttcagccccagcgccatgccaacgccaatgcttaagccctgccccagcgaaccgccggagatctccatgcccggcgtgtaggttgccatgccggacatcggcaggcggctgtcgtccgcgccgtaggtctccagctcctcttcaggaacgatccccgcttcaatcagggcggcgtaacaggcaatggcgtagtggccgtgagagagcaaaaaacggtcacgcccctcccactccggctcgcccggcttaa

SEQ ID NO: 4467 - DNA, 924 bp, Enterobacter cloacae
gccatgtccgcgcaggatcgccagacgttatcgctgccctcgctcagaaatttgcaggcgtttatcgccgttgctaacgccctgagcatccatcaggcggcggaacagctcaacgtcacgccttcggcggtaagccaccagatcgcgtcgctggaatcgtggctgggcaagaaattatttatccgcagcggcaaaggggttcaactcaccccgacgggagaacaatatctgcgggaggtctcggcggcgatgagcgccatcgggcgcgccaccgatcaaatcgtgaaagaaaaagacaatgctgtgcttcgcgtgcactcttcccccaccttcgggctgtcctggctgttgcgccgtctgggcagattccgcgccgaatatcctgatatcaccatcaatctcacctgctcctatgagaacctacagttcgccagagataatatcgacattgatatccgtcacggtattccggactgggacgcctaccgggtgatgaccattaaaaacgacacgctggtggtattggcctcgccggactatgcagaagagcatcccatcagcacgcccgccgatctgctgcaacagtcgcttatctcgtccaccagcactctggtgaactgggagaaatggttcgcctggcacaatatcgacaggccctggcttaatttcagcctcagcttcgaccgctcctacatgagctttgaagcggcgcgcatggggcttgggtttattctggagagcaaaatgatggctaccgatcacctgaaggatggctcgctggtgcaggtgctgcctgatgaaatgggtatcgccatcaacgcgcaccatctggtgatgccgcacatgaacgaacgcgcgtggaagatccagcagttcgtcgagtggattgaccgtgagttgcgattgtcggggtatcacctgtag

SEQ ID NO: 4468 - DNA, 891 bp, Enterobacter cloacae
aaggtgcgttctggtgccctcaccccggccctctcccacagggagagggggattaacagaggtatccagcacatgcttcaccacaaacatcccgcccatcatcaggtaggccgtgacaaacatcagggaactgccctcggcaaagcccaccaccggggcgtggatcacgccaaacagcgccagcagcgcgcctcctgcggcggcgacggccccgcgcagcggtttgttgaggatggcgaagatggcgatacagccccagagcatgctggcgagcggcgcgccgttgccgagatgcatcaggccttcgtagtagatacccttgctgtgcaacacgtcggtgccgattttcgccgcgctggtccccgcggcgctcatcacgctgttcatcatggtcagcgcccagttggcgatccacgggaacaggcagatgaagataacgggcacctccactttcggggtttccctcaccacctggttggcggtgacgacgccgataaacaccagaatcggcacgatggcggtcatcggtatgatggcgagcataaaggcccccagcccgaacagcggcacgatgaacatggtcacgccggacgccagggtgtagccgatgctggcgcccatcgctttccagccaggatggccgacgtagaccgtgaccgggaacggattgcccatcaggcagccgagcatcgaggccagaccgttcgccagcattaccttgcgggtcgggtattcatcccctgccgcgtgggcgctttcgatgttctccaggtcaaagatgtagttcgccagccccagcggtacggcggacgccagatacggcagcgcgtgcggcagcccctgcataaagctgtccacgtgcacttccggcgggttaaagccgaaggatga

SEQ ID NO: 4469 - DNA, 984 bp, Enterobacter cloacae
tgtaacgccagtgttaaaatatgttcaaaactgatggtcaccaggagccataatatgaattccatctttaccgaagagaatttgctggccttcaccaccgcggcacgttttggcagttttagcaaagcggctgccgagctgggcgtaaccacctcggccatcagttacaccatcaaacgcatggagaccggcctggacgtggtgctgtttgtacgcaacacgcgcagcattgagctgaccgaatccggtttttatttttatcgtaaagcgaccgacctgctgaatgactttcatgccatcaagcgcgggattgataccatttctcagggcattgagacgcgggtgcgcatctgcataaatcagcttttgtatacgccacgccataccgcgcgtttgctccaagtgctgaaaaaacagtttcccacctgccagatcacggtgacgaccgaagtgtataacggcgtctgggattccatcattaataatcaggccaatatcgccattggcgcgccggatacgctgctggacggcggcggcattgattataccgagataggcgcgatccgctgggtatttgccatcgcgcccacgcatccgctggcgttcgccccggagcccatctccgaaagtcagctgcgtctgtatcccaatatcatggtcgaggataccgcgcataccatcaataagaaggtgggctggctgcttcacggtcaggaggcgattctggtgccggacttcaacacgaaatgccagtgtcagatcctgggggaaggtattggatttttaccggaatacatgacgcgtgaggcggtggaggatgggctgctggtaacgcggcgaatcaataatccgcgccaggattcgcgcatgctgctcgccacgcagcatgcggcgaccggtcaggtcacgcgctggataaaacagcaatttggccccgaaggcgtgctgacccggatctacagtgacttactgtggcgtacctag

SEQ ID NO: 4470 - DNA, 513 bp, Enterobacter cloacae
aatcagattaccgacggctttacgacacttatgacgaagaaaaaagcacataaacctggttcggcgaccattgcgcttaacaagcgtgctcgccacgagtatttcatcgaagaagaattcgaggccggccttgcgttgcagggctgggaagtaaaatcgctgcgtgccgggaaagccaatatcggcgacagctacgtgatcctgaaagacggtgaggccttcctgttcggcgcgaactttacgccgctgaccgtcgcctcttcacattacgtttgcgatcctacccgcacccgtaagctgctgctgaacaagcgcgaactggaatccctctacggacgcatcaaccgtgaaggcttcaccgtggtggcactctctttgtactggaaaaacgcctggtgcaaagtgaaaatcggcgtggcgaaaggtaagaaacaacacgacaagcgtactgacctgaaagcacgcgagtggcagctcgacaaagcacgtatcatgaaaaacgcaggacgttga

SEQ ID NO: 4471 - DNA, 588 bp, Enterobacter cloacae
atgggacccacaacgaagggtccaaaaatcgagggtcccaaaatggcaaaaatcgctaagaagctcactgacactgaaatcaaaagcacgaagccagccgataaagaaatcaacttgtttgacggtgatggtttgatcctgcgaatcgctcctctcacaaaaggagggaagaagaattggtatttcagatatgcggtcccagtgagtaagaaaagaaccaaaatgagccttgggacctatcctcaccttacactggcaagagccagaaccttacgagatgaatacctttccttgcttgccaatggcattgatccccaagtccataacagcaataaagctaatgccttaaagaatgctactgaacacactctccaagccgtggcaaggaaatggttagatgagaaggtaaagacctcaggtatctcacaagaccatgcagaagacatctggcgaagcctggagagaaatatctttccaggattgggtaatgttcctgtcaatgagatccgacccaaactcttaaagcaacaccttgaccctattgagcaacggggagtcctcgaaactgaatcgccacggataatctag

SEQ ID NO: 4472 - DNA, 774 bp, Enterobacter cloacae
cggcggctggacggctacgtgagggatgcaatggaatatccgcttctggacaataccgatctgccgctggtgctgcttggtggcaccctgtgtaacgtccggctctggcagcccgtcattgaaaggctgaacatctcagcggtgctgtgcatcacgctgacgggcgcagagtccgcgccgcaggcgtcacggcggttattaaaggttctgccgccgcgctttctgctggcgggcttttcgctcggcgcgattgtcgcgctgcaaatggccgccgacgcgccagaaagagtgaacgggctgacgctgatttccgttaatccgttgcccgttgcgccagacaccctcgcttcacgccgggaagcggtacacaccgcccaggcgcatggcctggccgactggctggtctcctcgctgtggcagagctatgtcgccccgtcacgtctgtccgatcggatcctgcaagagactatttgccgaatggcgcaagagtgcggcattgagacctttgccgggcaaacggaaatggccattcaccggcaggacaaccggactgcgtttaacgccctcgcctgccccacattacttctaaacggcgcgcaggacgttatctgcacgcctcatcatcatcaactactggcagcaggcaatgcgaacgtgaccaggcatacggtggaggctggcgggcattttattccgctggaaaccccggatgagatcgcgccgctgctgcgtcagtggataacggagtgcatacagtgcgcaaaaacagtttaa

SEQ ID NO: 4473 - DNA, 306 bp, Enterobacter cloacae
cgccatgtcgttggtttttcaacgtctttatttataagcacaggcgcaatctggctcatggggcgtcgcgttctccatgctaaaaagtttcttgtattttatttagatagcgtaaacaaaagcatctggcaatttttgataacgcttcaaatattattaagcgtagttaacagttattttagcgcgtgtaaacaatcgagttttaacctctctggaattatttcctccgccatctacacttactttactttttgtttacggacgttattttccgttttgcgctccctgtcagtaacgggtctgtaa

SEQ ID NO: 4474 - DNA, 2277 bp, Enterobacter cloacae
gcgttttacatggcgagcttatcgaggaggccagacgctctgcggcctggctgcgccgcagagcacaggaggttaaagatgatcaggcttcttctgctgctggcaattagccctctgctggcccaggccagccagcccgtcacctggtcactggccggaatgtggcgcgtgcatgacgccaacctcagcacctttgatggcgccagcgcgcctgaccgcgactggcgatcgattgcggttccggccaactggtacagcgccggatacgatcatcagggtgccctctggtatcggcacgaatttaccctgcccaggcgcgcgcccgataccatggccaccctggtctttgatggcgtggactattttgccgacgtcacgctcaacggcaggcatcttgcccatcacgaggggtattttcagcgcttctcggtagacataagcgatgctttgcagcgacacaataagctcgccgtgcgggtggacagtccctgggaagatccgaaaacaatctggccgctgcataaaacgatggttaaaggcgtacttaaccagcacgatacccgccctggcggggcctggtcagaggacggccaggatgccaactccggggggatctggtcgccggtaaagctacatttgagccgcggagtgaccatcgacgaggtaatactgcgtccggactggcgtgaagggctgagcaaaccagcgctgcacgccgagatccgctaccgggcgttgtctgccggtgacgtaactttgcgcctgtcggccacgccagacaattttacgggcccgcctgtaaagcaggaattccctgtaaaccttgcgagaacggacggaaagccgcaatcgcttcgcgtcacgctgccaatgcaaggcgccaggctctggtggccagtgggctatggcaggccaaacctgtaccgagtgcgcgcaaccctgacggataagcaaggagtgatggataccgcagttgcccgtaccgggttacgcaagatagtgaagcagcctgacaacaagggctggctctttaatgacaaacgcctgtttatcaaagggagtaattacatcggctccccgtggcttagcaccatgacacgcaaaaaatatcgccgcgatttcaggctggtgcaggcaatgaacgccaacgcgatacgcgttcactcgcatgtggcaggccgggcactttacgatgtggctgacgaaatggggctgatgatctggcaggatgtccccctgcaatggggttacaataacagcgacgccttcgcggataatgccgtgcgacagacccgcgagatggttgaacagtttggtaattccccggccattatcgtctggggcggtcataacgagccgccatggaattcaccgtggatggaaaaacgctttcccgactggaataaaaacctgaaccagacgctgacgaaacgcgtcggagacgcgctttcgcaagatacctcgcgcatagtgcatcgtttttctgcggtggaagaacactactgggccggatggtactttggcaccatgcgcgatcttcttggccccgccaaaaccgcgatcatcacggagtttggcgctcaggcgctaccgcgactctcaaccttgaaaaccatcattcccgcccgcctgatgtggccgaaaagcaccgccgccgacgatcccggctggacgcactggaaataccataacttccagcccttccagacctttaaatttgccaatattccgcggggcaataccattcaggagatgattgccaacacccagcgttaccaggcagagctggtggcaatggcggcagagagctatcgtcggcagcgctaccagccggtaactgccctcttccactttatgtttgtagaaacctggccctccatcaactggggcgtcgtggattatctgcgtaagccgaaagcgggctactacgccctgcaaaaagcctatcagcccattctgccgtcgattgaacccgtgacggcggtgtggcgtcagggaagcgaagcaacggttcgcctgtgggcgatcaatgacacctggtccgcctgtgaggcgtgtcgtctgaagtggcaggtgaagcaaaatggtcgggtgctggctaaaggcaatacaagcctcacgcttccccccgattcgggcagcaggatcaaggacatcaccgtcacaccgaccaccaggcataacgttaccattgagtatgagatttcggatcgcgccggtaacaccgtgggttccaaccagcgcaatgagagagtggaaagccctcctgagcaatga

SEQ ID NO: 4475 - DNA, 11517 bp, Enterobacter cloacae
acagtattttcgccgggagcgcgttcgtctcttcagaaacgatggctttgttttacacgccgtaaccaatcactcagctggagtaataattgtatgagccaaatatctgttatatctaaattaactggcgtggaaacgaccacggaagggacacagataacactcgatcactcctcaatcgttaaacttaacgtggatcgcgccgacatctcaggttactcccgcagcggaaacgatctggtgattaccctcaactcgggcgaagtgattaccctcaagaatttctacgtcaccgacgcgcagggcgtgagccagctggtgcttgaggagagcgacggtgcgctgtggtggattgaagatccaaccggtgccgcaacctatgaatccatcgcctccaccgatgcattactggcggcgtcagggagtgatgccggcggcgccgctgcgtggccctgggtgctgggtggcctggccgccgcaggtgggattgccattgcggcgggaactggcggtggaggtggcggagatgacgataacaacagcccgaatcccggcaatccgggaaatccttccgagccagataccacgcctccggatgcccccaccaatctacaggtctcacctgacggcaaaaccgtcaccggtaccgctgagccgggcagcacgattaccctgaaagatgccgatggcaacaccatcggaacgggcaaggcgggcagcgacggaaaatttacgattgatctcggtacgccactcaccaacggggaacagatcaccgccaccgccaccgatccatccggcaataccagccagggcggtcaggtcacggcaccggatctcaccgcaccggatgccccggccaatctggaggtctcccctgacggcaaaaccgtcaccggtaccgctgagccgggcagcaccgttaccctgaaagatgccgatggcaacaccatcggaacgggcaaagcgggtagcgacgggaaatttacgattgatctgggtacgccgctcaccaacggggaacagatcaccgctaccgccaccgatccgtccggcaataccagcccgggcgttcaggtcacggcaccggatttaaccgcgccggatgcaccggagattgtcaccgtcaatgataacgtaggcgccgaaacaggcccgctgagcaacggacaacgcacggacgatgcccgcccgaccttcagcggcatcagtgaagccggcaccgtcattaccttctatgacaacgggaaaccgattggcaccgccacagccgatgccaccgggaaatggagctttaccccgtcgaccaacctgtctgaaggcaaccacgccattaccaccaccgcgaccgatgccgcaggcaatactagcccggcgtccacggcggtaagcttcgtggtcgataccgtcgcgcctggcgcgccagcgatcgtcagcatcaccgatgatgttgcgcctggcaccggcacactcgggagtggaagcagcaccaacgacccacggccacagctcaccggtacggcggaagcgggctcgacgatcaccatctatgataacggcattgctattggcacagcgattgtgggcagcaacggaagctggagctttacgccgtcggtgaacctgagcgaaggcagccaccagcttaccgtgcgcgccaccgacgtcgccggtaacactggcccagcctcgccggtctttaccgtcacggtagatgtcaccgcgccgcaaacgccttccgggtttatcattaacgacgacacgggcgtactgaaaggagcgatcggtgccgggcagtttaccgatgcctcagagccacgtctgacgggcagaggcgaaccgggcagcacgatcacggtttacgataacggcgttgttatcggcaccaccaccgttctgccgaacggcacctggagcatcacgccgacgagtccactggcagaaggcgcacactcgattaccctgcgggaaaccgatgcggcaggcaaccagagcggtctgtctcagccgatcaactttaccgtcgatcttacgccgccagacatgccggttgcgacgctcaactccgcaggcacccagatcaccggtaccgccgagccgggcagtaaaatcgtcatcaccaacaatgccgggctgcaaatcgggaccgccactgccgacagcaacggcaactatgtcgtcaacctgaaccctgcgcagaccaacggcgagattatctccgtggtcgcctccgatgccgcaggcaaccagagctcaccggcgctggtcaacgcagcggatatcaccccacctgccgcaccgggcaacctggtggtggcggaagacggggccagcgtcagcggaaccgccgagccaaacagcacgattatcattaaagcgccggacggtacgatcatcggccaggccaccgccggcccggacggcaccttcaccatcccgatttcgccagcccagaccaacggcgaagcccttgaagtgacggccaccgacggcagcggtaacaccagcccgtctggctttgccgacgcgccagacagcaccccaccgctggcaccggaaaacgtggtgatctctgccgacggcaccaccgtaaccggtacagccgagccgggcagcaccgtcaccatccgtgaaaatggcgtgaaggtcggggaaacggtcgccgacgatcaggggaatttcagcgttgaactgatcccgccgaaagccaacggcgaagccctgaccgccgatgccaccgataccgccggaaacaccggcccgaccgcgccgtttgacgcgccggacatcaccgcggcacaaaccccggtcatcacgggcgtggtggatgatgccccaggcgtcaccggtcctgtcagccagaacggtctcaccaacgacaacacgccaaccatcaacggaacgggcgagcctggcaccaccattaccctctacagcggtactaccgtgcttggcaccgcgctggtttcggcgaacggtcagtggtccatcacgctgcaaaccgcgctaccggacggcgggcacgtgctgacggcgacggcggttgacgccaataataacctcagcgggacatcgaacacctggagcatcacggtggataccgccgcgccgggcgcgccggccattacgcaggtcattgatgacgtaccgggccgcacgggtgcgctcgacaccaatgaaactaccaacgacacgctcccgacgctgaacggtaccggtgagccgggctccaccgtgacgatccgcctggacggacaggatattggtactgccgttgttaacagcggtggcgcatggaccttcacacctgctaccccattagtgaacgggcagcatacgttcaccgtcgtcgcgagcgatgcggccggtaacgccagcgcaccatcagccggctttacccttaccgtcgataccaccccgccaccagcggccaccattgacaccgtctccgataacgtggggcccgtgcagcttccgcttaacagcggggacaccaccgacgacacgctgccgcagttgcagggaaccgcaccggacggcaccaccatcacgatctatgacggaaccaccctgctcggcacggcggtgctcgacggcagcggcggctggagctttacgccaaccacgccgctgacggacggcccgcactcgctgacggtccacgcaacggatgaggcgggtaacaccaccatttcgccgccgtttgaactggcgatcaacacgaccgcgcctgcaacgccggatattcctgagatcaccgtcaacccggacggcggcacgccggggacggccctgaatccaggggagaccacccgggataccacgccaaccctgagcggctcgggcacgccgggggatatcgtgaacatttacgatggcgctactaaaattggtgaagccgagatcgatggcgacggtaactggagctggacgccggatgatccgctccctgacggcacctacgatctctccctgacggtcactaaccaggacagcgccgggaacgaaagcgcgccgtccacgccggtgaccattaccattgatactgacgcgcctgcccaaccgggaaccccaacggtgacagacagcgtaagccagatcaccggacccgtgctggatggcgaatccaccaacgatccgcgtccggtcctgagtggcaccggtacgccgaatgacgtcattaccatctatgaccaggtgggtacaggcgagccgcaggccgtgggcagcgttacggtggacggtaacggtaactggagctggcgtcctgagagcaacattggcgaagggacgcacgaatacacggcgaccgccaccgatgaagccgggaatgaatctgtgccatcagccggtatcacgataacggtcgataccctcgccccggatactccggttatcagtgccattggtggcgtgcagaatggcgagtctaccaacgacactacgccaggcatcggcggaaccggcaccaccggcgagacggtgatcatctacaacaacggcgtggaagtcgcgcgcgtagaggtcgtcaataatgaatggtcctataccctgccgacacaaaccgacggcccgctgaatatcaccgtcgccgcggtggacgatgccggtaacgttagcccggtaagtccggtctttacggtggaggttgatacgcaggcgccaaccgtgccgcaaattgacgccgtctctgacagccagctgaccaacagcgtgctttacacccgcgacggtacgccaaccctcaccgggattggcgagccgggttcgagcgtcaccgtctccgttgatggtgtcgcctcgccggtggtcgtggaggttcagccgaacgggacatggtcctggaccgccgaccctgcgctcaccgaggggccgcataccttctcagtggtcgcgagtgacgcggcggggaatacctccgccagctccggcgatctcagcgtgacggtggataccctgccgcctgcaacgccaacgaatatgaccattgccgcggagggcaccccgctgaccgggacggcggatgacggaaccacggtgacggttcgtgacgccaacggcaatatcatcgggaccggggtcgcgacgggaggctccttctacattgccctctccccggcccagttggatgccgcgacgctgacgctgatcgccacggaccccgcaggcaatgccagctcgtcaaccacctttgacgtgccggactctccgctcgagctgcctgcggtgccggtgattacggcgatcaacgatgacgtcgatcccgtcacgggcgacgtgaaagataaaaccaccaatgacaccacgcctacccttaccggcaccgccgatccgggcagcgtgatcgccatttatcaggatggatcgctgcttccggtgaccactgtcgttgcggataccaacggcaactggagctacacgccgctgttgccgctgacggaagggccacacaccttcgccgtgaccgccactaacaccaccaccggcgcgaccagcgggcagtcgcctgtcgcgaccgtcaccgtcgaccttaccgccccgacagcgccagccatcggtgcggtgaccgatgacgtaggtccgatcaccgggccaatcgccgacgggcagagcaccaacgacaaccgtcctaccctgaccgggacaggcacggccggggacaccattacggtgtacgataacggcgacccgctgggcaccgttattgtcggtccgactggcacctggagctacacgccgcctgtgctggacgacggcagccacaccctgaccgtgaccgccaccgatccggcaggcaatgagagcaccccgtcggccgggatcaccattgtggtcgacaccgtctccaccacgccggtgattaccagcgtgacggataacgcaggcaatgcggcaacgcctgttccaagcggcgatccaaccaacgacaccacgccaaccctgaccggtaccgctgagccgaacagcgtcgtcgccatttttgatggcaccacgcagattggtaccgtggcagcagacggtaccggcgcctggacatttactcctgaaaccgccctcggcgaagggacgcatgactttaccgtcagagccacggatccgcagggcaacgtcagccagccgtccaacgcctggagcgtcgaaatcgatcttactgcgccacaggtgccgacgatcgttacggtcagcgacaacgccccgggtggtgtaaccggcccgcttaccgccgggcaggtgaccaatgacaccacgccaaccctgagcggcaccggccaggcgggcaccactattcacgttctgaataacggcgtggagattggtaccactacggtcgacggcaacggtaactggacctttaccccggatccggtcctgacggacgggacgtataacctgcgcgtaaacgccagcgatgatgtcggaaacgtctccgccaactcgccagtgttcgcctttacggtggataccactggccctgcggccccggtggtcaccacggtgatagacgatgtcagcccgggaacgggaatcatcgccagcaacggttccaccaacgacacccgtccaaccttcaacggtacgggggaagtgggcgcaacggtgcacgttattgtcgatgatgtggaaatcggcacggcggtcgtcaacgcccagggtaactggaccttcacgccgaccaccgcgctgggtgaagggccgcataccattaccttcaacgccaccgatgccgcaggcaataccggggtcacctcgccaccgttcaacctgacggtggatacgtcggtgcccgacgcaccggtctttacccccgccaccgacaatgccggtcccgtgctgggcccggtcgcctcgggacaaagcacagacgacaccacgccaacgctgaacggcaccgcggcagccaacgcgaccattaccatctatgagaatggtcagccggtgggcaccgccgtggctgatgccaacggcgtatggagctttactaccggcacgctggcaaacggcagccacacctggaccgccacggcaaccgatgccgcgggcaacatcagtcctgcctcaccgggctttacgctggttgtggatacaactgtgcctgccgcgccggttatcacccaggcgatagacgatgttggcaccatcaccggggcgattggctccggccagaccacgaacgatcctctcccgcggctggtggggaccagcgagccgctggccaccgtgaatatctatgagggcactacgctggtgggcaccggtactgccgatgctaacggcaactggaccgtcgatatcaccgtgccgctgggcaccgggtcacacacctttaccgcagaagcaacggatcaggcgggtaacaccggcgcgccttccgccgacttcagcctgatcattgacaccacgccgccagccctaccggtgctgaccagtgtcaccgacgacgtcggtaatgctgcgacgcctgtcgccaacggcgggttaaccaacgatgcacgaccaacgctcaccggtacggcagaagccggcgcgacggtaaccatctacgacaatggggtacagattggcaccgcggtcgccaccggcggcgcgtggagctttacgccgtccaccccgctggctgacgggccgcataatctgaccttctccgccaccgacgccgtgggcaacgccagcgcacagaccgggggttacaccatcaatgtggatgccaccgcccctgtcgcaccggcaatcacctcgattgtggatgatgtgggaaccgtcaccggccctgtcaccggcaccaacccaaccaacgacacccgtccgaccttaaacggtacggcggaagccaatgccaccgtacgtatttacgacggcacgacgctggtgggaaccgtcactgccgatgccaacggcaactggacgctgccgcaaaccagcaccacgctgatcgaaggcgagcataacttcaccgccaccgccaccgatgccgcgggcaataccagcgcgccatcgccgattatcacgatcaacgttgacctgacgccgccagcagccccaaccgggctggcggtgatcaccaacgggacgcaggttaccggtacggcggaagcgggaagtaccgtcaccatcaccagcagcaccggaaccgtgcttggcacagccgttgcggacggcagcggaaacttcagcgccaccctcacccctccacagaccggcggggagtcactgattgtctttgctaccgataaggccggtaacgcgggtatcaccacctccgtgattgccccgatcaccacgatcccgaacgcgccggttatcgctaacatcgacgataacgtcggcacggtgacgggcaacctgaccaacgggaaaaccaccgatgacaccacgccaaccctgagcggcacggcgcagccgaacgcgaccatcaccctctataacaacggggtgctgatgggcacggtcaccgcgaatgccagcggcaactggagcttcaccacgccggtgctgagcgaagggccacatgccttcaccgccacggcgagcaacggctcgggcaccagcccgatttccacgtcgaccaccgtcattgtcgatctcactgcgccaacggctccaaccgggaccttcaacgcagacggcagcgtactgaccggtagcgccgaagcgggcagcaccgtcaccatccgtctggcggacaattcaacggtcaccgccacggcagacagcaacggatcctggagctacaccttcctcaataaacagacggaaggccagacgctgcaaatcaccgccaccgatgcggcagggaacgtctcgctgcccggctcagcccttgcgccggtggtgccgctctctgccagcaccaacgttgaagagctggcgctgacgaccaccgcaacggtgaccaactcgcagtacagcgactatggtttcctgctggtgggtgccgtaggtaacgtgctgacgctgctcggcaacgacaccgcgcaggtaggtttcaccgtcggcaacggcggcagtgcggatattgccgtgaacgccaacgccacgggtgccgttctttccctgctcaatacccttgagctggtggtacagcgctttgacgccgccaacaacacctggaccaccgtggtcgataccggacagccgcagttcgctgacctgctgaccctcggcgcgacgggggtgtcgctgaacctgaccggtctggcggatggtcagtatcgcgtcctgagctacaacactaacctgctggcaaccggttcttacaccagcctcgatgtggcggtgaaagagaccagcgcaggcaccgtgtccggcgaaaccaacattgtcggtaacgtcatcaccgacgtggatccaaccgcaggcagcgacaacgccccggcgggcaccaccgtcactgcggtcaccaacgcccagggctccaccactagcgttacggctgacggcacagtgattcaggggcagtacggcacgctgaccatcaacctggacggcagctatacctataacctgaccaacaccagcgccgccgtcattggccgcacggagaactttacctacaccatcacccacaacggcaccagcgcctcggcaaatctggtgctgtcgctgggcgaaggcaccagcagcagcggtatcgtggccgtggacgataccgcctcgctgaccttcgataccaccgtggaggcgatcaacaacggcacctcgtcgcagggcggctttaccctggtggggatcaaccttggcaatacgctggggctgaacctgctggacgatctggccaacccgatcatctataacgtggaagaaggcaccacccgcaccatgaccgttcaggcgtccgtgggcggcgtcgcgctggcctcggtgttcgacctttacatctataagttcaacaatgcgacacagaccttcgagcagatgcgcgttgaacccggctggctgcgcgcgccgctgctgggcggcacctccccgcagctgacattgaacctgcccgccggtgagtacctgttcctgctcaatacggcggcggggatcaccgcgctgacggcctacacgctgaacgtcttgcaggatcatgtctacagcgtggcaagcgtgagcgagagcaccaccggcgatgtgctggcggatgatattgcgccagcgggtaccgtagtctccgacgttaacggcgtggcggtgaacagcagcggtctgacggagatcaccggcgagtacggtacgctgcggatcaacgcggccggagagtacacctacaccctgaacagcggggtcggcgcggaccatatcagcacgccggataccttcgtttacaccatcaccgcgcctgacggctcgaaagacacggcatcgttgaacatcaccccaaccgcgcgcccaatggatgcggtaaacgatgtcagcaccgcgatggacgtcacgacggttcaccatacggccgcctattccgatacgacggtcgggtcggcgagctggaacgctgcgctgcttgcctcaacccagggcagcgggagcgggaccttcgtggtggatcctaataccgcgctgcataacgtggttctgtcgtttaacgtcgcctcgctgctgacgcttaccgggttaacggtggactggacgctgtccaacggcgcaaccaccgtcagaaccggctcgtttaacggtgggttactgctgggcggcacggcgaccatcaacctgacgggtctcgatctggaggcgggaacctatacgctgagctatacgggcaaaatggggccattgggggtaggaaatatcaccatcaccccaagcgtgaccggcaccagctactcgctgtcgcagttcgacgcgacgggtacccacaccgttgacggcaatatcttcgacggcaccgactccgcaggggcgatggaccagctccactcggttgatacccgcgtgagcattaccggctacgacggcgttaccactacgctggatccgtacaccggcagcacgatgtcaaacatcacgggccactacgggacgctggcgattgccgctgacggcagttacacctacaccctcaacccgggtatttcgctctctaccattaccagcaaggaggtctttaactacaccctgaccgatgccaacggtgttaaagataccgcgtcgctgaccattgacatggcgccgaaatttgtcagttcggagcataacgatgtgattagcggtacggcctacggcgacacgttgatttatcaggtgttgaacaacacggcgggtaacgccaccgcaggtaacagcacgggcgaccactggacgaacttctccctcacgcagggagacaagatcgacattggcgatctgctggtggggtggaacggtagcgcgtcgacgctggggaactatgtctctgtttcacaaagcggtaacaatactgtgatctccatcgaccgtgacggcacgggagccgcctacactaaatctacactcgttacgctggacaatgttcagaccacctacgacgagcttgtaaaccagcaacacatcattacctga

SEQ ID NO: 4476 - DNA, 2226 bp, Enterobacter cloacae
aaaccgcaccatccagaccgtggagatccagccatgaagcaacgcgacatcccgcagggtgaaaacatgacggatcaggcgctggagcagtgggcgcaggcgtttggctacgtggcgacgcgctatcgcgttgcctgctcgccaggctcgctcgtcgcaggcgcgccgtggctgaaaggcaaaccgatggtgcccgcgctgacgcagctcgcccgtgaagccgggctgacattccagctgctgacggcagatcagcagtccatcaacagctggcgtctgccggtggtggtggagctgaacgacggaaaaatcggcgtcatcgacaatttcgacggcgaggatacgctggaggtcagctttttcgacgacagcacgcacaccaaccgcctgtcgatgagcgcgatgctgcctgccatccgccacgtcatcgccctgcgtccgctggcggcgctgaaggacagccgcgtggatgcctatatctcaaaataccgcccggactggctctaccggctggtgatgcgcgaccttcgcccttacagctgggtgatgctggctgcactgttcattaacgtgctctccctctcgggcatcgtcttttccatgcaggtgtatgaccgggtgatccccgcccagtcctatccgacgctctatgtgctgactatcggggtgctgatcgccacgctgtttggctttgtgctgcgcgtggcgcgcggacacattatggatctgctgggcaaacgctcggatctgcgcgtctcggatcgggtgttcggccacgcgctgcggctgcgccacagcgccattccgcgatccaccggcagctttatctcccagctgcgcgagctggagcagatccgcgagatggtcacctcctccaccatctccaccatcgtcgatctgccgttttttatcctgtttgtgattgtgctggcgatcatcgccccgcagctggcgtggatcgctccggtggcggcggtgatcatggtcctgcctggcctgctgctgcaaaagaagctggcggagctggcgaagcagtcggcgcatgaatcaaccctgcgcaacgcggtgctggtggaaagcgtgcaggggctggaggacatcaagctgatgcaggcagagaaccgctttttgcagcagtggaacagctatatccagatcaccgccgaatccggcctgcgcacccgcgaactgacgcagaacctgatcagctgggggatgaccattcagagcctggtctatgccggggtgatcgtggtgggtgcgccgatggtgatcgacggcaccttaaccaccggttcggtggtggccgcctcgatgctcgcctcacggatgatcgccccgatggcgacgctatgcggcgtgctggcccgctggcagcaggtgaaggcggccaaagaggggctggacagcattatgcagctgccgaccgagaaccagcgcgaagagacaccgatccgccaggacgtgctgcgcggccactatcttttcgagcaggcgcagttccgctatcacccggaagatccccgcatggcgctgcgcattaaccgcctggagatcaaagcgggcgaaaaagtggcgatcctcgggcgcaacggcgcgggcaaatcaaccctgttgcaggcgatggcgggcgggatggatctggcgggcggtgaactgcggctcgacaacctcagcctgccgcatctggacgtggctgacgtgcggagaaacgtcggctttatgacccaaaacgcccggctgttttatggcaccctgcgcgagaacattacgctcggcatgccgcgcgccaccgataaagagatcttcgaggtgctggagatgtgcggcgcggccagctttgtgcagaagctgccaaaggggctggattacccgattatggagaacggcgtcgggctgtccggcgggcagcggcagtctattctgctggcgcggatgctgctgcgcgacccgaatatcgtgctgatggatgaaccgaccgcctcccttgatgaacataccgagcgggaatttattcaacgtctcggggcgtggctcggcaaccgcacgctggttgtcgcgacccaccgcgtgccggtgctggagctggtggagcgcgtggtggtactcaaagatggcatgctggtgatggacgcgccaaaagcccaggcgctgaacaacagccgtatgcagcaacagcagcaggcaaccggacgggagtggaaaaatgaaaatcagtcagcgtga

SEQ ID NO: 4477 - DNA, 447 bp, Enterobacter cloacae
acagacaatacaggcttgtatttcgctggtcagagggaaaagcagacgatctctatctctctccacacaagtacacgcaacacaagtgaggcatcacctatgacacttcaacaggcactccgcaaacccaccacgccgggcgaggtgttgcagtatgagtatcttgaaccgctcaatctgaaaatcaacgatctggcagagatgctaaatgtacaccgcaataccgtaagcgcgttggtcaataacaatcgcaaacttactgccgatatggcgatcaaactggcaaaagccttaaataccactattgaattttggctgaacttacagctaaacgttgatatctgggaagcgcaatctaactcccgcacgcaggaggagttaagccggataaaaaccgttgcggaagtcatggcgaagcgaaaatccggcaagccggacgttgcctga

SEQ ID NO: 4478 - DNA, 681 bp, Enterobacter cloacae
caatcttctaacatcaacccagtttatctgaatttttatttattaaagaatgaaggctcacaacataaggagtctgctatgaaaatcgtcattattggtgccagcggtacggtcggtcgtgctgtgacagaagagctaagccgtcgtcacgaggtgatcagcgtgggtcgcacgcagggcgaccatcaggtggatatcacctcgcaggcgagcgtacaggcgctgttcgaaaagatcggcccggtggatgcgattgtctccgccagcggtggggtacacttcggcccgctcgcaaccatgaccgacggcgagttcaaccggggcttacaggataagctgctggggcagattcgtctggcgctgaccggccagcactacctgaacgaaggcggctcgattacgctgataagcggcattgtggctcacgagccgattgctcagggcgtcaatgccaccacggtgaatgcggcgctggaagggtttgtgcgcgccgcggcctgtgaactgccgcgcgggatccgcattaacctgatcagcccgacggtgctgacggaatccgtcgaagcatatgatggcttcttcccgggctttgaaagcgttcccgctgcgaccgttgcgcaggcctaccgccgcagcgtggaaggggtacagagcgggcgggtatataaagtcggctattaa

SEQ ID NO: 4479 - DNA, 528 bp, Enterobacter cloacae
ggaaacataatgtctcttcctcttatttcgccgcagcaggcaaacgcgcttattgctgaaggcgccaaacttatcgatattcgcgaccccgacgagtatgcccgcgagcatattccggcggcgcactccattccgctggattcgttacccggcgggcttaacgcggcgccgggagaaacggtgattttccactgtcagtccggcgcacgaacctcaaacaatgctgctcgtctggcgcaggcagcatcccctgcgaacgcctgtgtggttgagggaggcattcagggctggaaacaggccgggctgctgaccgttgaagatcgatcgcagccgcttccgctgatgcgtcaggtgcagatcgctgccgggctgctgatcctctgcggcgtggtgttgggttacagcgtctccagcggttttttcctgctgagcggttttgtgggcgccgggctgctgttcgccggagtgacaggtttttgcggtatggcgcgacttctgaaagtgatgccgtggaaccgacgtacctga

SEQ ID NO: 4480 - DNA, 240 bp, Enterobacter cloacae
atggcagttacccttaaactggctacgcttagagaagtgtcttttataattttcaattggttagcttgcacggagttatttatgggtttttggcgcgttctttttacgattattctcccgccgctgggcgtgctgcttggcaaggggctgggctgggcgtttattctgaatatccttctgaccatcctgggctacttccccggtcttatccacgcattttgggttcagacgaagagctag

SEQ ID NO: 4481 - DNA, 1773 bp, Enterobacter cloacae
tttcaccaacggcaagccacacccaatgatcgacccgaccaaccgcatcagccgcctgctacaggaggcgcgcgatccgcaggtgggcgtcatcgtgatggacttcgtgctgggctttggcgcgcacgacgatccggtgggggtgatgatcgaggcgatcaaagaggcacaggcgatcgcgaacgccgacaaccgtccgctggaaattctcggctacgtgctcggcaccgatcaggatccgcagtcgctggcgcagcagtgccagctgctgaccgacgcaggcgtcatctgggccagcagcagcaccaacaccggattactggcacgcgaatttgtctgcaaaggggagaaagcataatgaccactttattcaaccagccgctaaacgtcattaacgtcggcattgcgatgttcagcgacgacctcaaaaagcagcacgttcccgtgacccagctcgactggacgccgccggggcagggcaatatgcaggttgttaaagcgctcgaccagctggcggaaaaaccgctggcggagaaaattgccgccgcgaacaaaattgccctggagcggattattcagtcccatccggtgctggtgggctatgaccaggccatcaacgtggtgccgggcatgacccgcacgaccattctgcacgccggtccgccagttacctgggaaaacatgtgcggggcgatgaaaggcgcggttaccggcgcgctggtgtttgaagggctggcgacggatctggaggacgccgcaaggctggcggcgtcaggtgacatcaccttctcgccgtgccacgagcacgactgtgtgggctctatggcgggcgtcacctccgcgtcgatgtttatgcacatcgttgagaacaaaacttacggcaaccgcgccttcaccaacctcagcgagcagatggcgaagatcctgcgcatgggggccaacgaccagagcgtgatcgatcgtctgaactggatgcgcgacgtgctcggcccgatgctgcgcgacgccatgaacattatcggcgaaatcgacctgcgcctgatgctggcccaggcgctgcacatgggcgacgagtgccacaaccgcaacaacgcgggcaccacgctgcttattcaggcgctgacgccggggctgatccaggcgggctattcggtgacgcagcagcgtgaagtgttcgagtttgtcgccagcagcgactatttctccggtccgacgtggatggcaatgtgtaaggccgcgctggatgccgcccacggcattgagtacagcaccgtcgtcaccaccatggcgcgcaacggctacgagttcggcctgcgcgtttccggcctgccggggcagtggttcaccggcccggcgcagcaggtgatcggcccgatgttcgcgggctataagccggaagactccgggctggatatcggcgacagcgccatcaccgaaacctacggcatcggcggctttgcgatggcgacggccccggcaatcgcggcactggtgggcggcacggtggaggaagccatcgatttttctcgccagatgcgcgaaatcaccctcggcgaaaacccgaacgtcaccattccgctgctctcctttatggggatcccgaccgccatcgacatcacgaaggtcgcgggcagcggcattctgccggtcatcaataccgccattgcccataaggacgcgggcatcggcatgataggggcgggcatcgttcacccgccgtttagctgttttgaaaaggcgctgttgaccttccgcgatcgctactttttataa

SEQ ID NO: 4482 - DNA, 1011 bp, Enterobacter cloacae
aggagtgctgtaatgagccagaccacggagaaaaaaccgcgtttaaccacgtcggcgatgattgcctctatcgcggaagagggccaggagacgcgagccgcaccgttcggccacgcgctggtgaagctggcggaacagcgaccggaggtcgtaggcatgactgcggatctgtcgaagtacaccgatctgcatattttcgctcaggcctacccggaacgcttctttcagatgggcatggccgagcagttgttaatgggggccgcgggcggcatggcgaaagagggttttattcctttcgccaccacctatgccgtcttcgctacccgccgcgcctacgactttatccatcaggtgattgctgaagagcacctgaacgtgaagatctgtgcggcgctgccggggctaaccaccggttacgggccgagccaccaggcgacggaagatattgcgattatgcgcggtattccgggcatgacgatcatcgatccctgtgacgcaatcgacacggaacaggcggtgccggcgatggcagcgcacgatggccctgtctatatgcgcctgctgcgcggcaaggtgccggtggtgctggaccagtacaactaccagtttaagattggcaaagctgcgctgctggaagaggggaacgatgtcctgatcgtcgcctcaggcctgatgaccatgcgtgcgctggaggcggcgaagcagctgcgtaaggataacgtcagcgtggcggtgctgcactcgcccaccattaagccgctggacgaagagacgatcctggcgcaggctgcgaagccgggacggctggtcatcgtggcggaaaaccacagcagcgtaggcgggttgtgcgaagccgtcgcgtcgctgttgatgcgcaaccgcgtgaacgtggatttcgataccgtcgcgctgccggacgcgttccttgatgcgggcgcgttgcccaccctccatgaccgctacgggatctcaaccacagccatggtggagaaaatccggcgcaggctgtga

SEQ ID NO: 4483 - DNA, 252 bp, Enterobacter cloacae
ttcaatgtacggtgtgaaggtgtcctcggtggcaaaggttatgccaccgccggccagcgcgaggctgagcataagacgcagatcgttagtggttatttgtggttcaattgccacatcgaaagggacgcctgcttcctcaaactcccagcgatagggggcaacgtccggggaagggcgccagccgatacaccgatgagcgaccagctcacggggatgcgccggtgcgctgtgtgtcgccagataggaaggtga

SEQ ID NO: 4484 - DNA, 342 bp, Enterobacter cloacae
acgatgaacattgatacagaccgactggacgacgtaaacattatgacgccttcggtgcgccgactggacgcctcggtggcggcggtatttaaggaagctattgcccgggagattggggtggatcgtaaagccctgatagtcgatttcagcaaaatcgattttatcgacagcagcggccttggcgcactggtttccctgctgaagatgatgaatggtaaaggtgaaatgatgctgtgtgcgctgaaccccggtatacgcaacatgttcaccctgacccgtatggatcgcatatttcgcatttgcccggatcgcgctacggcactttcgcatctaaatcagtga

SEQ ID NO: 4485 - DNA, 291 bp, Enterobacter cloacae; identical to SEQ ID NO: 568

SEQ ID NO: 4486 - DNA, 411 bp, Enterobacter cloacae
aaaccgtttttcactgatatagtgaccttccagcacgtccgccagctgctgctgcgcattgtccgggtcgaggtcggtaaggaaaccgagattgccacggttaacaccaataaccttaatatcatagcgagccagcgttcgcgccgcgcccagcatattgccgtcgccaccgaccaccacggcgagatccgcctgctggccaatttccgccagcgtgccggttctgacgcttttaagctgcaactcctgggcaatctgctgctcgaccatcacttcatagcctttaccacacagccagcgatacaacatttcatgtgtcgtcaatgcggtagggtgacgcggatggccgacgatcccaatacacctgaaatgattattcattttctggaggtccttgtgcctgatgaatga

SEQ ID NO: 4487 - DNA, 624 bp, Enterobacter cloacae
aacatagggagtctgaatatgtctgcaactgcactggttacagaatttctgctggcggcagaagagggcaatatcgacgcgctaaaagcctgcctggaaaaaggcgtggatattaacgtaaccaaccgccagaaaagaaccgccattattattgccagcctgaaaaagcattacgcctgtgtggaatttttaattgccgccggggcggatattgataaacaggaccagacctgttttaaccccttcctgatcagctgcctgaccaatgatttaaccctgctgcgcattgtccttccggcggatccggatctcgaccgtctgacgcgctttggcggcgtgggcattacccctgccagtgaaaaagggcacgttgaaatcgtgcgtgagctgctggaaaaaaccgacatcaacgtcaaccacaccaattttgtcggctggacgccgttgctggaggccatcgtattaaacgacggcggcgcaaagcagcaggaaattgtgaagctgctgctggatcacggcgcgaacccgcacatgaccgataaatacggcaaaaccccgctcgaactggcgcgggaaaaaggcttcaacgcgatcgcagacctgctgctggcggcaggcgcgtag

SEQ ID NO: 4488 - DNA, 1650 bp, Enterobacter cloacae
cgcattcggtcagccttcccctggctggccgttactgaaaaaacgcattgttaccgacgtgcatttagcacgacggcggcccccttttatcttaaacaggtgaaaataatgccaaccaaaatcgtcataaaaaagaatacgtatttcgattcggtttccttaatgtcggtttccaccaaagccaataaattgccgggcgtcgagcaggcgtttgtggcgatggcgacggaaatgaacaaaggcgtattaaaaaacctcgggctattaacgccggaattagcggacgcgaaaaatggcgacctgatgatcgtgattaaaggcgacgcggcaaatgatgaaaccctggccgccattgaagcgctgttcacgcgtaaagagcgcacgggctcacatgaagcacgctacgcgtcgattgccagcgccaaaacccatcgtccggacagcaacctggcggtgatttccgtcaacggcaccttcgccgcccgggaagcgcgtcaggcgctggaaaacgatcttaacgtgatgctgttctccgataacgtatcgctcgacgacgagctggcgctgaagcagctggcgcatgaaaagggtctgctgatgatggggccagactgcggcaccgccattatcaacggcgcggggctgtgcttcgccaacgcggtgcgtcgcgggccgattggcatcgttggcgcctccggtaccggcagccaggagctgagcgtgcgcattcatgagttcggcggcggcgtgtcgcagttaatcggcaccggcggacgcgatcttagcgagaagatcggcggcctgatgatgctcgacgccatcgacatgctggaggcggacgacgcgactcgggtgatagcgctcatctccaaaccgccagcacccgcggtggctgagaaggtgctggcccgggcacgcgcctgccgcaagcctgtagttgtgtgcttcctgggccgcaacgaaccgcctgccgatgaagacggtttgcagtttgctcgtggcaccaaagaggcggccctgaaagcggtgctgcttaccggcattaaaaaagacgacctggatttacatccgctcaactggccgctgatcgaagaggtacgcacccgcctgacgtcgcagcagaaatacattcgcggcctgttctgcggcggcaccctgtgcgacgaagcgatgtttgccgcgctggagaagtttgacgatgtttacagcaacatccagccggacccggccaggcgtctgaaagatatcagcgttagccaggcccacaccttccttgatttcggtgacgatgatttcaccaacggcaagccacacccaatgatcgacccgaccaaccgcatcagccgcctgctacaggaggcgcgcgatccgcaggtgggcgtcatcgtgatggacttcgtgctgggctttggcgcgcacgacgatccggtgggggtgatgatcgaggcgatcaaagaggcacaggcgatcgcgaacgccgacaaccgtccgctggaaattctcggctacgtgctcggcaccgatcaggatccgcagtcgctggcgcagcagtgccagctgctgaccgacgcaggcgtcatctgggccagcagcagcaccaacaccggattactggcacgcgaatttgtctgcaaaggggagaaagcataa

SEQ ID NO: 4489 - DNA, 990 bp, Enterobacter cloacae
gggcaccagaacgcaccttctaaaggaaacaaaatgaaagagcttatggtcgtcgccatcggcggcaacagcattatcaaagacaacgccagccagtcgattgagcatcaggcgcaggcggtcaaagcggtggctgagtcggtgctcgaaatgctggcctcggactatgacatcgtgctcacccatggcaatggcccgcaggtggggctggatctgcgccgcgccgaaatcgcccacgagcgggaagggctgccgctgaccccgctggcaaactgcgtggcggatacccagggcggcatcggctacctgatccagcaggcgctcaacaaccgcctggcggcgcgtggcgagcaaaaggcggtcacggtcgtcacccaagtggaggtggataaaaacgatcccggctttacgcacccgacaaaaccgatcggagcgttcttcagcgaggcgcagcgcgacgagctacagctcgcgcacccggactggcattttgtcgaggattcaggccggggctatcgccgcgtggtggcctcgccccagccgctgcgcatcgtcgaggcggatgcgattaaggcgctaacgcagaaaggttttgtggtcatcggcgcgggcggtggaggcattcccgtggtgcgcagtgaacagggcgattaccagagcgtggatgcggttatcgataaagatctctccaccgcgctgctggcgcgcgagatccgcgccgacgtgctggtgatcaccaccggcgtggagaaagtgtgcgtgaacttcggcaagccgaaccagcaggcgctggatatcgtcaacgtggcgcagatgacgcgctacatggatgagggccacttcccggcgggcagcatgttgccaaaaatcgtcgcttcgctggaatttttacgccatggcggcaggcgcgtaatcatcacctcgccggactgcctgcccgcagcgctgcgcggtgaaacgggtacccatattattaatgaaggaagataa

SEQ ID NO: 4490 - DNA, 1335 bp, Enterobacter cloacae
gttatgtctcgtatagaacaagctgtcccctacataaaggctaaaaaaaccaattaccgtttcgttgtgctggcattaatttttattgtttatgccattaactatgctgaccgaacaaatattggtgcagtactgccgtttatcattgacgaatttcatatcaataatttcgaagccggtgccatcgccagcatgttttttttgggatacgccctgagccaaattcctgcgggcttttttattgccaaaaagggaattcgcggcatggtggcactgtcgatattcggcttctctgcctttacctggctgatgggcaccgcaacctcagttctgggcctgaagtgtatccgcctggggctggggttaacagaggggccgtgcccggtcgggctggcctccaccatcaataactggtttccgccaaaggagaaggccacggccacgggcgtctacatcgccgccaccatgttcgcgcccatcctcgtgccgccgctggcagtgtggatcgccatgacctggggctggcgctgggtcttcttctcctttgcgatccccggcctggtcattgccgtcctgtggtatctgctggtacgcaccaggccgtccgagagcgcattcgtctcgaaagcggagctggagaccattaccgccggtcaggagaccccggacgccagacgggaaaatatcgtgatttcaccaggctttgcacgcctcgatcggctgatccgcgtgcgggaattagccccggtaagcacggtaaaagggctgtttacctcgaagaatattctcggcgactgcctggcctattttatgatggtcagcgtgctgtacggactgttgacgtggatcccgctctatctggtgaaagagaaaggctttacgtttatgagcatggggctggtcgccagcatgccgtgcatcggtggatttatcggtgcgatttttggcggctacgtctccgacaaactgctcggccgccgacgtaaaccgaccatgatgtttaccgccatcagcaccgttttaatgatggttattatgctgaatattccgcaaagcaccgtcgcggtttgcgtcgggttattttttgtcggcctctgtctgaatatcggctggcccgcttttacggcttatggaatggctgttgcggacagtaaaacctatccgattgccgcgtccattatcaatagcggcggtaatctcggcggatttgtttccccgatgctggcaggttatctgctggataaaacaggtagttttaattccgtgtttatttatttcggtatttgcgcagccattggcttaataatgattatgctgctggaagagccgaaataa

SEQ ID NO: 4491 - DNA, 762 bp, Enterobacter cloacae
tggagtaaatgtatgctactgaaaaataaagtcgccgttattaccggcgcggcttccgtacgcggtttgggtttcgctacggcgaaattatatgctgaacagggtgcgaaagtggtgattatcgatttaaacgctgaagccagccgggctgccgccgcgagccttggcgacgaacatctgggccttgcggcgaacgtcagcaatgaattacaggttaatgccgccattgagcaggtgctggggaaatacgggcgcatcgatattctggtgaataacgccggcataactcagccgatcaagctgatggatatcaaacgcgaaaattacgatgcggtgcttgacgtcagcctgcgcggcacgctgctaatgtcccaggcggttattcccactatgcgcgcgcaaaagtcgggcagcatcgtctgcatttcatcggtatcggcccagcgcggcggcggcatctttggcggcccacactacagcgctgcaaaagcgggtgtgctggggctggcaaaagccatggcgcgtgagctggggcccgacaatgtgcgcgtaaactgcatcacgccgggtcttatccagacggacattaccgcaggcaagctgagcgatgagatgaaaacgtccattctggcgggcattccgcttaaccgcctcggagacgcgcaggatattgcccgcgccgcgctgttcctcggcagcgacctctcttcttactccaccggtatcacgctcgacgtgaacggcgggatgctgatccattaa

SEQ ID NO: 4492 - DNA, 858 bp, Enterobacter cloacae
ggagatacgacgatgacggataccacagttcaacaggttgccgccgcggcctggcgcattcgccgctacgcgctgcgcatgggcgaagtgcaggggcagggctacatcgggcaggcgctgggctatgccgatgtgctggccaccgcgtttacccacggaatgaaccttaagccgggcgagccggagtgggaggggcgtgaccgttttttgctctctcacggccactacgccattgcctgttacgccgccctgattgaagcggggatcgttcctgaagaggagctggagacctacggcgcggacgacagccgcctgccgatgtccggcatggcaacctacacgccgggcatggagatctccggcggttcgctggggcagggcttaagcattggcgttggcatggcgctggggctgaagcgcaagcagagcgcggcatgggtcgttaactccatgtcggacggcgagctggacgaagggtcaacctgggaagctgcgatgtcggcggcacatcacggcctgtcgaacctgatcgtgctggtggacattaaccgccagcaggcggatggcaactcgcacgcgatcctcggctttgagccgctggaagataaatggacctccttcggctggtacgtgcagcgcgtcaacggcaacgatgtcccttcactggtaacggcgtttgataacgccaaacgctacccggaaaaccagccgcgcgtcattttgtgcgacacgctgatgggcaagggcgtgccgttcctcgaaaagcgtgacaagaaccattttattcgcgtggatgctgacgagtggcaaaaggcactcgctgtgctggatgccaacaaacctgaaggagtgctgtaa

SEQ ID NO: 4493 - DNA, 1185 bp, Enterobacter cloacae
agaatgtctgcaaacaaactcgccagcagcgcgcagggcctgcaatcctctgccatccgtgaattattaaaacatagcaaaatggcaggcgtgatttcgctgggtggcggtattccaaatccggacctgttcgatcatgaaggtttaaaaatcgccgctgatgccgtgctgtctcagcattttggcgaagcgttccagtacggtctgacggaaggcgtcccggggctgcgcgaagagatccaacgcatctgtgaaggtcgcggcatcgcctgtaaagccgatgacgtggtcattacttccggctcgcaacagtcgcttgacgtgctggcgcgggcgttaatcaacccgggcgatacggtcgtcgtggagcggcctacctacctcgccgcgttgcaggtctttggcctggcgcaggcgaaatttgaatccgtcggtaccgacggcgacggcatgaaagtggatgaacttgaagcgctggtggcaactaaaaccatcaaagcggtttatatcgtgccaacctttggtaacccgggcggcgtgacgctctccgaagcgcgtcgtaaacagctggtggaattatcgaagcgctatgacttcgtgattatcgaagacgacccgtacagcgagatcaactacaccgacgaagcgttccgcccgctgattgctcatgccaaagatatcggcaatgaggataacgtggtgtacacctccaccttttctaaaatcctcgcgccgggtacccgcgtgggctgggtgctggtgccggagtggctaaagcgcgcggtagtgaacctcaagcaaaccaccgatttgcacaccagcacgctgtcgcagctgatgacgtacgaatatctgaaaaccggtcgtctggcgaatcagattaaaatgatccgcgaagcctatcgccagaaataccagacgtttgcaacggaactggaagccgagctgggcgatgtgatgtcgttccacaagccgaagggcgggatgttcctgtgggcgaaaatgaataacggcatcaatacgacgaaatggctggaaaaaacgttgagcaacggcgtcgtgtttgtgccgggtgagttcttctactgcaacgagccggaccacaccacgctgcgcatgtctttcgttaccccaacggatgagcagcttaaagaagcggttcgacgcctgagaatttccctgtaa

SEQ ID NO: 4494 - DNA, 435 bp, Enterobacter cloacae
atcagtgagttgactgtggctaacgacgttacttttcccgccacgttaacctccgtctcgccgcttgcggcatggcttgagcgtcagatggcttcgctgtccgttagcgatgactggcgctttgcgctcgatctcgccgcctgtgaaacggctaccaacattattcgtcatgcgctacatgaggatccggaacgttgcttcaccgtggagttcatcgttaccgtctcggacgcggcgctgcgttttacggacgatggcgataaatttcccgctgaacgtctcgcggcggtgcgtgacgacgcgacgttcgatgcctctcttttggctgaaagcggcagaggactgaaactcatttttttgtatgtcgataatttcacggtggaaaacgttgcagggaaaaatatcaccgttctggagaagaggatggtcggataa

SEQ ID NO: 4495 - DNA, 1200 bp, Enterobacter cloacae
ttccccctcacttacgggtgcgggttcttattgtctgaaaacagagcaggagtttatatgtcttccaccgaagcaacaaataaagcaccagccgtacccgaaaaaagcagcgtgaaatctctgaaagaggaacctgtattacaggtggagcgtcgtgattttgtcgatctggtaccggaaaaaagaccgcgtgtgcaatcattacgcggctttgatgactgctataccgatattgtcgattatatcgttcgctgcacccataaaatatgggatgagcgcgatgtcggcttaatttattctcactatacccataactgcgtgctgtataacgcgctggggacactctataaccgtgaacaggtggtacaggatacgctgcaacgcttaattgccttcccggaacggcgcggaatggcaacccaggttatctggaacggaaatgatgttgacggtttttatacctctcacctggtgacgggaagcgggcggcatacccagcacagccatttaggcaagccgaccaaccgcaccttcgttacccggaccgtggcggattgcatgatccacgagaataaaatttatcgggagtgggtggtcagcgacaacatgtcgttaatgaaacagcttggcctgaacaccgatcaaatcgcatttaatatggcaaaagagcagttcgataaaggcttccgcgtgatggacatcggcgaaaacggccgcatgctggggcaatatccgccggagatggagtgcgatgtttccattgcgcacaccgatactgaggagcagtgcctgcgttggctgcatgagatctacaaccgccggatgtttggcaagatcaaagaagtgtatgcgcctaacgtacagtggcacggtccgctgatgaaagagctgtacggcaccgcggcggtaacccatcagacgctggcgctggtggggatgatccctgacggcgcgtggctgccgcagcatatttgttccaacccgtgcgatgaaggcggcgtcaaagtggccgttcgctggatcatcgaagggcatcacctgggttacggcgaactgggcaagccgaccggagagcgactgtttgtgatgggcatgtcgcactaccacatcgtcaacggaaaaattgttgatgaatgggtcgtgtatgaccacctggcgctgttggcgcaaatcaaactcggccagatggaggacgcgtaa

SEQ ID NO: 4496 - DNA, 1296 bp, Enterobacter cloacae
atgttaaatcaggtgagctggattaagcgcccgcaggggcaggatgcgcaggccgatcgttccctgacggagaaggtcagcgccattatcgagcgcgtgaaaaccgaaggcgatacggcgctaagagccttttcgcagcagtttgataaggtcgtccccgcgcagtttgaggtgagcgagcaggagatcgccgaagcactggaggggatggatgcccagacgcgccgcgacagtgagtttgcgattaatcaggtgtgtcgttttgcgcaggcgcagctggcgaccatgcagccgctggaggtagagacgctgcctggcgtgcatctcggtcaccggatcatcccggtgcagacggtgggctgctacgtgccgggcggtcggtatccgattctctccgctcccgtgatgtcgattgttcctgcgacggtggcgggttgtgaacagattatcgcctgtctgcccccgggcgcccatccggcgatgattgcagtttgccatctggcaggcgcgcaccgcattttcaaagttggcggcgcgcaggccattgcggctatggcctggggaacggagagcattccgtcggtggacaaaattgttgggccaggcaacgccttcgttaatgaagcgaaacgccaggtttttggtcgggtcggcattgatgccctcgccgggccgagcgagattttcactatcgcggacgacagcgccgacccgcgcattctggccgccgatatgctggcgcaggcagagcacgatattcatacccgcgtcgggctggcgacaaccagccgggatatcgctgagcgtaccctggcggaggttgagcgtcagctcgccagcctgccaacggcggcaacggcgggggaggcgtggcgccggcagggtgagattgtgctctgcgaagatgaagcgcagctgattgcttttgctgaccatatggcgacggagcatttgcaggtgcatacccgcgatccgcacgccacggcggcgaagatccgcaactatggctcgctgtttattggtcagaacgccagtgtggtgttctctgataaatgctgcggcaccaaccacacgttaccgacgatggcggcggcacgctataccggcggtctgtgggttggcgcgtacgtcaaaatctgtacccatcagtggattgacgagcagggtatcccggcaatcgcagaaccggcgatccgccagagccgtaccgaggggatgcaggggcaccgacgggcggcggaaattcgtctgcgtccgcaggacattgatgccattactaccggcatgcgggactaa

SEQ ID NO: 4497 - DNA, 1365 bp, Enterobacter cloacae
aacgtatcccgggcagccttctgcccggttttcatcacgagagagcctgagactatgaagcgcctgataccgccagacgactgcccggaggaaattgcccaccgtctcgacgtcatacagcagcaccgggcgctcaacgcgatcctcggggttaaccctgacgctatgtctcaggcggaacagcatcagcagcagcgtcgacgtggagaaccgatcggccccctgcacggcgtgccgctgatcgtcaaagataatattgcctgcgcgccgatgcccattactcttggctgccgggcgctggcctcacttaacgcgacagcggatgcacgggtggtgcagcgattgcgcagcgcgggggcgattattctcgccagggccaatatgtccgagttcgcgttcgatgtgcgctcgcgaagctcgctggggggcgatgtggcgaatccactttgcccgacactcaccgccggaggttccagcggaggatgcgctgcggccgtggcggcgggaatggcggatggcgcattgggtaccgataccggcggctctatccgcattccctgtagctataccgggctgatggggctacggcctgcctttcgccgttcacagctggacggtgtagcgccgctctcgcccagcaaagataccgttgggccaatggtacatagcgttgaagatgccgccttgctgcatgcggtgatccatggcctgccgccggttgcgcttcctgtgcgttcgctgaaaggcgttcgctttggtgtggtaaccgcgttacagggagaggatgaggtacagctggaggtctggcagtcggcgctgcacacgttgcgccgtgccggagcgacgctggtggaggtttcactccctttccttgaagaggtgaggcaggccacctgcctcagtctgtatgaatttcgcgtggcgattgacgactggcttagcaaacagcctggcgctccctccggactgacgagcattgtggactccggcgctttcctgccggagtttgcgccgtttctacgtcagatgctggcgagtaacacgctgaaaaccccgctctggctggcggggcgtcgctttcagcgcctgttgcggcagaacctttgccaggtggcggaggcgcagcgcatcgacggatttgtgtatcccaccgtacaacgattaccagaaagtatggcgaagatgccgccaggctgcgcgccggaactggccgccatcagcggcctgcctgccattacgttgccctgtggcgtaagccgtatcggtctgccggtggggatggagatgttatcggtgcaggaggatgaggcggcactgatggtgctggcgctggcgtgtgagggggcgctgggcgagaagggatag

SEQ ID NO: 4498 - DNA, 477 bp, Enterobacter cloacae
atgttattatttgtctgttgtgtgaccatggaaaatgctatgcctcagattagccgtactgcgcttgttccctacagcgcggaacaaatgtatcagttagtgaacgacgttcagtcctatccggaatttattccaggatgcaccggtagccgagtgctggaatccggcccgacgcagatgactgcggccgtggatgtctccaaagcggggatcagcaaaacgttcaccacgcgcaataccctgacgagcaatcagagtattttgatgcatctggtggatggtccgtttaaaaaactgatgggagggtggaagtttacgccactgagcgctgacgcctgccgcattgagtttcatctggattttgaatttaccaataagctgatcgaactggcgtttggccgaatctttaaagagctggcctcgaatatggttcaggcgttcaccacgcgcgccaaagaggtttacagtgtcgcataa

SEQ ID NO: 4499 - DNA, 381 bp, Enterobacter cloacae
gacccttccgggcggttggcaaaggggattattccctgggatgttttgggaagaagtggttgggaaaaattccggggttgttcagtgaagaaaaacgcagcgagccaggctgaattagagcgtcaacgcgctgaacagcaggataaaattaatgctctgctggaactgatgaaagctgacggtatttctccgagcgatctgttaggcagtgacctggcgcaggcgggtcagccgacgaaaaaacgtaaagcgcgtgcggcgaaatatcgttttattgacgcgaacggtgaagaaaaaacctggaccggtcagggacgtacgccaaagccaattgcgaccgcactggcaaacggtaaatcgctggacgatttcctgatctga

SEQ ID NO: 4500 - DNA, 1632 bp, Enterobacter cloacae
aaaggcgctgttgaccttccgcgatcgctactttttataaggcatgcatccatgaaaaacatgaaactggagtggaaaagaggtgactgggcagcttatttcgggttgatgaccaacaacctgaccaatttgctgaccatgatggggttgctcatttttgtcgtcggcatcccgaaggagattgtttatggacgcatcgcgccagccttcgggctggcggtgctggtggcgagtctttgctatacgtggtttggcctgcaaatggcgcgcgctaccggacgaacggacgtcaccgcgttgccgtccggcccgagcgcgccgtcgatttttaccgtgaccttcctggtcttaatgccggtttaccagcaaaccggcgatgcggatttcgcgattcagattggcctggtgtggtgctttgtggaagcgatgatcctcgcgggcggttccttccttggggaaaccattcgcaagatgatcccgcgtaccgtgctgctgtcgtgcctgtccggtcttggcctgctgctgctggcgatgaacccgatgttgcaggcgttcgaagcgccgaccgtatcgtttatcgtcctgctgctgatcttcattaactggttcggtaaaaagccgattttcgcccgtatcccgaccggcctgctgctgttaattgccggtactctacttgcgtggatctccggcctgcaaagcccggatgccattaaagcgtccatgtcatccttcggctttaacccgccggaagtgcacgtggacagctttatgcaggggctgccgcacgcgctgccgtatctggcgtccgccgtaccgctggggctggcgaactacatctttgacctggagaacatcgaaagcgcccacgcggcaggggatgaatacccgacccgcaaggtaatgctggcgaacggtctggcctcgatgctcggctgcctgatgggcaatccgttcccggtcacggtctacgtcggccatcctggctggaaagcgatgggcgccagcatcggctacaccctggcgtccggcgtgaccatgttcatcgtgccgctgttcgggctgggggcctttatgctcgccatcataccgatgaccgccatcgtgccgattctggtgtttatcggcgtcgtcaccgccaaccaggtggtgagggaaaccccgaaagtggaggtgcccgttatcttcatctgcctgttcccgtggatcgccaactgggcgctgaccatgatgaacagcgtgatgagcgccgcggggaccagcgcggcgaaaatcggcaccgacgtgttgcacagcaagggtatctactacgaaggcctgatgcatctcggcaacggcgcgccgctcgccagcatgctctggggctgtatcgccatcttcgccatcctcaacaaaccgctgcgcggggccgtcgccgccgcaggaggcgcgctgctggcgctgtttggcgtgatccacgccccggtggtgggctttgccgagggcagttccctgatgtttgtcacggcctacctgatgatgggcgggatgtttgtggtgaagcatgtgctggatacctctgttaatccccctctccctgtgggagagggccggggtgagggcaccagaacgcaccttctaaaggaaacaaaatga

SEQ ID NO: 4501 - DNA, 1458 bp, Enterobacter cloacae
tcatcacctcgccggactgcctgcccgcagcgctgcgcggtgaaacgggtacccatattattaatgaaggaagataagatgagtgagaataaaagccgccgcgagtttatcagccagagcggcaaaatggttactgcctgcgcgctgtttggcgccacgggttccgtcgcgtatgctgccgattctgtaaaggcaacctgcgagacgggtaaaccgatgaacatcaccgcaaaacattactatctcgacaacgtgctgctggaagccgggtttaactacgacggcagcgtggcgacaagcacccgcaccgagctgaaaacgctggagatcaaagacgggaaaatcgtcgccctgcgcgataacggcagccacgccgacgcgaccctgccgcactacgacgcgggtaaaaagctgatgcttccggcgatgcgcgacatgcacattcacctggataaaaccttctacggcggcccgtggcgctccctgaaccgtccggcgggcaccaccattcaggacatgatccgcctggagcagaagctgctgccggagttacagccctacacgcaagaacgcgccgaaaagctgatcgacctgatccagtccaaagggtccaccatcgcccgcagccactgcaacatagagccggtttccggcctgaaaaacctggaaaatttgcaggcggtactggcgcgccggggcgcaggctttgactgcgaaatcgttgccttcccgcagcacggcctgctgctgtcgaattctgaaaagctgatgcgcgaggcgatgcaggcgggggcgcattatgtgggcgggctggacccaaccagcgtcgacggcgcgatggagaaatccctcgacactatgttccagattgcgctggattacgacaaaggggtggatattcacctgcatgaaaccagcccggcgggcgtggcggcggtgaattacatggtggaaaccgtggagaaaacgccggcgctgaaggggaagctgaccatcagccacgccttcgcgctggccacgcttaacgaacagcaggtggatgagatcgccacccgcatggcggcacaacaggtaaccatcgcctcgaccgtgccgattggcaccctgcacatgccgctgaagcagttacgtgataaaggcgtgtttgtcatgaccggaaccgacagcgtgatcgaccactggtcgccgtacggtctgggggacatgctggagaaagccaacctctacgcccagctctatattcgcccgaacgagcagacgctttcgcgggcgctgggcatcgccaccggcgacgtgctgccgctgaacgacaaaggtgagcgcgtgtggcctaaagcgcaggacgacgccagctttgtgctggttgacgcctcctgttccgccgaggcggtggcgcgcatttctccgcgcaccgcgacgttccacaaggggaatctggtctggggcacggtcgcctga

SEQ ID NO: 4502 - DNA, 861 bp, Enterobacter cloacae
ccgctacgggatctcaaccacagccatggtggagaaaatccggcgcaggctgtgatttataagacggatacgttgtcaacgggcgaggggtgctttaccctcgccactgttgcgataaaggagtccgttatggcacaaaacatctacgacaacccggcattttttgaaggctatgcccagcttccgcgctcggttcagggcctgaacggcgcgccggagtggcccgcgctcaaggcaatgctgccagatttaaccggtaaagcggttgtcgatctcggctgcggctacggatggttctgtcgcgcagcgcgcgagctgggcgcgtctgacgtcacgggtgttgatatttcagaaaaaatgctcgcccgcgcggctgaactgactgatgacaatcggattcactatcagcgtagcgatctggaatctctggcgctgaaagcgaatagcctcgatctggtctacagctcgctggcgctacactacctgccggagctggacacgctattcgccaacgttcagcgcgcgctaaaacccggtggcagcctggtcttctcgatggagcacccgatttatacctgcgccacccgtcagggctggctgaccgacgacagcggcgagcggttctggggcgtgaatcattatcaggacgaaagccagcgcgtcagcaactggctggcggacggggtgattaaataccaccgcacgctgggcaccacgcttaacgcgctgatcaaggccggattgacgataagcgaagtcaatgagtggggaccaacgcagatgcaggttgacgcctggcccgcgctggccgaagaggcggaacgcccgatgctggtgctgatcgccgcccgtaaggcttaa

SEQ ID NO: 4503 - DNA, 903 bp, Enterobacter cloacae
ccagaggttcggaatatggataagcttcgcggcatggagacgttcatcgcggtggtggaaagcggcagctttaccggcgcggcggcccggctggagatgtcggcggtgatggtcgggaagtatattacgcagctggaatcgcagctcggtacgcggctgctggagcgcaacacccgtcgccagagcctgaccgacgccggacgcgtttatttcgtagaggccaggcgcgtgctggagcaggtctcgattgctgaaaacgcggttgagcgcctgcgagccacacccgccggcaccctgcgcgtgacagcgcccacctcgtttggcggctgcgttatcgcgcctctgacggccacgtttttgcagcgttacccggaagtgcgcatcgaactggatctcaccaaccgaatggttgatctggtcgaggaaggggtcgatctggccattcgtatcggtgagatccgtaatgaggacctggtggcgaaatatctgtgtccctacaacatgacgatctgcgccgcgccggattatctggcgcgtcacggtacgccgcaaacgccagccgatctggtggatcacctgtgcctgtcgcacacggtatggacggcgcgtaacgagtggcggctgccgggtgtggaaggcgaagtgcgctggaagcgtgatgccgtcttacgatgcaatgacggctacggcttacgcatggcggcgcgagccggggcgggacttctgctgcaaccggaagtgctggtggcggaagagctggcgagcggcaggctggttcgggttctggaagcgtttacgcccgcgccgaggccggtgcatttactgtggcgccaggatttgcggccgctgcctaagctaacggaatttattgcccatattctgctaagattgggcacaatataa

SEQ ID NO: 4504 - DNA, 744 bp, Enterobacter cloacae
actcaactgaaggagcaaaacatgaacaaagtgatcttaattaccggtgcctccagcggtattggagaaggtattgccagagagttgggaaaggcaggcgcaaaagttttcctgggggcacgcaggctggagcgcatccacgccctggctgatgaaatccgcagcgcaggaggagaggcagaggctcaggtattagacgttaccagccgccagtctatggccgccttcgttgaggctgcacgggaaaagtggggccgcattgacgttcttattaacaatgcgggcattatgcctctgtctccgctttcggctggcaagcaggatgagtgggaacgcaccattgacgtgaatattaagggggtactgtggggaattggcgcggttctgccgattatggaagcccagaactcggggcagatcattaatattggctcgatcggtgccttgtccgtcgtgcccacggccgcagtttattgtgcgaccaaatttgcggtccgggccatttccgatggtttgcgtcaggaaagttcaaacatccgcgtgacctgcgtcaaccccggagtggtggaaagcgaactggcctcgaccattacgcacgaagaaaccatggcggtgatggatgcgtaccgggctattgctctcaaaccagctgatatcgctcgcgccgtgcgccacatcatcgaggcgcctgagagtgtcgataccaccgaaatcaccatcagacctacggcctccgcaaactaa

SEQ ID NO: 4505 - DNA, 1269 bp, Enterobacter cloacae
attccgggaaggcaccgtcagcgtcatctggttcttaccgctttaggagggcgtatgttgtcacagcacgtcctgatagttgaagactcactggtttatcgtcgcctgcttagccgaatgctgacgcagtgggggtataccgtctacgaggcggagaacggcgttgccgcgcttgagatcctcgaaaaccagccagtcagcctggtgatcagcgactgggatatgccggaaatggatggcctgacgttgtgccgggaggttcgcagccgtcagttcggacattatgtttatttaattttgcttaccgcacgcgaagagccgggcgatctgacggtggggtttgacgccggtgcggatgattttctcaacaagccggtcgagcagagtgagctgcgggcgcgattgcacgcgggggcacgggttctgtcccttgaggccacgcttgctacgcgtaatgcacgtctcagtgaggcgttaaggcagatagagcaagaccttgaagtggcggcgcggatccagcagtcggttctgcctgcgcatcagttgcgttaccgggattactttgcagactggatttttttgccgtcagcctgggtgtccggcgatattttcaatgtcttcccgctggacaatcacctgggattctactgtgtagatgtgtcggggcacggcgttggtgcggcgatgatgtcacttgccgtggcccgtcagtttctgcatggcagggcggtagagcgttttctgtttgcggacgatagcgacgttgcctcccctgcggaagtcgttcggatcctgaatggtcgcttttgcagcgaagaggttgagataatgagttatttcaccatgatttacggtgttatcgacctgacaacaggtgaaggcaagctttgccaggccgggcatcctacgccgttcattgtgaaccctggcggcgaggtcaggacggtaggtgaaggcggcgcgccggtaggattgatgccggatctcagctggtcagacgtaagcttctcgctggcgccgggtgagcgcctctgcctgtttagtgatggcatcaccgagtgtgaaaatcctgacaacgaacagtttggtcaggctcgtttgcagcgtcggcttcaggatgacgccacgctcgcactggaacggctcttaccgcagtttgcgcagcatcttatacgctggcgcagcggaaaataccgtgaacagcaggccatggcggacgatgtttccttattagtaattgagcgtacaggagtaaacgatgaacattga

SEQ ID NO: 4506 - DNA, 1209 bp, Enterobacter cloacae
tctcgatcttgttgtgagaattttaattttttgtgttgcatacgcatgcaaaggtggtgtaagtataaaaaacacccacttgctgaggcgtttgaagcacgcgcaaatgggcaggacgttgataaggaatcaggggtaatgaaacgtaagacttttgcagcagtcacatcccaacaggtcgctcagctggcgggggtatcgcaatctgcggtgtcgcgaacgttcacgccgggggccagcatttcgccggcaacgcgtgaaaaagtgctgaaggcagcgcgcgagctgggttatcgcccgaatgcgattgcccgttcgctcaacacggctcgttcgcgcattatcggtgtcgtcatttcttactttgataaccccttttactcgcaggtgctggaggcgctggcgcaaaagctggatacgctgaactatcacctgctgctgttcgttggcgaccgggagggcaacgttgaccgtatttttgaccagattatgcagtaccgggtggatggtattgtgctggcctcggtgacgctgtcgctggagttatctgaagaatgccttgccgccgggatcccggtagtgctgtttaaccgcagcgaagagagtggcatggcctccagcgtcaacagtaataacgaagcggccgcgcggcagattgccgagtttctgctggcgggggagcacaagcgttttgcctacgtgggcggcgtggccgattccccggtcaatattgcccgccagcgcgggttcatctccacgctggaagaacatggcatcaccgatgtgcgggtggtgcacgggaattacgacgctcagcaaaccacccgggcagcctataccctgttttcgacgtcgccagcgccggatgcggtctttgtcgccaacgatcatatggccgtcacggtaatggatgtggcgcgctatgagtttggtttgcgcattccggaggaggtctccgttgtcgggtatgacgacattggcccttccggctggccctcttatgcgttgacctcggcgtcgcagccggtgggcgcgatggtggatgccacggtggaactgttaatgaaacaaattgacagcggaaccatagagcctgaacagattacggtgcccggtacgctggtgatacgccactcggcgcgtcgcccacgcagcggcgttatcgaaaccaatggtttaacgctattccagtctaaggagcgcacatga

SEQ ID NO: 4507 - DNA, 984 bp, Enterobacter cloacae
acagtcagatgctcaggccgagatccgccgtcttcagaaagagttgaagcgggttacggacgaacgggacatattaaaaaaagccgcggcgtacttcgcaaagctgtccgactgaggtacgcctttatccgcgacaacagccgttgctggcctgttcgtttgctctgtcgggttctggatgtccatccgagtggattttatttctggcttcagcagccacattcgcagcgtcaccagacagatcagatgctgaccgggcaaatcaaacagttctggcttgagtctggctgcgtctatggttatcgcaagatccatctcgatctgcgtgataccggacagcagtgcggagtgaaccgggtctggcggctgatgaagcgtgccggaataaaagctcaggttgggtaccgtagcccacgagcacgtaaaggcgaagccagtatcgtgacacccaacaggctccagcggcagttcaatccggactcaccggatgagcgttgggtgacggacataacctacatccgaacccacgaaggctggctgtatctggccgtggtggttgacctgttctcccgaaaagttatcggctggtcaatgcaaccccgcatgacaaaagagattgtcctgaacgcattacttatggcggtgtggaggcgtaatcctcaaaagcaggtactggttcactctgatcagggtagtcagtacacgagccatgagtggcagtcgttcctgaaatcacacggtctggaaggcagcatgagtcgtcgcggtaactgccacgacaacgcggttgcggaaagctttttccagctactgaaacgcgaacggattaagaaaaggatctacggaacgagagacgaagccagaagcgatatttttgattatatcgaaatgttttataacagtaagcgtcggcatggttcgagcgagcagatgccaccggctgaatatgaaaacctatattatcaacggctcagaagtgtctag

SEQ ID NO: 4508 - DNA, 372 bp, Enterobacter cloacae
tcgaactggcgtttggccgaatctttaaagagctggcctcgaatatggttcaggcgttcaccacgcgcgccaaagaggtttacagtgtcgcataagattgctgttgaggtggtgtatgcgctgccggagaagcagtatttgcagcgcgtgacgcttgaagagggcgccaccgttgaggcggctatccgggcctccggcatccttgaacttcgccgtgatattgacctggcgaagaataaagtcggcatttatagccgtccggttaagctcggtgatgtgctgaaagagggcgacagggttgaaatctatcgtcctctgattgccgacccgaaagagttgcgccgtcagcgagcagagaaatccggtaagtag

SEQ ID NO: 4509 - DNA, 2427 bp, Enterobacter cloacae
agacacaataatccccgctcatccggctggttaggcccgtggtgcctgctggtgggtgtgatacttcttgtaacggggctcttttttgctatcggtggttttaaactggtttccgtgggggggagttggtattttctcatcgccggggttatcactctgctctctgcgattcagttcttccgccgcaagtcctctgccgtggggctgtttgccctggtgtttcttggcaccctgatttgggcatttttcgatgccgggctcgacttctggccgctggtttcccgtttaatggtacccgccgggctgatggtgctggcagctgccacctggcctgcattgcgtaaacgtgaaggaaaaccgtcctgcgcaaaaggggctctgggggtctgcgcggtccttattatcgccatgggcgtcacctttgttcagatgtttcaaccccatccgaccgtgccgtttagcggtgaaaaacgtccgctggtaccggtaaaagatgatgcgaaacagcagaactgggatcactacggtaatacggccggcggtagtcgctttgtggcgctggaccagataacccgtgacaacgtgaaaaacctgaaaccggtctggacctaccataccggtgacgtaccggaaagtccggacggcaatggcgcagaagatcagcaaacgccgctacaggttggcgatcgtgtcttcctctgtacgccgcataacaacgtgatcgccgtggatgccgatagtgggaaagagatctggaaagcggaaatcaacgccaaatctgcaatctggatgcgctgccgtggcctggcatactttgatgccaccaaaccgctggcacagccaacggtagcgggctccacgccggttctgccagcgcaggtcgcaccgggcgctgcatgccagcgccgtatcctgatgaatactattgacggtaagctgatcgcgttagacgccgataacggcaaattctgcccggacttcggtactaacggcagcgttaacctgcatgaagggatgggcgacgcgtcagatcccacctacgtgctgacgtcggccccgacgctggcgggtacgacggttgtcgttggtggccgcgttgcggataacgtcagcaccgatatgccgggaggcgttatacgtggttatgacgtgatcaccggccagctgcgctgggcgttcgacccgcgtaatccggatccgaactatgttctgaagccgggcgaacattacaaacgtagctctgcaaactcctgggcccctatgtcctgggatgcgtcgatgaataccgtgtttatcccgatggggagttcctccgtcgacctgtggggcgctgaccgtattccggaagatcataaatacgccacctcaatcctcgcgctggatgcgactaccgggaaagagaagtgggtataccagaccgtgcataacgacctctgggatttcgatatcccgatgcagccgagcctggttgatttcccgacaaaagagggcaacaagcccgcggtggtggtgggcaccaaagcggggcaaatttatgttcttgatcgcctgacgggtaaaccgctcactgaagtgaaagaggttccggtaaaaccagcggatattccacgtgaacagtacccggcaacgcagccgcgctctgtggggatgccgcagattggcgcggaaaccctgaaagaatcggatatgtggggggcgacgccgtttgaccagctggcctgtcgtatcagcttcaaatcaatgcgttatgacggtctgtacacgatgccgggaaccgatatttccctgagcttcccgggctcgctggggggaatgaactggggtagtctgtccacggatccgaacaaccagtacatcttcgtcaacgacatgcgtctgggtctgtgggtccagctgattaaacaagatccgcaaagcgcagtggcaaacacgggcggtgaagccgtgaacgccggtatgggcgctgttccgatgaaaggaacgccgtattcggtcaacaaaaaccgtttcatgtcaccgctgggtattccgtgccagaaaccaccgtttggctctctctctgcgattgacctgaaaacacagaaaatcgtctggcaggtgccggtcggtaccgttcaggataccggtccgtttggggtaaaaatgcgtatgcagatgcctgtcggtatgccgacgctgggcggtacgctggccacgcagggcggtctggtcttcattgcgggaacccaggattactacctgcgcgcctttgattcctctacgggggaagaagtgtggaaagcgcgtctcccggtgggtagccagggcggacctatcagctatgtatcaccgaaaaccggcaaacagtacattctgatctctgccggcggtgcacgccagtcgccggatcgtggtgactacgtgattgcctacgcgctggataaataa

SEQ ID NO: 4510 - DNA, 378 bp, Enterobacter cloacae
ttaaatcgggtacacgcaaaccggcaaaacagcagaaggagcagacccatgcagcagtttgaatggatccacgcggcctggctggctttcgccatcgttctggaaattattgcgaacgtctttctgaagttctccgacggttttcgtcgcaaagcctacggcctgttatcgattgccgcggttctgggggcgtttagcgccctgtcgcaggcggtgaaaggcatcgatctgtccgtggcctatgcgctgtggggcggcttcggtattgccgccaccctggcggcaggctggattatgttcgggcagcgtttaaacaataaaggctggatagggctggtattactgctcgccggcatgatcatgattaaactggcctga

SEQ ID NO: 4511 - DNA, 918 bp, Enterobacter cloacae
tactttaaaaatatgaatattgagctgcgccatctgcgctattttgtcgccgtcgccgaagagctgcattttggtcgtgcggcggcaaggctgaatatctctcagccaccgctaagccagcagatccagatcctggagcagcaggtcggggcgcgtctgctggcgcgaaccaaccgcagcgtgagcctgacggcggcgggaaaacagtttctcgccgatagccggcagatcctgagtatggtggaggacgccgccgccagagcggaacggctttatcttggggaaacgggggagctgcgcatcgggtttacctcatcggccccctttatcagcgctgtttcacaaacgctatcctcgtttcgccgtaactttccggatgtgcatattcagacgcgcgaaataaatacccgggagcagatatcgccgcttaacgaaggatcgctcgacctggggctgatgcgtaacacgcagttgcctgataccctggcgtggcaggtgatcctccgcgaaccgctgatggcgatgatcccccgggatcatccgctcgccgcgcagcacagcgtcacgctggctgaactggcgaaagagccgtttgtcttttttgacccacaggtgggtaccgggttgtatgacgatattcttggtctgatgcggcgatatggccttgtcccgactatcgcgcaggaggtgggggaagccatgacgatcattggtctcgttgccgcagggcttggcgtatcgattctcccggcctcatttaaacgggtacaactggcggaaatgcgctgggtgaagatagccgagcaggatgcagtctcagagatgtggctggtgtggtctaaacatcatgaacagagccatgcggcacagcgtttcaaagaacaattaattaccgcttctcgcgggcattatttatag

SEQ ID NO: 4512 - DNA, 687 bp, Enterobacter cloacae
ggctctgaaatgacaaaaataacgccagaatatacggtagttgacttatcacgttgggcaagaaaggaacactttgaagtatttcagggctttgctcaatctacatttaaccaaacggttcagctggacattaccgtgctgctaaagcatatcaaagaggttggctggaaattttatcctgcgattatttcccttatttctcacgtcgtaaaccggcatccggaattccgtatggccatgaaggatgatgagcttgtaatatggaatgaggttcatccaagctatacccttttccataaagaaacggagacattttcatcgttatggagtcattacgatggaaatattcaccattttcagcgcgtttatgcagaagatgttgcccgctatggcaatatccttgcttactggcctaaggaagagtcccgggagaatatatttttcatatctgatattccgtgggtcagttttagcagttttaacgtcaacgtcgctaacatgcggaatttttttgcgcccatgttcacgtttggaaaatactataaccaggatgaaaaagtcttgttgcctttcgccgttcaggtccatcattctgtttgtgatggcttccatgtagccaggatgatcaacgagttgcaagagttatgtgataatttaccacaccattcagaggcgccgaacgtgtga

SEQ ID NO: 4513 - DNA, 723 bp, Enterobacter cloacae
acggtaaatgatgtgaacaaatacgcagcgataacgctactggcaacggtactggtgggatgcgacaacaacaccgcgccgctgtcatttacgccagagatggcgagcttttcgaacgagtttgactttgatcctctgcgcgggccggtgaaggattttacccagacgctattcaacgataagggtgaagtctctaaacgtgtgaccggcacgatgtcaacggaagggtgtttcgatacgcttgaactgcacgatctcgaagcgaatacgggcgttgcgctggtgctggatgctaactactacgtcgatgcggaaacccagcagcagaaggtaaagttgcaggggaaatgccagctggcggaactgccgtctgccggcctgacgtgggacaccgacgataacgggtttgtggttgcagcgcacagtaaagagatggaagtgaagtaccagtatgacgccgacggctacccgctgggtaaaactacggtttccggcgaccagcgtttatcggtcaagtcggtgccttcgaaagatctgcgcaagcgcatggattatacggcggtaagcctgttgaacgataaaccgatgggcaatgtaaagcagagctgtgattacgatcgccacaacaacccggtgaactgtgagctgctgataacagatgacagcgtcaaacctgccgttgagcgcaagtacaccatcaaaaacagcattgaatattattga

SEQ ID NO: 4514 - DNA, 1116 bp, Enterobacter cloacae
gaagctggcagcgaaatacccgtacgatccggcttatctgccggtggcccgtctggaagacggcactctctggaactggtaaacgaggagcgaatgatgaaaagcgtagtgatccaacagccgaatgcgctggagattgaggagcgtcctctcccgttgccgggggcaggcgacgtccgcgtcaaaattaagctcgccggtatctgcggttcagacagccatatctatcgcgggcataacccgtttgcaaaatatccgcgggtaatcggtcacgaattctttggcgaaatagacgcggttggcgaaggcgtggagggcacccgactcggccagcgcgtttcggtggatccggtgatcagctgcgggcactgttacccctgttccgtcggaaaaccgaacgtttgcacctcgctggtggtgctgggcgtccatcgcgacggtggtttcagcgaatacgccgtcgtgccggcgaaaaatgcctggcacattccggatgcgatccctgacaaacacgcggtgatggttgagccattcaccattgccgccaacgtgacggggcaggcgaaacccaccgaacaggacgtggcgctgatctacggcgcaggcccgatggggctggtcaccgtgcaggcgctgaagggcgtttacaaggtgaagcaggtcatcgtggtagaccgcattgatgagcggctggagatggcgcaacgcagcggcgcagactgggtcttcaacaacggcgagcagtcgttacagactgcgctggatgaaaaaggcatcaagccgacattaatcatcgatgctgcctgtcatccgtccattttgcaggaagcgattacgctggcgtctccggcggcgcgcatcgtgctgatgggattttccagcgacccgagccagatcgtgcagcaggggatcaccggcaaagagctgtcgatcttctcttcgcgcctgaatgccaacaaattcccggtggtcattgactggctggaaaaagggctgatcgaccctgaaaaactggtcacccatacatttgactatcaccacgttacagacgccatcgaactgtttgaaaaagaccagcggcagtgctgcaaagtcttgctcacgttcgaccaataa

SEQ ID NO: 4515 - DNA, 2037 bp, Enterobacter cloacae
acgatgtcggtcaacaatcctttttttgaaattagcctgttgccttatcaggcgccacgttttgatgcgatcaacgacagccattatcgcccggcgtttgatgaagcaatgcgcctgaagcgtgcagacattgacgcgattatcgcgcagcgcgccgcgccggacttcgataacaccgtgctggcgcttgaaaaaagcggggccatgctgtcgcgcgtgagcagcgtattcttcgccatgacgtccgcacacactaacgatgatcttcaggcgctggacgagcagttctccaccgaactggccgggctggcgaacgatatctggctaaacgatacgcttttcgcccgcgtggaagccgtctggcaggatcgcgaggcgctggatgccgaatcccgccgactgacggaggagacgtatcagcactttgttcttgcgggcgcgcgtctgaacgccgatgaaaaagccgagctgaaatctctgaataccgaagccgccaccctgaccagccagttcaaccagcgcctgctcgcggcgaataaggcgggagggctggtggtggacgatgttcgccagcttgacgggctcagtgcggaggagatggctgccgcggctcacgctgccgcagaaaaagggctgaaggaacgctggctgatcccgcttttgaataccacgcaacagcccgcgctggcggcgctggcgttgcgcgagacccgtaaaaagttgttcagcgcgggctgggaacgcactcagaaaggcgacgaaaacgatacgcgcgagctgatccgtcggcttaccgcgttacgggcaagacaggcgcagctgctcggctttgacaactatgcgagctggagcattgccgatcaaatggcgaaaacgccggaagccgcgctcgaattcatgcgcggaatagtgcctgcggcgcgcggcagggctgcgctggagcaggcggatattcagaaagtcatcgacgacgagcagggcggttttacggtgcaggcctgggactgggcgttttatgccgaacgcgtgcgctcagcgaaatacgcgctggatgagtcgcagatcaaaccctatttcgcgctcaataccgtgcttgaagatggcgtattctggaccgccacgcagctgttcggtatccgttttgtcgagcgtttcgatattccggtttatcacccggatgttcgcgtgtgggagattttcgaccatacgggtgaaggcatggcgctgttctatggcgactttttcgcgcgtgattccaaagcgggcggtgcgtggatggggaattttgttgagcagtcttacgagtttgctgcgcgtccggtgatttataacgtctgcaactatcaaaaaccggcgaacgggcaaaccgcgctgatctcctgggatgatgtgattaccctgttccacgagtttggccataccctgcatggtctgtttgccagccagcgctatgccacgctttcaggcaccaacacgccgcgtgatttcgttgaatttccgtcgcagatcaatgaacactgggccagccatccgcaggtgtttgcgcactttgctcgtcattatcaaaccggcgaaccgatgccggatgcgctgcgggaaaaaatgctcaatgcgacccagtttaacaagggttatgacatgacggagctattgagcgccgcgctgctggatatgaactggcacggcattcaggagcccgttgaagacgtggaagcctttgaagccgccgcgttgaaaaaagaggggttggatcttccagccgtaccgccgcgctatcgcagcagctatttcgcccatatcttcggcggcgggtacgcggcggggtattacgcttacctgtggacgcaaatgctggcggacgatggctatcagtggtttgtcgagcagggtggtttgacccgcgaaaacggacagacattccgcgaggcgattttgtcccgcggcaacagcactgatctagctgaactttaccggaactggcgcgggcacgatccgaagatcgaaccgatgctggagaatcgcggattgagtgcgtaa

SEQ ID NO: 4516 - DNA, 825 bp, Enterobacter cloacae
atcggtcataaggagacgggtgtgcgcaacgtaaagattgaagaggtcgagcagctagatcgtgaagtggtagcgataggcaatgactatgtgcagggatttatgctgccacagcacaaacatcgccgcgcgcagctgctatatggcgcgaccggattaatgcatgtcataacccaggatggagagtggattgttcctccacaacatgctgtttggatcccacccgaaactatgcacgccgtcaaatttgttggcgtgaccactcgcagtctgtatatagaaccagatttcgtgaatgccttcttaaaatatcctcgttgtgaagttattagcgtatcgccattattacgtcagctattgcttgagtcagtggatttaccgccactgtatgaaagcacgcgtgaccgtgcactgataaatctgatgatattggagctggcggctatgccggttcgcgaattcgatattccgctgccgcgacatccggccctactggctctttgtcaggcgtttttactcaatccctcaatccatgatccagcagagcgctgggcaaatgcgctgttcatgagcgacagcacctttcgtcgccatttccttaagcaaatgggcatgtcattttctgtctggcgccaacgagcatgcgtggttagcgcgctggcattgttgataacgggaaaacccgtaaatgaagtagccttgactcttggatacgataatgcatcatccttcgcaacgatgttccgccgtgtcacaggacagccaccttcgtattatcacccggcattattcaaaaagttccacgggacagggcaccgatcatag

SEQ ID NO: 4517 - DNA, 495 bp, Enterobacter cloacae
ataatgataaataaaatactggtcagtgcctgcctgatgggccttaaagtccgttataacgggaaagagaaagcgcagatgactcatcaacttgctcgctggcaacaggagcagcgcctggtgatccactgccctgagttggctgcggggctacctgttccgagaccacccgctgagattatgtctgctgagggtaaagacgtaatgcgtggacaagccagaataattgaaaacaccggaacagatgttaccgggcattatcaacttgcagcctggctggctctgcgagcagcacaagaagcaggatgtactgctgctttgttaactgatggtagtccaacgtgcggaactcagtttatctacaacggttctttcagtaatcagcgtaaatcgggtatgggagtggcagcatcattactctccgagcatggtattgcggtattttcagaaactcagtttgcggagcttgtgaactggattgaagaaagggaatga

SEQ ID NO: 4518 - DNA, 309 bp, Enterobacter cloacae
atatatagattcatcaacaggaggaatgatatgaaaaaagcactattagggagtgtattggctttaacagtagcaagcttcggcgcatctgcggcagatatgatttccaaggatgaagcgcaccacttcaaacttgaataccttggtaatgtatctgtaggggcttcaggtggacaaatttcttcaccttcagatcttcatcaaaaactctcaaaactggcagacgagaagggcgggaaatactacgtcattatcgctgcccgcgagcatggccctaacttccaggccgtcgcagaagtctttaaataa

SEQ ID NO: 4519 - DNA, 1590 bp, Enterobacter cloacae
caaagcgaatgtcacacagacaaaagcaggaatgcgattcccctcttagactgcatacacaccctgcgaagcataacgaaggagtatcctatgtccgaatcacacgtcgccatcctgccaggcgtgcagcagtttttagatcgccagcacggcctgtggattgaagggcgtcaggcggcatccgacagcgaaaagcgcctgaacgtctacaacccggcgaccggagaggttattgcctccaccgccgatgccagcgtcgatgatgtcgatcgtgcggtgatgtctggctggcgcgcctttgtcgcccgaagctgggcagggcgtctgccggcagagcgggaacgcatcctgctgcggtttgccgatttggtggaacagcatggcgaagagctggcacagctcgaaaccctggagcaggggaaatccattaacatctcccgcgccttcgaggtgggatgcaccctgaactggatgcgctacacggcagggttgaccaccaaaattgccggtaaaaccctcgatctctcgattccactgccgcagggcgcgcgttatcaggcgtggacgcgtaaagagccggtgggagtcgtggcggggattgtgccgtggaacttcccgctgatgattggcatgtggaaagtaatgcccgcgctggcggcaggttgctccatcgtgatcaaaccctcggaaaccacgccgctcaccctgttacgggtggcggaactggcgagcgaggcggggatcccggatggcgtgttcaacgtggtgaccggtagtggcgccgtctgtggcgcggcgctaacctcgcacccgcgcattgccaaagtaagctttaccggttcgacggcgacgggcaagcagattgcccgcgtggctgcggatacgctaacgggcgtgacgctggagctgggcggcaaaaacccggccatcgtgctgaaagacgccgatccggcgtgggtaattgaagggctgatgaccggcagcttcctgaatcaggggcaggtctgcgcggccagctcgcgtatttatattgaggctccgctgttcgacacgctggtcagcggctttgaacaggccgtgaaatctctgagcgtcgggccgggcatgtcgccggatgcgtttatcaacccgctggtgtcgcgcgcccattgcgataaggttcaggcgttcctggatgaggcgaaggcgcacaatgcggagctgatcgccgggaaccggggaccagacggcaaaggctattacgtttcgccaacgctggtggtcaacccggataatcatctgcgactgacgcgtgaagaagtcttcgggccggtggtgaacctggttcgtgtggacgacggggaagaggcgcttcagctggcgaacgacactgaatatggcttaacggccagcgtctggacgcagaacatcagtaaagcgctggcgtacaccgacaggttacaggccggaaccgtgtgggtgaacagccacacgctgatagacgccaacctgccgttcggcggcatgaagcagtctggcaccgggcgcgatttcggccccgactggctggatggctggtgtgaaaccaagtcggtgtgtgtgcggtattaa

SEQ ID NO: 4520 - DNA, 999 bp, Enterobacter cloacae
cttttaagaaaccaaatgattcaccattttgctatttgtggtgatttaacgaatcacaaaggtggttatgtgacgcaagaacaacgctttgagcaacgcatcgcacaggagacggccatcgagccgcaggactggatgccggatgcctaccgcaagacgctgatccgccagattggacagcacgcccactctgagattgtcggcatgctgccggaagggaactggatcacccgcgcaccgacgctgcgccggaaagccattctgctggcgaaggtgcaggatgaagccggacatggcctgtacctttacagcgcggcggaaacgctgggctgcgcccgggaggacatctatcaaaagatgctcgacggcaagatgaaatactcctccatcttcaactatccaaccctgagctgggccgatatcggggtcattggctggctggtggacggggcggccattgtgaaccaggtggcgctgtgccgtacgtcttacggcccgtatgcccgggcgatggtgaagatttgtaaagaagagagctttcaccagcgtcagggttttgaggcctgcatggcgctggcgcagggtagcgaagcccagcggcagatgttgcaggacgccatcaaccgcttctggtggcccgcgctgatgatgttcggacccaacgacgacaactccccaaacagcgcccgcagtctggcctggaagatcaaacgctttggcaacgatgagcttcgccagcgcttcgtggacaacacggtgcctcaggtggagatgctcggcatgaccgtgccggatcccgacctgcgtttcgatgaagagagcggtcactaccgcttcggcgaaatcgactggcaggaatttgacgaggtgatcaacgggcgcgggatctgcaaccacgaacgtctggccgcaaaacgtaaagcctgggacgacggcgcatgggtgcgtgaagccgctctggcccacgcggaaaaacaacgcgcccgccaggccgcataa

SEQ ID NO: 4521 - DNA, 300 bp, Enterobacter cloacae
gaggaatcaaccatgagcaacgtttactggccgttatacgaagtttttgtccgttcgaagcaggggctgtcgcaccggcatgtgggcagccttcacgctgccgacgaccgcatggcgctggaaaacgcgcgcgatgcctatacccgccgcagcgaaggctgttctatctgggtggtgaaggcgagtgaaatcgtcgcttcccagccggaagagagcggggagtttttcgatccggcggaaagcaaggtctaccgccatccgacgttttacaccatccctgatggtatcgagcatatgtga

SEQ ID NO: 4522 - DNA, 798 bp, Enterobacter cloacae
aggacgctaattgtggaatctattctgagccatgttgagcagggcgtaatgaccattacgctgaaccgcccggagcgcctgaacagctttaacgacgtcatgcaccagcagctttccgaatgcctgaagcaggccgagcgcgatgacgccatccgctgcctgctgatcatcggggcaggacgcggtttctgcgccgggcaggatctcaacgaccgtaacgtcgacccgaacggcccggcgcccgatctgggcatgtccgttgagactttttacaacccgctggtgcgccgcctggcaaaactgccgaagccggtgatttgcgcggttaacggcgtggcggcgggcgcgggggcgacgctggccctcggctgcgacatggtgattgcggcgcgctccgccagttttgtgatggccttcagcaagctcggcctcgtcccggactgcggcggcacctggctgctgccgcgcgtggccggacgcgcccgcgccatggggttggcattgctgggcgataagctcagcgctgagcaggcacaggcctggggaatgatctggcaggtggtggacgacgagcagctctccgccaccgtacagcagatggcgctgcattttgcctcgcagccgacctttggcctgggcttgatcaagcaggcgatcaacgccgccgaaaccaacaccctcgacgcccagcttgatctggagcgcgactatcaacgcctggccggacgcagcgacgactaccgggaaggcgtcagcgcgttcctggcaaaacgcgcgccgaactttacggggaaataa

SEQ ID NO: 4523 - DNA, 1332 bp, Enterobacter cloacae
tgtgagtaccctgcgatgataaatacaacaaagcttgatccgatcgaaaccgcgtccattgatgaattgcaggcgttgcagaccgcgcgcctgaagtggacgctgaaccacgcctacaacaacgttccgatgtacaaacgcaagtttgacgccgcgggcgttcaccctgacgattttaacgagctggcggacctgcaaaaattcccgtgcaccaccaagcaggatctgcgcgacaactacccgttcgatacctttgcggtgccgatggagcaggtggtgcgcatccacgcctcgtcgggcaccaccggaaagccgaccgtggtgggatatacccagaatgatatcgacaactgggccaatatcgtcgcccgttccctgcgcgccgccgggggcagcgcgaaggataaaattcacgtggcctacggctacgggctattcaccggcgggctgggggcgcactacggtgccgagcgtctgggtgcaacggtgatcccgatgtccggcggccagacggagaagcaggcgcagctgatccgcgattttcagccggatatgatcatggtgacgccctcatactgcctgaatttaattgaagagctggagcgtcagatgggcggtgacgccagcgcctgttccctgcgcgtcggcgtgtttggcgccgagccgtggacgcaggcgatgcgccgcgaaattgaaaaacggctgggcattaccgcgctggatatctatggtctctccgaagtgatggggccgggcgtggcgatggagtgtcttgaaaccgctgacggcccgaccatctgggaagatcacttctacccggagatcgtcaacccgaatgacggcacgccgctggctgacggcgagcagggcgaactgctgttcaccaccctgaccaaagaggcgctgccggtgatccgctaccgcacccgcgacctcacgcgcctgctgccgggcactgcacgcaccatgcgccggatggatcgcatcagcgggcgcagcgacgacatgctcatcattcgcggcgtgaacgtcttcccgtcacagctggaagaggagatcgttaagttcgaacatctttcgccacactatcagctggaggtgaaccgccgcgggcatcttgattcactttcggtgaaggtcgagctgaaacagagcagcttaacgctgacccatgagcagcgctgtcaggtctgccatcagctgcgtcatcggattaaatcgatggtggggatctcgaccgacgtgatgatcgttaactgtggcagcataccgcgctccgagggtaaagcttgccgggtgtttgatttgcgtaaagtggcagccaacggttga

SEQ ID NO: 4524 - DNA, 963 bp, Enterobacter cloacae
ttcatccaggaaaaaaataacaacagaatgaatcacatgaataaacttgatgcctttatccagcatgcagtcagctctgttcccgtcagcggaacgtcgcttatatcctcactgtatggcgacgcgcttgcgcaccgcggcggagagatctggctcggcagcctggcggccctgctggaagggatgggatttggcgagcgctttgtgcgcaccgcgctgtttcgcctcaacaaagagggctggctggatgtgtcccgcattggccgccgcagcttttaccgtctcagcgacaaggggctgcgtttgacacgccgcgcggaaaataaaatctaccgtgcggaactgccggcgtgggatggcaaatggctgctgctgctctccgaggggctggataaaaccaccctcgcggacgtgaaaaaacagctcatctggcaagggttcggcacgcttgcaccgagcctgatggcctcgccgtcgcagaacctggcggacgtgcagtctctgctgcatgacgcgggcgtggcggaaaacgtcatcttctttgaagcccattcgccgctggccttgtcacgcgcggcgctacgatcccgcgtggaagagtgctggcagctgaccgaacaaaacgcgatgtacgaaacgtttatcaactcgttccgtccgctgttgccgctgctgaaagaaacgccgcctgaggatttgaccccggaacgctgcttccagatccagctgttactcattcatttttatcgtcgcgtggtgctgaaagatccgctgttgccggaggagttacttcctgcgcactgggcgggacagagcgcgcgacagctgtgcattaatatctaccagcgcgtggcggcgggagccctggcgtttgtcagtgagaagggggaaacctctgtgggcgagctgcccgctcccggcacgctttatcaccagcgttttggtggtctgaatatcacataa

SEQ ID NO: 4525 - DNA, 615 bp, Enterobacter cloacae
ggagagggtatgcctgtttatcaaattgatggtctgacgccggtcgtgcctgaagagagctatgttcacccgaccgcggtgctgattggcgacgtgatcctcggcaaaggcgtttacgtggggcccaacgccagcctgcgcggcgattttggccggatcgtggtgaaagacggcgcgaacatccaggataactgcgtgatgcacggttttccggagcaggacacggtggtggaagaggacgggcatatcggccacagcgcgatcctgcacggctgcattatccgccgtaatgcgctggtggggatgaatgcggtggtgatggacggggcgacgatcggcgaaaacagcatcgtcggggcggcggcgtttgtgaaggccaaagcggaaatgcctgcgaatcacttaattcttggcagtccggcgaaagcgattcgtgagctaagtgcgcaggaaatagagtggaaaaagcagggcacgcgggagtatcaggtgctggtggatcgctgtaagcagacgctgcatcaggtggagccgctgcgggaagaagagcccggccgcaaacggctggtcttcgatgagaatttacggcccaagtcggctggccgggataaataa

SEQ ID NO: 4526 - DNA, 1548 bp, Enterobacter cloacae
agcggcgttaacctggtttgccgacacgctgcgcctcgactgggaaccgaaagggattgccgtcacggtcgtttcacccggttttgtcgacacgccgctgacccgcaaaaacgatttcccgatgccgggccgggtcagcgtgggggacgccgtccacgccattcgtcgcggtctggcaaaagggaaggatcacatcgcgtttcccgccgggttcagcctggcgctgcgcctgctttccggcctgcccgatgtacttcagcgcgcactgctgcgcaggatggtgcgaccatgaaaatcgcaattatcggcagcggcatcgccgggttaacctgtgcctggcggctcgccggacatcatcagatcacggtgtttgaggcgcaggccaccccgggcggccatactgcaacggtagatgtcgacacgccccagagtacctttgccatcgataccggttttatcgtctacaacgaccgcacctatccgcgcttcatggggctgctcagcgaactgggcatcagcgggcaaaaaacgcagatgagtttttcggtacataacccgcagagcgggctggagtacaacggccacacgctgacgtcgctgttcgcccagcgtcgtaatctgctgaaccctgccttctggacgctactgaaggagatcgtgcgctttaaccggctggcgaaacagacgctccggggcgaagtcgatggatccgccacgctggaaacgttcctgcgccagcaccgctttacgcccttttttgcgcgccactacatcctgccaatgggagcggctatctggtcgtcgtcgctacaggagatgaaacgctttccgctgccgctctttttacgcttttttgaaaaccacggtctgctggacattacccatcgtccgcagtggtacgtcgtgccaggcggctcccgggagtatatccgcgcgatgatggacaagcttggcgatcgcctgacgctgcacctcaacgcgccggttcagaaggttgttcgccacgatcgtggcgtcgatattgagcgggaaggcgtcactcataccttcgatcaggtgatcttcgcctgtcactctgctcaggcgctggcgatgctcgccagcccaacgcaggctgaacgtgaggtgctgggtgatatcggctggcagcgtaacgaggtggtgcttcacagcgatccgcgctggctgccggtgcgcaagcgcgcgtgggcgagctggaactaccgcctcagcgagcaggatcgggccagcgcctgcgtcacctacaacatgaatatcttgcagggactgccgccgggtagcccgctgttttgcgtcaccctcaacccggaaacgccggtggaagaacgctatgtgctgcgccgctttgtctatgagcatccgctttttaacccgcaaagctggcaagcccaggcccgacgcggagaaataaacggtcgccagcggagctggttctgcggcgcgtactggtacaacggcttccacgaagatggcgtacgcagtgcgctggacgtggtaaacgctatcgcggccggggagggcaactga

SEQ ID NO: 4527 - DNA, 1227 bp, Enterobacter cloacae
acgctcatgaccgatcccgtctttgcgcttgaacccgatatcccgcgcaacgtccgcgtcgcgcgatggttgctcttccgcctgctgaacggtctgcgcggtggctcgctgacgctgcgtgaaggcgcgcagacgttccagttcggcgacgcctccgccgcgcttcatgctgaggtgcaggtacttgctccgggcgtctactggcgcattttaaccgggggcagcctcgccgcggcacaagcgtggatggatggcgactgggagacgccccacctgacgccgctgctggagctgattgcacgtaatagccaaatcctcgggcaactggaaaaagggtttcgcctgctcgggaaaccggtggagcggctacggcactggatgcggcgcaactcccgcgctcaggcgcgtgaaaatattgccgcccattacgatctgggcaacgccttctacgcccatttccttgatgaagacctgctgtactccagcgcgctgtttaacggggacgagcaggatttgaacgcggctcagcaggcgaaaatggccaggctgtgcgaccagctggcgctcacggcaaacgatcatctgctggagattggcaccggctggggggcgatggcggaatacgccgcccgtcactacggctgtcgggtgaccaccaccacgctgtcgcaggagcagtaccactgggccaccgcgcggatcgtccgggcagggttgcaggatcgcgttgaggtgctgctttgcgactaccgcgatctgaccggggtttacgacaaactggtctcggttgagatgatcgaagccgtcggccaacgctacctgccaacgtttttccgtacctgtcaggcgcgtctgcgtccaggcgggcggatggcgattcaggccatcaccattcaggatcagcgctatcgcgactacagcaaaagcgtcgattttattcagcgctacatcttccccggcggctttttgcccagcatcaccgccatgaatgaactgatgacccgccataccgattttgtggtgcgtaatctcttcgatatggggccggactacgcccgcacgttggcgcactggcgtcagcgtttcgttcacgcctggcaggagattgaaaagctcgggtttgatgaccgtttccggcggatgtggctgtactacctcggctactgtgaagccgggtttaatgcccgcaccatcagcgtggtgcagctgactgcggaacgcgtatga

SEQ ID NO: 4528 - DNA, 3942 bp, Enterobacter cloacae
aaagagattttatccggcagtgcactgcccgttaacgctatgacagaacaccaaaaattgaccttcccgatgctgatgcaaaagcttgattcgctgatgctgcgcgataaacagcggtttgcgcgccgtctgcacggcgttaagaaggttaaaaatcctgatgcacaacaggccatttaccaggaaatggccaaagagattgaacaggcggcagggaaagttgtgctgcgtgaagccgcacgcccggagattacctatccggaaaacctgcccgtcagccagaagaaacaggacattcttgaggccgtacgcgaccaccaggtggtgatcgtcgcgggggaaaccggttcaggtaaaaccacccagttgccgaaaatctgcatggagctgggccgcgggttgaaagggctgatcggtcacacccagccgcgtcgtctggcggcgcgcaccgtggcgaaccgtattgcggaagagctgcaaacggagccgggcggctgcatcggctacaaggtgcgattcagcgaccacgtcagcgataacaccatggttaagctgatgacagacggtatcctgctggcggaaatccagcaggatcgtctgctgatgcagtacgacaccatcatcatcgatgaagcgcacgagcgcagcctgaacatcgacttcctgctcggctacctgaaagagctgctgccccggcgtccggatctgaaaatcatcatcacctctgcgaccattgacccggagcgtttctcaaaacatttcaacaatgcgccgatcattgaagtctcaggccgaacctacccggttgaagtgcgctatcgcccgattgtggaagaggcggacgataccgagcgcgaccagcttcaggccatcttcgatgccgtcgacgagctgggcaacgagagttctggcgacattctgatcttcatgagcggcgagcgcgagatccgcgataccgccgatgcgctcagcaaacgcgatctgcgctataccgagatcctgccgctgtacgcgcgcctgtcgaacagtgagcagaaccgcgtgttccagccgcacagcggacgccgcatcgtgctggcgaccaacgtggccgaaacctcgctcaccgtgccgggcattaaatacgtgatcgacccgggtacggcgcgcatcagccgctacagctaccgaaccaaagttcagcgcctgccgattgagccggtttcccaggcgtcggctaatcagcgtaagggccgctgcggccgcgtgtcggaagggatctgtattcgtctttattcggaagacgatttcctgtcgcgcccggagtttaccgatccggaaattctgcggaccaacctggcatccgttatcctgcaaatgaccgcgctggggctgggcgatatcgccgccttcccgtttgtggaagcgccggataaacgcaatattcaggacggggtgcgcctgctggaagagctgggggccatcaccaccgacgagcaggcgacggcctacaagctaacgccattgggccgccagcttagccagttgccggtcgacccgcgtctggcgcgcatggtgctggaggcgcaaaaacacggctgcgtgcgcgaggcgatgatcatcacctcggcgctctccattcaggatccgcgcgagcgcccaatggacaagcagcaggcgtcggatgaaaaacaccgtcgcttccacgataaagagtctgatttcctggcctttgtgaatctgtggaactacctgggcgagcagcaaaaaacgctctcttcaaatcagttccgccgtcagtgccgggtggatttcctcaactacctgcgcgtgcgcgagtggcaggatatctatacccagctgcgccaggtggtaaaagagctgggcattccggtcaacagtgaaccggcggagtaccgcgaaattcatatcgccttgctgaccggcctgctgtcccatatcgggatgaaggatgcggataaacaggaatttaccggcgcacgcaacgcgcgtttctccatcttcccgggctccgggttgtttaaaaagccgccgaagtggaccatggtcgccgagctggtggaaaccagccgtctgtgggggcgtatcgccgcgcgtatcgatccggagtgggttgagccggtggcgcagcacctgctgaaacgctcatacagcgagccgcactgggagcgcgggcagggcgcggtgatggcgacggaaaaagtcaccgtctacggcctgccggtggtggccgcgcgtaaggttaactacagccagatcgatccggcgctgagtcgcgagctgtttatccgccatgcgctggtggaaggcgactggcagacgcgccatgcgttcttccgtgaaaacctgaagctgcgcgccgaggtggaagagcttgagcacaagtcccgccgccgcgacattctggtggacgacgagacgctgtttgagttttacgaccagcgcatcagccacgatgtgatctcggcgcgccatttcgacagctggtggaagaaagccagcaaagagaccccggacctgctcaacttcgaaaagagcatgctgatcaaagagggcgcggagtcggtcagcaagctcgactacccgaacttctggcatcagggcaacctcaagctgcgtctgacctatcagtttgagccaggggccgacgcggacggcgtgaccgttcatattccgctgccgctgttaaaccaggtcgacgagagcgggtttgagtggcaaattcccggcctgcgccgcgagctggtcattgcattaatcaaatccctgcctaaaccggtgcggcgtaactttgtgccggcgccgaactacgccgaagcgtttttgggccgcgtcacgtcgctggagctgccgctgctggacgcgctggagcgtgagttccgacgcatgaccgggaccaccatcgaccgcgacgactggaactgggatcaggtgcccgatcacctgaaaatcaccttccgcgtggtggacgataaaaacaaaaagctgatggaaggccgctcgctttcggaactgaaggacgccctgaagggcaaagtgcaggaaaccctgtctgccgtggcggacgacggtatcgagcagagcgggctgcacatctggagctttggtcagcttccggaaagctatgagcagaagcgcgggaactataaggtcaaagcctggcccgcgctggtggatgagcgcgacagcgtggcgattaagctctttgacaatccgcaggaacaacagcagatgatgtggcgcgggctgcgtcgactgcttctgcttaacatcccgtcgccgattaagtatctgcacgagaagctgccgaacaaagccaagctggggctctactttaacccgtacggtaaggtgctggatctgatcgacgactgcatctcctgcggtgtggataagctgatccacgaggcgggcggtccggtctggacggaagagggctttgctcagcttcatgaaaaggtgcgcgcggagctgaacgacaccgtggtggagattgccaaacaggtcgagcagatccttaccgccgtgttcaatatcaacaagcgcctgaaggggcgggtggatatgaccatggccctggggctgtcggacgtgaaggcgcagatggcggggctggtgtatcggggctttgtgaccggcaacggctttaagcgtctgggcgatacgctgcgttatttgcaggcgattgagaagcgtctggagaaaatggcggtcgatccgcatcgcgatcgcgcgcagatgctgaaagtcgaaaacgtgcagcaggcgtggcagcagtggctcaacaaactgccgccagcgcgtcgcgatgacgacgacgtgcgggagatccgctggatgatcgaggagctgcgcgtcagcttcttcgcccagcagctcggtacgccgtatccgatttcggataagcgtatcttgcagtcgatggagcagatctccggctaa

SEQ ID NO: 4529 - DNA, 1062 bp, Enterobacter cloacae
cgcaatgctttatcaggatactccactatgaaaaagatcggatttttgtcgtttggtcactggacgccgtcaccccagtccggcacgcgaaccgcggctgacacgctgctacagtccatcgatctggtggtcgcagccgaagagctgggcgcggacggggcttatttccgtgtgcaccactttgcccgccagctcagttcgccattccccttgctggcggcaataggcgcgaaaaccaaacgtatcgaaatcgggacgggcgtgatcgacatgcggtatgaaaatccgctgtatatggcggaagatgctggcgcggcagatctcatctccggcgggcgattacagcttggtatcagccggggttccccggagcaggtgattgatggctggcgttattttggttacgtgccgcaggaaggggaaaccgaatctgatatggcgcgccgccacactgaggtactgcttgatgtattacgcggtgaagggtttgcgaagcctaacccacagccgatgttcccaaacccgccgggattgttgcgtctggagccgcattcagaaggcttacgcgatcgtatctggtggggggctggctctaatgcaacggcagtatgggcggcaaaactggggatgaacctgcaaagctcaacgctgaaagatgatgaaaccggcgagccgttccatattcagcaggcaaaacagatccgtgcctaccgacaggcctgggctgaggcagggcatacccgtcagccacgcgtttcggtcagccgcagtatttttgccctgatggacgaacgcgaccggatgtatttcggctcaagccgcaatgagagcgacagcgtgggctatctggatgagaaaacgcgggccattttcggacgcagctatgccgcagagccagacaagctgattgaacagttgaaaaaggatgaagcgatcgcggaagcggatacgctgttgcttaccgtgccgaatcagctgggcgtggaatacaacgcacatgtgatcgagtccatcctgaaacatgtcgcaccggaaatgggatggcgcgatcgcaatgcgtaa

SEQ ID NO: 4530 - DNA, 1290 bp, Enterobacter cloacae
cgtcagccattgaagtgcttcaccatagccctcagtttatttcgaagctcgaaaataagggagtacgaggtggttgctgatagtcagccggggcatatcgatcagatcaagcagaccaacgcgggtgccgtttatcgcctgattgatcagcttggtccggtttcgcgtatcgatctttcgcgcctggcacaactggcacccgccagtattaccaagattgtccgcgaaatgctggaagcccatctggttcaggagacagaaattcaggagccgggcagccgtggccgtccggcggtagggctggtggtggaaacggaagcctggcactacctgtcgctgcggattagccgcggggaaatcttcctcgcgctgcgcgacctcagcagcaagctggtggtggaggaccggctggaactcccgcttaatgcagagcaaccacttctcgatgccattctgacccacatcgaccagttctttattcgtcaccagcagcgtcttgaacgtttaacggcgattgcgatcaccctgccgggaattattgataccgaaaatggcattgttcaccgcatgccgttttatgaaaacgtcaaagagatgccgctgggcgacgtgctggaaaaccacaccggtgtgccggtctacattcagcatgatatcagcgcctggacgatggcggaggcattgtttggtgcctcccggggcgcgcgcgacgtaattcaggtggtgattgatcataacgttggcgcaggtgtgatcaccgacgggcgtctgttgcatgctggcagcagtagcctggtggagatcggccatacgcaggtcgatccgtacggaaaacgctgctactgcggtaaccatggctgtctggagacgattgccagcgtcgaaagcgtgctggagctggcgcaggtgcggctcacccagtcgatgagctccacgctgcacggtcaacccttaagcgtcgaggcactgtgcgctgcggcaaggcagggcgatctgctggcgaaggacattattaccggcgtgggcaataatgtcgggcgcattctggccattatggtgaacctgtttaacccgcaaaaaatactgatcggctccccgctcagtcaggcggcagatatcctctttccggcgatttccgcctgcatcaatcagcaggcgcttcccgcgtacagtaaaaacatcgtggtcgaaagtacgcaattttccaatcagggtacgatggccggcgccgcgctggtaaaagatgcgatgtacaacggctcgttactgattcgtttgctacagggctaa

SEQ ID NO: 4531 - DNA, 699 bp, Enterobacter cloacae
gtcatgcttaagcgtttctttattactggtacggatacgtctgtcgggaagacagtcgtatcccgcgcgttacttcaggccctggcggcaagcggtaaacgcgttgcaggatacaagccggttgcaaaaggcagtaaagagacgccagaagggctgcgcaataaggatgccctggttctgcaaagcgtctcgtctctggaactgccttatgatgccgttaatcctatcgccttaagcgaagaggaaagcagcgtcgctcacagtgggcttatcaactacagcctgctttctgatggcctggcaaatctgagtgaaaaggttgaccacgttgtcgttgaagggaccggcggctggcgcagcctgatgaacgatttacgtcccctttccgaatgggtggtgcaggagcagttgccggtgattatggtcgtgggcattcaggaagggtgcatcaaccatgccttgctgacggcgcaggctatcgctaatgacggcctgccgctgattggttgggtggcgaaccgtgttaacccgggccttgcgcactacgctgaaatcatcgatgtgctgagcaaaaagctgcctggcccgctggtgggcgaactgccttatctgccccgcgccgagcagcgcgaattagcgcactacatcgatctctcggctttcggcggtatgctggccgtaggtcgagtcgtggcgtag

SEQ ID NO: 4532 - DNA, 351 bp, Enterobacter cloacae
atcaatcctcacgaaacgagaaaaatgttcaaaacgacgctgctttttttcgcgaccgcgctgtgcgaaatcatcggatgctttttgccgtggctctggctaaagcggggcgcttccgcgctgctgctgatcccggcgggtgtgtccctggccctttttgtctggctgctcaccctgcatccggccgccagcgggagggtatatgcggcctacggcggagtgtacgtctgtaccgcgctgctgtggctgcgcgttgtcgatggcgtccggctaagcctgtatgactgggcaggcgcgctgattgccctgtgcggcatgttgatcatcgtggccggttggggacgcgcataa

SEQ ID NO: 4533 - DNA, 1254 bp, Enterobacter cloacae
atttcctgcatcacaacgagcgatgtaaggaaatggattatgaagattgtcggggctgaagtttttgtcacctgcccggggcgtaactttgtcacccttaaaattacgactgatgaaggcattgtcggcctgggtgatgccacgcttaacggacgtgaactttccgttgcctcttacctgaaagatcacctgtgccctcagctgattggccgcgatgcgcaccgcatcgaagatatctggcagttcttctataaaggcgcttactggcgtcgtggtccggtcaccatgtcagcgatttctgccgtggatatggcgctatgggacattaaggcgaaagccgcgaacatgccgctctatcagcttctgggcggggcttcccgggaaggggtgatggtttattgtcacaccaccgggcacaccattgacgacgtgctggaagattatgcccgtcataaagagatgggcttcaaggcaattcgcgtgcagtgcggcgtgccgggaatgaaaaccacctacggcatggccaaaggcaaagggctggcgtatgaacctgcgaccaagggcgcctggccggaagagcagctgtggtccaccgagaaatacctcgacttcacgcccaaactgttcgacgcagtgcgcagccagttcggtttcagtgaacatctccttcacgacatgcaccaccgtctgacgcccatcgaagcggcgcggttcggcaaaagtattgaagattaccgcctgttctggatggaagatccgactcccgctgaaaaccaggagtgtttccgcctgatccgccagcacaccgtcacgccaattgcggtgggggaagtgttcaacagcatctgggactgcaagcagctgattgaagagcagctcattgactatatccgcgccaccataacccatgcgggcggcatcaccgggatgcgtcgcattgcggactttgcctcactctaccaggtgcgtaccggctcacacggcccgtcggatctgtcgccgatttgccacgccgcggcgctgcattttgacctgtgggtaccgaactttggtgtgcacgagtatatgggttattcagagcacatgctggaagtgttcccgcacagctggcgcttcgataacggctatatgcacccgggcgacaagccagggctgggcattgagtttgatgagaagctggcagcgaaatacccgtacgatccggcttatctgccggtggcccgtctggaagacggcactctctggaactggtaa

SEQ ID NO: 4534 - DNA, 1437 bp, Enterobacter cloacae
gagcctgcgaagacaggctctaagtggtacgcatcttacctttcagagatagccattatgactcaagcacaacctcaaagaagtacgtcagatttggtgaaagccgccgtatctggctggctgggcaccgccctggaatttatggatttccagctctactcccttggcgccgcgctggtgtttcatgaaattttcttccctgagcaatcggcggccatggcgctgatcctggcgatgggcacctacggcgcaggctacatcgcgcgtatcgtcggggcatttattttcggcagaatgggcgacagaattggccgtaaaaaagtgctgtttatcaccatcaccatgatggggatctgcaccaccttaatcggcgtgctgccgacctacgcgcagatcgggattttcgcaccggtgctgctggtgacgctgcgtattattcaggggcttggcgcgggggcagaaatctccggtgcgggcaccatgctggcggagtacgcgccgaagggtaaacgcggcatcatctcctcgctggtggccatgggcaccaactgcggaacgctgagcgccacggcgatctgggccgtgatgttctttgccctcgatcgtgaagaacttattgcctggggctggcgcgtgccattcctcgccagcgtggtggtgatgatcttcgccatctggctgcgtatgaaccttaaagagagcccggtgtttgagaaggttaacgacgccgaaaccgttgcgccagcggcggcgcaggatacctcattaggcgcgatgtttaagagcaaatcgttctggctggcgacggggctgcgctttggccaggccggtaactctgggcttatccagaccttccttgccgggtatctggtgcagacgctgttatttgataaggcgatcccaaccgatgcgctgatgatcagttcgattctcggcttcctcaccatcccgctgctgggctggctgtccgataaagtggggcgccgtctgccgtatattctccttaacatttcagccattattctggcttacccgatgctgtcgattatcgtcgataagagttacgcaccgggcgtaattatgctctctatcatcgttattcataactttgcggtcctcgggctgtttgcgctggaaaacatcaccatggcagagatgtttggttcgcggaaccgctttacccgcatggcaatctcgaaagaggcgggagggctggtggccgtaggctttggtccggtgctggcggggatcttctgcaatatgaccgggtcctggtggccaattgtggcgatgctggtggcgtactcgctgattgggctggtctccgctttgctgatgccggaagtgcgcgaccgcgatctgagtgaagccgaagatgcagccgaagcgccgcataaagaagcggtagcctacggcgcgctctcttcacgccgctag

SEQ ID NO: 4535 - DNA, 1476 bp, Enterobacter cloacae
cgagtctcaatcatggaaaaccagttattacaggcgaaggcaacgcgtcctcagtacgatcgcgacagcctcaaggcacgcattgttcatttagggtttggcgcgtttcaccgcgcacaccaggcggtgtacaccgatatactcgccgcagaacagggcagcgactggggttactgcgaagttaacctgattggcggcgaacagcagatcgccgatctgaaggcacaggataacctttataccgtggcagagatgtctgccgatgcgtggacagcgcgcgtggtcggcgtcgtcaaaaacgcgctgcatgcgcaggtcgacgggctggaaaccgtgttggcggcgctgtgcgagccacaggtcgccattgtttccctgaccatcaccgagaaagggtattgccattccccggcaacaggacaactgatgttcgatcatccgttaatcgttgccgacctgcaaaacccccatcagccgaaatctgcgccgggcgttgtggttgaagcgctggcgcggcgtaaggcggcggggctgccagcattcagcgtgatgtcatgcgataacatgccggagaacggccacgtgatgcgcaatgtcacctgcgcctacgcgcgcgctgttgacggcgaactggccgactggattgaagcgaacgtcaccttcccgtcaaccatggtggaccgtattgtgcccgccgtcacggctgacacgctggataaaatcgaacagctgaccggcgtacgcgatccggcaggtgtcgcctgcgagccgttccgccagtgggtggtggaagataatttcgtcgccggacgtccaaagtgggaaaaggccggtgcggaactggtttctgatgtcattccgtttgaagagatgaagctgcgaatgcttaacggcagccactcgttcctggcctatctcggctaccttgccggttatcagcacattaacgactgcatggaagatgaacattatcgcgcagccgcgcatgcgctgatgctgaaagagcaggcgccgactctgaaagtgaagggggtggatttagctcactatgctgacctgttgatcgcgcgctacagcaatccgaccctgcgtcaccgcacctggcaaatcgccatggacggtagccagaaattgccgcagcggatgctcgattccgtgcgctggcacctggtccaccagaaacccttcccgctgctggccctcggtgtggcgggctggatgcgttatgtcggcggtgtggatgagcagggtaacccgattgaggtgagtgacccgcagctggcggtgattcaggcggcggtaaacggtagcgctgaaggcgaaagccgcgttaatgcgctgttgggcattgaggctattttcggtaacgagctgccgaaggacgcggtgtttgtggcgtcggtcatgcaggcttatcagacgttgctgcaaaaaggcgcgaaggccacggttgctgagtacgccacccggctttaa

SEQ ID NO: 4536 - DNA, 2148 bp, Enterobacter cloacae
gcagccattccgcccgttacaaccatcgcgtcagaagctgaggagccgcccgtgcacaacgataagcattatcccttcataaaagtcagcatgacggcgctggcgctgctggtcgctccgctcgcgctacaggcgcaggataaggccactgaggcctctcaggggacccaggaatcgcttaacattgatgccgccgatcagcaggcacccggaaccacaaaaaccaccgacgatgcctcaaccggcagcggtgacggaaagaatgtcgcctcggccagccagcccgcgacgccgctggtgcccggcacgcccacctgggacagcttccacggccagcttaacgcgcagaaatacagccccctgacccaaattacggcggataatgtcgggaaattaacgaaagtctgggaattccataccggcgacgtctcggatggtaaaggcgatacgccagctaccgtctggtccgcaacgcccattttcgccaacgatacgctctacattggcacgccattcgatcgcctgattgcgctggatccgggtacgggtaaagagaagtggcattatgacacgaaatcgtcgcgcaaggcgctgacccagccagtgctgaaaaaccgcggcgtttcctactggcaggccaaaaatccggtgagcggagaggcatgccagaagatggtttatatgggcaccgttgacggcaagctctttgcgctggacgccgattcaggcaaaccttgcagcggctttgcgaataacggcgtgttggatctgaaccagtggaataccgttaacgcgaagtatccgctctctgtcctgcaaccgccaaccgttgtcggcaaccatctgctggtgggctgggccgggaaggactgggcctatgccgaagcccctccgggcaccgtattttcagtcaacgcccagaccggtaagcttgaatggacctttgaggcgatcccggcagagattcgcaagcgtaccggtaccgccaacgtctggacgcacatgtccgccgatgaggccaacgggctggtctatctcccggtttcatcgccatctcccaactattggggcggcaaccgcgtggacgctattccgcttggcacctcgaccaccgcgctggacatcaacaccggtaaagtggtctggtcccgtcaatgggtacaccacgacgtctgggattacgatattaactccgccccgacgctgatggacatcaccgtagacggcaagcagatcccggcgctgattcaggccaccaagcagggtttcctgttcgtggttaaccgcctgacgggggaggacgtatggccaatcgaagaacgtccggttccgcagggtgatggttcggttcagggtgaagttctctcgcccacgcagccgttcccgaccaaacccgcgccgctgctcgaccagtcgaaaaaaccggaaatctggaagctggcggatatcgtcggtggcggccagtgctcccgtctgtgggataacctgacctatgagggaatgtatactccgccgaccacaaagggcgaaggcacgctaacctatcctgatagcgctggcggcgtacagtggggtggggtggcgttcgatccgcaaaaacagatcgccatcgtcaacacctcgcatatcgtccagtacgtgaagctctacagccgcgaagattacgataacgcagacaaagactccggtaacgaaagcggctttgccccacaggaaggcgccccgtacggtatgcgtctgctggtggcgagcaactggctgggcatgccgtgctggcagccgccgtttggcgaaatcgtggcgctggacatgcatacgggcgatgtgaaatggcgtcgtccggttggcgcctcccagcagtatggcttcttcatgccggagagctggggttcacctaccattggtggcccggcagtgacggcgggcggcgtgatcttcatcggtgcttcaatggatgccaaagtgcgtgcctactcggtcgagagcggtgaagagctgtggtccgatcaggcagaagcgccggcagtagcgaacccgtcagtctatgaatataaaggtcgccagtatgtggccttcgtggcaggcgggaatacgatcctgaaggatcaggtgggcgatcaggtggtggtctacgccttgccggaataa

SEQ ID NO: 4537 - DNA, 201 bp, Enterobacter cloacae
ggaacaacaatgaaaaagagggctggtgtactcaccgtggccgtcgtcgcgctgctgtcaggctgcacgccgcgcattgaagtggcagcgcccaaagagccgatcactatcaacatgaacgtgaaaatcgagcatgaaatccatatcaaggtggataaagacgttgaagccctgctgaaatcccgcagcgatctgttctga

SEQ ID NO: 4538 - DNA, 594 bp, Enterobacter cloacae
gaaggggctacataccgaacacctcgggccgatgctggcagagatgcagtatctccagcgcgtttaccccggccagcagtggtaaaggaggacgccatgcaacgcctcgtcgacatcgcgcctgcacaaatcccgcagatttgggcgctgttaagccagatccccgacccggaagtgccggtgctgaccatcaccgacctgggcatggtgcgcagcgtgaaggcacagggggaaggctgggttatcggcttcacgccaacctattcgggctgtccggcaacggagcatctgctgggggcgatccgcgaaaccctgaccggaaacggctttagcccggtacatattgtgctgcaactggagcccgcctggaccaccgactggatgaccgacgatgcccgcaggcgcctgcgtgaatatggcatcagcccgcctgttggtcatagctgccatgcccacgttcccgcggaggtgagctgcccgcgctgtgcgagcaccgatacctcgcttatcagtgaatttggatccacggcctgcaaagcgctctaccgctgcaatacctgccgtgagcccttcgactatttcaaatgtatttga

SEQ ID NO: 4539 - DNA, 783 bp, Enterobacter cloacae
tgcgaaggggatggcatgagcgaactgattgttacccgtcatggccgcgtgttgcagctaacgcttaaccgtccggcggcgcgcaacgcgctcaacaatgcgctgctcctgcaaatcgcggagcagcttgaggccgccgccgcggatgctgagatcgccgtctgcgtgatgtacggcaacgaacgctgctttgccgccggggccgatctcaacgaaatggcggagaaagacctgcccgccaccctgaacgatatccgtccgcagctgtgggcgcggatcaacgccttcaccaaaccgctgattgccgccgtaaacggcttcgcgctgggggcaggctgtgagctggcgctgctctgcgatgtcgtgattgctggcgataacgcccgttttggcctgccggaaatcaccatcgggatcatgccgggcgcaggcggcacccagcggctgatccgcagcgtaggcaaatcgctggccagcaaaatggtgctgacgggcgaaagcatcacggcggtgcaggcgcacagcgccgggctggtcagcgacgtctatccggcctcgctgacgctggagtacgccctgaagcaggcagcgctgatggcgcgccattcgccgctggcgctacaggcggcgaagcaggcgcttcgccagtcgcaggaagtcccgcttcaggccgggctggcgcaggagcgtcagctgtttgcgctgctcgcggccaccgacgatcgccgggaagggatcaacgcctttttacaaaaacgcaccccagactttaaaggacgctaa

SEQ ID NO: 4540 - DNA, 1581 bp, Enterobacter cloacae
tcaagcaggcgatcaacgccgccgaaaccaacaccctcgacgcccagcttgatctggagcgcgactatcaacgcctggccggacgcagcgacgactaccgggaaggcgtcagcgcgttcctggcaaaacgcgcgccgaactttacggggaaataatatggtgaatatccatacggtcgccgtcattggcagcggcaccatgggcgccgggattgccgaagtggcagccagccacggtcatccggttctggtgtacgacattgacgcagcggcgatttcccgcgccgtcgacggcattcgccagcggctgtcctcacgcgttgcgcgtggaaaactctctgccgacgccggggagcagatcctcgcccgcctgacgccggtgacgaatatcagtgctctggcgaaagccgatctggtgatcgaggcggcctccgagcggcttgaagtgaaaaaggcgctgtttacccagctggcagaggtttgcccgccgcagacgctgctcgccagcaatacctcgtccatttccgttaccgcgattgcggcggagataaaccaccctgaacgcgtcgccgggctgcacttcttcaatcctgccccggtgatgaagctggtggaggtggtcagcgggctggcgacctcaccagaagtggccgatgcgctgtgcgagctggcgctgagctggggaaagcagccggtacgctgccagtccacgccggggtttatcgtcaaccgcgtggcgcgcccgttctactcggaagcctggcgcgcgctggaagagcaggtggcaacgcccgaggtgattgacgccgccctgcgagacggcggaggcttcccgatggggccgcttgagctgacggacatgattggtcaggacgtcaactttgccgtgacctgctccgtgtttaatgccttctggcaggagcgtcgttttctgccgtcgctggtgcagcaggagctggtgctggcggggcgtctgggtaagaaaagcgggcagggcgtttaccgctggctggaggacaaacccgccgtcagatggctcgccccggtcagcgacagcttcaaccccatgcgcgtacagcgaagaagtgacggtgtcacggaaattgacgatctgttgctgatcgaaacgcagggtgagaccgcgcagtcgctggcgctgcgccatggctgcccggtggtggtggtcgaccgcatcgagcgggatgtggccgtgatagccgccgcacccggcaacccgcacgccgccacgcagaaagccatttactgtttgcagcaccagcagaaacgggtggtacagattgccgattaccccggtctgctggtctggcgcacggtagcgatgattgccaacgaagcgctggacgccctgcaaaaaggggtcgccagcgagcaagacatcgataccgccatgcgcttaggggtcaactatccctgcgggcccatcgcctggggcgagcgccttggttggcagcgtctgttaacgctgctggagaacctgcaacgtcactacggcgaggaacgctatcgcccctgttcactgctgcgccagcgtgcgcttctggagagtagctatgagtcataa

SEQ ID NO: 4541 - DNA, 1290 bp, Enterobacter cloacae
aattcagaaccaacaacagaaaaccgtcgctctttttcgcgggaaatcgcaccgcaccggcggcagtatgacaggagaagcctgatgcgtgacgcatttatttgtgagggtgtgcgtaccccggtcggtcgctacggtggaggattatccagcgtgcgtgccgatgacttaggggccgtgccgctgcgtgcgctgctggcgcgttacccgcagctcgatctggagcgcatagatgatgtgatcttcggctgcgcaaatcaggccggagaggataaccgcaacgtagcgcgcatgtcgtcgctgctggccgggctgcctcagaccgtttccggtaccaccattaaccgcctgtgcggctccggtctggatgcccttggctttgcggcacgcgccattaaggccggggatggcgatctgctgatcgccggtggcgtcgaatccatgtcccgtgcgccgttcgtgatgggcaaagccaccgcggcgtttcagcgtcaggcggagatcttcgacaccaccatcggctggcgatttgtgaatccgctcatgcatcagcaatacggaactgacagcatgccggaaacggcagagaatgtagcggaattgttaaatataagccgtgccgatcaggatgcatttgccctgcgcagccagcagcgcaccgcgcgggcgcagcagaatggcgttctggcgcaggagattatcccggtacaggtggcggggaaaaaaggtgccgtaacggaagtgagcgtggacgagcatccgcgcgccgaaaccacccttgaacagcttgccgcgctgaaagctccgttccgcaagaacggtgtggtgacggcggggaacgcctctggcgtgaacgacggggcggcggcgctgattatcgccagcgagccgatggcgcttgcccaggggttaaccccgcgcacacgcattgtggccatggcgaccgcgggcgtcgagccgcgcctgatgggattaggcccggttcccgccacccgtaaggtgctggaacgtgccggactcagtatcaccgatatggacgtcattgagcttaacgaagccttcgccgcacaggcgctgggcgtgctgcgtcagctgggtttgccggatgacgcggagcatgtgaacccgaatggcggggcgatcgcgttaggtcatccgctgggaatgagcggtgccagactggcgctggccgcgagcaatgaattgcaccgacgcggcgggcgctacgcgctgtgtacgatgtgcatcggtgtgggtcagggcattgccatgatccttgagcgtgtttga

SEQ ID NO: 4542 - DNA, 1986 bp, Enterobacter cloacae
ggccattcaatgaaattaaccctaattgctaaacatctggcgcttgccggtgtgttgacgtcgctgtcgctttcctcgtttgcggaagtacagccgcaggatgccactgccacgacccggcaggtaaataacgccctgtataacaaattaccgtttgccgataaaaccgactttgagaacgcccataaaggttttatcgccccgctgccacaaaacatgattaaaggcgagcaggggaacgttatctggaacccggcgaaatatgatttcgtgaaagagggtgagaaagccccggatacggtaaacccgagcctgtggcgtcagtcacagttgatcaacattggcgggctgtttaagctcaccgacggcgtgtatcagatccgtaatctcgatctctccaacatgaccatcattgagggcgagaagggcattaccgttatcgacccgctgttaagcgctgaaccggcgaaagaagcgctggatctctactatgcaaaccgcggcaagaaaccggtcgtcgctgtggtgatcacccacagccacgttgaccactatggcggcctgcgcggcgtggttgacgaagctgacgtcaagtctggcaaagtgaaaatctacgcgccggatggctttatgaaagaggcggtttccgaaaacattatggccggaaacgcgatgagccgccgtgcgaggtatatgtacggcaacctgctgaagccggatgcaaaaggccaggtgggtgcaggccttggcaccaccacctctgcgggtactgtcaccctcatcccgccgaccgactacattacccataccggtcaggaagaagtgatcgacggtttgacctacgactttatgatggcgccgggttcagaagctccgtcggagatgctgtggtatgtcaaagagaagaaaatgatcgaggccgcagaggacgtgacccatactctgcacaacacctactccctgcgcggcgcgaaaatccgcgacccgctggcctggtctaagtacattaacgccgccattgagcgctggggcgcggacgcggaagtgattattgcgcagcaccactggccgacctggggtaacgagaatatcgtcaagctgatgaaaggccagcgcgatatgtatcgctacatcaacgaccagaccctgcgtatggcaaacaaggggctgacccgcgacgagatcgccgccgagtttaaactgccggaatcgctggaaaaacagtgggcgagccgcggttactacggctccgttagccacgacgtcaaagccacttacgtgttttatctcggctggttcgacggcaacccggcaaccctcgacgagctgccgcctgaactggctgagaagaagttcgtgcagtacatgggcggcgctgatgccatcatgcagaaagccaaagcggattatcagcagggtaattaccgttgggttgctcaggtggtaagcaaagtggtctttgccgatcctaacaaccaggctgcccgtaatctggaagccgacgcgctggagcagttaggttaccaggcggaagcgggcacctggcgtaacttctacctgaccggcgcgcaagaactgcgtaatggcgtgaagaagctgccgacgccgaacaccgccagcccggataccgtgcgggcgatgaccccggaaatgttcttcgactacctgggtgtgcacatcaacggggtacgggccggtaacgcgaaggcggtcttcaatgtcgatctcggtaaggatggcggcaaatacaagctggagctggaaaacggcgtgctgaaccataccgccaacgcgcaggcgaaggatgctgacgcaaccatcacgctggaccgtaccacgctgaacaacatcatccttaagaaagagacgctgaagcaggcgatggataagggtgacgtgaaggtgagcggaaacggggcgaagctggaagagatgctgagctacatggacacatttgacttctggttcaatattgtgacgccataa

SEQ ID NO: 4543 - DNA, 948 bp, Enterobacter cloacae
tgcgccgttgcagcagggcgatcgctttgtggtcacctggatgatgcactggtcgcacccgcgtattgcccggggtgcagtgcgacagctgccgggctgctccgtggtagacatgcgcgacgatcgcattgttcgccagcgggattactacgatgccggagagatgatttacgaacatctcccgatactcggctgggccgtacgcggcgtgaagcggagagtgaaatcatgaaaacggttctgatcaccggcgcaagctcgggcatcggggcggggctggcgaaatcttttgccgacgatggttaccgggtgattgcctgcgggcgcgatgcgcaacgtctggccgctgtgcatcagcacagccccaacatcacggtgcgcctgttcgatatgacagacagggacgcctgtcgccaggcgctggcggactgtgctgccgacacggtgattctctgcgccggaacctgcgagtatctcgaccgcggcgaggtggatgccgagctggtggcgcgggtcatgaccaccaatttcatggggccggtaaactgccttgcggcgttgcagccgcaactggtatccggcaaccgcgtggtgctggtcagttcgatggcgcactggcttcacttcccgcgagccgaagcctatggggcctctaaagcggcgttaacctggtttgccgacacgctgcgcctcgactgggaaccgaaagggattgccgtcacggtcgtttcacccggttttgtcgacacgccgctgacccgcaaaaacgatttcccgatgccgggccgggtcagcgtgggggacgccgtccacgccattcgtcgcggtctggcaaaagggaaggatcacatcgcgtttcccgccgggttcagcctggcgctgcgcctgctttccggcctgcccgatgtacttcagcgcgcactgctgcgcaggatggtgcgaccatga

SEQ ID NO: 4544 - DNA, 753 bp, Enterobacter cloacae
acgctatcgcggccggggagggcaactgagatgaacagctgcctttaccacggcacattgcgccatcgtcggcttgcgccgaaagcgcaccattttacctatagcgtgtttatggcgtggctcgatctcgatgagctggacgcgctgccctccgtcggcgtgcgccgtaaccgcgttgcgcccgcggcattttatgatgcggactacccgctgggcacgccgctcaaagagcacgtccttgagcgtctggaaaatctgaccggcgagcgtccggcggggcgggtcatgcttctgactcagctgcgctatttcggttttcatttcaacccggtcaatttttactactgctatgacggcgaagacactctgcgctgggttctcgccgaagtgcgtaacacgccgtggaatgaacgacattactacgcggtagcggggcgggacgccccgccgacgcagaaagcgtttcacgtctcgccctttaatccgatggatatggtttaccactggcgcttcaacagcccggacagcacgctgcgcatgcatatcgaaaaccatcaggagacgaaggtgtttgatgccaccctgacgctgcgccgggcgccgctgacgcgcgcagcgctgcgttcgctgctggcgcggatcccgttgatgaccctcaaaaccgttttcgccatttactggcaggcgctcaggctgtggctgaagcgcgtgccgctgcataaccatcccctcagcaggagtgaacgctcatga

SEQ ID NO: 4545 - DNA, 963 bp, Enterobacter cloacae
tctctactggacgctggtggtgctgtttcgcgagcaggggctggtcatctggatcgcgctggcggtgcttgcctggctgttattaccgccatcacaccgggtatacgcccttgtgctggcggcgtcgggtgcgctgctggacgccctctgggcgctgacggggctgattgcgttcacaggcgcgtccctgatgccgctatggatggtggcgctgtggctaatgtttgccaccgtctggacgcacctgacccgcacgaccaccttgccaggatggttgctgacggtgctggcgactctgggcggaccggtagcctacctgatcggcgagcatcttggggccattacgtttcaggagccgacctttatcgtcgtcagctggatgttccccggctggctggtgctgatgctgtttttccacctgttgatggggagacaacaatgagaaatctggtactgatgctcgcgttatccgtcttcacctgtaccgtgcaggcggcagactggctgagctggcgcaaggtgggtgacgccaccctcacctgggggccgtttatcgtctatacctctcagcttctgacgcccgacggcagctatacaggattagacggcgataatgcgctgattatcacctatgcccgggacatcgatggtgacgacctggtcgaggcgacccgtgaccaatggcaggcgcagggcattttgcagcaggagccgcagagtgaagcctggctacgcatgctgtccacgctctggcccgacgtcacgcccggcacgcagctcgcgtttgtggttaataacggccagggacaattctggtatcgccccacggcgtcgcagaaaaaatttacgccactcgggccacgccagacggcagcgtttagctcacgctttctggcgatatggctcgatccccgcaccgaatatcctgaactgcgtcagcagttaactggaggagcacaatga

SEQ ID NO: 4546 - DNA, 546 bp, Enterobacter cloacae
acgaacatgacaaaactcaccctacaagagcagatgctgaaagcgggcttagtcagcagtaaaaagatggccaaggtccagcgcacggcgaaaaaatcccgcgtccaggctcgcgaggcgagagaggctgttgaagagaacaagaaagcccagctggagcgtgataagcagctgagcgaacagcaaaaacaggcggtgctggcaaaagagttcagggcgcaggtgaagcagctgattgagatgaaccgcatcaccgtggcgaagggcaacattacctttaactttaccgacggcaacctgatcaaaaaaatcgaggtcgataagcagacgcaaacccagctgatcaacggccgtctggcgattgcccgactggtgattaatgcgaagggcgactgtgattacgcgattatcccggcggtggtggcggataaaattgcccaacgcgatgcggacagcattgtgcttaacagcgcgctgagtcaggaagagcaggacgaagacgatccgtacgcagactttaaaatccctgacgatttaatgtggtaa

SEQ ID NO: 4547 - DNA, 846 bp, Enterobacter cloacae
cgcgcagaaagggggataatcgatggctctgtatgctgtaaggaggtaacgatgacaatggcacttttcccctgtctgcctggcccaaccctcgacgccgtgaataccgttggggcgtggcttgctcaggacgactatcaggacaatcagcccgttgatctggtgattctggcgggtaatgcggtggtccccgcgattgatgctgcctgtaaaaacgcggctgaacagggtgttcctctgatcatcagcggcgggatcggtcactcgacgaccttcctctacgccgcgattgcgaaacacccccgctataacaggatacccaccaccgggcgggctgaggcagctattctggccgacatcgcccgtgaattctggaacattccggctgagcatcttcacgttgaggatcagtcgaccaactgtggtgaaaacgcccgcttcagccgggcgttgatgaaacaatccggactgaacgccgcccgggtgctggtggtgcaggacccgacgatgcagcggcgcacaatggctacgtttgcccgcgtatgccgcgacgaggccgcagcgcccgcatgggtgagtcatcccggcctgacgcccgtgctgcaaaacagcgacgacggtctggtgtttagcggcccggccgaggggttatggccggtagaacgttacctgtcgctggtgctgggtgaatttccgcgactcagggacgacatcaacggctacggtccggcgggacgtgatttcattgcccatgtcgatatccctgccgacgtggacgccgcgtggcagatcctgcgaaacgacgtcattctcaccgacgcgctggtgagccgttctctgctgtaa

SEQ ID NO: 4548 - DNA, 984 bp, Enterobacter cloacae
aacatgtcgcaccggaaatgggatggcgcgatcgcaatgcgtaatctggccctctggtatcgccggtttggtgagcctgaatcggtactgcaagcagaaaccacaccattgtccccgcgacagccgggagagatacgtgtgcgcatgcttttttctccggtgaacgcctccgatctcatccccatcaccggggcatatcgccatcgcacgccgctgcctgcgatagccggttatgaaggggtcggaatagtgaccgaaacgcccgccgcttatccggcgctgctgggcaagcgggtcctgccgttacgggggcagggaacctggcagcgctatgtcgactgcccggcggcgtatgcggttcccgtcccggacgacgtcgactcgcttcttgccgcgcgggcgtatatcaatccgcttgccgcacagatgatgctggaccgctatcctccggtcgggaaaacggtgctgctcaccgctgccggttctgactgcgccgttctgctcgggcaatgggcacgccaggcgggtgcagaggcggtttacgggatccatcgctcgcccgtgcacgctcaacgtctggctgaaaaggggatcgtcccgattgcgcaacacgatatggccgccgtcaacgctgccgccgcgcgcgcagacgtggtgtacgacgccacgggcggcagcctggcggagacgatcctgagcgtgatgcccgaaaccggcacctttgtctgctacgggctgctctccgggcagaccttccggcagcagcggccgttgccgcgcgtggcgtggtttcacattcgtaactatctggacgcgctgagcgctgaggcgtggcaggcggagtttcggcgcatctggcctaaactgcgtgccagtcagtgcagcgatgtcaccctctacccgctgtcggaatggcagcgggcagtaggcaactatcgcgaagcgggaagaacgggcaagcccatgctgtcgatggacaattaa

SEQ ID NO: 4549 - DNA, 432 bp, Enterobacter cloacae
ttcccaattttttggtttgctgtccgcagtgagcctcgatggattatattctcaagcaggagaaaaaacatgttttactggattttattagctctggcgatcgtcgctgaaattaccggcaccttgtcgatgaaatgggcgagcgtgagtgatggcagcaccggttttattttgatgctggtcatgattacgctttcctatattttcctctctttcgcggttaaaaaaatcgcgctgggcgtggcatacgcattgtgggaaggtgttggtattttattgattacgctgtttagcgtcatgttatttgatgaaaccctgacgacaatgaaaattgccgggctgacgaccctggtcgcgggtatcgtgctgattaaatcgggtacacgcaaaccggcaaaacagcagaaggagcagacccatgcagcagtttga

SEQ ID NO: 4550 - DNA, 456 bp, Enterobacter cloacae
atgttttcattcgacgctggcgtccggctggggccggatgattgccgtgcgcatcacgcccgatatggagatggctgtgttgacgccctggcgcattttcggcgctatggttttacgcagacgcccgccgatctggacgctcatccctgcattgcctaccagtttgccgacggtaaccactatcaatgggagcttgtgcaggatgggaagcgagtgactcaccgtccggaggggcaatgggccttttccgacagctacatggaggccgaagcggcccggctgggactcgggctggcctatgtcccggttgagctgatgggtgacgatccggagcgtggcacgcttatacgcgttttacagcgctatagcctgcggatggacggactgtacctctattatccacaccgcaacgtatccccggcgctgagagcggtgattgatacgctgaaaatttag

SEQ ID NO: 4551 - DNA, 459 bp, Enterobacter cloacae
cccttcatcggaaaaggagtcaggcttatgtataagaaaattttgatgcctgttgacgtgtttgaaatggatttgagcgataaagcggtacgccatgcggtcaacctcgcgaaggcggaaggcgcgacgatcaccctggtcaacattctccctaacagcagccgttcattactgcgggggttcaatgccgatattaagaagttcgaagagtatatgaccgccgagtctgataagaagatgaaggcgctgaaacggctctttgatatgtccccggaaaatattgattgtgaagttcgcttcggcaacgtacgcgatgaaatcatcaagctcagcaaagaggggaaatatgacgttattgttattggatcaagaaacccgagcatgacaacccatctgctgggttcaaatgctgaaactatcctgcgctacgccactattccggtgttagtggtccgctaa

SEQ ID NO: 4552 - DNA, 183 bp, Enterobacter cloacae
gaggtaaagatgaaagttgacgcactgacacaaaaggcagaggaagagatttcagcgcttatagccaaaaaaattgcagagttacgaaaaaaaacagggcaggaagtttctgaaatagagtttatcgctcgtgaggccatgacgggcctcgaggggtatgaagtaaaaatcaaactcctgtaa

SEQ ID NO: 4553 - DNA, 2646 bp, Enterobacter cloacae
ctgcccatgaagggtaaatacaaagccgcaatcgcgctattactgctgctattactcgtgccgctgacgctgctgatgacgctcgcccagtgggtacccacgctcgccgggatctggctccctgttggaacgcgcatcgcgtttgaagaaagcccacggctcacgcgccacgccctgatcatccccgatctccgctatctggtagaagagtgcgaaattgcccgtgtggaaaacgtgaccctgtcacaccccagccgttgggatcttgatattggcgcacttgaacttaactctgtctgcctgagcaaattaccgcagtcagcgtcctcaacggtggcgccgaaaacgctggcgcagtggcaggccatcctgcccaacacctggctgaccatccaccgctttaccctttctccctggcagcagtgggagggtgagctgcatgcttcactcacgccagcccgccaggacatcacttataacggcgagcaggtgagcattaaggggcagttgcgcggccagacgctctccatcagccagttcgatgtgcaactgccggatcagccgcagcccgtgaagctgatcggtgaatttaccctgccgttggtaccggacggcgtgccggtgaaagggcatacggtcgcgacctttaacgtgccacagttatcctcgctggtcgatgccgatctggactgggaggacaatcagggccagctggtggtcatggcgcgggacaaccccgatccactgctcgatttaccgtggcagatcaccgctcagcagttaaccatcagcgacggacgctggaactggtcagcctccggtatgccgatgagcggtcgcgtcgggctgaaagtggataactggcagcaggggctggagaaagccaccttcacggggcggctcaacgtgctgacccagggtgatgcggggaagggcaacgcggtgctgaatattggtcccggctcgctcagtatggaaaacagcgctatgccgctgcacctgagcggggaagccaagcaaaacgatctgatcctgtatgccagactcccggcgaagctgaccggcagcctttacgatccgcagcttacgtttgaacccggcgcattattgcgctcgcgcgggcgcatcatcgactcgctggatatcgatgagatccgctggccgctggcaggcgtgaagctcacgcagaagggcgtggacggccgcctgcaagccattctgcgggcgcatgaaaacgagatgggcaattttgagctgcatctggacggccaggctaacgactttttaccggacaacggtttgtggcagtggcgctactggggtaaagggaatttcacgccgatgaatgcgcgctgggatgtccggggaaccggggagtggcgcgacaacgttatcgaactgaccgatctttccacggggttcgacaaattgcagtacggtacgatgctggtcagcaagccgcgcctggtgctggatcacccggtgcgctggtcgcgggacccggataaccccacctttagcggcgcgctcgcgctcaatgccgggcaaacaagcttctcgggcggaagcgtgctgccgccgtccgttttgaccttcagcgttgacgggacagacccgacggtgttccagtttaaagggaacctgcatgcggacgacatcggcccggtccaggtgaatggacgctgggatggcgaacgccttcgcggtaaggcctggtggccaaaacagtctcttacggtgttccagccgttgatcccgccagactggaaaatgaccctgcgcggcggcgaaatgtacgcacaggtggctttctcagcggcctccgatcaggggtttgaggccggggggcacggggtgctgaaagcgggcagcgcgtggatgccggataacgaaatcaacggcgctgattttgttctgccgttccgcttaagccaggatacctggtcgctgggcacgcgcgggccggtaacgttacgaatcgacgaggtaaaaaacctggtcacagcccgaaatatcaccgcggatctccagggcgattatccctggaccgaagcgaacccgctcctgctcaccaacgtgaaggtggaagcgctcggcgggaaaatcaccatgcagcagttgagaatgccgcagcacgatccggctttactacgcgtggataatatttcctccagcgaactgataagcgcggtgaatccgaagcagtttgccatgtccggcccggtgagcggcgcgctgccgttctggctggacaatgaaaaatggatcattaaagatggctggctgaccaacccggggccgatgacgctgcgcatcgaccaggacacggcggatgccattgtgaaagacaacgtggttgccggggcggcgatcaactggctccgctatatggaaatttcgcagtcgtggacaaaactcaatgtggataatctgggtgtgttaaccatgcaggcggccattaaaggcaccagccgcgtcgagggcaaaagcagtttcgtaaacctgaattacacccatgaagagaacatttttaccctctggcgcagcctgcgctttggggacaatctgcaaacatggtttgagcaacatgcggcgataccccttctccgcggttcgacaggcaaggaaagtgaggaacaacaatga

SEQ ID NO: 4554 - DNA, 348 bp, Enterobacter cloacae
aatcccgcagcgatctgttctgaggatgccatgaaacgattagctctgatgttactggcgctggggatgaacgttcacgccgccacgcttacgctcaacgatgcacgtgcccaggggcgcgtaggggaaaccctgagcggctatcttgcgcccgttcagcacgacgctgaaaccctggcgctggtgagccgtatcaacgccgcacgcacggaaagttaccagcagttagctgacagcaataatttgcccgtcgacgaggtggcgaaaatggcgggacaaaagctggtggcgcgcgcccagccgggtgaatacgtgaaggggattaacggcaagtggctaaaaaagtaa

SEQ ID NO: 4555 - DNA, 774 bp, Enterobacter cloacae
tggtatcgagcatatgtgaggttggggatgaacaacgtatctgcttatgccctgtgtctgggcgacaacggtctggtgctctcacagcgtctgggcgcctggtgcggccacgcgccggagctggaaattgacctggcgctcgccaatatcggccttgatctgctcgggcaggcgcgcaatttcctgacctacgccgctgaacgggaaggtaagggtgatgaagataccctggcctatggccgcgatgagcgtcagttccgcaatttgctgctggtggaacagccaaacggcagcttcgccgacaccattgcccgtcagtatctgatggatgcgtggaacgtggcgctctacgagcggctgatccacagcagcgacagtcagcttgccgccatcgcggcaaaagccattaaggaggcgcgctatcacctgcgctttagccgcggctggctggtgcggctgggggacggaacagaaacctccgcacaaaaaatgcagcaggcggtggatagcctttggcgctttacggctgaactgttcgacgctgacgaggtcgagctggcgctaattgatgacggcgtggcggttgatccgcgcgacctgcgggacccgtgggagcgcgaagtgtttgctggcctggcggaagccaccctccgcgtgcccgaagaggtggcgtatcgcacgggcggtaagaaggggctacataccgaacacctcgggccgatgctggcagagatgcagtatctccagcgcgtttaccccggccagcagtggtaa

SEQ ID NO: 4556 - DNA, 1200 bp, Enterobacter cloacae
gctgcccgcgctgtgcgagcaccgatacctcgcttatcagtgaatttggatccacggcctgcaaagcgctctaccgctgcaatacctgccgtgagcccttcgactatttcaaatgtatttgaggctgccatgacaacgtttcattcattaacagtggcaaaagtggaacccgaaacccgcgacgcggtgaccattaccttcgcggtgccgcaggcgttacaggaggcgtaccgcttccgtcccggtcagcatctgaccctgaaagccagccctggcggggatgaactgcgccgctgctactccatctgccggagcaccgcgtgcggtgagatcagcgtggcggtcaaagccatcgagggcggacgtttttcccgctatgcccgggacgagatcaaaccgggcatggcgctggaggtgatggtgccccaggggcattttggctaccagccgcaggccgaacgcgaaggccattatctggcgattgccgccgggtccgggatcaccccgatgctggcgattatgtccgctacgctggccactgaagcccacagccacttcaccctgatttacggcaaccgcagcagccagagcatgatgttccgccgggcgctggcggacctgaaagataaatacccgcagcgtttgcagctgatcgccatcttcagccaggagacgctcgacagcgatctgctccatggccgcattgacggggaaaagctccaggcgctggcaaaaacgctggtgaatttccgtcagtacgatgaagccttcatctgcggcccgtcggcgatgatggatgaggccgaagcggcgctgcaagcgctgggtatgccggaaaaagcgatccatcttgagcgctttaacacgccgggtaccgccgttaaacggacagccagcgtgcaggccgatggccagaaggtcaccgtccgtcaggacgggcgcgacagggagatcaccctgacggcggacgacgaaagcattcttgacgcggccctgcgtcagggggcggatctgccttacgcctgcaagggcggcgtatgcgccacctgcaaatgcaaagtgctgcgtgggaaagtcgatatggcgaccaactacagcctggagccggacgagctggccgcaggctatgtgctgagctgtcaggcgctgccgttaaccgccgacgttatcgtcgattttgatgcgaaggggatggcatga

SEQ ID NO: 4557 - DNA, 513 bp, Enterobacter cloacae
cgctgctggagaacctgcaacgtcactacggcgaggaacgctatcgcccctgttcactgctgcgccagcgtgcgcttctggagagtagctatgagtcataacgcctggcataacgcccgcgcgatgtacgaacgggacgcctgcgcgcaggcgatggggatggacattctcgacatgggcgagggctactcggtggtgaccatgaccatcaccccgcagatgctcaacgggcataaaacctgccacggcggacagctgttctcgctggccgataccgcctttgcctacgcctgcaacagtcaggggctggcggcggtggcctcaggctgcgccatcgattttctgcgtccgggctttgccggcgataagctgaccgctaccgcgcgggtgaagcatcagggcaaactgaccggcgtatacgacattgaaattcagaaccaacaacagaaaaccgtcgctctttttcgcgggaaatcgcaccgcaccggcggcagtatgacaggagaagcctga

SEQ ID NO: 4558 - DNA, 978 bp, Enterobacter cloacae
gaaaaatgccataatgcaggaaacacctgtgcaggaaatgcattaatgatagatgccggacatatcagcattcgcgcgctgctgatcttcatcgatgtttatgaaacgcagaatttctccgtggtggcgaggcgggaagggatttctgcgtcgcaggtctcacgcgtgatccaccagcttgaggacgccctcgggcaacagcttttctaccgcaacacgcgggcgattatgcccacagagagcgggcatctttttgtgcgctatgcccgggcgatggccgggaatatggaggacgcgcgacgcgagctggatgaacgcgcccgcgagccgtcgggcacgctgcgtatcaatggcccggtctttttcggacagaggcacatcgcgccgggcctgccggggcttctggcgcgttacccgcgcctctccattgaactgaccctcaccgacgattttatcgatccgcaccgtgacgccgcggacgttatcttccgcatcggcgcgctgacggactcctcgtttcacgcccgggtgttcgggcagcagttctaccatctggcggcctcgccggactatctgcaaaaacatggcgcacccgaggggccggacgatctcagccgtcaccactgtctggtttaccgcggctcgtccgggcctaaccgctggctgatccgacagccgggcgaggcgtgggttcactatcccatcgtaccgctgatgacttccaataacgcggaaacgctcctgattgcggcgctgggcggtatgggcgttgtgcttttcccggactggatggtgagcgaacgactcaaaagcggtgagctggtggcactgctgccggaaatggagtgttcaattaatacggagccattgacgattgcggcgatttacccgaacgcgcgtcatccgcccctgaacgtcagggcggtgattgattactatattgagcgattcggtacgccgctgtactggcaaacctga

SEQ ID NO: 4559 - DNA, 483 bp, Enterobacter cloacae
ttacaggagcaggttatgacagtacccgtacaacatcctatgtatattgatggacagtttgttgcctggcagggtgatgcatggattgacgtgatcaatccggccacggaagaggtcatttcccgtattcccgacggcaccgccgaggacgcccgcaaagccattgacgcggcagagcgcgcgcaggctggctgggaggcgctgccagccattgaacgcgccagctggctacgcaaaatttccgccgggatccgcgagcgcgtcagtgaaatcagcgcgttgattgtggccgaaggcggcaagatccagcagctggcggaagtggaagtgaactttaccgctgactatatcgactatatggccgagtgggcgcgccggtatgaaggggactcattcagagcgacagtcgacatgccaggggcgaaggtagtgcgtactattcagagcgacagtcgacatgccaggggcgaaggtagtgcgtac

SEQ ID NO: 4560 - DNA, 1668 bp, Enterobacter cloacae
aaggtaaaccacgttatgcgcctgccccaacgcgacccttatgctcctcgcgagtggcagccacacgagaaacccgccctgctgggttccccttccaccccggaacatccaaccccaaaacggatcgcctatggcgtggtcggcctgctggtatgtctgaccggggcgctgggtaacgcggtcgtcaccgctaatctgcaaaatctgcaaggcacttttggcgcctggtcgactgaaatcgcctggttgcctgccgtctatgtcatgaccaacgtttccatcaacctgctgctggtaaagtttcgccagcagtacggtttgcgcgcctttacggaaggcttcctggtgctgtatgtgctggtcacctttttccacctgtttgtgaacgatcttagctcggcgctgatggtaagggcggcacacgggatggtcgccgccgcgctcagctcgctcggcatttattaccagatccaggcctggcccgcgaagcatcgactgaaggcgctgaccattggcattaccgggtcgtcgctggcgatcccgctggcgcggctgttctccaccgagctattacagcttgatgagtggcgcgggctgtacttcttcgagctgggtctggccctgatctccctggcctgcgtgatggtgctaaagctgccgccgggcgatcggcgcaaagtcttcgagaagaaagatttcattaccttttttttgcttgcgcccggcatggcgctgctgtgcgcggttctgtcgttagggcgtctggactggtggtttgaagcgccgtggatcggctgggcgctggccctctcgctggtgctgattgtctctgcgatcgtgtttgaacataaccgcagcaacccgctgcttaatacccgttggctgtccagcggcagcatcgtacgcctggggctgattatgctgctgatccgcatcgtactggcggagcagaacacgggcgtcatcggctggctgcaatatgtgggcctacagaatgaacagatgacccatctggcgtgggctattttcgccgggatcgtctgcggtatcgtcaccagctgtctgacgattaagcccactaaactggcctggccgataatcacctcgctggtgctgatgatcgtcgcctcgctgctggacagccagtccaacaacctgacccggccggatcagcttattttcagccagttcctgctgggcttcggcagcgctttcttcctcgcgcctgcgatgctggcagccattggcggggtgatcgccgacccgcgcaacctggtcagcttttccgtgatgtttggcatgagtcagaaccttgggggcctgctgggttccgcgatcctcggcaccttccagacctggcgcgagaagtaccattccagcctgctggctgaccagctcaccacccttaacccgctggtgaacgaacgtattcagctttacacccagatgtacaaaagcctgattggcgacagttccctgctgggaacccaggccattacccagctccagacggtgacggcgcttgaggcaaacattctggcttacaacgatacttatctcctgacggcgagcattgccactgccacgctggtctggattttatggcgcttgctgcgcctgcgcatcaccgcccgtatggcccttaagaacgccactggcaacaagtaa

SEQ ID NO: 4561 - DNA, 1452 bp, Enterobacter cloacae
gccggaggcgtaccggctgctgcgccctggcatgtcggtgcaggtgaccatcgacacgcgggaggcgaaacaatgacgcttcgcccgatagccggcctgctgatgatggctatcctggcgggatgccagtcggttgacgttgagcccgccaaatcgtccctgcacataccggcccagtggcgcgcgacgtcggggccagccagcccgacagagcagctctggtggcgaaattttcacgacagcaatctgaaccgctatgtggatcaggcgctgaagaacaacagcgacgtgctgattgcacgcgagcggattaacgagtaccaggcccgggtgttcgccgccgacggcagtctgttcccgtcgcttgacgcgggcgtgaccgggacgcgcgcacgctcgcagtccgccgccacggggcttccggtatacggtacgttgtacaaaggcagcctgaccgcgagctacgacgtggatatctggggcgtaaaccgtagcacctcccgtgccgctgaagcatcgctggaggcacaaaaggcggcggcagcggcggctgatcttaccgtcgcatcatcggtggcctccgggtatgtcaccctgctgtcgctggatgaacagcttcgcgttacccaatccacgctgaagtcgcgtgaagaggcgttcaatctcgccaaacgacaatttgagacgggatacagctctcgccttgagctgatgcaatcggattctgagctgcgcgccacccgcgcccaggttccactgcttcagcaccagattgcacagcaggaaaatgcgcttagcctgctgctgggcagcaacccgggtgacgttgcgcgcggtgaaagctttgatgccctgacgccgctgaaactgccctcccagctgccgtcgacactactcaaccggcgcccggatatcgttcaggcggaacgtcagctgattgcggcagacgcgacgctggcggcatcgcgcgccagcctgctgccgtcaatcaacctcacggccacgggatcggtgcaggatcgcacgctgtcgggattgctggataaccccctacagctctggagcgtgggcggcagtattcttgcgccgctgctgaaccgtcaggcgctgaatgcgcaggtggatatctcccagtcccagcggaatcaggctctgtatagctacgaaaaaaccgtgcgtaacgcgtttgctgaggtgaatgacagccttgatgccatcacccgctatcaggaacagcttaccgagctgctggcacagcaggcggtcgcgcaggagacgctgcggattgcgcaaaaccgctaccgcaacgggtactcttcttatctggatgtgctcgatgcgcagcgcacgctgttctcggtgcagaccagcgtggtacaggtgaaaaacaacctgttgctggcgcaaattgatttgtataaagcgctgggcggcggttggagcagtgcgtga

SEQ ID NO: 4562 - DNA, 696 bp, Enterobacter cloacae
ttcgggggctattgctgctatactcgctaccacggcaaacgttgcggggagaggcttagcgtgaattttcaggatatccatacctattatcagcaactcaatattgggcaattttttccgcacatgctttgtaaaggcgaggccttaaccgttgccgcaaataaaaaactcaccgtcgagcctggctatatctatttttgcactgaagggtcgctgacgatattaatgcctgatgatggccttaatattggcaatactatcgagtatatgccgatagggttaatggaaaggtattgtccactggcgaagtatgaatatcgcagcagtgcgaaggtgaagctggtgagaatatcctgggtcgacttcgaccagatatttttccagggcgggcctgagcgcatgcaggcgctggccaccatactgacctacatgtccatatttaccatcgacctgcacaatgaacgcaggcaggtcaccagctaccagaccatcaaaccaatgctgtaccgctatctctatcggcaggagacccacacgggagagaatgagggcctggcgctgtttatcatcaagcgcactaacctgtcacgaacgcatgtctttcgcgtgctggcagatctaaaagccgggggctatatcaccatgaagcgcggaaagctggtgtcgattgaccggcccctgccggatgcgtattga

SEQ ID NO: 4563 - DNA, 2091 bp, Enterobacter cloacae
ttcgagatcaaactatttatagtgaaatcacgaaacatctggagagaagaaatgcagcagttagccagcttcttgtccggcatctggcaatcaggccggggccgcgagcgcaccatcacccacgccatcagcggggaaacgctatatcaagtcaccagcgaagggctggatatggcggccgcgcgccgttacgccattgaacacggcggagaagtgctccgcgcaatgagctttatcgagcgcgccgccatgctgaaggcggtggccaaacatctgctgagccagaaggatcggttttatgccctgtcagcccagaccggcgcgacgaaggctgacagctgggtggatattgaaggcggtatcggcaccctcttcacctacgcaagcctcggcagccgtgagctgccggacgataccctgtggccggaggatgagctgatcccactgtcgaaggaaggcggctttgcggcacgtcacgtgttaacgtcgaaatccggcgtggcggtgcatatcaacgcgttcaacttcccgtgctgggggatgctggaaaagctcgcgcccacctggcttgccgggatgcccgccatcatcaagcccgccaccgccaccgcgcaggtgactcaggcgatggtgaaagcgatcgtggagagcggactggtgccggacggcgccatcagcctgatctgcggtggcgcgggcgatctgctgaaccacctcgacagccaggacgtggtgacgtttaccgggtcggccagcaccgggcagagcctgcgcgtccacccgaatatcgtcgcacattccattccgtttaccatggaagcagattctcttaactgctgcgtgctgggtgaggacgtgacgccggaacagccggagtttacgctgtttatccgcgaagtggtgcgcgagatgaccgccaaagccgggcaaaaatgtaccgccatccgccgcatcatcgtgccggaagcgcaggttgaagccgtcagccaggcgctgattgcgcggctggagaacgtggtcgtcggcgatccggcccaggaaggggtgaagatgggggctctcgtcaacagtgagcaacgtgctgacgtgcaggaaaaagtcgatcatctgctggcctcgggctgccagatccgtctgggtggtaaagctgatttgcaggcgcctggcgcattcttcccacccaccctgctgttctgcccgcagccggacgaaaccccggccgttcacgccaccgaagcctttggccccgtcgcaaccctgatgccctgccgtaacaccgagcacgccatgcagctggcgcgggcgggcggcggcagcctggcgggaacgctggttacggcagatacccgcgtggcgcggcagtttattgctggtgccgcgcgcgcccacggacgcattcagatcctcaaccaggaatcctcgaaagaatctaccggccacggttcaccgttgccgcagctggtgcacggtggtccgggacgtgcgggcggcggcgaagagctgggcggcctgcgcgctgtgaagcactatcttcagcgcacagccattcagggcagcccgtccatgctcgccgcgatcggtaaacagtgggtccgtggcgcggaggtgcaggaagatcgcgttcatccgttccgtaaatacttcgaggagttacagccgggcgacagcctgctgaccccgcgtcgtaccctgacggaagcggatatcgtgaattttgcctgcctgagcggggatcatttctacgcccatatggacaaaattggcgcggcggagtcgatttttggtgagcgcgtggtacacggttatttcctgatttccgccgcggcggggctgtttgtcgatgccggggttgggccggttattgccaactatggcatggaaaacctgcgctttatcgagccggtcaagccgggtgataccattcaggtgcgcctgacctgtaaacgtaaaacgctgaagaaacagcgcactgccgaggaaaaacccaccggcgtggtggaatgggctgtggagatcttcaaccagcaccagcaggccgtggcgctctactccatcctgacgctggtggcgcgccagcagggtgacttctga

SEQ ID NO: 4564 - DNA, 231 bp, Enterobacter cloacae
cggataagtacgagaggagaaaataccatgatgacatacgaccgtaaccgaaatgcaatcaccactggcagccgcgtcatgattagcggcacaggtcagttcggcgtgattaaagcgatccacagcgacggccttaatgccgagcaggtgcgtcgtggtaaaacggttgaagtggaaggatgcgaaggtaagttcgaaccgattgagctgattcgcctggggatgcactaa

SEQ ID NO: 4565 - DNA, 939 bp, Enterobacter cloacae
cgagacctgccaaagtggctactttgggcgcggaatattccacactattataaaattagattcttaaattttcgggttaacatcatgatttatgactgttttttatactatgacgaagatatgttgctcgacatcagattacatactctcgctgatgttgttgaccgttttgtcattgtagaagcaacacactcttttacgggcataccgcgagaattgcatttcgatattacgaagtttgccaaattcaaagacaaaatcatttacgtgccttttgacgcgcagcctattttaaaccgggcggataataaccaggttgatgcatgggcaaatgaagcagcgcttcgcaactccattatgaacgggttaaaagacgcggcagacgacgatctgattctggtgtcagacgttgacgaaatcttctctcccgacacggtcagggccattaatccgcgcgcgctctgcacgactattcatcaaaacgtattcaactatcagtttaatctccaggttcacaacacggatggtacgccgagaaaatgtaccttgccgcgcgcgacgtcctattacaaccttaagcatttcttccacggtgagcctgaatctttccgaaactggaagcgtgcgcgcaaagataaaaactggtcatggtttaaatggaactggctaaaaatcaataataagattgtgaaagatggcggctggcatttctcctgggtaatgaccccagaaagaatttccgaaaaaatgtctaccatttctcataccgaatacgatctgccggaattcaataacccggaacatattatgaaggttatcaccaacgccgaagatatctggggacgagaccgaaaactggtcaggcaagaggtatcaaaacgcaccctgccttcttatctggtagacaatcagcaccattattcgcaatttattttatga

SEQ ID NO: 4566 - DNA, 348 bp, Enterobacter cloacae
ccctgctatgcttacagtctacacagtgaaaaggagctacagatgaaacggttaccctggattaccgccctgctgttaatgagtgcttcacccgctcttcttgcggccccggattcctgcgagcgcgtgaaaagcgacattcagcagaagattatcaacaacggcgtaccggagtctggctttaccctgaacatcgtcccgaacgatcaggccgatcagccggatgcgcaggtcgttgggcattgtgccaacgatactttcaaaattttgtacacccgcaccagtagcggcaactacccggtgagcggcgcaggtacgcaggagaatgcgcccgctgagccgcaatga

SEQ ID NO: 4567 - DNA, 270 bp, Enterobacter cloacae
ccctgtggatgcagagcaacgaggtatcaaaaatggggatatggtgcgcgtcttcaacgaccgcggcgaagtgcgcattgctgcgaaagtcaccccgcgcatcatgcccggcgtaagcgcgatgggccagggcgctggcatgacgccaacatgaacggcgatcgtgtcgatcacggctcctgcatcaataccctgaccacgcaccgcccgtcaccgctggcgaaaggcaacccgcagcacacgaacctggtgcagatcgagaaggcataa

SEQ ID NO: 4568 - DNA, 783 bp, Enterobacter cloacae
gcgttcaggcaaagctcaaaccggaggtattctttgctgattaaattaaagaaagaacgaacgcatcaggaggatcgtcgtcttgccctctggctggcgacctccgcgggactgctgaatgccattgcgctgggcgcgttcggcttttttccctcgcatatgacgggcaatacctcgcagctatccagcgaagtttcctccaccgatctcagcgatattcttttcttcggcgccattattctttcgtttgtctcaggtgccatcgctgcgcggattattgttatctgggggattatccataacatcaggctggtattcagccaggttctgtttgttgaagggctattactggcaggggtatccctgtacgaaatgtattttcactcctttgccacgaatcaggagattattattttcctgtgcgggttgatgggaattcataattccacctccactcagctatccggtggacgggtaagatccacacacatcaccggcacgctgaccgatgcgggcatttcgctggcctccgttatggtcgccatgctgcgccgggattattccaaagatacggccgcgcaaaagagtcagctcaaaacccatttaactacccttttctcctttatcagcggaggtatcgcggggctgatcctgttcagagagtttggattccacgcgatgctggcgctgggcctgatgctggtagtcgtcgccgccttctctatcgtccgcatctcgtggcgggtacgaaaagtgcgcgccgcgcttagtcgacaggtttaa

SEQ ID NO: 4569 - DNA, 672 bp, Enterobacter cloacae
caaacagttgctgtaggaggcgctatggagacgattcactatattctcgacaactgggactatctcttaaccctgacgctgcaacacctgtggctggtggcactcgccgtcggcctggcgattattattggcgtgccgctgggcattttaattgtccgccataaatggctggcaacgccggtgctggggattgccaccattgtgctcaccatcccgtcaattgcgcttttcggcctgatgatcccgctcttttcgctgatcggtcagggcattggtgccctgcccgcgattacggcggtgttcctctattcgctgctgccgattgtgcgtaacacccatacggcgctcgacagcctgccccccggcctgcgtgaagcgggacgcggcatcggcatgaccttctggcagcgtctgcgctgggtggagatcccgatggcgctgccggtgatttttggcggtatccgcaccgccgtggtgatgaacattggcgtcatggcgattgccgccgtgattggcgcgggcggtctgggcctgctgctgcttaacggtattggcgggagtgatattcgtatgttgattgcgggcgcgctgatgatttgtcttttagcgattgtgctcgactggttgctgcaccgtttgcaggtggtactgactccgaaggggattcgataa

SEQ ID NO: 4570 - DNA, 1503 bp, Enterobacter cloacae
ttcagacacgaggacttcatgaaaaacaataactatcaacaactcacccgcaccttccagcgcctctcccgcttctctcacctctcctccatcgccagctgggacatgttcaccatgatgccgccaggcggcagcgccgcgcgcggtgaagcgctggcggagatgagcgtcctgcaacatcagatcctgaccgataaaaaagtgggtgaatggctggcggcggcggcagacgaagatctgaacgacgttgagctggccaacctgcgtgaaatgacgcgctactaccagcaggcaactttactgccggaatcgctggtggaggccaaatcgctggcgggcagcaggtgtgaacacgcgtggcgcactcagcgtccggccaacgactggcagggcttttcagccaacctgaaagaggtggtgaaactcagtcgtgaagaagcccgcctgcgcgctgaggctaaaggctgcacgccttacgacgcgctgctggatatctttgaacccgacatgaccagcgctcgcctggatgtgctgttcggcgatctgaagtcctggctaccggagttgctggcaaaggttgtggaaaaacaggctcaacgatcgttcgttccgccacagggtcccttcccgaccgccacgcagcgcgagctgggcctggaagcgatgaaaatgcttggcttcgattttaacggcggtcgtctggacgttagcgcccacccgttctgcggcggcgtgccggaagatgtgcgtatcaccacgcgttacgatgaagatgaactgctcagcgcgcttttcggcgtgatccacgaaaccggacatgcccgctacgagcaaaaccttccgcgagcatgggccggtcagcccgttgcgctggcgcgctctacggcgatccatgaatcccagagcttgttctttgaaatgcagctaggccgcagcgacgctttcctgaagcatctgcttccggcggttcatgcccgtttcggcagccaggcggcattcagcgaagagaatttcattgcctggaaccagcgcgtgaagccgggctacatccgcgttgatgcggatgaagtgagctatccggcgcatgtggtgctgcgctatgagatcgagcgcgcgctaatcaatggcgaaattgaagtcgatgatattcccgcgttatgggatgagaaaatgcaggcctggcttgggttatccaccaaagataactatcgcaacggctgtatgcaggatatccactggaccgacggcggttttggctacttcccgtcttacacgctgggggcaatgtatgcggcacagctgttccatgccgccaaaactgcgctgcccgggttgcagatatccattgccgggggcgatttctcagcactgtttgactggctgcgtcagaatatctggcagcacggcagccgtttcagcacatcgcagctcatcacccaggccacgggcgaagacctgaatatccgctacttccgcgaacacctgacgtcccgctatctgtaa

SEQ ID NO: 4571 - DNA, 1461 bp, Enterobacter cloacae
ataccctttccgccagatttgcctcgccgccattctgaatataaccctcttcctcctgcacccgtacgacgtcactcctcgttcccccttgatctttgctatcaatatacaatactgtatataaatacagtatttattaacggtgatcataatgcagtttttcaccccacctggcgataccagagcgagctgaccatgtttgcactgtgtgatgtgaacgctttctatgcttcctgtgaaacggtttttcgcccggacctgaagggacgaccggtggtcgtgttgtccaataacgatgggtgcgtcatctctcgctccgctgaagccaaaccctttgtgaaaatgggtgaaccgtacttcaaacagaaagatcgcttcaggcatcatggcgtggtttgtttcagcagtaattatgaactttacgcggatatgtccaaccgggtaatgaacacgcttgaagagatgtcgcctcgtagcgaaatatactccattgatgagatcttttgcgatcttaccggggtacgtaattgtcgcgatctttccgattttgggcatgaaatgagagcgaccgtactgcaacgcacccatctgaccgtcggggtgggcatcgcacccacaaagacgctggcgaaactggcaaatcacgcggcaaaacgctggcagctccagacgggaggcgttgttgatttatccaatgtggatcgtcagagaaagctgatggcggcgctacccgtcgaagacgtttggggtgtaggacgtcgcatagcgaagaagcttgagatgatggggattaagaccgtcctgcaactggcagacaccgatatccggttcataagaaaacatttcaatgtcgtgctggagagaacggtgcgtgaattacggggcgaaccgtgtcttgaactggaagagtttgccccggtaaagcaagaaatcgtctgttcgcgctcgtttggcgaacgcatcaccgaatatgacgatgtacgccaggccatctgtagttatgccgcccgggcagcagaaaaacttcgcaatgagcatcagcattgccgctttatctccgtatttgttaaaacctcgcccttcgcgcttaacgagccatattatggcaatagcgcgtcggtaaaactgctcaccccaacccaggatagccgggatattatcggcgcatcagttcgttgtctggatgcggtctggaagaacggccatcggtaccagaaagccggtgtgatgctgggagatttttatagccagggcgtcgcgcaacttaatctgtttgacgacaacgcacccaggaaaaacggccaaaagttaatggatgtattagaccatctgaatgctgaaaatggccgtggcacgctttacttcgcgggacagggtattcagcagccgtggcagatgaaacgggaaatgctttcaccccgctacacaacccgctttgcggatctcctcactgttaagtga

SEQ ID NO: 4572 - DNA, 996 bp, Enterobacter cloacae
ccctgtacatttccaaccgctaatcgctctgcccgccatccgtgcgggcatttttgtttgactacctggcccatcttcatgtttattaaagtcctcggttccgccgctggcggtggtttcccccagtggaactgtaactgcgccaactgtcagggtttgcgcgacggtacccttcaggcgacccctcgcacccagtcgtcgatcatcgtcagtgataagggcaaagagtgggtgctgtgtaacgcctcccccgatatcagccagcagattgcccatacgccagaactgaataagaaagaggttctgcgcggcacgcatattggcggcattattctcaccgatagccagattgaccacaccaccgggctgctcagcctgcgcgaagggtgtccacatcaggtatggtgtacgccggaggtgcatgaagatctttccagcggattcccgatttttaccatgctccggcactggaacggcggcctgattcatcacccgattgcgccgctcaccgcctttagcgtggaagcctgccctgatttgcagtttaccgctgtccccatcgccagtaacgcaccgccctattcgccgtggcgcgaccacccgctgccggggcataacgtggcgctgtttatcgaaaaccgccgcaacggtcagacgctgttctacgcaccgggtctcggtgaacccgatgacgctatcctgccgtggctcaaaaaggcggactgtctgctgattgacggcaccgtctggcaggacgatgaactccaggccaccggcgtcgggcgcaataccggccgcgacatgggccatctggcgctcggcgatgaacacggcatgatggcgctgctggcctcgctgccggcaaagcgcaagattctgatccacattaataacaccaacccgatccttaacgagcagtcgccgcagcgtcacgcccttgcgcagcagggaatagaagtgagctgggacgggatgaacatcacgcttcaggactaa

SEQ ID NO: 4573 - DNA, 1209 bp, Enterobacter cloacae
cggcgagcattgccactgccacgctggtctggattttatggcgcttgctgcgcctgcgcatcaccgcccgtatggcccttaagaacgccactggcaacaagtaatgactatttttcaggagaggttatgagtcagcaggatgccgccaaagagcaggccaacacccgtaaaaacgtgcgcgtcgtgtccattttcaccgccgcggctatcggcattgtcggggtactggtgatcctttatgcctggcagctgcccccgttcacgcgtcatgcccagtttaccgataacgcctacgtgcgcggccagactacgttcatcagtcctcaggtaaacggctacattaccgaggtccatgttcaggatttcgcgcaggttaaaaaaggcgagctgctgttgcagatagatgaccgtatctatcgccagcgcgtccatcaggccgaggcgcagctggcaatgaaaattgcagctcttaataacaacctgcaacagcgcagaagtgcggaagcggtgattgccaaaaacgaggcggcgctgaaaaacgcccgtgcccaaagtctgaaaacccaggcggatttgaaacgcgtgaaagagctgaccgcggacggctccctttccattcgcgagcgcgattcggcactggccagtgccgcccaggggagcgccgatatcgaccaggcgaaagcaacgcttgagatgtcgcgtcaggatttacaaacggttatcgtcaatcgcggctcgctggaggccgacgttgagaatgcaaaagccgcgctggagctggcgcagatcgatctgcaaaacacccggattgtcgcgccgcgtgatggtcagctcgggcagattgcagtgcgtctgggggcttacgtcgccgccgggacgcaccttaccacgctggtcccgccgcagcactgggtgatcgccaatatcaaagagacgcagctggcgaatttacgcgtcggacagccggtgaaattcaccgtcgatgccttaaacgataaagcctatcagggccgcgtggagagcatatccccggccacaggcgtcgagttcagcgctatcaccccggataacgccacgggcaactttgttaaaatcgcccagcgcatcccggtacgcattgaagtactcggtgagccggaggcgtaccggctgctgcgccctggcatgtcggtgcaggtgaccatcgacacgcgggaggcgaaacaatga

SEQ ID NO: 4574 - DNA, 858 bp, Enterobacter cloacae
aggtatcgcttacggcccggaagtggctaccaaagcgcagtccgacgcgaaagccgctatcgacagcctggtcgctgcctaagatctccccctctcaccgcccggtgggagggtttttcttttcctgcatatttcgtatcatccgcacccactctccagcccggcggcctgatgtctgtcattatcgatacgtttattgcaccaccctgtcacgacgacattgagatcctctggcaggacgagcatctgctgctgatcaacaaaccttccggcctgcttagcctctcgggaaaaaatccgcaaaaccgtgattccgttcaccatcgtctggtgcaaacctttcctggctgcacgctggtgcatcgccttgattttggcacctcgggcctgatggtcattgcgcgtaacaaggcgattaacgccgcgctttgtcaccagttcagccagcgcgccgtgagcaaggtttacaccgccctgttgtgcggacatgtggaacaggacgaagggaccgtggatgccccgattgccaaagatcaggcactgtttccgctgatgacgatctgtgcccgcaccggtaagcccgctcgctctcgctatcgggtgatggaacgtatttatcaggatacgacaatgccattgacgcgggtagagcttaccccggagaccgggcgcacccaccagctgcgcattcactgccagcagttaggccaccctattctggggtgcgatctgtatggtggtctggaatggccgggcgcggaagaaacgccccggctgatgctgcatgccagcgttctgaattttattcatccgctgagcggcgagacgataaacgcctgtcacgccgcgccattctga

SEQ ID NO: 4575 - DNA, 1041 bp, Enterobacter cloacae
aaggttcttctcatgaaaacattgctcccgacatcgacggctggcagcctgccgaaacccacctggcttgcgcagccggaaacgctctggtcgccgtggaaactccaggacgaggaattacttgcagggaaacaggatgcgctacgtttgtctctggatgaacagattcgcgccgggattgatatcgtcagcgacggggaacaaactcgccagcatttcgtcaccacctttattgaacatctcagcggcgtggattttgagaaccgtcagacggtacgcatccgtaaccgttacgatgcgagcgtgccgaccgtggtagacgcggtggcgcgtcagaaaccggtgtttgttgacgacgcgaaatacctgcgccagctgacggacaagccgatcaagtgggcgctgcccggcccgatgaccatgatcgacacgctatacgatgctcactataaaagccgtgaaaagctggcctgggagttcgcaaaaatccttaatcaggaagcccgcgagctggaggcggccggtgtcgacattattcagttcgatgaacctgcctttaacgtctttttcgacgaggtgaatgactggggcattgccgcgctggagcgcgccattgaaggactgaaatgcgaaaccgcggtacatatctgttacgggtacggcatcaaagccaatacggactggaaaaagacgctcggctccgagtggcgccagtatgaagaggcatttccaaagttgcagacctcaaagatcgatattatctcgctggagtgccacaactcgcgcgtgccgatggatctgctggagcttatccgtggtaaaaaagtgatggtcggggcaattgacgtcgccacccagaccatcgaaacgcctgaagaggtcgccgatacgctgcgcaaggcgttgcagtttgttgatgcagataagctctatccgtccaccaactgcggtatggctcccctttcccgccaggtcgccaacggtaagctgaaggcgttaagcgccggggctgacattatccgtcgcgagcttgcccgctaa

SEQ ID NO: 4576 - DNA, 2502 bp, Enterobacter cloacae
cgctggtggcgcgccagcagggtgacttctgacacacctctttcttgccgggtgtcgctccgcttacccggcttacaactacctgaccgggggtgtgatgcacccccgctcttttttaacctggcaagactgacaaacaacctggcagatgcaggcaaacgcttttcgtgcgcgcctgtcaggataacgctgacactacacaataaacacaacaagatgaggtctgcgatgggaagcaattcttctttttctgcccgtagaacggcactggccatggccgttgcgctctgttgcgcctggcaatcccctgtttacgctcacggcagcgaggcgcatatggtcccgatggacaaaacgcttcaggcgtttggcgcggacgtgcagtgggatgattacgcccagatgttcaccatcgtcaaagacggtgcctttgtgaaggtcaaacccggcgcaaataccgccatcgttaacggcaaaccgctgacgctccaggtgcccgtggtgatgaagaacaataaggcgtttatcccggagacctttatcaacgatgtctttcagtccggtcttgatcagacattccaggttgaaaaaagcccccacccgttaaacgcgctgacggctgatgaaatcaaccaggccgtagcaatcgtgaaagcctcagcggattttaaacccaatacccgctttacccagattgcgctggcggagccagaaaaggccaaagtctgggactttgtgcttaacggcacggcggtggatgcgccccgccaggccaatatcatcatgcttgatggtaaacacatcatcgaaagccgggtggatctgaaggagaaaaagatcctccgctgggagccgatcaaagacgcgcacggcatggtgctgctggatgacttcaataccgtgcagcagatcatcaatgaaagcccggagtttgccgccgtgctgaaaaagcgcggcattaccgacccgaagaaagtgatcaccaccccgcttaccgtcggcttttttgacggcaaggatgggctgaaacaggaagaccgcctgctgaaagtgatcagctatctcgacgtgggcgacggtaactactgggcgcacccgatcgaaaacctggttgcggtggtggatctcgagcagaagaaaatccagaagattgaggaaggcccggtcgtgccggtgccgctcacgccgcgcccttatgatggccgtgaccgcgttgaaacggtgaaaaaaccgctggagattatcgagccggaaggcaagaactacaccatcaccggggatagggtgcactggcagaactgggattttcatctgagcctggactcacgcgtcggcccgataatctccaccgtgacctataacgacaacggcaaaaagcgacaggtgatgtatcaggggtcgctcggcggcatgattgtgccgtacggcgacccggatatcggctggtactttaaagcctacctggactccggcgattacggcatgggtaccctgacctccccgctggtgcgcggcaaggatgttccgtctaacgccgtgatgctcaacgaaaccatcccggattacaccggcgcgccaatggagatcccccgggcgatcgccattttcgagcgttacgccgggccggaatataagcatcaggaattaggaaaacccaacgtcagcaccgaacgccgcgagctggtggtgcgctgggtcagcaccgtgggtaactatgattacatcttcgactgggtattccacgaaaacggcactatcggcattgatgcaggggccacgggcattgaagcggtgaaaggcgtgcagacgaaaaccatgcatgatgccaccgcgaaggatgacacccgatacggaacgctgatcgaccataatattgtcggtaccacccaccagcacatctacaacttccgtctggatatggacgtggacggcatcaacaacaagctggtggccatggatcccgacgtcaaaccgaacaccgctggcggaccgcgcaccagcaccatgcaggttaatcagtatgatattgataccgaacagcaggcggcgcagaagtttgacccgggcaccatccgcctgctgagcaataccagcaaagagaaccgcatgggcaacccggtctcatatcagatcatcccttacgcgggcggtacacacccggtagcgtccggcgcgaagtttgccccggacgagtggatttatcaccgcctgagctttatggataaacaactgtgggtaacgcgttaccatcccgacgagatgtacccggagggaaaatacccgaaccgttccacgcacgataccggcctcggccagtacagcaaagataacgagtcgctgaacgaccaggataacgtcatctggatgaccaccggcaccacccatgtcgcccgtgccgaggagtggccaataatgccgacggaatgggtgcacacgttgctcaagccgtggaatttctttgacgagacgccaacgctcggcaagaaaaaagagcagaaataa

SEQ ID NO: 4577 - DNA, 2037 bp, Enterobacter cloacae
cacactttcaccaggattcgaagtctccacaaacaacgtcacagtttactgagaggttttaggatgagaatcaatgagatcgtcaggagtctcgcgctggcgggatgttttatttctaccagttccgcctgggccgcagaagcacctaaggatgccagcgcagcaacgcaacaggccaacaacgcactcttcaaccagcttcctttctccgataacaccgattttaccaacgcccacaaagggtttattgccccgctgcctcaggaaattatcaaaggggagcaaggcaacaccgtctgggatcctcagcagtacgcttttatcaaagaaggcgataaggcgcccgactcggttaacccgagcttatggcgtcagtcccagctgatcaacatcagcggtctgtttgaagtgaccgaaggcgtctaccagatccgtaacctcgacctgtcaaacatgactattattgaaggtaaagaaggcattaccgtggtcgacccgctggtgtcggcagaaacggccaaagtcgggatggatctttactataaaaatcgcggtaacaagcctgtggtcgccgttatttacacccacagccacgttgaccactatggcggcgtgcgcggcgtggtggatgaagcagatgtgaagtccggcaaggtgaaagtctacgcgcccgccggatttatggaggccgccgtcgcggagaatatcatggcgggtaacgtcatgagccgccgcgccagctatatgtacggcaacctgctgaagccggatgcgaagggccaggtcggcgcgggtttcggcaccaccacctccgccgggacggtgaccctgatcgcaccgaccaatatcatcgagaaagatggtcagaaagaggtgatcgacggcctgacctatgattttatgctcgcgccgggatcggaagcgccttctgagatgctctggtatatcgaagagaaaaagctgatcgagtctgcggaagatgtcacccatacccttcacaacacctactccctgcgcggtgcgaaaattcgtgaaccgctgccatggtcgaaatacatcaaccaggcaattgtacgctggggtgataaggccgaagttatcatggcgcagcaccactggccgacctggggcaacgagaatgtggttaacctgctgaaaagccagcgcgacctgtatcgctacattaacgaccagaccctgcgcatggcgaatgaagggctgacgcgtgacgagatcgccgccaacttcaagctgccgaactccctggccaatacctgggccaaccgaggctattacggttcagtcagccatgacgtcaaagccacctacgtgctctatttaggctggtttgacggcaaccccgcgaccctggatgaactgccgcctgaagaagccgcgaagaaatttgtggagtatatgggaggcgcggatgccatcctgagcaaagcgaaaaccgactttgaccaggggaactaccgctgggtggctcaggtggtcagcaaagtggtctttgccgatccaaataatcaggccgcgcgaaacctggaagcggatgcgctggagcagctgggttatcaggctgaatcaggcccgtggcgtaacttctacctgaccggcgcccaggagctgcgtaacggcgtggtgaaaggaccgaccccgaacaccgccagcccggacaccgtgcgcgcgatgacgccagaaatgttctttgactatctggcggtgcacattaacggtgaaaaagcggcggatgcaaaatcggtgtttaacatcgacctcggcagcgacggcggtaaatacaagctggaactggaaaatggcgtgctgaaccacacggcgaacgccgaagcgaaagacgctgacgcgaccgtgaccctcaaccgcgatacgctgaataaaatcatcctgaaagaagtgacgcttagacaggcgcaggataatggcgatatcaaagtgaccggcgatgccgcaaaactcgatgccatgctcggttacatggataaatttgaattctggtttaacattgtgaccccgtaa

SEQ ID NO: 4578 - DNA, 1158 bp, Enterobacter cloacae
aggcagcactcgcgggcggaggttccgcccgctcaaggaaaattctcttcaatggaaaaaagacatccagccacacccgaacccgcgacatggcctacccgtaaatcaatggttgttcacgggctggccgtgaacctgccgtggctcgcctttgtgaatgccagctttgcccttatggtcctgctgcgcaattcgctgttcggccatatcgatgccctcctgcacatcagcccgcctctgcggcagatgatagacgcctccatgctgggcgtggtgatcctttccgtggcgctggtgatcatggcctggcgccacatccgcggcgtcagcgccgttttgtttatgtgcagtctgctgtggtcgataagttgttactggtttatcaacgtgttacatcttccgcatccctggcctatattcgttaccctgctgatggccggtatgaccgcgctctattttcacccggtggcactgctctgcttcaccgttccgctatggataagcctgcccgttgccagcatgctgctgaatcaggaaattaattatcgcttcgccgggctgtgggtggtgttcaccttcattctcgtgtgcgggcgctatatcctgttgagttggtttgaagaggcgtggcgtcgcaaccagcagaatcagcgtttaatttcgcggctggatgcgctggcccatcaggatccgctgacgaaaacggccaaccggcgggcgatggagctggtgctggaaaacgccgtggagcaaggcaaacgcttcgcggtgctgatgctggatgtcgactacttcaaactgtataacgacacctatggtcaccaggcaggagacgcgtgtctcgcgagggtggcagaggtgctgaacacctcggtgcgcacgccagaggatgtggtttcgcgctacggtggtgaggagtttgtggtgatcctctttgactgtgaagaaagcgttgctgagaaagtcgccgcgcggatccaggctggcctgcgcaccgcagccattgcgcacagcgcgtcgaaggtgagtgaatgtgtgacggtgagtatgggcattgccggctataccgcaggactggccggcccggaaatcatcgcccgcgccgatgcggcgctgtacagggcaaaggaggccgggcgggatcggtggtcgcgttaa

SEQ ID NO: 4579 - DNA, 438 bp, Enterobacter cloacae
ttcaggaagctgccggtcatcagcccttcaattacccacgccggatcggcgtctttcagcacgatggccgggtttttgccgcccagctccagcgtcacgcccgttagcgtatccgcagccacgcgggcaatctgcttgcccgtcgccgtcgaaccggtaaagcttactttggcaatgcgcgggtgcgaggttagcgccgcgccacagacggcgccactaccggtcaccacgttgaacacgccatccgggatccccgcctcgctcgccagttccgccacccgtaacagggtgagcggcgtggtttccgagggtttgatcacgatggagcaacctgccgccagcgcgggcattactttccacatgccaatcatcagcgggaagttccacggcacaatccccgccacgactcccaccggctctttacgcgtccacgcctga

SEQ ID NO: 4580 - DNA, 951 bp, Enterobacter cloacae
atgcaacaatgcgaaaacagtgacggtgcagcgagaacatcaatggcgtgtgcaagcgaacaggacaattttcagcagtggctggcgcaaattaaccaggtttgtgggcgctttgcggcacgtccgttagagggggcgtttctcggcgaactggaaaccagctatacccaaagtctgaagctgagcacggtgaccgccgcaggcgttaacctttttcgcacccgtcaggagatcaaaaacggcaacgacgcctggttctacaccgtgtttcagctggaaggcagcgccggaatcgaacaggacaaccagcgcgcgatgctgaaagccggggatatcacgctgattgacgcctcccgcccgtgctccatttactggcaggagcgttcccgccagatttcgctgctgctcccgcgacaaatcattgagcaacacgcgcgttttcaggaagtgaggtgcgcgctgcccctctccagcagtctgcctaccgtacagctgagctaccgactgctacaggagagcatgggcaatgccgatctcagcgccagcgaaagcgaagcggcgctggaggcgatggtgtgtctgctgcgtccggccttccagcagcaacacgaggtgctgccgcgcaaggagcgtcagttccgccacgttctgtccctgattgatgatcatattcagtcagaggcgttaagaccggagtggatagcttcagagagcggcatgtccgtgcggagcttgtaccgcatgtttgccgggaaagggctggtggtggcgcagtatattaagaaccgtcgcctcgatttatgcgctcaggcgctgcgttccatcagcgatgacgaaaagctggcgggcattggctacagctggggctttaccgaccatagccatttttccaccgcctttaagcagcgtttcggggtttcgccgggcgaataccgtaagcgttaccgctag

SEQ ID NO: 4581 - DNA, 1020 bp, Enterobacter cloacae
cgtggttccaaaatcactggagaaagtcttatgaaactcgcggtatatagcacaaagcagtacgacaaaaagtatctgcaacatgttaacgagacgtacggtttcgatcttgaatttttcgactttctgctgactgaaaagacggctaaaaccgctcacggctgcgaaggcgtgtgtatcttcgttaacgacgacggtagccgaccggtgctggaagagttgaaaaaacagggcgtgaaatacattgccctgcgctgcgcgggctttaacaacgtcgatctcgatgccgccaaagagctgggtctgaaggtcgttcgcgtcccagcctattctccggaagccgtggctgaacatgccgtcgggatgatgatgtcgctcaaccgtcgtattcaccgtgcctatcagcgcacccgtgatgctaacttctctctggaagggctgaccggctttaccatgtacggtaaaaccgcaggcgtgatcggtaccggcaaaattggtgtggccgccctacgcatcctgaaaggatttggcatgcgcctgctggcgtttgatccgtacccaagcgccgctgcgctggagctgggcgtggagtatgtcgatctgaaaacgctcttctcgcagtctgatgttatctccctgcactgtccgttgaccccggaaaactatcacctgcttaaccagtcggcgttcgaccagatgaaagacggcgtgatgatcatcaataccagccgcggtggactgatcgactctcaggccgctatcgaagcgctgaaaacgcaaaaaattggcgcgttgggtatggatgtgtatgagaacgaacgcgacctgttctttgaggataaatctaacgacgtgattcaggatgacgtgttccgtcgcctgtcggcctgccacaacgtgttgttcaccggccaccaggcgtttttgaccgccgaagcgctgatcagtatatcggaaaccacgctggggaatttacagcagcttgataagggcgaagcgtgccctaacgcgatcgtttaa

SEQ ID NO: 4582 - DNA, 840 bp, Enterobacter cloacae
aatatggcattcgtaacaacgaaagatggtgtcagtatttattacaaagactggggtccgaaggatgcgcagccgatcgttttccatcacggctggccgctgagcgccgatgactgggataaccagatgctctttttccttgcagaaggcttccgcgtcatcgccctcgaccgtcgtggtcatggtcgttccgatcaggtaagtgaaggtcatgatatggatcattatgcctccgacgcctcggccgtggtcgaaagccttgatttgcgtaatgcagtgcacgtcggccactccaccggcggaggccaggtcgccagatacgttgcgaagtacggccagcctcaggggcgggtggccaaagcggtactggtcagcgccgttcctccgctgatggtaaaatcagacacgaaccccggcggaacgcccattgaggtgtttgacggcttccgccaggcgctggccgctaaccgcgcccagttttacctcgacgtcgccagcggtcctttctatggatttaaccgagacggagcagaggtttcgcagggcacaatccagaactggtggcgtcagggaatgatcggtagcgccaaagcccactatgaaggcattaaggcgttttcagagaccgaccagacggacgatcttaaagccattacggttcccgtccttgtgttgcagggtgatgacgatcaggtcgtcccctataaaaatgccgcccttctacaggataagctgctcgcaaacagcgaactcaaaatttatccaggcttcccgcatgggatgcataccacgcatgcagataccataaacgccgatatactgacatttattcgctcataa

SEQ ID NO: 4583 - DNA, 696 bp, Enterobacter cloacae
ctggaggtttctatgtgtggacgttttgcacaagcccaaacccgtgaagaatatctggcttacctggccgacgaaggcgaacgcgatatcgcatatgaccctgaacccattggccgctacaacgttgcgcccggtaccaaagtgctgctgttaagcgaacgtgacaaacaactgcacctcgatccggtattctggggctacgcgcctggatggtgggacaaagcaccactgattaacgcgcgtgtagaaaccgcagccaccagcagaatgtttaaacctctttggcagcatggccgggcgatctgctttgccgatgggtggttcgaatggaaaaaggaaggcgacaagaaacagccgtattttattcatcgggccgacgggcagccgatattcatggcggcgatcggcagtacgccgtttgagcgcggcgatgaagccgagggatttctcatagtgacctctgctgcggataaaggcctcattgatatacacgatcgacggccgctggttctgtcgccagaagcagcaagagaatggatgcgacaggatgttggcgggaaaaaagcggaagagatcattgccgacggtacagtacccgccgacgagtttatttggcatgctgtaactcgcgccgtggggaacgtgaagaatcagggggcggagttaatcgaggtggctcataaaatggaaaaataa

SEQ ID NO: 4584 - DNA, 852 bp, Enterobacter cloacae
tgggaagcaggacgctaccggtataagctgcgaaatcattttcaggtcgagggtatgattttgaatgatatcgcaatcattgcgctggcaggctttactaccggtattaccaccgtgctttttggctttggcggcggctttgtcgtagtgccattcgtttatcaactaatgctacggcagaccgaactggcactaaacgccatgcatatcgccgttgctacctctacatcggtgatgatatttaacgcgggctgggtcacctatcgaaactggcgagcttgcgagctttcatcgcaaatgttattcccgttactatggtttatagccattggggctatcgtgggttcctgtctggcaggaatatttagtgagagtgttgttcgcgcgctgttcattttctacatgctgacaacaatcagcgattgtttgttgcgtaagggttttctcggaggaagttctctgcgtcgcttgtcatttcctgtagtaacgggcggcggagtaaccattggtatgatagccgcattgcttggcgtgggcggaagcgtaatgacggtacccctgttacggcgccatggttatgcgatgcgtgaatgcattagtgcttctaatccgctttccctgcccgtcgcgctatgtggtgccgtgacgtatgcagttattggctggcaaactattcctgtgaaaggatttctcggttttatcaacctgaaaattttaggtatgttggtactaacaggctgggcaggaatagtttttagccgtcgggttatacctgctgtacctgatatttggcacgcacgaatctatgtcatgctgctgttcctggtgttactggcgatgctatttcagtaa

SEQ ID NO: 4585 - DNA, 609 bp, Enterobacter cloacae
caccctgcgctgtctcgatcgtcgcactggccgcacggtagcaccgtaatgtcgacgccgtgtgacgttaagctccgtccgctggagcgcgaagatttacgctttgttcaccagctcgacaacaatgccagcgtgatgcgctactggtttgaagagccttatgaggcgtttgtcgagctgtccgatctctacgataagcatatccacgatcagagtgaacgccggtttgtggtggagtgcgaaggtgaaaaagccgggctggttgaactggttgagatcaaccacgttcaccgtcgggcggaatttcagatcattatctcaccggagcaccaggggaaaggtcttgcgtcgcgagcggcaaagctggcgatggattacgggtttaacgtcctgaatctctacaagctttaccttatcgtcgacaaagagaacgaaaaagcgattcatatctaccgtaagctgggctttatggtggaaggtgaactgatccatgagttctttattaacggcgaataccgtaacaccatacgcatgtgcattttccagcatcagcatctggccgggcataagtcctcctccgccagcctgcttaaacccaccgcgcagtaa

SEQ ID NO: 4586 - DNA, 2325 bp, Enterobacter cloacae
gtcatgtccgaagttgaacatcacggcgggataagccgtcgaactctggttaaatctactgccataggatctctggcgcttgccgccggtgggatcgcattaccttttggtctgaaaagcgccgccgccgctgtgcagtccgctattcagcccgcagaagataaagtcgtctggggcgcctgctcggtaaactgcggtagccgctgcgcgctgcgtctgcacgttcgcgatgacgaagtctattgggttgaaacggataataccggcgaggatgtttacggcaaccatcaggttcgcgcctgcctgcgaggccgttcaattcgccgtcgcatcaatcacccagaccgtctgaactatccgatgaaacgcgtgggcaaacgcggagaaggcaagtttgagcgtatcacctgggaagaagcgctggacaccatcgccgcgagtctgaaaagcgtggtcgaaaaatacggcaacgaagcggtctacattaactactcctccggaattgtaggcggcaacatcacccgttcctccccttacgcctcgctggtcgcgcgcctgatgaactgctacggcggcttcctcagccactacggcacctacagcaccgcgcagatcgcctgcgcaatgccctacacctacggcagcaacgacggcaacagcacatcggatatcgaaaacaccaaactggtggtgatgttcggcaataatccggcggaaacgcgcatgagcggcggcgggatcacatacttccttgagcaggcgcgcgaacggtcaaacgcgcggatgatcgttatcgatccgcgttataccgacactgccgcagggcgtgaagacgagtggatcccgattcgtccgggcaccgatgccgcgctggtggcaggtattgcgtgggtgctgattaatgaaaatctggtcgatcaacctttcctcgataaatactgcgtgggttatgacgaaaaaaccctgccggaaggcgcaccggctaatggtcattacaaagcctatattctcggccagggtgatgacaaaaccgcgaaaactccggattgggcgtctcgcataacgggcatccctgccgaacgcatcattaagctggcccgtgaaatcggttcggcgaaaccggcctacatttgccagggctggggcccgcagcgtcaggcaaacggggagcaaacgtcccgcgccatcgccatgctgccgatcctgaccggcaacgtcggcattaacggcggtaacagcggcgcacgcgaatcgacctacaccatcaccatcgaacgcatgccgctgccggaaaatccggtgaaaacgcaaatctcctgcttcagctggacggatgccatcgtgcgtggaccggagatgaccgccctgcgcgacggcgtacgcggcaaagataagctcgatgtgccgatcaagttcatctggaactacgcgggtaataccatcatcaaccagcactccgatatcaacaaaactcacgacattttgcaggatgagagcaagtgcgaaacgatcgtcgtcattgataacttcatgacctcgtctgcgaagtatgccgatattgttctgccggatctgatgaccgtcgagcaggaagatatcatccccaacgattacgccggcaacatgggatacctgattttcctccagccggttaccgccccgaagttcgagcgcaagcccatttactggatcatgagcgaagtggcgaaacgcctcgggccggatatccatcagaaattcaccgaaggccgtacgcaggagcagtggctgcgctatctgtacgacaaaatggtcgccaaagatccgctgctgccgtcctacgacgcgctgaaaaaaatgggtatttataagcgcaaagatccaaatggacattttgtggcctataaaaaattccgtgacgatccggatgccaatccgctgaaaaccccgtcgggcaaaatcgagatctactccagcaagctggcggatattgcggcaacctgggaactgcaaaaagacgaaaccatcaccccgctgccggtctatacctcaacctttgaaggctgggacgcgcccgagcgcagcaaattcccgctgcagctgttcggtttccactttaaagcccgtacccactccagttacggcaacgtagatgtgctccaggccgcctgtcgccaggaggtgtggcttaaccctgtggatgcagagcaacgaggtatcaaaaatggggatatggtgcgcgtcttcaacgaccgcggcgaagtgcgcattgctgcgaaagtcaccccgcgcatcatgcccggcgtaagcgcgatgggccagggcgctggcatgacgccaacatga

SEQ ID NO: 4587 - DNA, 621 bp, Enterobacter cloacae
ccgatgacaacccagtatggattttttattgattccagccgctgcaccgggtgcaaaacctgcgagctggcctgcaaggattacaaagacctgaccccggacgttagcttccgtcgtatttatgaatatgcgggcggcgactggcaggaggataacggcgtctggcatcagaatgtcttcgcctattacctgtcgattgcctgcaaccactgcgaagatccggcctgcaccaaggtctgcccgagcggggcaatgcacaagcgcgacgacggttttgtggtggtggacgaggatgtctgcatcggctgtcgctactgccacatggcctgcccgtacggcgcgccgcagtacaatgccgccaaaggccacatgaccaagtgcgacggctgccacagccgggtggcggacggcaaaaagcccatctgcgtcgaatcctgcccgctgcgcgcgctggactttggcccgattgaggagctgcgcaaaaaacacggccagcttgctgccgtcgcgccgctgccgtctgcgcacttcacaaagccgagtattgtgattaaacctaacgccaacagccgtccgacgggggacaccaccggctacctggcaaacccgaaggaggtgtga

SEQ ID NO: 4588 - DNA, 723 bp, Enterobacter cloacae
actgattggccgtgggctattttatggtctgcatatgaccgcagggttagcaattgcaggttaacacaggtgcgcggggctacccgcgcgcaagtaaggaaagttgtaatgaatgatgtctcacaccgcgaatcgttcgcgttcagcgcccgggtactgggcgcgctgttttatttcgccccagacagcgagcagatcgcgccgctggtgagtgccctgaccgcaggtgactgggttcaggactggccgctggcggaggaaaacctgctgcctgtcgccagtatgtttaagaccccatcggatgaagcgttgaaagacgcctggcagcgtctgtttattggcccgtatgccctgcccgcccccccgtggggctcggtctggcttgatcgcgagtcagtgctgtttggcgattcgaccctcgcgttgcgtcagtggatgcgtgaaaaccatatcgcctttgagatgcagcagaatgagcctgaagatcatttcggaacgttgctgatgctggcggcatggcttgccgagaacggtcgcgaaacagaacgcgaccagcttctggcctggcatctgctgccatggagcacgcgtttccttagcgtattcgttgaaaacgcggcccatccgttctacaccgcgctgggtaaacttgcccagctgacgctggcggaatggcagtccactttgctgatcccgattgtcgaaaaaacgctgtaccgataa

SEQ ID NO: 4589 - DNA, 291 bp, Enterobacter cloacae
gaaacacgaaatcctgacgcccgcgtttcgatggtgacaacctgggataagaccttcgccgagagcgataaagtcgaccaccgcaaggtgacgttcgagaaccgatacgggatcaccctggctggcgatctgtacattcccaggaacagcggcgaccagatgctggcttctcttctcgtcgttgtgaaatacacctatgtctacactgaatcaaatcccatcccgctccagcgagcatgcatactgggccggtatttatgcccgccagtctgctcgcgtcatcagcaataa

SEQ ID NO: 4590 - DNA, 738 bp, Enterobacter cloacae
cgcatgcgcacagggagacacaccgcaatgcacccattacttaaacgttcgctgctttttgtcggcgcgattatcgtggttctcgctctcctcacctggggaattggactggagacgattaaggcgcgccaggttgacctgatctacctcgggcaacagcacctgattctggtcttttcatcaatgttctttgccctgctggtgggcattccaagcggtattttgctgagccgtccagccgcgcgtggtatcgccgaatatgtgatgcaaatctttaacgtgggtaacaccctgccgccgctggccgttctggcgctggcgatggtggtgattggcatcggtgataaaccggccattatcgccctctttctggcctctctgctgccgattgtgcgtaacacctatgccgggctgtgctctgttcccgcgtcgttgctggaagcggcaaacggtatcggcatgaccaaatggcagcgcctgcgtcaggttgagatccctaacgcgtggccggtgatgctttctggtattcgcattgccactgcgattaacgtcggtaccgcaccgctggcattcctgattggcgccagcagctacggcgagctgattttccctgggatctacctgaatgacttcccgacgctgatcctgggcgcggcggccaccgccctgttcgccctgattctggatacgctgctggcggcactgggtcgactactgagcccgcatctcgcgcgataa

SEQ ID NO: 4591 - DNA, 912 bp, Enterobacter cloacae
caaggagcttctatgagactgttttccggcctgacggcgctatgcgccgccgcgctcttcaccagccaggcgctcgccgcgccgctgatcctggcaaccaagagctttaccgagcagcacattctctcggccatgaccgtgcagtatctgcaaaagaaagggtttcaggtgcagccgcagaccaatattgcaacggtgatttcccgtaacgcgatgatcaacaagcagattgatatgacctgggagtacaccggcacgtcgctgatcatcttcaaccacatcaacaaacgcatgtcgccgcaggagtcatacgagacggtgaaacgcctcgacgcgaagcacggtctggtgtggcttaaacctgccgatatgaacaatacctatgcctttgccatgcagcgcaagcgcgccgaggctgaacatatcaataccatgtctgagatggtggcaaagattgagcagatccgtaaaaccgatccggataacaactggctgctgggccttgacctggaatttgccggacgcagcgacgggatgaaaccgttgcaggcggcctacaagatggagctggaccgcccgcagatccgccagatggatccgggcctggtctataacgcggtgcgcgacgggtttgtcgatgcggggctgatctacaccaccgacgggcgcgtaaagggcttcgatcttaaagtgctggaagacgataaaggcttcttcccgagttatgccgtgacgccagttgttcgaaaagacacgctggaggctaacccggggctggaggaggcgctgaacaccctctcagcccagctcaataacgacgttatcaccgacctgaataagaaggtggatatcgaccatcagtcaccgcagcaggtcgcccgtgatttcctgcgtagcaaacagttgctgtag

SEQ ID NO: 4592 - DNA, 1338 bp, Enterobacter cloacae
acagaatatttacattttcctaccctaatcttgtggtcatacccgtcaccagaaaccacggggatgtttaagcaaggattatgtgtgagccgtacaacgaccgttgatatcgcgccggccagcgacattgatgatttacccgcagcaccgcagccggttcagtttattaaacgtggtaccccccagtttatgcgcgtcacgctggcgctcttctcagcaggtctcgccacttttgccctgctctactgcgttcagccgatcctgccggtcctgtcgcatgaatttggcgtgtcgccagccagcagcagtatttcgctctccatttcaaccgggatgctggcgatcggtctgctgttcaccgggccactttcggatgccatcgggcgtaagcaggtcatggtaacggcgttaatgctggcctccgtgtgtaccttgttgtccaccatgatgaccagctggcacggcattctgatcatgcgcgcgctgattgggttatccctgagcggcgtggcggcggtcgggatgacctatctcagcgaggagatccacccgagtttcgtggccttctccatggggctgtacattagcgggaactctatcggcgggatgagcggacgcctgctcagcggtgtgtttactgatttctttaactggcgcattgcgctggccgttatcggctgcttcgccctcgcttcggcgctgatgttctggaaaatcctgccggaatcgcgccatttccgcccgacctccctgcgtccgaaaacgttatttatcaactttcgcctgcactggcgcgatcaagggctgccccgtttgttcctgaccggtttcctgctgatgggctcgttcgtgacgctgttcaactacattggctatcgtctgatgctttcaccgtggcatcttagccaggcattagtgggtttgctctctgtggcatatctcaccgggacatggagttcgccaaaagcgggcgccatgaccgcgcgcttcggccgtggtccggtgatgctggtatccaccgccgtgatgctgttcggactgctgatgacgcttttctcttccctgtggctgatttttgccggaatgctgctcttctctgcgggcttctttgccgcgcattccgttgccagcagctggattggcccacgcgcgcgccgcgctaaaggtcaggcttcgtcactgtatctgttcagttactatcttggttccagcatagccggtacgctcggcggggtgttctggcataactacggctggaacggcgtgggcggatttatcgcgctgatgctgtgcgcggcactgctggtgggcgcgagcctgcataaacgactgcattaa

SEQ ID NO: 4593 - DNA, 843 bp, Enterobacter cloacae
ttacccccaccagagtgtgatatgcgtaaatctgttgtgttgttactgggaacgtttagcctttttgctggcttttcacatgcggatgatggcgacgatgacgccattagcgccaaagaggtaaagacgctgttttttggtcatgacgatcgtacgcgtgtcaccgatcctaccgaatcgccctgggatgccatcgggcaactggaaaccgccagcggcaatttatgtactgcaaccctcattacgccacgccttgcgctgacggcgggtcattgcctgttaatgccgcctgaaggcaaaccggataaagcgatcgccctgcgctttgtgtcgcaaaaaggaatatggcgctacgaaattcacggtattgaggggcgggtggatccgtcgcttggcaaacgcctgaaaccggatggcgatggctggattgtgccgcccggggcggcctcctgggatttcgggctgatcgttttacgttatccgccgtccgggatcaccccgctgccgctctttgatggcgataaagccgcgctcaccgccgccctgaaagccgccgatcgaaaagtaacgcagtcaggctaccctgttgatcacctcgattcgctgtacacccatacggactgcgtggtgacgggttgggcgcaaaacagcgtgctgtcgcatcagtgcgatacgctaccgggtgatagcggatcgccgctgatgttaaaaaccgataacggctggcagctgattggcgttcaaagttctgcgccagcggcgaaagaccgctggcgcgccgataaccgggcgttgtcggtgaccggttttcgcgaccggctggaagccctggcgcagcagtag

SEQ ID NO: 4594 - DNA, 438 bp, Enterobacter cloacae
cgcggaaaagcagaatcggatgctggagatccttcagttcaaactcgatatcctgtggtcgatgctcgacgcgatgaccatggcctacgcgctacagcgtccgccttatcacacggtcaccgacaaagcggcctggcacacaacccgactggtataagcatgcaaaaaaactccatcgtcgcctttcgtcgcggctatcgcctgcaatgggaagccgctcaggacagccatgtcatcctctatccggaaggcatggctaaactcaatgagactgcggccgcaatcctcgaactggtcgatggccaacgcgacgcggcggctatcattgccatactcaacgaacggttcccggaagccggcggcgtggatgacgacgtcgtagaattcctgcaaatcgcttatcaacagaagtggattattttccgtgagccagaataa

SEQ ID NO: 4595 - DNA, 2298 bp, Enterobacter cloacae
aacccgggaactgtaacgataatgaccatccgcatcgtggaactggcaggcggtttacgcgcaacgctggtgcatcagccgcaggcgacacgcgcggcggcgctggcgcgcgtgagtgccggaagccatcacgagccaccgcgattcgccggtctcgcgcatttgcttgagcacctgctgttccgcggtagccagcgctatcagggcgatgatcgactcatggcctgggtccagcgccagggcggcaacgtcaatgccaccacgctggctcgccacagcgcttttttcttcgacgttgccgccgataacctgtccgacggcgtcgcgcgactgcgggatatgttgcaggcgccgctgctttcccggcaggacatccagcgcgaagtggcggtcattgatgcggaaaaccggcttatccagcagcatgatcccgcccggcgcgaagccgcggcgcgccacgcgatggaacaaccggaggtttttcgccgttttcaggtgggtagccatgattctctggggcaagacacgggatcgctgcacgccgcgttgcgcggatttcatcgccgctattatggggccagacacctgcaattgtggctacagggaccgcaaacgctggatgcgttagccgagcttgcccatacgtttgcgacaggttttgcttcaggtggcgtgcctgaagccgcccccccgttacgccttagcgctgaagcagattatcagctggcagtgacggagcgacccgcgctgtggcgctgtccgttgatccgaaaaagtgacaacgtcaccttgcttcgggaatttttgctggacgaggcccccggaagcctgattgacgggctgcgggcgcgcgggctggcagaagaggtatcgctggactggctttatcaggatgacgattacggctggctggcgctaacgcttgacggcgaacggcccgaggccatagacgcgcaaatcacgcgctggctgcgggccctacagcaaacgacgcaagagcaacagcggcattattataggctggcacagcagcgctttagcgccctgtcgccccttgaccagcttcgccagcgggcgtttggttttgcgcccggcgcggcgccggttgatttttccgccttctgtgccgacttactggcggcgcccacctcgtatctggcctgcaaaaaaatggaaaccgctgaaattatcgccagccagggatttgccctgccgcttagccactggcgtcgccagccggttgcggatgagagccccatcgcgttttccttctacccgcaggctacccaatattctgccccagccctgacgccagaagccgttccgctgctgcatttaccggcgcaggcacaagcgccgacgctgatcctccgcaggcctttttattcgcgcgtaagcgagtcacagggggtggcgatcggcaaacaattacgccctcttctagctgaaatgcgccatatcggcagcagcggcgagtggcaaacggttgacggtagctggcagctaaccctgcggcttcctgacgccgtggtgatggcggaacccatcatcggggcgataatcgatcgcctctcccgccccacaccggctattacgcctgcgccagatggcattgcgatccgtcagttgcttaagcaattgcctgaacgactggcatcggaaccgtcacggaatggctggctggcggcgttagctggcggcagcgccggacacgcgcacgggttagcccggcagcttggcctgctccgggcgccggttaacgctaagccgttgccgttaagcgattgtcccggcggggtcgaacacattccgcacgccagcgcggattcggcgctgctggtgtttattcccctgccgccgggtgcgtcgctcgccgcgctgcggctgctggcgttatgctgcgaaccgcgatttttccagcgcctgcgcgtggaacagcagattggctacgtggtcagctgtcgttatcagcgtattgccgatcgcgatggcctgctgctggcgttacagtcgcctgatcgttctcccgtgaacctgttgggttgctgcaaacgatttttgcgagagctgacgctgtgcgatgaatccgagttcagcctattgcgacagcagctggcgacgcagatccgctcaccgatggatgccagcgccacggcagtggccgccctgcgccagcgctatggtttgccggtgttaacgccgcaggctattgatgccctgcaacctgacgagatagtcgcgctatggcgcgagatgactcgccgtcgccgtcgctggcgggtgcttttcacgggctga

SEQ ID NO: 4596 - DNA, 666 bp, Enterobacter cloacae
ataaagtgtcaacaagcaacggggcaaccccctcaatcaaatacaaaacaggaatttcccatgagcaaagtattagtattgaaatccagtattctggcagggtattcacagtctggtcagctgtctgactatttcgttgaacagtggcgtgaacagcacagcgcggatgaaatcaccgtgcgtgacctggcagcaaacccaattcctgtgctggacggcgagctggttggcgcgctgcgtccgagcgatgcgcctcttaccccgcgtcagcaggaagccctggcgctttccgacgagctgattgctgaattgcaggcgcacgacgttatcgtgatcaacgccccaatgtacaacttcaacattcctacccagctgaagaactacttcgacctggtggcgcgcgctggcgtaaccttccgttacaccgagaacggcccggaaggtctggtaaaaggtaaacgcgctatcgtcctgaccagccgcggcggtattcacaaagataccccaaccgacctggtggcgccgtacatgaccctgttcctcggcttcatcggcattaccgacgtgaactttgtgttcgctgaaggtatcgcttacggcccggaagtggctaccaaagcgcagtccgacgcgaaagccgctatcgacagcctggtcgctgcctaa

SEQ ID NO: 4597 - DNA, 1299 bp, Enterobacter cloacae
ataagtcgtcgctcctctaacaacgcggtaaatatgatgaataaagccaccactctctcagctaatattacaacacgctctaactggcactggcaggataacatctggacgctgggcctctacggtacagccgtcggggcgggaacgctgttcctgcccgtggaaatcggcacccgtggtccggttattttcctggtcatgctcctgctggggctgccgttatccctgatcccccatttactcctctgtcgcgtgtatatgcgtgaggaaaagactgaaaacggcacgttgccgatcttcggctccttcttcagcggacggggtgaaaagctgatcaccctgttctattgtgtgaccttcttcccggtaaccctggtttacggggtggcgctgattaatgcgctgagtaatttactggtggagcatctgcatattaccgccctcagccgtgggccattgtcgtttatcgtggttgccgcactttatgtggtgcttagcaagggccgggacagagtcgtggccattatgagcgcgctggcgctgccgttcgcggcatctgtactgctgatcgccgtatcacttatcccgggatggcatctgtctaacctgaccgatacggccgctgaaatgaacgccacgccgctgccggtaacgctgaaaaatatctggctgacgctgccgcttattaccttctcgttttgctgtgcgcctatggtctccccgctgacctcttactaccgggagaggaaagcggagggcgagaaaaaggcactgttcgtgatccgcatcgcctatttagccatcttcgccagtatcctctttttcgtgctgagctgcgtgctggggatcccgcatgacaactttgtacgggcgaaggcggaaaacctgaatgtgctgtccgtgatgaaaggaaacggtgatttcagcctgatttaccacattgccccgctcatcgctatcatcggtatgacgaaatcctttctcggcgtaggcctgtcggtcgcacaaacgtttggtcagctggctgccagcgtatccggcaaaaaggccagcgccagcaagcggctggcctctctggcgctgttcctgctgacctatggcattgtttatgccaatccggatgtgctcagcctgattgaaatgttctgcggaccactgatcgcggtgatcctgttccttatccctgcgtacctcatatacacccgcccctcgctggcggagcttcgcggcgtgacggggtttctggttgttctgggcggactggcaacgctgtctgcattgctctggacaatgctttag

SEQ ID NO: 4598 - DNA, 246 bp, Enterobacter cloacae
acaatcatgtttgtggaactggtttatgacaagcgaaacgtacaggggctggagggagccagggaaatcatcctgaccgagctgacaaaacgcgtgcaccggatttttcctgatgccagcgtgacggttaagccaatgcaagcgaacggcctgaacagcgacgccagcaaaagcgaccgtgaaaagcttaaccgcatgctcgaggagatgttcgaagagtcggatatgtggttgatacaagagtaa

SEQ ID NO: 4599 - DNA, 897 bp, Enterobacter cloacae
ccgacatcgtttactcctgtgcacggtatttctccccagagtaggccagcctgcgccagcctgcaatggcgtcatacaaatgttgccttaacgacgtgccggagagcgtgctatgttagtacaacacaaaaagcgttgaggaacagtgagatgattattttagttaccggggcgacagcgggttttggtgaaagcatcacgcgtcgcttcgtcgccaacggacacaaagtgattgcaacggggcgtcgtcaggagcgtttgcaggagctaaaagacgagctgggtgacagcattctgaccgcacagctggacgtccgcaaccgcgccgccattgaagagatgattgccaacctgcctgccgaatggcgtgaaattgacgtgctggtcaataacgctggcctggcgctgggtatggaacctgcccacaaagccagcctggaagactgggagaacatgatcgacaccaacaacaaaggcctggtgtacatgacccgcgccgtgctgccgggcatggttgaacgtaaccgtggtcatatcattaacatcggttccaccgccggaagctggccttacgcgggcggcaacgtctatggcgcgaccaaagcctttgtccgccagttcagtctgaacctgcgcaccgacctgcacggaaccgcgatccgcgtgaccgatgttgaaccgggtctggtaggcggaaccgaattctccaacgtgcgtttcaaaggcgatgacgcgaaagcggataaaacctatgaaaacgcgaatgcgctgacgccggaagatatcaccgaaaccgtctggtgggtcgcgaatttgccgaagcatgtcaacatcaacacggttgagatgatgcccgtcagccagacctatgccggactcagcgtgcatcgcgggtaa

SEQ ID NO: 4600 - DNA, 708 bp, Enterobacter cloacae
ctctctgagaaatcacaacccatggccgctgaatcgcaacttaatcctacccagcccgttaatcagcaaatatatcgcatcttacgccgtgatattgttcgctgcctgatcccaccaggaacgccactctcagaaaaagaggtttcggtacgttttgacgtttcccgtcagcccgtgcgcgaggcgtttattaaactcgcagaaaacggccttattcagatccgcccacagcgcggcagctatgtaaataaaatttcgctttcgcaggtacggaatggctgttttgttcgccaggccatagagtgcgccgtggtgcgtcgcgccgcgtcgctcatcaacgataaccagtgctacctgctggagcaaaacctgcatcagcaacgaatcgccatcgaccgcaaacagttaaacgactttttccagctggacgacgagtttcaccagaaactggcgcagatcgccgagtgccagctcgcgtgggataccgttgaaaacatcaaagcgaccatcgaccgcgtgcgctacatgagcctcgaccatgtttctccgccagagatgttgctgcgccagcatcatgatattttcagcgcgctggaaaaacgcgacgtggaagccgtagataaagcgatgacgcttcaccttcaggaaattagtgagtcagttcagttaattcgtcaggaaaaccgcgagtggttcagcgaagaataa

SEQ ID NO: 4601 - DNA, 372 bp, Enterobacter cloacae
tccgattgtctgcacccgtttaaaggaaacgctatgactacattaagcaaacgcctttgtctggcagccgcactggcactgtcctcgttcgccttcgccgcaacggcatcagccgaaaccagcaaactcatcattgagtctggtgacagcgcgcaaagccgccagaatgctgccatggacaaagaacaatggaatgacacccgcagcctgcgtcagaaagtgaataagcgcgtggagaaagagtgggataaagaagacgtcgcgtttgatgcccgcgacaaatgccagcaaagtgccaacgtcaacgcttactgggagcctaacaccctgcgctgtctcgatcgtcgcactggccgcacggtagcaccgtaa

SEQ ID NO: 4602 - DNA, 927 bp, Enterobacter cloacae
ttaaacctaacgccaacagccgtccgacgggggacaccaccggctacctggcaaacccgaaggaggtgtgagatgggaagtggatggcatgaatggccgctgatgatcttcaccgttttcgggcagtgcgtggccggcgcgttaatcgtgatgggcttcgtctggcttaaggaaaatgatgacaaggccagaatgcgcatcgtgcgcagcctgttttttctctggctggtaatgggtattgggtttatggcttcggtgctgcatcttggctccccgctgcgtgccttcaactcgcttaaccgcgtgggcgcgtcagcgctgagtaatgagatcgcggcgggttcgctcttctttgccgtgggcggtttctggtggctggtgtcggttatcggtaaaatgcccccagctttgggcaaaatctggctggttgtcagccagcttctgggtatcgtttttgtctgggcgatgacccgggtctatcagatagagactgtcccgacctggtatacgggttacaccacgctgagcttcttcctgacgatggtccttgctggtcctctgctggccgcgctgctgctacgcgtcgcaaacgtgacattcaaaggtactcttgccgcgtctgtcagcgtactggcaattatcgtctgcgtggcggtcgtcgtgttgcaaagcaatacgctggggacgatacagagttccatccagcaggccagcgccctgctgccagattatggttcgcttcaggtatggcgcatcgcgttgctggcggcgggtttaggctgctggatctgcccgcttattcgtcgtcaggagccaaaaacactcggcctgtttgcaggtgtcgttctggtggcgctgggtgaactgattggccgtgggctattttatggtctgcatatgaccgcagggttagcaattgcaggttaa

SEQ ID NO: 4603 - DNA, 453 bp, Enterobacter cloacae
tcccgattgtcgaaaaaacgctgtaccgataacagcacctggcttgtccacccgttgtgcaggccaggctcgcacatttttgctgcaacacaacgtcacaactgctatactgtatataattacagtatacgggggtgcacaatggctgttgaaacaaaatttgttgtcgtaagaaaaggtgaagaaaaaatgacatttgccagtaagaaagaggctgacgctcacgacaaactgctcgatatggcagaagcgtttaccgactggctgttgcaaagcggaatgcagatggatgaaacgcaggcggaaaaccttggtctgtatcttgccgagcagaaagagtccgtgcagcatatcctgcgtaccagcaagcttcccgagcgcaatgctgcaacggataaaacagcatcagatgcggatagcagcaaaaaaatccgggccgtcaaagccgcctga

SEQ ID NO: 4604 - DNA, 1257 bp, Enterobacter cloacae
tattcgtatgttgattgcgggcgcgctgatgatttgtcttttagcgattgtgctcgactggttgctgcaccgtttgcaggtggtactgactccgaaggggattcgataatgataaaactggaaaacctcaccaaacaattttcacagaaacacggccagacgtttaaggccgtcgacaacgtcaacctgaacgtgcctgaaggggaaatgtgcgtgctgctcggcccgtccggctgcgggaaaaccactacactgaagatgatcaaccgtctcattacgccaagtagcgggacaatcctgattaacggcgaagacaccagcggaatggacaccgtgaccctgcgccgcaacattggctacgtgatccagcagattggcctgttcccgaacatgaccatcgaagagaacattaccgtcgtgccgcgcatgctgggctgggacaaggcacgctgtaaatcccgtgccgaagagctgatggatatggtggcaatggatccgcataaattccttcaccgctatccgcgtgaaatgtccggcggccagcagcagcgcatcggcgtcatccgcgcgctggcagccgatcctccggtcctgctgatggatgaaccgttcggcgcggtcgacccgattaaccgtgaggtgatccagaaccagttcctggagatgcagcgcaagctgaaaaagaccgtgatgctggtgagccacgatattgacgaagcgctgaagctgggcgaccgtattgccgtcttccgtcagggacgtatcgtgcagtgcgccagcccggacgagctgctggcgaaaccggcgaatgagtttgtcggctcgtttgttggtcaggaccggacgttgaaacgcctgctgctggtatcggcgggcgacgtcaccgaccagcagcctaccattacggtacgcgaatcgacgccgctgccggaggccttcgccaccatggatgacaacgatattcgcgccattaccgtggttgatgagcacggcaaaccgctcggctttgtgaagcgccgcgaagcgcgtaacgccagcggcagctgcggggatattctgcatccgttccgtatgaccggtaaggccgaggataacctgcgcgtggtgctttctcgcctgtatgagagcaacaccagctggatgccgattgtggacgaggacggacgctataacggcgagatatcccaggattatattgcggagtatttgagttcagggcgtacgcgccgggcattaaatattcatagcgagagttaa

SEQ ID NO: 4605 - DNA, 1416 bp, Enterobacter cloacae
gcattcaggccgggtactgcccggcctttttccgcacgcataccttttgctaacctcccgatttcccgccacaatattgtatcgtccccgttaaatcacgacttcatgcaacgtcttcacgcttaccccgacatccgcgcgatgtttcgccgtctcctgattgctaccgtcaccggcgtgctggcggcgctggccgttgcggtgttccgccacagcatgtatctgctggagtggctatttctcagcaacgaaagcggaagtctggtgaacgccgcagccgcgttatcgccctggcggcgggcgctgacgcctgcgctgggtggtctggccgcggggatgctgctgtggggatggcagcgcatgacggcacaacgtccccacgccccgaccgattatatggaagcgcttgagacgggtgacggccagtttgactacggcgccagcctggtgaaatccctcgcgtcgttgctggtggtcgccagcggcagcgccatcggccgtgaaggcgccatgatcctgctcgccgccctcgccgcctccttttttgcacaacgttgtacgccaaaatccgaatggaaactgtggatcgcctgcggtgccgccgccgggatggccagcgcctatcatgcgccgctggcgggcagcctgtttatcgcagagatcctgtttggcacgctgatgctggcctccctcggcccggtggtgattgccgctgtagtggccctgctgaccacgcgcctgttaagtcccggcgcgaatacgctatatgatgtccatctcagcgagatgcttacggcggtggattatttcctgatcgttggcgtgggtctgctggctggcgtttgcggcccgctgctgatgtggctgatggcggccagccacaggctgtttctgcgtctcaaactctcaccgccgtggcagctggcgctgggtggtctgatcgtcgggctgctgtcgctgctgacgccgaaagtatgggggaatggctatagcgtggttcaggcgtttttgcagtcgccgccgctgctgtcggtgattgccggcgtctttatttgcaagctgctggcggtactggcaagcagcgggtccggcgcgccgggaggcgtgttcacgccaaccttgttcgttggtatggcaacgggaatgctgtttgcgcagatctttgcgctgtggtttcctggctctgagacggcgatcctgcttgggctggcgggaatggcgacgctgctcgccgccacaacgcatgcgccaatcatgtcggccttgatggtctgtgagatgaccgggcagtattttttacttcccggtttgctggttgcctgtgttgtggcgtcggtattgtcgagaacgctacgccacgactcgacctacggccagcataccgccgaaagccgagagatcgatgtagtgcgctaa

SEQ ID NO: 4606 - DNA, 1065 bp, Enterobacter cloacae
ataaaaaactgttcaggaacgtccatggccaaacctattatcaccctcaacgggcttaagatcgtcatcatgctgggcatgctggtgatcattctgaccggcgttcgttttgcggccgatatcatcgtgccttttatcctggcgctttttatcgcggtgatcctcaatccactggtgcagcgaatggtgcggctgcgcatcccgcgtgtgctggcgataagcctgcttatcagtattattatcgttgcgatggtgctgttagtcgcctatctgggaacctccctgaacgagctggcgcggacgctaccgacataccgctcttccctggcgaccccgctgctgcaaattgaaccctggctgcaacgcgcgggtatcgaagtctcggttgaagaaatgcttaaatacatcgatccgaatgccgccatgacgattgtcaccagcctgctggcacaactctccaacgccatgacctcgattttcctgctgttcctgacggttgtgtttatgctgctggaagttccacagctgcctgcaaagctccagcacatcatggtgcgtccggtagagggaatgggcgccattcagcgcgcgctcgacagcgtttcacgctatctggtgctgaaaacggccatcagcctggtgacgggattagtggtctgggggatgctcgccgcgctggatgtgcgttttgccttcgtctgggggctgctggcctttgcgctcaactatattcctaacatcggctccgtgctggcggcgatcccccctatccttcaggtgctggttttcagcggtttgtatgatgccctgattctgctggcaggctatctggtgattaaccttgtcttcgggaacattcttgaaccacggataatgggacgcgggctggggctttcaacccttgttgtgttcctgtccctgattttctggggctggctgctcgggcctgtcggcatgctgctctccgttccgctgacaattattgtcaaaattggcctcgagcagaccgccggtggacaaagtatcgctgtactgctgagcgacatgagccataaggccgattaa

SEQ ID NO: 4607 - DNA, 363 bp, Enterobacter cloacae
caggtaacatcagcaatggctctgatccccaaaaactacgcacggctggaaagcggctaccgtgaaaaagcgctaaaaatctacccctgggtttgtggacgctgctcgcgtgagtttgtttattcaaatcttcgtgaactcacggttcaccatatcgaccacgatcacaccaataacccggaagatggcagtaactgggagctgttgtgcctgttttgtcacgatcacgagcactcaaagtacaccgaagcggatcagtatggcaccaccgttgtcgcgggtgaggatgcgcaaaaagacgtgggtgtcgccacgtttaacccctttgccgatctcaaggcgatgatggacaagaagaagtaa

SEQ ID NO: 4608 - DNA, 1038 bp, Enterobacter cloacae
aagacagtgggatgcgctatggcgatttttgatggtcacaatgacctgttgcttaatttatggcttcaccatcgccaggatccggtaacggccttattctccggcattgaaaacggacacctcgattatccgcgcatgcagcaaggcggattttccggcgggctgttcgcgctgttcgtgccgccgcaggagtatatcgcccgcatggcgccacaatacgcctgcgagccgtggcagccggtcgacattctctggcagcagctgacgctccttaagcagcttgtcgcccactccgacggccgggcgcgattgtgcctgagcgcggcggatatcgaacgctgccgtcaggataaggtgctggcgatggtggcgcatattgagggcgcgggcggttttgacggcgagggaggcgatctacaggctttatatgccgccggggtgcgtagcattgggcctttctggaacattgctaaccgttttggcaccggcgttaacggggcgtttcccggcagcccggacagcggcccagggcttaccgcagagggtatcgccctcattaagcacgctaatgccctgaatatgctgattgacgtttcgcatatgaatgaaaaggcgttctgggataccgctcgtcattcctcatcaccgctggtcgccacccactccaacgcccatacgctgtgcccgcaaccgcgcaatctgaccgatcggcagctgctggctatccgcgacagcggcggcgtggctggcgtcaatttcggcaacgcgtttctgcgcgccgacggtaaacgcgatagcgataccccgctgagtacgattgttcgccatatcgactatcttattaacatcatgggtgacgatcatgtcgcgctgggctccgattttgacggtattacgttgcctgatgacttacacgatgtgagtggtttaccacggctaatcagcgcgttgcgtgacagcggctatgatcaatttgtgctgaataagctgctgtggggtaactggcaaaaggtattgcaaaatgtttggcaacaatag

SEQ ID NO: 4609 - DNA, 843 bp, Enterobacter cloacae
cgagcagtcgccgcagcgtcacgcccttgcgcagcagggaatagaagtgagctgggacgggatgaacatcacgcttcaggactaactatgcacattcgcgaaacgctctcgccgcaagagtttgagcacgcccttcgggcgaaaggcgcctactatcatattcaccatccgtaccatatcgcgatgcataacggcgaggccagccgcgagcagatccagggctgggtggcgaaccggttttactaccagacgacgatcccactgaaagacgcggcaattatggcgaactgcccggatccgcacacgcgtcgcaaatgggtgcagcggatcctcgatcacgacggcagcaacggtcatgacggcggtatcgaagcctggctacagctgggcgaagccgtggggctcagccgcgaggacttaatcagcgaacgccacgtgctgcccggcgtccgtttcgccgtcgacgcttacgttaacttcgcccgccgcgccaactggcaggaggctgcatgcagttcgctcaccgaactgttcgccccgcaaatccatcagtcgcgtctcgacagctggccacagcactacccgtggatcaaagaggaaggctatttttatttccgcagccgcctcagccaggccagccgcgacgttgaacatggtctggagctggcgaagcgttattgcgatagcgcggaaaagcagaatcggatgctggagatccttcagttcaaactcgatatcctgtggtcgatgctcgacgcgatgaccatggcctacgcgctacagcgtccgccttatcacacggtcaccgacaaagcggcctggcacacaacccgactggtataa

SEQ ID NO: 4610 - DNA, 1185 bp, Enterobacter cloacae
aattcctgcaaatcgcttatcaacagaagtggattattttccgtgagccagaataaacccgccgtcaatccaccgctgtggctgctggcggagctgacctatcgctgtccgctacagtgtccttactgctctaacccgctggacttcgcccggcaggatcaggagctgaccactgaacagtggattgaggttttccgccaggcgcgggcgatgggcagcgtgcagataggtttttccggcggcgaaccgttgacgcgtaaggatctgccggagctgatccgcgccgcccgcgatctcggtttttataccaacctgatcacctcgggaattggcctgacggaaagcaagctcgacgcattcagcgaggccggtctggaccatatccagattagcttccaggccagcgatgaagagctcaacgctgcgctgacggggaataaaaaagccttccagcagaagctggcgatggccaaagcggttaaagcgcgcgattacccgatggtgctgaatttcgtcctgcaccggcataatatcgatcagatcgataaaatcatcgaactgtgcatcgagctggacgccgacgacgtcgaacttgccacctgccagttctacggttgggcgttccttaatcgtcaggggcttctgccgacgcgggaacagattgcccgcgcggaacgcgtggttgccgaatatcggcaaaaaatggccgccagcggcaatctgaccaacctgctgttcgtcacccccgattattacgaagagcggccaaaaggctgtatgggcggctgggggtcgattttcctcagcgtgaccccggaaggcacggcgctgccctgccacagcgcgcgccagctgccggtggatttcccgtcggtgcttgagcagagtctggaatccatctggtatgactctttcggcttcaaccgctatcgcgggtttgactggatgccggagccgtgccgctcctgcgatgaaaaagagaaagacttcggcggctgccgctgccaggcctttatgctcaccgggaatgcggataacgccgatccggtgtgcagcaaatcgccgcatcatcataaaatcctcgaggcgcgacgcgaagcagcctgtagtgatatgaagatcggtcagcttcagtttcgcaaccgaacccgttctcagcttatctataaaacccgggaactgtaa

SEQ ID NO: 4611 - DNA, 465 bp, Enterobacter cloacae
caacaggacagattccgcatgactgacaacaataccgcattaaagaaagctggcctgaaagtaacgcttcctcggttaaaaatccttgaagtgcttcaggggccagacaatcaccatgtcagtgcggaagacctttataagcgtcttatcgatatgggtgaagagattgggctggcaaccgtctatcgtgtgctgaaccagtttgatgacgcgggcattgttactcgtcataatttcgaaggcggtaaatccgtgttcgagctgactcagcagcaccaccacgatcacctgatctgcctcgattgtggcaaggtcattgaatttagcgatgattccattgaatcgcgccagcgtgaaatcgccgcccgtcatggcatccgcctgaccaaccacagcctgtacctgtacggtcactgtgctgaaggtgattgccgcgaaaatgaacatgcgcacgacgcaaaataa

SEQ ID NO: 4612 - DNA, 240 bp, Enterobacter cloacae
aggaggcgtatagcgcctgtattaaaactgcggaagaatcccccggagaaaattgaagctttcaagagcgtgctgaatgtgttgaaaaaagagaaagcgcatgagcagtttgcgacgcaggaaaatgttcgcgtgatggattaccaggcctgtatccaggcgcggaaaaccggtaacgatcaggaagtggcgaagcgttgcgataagatctggaacgagatacgcaataacaataaataa

SEQ ID NO: 4613 - DNA, 425 bp, Enterobacter cloacae
aaattgactccatgtacaacctgcgcatgtattcacgcatcggtcgtcgtaacccgctctacagcaccgcaattggtaaagtactgctggcctggcgcgatcgcgaagaggtgaagcagatccttgacggggtggagtacaaacgcagcaccgaccgcaccattaccagtacggatgaactgctgagcgtgctggataatgtgcgtgagcagggttacggggaagataacgaagagcaggaagaggggctgcgttgcatcggtgtgccggtatttgaccgtttcggcgttgtcattgcgggcctgagcatttcgttcccaacgctgcgtttctctgaagagcgtcttcatgaatatgtggcgatcctgcataccgcagcgcgcaaaatttcagagcagatgggctataacgattatccgttctga

SEQ ID NO: 4614 - DNA, 356 bp, Enterobacter cloacae
actatggcgacatttcatatcagctttaaaaaattacgaagatcagaaggtaaatcttcggtttatttatctgcatatcaaaaccgagaaaagacaaaagataatcgaaccggggcaacctgggattattcaaaaaaagagggatttttcggctctgctatcctctcccctgccggcacacctgccgaacttgtgaaggactcaggcaccctctggaatgccgtagaggctggcgagaagcgaaaggatgccgaactatgccgttatctggacatagccattcccaaggagctggacgacggccagaagaagcagatcgtcctcgattactgccaagaaaatttcgtggattatgc

SEQ ID NO: 4615 - DNA, 303 bp, Enterobacter cloacae
atgagatatatacatatgtctgaatatattaaagtatttctggcgttatgctcttttgttttcactggtacgctcgcccatgcggccagttcaggtacgatcacctttaccggttcggtgaacagtgaaacctgtgcggcggtggtaaataacggtaatgcagatgcgacagtaacattacccgccgtaccgacatcagcattaagtgcagcaggagcgacagcgggggcaaccacatttacgattaatttaacgggctgtgagttttatccaagcggggcgaaggtccagcgctactttcaa

SEQ ID NO: 4616 - DNA, 459 bp, Enterobacter cloacae
attatgttgtctgccgcgcgtggtgaagaccagatgaacatcccgtatcgctttgccgataacggcggtgcgcttgaagtaccggcagataaagtgcacgagcttcgcctgcgtctcgcccagcaggggctgccaaaaggcggcgcggttgggtttgagctgctggatcaggaaaaattcggcatcagtcagttcagcgagcaggttaactaccagcgcgcgctggaaggtgagctggcccgtacgattgaaaccttaggcccggtgaaaagtgcccgtgtgcacctggcgatgcctaagccgtccctgtttgtccgcgaacaaaagtccccttctgcctctgtgaccgttaacctcgaacctggccgtgcgctggtttccggcggggtaatgcggctccacgaaagccccatcatctgttccaccagcgccgccacgtcgtgcccggcaagacgataa

SEQ ID NO: 4617 - DNA, 477 bp, Enterobacter cloacae
  unsure (58)
ccctctgataacagcgcgatgctggaaaaggcgattgccgcggtggcggctgcaatgnccgatccgtcgcgcgtgaagatgctttgtgcgctaatggacgggcgtgcgtggacggccactgaactgagtgcggcggcagacgttgcgccgtcgaccgccagcgggcatcttgcccggctggttgaagggcagctaattacctgcctgtcgcaagggcggcatcgttattatcgtcttgccgggcacgacgtggcggcgctggtggaacagatgatggggctttcgtggagccgcattaccccgccggaaaccagcgcacggccaggttcgaggttaacggtcacagaggcagaaggggacttttgttcgcggacaaacagggacggcttaggcatcgccaggtgcacacgggcacttttcaccgggcctaaggtttcaatcgtacgggccagctcaccttccagcgcgcgctggtag

SEQ ID NO: 4618 - DNA, 744 bp, Enterobacter cloacae
cgtttactgggcaaaaaagagcccacggtaaacgcaccggttcgtggattatatatgtggggtggcgttgggcggggtaagacctggctgatggacatgttctaccagagcctgcccggcacgcgtaagcagcgtctgcactttcaccgttttatgctgcgggtccatgaagagctgacggcgctccagggcgaaaccgacccgctggagattgtggccgatcgtttcaaggcggaaacggacgtgctctgcttcgacgagttctttgtttccgatattacggatgccatgctgctggggggcctcatgaaagcgctgtttgcgcgtgggatcaccctggtggcgacctcaaatatcccgccggatgagctttatcgcaatggtcttcagcgggcgcgtttcctgccagccatagatgccattaagcagcactgcgacatcatgaatgtcgatgccggcgtcgattatcgtctgcgcacattaacgcaggcgcacctgtggctttcaccgctgaacgccgacacagccagcgagatggataaactgtggctggcgctggcaggggcgccgcgggataaggcgccagcgctggagattaatcatcgcccgttgtcgacgcttggcgtagagaaccagacgctggccgtctcgtttgcaacgctctgcgtggacgcccgcagccagcatgactacgggccgctttcacatctgggtctgaaccagccggatagaatgatatatggt

SEQ ID NO: 4619 - DNA, 339 bp, Enterobacter cloacae
  unsure (97)
  unsure (98)
  unsure (99)
  unsure (100)
  unsure (101)
  unsure (102)
  unsure (103)
  unsure (104)
  unsure (105)
  unsure (106)
  unsure (107)
  unsure (108)
  unsure (109)
  unsure (110)
  unsure (111)
  unsure (112)
  unsure (113)
  unsure (114)
  unsure (115)
  unsure (116)
  unsure (117)
  unsure (118)
  unsure (119)
  unsure (120)
  unsure (121)
  unsure (122)
  unsure (123)
  unsure (124)
  unsure (125)
  unsure (126)
  unsure (127)
  unsure (128)
  unsure (129)
  unsure (130)
  unsure (131)
  unsure (132)
  unsure (133)
  unsure (134)
  unsure (135)
  unsure (136)
  unsure (137)
  unsure (138)
  unsure (139)
  unsure (140)
  unsure (141)
  unsure (142)
  unsure (143)
  unsure (144)
  unsure (145)
  unsure (146)
  unsure (147)
  unsure (148)
  unsure (149)
  unsure (150)
  unsure (151)
  unsure (152)
  unsure (153)
  unsure (154)
  unsure (155)
  unsure (156)
  unsure (157)
  unsure (158)
  unsure (159)
  unsure (160)
  unsure (161)
  unsure (334)
  unsure (336)
tggcgtaactgtgtcagaatagagacttctcttttcacgacgccagaatgtatgaaagcgatcactctttatgacgttgcccgcgtggcaggcgttnnnnnnnnnnnnnnnnnnnnnnnnnnnnnnnnnnnnnnnnnnnnnnnnnnnnnnnnnnnnnnnnnggtccggcaggccatggcggcgctacactatgtgcccaaccgtggcgcgcagcagctggccgggaaacgcacccgcacgctggggctgatgaccagcgatctggcgctacatgcgccgtcgcaaatggcctcaggtcttcacctcgaggggagccggaaccgcgaaagtactntntaa

SEQ ID NO: 4620 - DNA, 426 bp, Enterobacter cloacae
  unsure (7)
  unsure (58)
atcccgntgcgtcacttcccggggctgggcattatcagtaaattgattgtattgtttntgccggcagatgcgtcaatggcggtgatccctgagctcacttcggtgcccgtgcgcatcaccctgctggtttccggcattgtggttaacgcccttgccaccgggatgtatatcggcgcgggttttggcgcaggcccgcgcgacggcctgatgaccggcatacacgcccggctgggctggtcgatccgcagcgtgcgtaccgcgatcgaggtgactgtgttgatcgtcggctacctcctcgggggagcgtttggcgttggaaccgtgctgtatgcattaaccatcggcccgctgatccagctctgtttgccgtggtttcgccagagaccgcgcattcagaaagctgcacagccggagcggattgtttaa

SEQ ID NO: 4621 - DNA, 385 bp, Enterobacter cloacae
ttcgctttgtggagattggcagcgctctttaatgatgattacaatggcaaaaaatttaggtttttccaaagcaacattgcgtaaggtgggagccaatagtgatggtgatggctttttatgctttgctgcacacggaaatagcatggagccagtgatcgctgatggctctactgttgccataaactgccatgacaagcgtatcgttgatggtaaaatttacggcatcaaccaaggtggatggaaaaggttaaaaatcctctacagatctgggccagataaggtgacaatcagaagctataactctgatgaataccctgatgaagaagtagacatggatagccttgaggttttaggaagactgttttgggtatcaacaattttctga

SEQ ID NO: 4622 - DNA, 1290 bp, Enterobacter cloacae
cgcttcttcggtgatgccatgcgccagttgcagccaaaaacgaatgcggtttttggtggccagtatcatattgccggacgtgacgtgacgtacgaacctgccacgcaggcagacggacagttcgctgcaaaaggcgaggtgatcaccgccaaatgggtggaagcagaacagctgttcggctgccttcgtcagttcaatggcgatgtgtcactgcaaccggggctggtacaccgcgcgaatggcggcctgttgctcatttcccttcgcaccctgcttgctcagcctctgctgtggatgcgcctgaaaacggtggtgacgcagcaacgttttgactgggtaggctacgacgattcgcgtccgctgcctgtatccattccgtctatgccgctgtcgatgaccgtcgtgctgacgggcgaccgtgaatctctggctgatttacaggaaatggagccagaactcgcggagcaggctgtctatagcgaatttgaagataatattcagatcgccgatgccgatgacatggcgcagtggtgtcagtgggttatggccgtggcggaacgtttcgcactgccctcgcctgccgaggatgcgtggccgggcttaatccgcgaggccgtacgctacactggcgatcaggaaaccctgccgctctgcccgctctggatcggtaaacagctgcgtgaagtgggggttatcagcggtaacggtccgtttaccggtgagcagcttagccagatgctggcccagcgtgaatggcgtgaaggttatcttgctgaccgtatgcaggatgaaattctgctggaacagattctggtggagaccgaaggcgaacgtatcgggcaaatcaacgccttgtccgtcatcgagttccccggacacccgcgcgcctttggtgagccttcccgtatcagctgtgtcgtacacattggtgacggcgaatttaccgatatcgaacgcaaggccgaactgggcggaaacattcatgccaaaggcatgatgatcatgcaggcgttcctgatgtctgaacttcagctcgagcagcagatccccttctctgcctcgttgacctttgagcagtcctacagtgaagtcgacggcgacagcgcctcaatggcggagctgtgtgccgtgatcagcgcgcttgcagacgtgccgattaaccagaatattgcgattaccgggtccgtggatcagtttggccgtgcccaaccggtgggcggactgaatgagaaaatcgaaggttcttcgcaatctgcgtcttcacccacgggggctggaaggtcatgcgct

SEQ ID NO: 4623 - DNA, 1028 bp, Enterobacter cloacae
agacgggttagtccattgtgccgccttagtaatttttcactagggcagcgcacactattgaagttttgcccggtttgcgctcgtgaagatacttttcattatggtgttacttattggcatctggcgcatcagcttcatggggttacaacctgccatcggcatccggtagcgcttgaaagcatccatgtcccttcttcaccgcacatacgtattggactgatgcctcctgtttcgtatacagaacaacttagcaatgagatagacttcgattttgctaagttttgttatgagtccctaaatataatcagaagaaaagatattacacaccccaattacatggatgtacttaaaaagttgaatttattatcattggatggaaatttaaagaaaaatgtattctacgcacatgtttatgctaagtgccagttatttggggagggttcatcgggacttataccaacatccctaactgattatcattactgggagcctatactcaaagacaaatgttgtcagcatcccacaaagcatcttttgctttgttattgtttgttaaatacttgctggccaacgtatgcaggaagtcgtactaataaaaagaaagaaatctttaaaagtcataagaaatacagttttcatatagttgaaaataatactagtgttagcaaccttgggaaggaatttagtcgcagcagatgttacattaaaacacttatttataaaaaatacctgagggcgtttaagcgaaacacaaaaattaatatattcactgaattgcttatcaagtctatggctgtaagggggtttagtctggcatccatagctgagaaaaactcattatcggaaggagctgtatcctctgtaatttcatcttgttacggtttatgctcatggcgtaaaaaatgtaaaaaagattctttaagacggcgtcataagcagaaaatattaagatttatacataatcaatccgtttctataacacgaaagttagtcaatcttcacgacggggctgaaaggaaacgcgctac

SEQ ID NO: 4624 - DNA, 246 bp, Enterobacter cloacae
accttgcagcccgtggtgaagatgtctgagaaacgtgctcagtctgtagttgattacctggtatctaaaggtatcccagctaacaagatctccccacgtggtatgggcgaatctaacccagttaccggttctacctgtgacaacgtgaaaccacgcgctgcactgatcgactgcctggcaccagatcgtcgcgtagagatcgaagttaaaggtatcaaagacgttgtaactcagcctgcggcataa

SEQ ID NO: 4625 - DNA, 483 bp, Enterobacter cloacae
acagagttacacggtaacactgagatcgcaatgaaatatcaacaactggaaaacctcgaaagcggctggaaatggaagtacctggtcaaaaagcaccgtgaaggggagctgatcacctgctacatcgaagccagcgcggcgcaagaagctgtggatatgttgctgaccctcgaaaacgaaccggtactggtcaacggctggattgagaaacacattaatccggccctgttaaaccggatgaagcaaactatccgtgctcgtcgtaaacggcatttcaatgccgagcatcagcacacccgtaagaaatccatcgacctggagtttatggtctggcagcgtctggccgggcttgcgcaacggcgcgggaaaaccctgtcggaaacggtggtgcagctgattgaagatgccgagcacaaagagaagtatgccagccagatgtcgacgctgaagaacgatctacaggcactgttaggtaaaaaataa

SEQ ID NO: 4626 - DNA, 198 bp, Enterobacter cloacae
  unsure (109)
  unsure (131)
atttccaagcaaattaaaattattggtgaggcggccaggcgggattacaacgtgaccgaagtcgccaatatgctgtacacgtttccagtcgggccgggtttccagcccnggggcaatatcccggcgagtcntgggaggagggagtttagggtattggagatttttatcccgtccgcggcaagcgcctgctgggtatga

SEQ ID NO: 4627 - DNA, 822 bp, Enterobacter cloacae
ggtattggagatttttatcccgtccgcggcaagcgcctgctgggtatgaccgagccaggcaaggcattgctgaccatcgctgagcgcattctcaacgaggccggcaacgttcgccggctggcggatctctttaccaacgacgcttccggtgtgatgactatcgccaccacccatacgcaggcgcgctacagtcttccgacggttatcaaagcatttcgtgagatcttcccggacgtacgtctcgaactgatccagggcacgccgcaggaaatcgaagtgctgatgcataacggcggggccgatatcggtatcgccagtgaacggctgagcaacgacccgctgctggtggcgttcccgtggttccgctggcaccacagcctgctgttacccgccgatcacccgctgaatcaggtttcgccgttgacgctggaagagatcgtcaaatggccgctgattacctaccggcagggcattaccgggcgctcgcgcattgatgaagcgttcaagcgtaaagggctcacgccggacgtggtgctgagcgcgcaggattccgacgtgatcaagacctacgtcgagttagggctggggattggcctggtggccgagcagtctggcggagaatatgaggccggaaatctggtgcgtctggatacgcgtcacctgttcgatgcgaataccgtctggctggggctaaagcgcgggcagcttcagcgtaaatacgtgtggcgttttattgagctatgcaacgcggggctgtcggtggatgagatcaaacgccaggtgatggagccggaagaggtggcgattgattatcagatttag

SEQ ID NO: 4628 - DNA, 219 bp, Enterobacter cloacae
gatacggtcgagtcgatggtccgggcattacgtaccgggaactatagcgtcgtgattgggtggttgcctgaggatctgtcgcaagaggaacatttgcgtctgactgaagcggctgaagaaggtaacgcgatgggtttcatcatgcggccagttcgtggagattcctatcgcagaggacaacatcccgggctaaaaattcactcaaatgtgtaccattga

SEQ ID NO: 4629 - DNA, 426 bp, Enterobacter cloacae
ataacacaaatcttcatggagtttatcatgttcaaatcgatcatgaccgtatcactgctggccgccgctattgcctctaccagcgcagtggccgcagacaattcagcgggtggtatcattaactttaccggcgctattaccgatacaacctgtaccattaacggcggtaaaagcgcagactttaccgttgcgctttcccctatttcggtaaaagatgcaggcaccacggttggcctgatcactaagaataaaaaatctattgcgctgactttctcaggttgttcaccagcagccggaacgaccggcaccccgctgaaagtgtatttctccagcgcggataatatttccactgacggtaaatacctgctgaataacagcgtgaacgaaagcgatgccagcgtggcacgtaatgtcggttttgcgtta

SEQ ID NO: 4630 - DNA, 1026 bp, Enterobacter cloacae
  unsure (1017)
ggttccgggccggcgctgaaaccacggctgcgttctatcggcgctgccgtcgatcctcgacgcgatcgcccacgtgctccggtgaccgcgcggatcggcgcgcgcggtgtccccgcccggttcgaccgcacctcgacgcaccggcgcgggatgctggcgaaggtgcatatcgccaaggtccagttggggatgagcgacgacgactatgtcgcggtcctgctccgcgcgaccgggcggaccagcgcggccgagtgcaccgaccgcgagctcgacgacgcgctgcgcgaattcaagcggcttggcttcgagccacaggcgcgctcgccgaaagcggcgaaaccagcggatcatcctctcgctctgaaggcgcgggcgctgtggatctcgctgcatcacctgtgcgcgatcgccgacccgtccgaaaaggcgctggaggccttcgcgcggcgccagctcggctgcgatcggctccaatgggcgaaccagtcgcagggccaccgcctgatcgaggcgctcaaggcgatcgccgcgcgtcacggctggaacctcgccatggatggggtgaagcctgaggcggtgctgatcgtcaccaagcggcggctggtcgacgcgatcgcccgccaagctgcgcgcgcgcgacatcgtgccggacgggtggagcgagcggaagatcgcacggcagctgaccgggatcgaggtcgactcgatcctgttcgcaaccgacggggaactggaccgcatcgcccaggcgccccggcgccaagctgcgggcggcgatggaggccggggtatgatcgcgcccgccacccgcggatatgtcgtgctgtatcgcgcgccgcagctctgcccgggatgtggccgctcgcactggctggtcggacggttctcggcggaatgcgcatggtgccacctcgcgctgccccttgcgccggccgtgccggagcggatcgcggcatgaccacccagacccagatcgtctcgcggaacgaacagattgaggagttggccgcgaggccngttttttag

SEQ ID NO: 4631 - DNA, 282 bp, Enterobacter cloacae
tgctgtcttcgtgtcctcgctgctgcgcgtcggcctgctgtttttttggcgcgtgtgctggtcgagcgctttccgctgtgcctcggttttctgggcctggtttccttcggggctggtggcctgtatataggcctgcgtactattccggtcatttttgacatcattaaagacgtggaggacatctgcccgaacgcctgggtgattaactttaccaacccggccgggatggtcaccgaggcagtctatcgccataccggtttcaaacgctttatcggcgtctgc

SEQ ID NO: 4632 - DNA, 345 bp, Enterobacter cloacae
atcgcgtttcctgccagtcccgtcggtttaagacacttgaaggtttccgtgattcggtttcttgtatttccggtctgcgaattttggctggtggatgttgatgatggtctggagttgctgatttttttttttgttctgtgctttcgcttggttgattttgcgggcgtgcccttttccttgcttttttcgctggttcgtcgcctggctctgtttgatgctgtcttcgtgtcctcgctgctgcgcgtcggcctgctgtttttttggcgcgtgtgctggtcgagcgctttccgctgtgcctcggttttctgggcctggtttccttcggggctggtggcctgtatatag

SEQ ID NO: 4633 - DNA, 687 bp, Enterobacter cloacae
tttgccaaccagcgcgagcgccagtcactctttttctccaccaccttcgaggtgatggggcacttaaccaaatcaaaagggcgcgtaacggaagccgatattcaggtggccagcgtctttatggatcgcatgaatctgcacggcgaatcccgcatcgcagcgcagaatgcgttccggattggtaaatcagataactacccgctgcgtgaaaaaatgcggcagttccgtagcatctgtttcgggcgttttgatttaattcggatgtttctggaaattcaaatccaggccgccttcgcggatggttctctgcatccgaatgaacgggacgttttatatgtgattgccgaagagctgggcatttcccgcatgcagttcgaccagtttctgcgtatgatgcagggcggcgcgcagtttggcggtggttatcagcaacagcactcctccggcggctggcagcaggcgcagcgtggccctacgcttgaagatgcctgcaacgtcctcggcgtgaagccgtctgacgatgtcacgaccatcaaacgcgcctatcgtaagctgatgagcgagcaccatccggataagctggtggcgaaaggcctgccgccagagatgatggagatggcgaagcaaaaagctcaggaaattcagaaagcctacgagctgattaaagagcagaaaggttttaaataa

SEQ ID NO: 4634 - DNA, 579 bp, Enterobacter cloacae
gcgggcgtcaacgtcccggacagcgtgttttatacctctgcgatggcgaccgcggatttcctgaagcgtcaggaaggcaaaaaagcctatgtggttggtgaaggtgcgctgatccacgagctgtataaagcgggcttcaccatcaccgacgtgaacccggactttgtcatcgtgggcgaaacgcgctcctttaactgggagatgatgcataaggcagcctactttgtcgccaacggtgcgcgttttatcgccaccaacccggacacgcacggtcgtggtttttatcccgcctgcggtgcgctgtgtgccggtatcgaaaaaatctcgggtcgtaagccgtttgttgtcggtaaaccgagcccgtggattatccgcgccgcactgaatacgatgcaggcacactcagaagaaaccgtcattgtgggcgacaacctgcgtaccgatattcttgctggcttccaggcggggcttgaaaccatcctggtgctttctggcgtttcacagcttgatgacattgatacgatgccgttccggccaagctggatttacccctctgtcgacgaaatcgacgttatttga

SEQ ID NO: 4635 - DNA, 345 bp, Enterobacter cloacae
aacgcttgcgccccctcccctttttgcggcattttcataagcaagcaacatcacaacgcaacagggttaacggagaaggttatgtgttctatttttggcgtactggatattaaaactgacgcgggcgaactgcgtaaaaaagcactcgaattgtcccgcctgatgcgccatcgcggtccggactggtcaggcgtttacgccagcgataaagcgattctggctcacgaacgtctctccattgttgatgttcacgctggcgcacagccgctgtataacgagaaaaaaacgcccgcgctggctgttaaacgggaaatttaccaacatcaagccctgccccccgaataa

SEQ ID NO: 4636 - DNA, 684 bp, Enterobacter cloacae
agattaattatgaaatatcagttcttttggtcttcaacgcctaaaatatatgagcttttattaaatctaacaattggaatagctattataaattatttggttcccactgaacaagggaaaatagggtttttaataaatttatgcatgttgttaagttttttaactactttaggtataggtccagttttctcaaattttgtaagcagatcaaataattacaatctaatttcaggaaagttcaaggatagtatttcgcttcgcttttgtggctatattgtatttttagttatatcttttttgcttatttatataataaagcccaatcttttaattcttgctattccttttttgctagggaaatttttctttagcctcgatatttattataattttgttgaaggtcaggggcgatttaaagattatgcaatttcaaaattcttttctttgacattaataaatggcttcagattgtattgtgtcgttcaaaaacttgatgtcttttgggtagctgtttcatactttttaactgacttccttacctttttcatgtattttatcttttatgataagttaaagcttttaggattccgttttaattataaaaaatcgttagttttattaaagataaattataagctcgctctgtcttcactacgaaggtgccggagccgcgatatcacatcc

SEQ ID NO: 4637 - DNA, 594 bp, Enterobacter cloacae
cccattgccagactggtgcaggactatcctattaaatcctgttcggtgatcgcccatatccgccaggccaatcgcggcgaagtggcgctggaaaatacccatccgtttacccgtgaactgtggggccgtaactggacctatgcgcacaacgggcagctctcgggctataaatcactggaaaccggcaattttcgtcctgtcggtgaaacggacagcgaaaaagcattttgctggctgctgcacaagctgaccgagcgctacccccgtacgcccggcaacatgaccgccgtttttaaatacatagcgtcactggcgtctgagttacgcgagaagggcgtctttaatatgctgctgtctgacgggcgctacgtgatggcgttctgctcgacaaatctgttctggatcacccgacgtgcgccgtttggcgtcgccacgctgctcgatcaggatgtggaaattgattttcagaaggagaccacaccgaacgatgtggtcactgtcattgcaacgcagccgctgacgggcaacgaaacctggcaaaagatcatgccaggcgagtgggcgctattttgtctcggggaccgcgtaatttga

SEQ ID NO: 4638 - DNA, 987 bp, Enterobacter cloacae
acgttgatcttccagccgccgtgcgtgaagatcttatttctggcttcactgctcttcatggcacctgccgctttcgccgcaaccacctggcccctcacgattgaaaattgcggcgtaaagcagacctttacgcaggctcctcagcgcgtcgtgaccgtgggtcagcatgaaacagaattactgctcgcactggggctggagaaaaccatcgccgcgacgtcagtctggttcggcacgctgccacccacgctggaggatgccgggaaaaacctcccccggcttgcggattattccccctcctttgaggccgtggtagggcagaaacctgaactcgttctcgcgcagtatcactggcacattggtccgcagggagaagtgggaacccgtgaacagtttgcgtcgctggggattaatacgtggatctcccctgccgactgcacggataaaacggtaacggaaacctcaaacgcagacggagcacgtagcgcgccgttttcactggcggaaattacgcgggaagtgacagatctggcgacgatttttgatgtttccgcgcgaggtgagcagctcaatcgtgcgctggcggagcgtattaaaaaggcccaggcgcgcgcctccgcgaaacaacttagcgtcgtattctggttctccagcagccgtctgaatggcgatccctgggtggcggggaattacggcgcgcctggctggattagccgcacgctggggttgaagaacattattgactctcacgacgaatggcccgctgtaacgtgggaacatattgcccgatcgcagccggacgtgattgttatcgccgggatgtcccgcaggctctatcctgccgatgaggttgaggtaaaaaaagcgttcttgcgcagtgacccggtgacaaagaacatgcctgcggtcaggaacaaccacatcatcgtggtgccagcgatgtcgttaaacccttcattgcgtaacgtcgatgcggttgagcttatc

SEQ ID NO: 4639 - DNA, 222 bp, Enterobacter cloacae; identical to SEQ ID NO: 376

SEQ ID NO: 4640 - DNA, 1035 bp, Enterobacter cloacae
  unsure (105)
ccaaagcgccggccgagcggcgccatggagctggacaatgccaacaacgtgggcggttatccgggttacagcattaccaacctcgcgccgttcctgcaagccagntatgacattgacgccatcaccctgagcggcggcgtgcgttatcagtacaccgaaaacaaggtggacgattttgtcggttacgcccagcagcaggcaatcgccacgggcaaagccacctccgctgacgcggtgccgggcgggaaaaccgactacaacaacttcctgtttaacgccgggatccttggacgtctgaccgaacagcaacagctgtggtttaacttctcccagggcttcgagatcccggacctggcgaagtactacggctccggcacctatcagctggtcgatggtcactatcgtctgcaaaacagcgtcaatgtgaacgactcaacgctggacgggattaaggtcaatgcttacgagctcggctggcgcttcaccggcgataacctgcgtacccaggtggcggcatactactcgctctcggataaaaccatcaccatcaacaagagcgacatgaccatcaacctggaggacgacaaacgtcgtatctatggggttgaaggccaggtggactatttcttcaccgacagcgactggagcaccggggcgaactttaacgccatcaagtccgaaacgcgtgaaaacgggaaatgggagaagctgacggtcgacagcgccagcccgtctaaagccagcgcatgggtcaactgggcgccgggcgactggacgctacgcgtgcagagcacacaaacctttgacgtgtctgacgccgacggtaagaagattgatggctataacaccgttgatttcctgggtagctacgccctgccggtgggcaaagtcagcttcagcgtggagaacctgctggacaaagactacaccaccgcctggggccagcgcgcaccggggctgtatagcccaacctacggcgcaccgggtctgtctacttatgtcttctccacgaggcggccaagaatacgcagaaag

SEQ ID NO: 4641 - DNA, 614 bp, Enterobacter cloacae
cggaacaataaaatacaacgtatgaaaaaacgtatccccacccttctggacacaatgattggcaccgccctgtatagccaacaggggctcgcagccgatctcgcctcgcagtgtatgcttggcgtcccaagttacaatcgcccactggtgaaaggcgatacgaatgacttacccgtcaccattaatgccgacagcgcaaaaggtaattatcctgacaatgcaacctttacgggcaatgtcgatattaaccagggcaacagtcgcctgcttgctgacgaagtgcaattgcaccagaagcaaccggaaggtgctcaggcgcctgtccgtacggtggatgcgctgggtaatgtgcactatgacgacaatcaggtcatcctgaaaggtccgaaagcctggtcgaatctgaataccaaagacaccaacgtctgggaaggtgattaccagatggtcggtcgtcaggggcgcggtaccgcggacctgatgaagcagcgcggcgaaaaccgctacaccattctcgaaaacggcacgtttacctcctgtttgccaaggtcaaatacctggagcgttgtgggcagtgaagtgatccacgaccgtgaagaacaggttgcagagat

SEQ ID NO: 4642 - DNA, 366 bp, Enterobacter cloacae
gtggaaacaacaaaattatggatttcattaggcactattgtcagccctattactggaacgtttttcaccaagataattacgcaatataaccataaatacctgctctggtataatggagaatatcttatcaaacccggtgataacattaaggttaacaacaacggaattgttatatcagaaaaattacggaagattaatataatacaaattgacaagtatagcccgacgctctggcgagtcatgcacaacatgtccagctgccctggcgataaagaacctgaaaattcattttgtacatcctccgtccgctgtattttcaaaacctgcccttatggtaagaaacggagaaacgcatgtaaacgctga

SEQ ID NO: 4643 - DNA, 801 bp, Enterobacter cloacae
gactcgggccactacaataaaagtttgggatggttgtcattattcgcaggcactgtattactcagtggctgcgattctgcactactagaccccaaaggacagattggactggaacaacgttcattgatactgacggcttttggcctgatgttgattgtggttattcctgccatcttgatggctgttggtttcgcctggaagtatcgtgcgagcaataaagatgcgaagtatagccctaactggtcacactccaataaagtggaagctgtggtctggacggtacctattctgatcatcctgttccttgctgtactgacctggaaaaccactcacgcacttgagccgagcaaaccgctggttcacgatgaaaaacctattaccattgaagtggtctccatggactggaaatggttcttcatctatccagaacagggcattgctaccgtgaatgaaatcgccttcccggcgaacactccggttcagttcaaagtgacctccaactccgtaatgaactccttcttcatcccacgtctgggcagccagatttacgcgatggccggtatgcagactaacctgcacctgatcgcgaatgaagcaggcacctacgacggtatctccgccagctatagtggcccgggcttctcgggtatgaagttcaaagctatcgctacgccagaccgcgcgactttcgaccagtgggttgcaaaagcgaaacagtctaccaacaccatgtctgacatggcggcgttcgaaaaagtggctgcacctagcgaatacaacaagggtggagtacttctctaa

SEQ ID NO: 4644 - DNA, 441 bp, Enterobacter cloacae
cctgcaaccgggcttttccctcagtggtctaggtgccctggcacaggcggcgttgacctgcgacagagtggtgcaattttgatgaagcgcgtagcgtttgtttttacttctgcgccgcatggcagcgcttcaggccgggaagggctggatgcattgctcgcgacatcggcattaaccgaagatatcggcgtcttctttttaggcgatggcgtattccagcttcttgcaggccaacaaccgcaggccattcttgcgcgcgactacattgcgacctttaaagttctgccgctctatgacattgaaaccttctatgtgtgcgccgactcgctggccgcgcgtgggttaaacgagaaaacaccgttcgtgctggacgtgacgatcctgacatctgctgcgctgcgcgaacaactctctcactacgataccgttctgactttctga

SEQ ID NO: 4645 - DNA, 441 bp, Enterobacter cloacae
ataattcccccgggttccaaaagcggggacttttcttgggacaagacaagtaatgcgttttgcgttaatggtgacgggccccggcgtacggtacccagccgggccagcagcgcggtacagtttgcccatgcgctgcttgatgccggtcatgaactggcaagcgtcttcttctatcgtgaaggggtctataacgcgaaccagtttacgtccccggcgagcgatgagtttgaccttgtgcgcgcctggcaaaaattaaacgaaacgcagggcgttgacctgcatatctgcgtcgcggcggcactgcgtcgcggcgtgacggatgcgaccgaagccgaacgccttggtctggcgggggctaacctgcaaccgggcttttccctcagtggtctaggtgccctggcacaggcggcgttgacctgcgacagagtggtgcaattttga

SEQ ID NO: 4646 - DNA, 615 bp, Enterobacter cloacae
cataagttggatcggcaggcccgtggtgaagaattaaggattattttcatcttactttccgacgtatttaatttgtatcgtgactcgcatgtaaaatatcagcagtcttatcaaaattccatccgcgaccccctcacccgtctttataatcgcagctatttctatgattcattaaatcacgcgctaaacacggccacggtgacacatccggtatcggtggtcgtgagcgatcttgaccgttttaaacgcattaacgactgctacggtcatttgcagggggatagggttttacagtttgtctcaaacctgttgaccgattcggtgcgaccgcaggatatcgcggcgcggatcggcggcgaagagtttgtgctcatgctgacaaatacaccgtccgatgtcgcgcatcaggttgccgaacgtattcgcctcaagttgagcgggtttgacaaggccagcagcggtgggcagcttccggaaccgattaccattagtatgggagtattcaccgctacctcgccggaaaccagcgctgaaacctgtgtggaaagcgcggataaagccatgtacgaggcaaaagagacgggccgcaaccgggtggtggtgttcagaacatga

SEQ ID NO: 4647 - DNA, 390 bp, Enterobacter cloacae
agacgtgctctgattgaccatcgcctgaaacctctggaactcacacagacgcactgggttacgctgcacaacatccatcagcttccgcccgatcagtcacagatccaactggcaaaagcgattggtattgaacagccttccctggtgcgtacccttgaccagctggaagagaagggactcatctcccgacaaacctgcgccagcgaccgtcgcgccaagcggatcaaattgacggaaaaagcggccccgattattactgagatggaaaccgtcatcagtaaaacgcgaggggagatcctggccggtatttcacccgctgagctggagatgctgatcggactcatcgcccgtcttgagcaaaacatccacgatttacagtcgcgcgactga

SEQ ID NO: 4648 - DNA, 468 bp, Enterobacter cloacae
cgcctggaaggaagtaaaacgcacagggaatggcgcgttcccgttgtcaggcagctgcgtttgcggttgcagcttctcctgtcacgggcaacagaagctggagccgggccaaaagataaccttttcgatgtcagtttttacattgccggaagaaaggcaaagtttgaaagaaatgatgtgagtgtgatgcatcaaaagatccgctctttctttcgacgcctgtcaaaggagtgcggttttgccgtttcaccgcaccgtttcagacacactcttgccacggaactgatgaaagcgcccgaaaggaatcttcaactggttaaagatttactgggtcatcgtagtgtcagtacaacaatggaatacgtggagctcaggatggacattgtgggaaaaacactggaagaagaactgtctctgcacacagatctctgtgtagaaagggaattacaactattgacacaaaactga

SEQ ID NO: 4649 - DNA, 402 bp, Enterobacter cloacae
tcttggaaccccaatgagttgctgacgggcaaaacggaatgtaataagtgtgaggaggcttcaccgggaaacgtgacgttgaagaccatagaaggggtcgtacggaatgttcctttctatggtgaaatcgccgggagccgggtaaaaaaaggtccctggtggctgattatattaaagcgttggttacaaaaaagcctgacgcggggattcagtcacttcaaccccgaccagtataatggcgcctgtctgttaggattgcgcggcatcgtgattaagagtcatggcgccgccaatcagcgagcatttaccgtcgcgattgaacaggcagtgcaggcggtgcagcgtcaagtccctcagaggattgccgctcgcctgggatctgtattagctaaaagtgactga

SEQ ID NO: 4650 - DNA, 519 bp, Enterobacter cloacae
gcgtacatgtatacgaagattttaggtaccggcagctacctgccaaaacaagtgcgtaccaacgccgatcttgaaaaaatggtagatacgtctgacgagtggattgtcacgcgcacaggtatccgtgaacgtcgtatcgccgcgccagacgaaactgtgtccaccatgggctacgaagccgctcagcgagcgcttgagatggctggcattgataaagaacagatcgggcttattgtggtggcgaccacctctgccacgcatgccttcccaagcgcagcgtgccaggtgcagaacatgctcggcatcaaaggctgcccggcatttgatgttgcagcagcatgcgcgggtttcacctatgcactgagcatcgccgatcagtatgtaaaatcgggcgccgtaaaatatgcgctggtgatcggcgctgacgtgctggcgcgtacctgcgatccaaccgatcgcggcacgatcattatttttggcgatgtcttgcccagcccgtggaaaatccgtatttgcgtt

SEQ ID NO: 4651 - DNA, 789 bp, Enterobacter cloacae
caggtcaccgtcaccaatgataacggcaagctggacattcgtctgaccggcccgtggcgcgaggtgatcatgtgggaagtgccgcttctggccgtgatcagcgagctggcccaccgctatcgctcccctgaaaccggtgtgacgcaggcggtcgccgctctggagaataaactcgttgagttttccagactgaccgaagggctggatatgtcccgcttccgtctgatggactttggcacgcgccgccgcttttctcgcgaggttcaggaagccattgtcagacgtctgcaacaggagccgtggttcgttggcaccagtaactacgatctggcacgtcgccttgatttaacgccgatgggcacccaggcgcatgaatggttccaggcgcaccagcagattagccctgaccttgccaacagccagcgcgccgccctcgccgcgtggctagaggaatacccggatcggctgggtattgcccttaccgactgcattaccatggacgcattcctgcgcgactttggccctgagtttgccgaacgctaccaggggttacgccatgattccggggacccggttgaatggggtgagaaagccatcgcccattacgaaaagctgggtatcgacccaatgagtaaggtgctggtcttctccgataaccttgatctgtcaaaagccgtcgacctttatcgccatttctcatcgcgggtgaacctgagtttcgggattggtacgcggttaacctgtgatatccctcaggtgaaaccgctgaacatcgtcataaaactggtg

SEQ ID NO: 4652 - DNA, 522 bp, Enterobacter cloacae
  unsure (104)
acttctgaccagacagttaccacccagaaacagcagattgaagaagctggctatcaggtttctaagtgtttcaccgatgaagctgtatctggtggcattaaggntacagagcgtaaaggtttcagtgacctgctgaactatgtccgtgaaggtgacacgctggttgttatcgggatagacagattaggccgtaataccatcgacgtattatccacggttgagactttacaggctaaaggtgtgaaggttatcagtctccgtgaagggttcgacctgtctacaccagttggtaaggctatgctcactatgatggctggattagccagtcttgaaaaagacttgatagcagagcgcagaacagcagggattaaacgtgctcagtctgaaggggttcactgtggcagaccgattaaagcaactactgaacaggttcaggaactgattgcacaaggttatttccctgctcaggtacaggaagagttaggaatcagtaaggcgactttctatcgtctgaataagtaa

SEQ ID NO: 4653 - DNA, 651 bp, Enterobacter cloacae
tgcatgaatcttatcagtatttccgcctttcaggacaattacatctgggttttagtcgacgacgatcgcagatgcatcattgttgatccaggcgaatccgcaccgatcctgcacgcgataaaagaaaacggctggcagcctgaagcgatcctacttacccatcaccatcacgatcatgtcggcggtgttcccgatctccttgcgcgctatcctcatcttcccgtctacggaccggcagagacacaggataagggtacgacgcaagttgtcgaagaaggcgaaagtatcctcatcctcgggtgggagttttccgtatttgctacgccaggtcacacttccggtcatctctgtttgtacagcaaaccttatctgttttgtggcgacacgctgttttctggcggctgtggaaggctgtttgaaggcacgccagaacagatgtatcaatctttacaaaaaattaatgcgcttccagccgacaccgtaatttgttgcgcacatgagtatacattagggaatatgaagtttgctgcaagcgtgctgcctgaggatcgggcgattcaggattattacctgaaagtgaaggagttacgtgcaaaaaacctaaaaacactgcccgtaatgtcttcactacaacgtgcccggtcacattag

SEQ ID NO: 4654 - DNA, 420 bp, Enterobacter cloacae
gattcatgcattacctcttatagcgtggcgggtgttttgatgaaaccggcaaggatacctcagactgtcgcaccaccggaacgttgggcagagttgccctggggtgaatattatcgcgaggccttagaacttcagcttaaaccctggctcgcgaaaatgaatggttttcacctgcttaagattggcaatctgagcgcagaaatcaataccgaaagctgcgctatctcgcatcaggttagcgtatcgcttaatggctccccggttcaggtgaaagcggatccgatgcatttgccgtttgcggaaaaatccattgatgcctgtctgctcgcccatacgctgccctggtgcagcgatccccatcgtctgctgcgggaagccgaccgccctttgattgtagttgtcgaccagccggtagattgg

SEQ ID NO: 4655 - DNA, 849 bp, Enterobacter cloacae
tcacaggcttttgtacgaaattatggctatgagcttgcacatcgggtaatctgcgcgcttcgcgcagcgctggtggagaaaagcatgaacgacgaaatgaaaaacaaaagcggcaaggtcaaagtgatgtatgtccgcagtgatgatgactctgataaacgcacccaaaatccgcgtaccggaaaaggtggcgggcgtccggcgtcttctcgtgcagacggtggccgtcgccccgcccgcgatgacagaaataaccgcggcgatgaccgcaaacgtgatgaccgtaagcgtgacgatcgcaaacgcgatgattttgtccgcgacggtggatcgccatggcgtaccgtttctcgcgcgcccggtgaagagacgaccgaaaaagccgatcacggcggtatcagcggaaaaagctttatcgatccggaagtgctgcgtcgtcagcgtgcggaagagacccgtgtctacggtgagaacgcctgtcaggccctgttccagagccgcccggagtgtatcgttcgtgcatggtttatccagagcgtgaccccgcgctttaaagaagcgctgcgctggatggcggcgaaccgcaaagcctaccacgtggttgacgatgccgagctgacaaaagcgtccggtacagaacaccacggcggcgtctgcttcctgatcaaaaaacgtaacggcactaccgtgcagcagtgggttagccaggcggatgccgatgactgcgtactggcgctggaagatgtgggtaacccgcataacctgggcgctatgatgcgtagctgcgcgcactttggcgtgaaaggcgttctgttgcaggatgccgcgctgctggaatccggtgcggcg

SEQ ID NO: 4656 - DNA, 429 bp, Enterobacter cloacae
atgaaaacttttacagctaaaccagaaaccgtacagcgcgactggtatgttgttgacgcgaccggtaaaactctgggccgtctggctactgaactggctcgtcgcctgcgcggtaagcataaagcggaatacactccgcacgttgataccggtgattacatcatcgttctgaacgctgacaaagttgctgttaccggcaacaagcgtactgacaaaatgtactaccaccacaccggccacatcggtggtatcaaagaagcgacctttgaagaaatgattgcccgccgtcctgagcgtgtgattgaaatcgcggttaaaggcatgctgccaaaaggcccgctgggtcgtgctatgttccgtaaactgaaagtttacgcaggcaacgagcacaaccacgcggcacagcaaccgcaagttcttgacatctaa

SEQ ID NO: 4657 - DNA, 396 bp, Enterobacter cloacae
gcaatggctgaaaatcaatactacggcactggtcgccgcaaaagttccgcagctcgcgttttcatcaaaccgggcagtggtaaaatcgtaatcaaccagcgttctctggaacagtacttcggtcgcgaaactgcccgcatggtagttcgccagccgctggaactggttgatatggtagaaaaactggatctgtacatcaccgttaaaggtggtggtatctccggtcaggcaggtgcgatccgtcacggtatcacccgcgctctgatggagtacgacgaatccctgcgttctgaactgcgtaaagctggcttcgttactcgtgacgcgcgtcaggttgaacgtaagaaagtgggtctgcgtaaagcacgtcgtcgtccacagttctccaaacgttaa

SEQ ID NO: 4658 - DNA, 609 bp, Enterobacter cloacae
acatcggtgcggcagttgcgcccagatgccgcgctggcgtccattaaatcgaccgttctggttatcgccgtccatcagagtattggtgccggtatcgcgctggccatcccgctgaccgcagcgggtcaggtgctgaccattattgtccgtactattaccgtggccttccagcacgcggcggataaggcggccgaaaacggcaacctcaccgcgctctcctggatccacgtttcttccctgttcctgcaagcgatgcgtatcgcgatccctgcagttatcgtggcgatttctgtcggtaccagcgaagttcagggcatgctgaatgcgatccctgaagtggtcaccagcggtctgaatatcgccgggggtatgatcgtggtggtcggttatgcgatggtcatcaacatgatgcgcgcgggctacctgatgccattcttctacctcggcttcgttaccgctgcgttcaccaacttcaacctggttgcgctgggtgtgattggtgcggtgatggcgattctttatatccagctcagcccgaaatacaaccgtgtcgcgggtgcccctgcgcaggctgctggtaacaacgatctcgataacgaactggactaa

SEQ ID NO: 4659 - DNA, 474 bp, Enterobacter cloacae
caggtgagcgaaatggttgatatgacaaaaactaccactgagaaaaaactcactccgggtgatattcgtggcgtgttcatccgttctaacctgtttcagggttcatggaacttcgaacgtatgcaggcgctcggcttctgcttctccatggtgccggccatcaaacgcctgtatccggaaaacaacgaagcacgccgtcaggcaattaagcgtcatctggaattcttcaacacccatccttatgttgcggcgccggttctgggcgtgacgctggcgatggaagagcatcgtgcgaacggggctgaaatcgacgatggtgccatcaacggtatcaaagttggtctgatggggccgctggcaggcgtgggcgacccgattttctggggtaccgtgcgtccggtctttgcggcgctgggcgccgggatcgccatgagcggcagcctgctcggtcctctgctgttcttcatcctgtaa

SEQ ID NO: 4660 - DNA, 414 bp, Enterobacter cloacae
agcgtagggctgcgggtcagctcgggctgtatgcggatgaacgcgccggatatcaaagcgttgtttgagcaagtgcgcgtcggcacgcgggtgcagattatcaatgagccggtgaagttctccgtcgagccggacggcaaacgttatatcgaagtgcacaggccgctggcgcaggcagagggcgaaaacccacagacggtgccgttcacgcactcggcggcgtttaccgcttttgcagcggagtcaggtagcgataaaacgcttatcgataaagccctggcgcgcagagccgggatcccggttgccgtttcaacaggcaatggttcgtcagccagcaattctgtcctgtcggttcagaatagtcgtgtctcagcggcggtggcggaagacgagggagagaaagcgcttcagtag

SEQ ID NO: 4661 - DNA, 648 bp, Enterobacter cloacae
cttctcgctttgactgctatccggtacactccactgtgttatttcatcaatactgaaggattatcctgcatgtaccaagatcttattcgtaacgaactgaacgaagcggcggaaacgctggcgaactttctgaaagatgatgccaatattcacgctattcagcgcgcggcggtcctgcttgccgacagcttcaaagccggcggtaaagtgctctcctgcggtaacggcggttcccactgtgacgccatgcacttcgccgaggagctgaccggacgctatcgcgaaaaccgtccgggctacccggcgattgcgatttccgacgtgagccacatctcctgtgtaggcaacgactttggttacgaccacatcttttcccgctacgttgaagccgtaggccgtgaaggcgatgtgcttctcggtatctccacgtccggtaactccgctaacgtgatcaaagcgatcgccgccgcgcgtgagaagggcatgaaagtgatcaccctgaccgggaaagatggcggtaagatggacggtacagcggacattgaaatccgcgttccacacttcggttatgccgatcgcgttcaggaaattcacatcaaagtgatccacatcctgatccaattgatcgaaaaagagatggttaagtaa

SEQ ID NO: 4662 - DNA, 870 bp, Enterobacter cloacae
cgccgcttctccgctatcccgctggttgactatttctatgggctggttgttgttatctggggcacgacctggatcgccatttttttgcaacaggggccggttgcagcgccggtctccattttctggcgcttcgccgtggccagcgccacgatgatgatcgtcctggtcgcccttcgccgtctgcgcaggctggcgctgcgggatcatctctactgcatgcttcagggctgctgcgttttctgtttcaacttctggtgcttttacaccgccgccgcccatatcaataccggccttgagtcggtgattttctcgatggccgtgctgtataacgccatcaacagctttatcttcttcggccagcgtccacccgcacgcttctggacggcggcagcgctggggcttatcgggatcattaccctgttctggaacgatctgctcgccagcggctggagcgcgtcgttgcttacgggcatcgggctttccgccctcggcacatacggcttctcgctggggaatatgatcagcatgcgtcatcagcgaaacgggatggaaaccatgaccaccaacgcctgggcgatgctgtatggcaccgtcgtgatgggacttatcgccctcttcagaggcgataactttatgccggaatggacggtgagctatatgggggcgatgctctatcttgcgctgtttggctcggtgattgccttcggcgcctactttacgctggtaggccgcattggtcccggtaaagccgcctacagcaccctgctgttccccgctggtggcgctgtcgatttcaacggtgttacaaggttaccttttggcatcctcaccggattttccggctgttttttgataattggggggcatttt

SEQ ID NO: 4663 - DNA, 270 bp, Enterobacter cloacae
aagaaaaatacaatgttccagcaagaagttaccattaccgctccgaacggtctgcacacccgccctgctgctcagtttgttaaagaagcgaaaggcttcacttctgaaatcactgtgacttccaacggcaaaagcgctagcgcaaaaagcctgttcaagctgcaaactctgggcctgactcagggtaccgttgttaccatctccgctgaaggtgaagacgagcagaaagcagttgagcatctggttaagctgatggctgaactcgagtaa

SEQ ID NO: 4664 - DNA, 845 bp, Enterobacter cloacae
ggtagggttatgatttcaggcattttagcatccccgggtatcgctttcggcaaagcattgctgctgaaagaagacgaaatcgtcattgaccggaaaaaaatttctgccgacaaggttgatcaggaagttgaacgttttctgagcggtcgtgccaaggcatctgcgcaactggaagcgattaaaactaaagctggcgaaactttcggtgaagaaaaagaagccatcttcgaagggcacattatgctgctcgaacatgaggagctggagcaggaaatcatagccctgattaaagataaaggcatgacggccgacgcggctgcgcatgaagttatcgaaggtcaggcatctgccctggaagagctggacgatgaatacctgaaagagcgtgcggctgacgtacgtgacatcggtaagcgcctgctgcgcaacatcctgggtctggccatcatcgatctgagcgcgattcaggacgaagtgatcctggttgccgctgacctgaccccgtctgaaaccgcacagctgaacctgaacaaggtgctgggtttcattactgatgcaggtggacgtacttcccacacctctatcatggcgcgttctctggagctgccagccattgtgggttacggtagcgtgacgtctcaggttaaaaacaaccactatctgattctggatgccgtaaaaaatgtggtttacgtcaaccccactaacgatgtgatcgaccactgcgcccccgttcaggagcaggttggtaccgaaaaaaacgaactcgctaaaactgaaaaatttgccaaccatcccgcttggaatggcttcaggttgaaattgtgcgctaacatccggtacgg

SEQ ID NO: 4665 - DNA, 357 bp, Enterobacter cloacae
aatcataaccctaccttacttgtgactgatattgaaaagaacccggtaaacttactcgagttcagccatcagcttaaccagatgctcaactgctttctgctcgtcttcaccttcagcggagatggtaacaacggtaccctgagtcaggcccagagtttgcagcttgaacaggctttttgcgctagcgcttttgccgttggaagtcacagtgatttcagaagtgaagcctttcgcttctttaacaaactgagcagcagggcgggtgtgcagaccgttcggagcggtaatggtaacttcttgctggaacattgtatttttcttctaccagccggcctggaggatctatgctctcgagac

SEQ ID NO: 4666 - DNA, 192 bp, Enterobacter cloacae
cttagcgcggatgccgccagccccgtggtgaagattccagagattaaccaaatcactattgctaaattcttcagcggtcaagggttatcactgatgggtgctgcactgatttatgaaatggtactgaaagcacacgatgcaatgacagatttaatctggaatgaatacgaggtgaaaactatgaatggctaa

SEQ ID NO: 4667 - DNA, 231 bp, Enterobacter cloacae
gatgaacatatgcgcgcatctgcaactcgtagtgaagacctgggacaccccgagaacaaaagtgaattagcgtggaatgaaaacaaaaaatggaagaaaaatcaagaatctcttttattaaatggtgttgaaatacctattgtcagcttagattatgaaattgaaataaaccaagaaattggcaattataatgcatttaaagatacttgctatctggaaaattatagatag

SEQ ID NO: 4668 - DNA, 426 bp, Enterobacter cloacae
gggggaaccctaacggggcttctctttgaacaaatcgaggagcggaaaatgtcatatcttgaatatatcaatgaagtaaaagtgtccgggatagttatcagtgctgtggagaaaaaaatgactgaccagagtataggtttgttaataaagctcaaaaataggatgaagacagaagttgatggtgaaatcactgagagagaattttcagttcaaatcaaggtgtcgcctgaaatgtattcaacctgtttcactggtataaatcagggtgatgagttgatggtctccggttatattgttgtcgatactattatgattgaagggagagaacatcctcttgactacatgagagtggtagcaacaagtaagttggctcacatacctaaacctctaaaaggttttggacaaagtagctttaatcagatctga

SEQ ID NO: 4669 - DNA, 198 bp, Enterobacter cloacae
atcaactatttgcgttatttcatcttcatctatatcgaatatagaaaaaaaactaagttgattactacttattgcagtagccctaaatttttgtttcatggggactccaaaaggagaaatcccatgaagggatttctcccctttagggtgggtttaatgtcagatctgattaaagctactttgtccaaaaccttttag

SEQ ID NO: 4670 - DNA, 369 bp, Enterobacter cloacae
tcctctgcggcgcttgaagaacaaatcatgttggacgattgcaatgacgatatgggctgggacatcttctttgatcaggattatttaatgtcagaaaaaaaactggctgttaaatggactgacagggaaattatggatgtttacataaaagcttttaaatccacattagagttgtttgacgagcttgtttcatgtgatctgttaactaaacgaaacgcttttggcaagttagaaataaatccaatattcgaaaatcattttgaatggatcatgtctgaagcttttgaaatagtgggaaatcatcttggttataatgtgcctcaaatcaggaaactgatggcaactatttgccaaatgaatctcaaataa

SEQ ID NO: 4671 - DNA, 258 bp, Enterobacter cloacae
cgcttcttatcaatggtggcagaaacgggctggataaacgccgcgcgctgtttaacctggcgaaatcagttctggtgtgaggtgaatgtgggtatcgaaacgataatcgggctggccgcactggtcatttccgccattgcaggcgcttttggcctgggccatatccgcggcaccagcaaagcacaggctaaagccgaccaacagcgcactgaagataacgcagctgcaacggtcgcagcagcggaacgccgggtatag

SEQ ID NO: 4672 - DNA, 411 bp, Enterobacter cloacae
gttaattcaaaagggaaagcttttgacgtaaaactggaagcatatgctttaagtgaaaatgacggaaaaaatgggatccgaggcacgcttatcagccgaaatggtcacgcaattgcaggagctgcatttgccggtggactttcttcacttgccggtagcttaagtcccagtaaggtatcttcattttacatcgacccttattcacaggctcagtatcagtcccctaattttggtgcacttggggcattagccggggttggtgcagctcaaggtggtcttaatcgactcgtcgattactacaccgcaattgcagaacaacagtggccaatcgtagaaattagccctggccgagctattacatttgtcgttcagaccggaactacaattccaacgaatctgaccagtcgctga

SEQ ID NO: 4673 - DNA, 483 bp, Enterobacter cloacae
atggatagtttagaaaaaaaagaatcgcctgaatcagctggacctgaaatcactaaaaaaatggtgcgagaaaggacaacaaaaaaaattaccttcgaaattgatattgaaaaaatattgaagtatttatttttcttcgcctttgccgtattggtcattatttatggttataaaggctttatgaatgtttacgattacttcaataaacaatcccagccttcgtacaagattgcagtgcttgacatgcctgaattacgtaaggaatttttcaagcatcacggaggccgtactgctgacaatgatagatctcaattcgaagaatatttcagaacattaatgaagatctaccgtgaccgtggctatttaattattgatgcaacgcttgccgttactgtaccggatagtgttgaaatcgtcacttatatggaacttgaagatagctctgaagcggtacaatcaagttcttataatgcaaagaagtag

SEQ ID NO: 4674 - DNA, 924 bp, Enterobacter cloacae
acctttacaaactttttccggaaggattttcttttctggcagatccttcatggacattactctgcgctgtgcaacttgatccaatcagttacaaagccagaagaagagatagtaattttctctactggaaatttgtttgactatgggccggaacccatagaattgatgaaggcgataaacagtggctttttcgatggacgttttgtgaggcatttctcagctgccggagccggagaagaaatgttaaaaaaattgttaccattaaacaaagaccggagaacattttaccccagcacatacctcaatgagagatggtgtgtaatgggcggaaagtggcataaagctgtgaatcgttactatttagaggaagaggtaaaaaaacttcttaatacccagcttggtacgatgatgcagattttactaaaaggcgatataaaaattggggtttgcccttctgattacgcccctatccgcacatcattcactgatacttataatgcgcttcaagcattcaactatgccaatgtgaatatttttcagagccagtttctattcggtatggaccatgccgtaataccaatgatgataaatgacgtcaaccttatggtcctaggtaggaatcctgtaaacagcattcgaaaagcccatggtcgtactcaaaacaatcttccagtactgatcggtaattgtttgcatataaatactggatcactctatatgtcaaaattagaagaccaggtaatagttgctccgggtataccgcaaactgactcaccagcacttacattagtagaaataatcatgaagaacaatccagttttattgtgtcatcagctaatacaaacaacaaacaagttttattcacttaaaacctatcctttagaactcgattcgattgaaaacaacattgaggtaacaagatga

SEQ ID NO: 4675 - DNA, 348 bp, Enterobacter cloacae
acaagagtacggaacccactcatggatattcgtaagattaaaaaactgatcgagctggttgaagaatcaggcatctccgaactggaaatttctgaaggcgaagagtctgtacgcatcagccgtgcagccccagccgctagcttcccggtaatgcagcaagcttatgctgcgccagtgcagcagcctgcgctctccgcagccgttgcgccagcggcagcagaagcggcacctgcggctgcaacagaaaatcatggtcacatcgtaagttccccatggttggtactttctaccgcaccccgaagccggacgcgaaaggcttcaactaaatgtgtcaaaaagtcaacgtaa

SEQ ID NO: 4676 - DNA, 183 bp, Enterobacter cloacae
  unsure (128)
  unsure (155)
  unsure (171)
  unsure (174)
  unsure (176)
ggaggaggaaagggggagggagaggtaggggggacgagagaagagaggaggaagaggggattggggaagggaagagcgatggagggcggtgaggggggaagagaagggaaggtggaggggggggcggnagtgggggggggggttggggggggggngggtgggggggggggnggngngaggtga

SEQ ID NO: 4677 - DNA, 240 bp, Enterobacter cloacae
aaaagaaggaagcgaaaaaagaaaaaggatctcagcgcgaaaggccaggcggaagcatcaaagagaacagctaaggcaaccacgaacccgctcacgaaagaaaacagcgggaataaagaaaccttcaccaaagcgccggaacgcgaagaggccctggggcagaaaaccgtcgagatccagcttcagcagggtctggaagaaaaggagaaagccagcgcgttctggccgaccaaagaatag

SEQ ID NO: 4678 - DNA, 189 bp, Enterobacter cloacae
acggcacttgcgtcttccccagatttacgtataatgcgcgggcttgtcgtaattgacggcgggttcaatctgaaccagagtagctcactttgttactcaacaatgctcccaattggggagctacgtaagaacggttacactctcccatcaatcgtaatgggtttgaggagtaatcattttcgtttataa

SEQ ID NO: 4679 - DNA, 213 bp, Enterobacter cloacae
atacttacccgggtcaccgaatccgtcaggactggcagtgggttagtcttgtctacgttgataaaagccttcttcattgccctgtttccccttgtcctgaaaaagttaccgacccgtccggatggaggggtcggtcagaaaatcatgcctgtcccttattcatcttctcagcatgcttacgcaggtactctttcaggtcagcatgagcattga

SEQ ID NO: 4680 - DNA, 339 bp, Enterobacter cloacae
ccgacccctccatccggacgggtcggtaactttttcaggacaaggggaaacagggcaatgaagaaggcttttatcaacgtagacaagactaacccactgccagtcctgacggattcggtgacccgggtaagtattcagtgcacggcaaaagatgaaaacggggcagggatcgaagtgaacatcctcgacctgattcaggatcatgatacggatgaagtgaaagtgcagtttgggagctcgcctgttcaggctctggcgatgctccgccgggttatgacagcactggaaaagcaggcaaatgcagaactgcaacagaattcctgctcgcgtatgcagtaa

SEQ ID NO: 4681 - DNA, 345 bp, Enterobacter cloacae
aatggtgaaaagccaaaacggagaacgctggtttacgccaccggtaacaggaaccggttccggctccaaaggaacagggttcataaacagaacccggcaggtaaagcaccatccatgtccagcgttctgaacaaaaagaccgtgaccgtcattgccgacaccgcgatcccgatttttgaacgtattgctgaagaagccaagcttaaagaaggtgaatctgtcagcactgatacttacacgcttgttctgaccaatgatgaaatgaacgatatcatcaatgctcatgctgacctgaaagagtacctgcgtaagcatgctgagaagatgaataagggacaggcatga

SEQ ID NO: 4682 - DNA, 339 bp, Enterobacter cloacae
acttacggagaggatatggtaattacttattcattatcggaaacgtttaatatgtttttacgcgagattattgcatctggacttgcagttttttgcgcatggtgcgttttgtgtcttttctctgatcaggaacgaggtaaagaggttcctgtttctatgaaaaaaataacttcaaagtcagctttctcctactttatcagttctcaaattgccgcttttattatctccttgttgggttcaatcttaagcacgaaatgggacaacatcgtctggaatgatgaaataagacagtcggacctgcatgtcttcacaacgaccagccagatccgatctaacgcc

SEQ ID NO: 4683 - DNA, 192 bp, Enterobacter cloacae
tccccaaacgtatgtctttccatccggctggtgaagtatggttcatcactgattaaaatttgctccctcattgtgttttttgccgggtcgccccggctttttttcgtttcgtctcctgaaagttcaaaatatttcagcatcttcttagaaaatcgtgaacaagatggcgttttattgttcgaacaatcctaa

SEQ ID NO: 4684 - DNA, 492 bp, Enterobacter cloacae
  unsure (30)
atgcactcattaatgaccgtggcaattaanatacagaatcagcaaggattttttgatttatttaaatcacaggaacgtaaaagtaaagaagtgatatcaattctgtttgagtatgttcgtgagaattctgtatgggtagaacattacgaatctcaaatcagcataacccaggatgaccgatatagtctggttcacttcaaccagtaccaggaacctaactggtcttttatttctaaagaaaaacttgaagagacatatcctgaatttgattttcatgtttccagaaagtctcttgaaaactggagtaatgcccgattatcaactcagacgattaaaaaattattaaaagaaaaaaactggaccatgaaggaagttgctgctcgctggaaccgttcggaatcatggatgagtaaagttgttaatgatgaggaaagggaactctactgggaagacgcttttaaagggctcccttcaaaaatacacgaaaaatga

SEQ ID NO: 4685 - DNA, 294 bp, Enterobacter cloacae
ggcagcataatgtctaaagaacttgttcgacctataatggaaaaacctgaacgggccagaaaagaaagtagcctgactaacattgcggctaaaaagaaaaatacgacaggcgaaacaccaaaaactatacgcatgacacctgcggaaaagatgctggcgcaggaactggttgagcagatccaggcacttacgcacaagaacattacggtttccacattacttcgtgcagggctgtaccttgctcagtcagcaggaccagaaaaagttctgaaggcgattaaagagaacatttag

SEQ ID NO: 4686 - DNA, 291 bp, Enterobacter cloacae
aaaatggataaacagctttaccacattcgctggaagcttcatcacactctggctgagctaaattactcacttgaatgttttggcgattacctggccaaacaaaacgattatccttacgatattgacgggtttgaggcgatctatttatatttacaacgtaaatattcatggcctctggataaatccagaggaatgagcctttcagatatcagacttgctctttcagtagagatgaaaggttggacattgcctcgcgatgcgatttttgaagaatttcctggtgtgtattga

SEQ ID NO: 4687 - DNA, 189 bp, Enterobacter cloacae
  unsure (81)
agcacaaacaactgggaaaaagaatacctccccccccccaagggactcgaatttatggaaattccaaccgaccccttccantgcgttctgcttggctggggcggcggaattaagggagggcctttccccggaggggaatcccgcacaaattaccccgcccagggggggcccaccttcccctgggtggtt

SEQ ID NO: 4688 - DNA, 195 bp, Enterobacter cloacae
attcagaaggttacttttatcatgccatctttgttaggcatatctaacaaaaaaagcttgcctaatctgttagacatatctaatctacatctcatcgacaatcacatgcacagtgattactcagtagatgtaccgttcggcggcccggccttaagggaacaaaaaaagcgccctatcggacgcttcgctctttaa

SEQ ID NO: 4689 - DNA, 213 bp, Enterobacter cloacae
aaatctggatatcccccctttccacaggcaggagatgactatatgcaggataatgaattggccaaagttagagatttctggttaacagtaaaactcatggctgagaatagtttgaaagaaatctcattactcaatacacaccaggaaattcttcaaaaatcgcatcgcgaggcaatgtccaacctttcatctctactgaaagagcaagtctga

SEQ ID NO: 4690 - DNA, 432 bp, Enterobacter cloacae
aagggggccggacccggtatgagtcggataatcgcgcgtactgggatgatcagatccagctcaatattgacgcaccgctttatcagggcggcgcggtctcggcgcgcgtccgtcaggccgagggcgcaagggcaatggcatcgtcgcaggtcgatcaggcccgttttgatgtcctgcaaaaaatcctccgtcgcacaggccgactggaccggggcgcgtggactaatggaagccgggaaacgtcagctggaaaatgcgttgcgcgcccgcgatgtctacaaaaatgaatataccctgagcaagcgcagcattaacgatctgctcagcgtggagcaggatgtctggtctgccacctccgcgaaaataatggctgaatacgatggctggagtgcggcgattaattacgcctctgcggtggataatctcatgccg

SEQ ID NO: 4691 - DNA, 195 bp, Enterobacter cloacae
ctcaccgaggggtcgcgatcgagagcgaaaagaatactttctttcatcgtcattgccgcaacgggagatatccccgcctggccgttatttgcattagccgcagtcaccaccaacgaaattaaggtcagggaggcagataatctgagtaacctgttattgcatttcatcttcataatatcccccgactccaggtga

SEQ ID NO: 4692 - DNA, 297 bp, Enterobacter cloacae
atttcgttcgctgtcagacatctgaggaacgatatagggttcacctgctctggcccagttttcacgaacagatggatgattcatttcagctttatctatctggctcgttctagatatttcatgtttgtaattaggttccaaaacgttacttttgtgatagtcaaaagcattctcctcattaatattgccctctcctacaaatttatcaataagagttggatcgttcattattactgtctgaacgggaaaagcgttactgccatcttcgatactaatgggtgcgtccggaacgattaa

SEQ ID NO: 4693 - DNA, 393 bp, Enterobacter cloacae
gcttttaataacaggtcagaatatataccaaaaaggagtgtattaatcgttccggacgcacccattagtatcgaagatggcagtaacgcttttcccgttcagacagtaataatgaacgatccaactcttattgataaatttgtaggagagggcaatattaatgaggagaatgcttttgactatcacaaaagtaacgttttggaacctaattacaaacatgaaatatctagaacgagccagatagataaagctgaaatgaatcatccatctgttcgtgaaaactgggccagagcaggtgaaccctatatcgttcctcagatgtctgacagcgaacgaaatctaaaaattaaacgattccagaaacctacaagtggagctaatcatggacattaa

SEQ ID NO: 4694 - DNA, 696 bp, Enterobacter cloacae
aaattaaacgattccagaaacctacaagtggagctaatcatggacattaaaaaggcctgggaaaataagaccgtcagactttctgttattggcgctctgctggtagtgattgtttatattattagccagtctattttttccacaccagttaagaaagaaaagaaaacacagaaaaaagacatgcagaccaatttgttgttagatgattcgcaaatgaacaaattgagtaatgaagaaagccagaaagtatataaagaaatggttaagcaaaaccgacttgaccaaaatgcggcgaaagaggaccgcgaaaaagcagaaaaagcccaacaggaaactaaagcccaagttgcaagtttaacttctcaacttcagcagctgtctcagcaaattaatgatatgcagacaaatcgaaacggcaatcgtaacttggatgctggtagttcgcgtaaaacgattaatgagcaggcaccggcagctccttatcagcttaatgctaatgcgccgattaatggcgtaaaccctaattacgcttctatcacacctacgcgtaatagcccaatgagaacaatcacacaaagttccattaagactaatggtaccgatggtgtcattcaggttatgcccgtgtctgaaaacagaatcaaggaaggcagagaggtcattgcaggtcttcaccaagggccggaagatacgcat

SEQ ID NO: 4695 - DNA, 225 bp, Enterobacter cloacae
tgcccgaaggcgttaaaagggatagagaatcctttcagaagagcgtttgagttgcagcgcagatcctccctgaaatgcccctcgtgccctacaatctgtcaacagaatgtgaaaacgtcaatacaggtggcggggatttacgtggagtgtgagaaaccgcaaacaaagattaaaaaaaccctgaccgtgagttttcagcagagaaatttatgctactcgccatga

SEQ ID NO: 4696 - DNA, 255 bp, Enterobacter cloacae
cactttttcgcgagaaactgggaaaagtgtcaacccaacctaacggatcctgacgcctacgaacggcagctacagcagaagggtaaagggctggcgttgagatttgttgagccttggctgctagcttttgttaatcctgatgcgaagcagggcaggtgtcagcctgttatggtttgttatgccttactagggaaaaccagggggaaagtgtccaccgctaccgcttcagaaaacttcaggtacacgaactcgtga

SEQ ID NO: 4697 - DNA, 228 bp, Enterobacter cloacae
aggggaggtgttaagcacaccccctttgcaaccatcctcaagcctctttcagatcgatgttccagtttacccggaagctggcgttcagatttagttgtcaaaacttatcacccaccggcacagccagtggggatttttggctgtaaccgctttaagttacagtttcttccttctgtaatgggcatgataaggggccaaaatttagacaattattctaacaatccatag

SEQ ID NO: 4698 - DNA, 270 bp, Enterobacter cloacae
  unsure (149)
  unsure (198)
  unsure (215)
  unsure (217)
  unsure (264)
  unsure (267)
aggaatcaattgccagctaccgcaacgttgcccttttgctcctcaatcccagggggggaagtgctctttagctcagctcagggggcggcactacgcccggcagtgaattcagcagattttagcgagcacagccgcgcacgggatgtctntctctggacggtggaaggatctgcggggacgattgataccggggtcaanaatgaatatggaacatncnggattatcgccctcttctgggtcaggccaatatttctgggcaaacancantaa

SEQ ID NO: 4699 - DNA, 240 bp, Enterobacter cloacae
ggcggcggagtataccacaagctatggcaaaaaatgcagtggttgttttttatacttgtcgcgccgcgattattggtcgacgcggattatgaaggtactctgtccaatatgttagcggcaattaaatgtttatccccggttcgtcattcgttaattgttgttacaaaaaatcgcgcgctctttttcgtttgggttaacaactgttttagtaactttttgaatatcgatgctagaaaatag

SEQ ID NO: 4700 - DNA, 246 bp, Enterobacter cloacae
gcgtcagcagcgacttcaggcagtttacttcctgtgccagttcctggttattctcggcagtggcaaattcaggtgtgctcatttattttcctcattataaaacagcgcatgagcgcgacgatgaaagttaaggcggcggagtataccacaagctatggcaaaaaatgcagtggttgttttttatacttgtcgcgccgcgattattggtcgacgcggattatgaaggtactctgtccaatatgttag

SEQ ID NO: 4701 - DNA, 318 bp, Enterobacter cloacae
cagagtgagattgaaggtatgcatagaactaaatttgaacgacttaaggatgaccttatcggtgaggccgtattatccatactgaaagagaacggacctattacctttgtgtctcttgctaatcgcctgcgggcgatggctaacgttgaatcaaatgatgaacgtaaaaatgcattgattgccgctgaagatgaagtgcgccagcgtgtaaccggcgtctcgcacgaccggggaagagtgatgggcaattatgacatgggtcgcatgcgatctctctttactcacaacacgcttttgaccccagacaagaaacactaa

SEQ ID NO: 4702 - DNA, 183 bp, Enterobacter cloacae
cgcgacaagttttttaaatttttcttcgctatcgacgccttccgcaacgcattcccttcccgtcatgtcgctgtatatctgtatcgctttaataatgctatagtcattgtcgttagcaacaaagtgctcaactatatcgcggtcaagcttcaatccatcaacattaatctgtcggatgggtaa

SEQ ID NO: 4703 - DNA, 246 bp, Enterobacter cloacae
attactggttcatccacttacaatgaaatgaatctagcacaccttaagaaacaaattcattacaatcgtgtaatgtacatagctgtattacatttacgtcatcttccccacaggttgattatttttatatatgatcataaggatatcttttatgtacctcagaaggtaattacacatgaatatattaatcacgaccactgcgtttacagctttattttgtggggcagcttttgctcagtccagtga

SEQ ID NO: 4704 - DNA, 555 bp, Enterobacter cloacae
acttctctcttcatatttgtaaggctctcatttgattcttgtcaaacattaatctggaagactaaaaaatcatttcttttaattcgttttacagaaatcctcctccgttatttcggatattatttgaataattatcaaaaacggggtgcagccatgcgtaagagttacacatttggtattccatttggactccagagagaatcaggactctttttagatattacagaggtcagccggggtatcgactgtaactgcatctgccccgcttgcaaaactgatctgttagcaaagcagggggaggtcaagctttggcatttctcacacagtactgctgtagccggtgactgtgatggtctgatggaagccatccggggaaaaattattgaagtcatcaacgagcaccaggttcttggtttcccaaatcttctcgctggcgacgatggtgggccggtttcactgaatgaggttagtggaagcggcagtatgttcggaggtacagctgatctgttcgtaagcgtcaagccactgccgcctgttgcgattactaacgattga

SEQ ID NO: 4705 - DNA, 183 bp, Enterobacter cloacae
tgtccaacacatcagattgcggcaacgtacgaaactgttccgcgacagattatggcacagagccagatctatcaatgctctcgcaaaatgaaattgggctactttccgagattttccatctactgggggaccagtcaagactacgaatcctgctttactgtatgcgtggttcggtctctgtag

SEQ ID NO: 4706 - DNA, 246 bp, Enterobacter cloacae
aattatttttcagacttaagggggctttattatctcccctctgctaaggtgagtcacaacttcacaatttcaacttatcagaattttctgggattattattctgctatgtgaaatgccatatcctgaagaacatggcttacatgctgatccataatgctataaaagatgtacttgccctttctctctcctcgaacgagtcttgcaccccgcaacaacctcagatgatgactgaccagagattgtga

SEQ ID NO: 4707 - DNA, 309 bp, Enterobacter cloacae
aaacagcttgcgccaggcaatcgcgcagcgagaaaaggagagagagcaggagcagcgccacaaaaagaagaccgacgccgtcacggccggggggtgcagaaggggcaaaaacccgcagagggcaacaacaatcaacaaaagcaggagatccagaccgcgcaaaacgaaccggacaaacagagcaaaaccagaaccgacgggcgaggcaaaaccgggcagccgcagaaagaaggagaggaaaaaggaacgcaggaggagcaggcagaaaggacgcaatccagccggataaagatatttacttgcccataa

SEQ ID NO: 4708 - DNA, 213 bp, Enterobacter cloacae
ccggggaaaggatggtttgggttaggcaagaggaatccgcatggggcgaaggggaattatgacatggtggaaacggtaaaggggtggaaaggaacgatggggaatatgggatatttaggggatgggtttgcacgcattacccgcggtgatgcatcactatttttgggaaagaacaaaacgttggtgcgcatgatgcggaaaaggcgtcagtaa

SEQ ID NO: 4709 - DNA, 195 bp, Enterobacter cloacae
atcttgcagttggagattcagtttcacaagctgcttgattctttccctgattttgattttttctcacatactcttatggcacggtttccgtgccttttttttgcctcgcttacaagcgtctactcctcttctacctatcccaccttacatcaccacttaaaatctatctttctaattccattatccttttcgtag

SEQ ID NO: 4710 - DNA, 312 bp, Enterobacter cloacae
agagatttgtatactgttctcaaccaaggagagctcatgaatgaactaaaatccaaaaacgagaacagtaccaaaagcaactttcccccggttgataatcagttttgcttttaccatgttgatttcagcatagaacgactactttcaacggccgaggatctccagcttgagtacatcttccagaaacctggaagtgaagtaagaaaggatttggttgagcgattcgaacgtggagagcgctttgttacagcttcacactgtgacaatttctgtgaaatccttggttgtcaaggccatcaggaaaatgcataa

SEQ ID NO: 4711 - DNA, 255 bp, Enterobacter cloacae
cgtcatattcctgcgtgccggtctgccgacaccagtgcacgggcttttttcggtcatcacatttccgggcaggagattttatcagggcgtggtgtgactgagcagcaactggggcactgtcagcagcttgcagatttaacacccttaatcgccaaactgggattctgttctgatgttgaccttccgttctgggcgggctttggtttactaacacttacttccataatacgaaatgtgcttgatgatgcagattaa

SEQ ID NO: 4712 - DNA, 183 bp, Enterobacter cloacae
tacagattaacgtcatattcctatatgccagtctgccgacatcagtgcttgggctattttcggtcaaaacaagacctggcgagagatttaatcaagcgtggtgtgactgagcagcagctgggggcactgtcatccgcttgcaaatttaacccccttaatcgccaaacttgggttcagtcctga

SEQ ID NO: 4713 - DNA, 234 bp, Enterobacter cloacae
gtaatgccaatgtttacccgtatccaaaaagataatggatgggatcacctaaatgatttacgtgaaaaatttaacggtaaggtgtttaaagttaacgaacagatcatctcacgctttcagattaaaaacacacctgcgattataactactgaccaagataaattccggatcaccctgtttagcgaggcagaagtccgtggtatcggagccccaaatctttcagaggaaaaataa

SEQ ID NO: 4714 - DNA, 417 bp, Enterobacter cloacae
tttctaagggtaaaaataatgaaacttagaaaaacgatagcttcaactattattgcatcaatgattgccaatactatgagttgggctttttatatctctctcataaatatggtaatgactcctcgtatttatgcggcagacgctatatttgaccagctcgaaagtaactttaatcttgctaatcctaacgcaaatcgcaatgcgacaaccagtgctcaggacattgttgagaagtacaagaatgcggattcaggcgagaatgtcagtgggaagatcaccgagaaatacgtgggtaaagccgaatccgctaatcttaatctcggaaagtatggggcagggaactcaaatgaaagtgtcatgaaaaatgccgcatccgatggaaagtccattggtagcgccgtacaactgccgagtatg

SEQ ID NO: 4715 - DNA, 198 bp, Enterobacter cloacae
  unsure (6)
  unsure (7)
  unsure (8)
  unsure (9)
  unsure (10)
  unsure (11)
  unsure (12)
  unsure (13)
  unsure (14)
  unsure (15)
  unsure (16)
  unsure (17)
  unsure (18)
  unsure (19)
  unsure (20)
  unsure (21)
  unsure (22)
  unsure (23)
  unsure (24)
  unsure (25)
  unsure (26)
  unsure (27)
  unsure (28)
  unsure (29)
  unsure (30)
  unsure (31)
  unsure (32)
  unsure (33)
  unsure (34)
  unsure (35)
  unsure (36)
  unsure (37)
  unsure (38)
  unsure (39)
  unsure (40)
  unsure (41)
  unsure (42)
  unsure (43)
  unsure (44)
  unsure (45)
  unsure (46)
  unsure (47)
  unsure (48)
  unsure (49)
  unsure (50)
  unsure (51)
  unsure (52)
  unsure (53)
  unsure (54)
  unsure (55)
  unsure (56)
  unsure (57)
  unsure (58)
  unsure (59)
  unsure (60)
  unsure (61)
  unsure (62)
  unsure (63)
  unsure (165)
gtccgnnnnnnnnnnnnnnnnnnnnnnnnnnnnnnnnnnnnnnnnnnnnnnnnnnnnnnnnnntatccaccgggacaggcatcagcctcttacgcacctgagcctcatctcacagttttcatgactgactatttcatcccgattcgccctggtcccaccatagtnagtattgcgacacgccgtgaagagtccattggg

SEQ ID NO: 4716 - DNA, 198 bp, Enterobacter cloacae
agttatcatgtgacaatggttttatctggtttgcttaatcaaaaaatcaactggtcaacagggtcaagaggtattttgagaaagcaatgtaaaagggactcttcggagtccttttttatttgtattgaaaaaggttcgattatgaatgaaaacatattacaaggtaacaggaaaaacctgtcacactatccacgctga

SEQ ID NO: 4717 - DNA, 183 bp, Enterobacter cloacae
atgaaaacatattacaaggtaacaggaaaaacctgtcacactatccacgctgaattacgaaagattggtgatttgattaacccaatcccgaacaagaaatatcacatcaaaagaatgatgactaaagccactcgcttattactcatcaaatcaatcagtgaaagaattaaaaataaccgttga

SEQ ID NO: 4718 - DNA, 921 bp, Enterobacter cloacae
  unsure (180)
atgaatgcgatacaaaagttagttgaatctattcttgttaaaatgggttttgttggcgctgtagtggaaaatatatacttggattcaaaaccatttcggcatattcgatttgtggctgatattccagtaatatcttttctacctcatttggtgaaatatcttaagggcgcagaccatctntactgtggtaacgatgatttgcatcctcttttcatttatttttccgaagcggctacattaaaagcaggccctgtaaatctcgcgaactttcgttttgaagtttctatagcttcaactcatttacgactggtctcagagcagcctgatttgcttatcaaaggatttaaccgggataatctagaatacgtttattaccgctcagatttggcctctaaggatcttatactaggccttgttgaacacggttctcctttcataaaacatctacatggacttatacaaaagcgaattttaaacgagttctctctgattttttctgttcttgaaaagattttagaaagcgcgaagccacaaattcttgcttgcttccatagtgttgattatgaaatgaacgtaaaaataatagccgaagctatacctgaaactgtatctaatcagatagtcacatctgattatatagttaattctatatcagatgcggacaagtttataaatcatgttcgtcgctatttagcaggcagggtaatgaagaggcggatatacgctgaattagatgtttgtgaagaaacatcaaatatttcactagtgaacttaggatgctttacgtctcctctgctcgttacggaatatcaaatgtttaagccacactcttcagggttatatcgaaaagctataaacaactccttaaaacagttcaaaccagaaatgcatgtaccttctgaagaactcttttataattaa

SEQ ID NO: 4719 - DNA, 531 bp, Enterobacter cloacae
atgtttaaagaatctgaccacgtggaatttgttagtgcctttctttatcaaaatttaggccttaatgttcccgctgacgatataaccgttcaattatctgatacttcgttcgacaaagtaacctttgattacgatgtagatatcgataatttaaattgtatgttggatctctacatatctgaactaataaagcacaacgcatcttattccgattctattcttttgaaacaaaaaataatttattttcttggagtatttaagaatttcggattttttacgttcgatattcgcggatatagtaatactttaagcccagttaaagttattgatattgtttcaatgattattaatgactgtgaagagttatctaaagctaattcttctactgatgctataagaaatctttatctcgataaaatgaaggtggatgggaaagtgttagttgcgaaatttgcacttaaacagttttttcattccgactttggtgactttatctcatttgtcgaagaaaagaattacagattgtcttaa

SEQ ID NO: 4720 - DNA, 669 bp, Enterobacter cloacae
tctttcattgttaaccatttgaggtttcctatagttttaagggaagggtgcaaaatcgaaagaggagaagtctattcaatttcgaattgcacttataataaagaaagattgcagtatcttttttctcaggatatttacggtaagttgtataattccttagagaaagaattaagctcgtttttctcatttatcaatgttgaggtgcacgagttgttaaaagatgctgtatgctttgcattaaaaatcctgaataagatatctttggatacacctgaaagacttattaaagcttttaattatcgtgactggtattgtagttacgatgttgagctttttaggaaaggcttacctggtcatattctggaagagctcattgctccagatatcttactttcagaccttaacggttgtagaaaaatacttagaaatgcaaaacgatttctaaatggacatacaaaaaccaattgtgtttatattaaatatgaatggtggttggggcctgtggatacctcacactcagctaagttgatgtctgacaaagaaattaataaccgaagtgacttgaagaatttttcaaaggtctttttcaaagagtgtttaagttctggtaagtcggaatatgaaaaccatcttagtgaaaaagaacatgcgcttcgctacaattattaa

SEQ ID NO: 4721 - DNA, 498 bp, Enterobacter cloacae
ttgcgaaatttgcacttaaacagttttttcattccgactttggtgactttatctcatttgtcgaagaaaagaattacagattgtcttaatgaaactttaaggattatcaaagctgttgaacatggctttgtacgtgttgggcagcataagattaatcgccgtattaatgatgacttaaagttatgcattgatttcaatactgatgattatccggcaaatatgccagatatatatattaagtttaacgatacatttgatgggaacggggcgttatattgtgacaatgatgccctcatatccctctataccgatgttgcttcaattatcaatgtgccggtgatgatggaagtaagattgatcaataaaagagggcgtgttgtctgtgattcttcgcattcaacttacgtatctctcgaaagtaatgaccgatacagagtaactgatcgcacattactaataactgaagcttttgacgattttcgtaacgcgtctcaatga

SEQ ID NO: 4722 - DNA, 270 bp, Enterobacter cloacae
  unsure (70)
ccaaacttttatctaacccagtggggaagtcgcttcccttctggggcacttcctctcaaatttgaggtantgtatatgacacattcatctgatgataaaaactatgtccgagcagttctgagctatcttggcatagattttgatgaggcggatatagtattaagtgtttgccattgtcaaagtgacgagctttcttttacctgtaatatcaaagctattgaactcaagaatgctgttgatttatatgtcgatagtatctctgaacaatga

SEQ ID NO: 4723 - DNA, 195 bp, Enterobacter cloacae
ataagatatctttggatacacctgaaagacttattaaagcttttaattatcgtgactggtattgtagttacgatgttgagctttttaggaaaggcttacctggtcatattctggaagagctcattgctccagatatcttactttcagaccttaacggttgtagaaaaatacttagaaatgcaaaacgatttctaa

SEQ ID NO: 4724 - DNA, 234 bp, Enterobacter cloacae
attcagcaaattgccgtaaaaaacagtacagcactgaatgacaaaaaaattcccttcaataccactaaaataaccctcgctatcatcattaactttatttattaccgtcattcagttctgaatgtctgtttatccctaattgaaccggatgcttcgcattcggtttttttttacctttctttacgtcaacctacatttaatgtgctaccgcttggtaatgataacgactattaa

SEQ ID NO: 4725 - DNA, 186 bp, Enterobacter cloacae
gttaattttgattactttcatttatgggatattaaaagcttgattctttttactagccgcctgattcccacgaaaatatttcagatgattttacgggctcttcaacatataaaccaaaatttgaaggactgctctgaagagcccgccttcctgcttccttattatttagccattttctttttctga

SEQ ID NO: 4726 - DNA, 231 bp, Enterobacter cloacae
agacaaggattaactcaaagagaattatctgccatgttgggtgtaactcagcagacttatgctcgccttgaggcaaatccttcaaaagcaagttttgagcgtctatacaaagtgttacatattttaggggtggagatttcgctcagttctgcacctctttcaacttatacaaagcctacgaattttgtagaaaaggagtttgattcaccggcaaggcgtgaggaatggtga

SEQ ID NO: 4727 - DNA, 507 bp, Enterobacter cloacae
  unsure (7)
aaactancgttttccgttctcattacagcctgtggagataaggatggacaggttaaaaatcagtctgtcaggattgtagatatacagcaggtaattatcaactcaggtctggccgaacaggaggctgaacacctgaaaagtgtcaggaagacgctggccgatggacttacgcttgctcaggctcagtatgaaaatttacctgaagagaagaaaaatgaggcgaagcagaacgataataagcttattgaatatcaatggcagaatgagagattccttgccagaaaggctgtaggccaaaccatccagaatgcaatagataagtggcgtattaaaaacaatatctccatcataattccacgacaacaagctctttctctggatgaagggctggatattaccccgctaatcgtaaaagagcttaagggggcgaaagttaaatttggagaactaccggtgattagtttaaaacaaaaagaaaactctccatcagaaaaagaaaatggctaa

SEQ ID NO: 4728 - DNA, 204 bp, Enterobacter cloacae
agcttcaaacttattaataagcgtcaggttttaatgctcagtaacataaggatggacaggataaaaaatcagtctctcaggctagtagatatacagcaggtaattataatttcaggtttggacagacaggaggctaatcacctgaaaaaacttcaggggaaaagttcatcgatggacttgcgcttgctcaggcgctcagtatga

SEQ ID NO: 4729 - DNA, 213 bp, Enterobacter cloacae
tcacctgaaaaaacttcaggggaaaagttcatcgatggacttgcgcttgctcaggcgctcagtatgaaaatttacattaagagaagacaaatgaggcaatacgacaataagtttattgaatacctggggcgcaggtcaggaaagttagtactgttgtcaaccaaaggactactttcaaataaaactaccgtctcagcattcttaggcatctga

SEQ ID NO: 4730 - DNA, 717 bp, Enterobacter cloacae
atcgcttgtggtctaactttcaaaaactcatgtaaaggtggtcagatgttaagcagtaaaaaaaggaagtcccctacaaatatcaaagaatcgctcaatgataacgctgaccgtttttataagatgtttcgcattcataccacggcaaaagttgctatgtcgctaattgccatgaccgctgtagggttttctttctacaatctttacgaacaatggcaggacgctgaagggaagaaagaccatatagctgtaatacggatttctggcgagatgggtaccggctcggaaacgggcgatggaacagtgatcgcaacagctcttgccaaagcttacaataatccccatgccaaagcagttattatcgaggcagagtcaggtggtggtggtccctctgacgccatcattatttaccgccagataaacgcgcttaaaaaccaccagccacagattgaacgcgtatcagatgccggtggctctctttcatctgtagccgctgacaagagtaacaaaaccgggagcacagaacgtggcgatgaagcacggtcgaagcaaaactccctcgaagtactctccagcggtaccggtcgttttttctctgatatcgcagactcatataaaccaatcatcgttagtgtgaaaggcatatgcgcatccgcatgctattacgcggtatcgcccgctgatgcaatttatgccgacagtaatgccctgatcggt

SEQ ID NO: 4731 - DNA, 585 bp, Enterobacter cloacae
acaagttacaggcggggcatcaaaccccagattcatccagaaacaacacatagtcatatagttactattgaggactctccctttctttctcggttaaaatttaaaatcattactgccatagatcagcttcctgaccctaatggcctttatacaaacacctttaacagcattattgaccgtgcactgctgactcatctcaaaaccgaacaggaaaaaatagatagtccaagagtctgcaaaaatgtgatttcggcttttgccgactcaactctttctctgccggtgtttaacatcggcctaaacgagcagtacagatactggacgccgtggggcatcaactttatagaattttcccgccaggccgcaaaagcaaggaccgctgtatttgttcctgatgtgggacagatcgagtggaaaagcgcagagcataaagaactggcggagttaagcctcatcgaccaaatcatacctaaacagtaccactggctcctgggtatcccgacgatgtggcgtaacaactattgcaatcacgatcagaggctagctctttttcgtgaatggagggaaagcaatggctgcggataa

SEQ ID NO: 4732 - DNA, 690 bp, Enterobacter cloacae
ctctttttcgtgaatggagggaaagcaatggctgcggataatacaagcagggcagcagtgctcagaacaatgcttttttttggcatggtcatttattttggttacagcttggctttccagaatactgaggagctcaaatatcagattactcaggaggttaatgcaagccggtccatcatatcaaatgaccgttggaagtctgtcattgcaaatagtgaagcgactttaaattggttggtacatgactataagttaattgactatctgaatactattctgatccctgacaccaaaaaaccagccagaggtattaacattgttgctgaaaaatttacctctattaattacactatggccaaaaacatacccctcttactttatcagtccattttccggtggaacttaatcctggggtggctaatcgtttttctgccctatctatttgccatgctagcagatggaatgtaccagtggaaattgaagaggtacgtatttggtaaggttacagttcagttttatcgtatttggtttcgagcattttgggtgatcagtgctttaacgatggtctacctggtcatgccaaatatgtcactatttaacaatatcgctcaacttttcccaccagtcgctttattgatactgggaattgcattgaatcgcttgtggtctaactttcaaaaactcatgtaa

SEQ ID NO: 4733 - DNA, 510 bp, Enterobacter cloacae
ggatcgatgaacaacatattcttacagtttcacatttatgggcttgatgcaagcaaggattatagtttaagtataataacaaggaatgggagccaaccagcaacagttatcaatattgatgatcctaagaaccgggacctcgctcttttaaaagtagaaaaaaatactattgtcaaagccccacctaattggaagcttccagtatgtgataatgttctagctccaggtgagtctgtttgggttctatcgggaatgtataatacgctttcaaatacgtatgcttcccccgactcaacctactattataaaggaatagttggttctgatggtttgactgctttttatcaaaatggagttagtggaagcgctgtgttaaaccaatctaagagttgcttatatggtgttgtgagtcaacaagacattaaaaagatcaatgtctatcagatatatattacgaagattactacaaatgaaattatacgcggattcataggttataaaaataattaa

SEQ ID NO: 4734 - DNA, 258 bp, Enterobacter cloacae
atgagcgtaatcttacaacaggcaattccgacgttatctgcgttggtctacctatctgaacctttaaaaggaacgtctatcatgtataaacttttacccgcaatactagtctttctttcggtgttccttggactaatcgctctactcagtgctatcaaaaatggttctgatgaattggcggtattcctcattacactttcggcgtggttcgctgctttaagtaagttttattcacttaaactgtataaaaatagttag

SEQ ID NO: 4735 - DNA, 183 bp, Enterobacter cloacae
cggaaatcaacgactgcactttcttattatatctacggtgcaaaggaagacggtggcgaagtggttttaagaccatttattgtaaatcctgatgaattaatgcttactccagcggatgtcgttgaatttaattcgcaggttatcaacgttgatcggcagcgtcatcctgagtggttccgttaa

SEQ ID NO: 4736 - DNA, 183 bp, Enterobacter cloacae
cccccccccccttttttgggggggcttggggcgtggggaatggtctacatgactaagcaggggctcgagggcagcacgcagcaacttaaggcaaactggcaggatttacccgacagcgtacccgacgtgaaaggctacaccggctgggatcatatgcgctgtgatatggatgcggggcgataa

SEQ ID NO: 4737 - DNA, 711 bp, Enterobacter cloacae
ctgatgaaaggattatgtaccgttctcgcagctacgtccgttgtgctggcaaccgggtgccaggcgaaagagccaccgacacaggttgtttaccggttcgatgatcaccgttttctcgaattgaaaggctggggctgcgaaggtgaactctggtatacggatactcttcggggtattcataccaggcccgtcagtcaattttatcggattttcaccaaaaaatttgttcatccttctgaacgatatattgccatacccacctgggatgacccaggaacaatgatttcaaaagattatggtaaaacatggtctccccagtttttttcggtagggcctaatgagcccgatggtactaaccaaccatcctatgaggatattatttctttcaccgtcgtcaacgatcagggctttttactaaccaaacaccggctgtatatgtcatcaaagccatttgaagacccgcgcattctgcccggcgggccggggattgcctataccgtggatgacggaatgcgaaataaagtaagcgatacgctggacccccgtttccctggctgggcctggggaatggtctatatgactaagcaggggcttaagcacagcacgcagcaatttaaagctaactggcaagatttacccgacagcgtacccgaagtgaaggggtacaccggctgggatcatatgcgctgtgatatggatgcggggcgataa

SEQ ID NO: 4738 - DNA, 711 bp, Enterobacter cloacae
  unsure (634)
ctgatgaaaggattatgtaccgttctcgcagcgacgtccgttgtgctggcgaccggatgccaggctaaagaaccgcccacacaggttgtttaccggttcgatgatcaccgttttctcgaattgaaaggctggggctgcgaaggtgaactctggtatacggatacttttcggggtattcataccaggcccgtcagtcaattttatcggattttcaccaaaaaatttgttcatccttctgaacgatatattgccatacccacctgggatgacccaggaacaatgatttctaaagattatggtaaaacatggtctccccagtttttttcggtagggcctaatgagcccgatggtactaaccaaccatcctatgaggatattatttctttcaccgtcgtcaacgaccagggttttttacagaccaaacaccggctgtatatgtcatcaaagccatttgaagacccgcgcattctgcccggcgggccggggattgcctataccgtggatgacggaatgggaaataaagtcagcgggaagctggacccccgttcccctggctgggcgtggggaatggtctacatgactaagcaggggctcgagggcagcacgcagcaacttaaggctaactggcaagatntacccgacagcgtacccgacgtgaaaggctataccggctgggagcacatgcaatgcaacatggatgcgggaaaatag

SEQ ID NO: 4739 - DNA, 204 bp, Enterobacter cloacae
  unsure (86)
ggagataaagcgatgaaaggcgtcattaggttaaacgatccgctgataagcggaagaaaagtcactaaggcctctggggcaaactntatggggcagcccgtggccttaaaagatgatcttgcgcagtgtccgctccataaagggaagttcgcaatcactgattgtcaccaacctggaacatgcattggccttgggttgtggtaa

SEQ ID NO: 4740 - DNA, 198 bp, Enterobacter cloacae
atggctaaattaacagacatttacagttacccatcgttgatagaaattgcctatcaagccttgtcatatctgagttttaacctatcaactgtttatattcgaaaaagagataaaaagcagtttttatataacctgttttttgtctcaaaaggagatagttttgatactgctgaaaaaggtctaaaaaggtgtgtttag

SEQ ID NO: 4741 - DNA, 186 bp, Enterobacter cloacae
actggcgaccaagatcgagaatggtttgggcacgaatgtttccgtcgaggtggcggtgaatatcagttaaaggcaggcgtgtatcaatcatggtcgcactctttgctggttaaagtgcgccatattataaaaacaaaacggggtaaaaagctatttgcgcaagggaatattccgttgcgcaaataa

SEQ ID NO: 4742 - DNA, 303 bp, Enterobacter cloacae
gcgcgggattcagccaggcctgtgcggcaagacgaaggcgccaaagcgggtgctctggttccagcgacgcgccagataaccgtcaaaccagtccgtcacggcagcgatcaggaaaataagcgcacaggcaaaaggcgcccagacgaccggcaggtaaaatgccaggacgaagaacggaatgagcacaacgcgaaagagagtgagcaacgtagggatattaaatcgcatgatgacggtaactgtctgttgtcagtaaaatttagctctatgttgctacagagccctcaatgtttcaacgagtag

SEQ ID NO: 4743 - DNA, 222 bp, Enterobacter cloacae
attatgaacattaccgacaaagaacttatctcaaatacagtgagacagtatggatggaacttacgagagttcaatcactcaacgccttttacatctcattttatttatatcaccgactatcataaagataatacatggatgatttcactttcgcaggaggattttaatacaaccaaaattttaacatcgttaagtctagggaaggtgcgaacaagttcctga

SEQ ID NO: 4744 - DNA, 516 bp, Enterobacter cloacae
atggtagaagcacgttatcaaggcaagcctgttagcagtcttcctgaagaagcttttgctgaagggttatcgcgatccggtttaagccccgttctgctactggcatccccgaccacagtacccgttaccacggatgagcgctggtggctcgcaaaggaaaacgtgtcaggacattacggcaggattttttatgctgcggtgcgggagttggtcataaggtcggatatcatctcagtagtgagaagtattgcagatgagaatttcacgtccgaacatatggggtacttcgagcgacttacctctgatgaaaaagaagtcgtgtttagtgattacctgcgcactctcgctgaaggcggtcttacctgcactgagaagaatctcgtcaaactgacgcaagatttatacccgattgatgcaactcctgacaacattagaaagctatccacggacagggatgcactgaacgaactacacatcgatggtatggtactttttattaccggccctgcgctttga

SEQ ID NO: 4745 - DNA, 501 bp, Enterobacter cloacae
aggtctaacatgatagtaaataaaaacaggtttatgcataaaaacgggaaaaggtttaagtccatcggaaggtatttaagattttggcaagcagtagcgtcctctggtttacccatggacatggtaatacgggaaaaaccatatcaacttatggtcgctttgattgctttatatacggccatccctgttgttacaatagtaattttatctggtcagcaatcgcataagttggaactaattgctgtgcatttcagtacaattatcacgatggtgtttgttttgcgtcgaaagatggggaaacgttggctggatttatttgaagaaaaattagccatttataaacctaatgataaactcgcgcttagcgaattacacgaaagcatacgtgagaaaaatgggctagacttgcaggatttacaagattggtactggaaagagaagatgacatatgagtatcacaaagaacgtaaaacaactataagctatcaaaaattcaagtag

SEQ ID NO: 4746 - DNA, 186 bp, Enterobacter cloacae
tatggtttttcccgtattaccatgtccatgggtaaaccagaggacgctactgcttgccaaaatcttaaataccttccgatggacttaaaccttttcccgtttttatgcataaacctgtttttatttactatcatgttagacctctatttttctgtaattctagaagaatgttaccttaacccttaa

SEQ ID NO: 4747 - DNA, 201 bp, Enterobacter cloacae
ataacgcctaagctctgcacatcatccatgtttctggcctgttggctgtctattctgatggctgccatcgcgtttgcactgagcaaaagcgcagccaaaatggcgattgcgattcttttcatgatatgcgctccacgactgcgtgctgtgatacgggggaatgctctccttctctgttcagggtttctgattaaagtgtaa

SEQ ID NO: 4748 - DNA, 189 bp, Enterobacter cloacae
cgtgatccgccaggctttctgatcccgcctttcagcgcaagcccctgccgcaagcggggcaaaaggcacaaaacaacaactattttacaaattggcgacctggcaggctgctttatcgcccctttaaatgatatactgcctgtcgttcgttcaaaaatagttgataattacaacattcccttgaattga

SEQ ID NO: 4749 - DNA, 234 bp, Enterobacter cloacae
cgcaggtggcacatggaaattgatctcgataacttactctttaacgggctggatgaagcagaagagcgcaacgcggaacgtctcgacgatgcggataaaaaagcccaggcgattgtcgccgatgacgactgcggggaatgcctgcaagatctgaagaaaaagcaccgggctccccggtgctttttttatgaatgccttttgttacctgatatcagatctccggcgttttgctaa

SEQ ID NO: 4750 - DNA, 231 bp, Enterobacter cloacae
cccggtaaaaaacaacgacaccggtgtgaacagataaagttgcacgcgaaagttctggttatcaccaaacgcgttaatcatcattttgaaaactttaaacagataccacagtgtcaacagtacggcgaaccaggaaaaatagataatttaccgaattcgaccatggtttatggttttaccgaaattcgcaccgttaaagaatcccaaatgaagcaccatattcctaaaagt

SEQ ID NO: 4751 - DNA, 1110 bp, Enterobacter cloacae
gtggatcactttttacccgttgttgacaagatggctttaaattatattcgtgccgagcgtgaggcagaagaaccttaccggcagatgctgagccaggctctggccgatggaaatattggccagcctaatctgagatcagagttgatagatcgatgcattgtagcctggcgagctgataacaggggggcgacgctggaagctgccatgagtacagagaagggctccaaagagctcctgaaccagctctatatgctcgctgatgtggggctcaaacatcttcccggggttcgtaattttattagcagcaaaggctatgagctggtcaggttatcggtaaatgcttcagggaaacttgttgcatatgccgcaccagcaaattttgaatgcgacaaccggatggaagggcatgcctgggttcatcgaatggtacttgctacatcccgaaatgtcttaaacgtcactcatcaacgttttgcgaaaatgaaacacttcttaccagctgaaaacaccctgttcgaagatgaacagctggtggccacatggtcgggcaaaaagactgctttcaaaagcttcgaagagaagcagcgttattttgatacatgctcccgtggcgctcaggctcttaagcagtttttaaagctgaacgatccggtgatttacaccaatctgcttggccagtggattgaggcctatgaaagtatcaatgaaaccagtgagtacgtacagcaagtaagcctaatggctcctgttgcggtcaagagcgaaaaaggtaaagccagcctcatctatattggcactaaagacctggccgactggttttatcagaaagcgccgacacccgagttgcaggcgctgttccttgaggaatacctgtccaaatttgaaaataaagaggtcaataaagaaaagctactttcacgcagaaataccgctctgtctctcagtttttacaccatggacaacggggaagtaccagatgaaatcctcgtcaccaaatcagttgataatgccagacggtggtattcaggaatgttcacaagcatgccaacgatgttaaatgaccagtggtccgtcttcaccacgggagctggcaggatccgcgcttattta

SEQ ID NO: 4752 - DNA, 276 bp, Enterobacter cloacae
aactggcagatttgctacacagtaaaccttcatcgccgcgtcatagtgcgctttcatagacgatatctgctttcaaaggtgagcagatttgccacatttttcatgtactccctttcaggcttagagagttttattgtgcagtcacccgaaggcgctcctcacagactgccggaacattggtggtcgcagcttaagtgcgactgtagccacccgaaggcgctcatcacaggctacaagagcattggtggtcgccagtgcgacagtacaacagtttga

SEQ ID NO: 4753 - DNA, 459 bp, Enterobacter cloacae
cggaggggcaggagatatctcatgtacagaaacgacagaaacgtggattccttcaacctggttaatgctcttcagccggtctttcgtaacaccggctgtgggatgtttgaatatgatcgtaaaaagcagaatgaaaccgctgattcaatcttacgagcgttggcgttaaatgccgatttcgcgagggccttaaaacagtacgtccggattaattctgtacgacgggttgttcagttcgatgacggctcggttcgctatggtattcatgccgaatttgaagggcataataaaattaattccttccgtatttttaaagatgaagatacagacgcatttgactcctatttttattcggtttgcgataataaagctgagctggtggattttaaaatggactctctcgatattcaattgcaggcagtttttgaaaaggtgacaggtatttttctgtcacattaa

SEQ ID NO: 4754 - DNA, 369 bp, Enterobacter cloacae
aagaaattacagtgtgggttattagccagtaggtcggagttttatataatacccaaaaacacaggaggtattatgaaaaccaatctggcctatgcatctaattgctccgattctgtctactcctatatttatcaggcactgcaaaaacgctctggtgccgagaatgaaagcctttatcagcaggccatttccagctgctgcacagataaacaaaaaaagaaactggccgggtattatgccggtccatggaagctgctattcaacgcgtggtgtaacaatcgcgtccctaacacagcggtgctggcccttttactccagcagtgcttatctcatttccagtgcgaaaaagtgatcgcagcctggcagtaa

SEQ ID NO: 4755 - DNA, 555 bp, Enterobacter cloacae
aatatagatgagatgaatatgaaaaacgtaaatattttggataccgatattgcggccattaatgctctttctggcgtaaaactgactgactttctcactgccgggtatcaggtaaactggttaggagaaagggaggtttcgctggtgggctttccgtgtttagcaagcaacaagcagccggtagaagttggtcccggcattttcattaatcgcgtgtacagcagagacagccagtctctgagcgggaaattgcgctatgacctgtctaatggtctggcaacgagtgcattttcatttttctcccagtcaggctggtatgggggattccgtgtcgtatctttccgtgacaacgggccagctgcgttaatcaacattggtattgtccatgagaatgttttgaatgcattttgtgctgacttcccccgggccaatgtgagcgtaacccgttttcattgtggcatgacgcttgagcagatccgaatgttcatttcagacactgcttacgatatgccgctttataacaacgagtctgactttcgcaggctcgccagttag

SEQ ID NO: 4756 - DNA, 237 bp, Enterobacter cloacae
aatcgccagcagatatcaacgcccattaagaaactccattactatcgttcgtatgagataactatcatttcagaatactatgacttcttcccgtatagaactaatcgctcacgccatttagctacttactttttttacgtacgcttgcagcgcagtaccttgagagaagtaagtaagactgggcgaagccaaccggttccgccacctcgctcaccggcttttaggcgtaagcactga

SEQ ID NO: 4757 - DNA, 243 bp, Enterobacter cloacae
cgtatcaccctttcgagcggcgggaaaaccaccgatgatgacgtccgggcttccggactgtattggccccgaatgtgcgctgacatctatggtcgctctggcggcaggctgtcccatgttcaaaaatccttctacatattagctgttaattttaacaacagcgcctttaatatctgtcaggtttgtaccattgagatgaagagtatcattagctttcatctcggcatttattccgccgcctaa

SEQ ID NO: 4758 - DNA, 186 bp, Enterobacter cloacae
acttctacttctacttctactttttctaacaaagatgaaatttttgtccgcatttccccggttctgttgttcctgtcattaaccattgaagaagtgttaacatcaaacaaattcgatataacatatgtgtttttgacttcctggtttagaagcgcgatactatttattcaacgcaggagatcctaa

SEQ ID NO: 4759 - DNA, 630 bp, Enterobacter cloacae
  unsure (481)
acaactgtaaggtcaaatatggaagctatcaataattacaatagcggtttaaatcgccatcaattaggtgggtttatccctgtttacgatcaattagcagggactcactattttttgattgatggcaacagattagggtttatgtttatctgtaatccatcccctggagtttttgataatcagcaagatgttcttgctgaaatgttcaaaatggatttccctacagatactgtctgtcaaatatctctgactgcattgccagacctgactttacagcttagtgcttggtcagctgtgcgaggtgggcgtatgactgggaacgataagcttaaagcagatctgcttaatggttatcagttggactactacgacagaagtatgcataagcctttaaaacctgatcatgatacccttatgttgagggattttcaggtatggatctcgctatcgattcctttacagtttgcctttcctaccgagntggaacattcgcgtatcgattcactttactctgaacttgtaagtaagttaattacgattggattgcatccgtttaaggtcgatgcagaaaactggctctattgtatagataaggtcgtaaaccccgcgaaagaactcccggtgggctga

SEQ ID NO: 4760 - DNA, 459 bp, Enterobacter cloacae
actttcccgttggggtttattatgaaaacacctaatgaagctgaatcagagcttttacagacattagctcaagtacgcagcgtaaataaaaagcgacatcatgacgaggcggaagagccggataagccatcggtagtgaagaggcaacgcgttacacaaggcttaacgcggattagtactctcgatcgccaggctgtactgcatgcagccatacgggacattttgctggggaaaatcacacagggagaggcgctgaaaaggctcagggtcgaggtgttagggctgaagcaggatgaatatgcaaagctggtcagcgtatcccggaaaacattgtcggatgtagaaaataacagaggcaattattccgctgacgtcataaataaaatctttaaaccctttgggcttcaaaccggactagtgcccgtttcaaaatcgcttatcgcttcacttttctcataa

SEQ ID NO: 4761 - DNA, 189 bp, Enterobacter cloacae
tactcccataactctaatcagcctggctggtttaacccttcggtacctgtccatcaggtgtcgtttttttccgtaagaatgtctatagatggcgctccgcagaaagaggtgggtgttacggttattctgccagaaatcccgttgtgttcaggctgtgtcctgtcgttccggcaggacacttggctgtga

SEQ ID NO: 4762 - DNA, 939 bp, Enterobacter cloacae
gttatgacgattgaaagctttttcatcggcactcgcatgtcaggaaaacgttatggacctcagagtaaagacatgcaggtttctgaattcatagcacttatatctccgaaaaatgaaccagagaaatttgtcctacccgatttctccggtctggcacgtcggattgacgcccagatccggaatcagtttattcagcaaaaagaggatgactattaccgtcgataccgacagctttcggaccggtggtatcaggccggctctatcagtgacagaaacaatcgcagccagcgttttgagaaggtcatggatgagtcgcttgagtttttggtttacagtcatgatgttatgcccaacatcaacccatataatctcaaatacgatgatcgcgttcaggttagcacgaaaggcaaaatgtactgcgtagcgcttctgttccatattatcgctcgagcggcctatgagccagtctctgtaggtgcagatcctacgctgcaaaggcattgcaagtggctgaaggactggattaataaaacgttaggggatcattttttagagggaatgatgattactttcgccctttgttatcctgaccactttcctgccctgcagcgccttagcggagagttagaaacacgtgatgttgacacattcctggctgacgaagttcgtaaggcaaggcaacacacagaggaacaggttaattatcataacggccggtaccggttgaaattcgagtacactcactttcaccaggagcaatttgattttttagccgaaatgcgtgatctccattaccggatagatcgtattgaacagctccttcagaaactgatagataacccggtagtagatttcagtgaagctgctgttgcagggcagtggattgacgaacaagtacagctgcttgaaacaaacgaaacgaagctaatactcccataa

SEQ ID NO: 4763 - DNA, 291 bp, Enterobacter cloacae
agtccattgagtaggacgcccgcgccctgcggggctgaagagtgtttgacattgatagagtccattaacgttaataagaggactctatcatcgtcaatcgttagtaatcgcaacaggcggcagtggcttgacgcttacacccaatctccggagattcacatgcctttctctgattttctgaaaatcattcagaagtttcagtgtgcaactgtgctggaaaaagtactgatgctgctgtttgtaattctgatcattgtgcaacaggtgatcgatacgttctgcagtcgataa

SEQ ID NO: 4764 - DNA, 597 bp, Enterobacter cloacae
tcaaggggcattatggcacgcacatacgttaagcaaacagtacagaacaatgaacaactttttgattctttagtgataaatgccatagatttccttgagtcatcaattgatgatttaaatattaggcccaagaattcgattgttgatttctatacagccattgaacttttcttaaaagcaaggttaatgctcgaacactggactttaatattagatgaccctagcaaagctaataaacaaaaatttagcgttggtgactttaattctgtgtattttaatgacgcagttcaacgtctcaaaaccattattggcattaaacttgatgacaatatccttgatgagttcagaacgttaggtgcgcataggaaccaaattgttcactttgcacacactggatattcaagcactcaagctaataaagcaggggttgtagctcaacaatggtcttcatggcaccatttatataatttactcactgttgaatggaaagatgaatttattaaatttaaggaagagtttgagcgtgtgcataagagaatgctgcaacaaaaagatttcctcagcacccgattcaatgagctttcaaagggagattga

SEQ ID NO: 4765 - DNA, 453 bp, Enterobacter cloacae
gtgaagaccaatagattcatagtttctaccgttgattgtatcaatgaatttgcaagtgacgttccgcagagtgtttccttacggatagatacaatgcttgaacagcgtatccgcaaattggcggcatacgtgaaagaaaacgatcttcatttaactgagttttacttctatgacgctaactggtcattttgtggtgaagatgaaattcaagaaataaaagacatggatgaatataagcatagcgacagcataaagcaggaagcgatgctgcgggaagtaatgccatcagcacgtacggaatgcccggttattagggtgatgaaagattcatttcagctttcagctctaccacgccattgtggtgatgacatgactcttaacactccttttattccgctgtctgagttgaaaacaaataatacggcatttattacgccgccaacctataactaa

SEQ ID NO: 4766 - DNA, 414 bp, Enterobacter cloacae
tgcagcatataccgtggttcaggaaaatatatgtttattgaaaaaagcgactcattccttgaattatcctcagaagttatttttcctgaggcggctaatgctgccattttgaaacatgataaatgggcggatgtttgggagaccctgacaaccgatgccgatctgaactataccgatgaaaaggagactgtgagtctttcttctctggtcatgtcagccacatctgctatttatcaggctattacggacggctggacaatgtgcgtgggatacagtggcggcaaagactcccattctcttctgcacctgtttctgatggcattgatcagggcagtacgtaacggcacaaatatcagcgaacatcatttcattcagatgtccgatacgaactactaccacactgttacagcgtag

SEQ ID NO: 4767 - DNA, 222 bp, Enterobacter cloacae
gatatttgtggtgatctcataagcacattgtggacatttattgatatcttaactgaaaaatttgaatggtactttacactttgggcaaagcaaactatcggtgaattgctctaccgcatagcccttgcgattcccaaacaagaaattcataaatcatctcccccatttatgagtatcattaactttaaccggctttccacggccccatttgaccgcacttaa

SEQ ID NO: 4768 - DNA, 228 bp, Enterobacter cloacae
gcaaaaccattggctcggtcgctttcagtccggttcgccaagacctcatatcagtacttgatggctgtgggaaatcttcgggatgcgtatgccattcgcccaaatagactagagaaccatctgattgctgaaataagtcatccactttttgctgatgatgttctccttttctttctattcgtgttcgcgatcttacatcacctgatccaggttctgatatgtgagtga

SEQ ID NO: 4769 - DNA, 930 bp, Enterobacter cloacae
catgattggttcataggaactatttactccccatacgttatgaacatattcttgccccaacatcttgacattgccaatccgtatgtaaaaatacaaaaaaaaagtgagcaagatagagaaatggaatcaaaaaatagtagtttttattttgatagagttgactttttatctaagtctatcagctattcaacattaatgatttcctgcttatcgatcgtcgggatttttttgaattctcattggctctacggtatcgcaaccctcacttttataatacaactcctcacttggtttgcaatgcattttaaaacttcgtatgcagctaaggctatagaaacaaaaagattagaaatgctgagaggtattataggcgaggaaaatttttatcgagagcggctctacattgatgggaatgcggaaaataaaaatggctttcgtgcagagaggttaataacactcatacaagagaatgcatactggaactctatcttatatattaaagctttccagcagaagttattctatttattactaacaatactactactaattactataattattattatgtataccacgctgactgataatttagattttcagtatagccgcgccatatttgggatactagtcataaataatttctataatttattctcagaggtgtcaggttttctcaacgctcacaatgagatgaaaaaaatagatagcttcatagagattaataaccgcaaagcaccagaatatctatcttatatatattctaaatacgaacatgagatatttattgctccaagcattaataatgcaatttatttaaaacacagtatgcaaataaaacagacctgggcccagcggctttataataaaaataactttcaaagcaaacaattgatcgacgcgattacagaatttacattagtacgcccg

SEQ ID NO: 4770 - DNA, 792 bp, Enterobacter cloacae
cccccgttgagagctcctttgccgctagtggcaggtgtagaaaatcagcgcttgattgcgcatccttccggtagtggcctttttgcagatgtgctaactctcaaaacgcactcgtccggcgacgaggtcatttcacgttataccgtacagaaagattacaatccgcaagaaggaggcggaaattatttcctgattaaagcggcctgtgccgctcgcgactaccctgcgctggcgaatgatatttactttactgtagtgaactgggatttactgcatcgtagtaacttggttctggctgaactgcttaagaccgtgaacctcagtgctaaaaacagcagtggatttaaagtaccggaatcctggcaggtgaatccccttacagaaacgcgcctggtggtcgagcactcgtttgatggcattaactacggtgtcattaatctttgctttttttcgcaggagatgttgtttaccgcgcaggatgtttttagcgtttcgattaaacggtttcacgatcgagaacctgccgttacgcttaagactgaagcacttgctactattccaaatgagtttaatccatccctcggaaaaacactgtggacatgccggggggaaatgttcagcgcagaggaagaaatgcgcgctgtttaccagtgctatatttttagcgtgggcaaagtctggtgctatgcagaactgattggcagacaccgtaactatcatgattaccacttcgaggcgaataaacgctgcctcgaaatcatcctgtcaacattccatatagaaaatgtctaa

SEQ ID NO: 4771 - DNA, 399 bp, Enterobacter cloacae
ttaactgaatctactgcaatgaatgaaatgacaatgtttggttacgttgatagagcattaactttagcacagaaaagatatgcagacgtcaagaatcgtgatccccaatccccgcttttgcaaatgtacgactctattgtacaacaattattatttctacgggatttaatcgaaggcaaggaaaaggatagagcgaaattatgggatatgacgttcggtatgtatgcagggaaggagtttgatcattctgatgagttgttttttgaaaggttgtcagatgcctggtttattgtggatcaaatccgccgagggttaaaggttaggctgccgcatgaggtcgataccaactataataaaaagaaacaaaacctcatgaagaaattccctgatgaattttag

SEQ ID NO: 4772 - DNA, 252 bp, Enterobacter cloacae
ttctctgaggtcagttactccactcatggcattagataccaggagcatattaatgccagtaagaatgatgcctgtaacaacagcaaaagttataaacgacctgaaattagtcaggttataggtttcatgtctgacaccgcttattccatatatctgaaaaaatggcaatccaaatattaccatcaaatccagataaagaagaaaacgaataacaatcataatcaggtcgttcataatattacttcactgtaa

SEQ ID NO: 4773 - DNA, 405 bp, Enterobacter cloacae
tgtgtaaagcagcttaaaactctaaatggacgaacaggggaggtgacaaagatgacaaccaatacaacaacgaccacctaccgctcagaagaaatcgtgccgttcagacggcccaaaggggatctggatagtcggtatatgcctcaggtgtatgcaatggtgcggaactgggcaagtaaccctgctcaatatggtgagggtgtactggcctcctaccgccaaccggcagtaaaccttgcctaccaggtaaaaggaactcgtgttgttttaattctggtaccagtagagtgcgagccacctggagtgataatgacggaaacagtcctgtggccgtcactatcacttgtagaagtcttgcagaccttgcaggaggcctggcaaaatattccggcgttaaacccctga

SEQ ID NO: 4774 - DNA, 306 bp, Enterobacter cloacae
tcacatacaaaggagggcattatgaatacatttttatacgtgcttttggcctggattgttgtgctttttatcgccaacaaactgctcgcaagacgtaagcccaatacggttaaaatcctggtacagcgcaacgggaaagccgcagaggttgatgctgtagtggttcagggttcaaagagagctaacaacagttctgttgcggacagcgacgcggtagatagttattttgaaatgaatccttactcccgcgaaaaccaggcgaatggttgggctatgctggccagagacgatgaccagcttaaataa

SEQ ID NO: 4775 - DNA, 309 bp, Enterobacter cloacae
ccattccggcttgatgccatcaaacttacaacgtccgtttatgatgacgacattgatacattccagttctctagccttaagagcagactgaatagccctgatgtgcccctggttttgcttaaacgggttctgcaacttgagggttcgggactgagtccatttccgccagtggctttcctccagagtaccgtagagcttgcctacgtagtttttctgctctatgacgtatataccatgtggggctacgagaatgtgatcaacctgcgtagtgctatgagccgacaactgaaaggtgagatcactaagtag

SEQ ID NO: 4776 - DNA, 222 bp, Enterobacter cloacae
accggctggatctgcggcgtttgctgcgccgttgaggtgcccattttaggcggaggggtgatcaacattccgctggacgtgttacccgagccgctggttccattaacggaactgacgggcgcaggcgcgttatttgaacttgtacagcctgccagccagagcgaaaccagtgataatgccgcaacacgtcttcaccgccggggccggcaggaaccgcagtga

SEQ ID NO: 4777 - DNA, 561 bp, Enterobacter cloacae
ctgatgaggtttttgaatccccaatggcgaaagccgtgtacgttgctggtgggcaaagttcgcttgctaaaaaggttggcgttacgcaaggagctgtctggaagtgggtcagggggatcaagaaagtttctccggtccatgcagtggcagtctcaaacgcagttaatggagttgttaagcctcatgaactgcgtcctgatttgccgactcttttccctcacccgggcaatgaggtgtgatatgtcgcggcatgctggaggaatcatgaatcactctgacttcgtacgtaaatattcattcgataacccacttcagcggttggtcatgcttcgcattttaatgggcggatctatggatggagaaggggagcgagtaatcgatcatcaggtactgtacgaattctgttgctgctcaaagcaggcaatgtttaaggagatcaaggcccttgaacgagcaggcttcctgaaagtgagaaaaattggtgctctcgataccgggcttgcagttcgtcttgagccagctcgcggctacacaatcacgccagttcaggagtttgtgtga

SEQ ID NO: 4778 - DNA, 210 bp, Enterobacter cloacae
tcacccaactgcttgttttcgataaacaagggaaacttacgaaacactttacgaatctctgcaagcataataaataaattcaactatcattcatattgtgaatggatacggagtaagagcgtggagcctactaatttaccagccaaacgcctgaatgaaaccagcggcgaagataagccgcaaattttccccgacgtcttcactcactga

SEQ ID NO: 4779 - DNA, 201 bp, Enterobacter cloacae
aatagtggctctggctcatcgaatgaagacctatgtcctgtgattattgtcaccaaatatcgtattaaaccctccctgtcactggctaacgacgaaaacttattttatcattcaaaaaatcaaggcggattgatccggcctgaaaggttccaggttacgcttagttcaggttgcactaatcatccgcccacttttacttaa

SEQ ID NO: 4780 - DNA, 354 bp, Enterobacter cloacae
catactccgaggaataaaatgaatattgaagttttacgctatctcgaaagtgacggtcgcgaacacgttgaggaaaaggtgcaaccgaccaagtatgatagtgaagcaacttttgcagtaataaagattctcatagccaatgatggcaatgcagatgctctgagtgataagcaaaaattccatctcaaaactttcgtagaacccttaatcaaccgtgttccttgctctggtatctatggtgaagatacctgcacaggcgatggctttgttgacgatgaatctctgttgatgagctatcaagaggacgattttatgtgccaacactgccggtatgatgcggaaaatcgacattaa

SEQ ID NO: 4781 - DNA, 399 bp, Enterobacter cloacae
aagggcggcggcatgagcaggaaaagcacatacaaaaccaaagccgaaaatgagcacctggcccgcgttgccgcgctgggatgcatcgtctgtaaaaacatcggacatgaagatactccggctgaaatccatcactgcagcaaaggcaccggcttagccgttcgtgcagataatttccatgtcatcccgctttgcgccattcaccacagacagggtggccacggcgttgcaattcacgctggccgaaatacctgggtacagaaatacggtacggaagcagagctgctggcacaggtaaacgcagaattggggatagcagcatggcattccatccaatcaatatcttcacattacaaccttaatggcgcggccagtttactgaaggaagaaaataaatga

SEQ ID NO: 4782 - DNA, 282 bp, Enterobacter cloacae
gcaaatttaaattactctgatgtctccaacgataatacactgtgtaaatatacagtgtggtggtttctaacgggagatatcatgcacatttcagacgatgtgatacccggcgcagcggggcatactggccctgttttagtctatctagagtgtggtcggattagcggcggatttgttttacagccagatgagttcgttacttcgctggctgctcttgatgaagcgcgacagcacgcaggccttactccgtgctcttttagccatccagtaagtgatttataa

SEQ ID NO: 4783 - DNA, 267 bp, Enterobacter cloacae
actgttaatcgctcattttgttattggtatctctctgagaacaattgcaaagaaaaagaaatgctcggatggtactgtaagaaaagatctgcaaaccgcactcgggttcgtagagggggtgatgtcaatgctataaaatggggggatgccccccctttactttactgttttaacagtagccttatattttgcctaataatgattagacagtgtaataagaaaaaaacagtaactatggcaagccagacgcaaaataaacaagcgtaa

SEQ ID NO: 4784 - DNA, 288 bp, Enterobacter cloacae
cttccccccccgaatggcgcgctgatgcctccatcccacgtggtcgaagacaagcgtatgaaaaatattcgtacagtcaaaaaggtgttttcagagatgttagtcaggttcgaaaacttccaagagatctgtcggttatacgtagaccggaaaatggagctttgttttactacggatagtgctgacaggagtaaattatgggaaattcaaagccgcgagaattgtagctatggcgaggcaatagaaattctctatgctcaagaagtagcagcgggtttggccgcgtag

SEQ ID NO: 4785 - DNA, 249 bp, Enterobacter cloacae
cgtcatattcctgcgtgccggtctgccgacaccagtgcacgggcttttttcggtcatcacattaccgggcaggagattttatcaggacgtggtgtgactgagcagcagctggggcactgtcatccgcttgcagatttaacccccttaatcgccaaactggcgttcagtcctgatagtgtccttccgtcctgggcagggttgctaacactggctcccttaatacgaaatgcgcctgctgataaagattaa

SEQ ID NO: 4786 - DNA, 576 bp, Enterobacter cloacae
cgggagtattaccgttatggtgatgctcgtcgttttacatcggagagcattttaatgaattttcaaactaacgaagtttttaataaatttgctgctgttataaaatcgcgcatcgtcaatgaaccatcgtcatgctatttgctgcatgataatgagatagatataacgattttgaaacatggcatattagaaaatgacagaaacctgttgtacgtagttcgtccttcaggaacgtgtttgttgcgttgtgacaaatatttctatccgaaatattatcttcgttgccgtggagattataagtcattcatatatgtccatcttgatctacatagtggtgaagctaaagaaatcacatgggagcaagcagacgatatgctgtctagtccaggaaaacccccattaaaaggaaatcttggacgatttgagtatataaaagttgtggttgaggaccttcgtattcgaggttacgctgattatcttcctgcgtataatcttgatgaccttcgccgttttgccttacaggacgaccgcccatcccttgtcagatacattgacaatgtaatggcaacggtctga

SEQ ID NO: 4787 - DNA, 924 bp, Enterobacter cloacae
tggccaacctgcatcagggaggcctcaataacgactggaggctgtatgaagttagctacggacctggtaaaagctattttgattagaaatggtgttgaaccagtaaatataagcgaatcatctaaattatctttgaaacaaccactgacagaacttaaattcagtttatatttgcgaactgagcatttatctcacttcctacccggttatgtttattctataaaagaatgtccactgtcatatgacatcgggatcgaaattcagaaaatcttcgaaagtttacatttgttaaacgaagaatttgaatccctcggttttgtttctgtatggatagaaatgcatcaaagcatttttgaacaaagtcggtttaagaaaagtaactttacttttcgggaggaagaggtcgagcttgctaaagggcttgtttgttctcacaattcacaaataagtaatgcggcttatttctggcttcagcactttgaggagtttatgatttatgttcgtaataaacttatcgacctctttcgagaggcctatgacctgatccttggaatgcagcaagtatttttcattcgggaaaaggaagagctgttgaaaactataagttatggggatgacctgtatgaggtgaaattaatggcggctgagctttactctatcgaacagaacttaaagtgttctgaatcgataagtacaaaatctcaagcttcggcatatattaaccgcatccgtgagtttgtgcgttcggggtggaggcagggctatatagtctgccatcataagcgaagtaatcaaatctcatcattgtcattaccgatgtacttgaaagatacgtcaggccgaagtgctcgaaagcgagtaaaacgtcttatatcttctacagtttgtggtagaaataaagatttaggtcttacagatttttaa

SEQ ID NO: 4788 - DNA, 1353 bp, Enterobacter cloacae
agcataaatgttgagggcccccgggccctctttcttaaattctgcgttgtgggtttctccctgtcttctgcaccgcagaaggcattgagaaactcacaatgccagataagagagatcatcatgacttatgcatccccggctcttcgtcgtaaaccacaggaagtatctgaacactttattaaactcgttcatgctcgaattgctgaagtgtctggctggaagtatatattcgaaagaatacctgctttcaaagacgcttgtgcaaaagccccgagccaggttccttgcccgtttactggcgcagggaaatcgaagtttcgtttccgacaaaaagacctttataccggatgtgcgatccataatgactttccggtaaatgagttttgcgacggaattgatgttctggcgaaatattatgaattaagtaaaacgcagacttgcaaaaagattctctcagattttttcgggatggatctgcatgctccgttaactgacgccgacattgaaaatgaacgacgctataaatcagcagttcgtgccacagaaactcttgaccgagaggaagtggcaaagcgaatgcgaaaacttgatgtgatgtatcactataccggtgaaatcaagcctaatactcctgttgctttgtacctccgtaatcgtgggatctcccgcttactgagtcacttaccaaaggatttaggctttaataaccggatctactattgggataaagataagcagaaatcgattatctatccgggaatgattgcaatctatcgtgacacccgaggtcggcctctgactatccatagaacatacgtagacaaaaacggtgataaggcacctgtagaaaatccaaagctgatgatgaagcctcctgccgatatgacaggtggctcaattcagttgtttgaccctcactatgattcaggtagttcgacctggacactgggagtggctgaagggatcgagaacgcgctttctgttgtagaagcgacttcaacaccatgctgggcagccagctccgcatggtgccttgaaaacgttactgttcctgattttttactgcctccgccggatgtaaaatatataaacttttatatctgggcggataaggatattgctaactcacaaggcactcgtgccggtatcgaagctgctcagcgacttcaaagccgcatggttgagtttttggctaaacgatatcccgcatcaaagctgacaattgaagtcttcgaaccagcacaagatattcctgatgggaaaaagggtatcgactggaacgatgttctccagttaacagggcaggatggattcccgattcactgggctcctgaatgtcttaaccagctgtaa

SEQ ID NO: 4789 - DNA, 345 bp, Enterobacter cloacae
tccctttttttattgagagaggatcacatgaaaattatcgaaaaaatcattaatgcctttttggttgttcaacataaaaaaatacaggttaaaaacattacatttttagacaatgggcagggcatgttctctggtatgtcttttgatgctgatgtttcactggagtttatgtatgaatcagcaaaagcatatagttcttgcttctgtgatattccctttccaggttttgaagatgcaaatctggaggaaattacgaaatttcaattagatgctttgaagcaaagaaagaatcatctcgttccattgttgtcttcatcaggacgtgccagatccatcaagacgccc

SEQ ID NO: 4790 - DNA, 327 bp, Enterobacter cloacae
gataaatgctcagttcgcaaatataaactgaatttaagttctgtcagtggttgtttcaaagataatttagatgattcgcttatatttactggttcaacaccatttctaatcaaaatagcttttaccaggtccgtagctaacttcatacagcctccagtcgttattgaggcctccctgatgcaggttggccatcagggaaaatatgtaaatcaattagcaaccaatcagaccgttgccattacattgtcaatgtatctgacaagggatgggcggtcgtcctgtaaggcaaaacggcgaaggtcatcaagattatacgcaggaagataa

SEQ ID NO: 4791 - DNA, 564 bp, Enterobacter cloacae
agaagtagcgattccaggctccgggaatgtaagataggttactatatgaatatcaataaagatgacgaactccttgtgatagttaagtatgaaggaagattttattggttcgttgcgttcaaggaaatgtgggtcttagacagagtaaaatgggtagaggattttgtgaaaagtggggtggaaataaacctacagaatacccataaggaaagatatgacataccagttgtaaatgaagaaaacgcgcagatattcattgatggtttaattaacgatggttattcatacgataaggatgacattgctgaggagttttataaaaggctttcgcaaaaaacaatttggtgggatatatatgaacttatgccggatttatttatagactttgataataaaagattatattcggaatatgttgagagtatgcattatcaagaatatgttcctgatggttggcaaggtgaacttgttgatttttgcagtaatggatcgttacctcaagatgaaatgttctggataaaaaatgaaactgatcatagaagcgttttgatcgctaaaggataa

SEQ ID NO: 4792 - DNA, 342 bp, Enterobacter cloacae
gtggtatttgatccattaccagaggacgcatttggggcaaacgtcaatatcaaaatagataaggtttttaaattagatcaaaatgcacaacgctgcattgttgttccattttttattacggataaaaataagatccagatcgcatctgcgacagagaaatttgatgtaagcattaacgtaaccggcaagatttattcgctcttttatgaggtttgtgaaggggacgagatttattataattttactcttgtgcctgaaaaagaagcaatcactgctaagtttttattagacgacccttggggagggaaaaaatacaatcctctaaaagagggttttttttaa

SEQ ID NO: 4793 - DNA, 198 bp, Enterobacter cloacae
accgctacctctacagaacctttaccgcttgaagactctgctgagaaggtcacgcacaaccgtctgacgcagctgaacgtcattcgctggcactactgttatgacggtgaacatcacctgacggaggtcatcagccagctgcgggaccgtaacaggccgcggacgcaggtcagcttccgttaccctcatacattgtga

SEQ ID NO: 4794 - DNA, 270 bp, Enterobacter cloacae
caatatactattgatcaagggaacgagtttcacgacaaccaaaaatacgccgaggctttagagcaaaaccaaaaagcctggcaagcgcttcctgagccaaagctcgaatgggaactcgccaactggatcgctgcctgcatgtacagcgcatgttttgatcttgcggattatgctgaggaaaacaaatggggaaaaacgacattacggacacgtggatcggatatagacactgcacccttaatcgatctcggcatggtctgttatgagtga

SEQ ID NO: 4795 - DNA, 309 bp, Enterobacter cloacae
aggataaaatatattttcggcaaaccatttttagacattgcaatggtcgattcaacacgccaatttgtgtttgtgttaagcgagacaaagccgttaccaatcgttttgaccatcttcaacgctcagggtgaaaaactattttggtctacatctcctgaaagtgctattttctattacttaacattaaaccagtcaaaggaagtggttgttgtatgtaattttacagtaatacaaaatggctggcataattggttttattcttgggatatgaagcgtaacgcgttgtctagatcaggaccttcgtactaa

SEQ ID NO: 4796 - DNA, 237 bp, Enterobacter cloacae
acgtgttactataattccggagtaaaagcgatgacagatgaagagttacgaaagaatcttgtttttttaataaaaaaatatgttccggaaagtcaacaaaaagcattttatgatgatatatcaaagtctactgtgccagtgaaaggtattttagctgactttaataaaatcaaaaccagaactgttgatgaagttgatggagatttaatacgggatatttacttttatttttgttga

SEQ ID NO: 4797 - DNA, 498 bp, Enterobacter cloacae
cagatccagcaggagcagctaaaccaggagaagaaagcgaaggaagcgaaggcggaagagacggatcgcccgagcagcatcacgatctccaccgcgaacagcggcgaggggaaggagaacaaagagaacgccgaaaccggcagcggcaaagaaccggagcacaccgagcggaacaaagacacgaacaaaacgaccaaagcgcagggaaaggggaaggggaagaccaacagcgccgggtacaatcaaagaacggcaccgggggaaacagagcgcgcgccgcagagagccgaacggcacggaaaaaaccaacgcgaagccgcaagccggacaggaggagaaacggaaaaaccaaaggaagaagaaaggacaggcgcacgacggcccagaccagaacggccacggagcggaccagcaaaaacaccaaaacccggcggcggagcacaaagcaccgagatcacacagattaaaaccgccggactggcaggaaacgcgattccg

SEQ ID NO: 4798 - DNA, 201 bp, Enterobacter cloacae
tcaccaggcagatgcgaaacctggtcgagcgtattcagcgcgacccgtgggtggtgcccgaagattcagactgccgaagtgctgcacgccaaatggccagaactggtcctaaggctttgcccggtgaaactagccgacagcaacggcgtattcggaaaaaacaaatgcgatagcacgatccccaaagggtttcgtggataa

SEQ ID NO: 4799 - DNA, 264 bp, Enterobacter cloacae
  unsure (47)
atttgcccacggacgtaccgccggaatttcaacactcggaaggtttntacgtcatttcctttagccgaaaaaaaagcccgcactgttcaggtgcgggcttttttctgtttttcctgtacgcgtcagcccgcatcgttacctgtggtaatgatgatggttgtagtaatggtggtgatgctgatgcgtttcatggatgttgtgtactctgtcattattatctgtctgtgctctattcttttagggttaaaggatcgagccccttaa

SEQ ID NO: 4800 - DNA, 690 bp, Enterobacter cloacae
agggtgggaccgcggtcccaccccgcaggggggcacatgtcagaaccgcgcagcaatgcgcagatgttcgatatcgatatgtctgcgctgcgtgaattacgtgaagctgtgggagccacacagcagcaaatgctcatggcatacaaccgcgcgctgaacagaacggcgaagcatatgcaccgcgtttcggtcgggatgatgatcgatgcgcttgcagtcaaaaagcgcaaagtagcgaataagcgcattaagccattcgtgaaacgtcgtaatttcgggaaagagagcaccggcgagctgagcagcgcgaagctctggtacggcctgaacgattttcgcgttcacgatttgcgcgggtcgatgcggaaacagcgaaagcagaagcaaaaacgtgacccggagacgggtcagtttatgaaaacggaaaaaggcgcgcgcggtgcgacattcattccaaagagcgcagggctgcactcgatgagctggccagattcgtttgtcgctaaacgttacagcgtgaaaagcatctggattcggcgtgagggtggcggcgttgaagaggcgcgcgtaccggttcatgaagcgctggaagacgctatcgacgattacatttttgaaaatatcggctctgtattcatgcgctattttgagcaggatttacggggccgcgtggcggggaacgttcaatga

SEQ ID NO: 4801 - DNA, 591 bp, Enterobacter cloacae
gcaggatttacggggccgcgtggcggggaacgttcaatgacagctactgctgaagcgggaatggacgcttttgatgagtatacgaaccgggttcgcgcagcagttctgcagatccctttcgtcaaaacgtttggtgtatatccggaaatcccggaaggattccaaacgccagccgtcttttttgaaattgaaaactgggagccgagcagtgaagtgatcgctggctcagcgctgacagtttcgctcaactgcagtctgtatgtccttcgcgaatttgctgcagaccagtacgggcagaaggccaggaacgcggcgctgtatatatcgagctggatagacggtcggggatttggcccggcgactctgccagccacgttcggcggttcagaaccggcagactggatcaaaaacggtaaagcgctcggatcgcactccgtctggtgcgtatcattttcgcaggtagtcggcgtcggcgttgggcctttcgttaccccggctgatgccccgcttctgaaagaagtgtttgtcggccttgcgccagatattggaaaagagcacgaggctgattatgtccgggtcttcccaagatga

SEQ ID NO: 4802 - DNA, 198 bp, Enterobacter cloacae
  unsure (12)
  unsure (13)
  unsure (16)
  unsure (18)
ggaaggcggggnnagngnagccacccccggcaacaggccgcatataaattaaccgtcttactgattccttttcgttttttagcctgccgtctcgttgtcgatatagtcttcaacacgtctttcaaaaggaactgtctcgtgaaacttcgaatgggtgtgcttctcctgactggcctgctgctcgcgggctgtgactag

SEQ ID NO: 4803 - DNA, 312 bp, Enterobacter cloacae
aatacgctgcatggtcaactcgctgatatgaaagtaaaaatctcacgcatgagctttggctgtcccctagctgacctgagacggagcaagcattccgagccacgctacggcgcccagaatgataatcgcaacaacgaattctgtcaggatgctgtttcgcatcagggcaacgctgcgatcataattcccttccctgaccataacttcaagccggggacccaggtgaaaccggtttgctgcagccagaagaagcatcagaacaaacagagccgtcttggcaagcaatatcctcccccaggaactgttgaataa

SEQ ID NO: 4804 - DNA, 372 bp, Enterobacter cloacae
  unsure (47)
  unsure (48)
  unsure (49)
  unsure (50)
  unsure (51)
  unsure (52)
  unsure (53)
  unsure (54)
  unsure (55)
  unsure (56)
  unsure (57)
  unsure (58)
  unsure (59)
  unsure (60)
  unsure (61)
  unsure (62)
  unsure (63)
  unsure (64)
  unsure (65)
  unsure (66)
  unsure (67)
  unsure (68)
  unsure (69)
  unsure (70)
  unsure (71)
  unsure (72)
  unsure (73)
  unsure (74)
  unsure (75)
  unsure (76)
  unsure (77)
  unsure (78)
  unsure (79)
  unsure (80)
  unsure (81)
  unsure (82)
  unsure (83)
  unsure (84)
  unsure (85)
  unsure (86)
  unsure (87)
  unsure (88)
  unsure (89)
  unsure (90)
  unsure (91)
  unsure (92)
  unsure (93)
  unsure (94)
  unsure (95)
  unsure (96)
  unsure (97)
  unsure (98)
  unsure (99)
  unsure (100)
  unsure (101)
  unsure (102)
  unsure (103)
  unsure (104)
  unsure (170)
  unsure (171)
  unsure (172)
  unsure (173)
  unsure (174)
  unsure (175)
  unsure (176)
  unsure (177)
  unsure (178)
  unsure (179)
  unsure (180)
  unsure (181)
  unsure (182)
  unsure (183)
  unsure (184)
  unsure (185)
  unsure (186)
  unsure (187)
  unsure (188)
  unsure (189)
  unsure (190)
  unsure (191)
  unsure (192)
  unsure (193)
  unsure (194)
  unsure (195)
  unsure (196)
  unsure (197)
  unsure (198)
  unsure (199)
  unsure (200)
  unsure (201)
  unsure (202)
  unsure (203)
  unsure (204)
  unsure (205)
  unsure (206)
  unsure (207)
  unsure (208)
  unsure (209)
  unsure (210)
  unsure (211)
  unsure (212)
  unsure (213)
  unsure (214)
  unsure (215)
  unsure (216)
  unsure (217)
  unsure (218)
  unsure (219)
  unsure (220)
  unsure (221)
  unsure (222)
  unsure (223)
  unsure (224)
  unsure (225)
  unsure (226)
  unsure (227)
  unsure (228)
  unsure (229)
  unsure (230)
  unsure (231)
  unsure (232)
  unsure (233)
  unsure (234)
  unsure (235)
  unsure (236)
  unsure (237)
  unsure (238)
  unsure (239)
  unsure (240)
  unsure (241)
  unsure (242)
  unsure (243)
  unsure (244)
  unsure (245)
  unsure (246)
  unsure (247)
  unsure (248)
  unsure (249)
  unsure (250)
  unsure (251)
  unsure (252)
  unsure (253)
  unsure (254)
  unsure (255)
  unsure (256)
  unsure (257)
  unsure (258)
  unsure (259)
  unsure (260)
  unsure (261)
  unsure (262)
  unsure (263)
  unsure (264)
  unsure (265)
  unsure (266)
  unsure (267)
  unsure (268)
  unsure (269)
  unsure (270)
  unsure (271)
  unsure (272)
  unsure (273)
  unsure (274)
  unsure (275)
  unsure (276)
  unsure (277)
  unsure (278)
  unsure (279)
  unsure (280)
  unsure (281)
  unsure (282)
  unsure (283)
  unsure (284)
  unsure (285)
  unsure (286)
  unsure (287)
  unsure (288)
  unsure (289)
  unsure (290)
  unsure (291)
  unsure (292)
  unsure (293)
  unsure (294)
  unsure (295)
  unsure (296)
gatgaggctcaggtgcgtaagaggctgatgcctgtcccggtggatannnnnnnnnnnnnnnnnnnnnnnnnnnnnnnnnnnnnnnnnnnnnnnnnnnnnnnnnncggactcacggataaagacgtggcggggaaatacgtgaatgcaagaggggaacaaaggatgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccccgcattcctgcctttcggtctacccgtgtcagtccgctgttatggccgccgtctctattgccacgcctgac

SEQ ID NO: 4805 - DNA, 257 bp, Enterobacter cloacae
acccgcttcggattaaagtggcggtcttttccatgcggggagaaaaacgggttgatgaaaaaattgggggattatgtggaatatcattcgcaggaaattttgctcgccaacgagcaggatctgctggaagcgcgtcgcaacggcttgagcgaagcgatgctcgaccgtctggcgctgaccccggcgcgtttgaaaggtattgccgacgacgtccgtcaggtgtgcaacctcgccgacccggtagggcaggtgattga

SEQ ID NO: 4806 - DNA, 378 bp, Enterobacter cloacae
  unsure (295)
gaggacgtggggtggcgtgtgactcgagctacaaaaaaagatttatcgtggtttaacctcagtaattacgattttattaataatttaactctctctgaattcatcgttgagcttgagtggcgagatttcctttatcgtaatgtaaatgaggatgatttattttttgatgaagaatacgaaattaaatatcagcgtatatttggaggggatcctcatcttgatattccaaatgaagaagaaaaagagattgatgagtttgtccgtaaagtaaacagcgagactccgtctttgctanatatgtacggtactctacctcacctaccatcagatcctagggtaagccccattagttttactgaactttctaagtatggttaa

SEQ ID NO: 4807 - DNA, 183 bp, Enterobacter cloacae
  unsure (149)
ccgttacggatacgggtcagcatatccgcgatcggatcttgcatgctcatctgtctttactcccgtgattcaattggtaattaccagctagcctttttcaagcctggtacttcaccgcgcatggcggcttcacgcagtttgatacggtngtcaccaggcggcggaaaggacaagcgtaagggg

SEQ ID NO: 4808 - DNA, 321 bp, Enterobacter cloacae
aactcgttgaagcaggtcgaatattccagatacagcatttccgcttctccacacccgagctggcaggcgaagaaagagtggctaagtcagcagctggtgaccagcatgtgtttaagtgctaaatgccgcaaggccaataacaccgcggccgcagttgtacagacaggctatagtgatctcctttgcctgctcaatacggatcttaacttgagtttaaaactggccgcaatttttaggtatggccatctggttttgaattcattgatagctacttcatacaatgtagaaatacactgcgggtattataattactattattag

SEQ ID NO: 4809 - DNA, 186 bp, Enterobacter cloacae
ctggcgtttgaagtgtataccttcaagccaggggccactgcggagagcttttatttgtcgctcgctcaggcccgtaagtgcagtcagttctgcctcaacaacccattctctattaaatatgatttgcgccatgatgactccatgacgccgccacgataccgcggcggcagaaagtttgttgattaa

SEQ ID NO: 4810 - DNA, 747 bp, Enterobacter cloacae
cgaaaacaaacttcattaaatcacaacacccacggcaaccccgtctgggtaatccatttaaatggtaaagaggttattatgtctgttgaattaaaaacatttggcggtgcttatttcccgaaagataaggcgctgaaaaaacttcctgatcttaagccactggcaattgctgttaacgcgttaaataaaagcattgctgaagctgttatttttggcaagctggcagccgagcatcctgaacacattgacgattattttaaagttaaaatttgggagcaccgcgaagacctgccgtgccctgccctcgatgatttcagccaggacttcttcagcacggtcgccacctggaatgtgaacgctggggagcccgtcgccgccacacagcctgaggtcgacgagagccaggaccagagcgacgaccagcaagccggagagatgaagtctgtgcgtctacttgatcagcattcccgcgctgcatgtctggcgcttttcggaccggttgagcatatcaccgcggcgcagtatgggcaggtcgtcgatctgattaacgatgatgacggatgcttccagcgcgaaatggcggaggcattcacgagagagccgcgcgtgttggcgctcagcgcagaacgccaaaaagaatgctggcgtggatccgtaaaaccatgctggtttcgactcaatggccagagattaaaaagcagctcaccaaatggctggatactcctccagcgaagcgtgagccggtag

SEQ ID NO: 4811 - DNA, 240 bp, Enterobacter cloacae
cttgatcaatcaggatggtatctgatgaaactgggtgatgaaacggcgcgggttgtcagggcactgcagcttcggggtcgggctggtgcgcgggatattgcgtgtcgggccggtatgaggaatgaagaagtgatcgcagccctgctggatctggagaagcgaaaaaaggtcgaccagtccaacggtttctggtggcttgcagtcgaccttgaggaaaagtcagggagaaatcgtaaatga

SEQ ID NO: 4812 - DNA, 243 bp, Enterobacter cloacae
cttagccactctttcttcgcctgccagctcgggtgtggagaagcggaaatgctgtatctggaatattcgacctgcttcaacgagttctatgttgagcagctacagctgtttaacgagcggttggggtttacccttaacgtctctctcagagatggtgcaaccatatttagggtttacccccacctcgaccaaccctatttagctcaaaatgttaaaaatccgcacttatatggcacattgtga

SEQ ID NO: 4813 - DNA, 663 bp, Enterobacter cloacae
acagaaataacattctcgtcacctaacatactcgctacaaacaaaatggtggtgttaatgattgtactaaagagctttttattcttcgttggcgcggcggccgcttgcgcacttattgtactgtgtctttgggttgatatgcggtttgtcggccatgatattccggaattatcactgaccgaaattatgcaggaaacggtattagcgagtattgtctttctccattttcgtctggcgaaaatgtacgattccatgcgttactgtaatattctggtgggcggatttttcctgacaatgctaattcgtgagctggacgcgctttttgatctcatttctcatgggagttgggtgtggttcgcgctgattaccgctgtgctggcgttaattcgccccgttatgcattttcgtgctaccctggaacagctggcaaaatatacccaatccccctggtacggtattctgttgagcggcctgctggctgtactggtcttctcccgcctctttggaatgcaggtgctgtggcacgccatcctggagcatggctatatgcgtgtcgtgaaaaacgccgtggaggaaggttcggaatcgttcggttatatgctgtgcctggccgcatcccttggttattacgttacctttcccgctcacgcacgacaaaaataa

SEQ ID NO: 4814 - DNA, 249 bp, Enterobacter cloacae
aatcagcgtctatccttagactatcaacaaaaggaggctggaatgtctgatttcgacactgataaaaatgcacaatacgctggcgataaagccaaaaacaaacttgatgaattatccggctctgcgcagcagcagtttggtgaattcgttgactcccctaaacaccaggtgaaaggtgcagcgaaaaactatgctgtcttcacctacgaggctgacaggtccgcgctcaggtgtgcggggcagggggga

SEQ ID NO: 4815 - DNA, 249 bp, Enterobacter cloacae
atctgccgtcacagacttcgaaggttcgaatccttcccccaccaccactttctggcagcgtcaacgccgccggagctggttggaaaaattgaccagctcgaacagaaaagagagaaatctctttttttgttacagaaagaactgggtagccgagtttcaggatgcgggcatcgtataatggctattacctcagccttccaagctgatgatgcgggttcgattcccgctgcccgctccaatacgtgctga

SEQ ID NO: 4816 - DNA, 195 bp, Enterobacter cloacae
gtcccgcaacgagcgcaacccttatcctttgttgccagcggtcaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataa

SEQ ID NO: 4817 - DNA, 363 bp, Enterobacter cloacae
gtcgctgacccattatacaaaaggtacgcagtcacaccacgaaggtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcttcgagttcacagcatgtgcattttcgtgtacgggactatcaccctgtaccgtcggactttccagaccgttccactaacacacaagctgattcagactccgggctgctccccgttcgctcgccgctactgggggaatctcggttga

SEQ ID NO: 4818 - DNA, 195 bp, Enterobacter cloacae
gcagcgcggtaccttccagccccgtgggctgaagaccccctgaaccagccttacaccacagatattatgggtacagcgaccgcgccagatcccgagacgctgacgctggatgtttattattataaaacgaacgccgctgccgccaccgtgggcgagttaagctccaacgtaacgtataccatttcctacctgtaa

SEQ ID NO: 4819 - DNA, 432 bp, Enterobacter cloacae
  unsure (417)
tgccgtactggaaaaagcgctcaaacttctggagtcataatggaagacttagaaaccacgatcatggaactgctggtcaacgcaggcgcggcgcgcagcgcggctcagacggcgaagcagaaggcgcgaaaaggcgacaaagacgaagccgagaaagcgaaggaagagtcgcgagaaaaagagaaacaagttcctgacaaacgatccagacgcagcaaatcggtcaagacgaagggacaggaaaacagccggaaaaccagatcaccgatcattctcaggaccaccagaagaacgcgaaggaaaaacaggatcaggcgggcgacaagaaagagcaaaatcgacgcatcccgcaggaaaactgaaaatgcagatataaaaaaacccgccgaggcgggtttttacatttacgcgcatcanacgaaaagatcctaa

SEQ ID NO: 4820 - DNA, 225 bp, Enterobacter cloacae
gagagtgacgtggaaaaagagcagctcgttgagatcgccaatacggagatgccgttcggtaaatataagggtcgcaggctgattgatttaccggaagagtatctgctgtggtttgcccgtaaggatgagttccccgccgggcgtctgggcgagctgatggctatcacgttactgatcaaaacagaggggctgacccagctggttcagcccctgaaacgtccttaa

SEQ ID NO: 4821 - DNA, 432 bp, Enterobacter cloacae
cacatccccattgcagccagaccgcttgttttactcaagctcacgccttctttgccgatacctctattttatggcgaaaaggatctcaatatgacaactcttaagcccgtttctctgtcggcgatggaaatcggcagcgtagataacagctccggcggaaacgacattgcttctcaaatcacccgtctgaccaaacagataacgaaagtcactcagcagctcaaagaagtggccatgggtgatgccacagcagaagaaaagcaaaagcagcaagaattactcgaatctcagctggctatgttgcaggcacagctggcgcaattgcagcgtcagcaggccgaagaggcgatgccaaagcaggaaaaaggtgaggcagtcgcggaaggcatcaataagccctccgcagaacatcagattaatatctacgtctga

SEQ ID NO: 4822 - DNA, 210 bp, Enterobacter cloacae
  unsure (106)
tggaaaatctctcccagccatggaatttggcgcggcgagctgatcagaaataattattacccacaggcagcgcgtcaggggggggaatatttggctcacacccttntccacaccagcgatttttatctgcatccgcacgagaaaaaagcgcaggtggcaaaattcatcaaccgatttgcttttcaccgacgcctttggcgcgcgcggtga

SEQ ID NO: 4823 - DNA, 201 bp, Enterobacter cloacae
tatatgattgttccatctggtatatcattacttaccgctatcgatgatatattaagcggcatactcacattactggccgttttaaatacggacgcactgtcaagtgaacacgtttcggccattgctgcgtttgagaaaataagcagacaaaaaaatgtagcaacgctaatccatcctgaaattttcatctcgccctcttaa

SEQ ID NO: 4824 - DNA, 315 bp, Enterobacter cloacae
cgtcccgttatgtcgaaaataccaggcaccgatattcagcccgccgttcagcgccgcgtagaggttgttatattccccgctgctattttcgctgcgataaccattcacgttataccccagcatcagcgcggggatcccggcatcccagagcaccgggtttacgctgccgcgtgcgacatgctgcaacatggcctgggggatactgacatcaaggcgctgtctgcccccgttaaatttcagccggctttctggcaggacggcctggagatcgcaccactgcccggcattagtggcgcacagcctgcttttttttaa

SEQ ID NO: 4825 - DNA, 438 bp, Enterobacter cloacae
cagcgttacgattcctctctcggcaaggtatattcagacggaagacagcgtgacggcgggcatggcgaacggcaagctagtttatacaataagttattattaaagagtgatattttgatagcggtagcatatgtgatgagatttttattcagtttctgcttggggctcctcgtattattaaatacgacagtatgttttgcaacctgctctgcaacctatctttataacccggtcccaaaggtgccccttttaaccaatagtatttcactgggaaaggatgcacctgttggaaccgtgctgtaccggcagaccattacgccgtcaggaacttatgatatgaagtgtgacagtaacacggacgttacgtttttgtacattattgccgatcctgtaggtcttcattacgaagttgccaagatcgccgcatatatcccccca

SEQ ID NO: 4826 - DNA, 249 bp, Enterobacter cloacae
atggcattaggtcgaatgacacacagttcagctttgttaagagcgagaatggtccaagacatctatgacattgggcatcagaaggactatgtgcttgatatgagatcaaaaaaatatcagaagcatcacaactccaatggcattcaaagaaatgcctttgttttgttagtacaccaaacaacccaaaattcatgcagttatatcaaagactcattcgcaaaaggactcagccagaaagcatttgcttaa

SEQ ID NO: 4827 - DNA, 450 bp, Enterobacter cloacae
acgttaaaaaaagggggtttatgcgaacggaaggatcggaataaaaaagtattattcattcgcgtttacgtgaactcaaatctacacggagtaattatggaactttctttaaatattggccttagtgaaaagaaatctaacacggctgcactttttaaaacaaaaagcgcaaaagtgattttgtttgttctgctgaccgtgcttttttgcggtctggcatatgcgggttcagatgatggggcactgggagatatttggtcatacatgagtgaaagtatgactggagctccgggcaaaattctggcagccgcgatgttgatctcaagcgtatatttctctgtccttaagcctaacccgggcctggcactggtttcattattcatgatgctggtaatggccaacggcgagaaaattatcagcacctttatggatgctggcgtaccgctgtaa

SEQ ID NO: 4828 - DNA, 363 bp, Enterobacter cloacae
ttcgtaaagcaatgcgggaacttgaatctatcggatatctcgattatcaagaagttaagaaaggtcgcgacatacaatttcagatcttcaaaagaagccctaagctggcccttgccaaacaaggttgaaagctatctggtatgcactggttataacctgctgaaaaataagttatttatcagtgctatgcttagtgcttcttttactactggtcttacatctcggcttaatgtgcaaaaaagtaacttttcaaacgaactcctgactattcatctgtatgcctttctgactcaagcgtacatgctagcccattcattaaatgccgttgagcaagatggtttcgtgcgcactctattcacgtga

SEQ ID NO: 4829 - DNA, 357 bp, Enterobacter cloacae
  unsure (202)
tcatgcatgagggggttcatccccctctctggatttttaatgagtaagcagaacgacgttcctcagcatacctatagattccctttcaggatcaacatgcctctactgattttgttttgggatgccaaaaaattagggcttgcattcattctggttgcatttgggaatatcttcgaatgcttcgggttttctgttgtagcancggttgtgtattggattgcgtataacaaagcagctgagtcaggaataagaggattgctaaaacacaaactctggtggctcggttttttgccaagtaaagcagtttttagtagccgttatttcaacgatccatttatcagagatttgtattcttga

SEQ ID NO: 4830 - DNA, 537 bp, Enterobacter cloacae
gtttaccttttagatgtatcagccctatttggcaaatttgaggttcatgtatcatgtagtaaacaggaggaagatatgaacaacagcaaacatacagtcattgaagtggatactaatctagttgaaattgaaaagggatttaatccccgagaggcggtaatcggagatttgtgttacgaacaagaacctgtcaaatcgatgattgtgtcaatcaaacaagcctttaaggaaggaaggcaggttgatatgatcaaggtcgtaaaaagaaaaggtaaatatttagttcgtcaaggtcatactcgttttcatggcttaaaattagcaatttctgaaggtgctaatattccaaaattatctgttatcttaatcgattataaaaacgaaattgaagaataccttgagaacctcgatggtaacagaagcaatgggctaaatccggttgggcaagctcatgcattagctcatgctgttagtctcgggtattcggttgaagaactagggaaggtgcgaataagtggggaaattcttctcggctga

SEQ ID NO: 4831 - DNA, 198 bp, Enterobacter cloacae
cttaactcgtcggtgataagattttcatttggcaaactgtttataacatattcttgcaaatgctttttacgcatttacctaaatgccataagcattccagtaaatgccttccttattcattcaaatgcttttcgcatgcatccgaatgccggatcctttcataaagttactataatcaatgagttaaagatgccgtga

SEQ ID NO: 4832 - DNA, 216 bp, Enterobacter cloacae
catgtaagtgaaagccctgcgaaatgtaagagatttgcccttaagcgtatgagaaatttaagagaaatcgcaggggctaaaaaactcaagatattaaaattcaaagagttattaatgagtaattatctgaaaatccggttttgtaccttttcgttgcttgttagtttaaaggaacaaggtaaagtgtgtgctacggcgaggatgccaacagaataa

SEQ ID NO: 4833 - DNA, 942 bp, Enterobacter cloacae
ataagagggagttatatggtttacgaaaatgaattgtggcacagttttcttctgcgttcacagataatgtataacttatccaattgcaggaacataatatcaaagcatggcgcactaaggtacgatgcctttcctcgtttcgaactgattgatatgtacaaattgcatagcttgcaggatatatatgacattcttgccactagaaatggttatatactaacttccaatatagtgtcgttatcttctggtgtttacgggtattttaacgctattgaagatgcctgtcggaaaaattttcacataactaattcatatccattggtaaacatctcaaacattcgttactgtcacaaatgtattgttgaagatatacactctaaaggcattggttatctgcgtcatagatggttgtttgaatctaaatgtgcagttcatagtaccagtttatatgaggtttgttttgataactatttgaatgcagtgaaaggacttagtgacttaattataagtggaataaatcctcatggttattgttcccttgtggttgacgtttcaaaccctttcaaaaatccagtgtatatattaccatgtgcacgtaataaaattttaaaatggatttcggacaataaaaatatgctgatttactttctctttgatctcttcaaatgtaagtcgcattcaagtttatctaaggttatcgaagtcaagataatgcatgatagatatatttctgcggtgttcaagatgttaagtgaagttaatttttgtaatttcaactcatttatttctgatatttttgaggacgtaagctatgcctctatcggacttgatgattattctgttaatgtgcattttctcaggctaagggctgcagattgtaaattttgccagttgaatggtaaatatttttgctcactttacaatgtaaaacttcttcgctaa

SEQ ID NO: 4834 - DNA, 1671 bp, Enterobacter cloacae
atgaatgctgacaagaatgacatgaactgtttcagcctaagagaaggggacggccgttttgaaatagcctgtgaatttgatgacctgcccgattttatcatgatcgacgacagggtgcagaccacgctcgcctcagaacatctgctgaatgaggacggcaattttgaaatcgtcaaaacgtttaaagcaacgacctcaggaaaaccggagcagacctgcatccgctgcatccacccggatgaggagcccctgagaaatttactgggcatgaaaatttctgagctcaaggcggtgggaaaagaagttgaaaaaaatgtggcggataaacgcactgcatcgttatggcgtcaggccatcagggaagccgcagccccctatacctgttcggaaattatgctggatgtcgataaagagttcggaaccgacacaaaatcattatggggtaagatcctcgatttgctgcccacgtatgcgattttcaaagccgacagggaaagcagcgacggggattccgaagctaaaaaccccttacagcaggccgtaaaagacgctcaggctgcgctgcaggacaaaattacagcgctggaaaatgagattcaggacagcgtcctggatgtcgcacagagaacgctggataaattacgtgaaatggcccccgaactcgccagtgaactgactccacgatttaaggagaaacccaagtggaccttcaatttcaccctggacggggaaaatggcatccccatcaataagcgcggcagcgggataaggaggcttatcctgttgaatttttttcgggctgaggctgaaaagaatgtcgcggggacgcccagaaatgtgatttatgccatagaggagcctgaaacgtcacagcatccgaactatcagatgatgctgatgaaagcgttactggcactggcaggccagccgcaccgtcagattatcgtcaccacccatgtcccggcgctggccggattaatccctgtcgaaggcgtacgttatgttacccgaaatgaggcgggtgaacccgtagtaaaaatgccggatgacgcagtgctgaaggaagccactgaaagcctgggggtgctgccagagaccggtatggaaagggcgcaggggattgttctggtagagggaaagtcggatgttactttcctgaggcatgcggccagttcattaaaacagtcaggtgcgctgccagcctctctggaggacgtgaaaatagtgccagtcctcataggagggtgtggtagcgtcaaacactgggttacattgaatctggccaaagatctggggcttccctggtgcgtatttctggactccgatattgggggagaccctgcacaggttctgtccatccagaagcgtaaaaaagaagtagaggaggccggtaaggtatttttcgctacgcgcaaacgtgagatagaaaactatctgtgcccggatcttatcgaggaaattactggtgtagccgtcacgtttacggacacctgtgacgctaaaaaaataatcggccgggctgtgggaatgaaacccgataatgtactagataaattctggcctcagatgacatcagaaagaatcatctcaagatcaacctatcatgacggaacgcaggagagaagcgagctggttgagatcctgagcgacattgtatccatgacgagataa

SEQ ID NO: 4835 - DNA, 549 bp, Enterobacter cloacae
cagattattgatcgcccttctgaacatttgtggatctccctcaaccaggcagggcatcccgttaaatttgagcgtgatattgcgttcttcggcccaggcttcgaaaaactcgaagactttcatgacttccgctctgaggtcaaacatgaccctgtcaggtatcagctgattattatctgcctgtgccaggaacagcatatcgctgaccattttggtcatccggttatactcttcaagactggaatagaggacatcctcaagttccctctgtgttcgatcctgactcagtgcgatatcagtctgcgtcaccagattggtgatgggcgttctgatctcatgcgcgatatcggcagagaaattggcctggcgggtaaagacatcctcaatctttccaatcatatgattgaacgagataaccagttgctccagctcaatgggaacgcgtgtccgttccagtcgcgcatcaagattctcggaggtgatgtcttaaatggcatagttgacattaccaaggggcaggtgccccttgacggacagcgattcgaatga

SEQ ID NO: 4836 - DNA, 183 bp, Enterobacter cloacae
acgcagaagaaaactgtgccacaattcattttcgtaaaccatataactccctcttatttaattagttccatttttctgagaagtatcattgtcattggtagtttatctctgtatttcaaaagccagccatgccctcccagtaaagcatctagacttgtaagtgacatcgagtactgcccctga

SEQ ID NO: 4837 - DNA, 336 bp, Enterobacter cloacae
ttcccggcagtgatgttaactcactatggagatcgcgaatggttgcgtcctgtactggacaaggtaaacacatcaaccgcagtacccggcgcggaggctcagactccggcagcgatttcttcaccaccaaattctctccttcacctcaacaacctttttctaccgacgtgcataacggtgcgcgtagccgttgtatatcgtcatccggtaatgcaagcaatggcttacaaggaagccaaccctctgatgttcgtgcgcataatcgtgccgatgctggcgcgtgtgatgaataccaacaactcaaggtgctatccatgggaagacagaaagcagtga

SEQ ID NO: 4838 - DNA, 228 bp, Enterobacter cloacae
gttaacatcactgccgggaactaccgctgtcttctcttaagtacatcaggaattatcataaatgcaacatttattttacctgaatgcaacttttcggactgcccctacatggaaaatcagtcttatatagaaatattacagaaatataacaataagatagtctggaaaaaaaataatgtccccgcgaactgtcgcggggacgattatcaggcttctatgagaccctga

SEQ ID NO: 4839 - DNA, 786 bp, Enterobacter cloacae
gtagttatattgcgacaattttgtcccgctgctacagcatttttcgcaataaggcaaagcattatgcaaaggaaactatctattaaacctcagctattaataaaaagaattgaactattcgcagggaacatagataagaataaatttagcatttctccattcaaaggttctgacctaaaaatttttgagccatccataataaacacaggttctggctcagctctcaatatcaatataaaatgggattacccatacgaacttaaaatgaggcagcttaatgaatgttataaatccatcaacaaagaagctaaacttgaacatgaaataaatgataaattaggtgtaagatgcttagagataaacactggcgaaatagtattatatcctttgactaatacagatctgattgattttatggcaccgattaatgttgaaaaaaaagaatacaaaaccagagcccccttctctattttcaatattatgattaatgatgctatgacattattacacattgaaaataaattaacaaaagccgttgaaggtccatcattgaacatatcctatactgatgtagaaggtaaaaaatactccttgcaatataaaagttattttatagttaaagaaattaccgcattattatatacaaactccatatctggaatattgttcttcgaagggacaaaaatgcccctcgctaacagagtcaatcatttatataaaaaacaaaaaggtattttcattaacttcgtaagaaataaactccaaaacattaaattgcgcagttaa

SEQ ID NO: 4840 - DNA, 666 bp, Enterobacter cloacae
aggatgactactttgaaaatcaaatacttatatggcaaagccctccacctcaaccaagtgatcgatggcaagactgggattcgcctaagtgatctttctcactattcaagattagaaaatgaaaaaatgagggatgatgagatgtctaaagtctttatagccaaaagagaagaaataataatggaggttaatggcattaggataaacacttctgatttaaccaacgatccaataattagaattacacctaggcattgttactgtttatgtttaagtagcaagggggatgatgattatctttattcaaactttcaagcggatacttgtattgcttttgatgttgataaattagaagaacggctttctattgcatctcaaaaatttcagggttcgtttgtggttggggatgatatcatttactacaatcaaacaagcttgcacggtttgggtcaaacgccagaaaaacttgtcttctataagcccgatttcttttcacatgaacatgaatatagaattgcatggttctaccctcttgataaagatggtttccgtgcgggtgataaaaatattccttttacatttaaaaatgaatcgtcacatctttttttctttcataaagagcgatcatttattaccgattgcataataaatgtattcaggaaatag

SEQ ID NO: 4841 - DNA, 318 bp, Enterobacter cloacae
  unsure (278)
cgagtggaaagaccgatgatccgctgcacgtttcatctcaacaatagccagctttcaacgctgagctgccccggtgttgggttctttcccgcctactcaggaaacgccggtgagaaccgcaacaatccggacaagatagcggtagcaggaataggaccactgccacccggcaagtattatattgtgatgcgtcccggaagtagtgctgctcatttcaccaaaagctttacatcatcaattttatccggctcaaatcatttcaagtcgttcggatcgtntttcaccacgaggcctagaacgaccataagtcccccatcc

SEQ ID NO: 4842 - DNA, 240 bp, Enterobacter cloacae
gagagcacttcattgattcagaactactatccagatattgcagatgaaatcaggaggatagcagataatattccccggcgttctcgggcagcattacgtgaaaagttaaaggatgcaaatgccaaaaacaaagttttacaggatgagatccaacaacttcagcttcgaatatcaaaacaggcaaccatcaatgaaatgctgaattacaatctaaaaaataaaccttctcgaaataaataa

SEQ ID NO: 4843 - DNA, 1188 bp, Enterobacter cloacae
  unsure (140)
agccaattggcgcattttttggccaagacgggttgcccaagggaaattttcttccctcatctctgtcatcagggaccaattattccgaacaaaaatttggacaagtatgaaaaatgcactcattcttataaaaagttcgntataccgaacttggtggccgacgaaaatgaacatgacatgtcgtccggcttggatagagtgaagacttctagtgaggatgagatgtcaacagaacatgtcgaccataaaactatagcgcgatttgccgaagataaggtaaatcttccaaaagtaaaggctgatgaattcagggaacaggccaagcgattacagaacaaactggaagggtatctttctgatcatccagacttttcattaaagcgaatgattccatcaggtagtctggctaaaggaactgctcttcgttcgttaaacgatatcgatgtggctgtgtatatcagtggatctgatgcaccacaggatttacgtgagttacttgactatcttgctgatagattgcgtaaagcatttcccaactttagtcctgatcaggttaagccccagacatactcagtaacggtttccttccggggctctggcttagatgtcgatattgtccctgtattgtattcggggttacctgactggcgaggtcatttgataagccaggaagatggctcactccttgaaaccagcattcctctgcaccttgatttcatcaaggcccgtaagcgtgctgccccgaagcattttgctcaggttgttcgtttagctaaatattgggctcgtttgatgaagcaagagcgaccgaattttcgctttaaatctttcatgattgaattgattcttgcaaaattacttgataatggcgtggatttttcgaattatccggaagctttacagacattttttacctatctggtgagcactgaattacgtgaacgtattgtcttcgaggataattatcctgcgtcaaaaataggcaagttgtcagacttagtgcaaattatcgatcccgttaatcctgttaataatgttgctcgtttatatacgcagtctaatgtggacgccattattgacgctgcaatggatgccggtgacgctatcgatgctgcattctatgcaccaaccaagcaattaaccataacctattggcagaaagttttcggttcttcattccaggggtga

SEQ ID NO: 4844 - DNA, 567 bp, Enterobacter cloacae
cctattggcagaaagttttcggttcttcattccaggggtgaaatcattatgtcttcttatagttatacggtagcagagacacaaactttcagcgtaacccacgctcgtcacatggccgctaaagttgcaactgacttgcggcggatgcagcgtttttatggttaccccagtgatgccgacattgaagcatacgaagaagaattggttgtgattcttaaggctggatatttgggtgaggtctcttatggttttcagaaaaataataactggatcgagccgacccttcgatataccgcaggcgacttgcttggttcaggaacagatgacgatcccggaaaaatccgccaaggaaaagatgtatcgggtgcatccttctacagttttatgacttatagctcgaaatatctgaatgctactcaatcggaaaaagatactgctttgaaagatctaccattcaaacgggtaggtgcccagtctccagggattaatggctacctcgaaaatgataagacttactcggccggtggtcgctccctcactcgcactagcgtaaggaattttgtatga

SEQ ID NO: 4845 - DNA, 597 bp, Enterobacter cloacae
atcaatgaagtgctctcttattcctcgccaagtggtagttctaacggatatagcagcggcggtggaggcagctccagtagcaccagaccacgttggtcacgggcgggatcatctgtgatttatacccctgcggaagtgcgcactcacacgccagcccgtgaaaacgttgagaggcgggcctctgtccctgatttacgagatgtttttctgtgccatgcctgggacgatcgcaaggacgcagccaaagagcttcatgaccagcttgagatgaacggggtctcagtctggtttagcgaaaaagatgttttacttggtgcaacattgctgcgcgaaatcgatgaaggattggcaaaatcacgcgtagggattgttctggtgacccctgcgctactaaaacggctcgcaggagaagggattgcggataaagagctatcggcccttctggcacgagaccttcttgtccctatcgttcataacacaacatatgaagatcttcgcgaagtcagtccgttacttggttcgcgcagcggtttgagcacagctgaagattcaatggccaatattgccagcaaactagcggagctggtaacaatctag

SEQ ID NO: 4846 - DNA, 216 bp, Enterobacter cloacae
aaatttattaagatttttgatatcgagattttgacgcaaagtaacttttccggctttcttgaaaagcatttccgacagagttgtgtttggcttcatttgtttctcagcaacagcaatagggatttggcctacaaccttcctgccatcttgaagcctggcaactatgtgaaacatagggacctgacccaagagatcctttggaatactctcttctaa

SEQ ID NO: 4847 - DNA, 222 bp, Enterobacter cloacae
gaaatagcagctgctgtatcggggtttgaaaggccatcaagcgaaatgtatagcaccccgccagtgctgaacatcccttcgcttgttacaatttctcttgatgatactgagttcgggttaggagataaaagctcatttaaaggtttttcaatgagcatatcgaaaacaggcataatacctgcggtcattttagccatatgctctgggtcggacattgagtaa

SEQ ID NO: 4848 - DNA, 261 bp, Enterobacter cloacae
atttctaaggaagttgcattgatggatgaaaaaattgtcctgacgcgccagcaaattttaagctctgcactaaaagtcagcaaatgtcgctcgctcgtaaaaaggcgctttcaatctttgggtttaaagtacgcagattctcaagaaattccagatcggctaactatgatagacaaaaacgcgtttcaccattttgggaaaaatttgtccgacccaacgatttcgattccctattcctccatgggcaaatacccttgtccg

SEQ ID NO: 4849 - DNA, 651 bp, Enterobacter cloacae
aaaggtaaacgttatctctgctctgccgttgaacagccatcacttttcaataatgagcaatttatgatcacctttttccgccgggcaggtctgggcacgaagctatcgctgctaacaggtgccagtgtcgccacgctttttttgctgttcacttttctgttgagccacaacgccagccagcagcttgaagatcttgcggttgaagacctgcataaccagtctaccggcatggtggatatggtagagatgttcaacaccagcctgagcgaagaggtcgagagctatacccgcctgttcaccacctttttgccacagccattgaacagcgacagcagccagagccggaccattaacggccttaccgttcctctgctgaagggcggtgaaacggagttgcatgaaaacaatacgctttctgatgacttcctgagccgaacgggggccatctcgacgctgtttgtccgcagcggtaacgattttatccgcgtggccacgtcgctgcgcaaagagaatggcgaccgcgccatcggaaccgttcttgataccaccagcccggcatttgcggctgtcaccaaaggggaggtctatcgcggcctcgcgccgctcttcggcaatcgttatcagcagccgcaggaaagagtatgcccaaag

SEQ ID NO: 4850 - DNA, 243 bp, Enterobacter cloacae
accgaggcccaatcgccagaccatgcgtcaggcgatgtcatttttattttagtaatttcacgctatttcaaatatcatcttttcaaatcaattcttatcggaatagctcatgacggaagcgcaacggcatcaaattttactggaactcctggcgcaaacagggtttatcaccgtcgagaaagtgatcgaacgtttagggatctcccccgctaccgcgcgacgggatatcaacaagctggatga

SEQ ID NO: 4851 - DNA, 588 bp, Enterobacter cloacae
ggaagtaaacggagtatgccaatgaagactcagcgcgtaatcaaagtagcgacgtttctggcgttttgtttacccggtttgacgcttgccgaagattgtcagatcacgctttctcagcccatagtagattataaacagctcaagcgtgacgatattgttacgtctcagcaaagctggcataaattgccggaacgggaagttaccgtgaatgtgttttgtccagacaaacagaagctggcagtgcttttacagggtaatgctggagagaaaggtcgcttccgttttggtcagaatggcggtgtcgcagttaaaattgatgatatgaatgttgatggcaaaagctataccgtgggtaaaacggttgatcagcttaactttacgccggaaagcgggtcgccttcgccattctatttaagaaataatgaagccgtcgtcgcggttgaaaataaccaggccgttacgggccagcagatgacatttacagctacgatattccctgtgcttaatgaaagtgcattcagtaataatgccgatcaaacaacgctggaaagcgattttagctggaaaatattgcaaaataatccatag

SEQ ID NO: 4852 - DNA, 222 bp, Enterobacter cloacae
  unsure (81)
attattaaatcgggtattacgcaaggctacccgcttaaattattcattgcgtttattattgtaaccattcttctcgagatnaaaaaaaacgaaaaatgcagtctcatattcttatttttcgatcaatttaaaaaatatataattttctccaaaaaaaaacggccaggcataaacctgaccgttaagattaaaattgagttagcgttattttacaacgcgtaa

SEQ ID NO: 4853 - DNA, 285 bp, Enterobacter cloacae
cgcctgaccggcggtattgagggcatcgagaactttaacggcatgcgtcaggaactgttcgcccacgagcgtaagctgagcccccagacggccgcgatcgaacaggcgggttccggtaagctgttccagttcgttcagcgttttggagagtgcaggctgactgaggttaagggtttcagccgctcgccccagcgttccctgttgagcgacggccacaaaagtatgcaaatggcgcaagcgtatgcgctgactgaacagaccatttttttccataggcgatgttaa

SEQ ID NO: 4854 - DNA, 204 bp, Enterobacter cloacae
agacagaatgcctcgctggtggaagaagcttctgcggcagcggcttcgctggaggagcagggcgcacgtctgacggaagccgttggcgcgtttcgtctcaacggggcgcgtgcaggacgggctccagccgctgcaaacgcagcgaaaccctcgcctttaaccccggcggcggtcgtctcaggtgataactgggaaacgttctga

SEQ ID NO: 4855 - DNA, 267 bp, Enterobacter cloacae
tgggcggcattcgacgccgtctatgatctcatcgggggtgaaattaaaaaattttttatccttccccccttgatggatgccgttgtgaccccatcttgtaagcaaccgcagtgtgtggacctgaaaaaaatcaaatctgggcagttgaaaaagcacgttctgcccttattacaggtacacaaccacatgttgactgaatttttagtggagacgtttagatgggtaaaattattggtatcgacctgggtactaccaactcttgtgtag

SEQ ID NO: 4856 - DNA, 204 bp, Enterobacter cloacae
tcagcatcaaaagaagaagaaaaacaatcaaagaaaaaagaaggctcatcagacgaaaaagagaagaaagccgaaagagaaaaagaaaaagaaaaagacacgcagaaagaaaaatcagagggagaggaagcagcagatccagacaatccagaaaaagaagaaagagaagaagaaacggcaaaggacacggaatcccaagtttag

SEQ ID NO: 4857 - DNA, 282 bp, Enterobacter cloacae
  unsure (253)
gtcaaccaacatcatgaactccaaaaaagcgatccacaaaccaaagataaaaaagagagagaagaagcagtccctaacctctacaaagaaaccataaaggcaaagcagccgggaaaagaagaaaaagcaaacagagaagatcctaaaatccaacagacaatcagagaaggatctctcgaaggaaagaggaaagaaagggacaaagacgatcagcgaaaaatccagatcggcgataactgtgtgttttcacacnaggccgtctggcaaggatacctgtgctga

SEQ ID NO: 4858 - DNA, 627 bp, Enterobacter cloacae
ctgagtgttgtatctaatcgtgggggcaggtcaggcggtctaaaaggttttgggatcatgagcctcagctctttgtacagttcttctgacgccgaatacatccaggtcaatcaatacctagtgttcgtccccaatccaaaaaaattgccttacaatgatgaaagtttggtacgtgagggagctaagtatgtttttgagcatacaaaagcaactcaggcctcatttggatacaaccctgaaaaacagaaagcagctctggccacatgtaaaattgatatggcagtcgtcaataaatggagtacctgtgatctgccctctaagcctgatgctgatgttttccctacagattcaatgtacagctttcaggcgattcgccccgcaacaggaaccgaaattcctgagctaaaccttcccgctggtgattacgctgtaattcgttatgtgttcatcccatttaaaggaaacgaaacaagcgctgatttttcgggtatcattttccgttctgatagcccaaatacaacaactccagggggtgttgcagcctccatcaacggaaaagattattacctctttaccggtgaatacggtaaaaaaggcttcccagaaaaaacattgaaagccaagtaa

SEQ ID NO: 4859 - DNA, 450 bp, Enterobacter cloacae
tttcagctggctaatactgtggaccctgacggggatatctctccgtcggaggggatatcccgttatttaactgaggatagacccatgcacgcagacgtttgcacacttaagacacctctggacacgctcagctggctttgcctgcttgagagtgaacttctgagcatcagggcatttcagcgtctcgaccttcatacggagcgggatgaaccgaatgaactgacgtatctggaagatgccatcattaacgccggcacagcctatggctggtttgtctgttttctcagggacggtgatattccaccgttgccagcgactgcccgagaaattctctgcacccttgacagtctcggtaaagaaattaaccgtcctttctgggagaaggctgtggcccgcgggcaggatgaggcctgtggcgacaaagctatcgcagccctagaaatgatgtaa

SEQ ID NO: 4860 - DNA, 681 bp, Enterobacter cloacae
atccccctttttttctttgcggaggatttatcaatgaaagacctgtcttcttccccggcttccatgtcggttgtttataccattgagcacgtcagcacggttccgttacgtcactggcatgctttcgttctggccgtaacagaaacgttctggcaactgccggtgcgtctgcgtccgggaaatatgtatctgccgtcgcttaatcgcgcggctgacctgtttccggttgctgatgtcatggcgttctgtggcgattcaggcggcagtttctggccggtcaacatgaccattgagcgcgagcgcagcaacaatacgctgagtattcaggagctggattttcagcatcagccctgcgatttctttgcgcgtgttgtgatggtcctgctgcacaacctgtgtccgggcagcttccggatacattcttctgacgaagggcgcagctgggcaataccgttacgctggattgagcgtcatattggcctgcctgagcagtcgtcactgaccacgcctcagccggtactgcaaacgccggtgagtgagggggcgtttgattccctgctgctgcaactgctctccggtggtgagcgggtgctgagcagtgaggactggaatgccttcgtgctggcggaatttcatctgtacgaactgaagcgcgtcactgaaagaactgacgcgccgtaa

SEQ ID NO: 4861 - DNA, 1008 bp, Enterobacter cloacae
ctgtcaccgtcccgtgaggacacggctcctcacggggctgtgtcctcttttttttatgaaagaggagtattcactatgtccgaatggtgtcataaccgcctggaaattaccggtaagcccgtctgtatcgatgtcatgctgcagtggataaacgggactgacgccccgcgtcaccgccacgccgtgcagcagagcatacagctttttctggccggtgcggcggggatacttaagccggtgcgcaccacgtcgtatccgccctttcaggggctggtccgtgcaggcacagggctttccactgcggctaaccaggcgtttgaaaactggctggcattgttgctgacggatgccgttcttgatgcggaaaccatccgggtcattgaccggctgtatcaccagtcaggcctgggggcgctgaaatgggaaaacatccccgtctcatcccgtgacgttatggcagaactgattatccggcaatacaccgactggtttggtctggtcagcgccggcgatgagtctgatgccgcggctgcctgggaacggctcagccagtatcctgagcgctcgcagccctgcgacatgctggccgtgataccctcccggctggctgcagagctgaacggtgccggtgggctgatgtccggtgtgtcgaccacaaccagcctctactgccggcagtacggcatggagtggccggccgggcacaatgtcagctggcagcggcatacgccaaacagtcttacgctgcagatggatacgccctggcttccgccgtcaggtgaggttgtcggggaaatctccgcggtgtttgactgcgaggtgcgtcacagctacagcgagcccgtaagcgggctcagcggttacgactgctatgacggcggtgaacatgtcgacgggcacaaaggcgcgtccggcgcacctcagcccggtcaggtgctttatctggtcagcgatgagcccgattcaccggctcaggacgctacatcatatcgtgaggtccgggggtaa

SEQ ID NO: 4862 - DNA, 228 bp, Enterobacter cloacae
tggttgcaaaagcaacatataagcctgctcattttcagagcaaatggagcttatgtcaactgtggtatcaaatgggtcacccatagtatgctcagggcagtaaacaacatgatgctggacatgccagccgcaattgctcgtaaatattatcaggatcgccttatgaggcagataaaaaggaaaaaggaaaaagacagggaaaggctggcacacaaagaaaaaatataa

SEQ ID NO: 4863 - DNA, 201 bp, Enterobacter cloacae
tttaaaatactttcgagacgaaactacctacaaagcatgatcccccggcgcacacttaaggcgcatttcctgccctggggtagtgcaattgacgacaccccatccccggctcgttatcccttatcccgtgcggcgcgcaatggcatgattaaatattgtgcaaatttgatttcacctggcgtttatcccgatttttgttaa

SEQ ID NO: 4864 - DNA, 1191 bp, Enterobacter cloacae
catgccttcgttcacgtgcagcagctcaaacgttcccgccggatgtcccggagaggtgaacgtttctcccggatgcatctcccactgccacagctcaatcatatccgggcctgcggtgcctgccagcaatctggcgtaaccgccctgtgcgccctgccacagaaccgggatcgcctcttcccgaataatgtgtatctgcggctcgctggagacgttaacgatatctgccaccgagacgccaagcgcggcggccagtttacacagaatggcaatgctggggttggcagcccctttttcgatctctaccagcatgcctttgctgacgctggcgcggcgagaaagctcgtccagcgacagttttttctctttccgccagctgcggatacggttcgcgacggccaggcttacctgggcaacatcggcacccgcatcggtcattatattgactttatcagtcattggtcactaccatggtataaaacagtcaatacaggattatttatgtctcttgtaacaccgtcaatagattcgcgacttgtcgggatcgcgcccggctttcgggcgctgagcattctggttgaagctgccccgattacccaaccggaggttgcgcccgctgcgctggcgcaggcctgccagcagatgctcaatgatgatgtgccctgggcagaaaatcatctcgccgcctgggatgaggtgtttaaagcctttggtgcaaaacccaaacgtacgccctgctcggcctcggccctgcgcaagcgcgtgatgagagacggttcgctgccgccgctcgacccggtggtggatatctataatgccatcagtatccgctacgctattccggtagggggagaaaatctggcggcttactcgggagcgccgcgcctgacgctggccgacggcagtgagccgtttgataccgtcaaagagggtgagccggtagtcgaaaatccggagccaggcgaagttatctggcgtgacgatcttggcatcacctgccgccgctggaactggcgacaggggatacgcacgcgtctggacagccaggcgcagtccatgtggtttattctcgaaagcctgccgtcgatgccgctggcggcattacaggaagctggcgatgagctggtgagcaatctgcaaaagctgatgccgggcgcgacggcgcgtattcagttgctggagctggcgtga

SEQ ID NO: 4865 - DNA, 219 bp, Enterobacter cloacae
caaccagcatcccgcctgcccgccatccctgaaatccgccatttcgtgcgtcatctctccgtttcaaacgtctcctggcaaattgccgttcccaacaacagaacagcactatctgctgttttcttcacctctcatcgcattcttttacaggtaaatcgcttgtttttacaccattatcatcctgttaacggaagcgccagaaccttaacgcatggataa

SEQ ID NO: 4866 - DNA, 399 bp, Enterobacter cloacae
ggtgcactcatttttataggccaaatcatgccgcatacgtcgagctggtggggattaatgttggagctgtatcgctctcataaaacctcgtttgatatttttttgttgatcgtcctgggcgtaatcgttcgggtgttctattggggcggaaaacttcgcgaatgttgcggtgatatcttgatcgggactgtgatcatgacttttgcggcagctcacctcccaaatgtaatgatcgctatcccgcaaattggctcagtcaaattcagccacaatgaaattgcgtttgtaatcggtatgttgggttacaaagggattaaggctgtcatttttttggtattaaaaaaccggtttggcatcgatttacccgctcgaattgcacagcgcaaagacaacgtataa

SEQ ID NO: 4867 - DNA, 516 bp, Enterobacter cloacae
cccgctcacgcgggtttttttatggagcaaaccatgactgatagatgtaaatgggtcgctacagctcgtaagtacatcggagaagctgaagtgcatggtccgaaacataaccccctcattctgcaaatgtggcgcgatatcaagcgcggcgggattaaagatgatgaaacgccatggtgtgcagcgttcgtcgggtctgtcctggaacaaaacggtattcagtcaacccgttttgaatccgcgcgctcatatctcgactggggaatcgagctgcaagagcctacatacggctgtgtggctgtattaacgcgtgatggtggtggccatgtcggatttgtcgtcggacagaacaaagcaggggacctgatgatcctcggtggcaatcagtcagatgcagtcaatatcaaggcgttttcacgtcagcgcgtgacgagctatcgctggccgcgcggccagtcctccgttcctcagtcattacccgtcatgagtgcggaacattcaacatcagaagcataa

SEQ ID NO: 4868 - DNA, 383 bp, Enterobacter cloacae
tccggaagaggccgcgttgctcatcgctgcaaatcacgtctacgcgctatgagctgctacgacgacgatttgaacgccggtgacgagcagatgctcgaagcgtttggtcgtccagttcgcctgccgaaccgcgctgacccgatcatcgcgatattcaacgaaccctacgcgcgaactgatttacccagctcggggggcgggtttatcaccggcacagtaacgagtatcacggttaaatcggggagcgttgatggtatcgccaggcgtgatgtcatccaaggtaccaaaaaagcgcgaaactgggatgaaaaaaggaaaccctggttctgggggcagctggaactgaattactttcttgaaagtagcccctgcccggacgggtc

SEQ ID NO: 4869 - DNA, 972 bp, Enterobacter cloacae
actgcaggaaataatttcttgttccatttagggtacacacaaatgcaagttaaaagcttagggttttcaataacaaatgataatgaaaacatcaaaacaatagatgtaatgaatgaatttattaaatcatcctcacgtcaatataatcgcgcagattatacgcgcaggttccttatgtccgatgtgaatgatttttattatggtttggtggtcacattcaaaaaccaaaagaagaactgcatgtcacagttcattgacggcaaatttaagcttaaagtggaagaacttcagggtgacgaaaaattagtcacattcaatttatttttgctgaacaaaactaatcttcgcggtttgtatatgtctcatcatggttcttgcagcctcaacacacttttcagccactttcaaaccgtaagtaatgaatttatcagaaagcaaaacgcagcagatattgaaaagctgggagacaatccaaagcaaaaagaagtcaccgcagttaacaaaaaatataagaagcgtttttcatttagcataatgacaaccaaggaggatataaaatccattcttgggcagttcaaagaaataaaaaaagcatcatttaaattcgattacatagactttaaggggggagcattgactccactcgaagcatttgccaattcaacaacaatagacatgagcattaatccagacgacaaatataaagttggggcactgtcacaaactatgtcggatacttttgaagccatgaaaggtggaatatctaaagctagagttactgcggtagatcacggtggaatagagaagattatagatttcatggattgccctgctttcttcgaatcttatgattttgatgtaatagctgaaaaaattaatggcctgactaacgataattatacttccaaccctgtatttgatatgatcaaggatgagatattgaacgggaccaacaaaaatgcctttgtatga

SEQ ID NO: 4870 - DNA, 297 bp, Enterobacter cloacae
atgaatgctgatatttatatttacctcttgaggagatctaaaatggcagatgccgcatttaccctacccaaaggcgtataccaaaagcacaaagagttctttgagaaactcaaaatggatatcgaggttcataccagtgataagaacgtggatatggtatccatgagttgccataaggatggagataatcaggatttctgggatctggttgaagcaacacgactcactatttgcaagcaagaaaacctaactgccgatacgggaggggctggtgttgtctggatattccataagtga

SEQ ID NO: 4871 - DNA, 237 bp, Enterobacter cloacae
gagatcaagctttgccgcctctactgcagcctgcgctacattgacttgggcaatacgggcatttttatcagaagctgcatcgtcataatctttacgggaaacagccccattattgaccagtcggctgacacgttcaaaattgcgatttgcctgaaacgcctgagcctcagcttggcgaagttgcgccttagcgctatcaagagctacctgaaatggtcgcggatcaatttgaaatag

SEQ ID NO: 4872 - DNA, 285 bp, Enterobacter cloacae
  unsure (38)
tcgagctgcatcaccaatagtgctcattctctccccanatgctattcggtgatactaaagttagtgttaaaagacatagtttcaggcaagacttttggggaatttgttaagcctctgaacaagttggcacacaaattatttccaaaaaattcgggccagaagttaccctctttaaagggtaaaccctcccctgataggaaggtcaagggccatattatttattttttttcaatcataaccaagataatttactttatattttattcattcattaaagaatcctaa

SEQ ID NO: 4873 - DNA, 201 bp, Enterobacter cloacae
cgccatctacgtggtgaagacagggatacgcttcgacggatggcggcagagttaaacgtgccgttgaactactttttttgtgatgatcagacgacagcagaacttgcattactcatatcccgaatgacagaggaagagcgaagtaaacttatcgaagcactcaaaacgtcttcaggtgacaacactgctgacaaaaaatga

SEQ ID NO: 4874 - DNA, 189 bp, Enterobacter cloacae
aggctcgacccaatgcgttcgttcgccagcccccttaacaccaacatagcgtatgccaagaaaataatctggcaatcctttattccgcaaacgtttgctgaggtcagagttatctatatgtcgtttgaccaaggcatcctgtctgagattgaatgcctcaacagaacggaatccagtgacgatcagtaa

SEQ ID NO: 4875 - DNA, 465 bp, Enterobacter cloacae
aaacaaagaggaagaaaactaatgcgtggtaaagaattggatactcagatagagcatgaactccagttgatgttgattgaagggtttgataaatcgcctatttcagctataaacttacatgccagacttaaatcaaaaggaatcattaatggtggcttaagtacattaagtaacattgaacgaaggcgtcttattgcagcctatgtcgatcaacaactatcgcctttgaatcttcgtcccaaagaaaaacagcagtatgtgaaccgtaagactcggcaggccttgcttggtcgtaatcagcagttacaggaagagaataaagagcttcgcgaacaactagcacagaataccttgtcattgattgaaattgtcaaagcggtaaaaatcaatacggttataccggtagaaagccttcttgctccgcatttgatcatggaattacacaaaaggaaaaaagatcaatga

SEQ ID NO: 4876 - DNA, 1242 bp, Enterobacter cloacae
gtcatcttaaatgactctgaggtgtctgttaaacccgtggcgattcagtatatagaggacgatattctcgatgccagagctttctattctatattatttgggttgaagatcctttgttgtgaagagttccctggatttactttggaagactatgaggatcttgagtttatacctagaccaaatgcgtttaactgggagatttatcaggacattgacaatattctcgaacctttggaaaaaagcatgataactaaaggtttatttgagatagcaactggattggccagaggtaaaacttatgatattaaagagttaaagcataccgcagtactggcgttaagttatgccactggagcgcgtcccgtgcagttggcaaagttatctgttcgagacttgagaattgatacgtgcgatacacatactgggctaattagatatagcattctactaccttacgtcaaacagagacgccttacgaccgagcgtttgctgcttgctatacctccggaaattggtgcgttaatcaagcattatgtggacaaagctcagttattatcccatgacagaatgttcgaaatgggagtgtctgcccctgcttttgtctcccaatctataagccaagccattctaaacttcagtccccctgaatatcaaactgccgttggtcgcggagaggccgctcccccgtcaatcacatctactgatctacgtcacaacgttggacactcacttgcaatgcagggcgctagtgcagaggaaattgctcacattcttggccattcatctctggttgtagcaaagcactacatccgtgcgaccccagccttggcattgatccgcgctaaagcactcggttctaaccctgtgtggcaaaacatggtggctatgatgcttactgggaaacttgtcccttcaaaagaatgggaaggtcgacgcgtggttggtatggttggtgatcgattgcactatgagattggtggctgtgcgagaaccgatgatgaatgccccttctgtgaagtccgttgctgctatggttgcttatattaccgccctttccttgatggccatcaccagggcgtattgaatagcgtctctaaagaagtcgatgagctgatagcagtatcagatagtgttggtaatgctctcaatccactaatttctgtccacgagacgacgcaaatagaaatcaagtcagtgattgcccgttgtcatttgcataacgtcagaggttgtgggaaatga

SEQ ID NO: 4877 - DNA, 261 bp, Enterobacter cloacae
  unsure (15)
cgggccttgtcgaanaaacaacacaaagtctcgacaagaagtctttttgatacccgcacacaagtcagattacaactaagtcgaagcgttcataaaacgctggcatctgctaaagaaattttacagggaaggggggttgattcggtctctattgaagatcttgtgcgagcctgtcttgaagagaaccagccaattgatctagcctcactttaccttgaaaatctcttaaaacagaaaggtaccagcatttgcgatttttag

SEQ ID NO: 4878 - DNA, 453 bp, Enterobacter cloacae
tggtggattgttttctgtttcaccataccaaacctaagaaaaaagcaaaaaacaaaactactgtggctaagcctcaacttaaacagactaaaagagaagggagtgaaaatggaactgggcattatggtgtgcatcgtgttgttactctcagtggcggcggcgtggatcagtaataagacagttgatttgctcgaaagattctatttcaagcgtccgctgagcatggagtacgcggcatggttacgtgtaatgtgtgcaggcttgttattagtttttattcaggttgctccccaatttacactcctgtatacccttaaacttgtcacgcttattaatcttggaatccagacaatgaaattaaatggcgtgtacaaatataaaaggacgggaattttgcctccgggaggggcactctctaatctcaccagacttaacccgttcaagaaaaaataa

SEQ ID NO: 4879 - DNA, 540 bp, Enterobacter cloacae
aacatgagtactcaaaagcaactttccagaactaccggcactgaacgtatgtttaaggaagagctggcgttatccttaatttgttgggttttcaccagtccttttaccaactggaccgataaagtcttcagtggtattgaagttccgtctgaaggaccgtcatcattacggggtgagacagaaaaattctttcgttttgtcgttaatgaagaaggctacgacgcaggaagggctgctattggtcttgacctatgttgtttttcacttccgttgtgtttgttcccggacgctgccctgtctgaggaagaggttatgagtaagttaaccggagaagttatccatggaattcttctttccttacctgagtttattgatatgccagaagtgctcgcttaccaggtcagggatgaaattcttgcttttaacactcgctgtggagacgggatctttcatggttggaacacggcttcagaattgtggaagtttgaaatctttccccgcaccaccatcatgatgcagcatacttcggcaatacattaa

SEQ ID NO: 4880 - DNA, 915 bp, Enterobacter cloacae
ggaacaacaatgcaatggatttccacagccagccagaaaatcgatgagcgtctctatcgtgtctgcgtctgggtaaaaaaatatcacgctgatgcgattaaccgcgttgtgctaaccgttgatctaagtaaagcccgacatgaccctgacgaggaccaggtaagagcagaactgctgtgcggccattattttttgcttcgtaaggaaaacgcttcgaactctgcgcctgacgatcaaaagtttgctttcctgcctgacgggcgcaatctgtgttggcagaccgcaaccccggtgcttcagcatctcctactcaataaaaacgttcctgagtcgctgaggttgcttacggactacatacatatgcgtctggccaggctgacaatggtacctatgtccggaaccatcatgaacgaggctctgctggacagcatcagctgggttaaggtggatttgacctacttctggcagtacgaacagctcagctctcatctgggacccatccagataacccacaaggcacttgtacgcttcgggcacctggcaaagaatgatgaaaactccagtgccataagaattctgcgtcagcgtctgtcttcagaattcttacaagaatttcagatggctgaggatgagctaaagcgcaaacagtcgttgatgggcaccatggacgtgaaaatgctgtttcatgctcattaccccagccagaagatgctggtggctcgatataaaaatggttgggtaatggtggattgttttctgtttcaccataccaaacctaagaaaaaagcaaaaaacaaaactactgtggctaagcctcaacttaaacagactaaaagagaagggagtgaaaatggaactgggcattatggtgtgcatcgtgttgttactctcagtggcggcggcgtggatcagtaa

SEQ ID NO: 4881 - DNA, 564 bp, Enterobacter cloacae
tgtatctactttatcgatggataccatcttttatatatcaccttaaacgataagaatagaccgcatcaacgcccatactggcgtcaatatgaggtaaatatgcaacatcaggatgcactccaacgtaaattgccggagcggatcttccatgccgtctgttttgaaggcattgctacggcgatcctcgccccgacggccgcgtggctaatgcagcgctcggtggttgaaatggggggtctcaccataattctggcgaccacggcaatgctctggaacattatctataactttggcttcgaccgtttctggcccgtccagcgggtgaagcgcacggcgaaagtgcgcgccctgcatgcgctgggttttgaatgcggttttattgtgattggcgtaaccatcgttgccgccgtgctgggcgtgacgctgctccaggcctttacgctggaaattggtttcttcctgttcttcctgccgtacaccatgctctacaactgggcgtacgacaccctgcgggagaaaatcatcaagcgccaccagcaacgccgcgccctggcaagcgaataa

SEQ ID NO: 4882 - DNA, 303 bp, Enterobacter cloacae
ccacgcaacaccttcctgtcgctgctctgtgacccaatcgaggacgcgtgtaatctcctcgtcctgattatcaaagctggccagcgcgggatacttcccggacaggccacctgcggcaggctgctggtatttgagagaagcttctatgtgattattgagataattaaatggtacgctgctggcaaaatggagtatttgccgggtgttgcgataattggtatccaaaatagttgtacggccctgagcctttatatcgacgctggacagggtaaaatcgagagctttctttttctgataaattga

SEQ ID NO: 4883 - DNA, 1407 bp, Enterobacter cloacae
cacgtttcttcattacgttgttggcttcacttactggatgctaacaatatgaaaagaaaaattattcctgtgcttatcggttgtgcgctctctttctctggcctggctgcgcagcctaccgctgagcgctatatcgtcagcttccctgacggctcccatgtgaaatacagcggcgcgtttgccgatgcgttcccgaacgggctcccggtggggatgggttctggtctgttgttcacgggcaagcagggcgatgcgctgacgtttgcgaccgtgaccgatcgcggtcctaacgcggattcgccaaaaatggggaaaaacgatgccaaaatctttgttaccccggatttcgctccgctgctgatgacgatccgcgtgcaaaacggtaaagcggaggccgtggacgcgcgaccgctgcatgacgataaaggcgagatcaacggcctgccgctgcaaagcggtgtgattggttccaccaatgaagtcgcgctaagcgacaccttaaaagtactgaaaggcgataaccgcgggctggatacggaaggcatcacgccggacgggaaggacggctactggctgtgcgatgagtatggcccgttcctgattaacgtcgacagtaaagggaaaatcctcgcgatccacggtccgcaggcgacgcaaggggagaagtccatcgcgggcggtctgccaaacgttatcaaatggcgtcaggcaaaccggggcttcgaagggctgacccgcatgccggacggacgcattatcgccgccgtgcaaagcacgctggatattgacgggaagagcaaaaaacaggcgctgtttacgcgtctggtgagcttcgatccggcgaccgggaaaaccgcgatgtacggctaccctgtcgacagcgcggcctacagcaaaaacagcgacgccaaaatcggcgacatagtggcgctggataaccacaccatcctgctgattgaacagggtgaggataaaaatgacgcaatgcgtaacctcatctacagggtggatctgagcaaggcgagcgatctggccgccttcgacaagccgggcgaatacccggagtttgatgatgagaaaacgctggcgcagcgcggcattacacttgctgaaaaaacgcaggtggtcgatctgcgtgcgctgggctggcagcaggaaaaggccgaaggactggcgctgattgacagcaaaacgctggcggtagcgaacgataacgattttggcgtgaaggtagcgatgcaaaacccggtcgagggcaagaagcttaaggattaccgggtgaacgcggaaggcaagctgacgctggatgataaaccggtggaaaccacgctcagcgtgaagccgctgaagaagccggagtccgacagcgagctgtggattgtgacgctgccggaggcgttgaaataa

SEQ ID NO: 4884 - DNA, 219 bp, Enterobacter cloacae
aacgctgctaataacaataaaaatggagaacatcaccaacagtacttttgcaagaaaaccaaactgtatatttattgcaaaaggaaaaagaagaaacgcaccccaggcaaggagcgacgcccatccggccaacttatttacaacaccgccactttcgaaccgaataaaatgaataataatttcctgtcttcaccgcgaggctgccaggtaccgcgctaa

SEQ ID NO: 4885 - DNA, 216 bp, Enterobacter cloacae
cctacactatttttaagcggattagaattgattaaatacaaaaaacagaatggtataaatatgattttcagcagatgtgccagagcagaaattaaggaaaacatgagaaagaggaaaaacaaaaaggcccacgttacaagtaacgtgggcctgaatattggcggaacggacgggactcgaacccgcgaccccctgcgtgacaggcaggtattctaa

SEQ ID NO: 4886 - DNA, 186 bp, Enterobacter cloacae
ctaaacggaatcccggaggttaaatctgcgctaaatggccggaaatattttgcgaagcagatcgttagcttcagattttgtggtgaaataaagcctgtgttgcgttactcttctgacgataaagttaatgattcttgtcagaaagcgggtgcgtatcgtgaacagacttataatgagagaaaatga

SEQ ID NO: 4887 - DNA, 261 bp, Enterobacter cloacae
  unsure (65)
tacgggcatttcgattccctctgccggaaatatgatttcgttttacccttttggcgttgtgatcngcgcgcccattgtggcgctgttctccacaaattttcgctgataaacaagctgctgtttctggtggcgaagtgcctcgttggtaacacaccctttaccttctctgaactcctaactggggcttgccggcggggccctaaatctctggttttccgcattggcgcctattttcggcgttgggggctattaacccgttca

SEQ ID NO: 4888 - DNA, 321 bp, Enterobacter cloacae
agaggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcttcgagttcacagcaagtgtgttttcgtgtacgggactatcaccctgtaccgtcggactttccagaccgttccactaacacacaagctgattcagactccgggctgctccccgttcgctcgccgctactgggggaatctcggttga

SEQ ID NO: 4889 - DNA, 234 bp, Enterobacter cloacae
ccagatttttctgcaatttcctccacaagtaaagtagatgtcagtgaattttcgacccattggacgatatctttaaccacactatccgcatacgtttttgtgatcatatgtccccttataactaaattctacatttatctaaaaaaaaaatataagttcttcatccatgaagaactttctagaaatactatttacgtaacaatctcagaccatttgctacaaccagaaggctag

SEQ ID NO: 4890 - DNA, 198 bp, Enterobacter cloacae
gcagcagtcaccgctatgtccatgatgttcatcagcctgatcatcctgagcgtggtcatggttacaccccttatgctgatgatcgccatgactatgttcttcctcaccatgatcatgttcttcatcagtatgactatgttcatggctgcatccttcatgtgcatgcccacctttcacatgcccttgctcgcgatgtaa

SEQ ID NO: 4891 - DNA, 201 bp, Enterobacter cloacae
tatttccgtataaagttaattaatagaaaaagctcagtgatggcgaaacacaagtccaactctttagtgttacgccatcatggtcctagaaaaatagctaatcttttgacactctgtttccacgagaacgacgttgcaccgcaccttctcgtttacccgaatgacttatatcatcagcaatcgttaatctatgaagaatag

SEQ ID NO: 4892 - DNA, 201 bp, Enterobacter cloacae
gctaccaggcactttctccactgggataggctcccccgttatcatcgattcatctacaaaacttgttccttcacttacctcaccatcaacaggcactcgctcacctggtcgaacttcgataatgtcatcaaggactacatcattaattggaatatcgacaacaacgccattacgcaacacatgcgcctctttggcctgtaa

SEQ ID NO: 4893 - DNA, 189 bp, Enterobacter cloacae
ataaatcattctgaatttatgtgtgataaaattgtctggtccttttttatttattctgtgaatagattcacttcccgtgaattaattcaacctgaagttgggtattttaatgggggagcgatgggtgtattgtttttaatgaacggaatgtttgttaaaaggatagctaataatgtcaggggaatctga

SEQ ID NO: 4894 - DNA, 2130 bp, Enterobacter cloacae
aatggagataatggaatgacggaggcgaagacaaaaccctacgctccacgggtggtatcagaaggcgatattccggtacacaaaaccctgggcgaagtcgcccagacgcgcaacgtcgggataccgcgcccgatgcccggcattgtgatcctcgtccatggcgtgaacgacgtgggtgaagcctaccagaaccaggagaaaggtatacttgccgggctgggtaagcgacttaaccggcaggatttttacgcccacgaatggaaagactacagaattatcactccagggcgttcccccatcatcccgttttactggggatataaaccggttacgcatgctgattaccgggcggaccagaagcgctaccgggaggaggtcgggaagctgagtgacaaagcgcatcttccctatgatgcgtaccaggaagataacgagacgaataaaaagtcgctgggtaatgacggaaaagggccgtttcagtaccagaacgataactttaagaacgcacttgataagagttttgccaaggggggcgggacctttgccaacgcgacgacgacgatcccggatatgctggggcccggcgccggtggcttcggcgttgccgctgcgggatttgcctcgctgcacttcaatgatggcgattttacccatcccatttatgaaaacccgcaccgcatttaccagttttttgccgctcaacggctggcggatttgattattcagattcgtcagccgttagtaactcaaaacgatgttatcaatatcgtcgctcacagtcagggcacgattattactatgctggcaaatatgctggtgaaacaggccggatacgatccggtaaattgtgtgattcttaatcactcaccatattctcttgagtcgcgcgtggctgaaaatattcagccgggttatcaacagaccgacgacgccagacagcagacatttaaaaatttctgtcgcctgatgcatacgcaatggaaaggtggcgggaaaatggccgagagcgaattacttgctctggaggcctcctgtaccctgcgtaaaccttccgataatccgctgcgaacggatggcagatattgccgaagcaacgacggtaaagtgtataactacttttgcccgaacgatggcgtcgtgtcgctggagaatgtgcaggggtttggctggcgaggcattcctcagaatattgccagtgatatacctaatctgtttcagcgcgtgttttaccagcatggtgaagtaggaaacatccctgacgctaacccctttgagctaccaccgcgaaatgagggggatgcaaaatatgcctttctcacgaacgccagttacagcgctcgcgatgtggtgataaacggtgaggagttaccggaaccttttattttcaaacttcagggggaggataatcacccggataacgatcctaaaaccagtgataatccgtatacctattatgtcgatccggacagcccggacgcctacatttcctattccgccaaagccagcgccattaagcgcacggtaacgacaacctttgcagtgaaccgctatcaaaatattggctggcagccgggtcacgttttatctgcttcagagcttaaagaagagagttttgaacgcaagcatgaggttatttatggtgaggtatcaggttcgcgtgattttcagttagttacccttacctggaagaaaacaccggaagaactgcaagcggaatggcagaaaatcgacccggtgggctacagccagcactcctctattgtgatgagcgaatttgcgccatcgcacgctatggcgtttgatttggctattgggcagtgcaaatcattcgattatcaggcggggaaattttgggaagggttgttacatcgtgcagactggcgcgatcctcagaatgaaaatccctatgcaagggcatattaccggacgggtaagctagatgaacctacaaccaaatttttcatgaataagccatatgacgtgctgccgaaaggtgagtatggggtggtaaataagttcaataatgcaacgactgtcaagccgtccagtgatcttgtcgcagggaatcaggacgtcgcaaatctgcaatgggacatgccaaagcccataagtgacagtcaactggcttaa

SEQ ID NO: 4895 - DNA, 711 bp, Enterobacter cloacae
agcatgaaaatatcatttatgggtctgatggccactgctgttttactggcgatcggatgccaggcgaaaagaaccgcaacgcaggtggtgtaccggttcgatgatcatcgttatctcgaactgaaaggctggggccgcgaaggcgaactctggtacacggatactgagctgggtatacatacccaacctgttagccaattttacaagatcttcaccaaaaaattcatacatccatcggagcgttatatagctatccctacctggggctctccaggaacaataatttcaaaagattatggtaaaacctggtcccctcagttttattcagcgggttctaacgaaccaaatggagattcttcaccgccctacgatgacattatttcctttactgttgttaaggaccagggatttatgctgaccaaacaccggctgtatatgtcgtcaaaaccgtttgaagacccgcgcattctgcccggcgggccggggattgcctataccgtggatgacggaatgggaaataaagtaagcgggaagctggacccccgttcccctggctgggcgtggggaatggtctacatgactaagcagggactcgagggcagcacgcagcaacttaaggctaactggcaagatttacccgacagcgtacccgaggtgaagggctataccggctgggatcatatgcgctgtgatatggatgcggggcgataa

SEQ ID NO: 4896 - DNA, 711 bp, Enterobacter cloacae
ctgatgaaaggattatgtaccgttctcgcagccacgtctgttgtgctggtgaccggatgcctggtgaaagaaccgccgacgcaggtagtttatcgattcgatgatcaccgttatctcgaactgaaagggtgggattgtgaaggcgaactctggtacacggatactaagcgaggcattcacaccgaacccgtaagtcagttttatcgactctttacccgtaaatttattcatccatcagagcgatatattgcactgacgggatggggagtgagtggattcatagtatctaaggactatgggaaaacgtggcgctctgtagcgttttcaccaaatcataatgaacccaatggtgatgactacgcgccgtatgaggatattatttctttcaccgtcgtcaacgatcagggttttttacagaccaaacaccagctgtatatgtcgtcaaaaccatttgaagacccgcgcattctgcccggcgggccggggattgcctataccgtggatgacggaatgggaaataaagtaagcgatacgctggacccccgtttccctggctgggcctggggaatggtctatatgactaagcaggggcttaagcacagcacgcagcaatttaaggctaactggcaagatttacccgacagcgtacccgaagtgaaggagtacaccggctgggatcatatgcgctgtgatatggatgcggggcgataa

SEQ ID NO: 4897 - DNA, 204 bp, Enterobacter cloacae
ctgatgaaaggattatgtaccgttctcgcagctacgtccgttgtgctggcgaccggatgccaggcgaaagaaccaccaacgcaggtggtgtaccgatttgatgatcatcgttatctcgaactgaaaggctggggatgtgataggaaactctggttcccggatactaagccaagcattcactccgaaacccctaagttcgtttaa

SEQ ID NO: 4898 - DNA, 183 bp, Enterobacter cloacae
aaaagatcgatttttgagcgatgtgtgcgcatccatctgccagtgttcacatttcaggagcgacaaaactcttcagccctggtcatgattttccctcccttttatcactcatgcagaaaacctaaacgccagccatgcagtaagttcgccacgtatccggaaggtgcgaacggcgtgctttaa

SEQ ID NO: 4899 - DNA, 234 bp, Enterobacter cloacae
aaaagaacgccgcgtagcggcctgccgaaatgcccttgcgcgctttttgtgagcctgacaaaaagttgctcaaaggttggctaccagattattttgttactttatcgaagtgatggaatagtccagccacggactattccatcactcacagttataaaaaataaggataatattggccccactatatatttaaatatcctatctctttttttaacccctatcacatacagataa

SEQ ID NO: 4900 - DNA, 213 bp, Enterobacter cloacae
aaaagcaacgggccgttaagcccgttgttcgttacatcatcgcagttctattactctcgcccgctcagcctgctttcggtagtggtcatatcgctcccggaaccatgcctgctgtttattactcatattgccggtcacggcatcgatatcaactggctggccctgggcgtacatacgggcaaaactgcgtgccagaaaatcaaaattctttaa

SEQ ID NO: 4901 - DNA, 765 bp, Enterobacter cloacae
tggcgctgctgcacgtgtggctgggcgcgcacctggatgtacgtatgcagttatgcgttgcccggcatttgctgccggatgcgcggctgtcctgcaatgcggaacaaatcgcgcaggtcgggcgcacggcagtgctgcgtccccttaatccgcaacagaacagaaacgacattatcaccattcaccctggacgctttcagcgcgtccgggaaaacattcagcgaaggaaaaacgatgaagatggcgattaccgctggtaaagcgctggcaatcactctggcgaccctgttaaccggctgcggtctgacgcagaaagtgacggatggcaccgtcgccgtcacgaagtccattttttacagacaggtgaaaacccttcacctggatattcaggcgcgcgaaggggtgaacaacaacgcgaagggggcatcgctggcaacggtggtgcgaatttaccagcttaaagagcgtaaggcgtttgacagtactgattatccgtcgctgttcgccagtgacactcaggccattaaagccgatcttgtggcggaaaaggatatccgcctgcgccctggcgaatcggtgacgctggatatgccgatggaagagagcgcgcaggttgtggcggtggcggggatgtttatggcaccggaccaggtaaatgatacctggcgtattaccctgacccgtgacgaccttgacccggataaggcgcgggttatcgaagtcagtaataatcgtctgacgctgaaaccgctggagggggaatga

SEQ ID NO: 4902 - DNA, 213 bp, Enterobacter cloacae
atccctgttgggcctgagccgataatggcgatttttttcatcgaaagcgttcctgcgtttctgaaccatacaacaagcgtagcaggagaaaggctaagtcattcaatgaagggagaaattaagacgtttagaagaggggatgttgcgccccttcctgaatttatgggaaagtcaattcaattgaccctgctgattagatataattctgcctga

SEQ ID NO: 4903 - DNA, 429 bp, Enterobacter cloacae
gccagatgccgaaagcgaaagcgtaaggcggtagcagggatgaaaatttatcgtccgttatgggaagacggggccttcctggccccgcagcagttccagcagcaggcccgctgggatgcacatgtggccgacaccgtggcccggatggcgctggcgaacccgtggggtgtgctgtgtgcggagttcgacgaaggcgctctggccctttcacggctgaatgccacccggctttgcgtgcgctttgcggatggtacgctggtggacacagatctggcggatacccggctgcgctcaggcagccggtacgccgctgtcgcgatttctggcgctgctgccggtgatgatgctgccgggacggacggcggagggaatgggggcgctggtgcggctgctggcaccggatacgcgcacgcaggtttatcaccatga

SEQ ID NO: 4904 - DNA, 660 bp, Enterobacter cloacae
atgccacccggctttgcgtgcgctttgcggatggtacgctggtggacacagatctggcggatacccggctgcgctcaggcagccggtacgccgctgtcgcgatttctggcgctgctgccggtgatgatgctgccgggacggacggcggagggaatgggggcgctggtgcggctgctggcaccggatacgcgcacgcaggtttatcaccatgaccgctgccgtatcccgctgaagcagccggttgcgatgagtacatgccagccggtcagcctgaagcaccggccggtgatgggcacgcatgccacggatgtgaacggccaggtgctgttgcgcctgagcacggacaacccggaagagatccggggctggctgccgggcggtgacctgcacgctgacctgatggcgctgctgcacgtgtggctgggcgcgcacctggatgtacgtatgcagttatgcgttgcccggcatttgctgccggatgcgcggctgtcctgcaatgcggaacaaatcgcgcaggtcgggcgcacggcagtgctgcgtccccttaatccgcaacagaacagaaacgacattatcaccattcaccctggacgctttcagcgcgtccgggaaaacattcagcgaaggaaaaacgatgaagatggcgattaccgctggtaa

SEQ ID NO: 4905 - DNA, 477 bp, Enterobacter cloacae
tcgtctgacgctgaaaccgctggagggggaatgatgccgcgtccgtctctgtatgacatgctgtacggtaacttcgccggcgggcttgacctgcacagtgtcagtgaggagaaccagctgattttatcagtactcgataacatgcagcgcatcctcaactgccgcgccggtacgctggctcacctgccggactacggtctgccggatatgacaaaaatcctccagggaatgcccgggaccgcccaccagctgattaccacactgtcggctgtgttgctgaaatacgagccgcgcctgagccggattaatgtggtgatgcaggaacagattcagcccggtgaactccgctacgccattgatgcggagctgaagggggtggggctggtgcgctacggcacggaatttatgcccgagggcagggtattaatccgtcatttgaaacaacagcagtatctggataatacagcccgattgtga

SEQ ID NO: 4906 - DNA, 186 bp, Enterobacter cloacae
aaattgggcgagcggcaacctgaacgaccagatatttattttaccctggtcggaaaagatacattaaagagtaacttttcaatggtttattgtagaacttgtgctgtagcgggttctgaaatattaataattgatttcttcgccgtgagtcattgcattttatctggcgaaaaggtcaatggctga

SEQ ID NO: 4907 - DNA, 255 bp, Enterobacter cloacae
aatgtgagagaaaacagattggtgcgtctgaatggactcgaaccatcgacccccaccatgtcaaggtggtgctctaaccaactgagctacagacgcaagatggtgcgttcaattggactcgaaccaacgacccccaccatgtcaaggtggtgctctaaccaactgagctatgaacgcattgtgttgtcggtgacaacggggacgaatattagcggcacagcagtcttcaccacggggctggaaggaaccgcgctg

SEQ ID NO: 4908 - DNA, 705 bp, Enterobacter cloacae
gttacgctttgcgtcggatcttcggcccgctcgtggtcgaagacaatccatagccatctttcgtctgcatgccctatcaaccaaaatgaatgttcaaatcatatatcgcaattttctatcgacattaaagtacaagattggcttagccgttcaagagtagcgtttattgatttccataatctaagaaatacagataaaaccacattaataacagtggaacatcttgaagctttacttactgttatgtcaactactcttgtcgcttacgctccatattcaaaaaagagacttaactttagctttctaaattcatttactttgtctaaaacttctcaaagttacacattaactttcccggtagttctcagtccgcttttagatgctcttggcggtttcattcaggaatgcataaccgaaaaattgttaaaacgacgaaattcgaatttcatggtttacgagtatcttaaacgttcaggccagagctctcataaagtggaggacattaataacgacttacagcttaaaactctaaatataagacttatgagcgtccttactgggctttctcagcaaggactcatttcatttatttgcgatggaaagaggggcgaccggagaatagaagagcttcagtttataccttatgttcaacgaactcaccctgaggtattaacttttcaggaatggattagccccgttgattag

SEQ ID NO: 4909 - DNA, 237 bp, Enterobacter cloacae
aaacacgaccgtttcggttcgcatcctgtacgccgaacgtattcaacaagaggaagtcctatgagcaaccaacccaccagcctgccagaagaagatattgagtttgttatggatacctttcagaggagcatgggtaaatccaaacctgtcagggatactcaaatagagggcgagaaaccgcaaagtaaagagtccgcaaactcaactgaaaaccccggttatgaagaattcttttaa

SEQ ID NO: 4910 - DNA, 459 bp, Enterobacter cloacae
gggatgggggacattgtgattaaaaggcgtaacattcgacgatcagtttatggattgcttattgttcttatcgccggaaatgtgtggttaggccttagagctgataaaattcataaagtgcgttatcaggatttctggtcaccggcaactgtgattaaagtaactgtaatgccttcaacgaatgaaatccagctcagtggtaaaatccctaaatcggtaagagtttcaaacaattatgttgagtactcgttaccgggcacactctcggacaagaccatttaccgaagcgtgttagaagatgagatgctcactttgcttaatgctggaggtcaacttgaagttaaatacactctggacaagcagacaaatcgaactaaggtatgcactaagtgcttacgggtgattaaagatattaaccatcaatattcagccactgaggtaaagcatgggcagtcctaa

SEQ ID NO: 4911 - DNA, 330 bp, Enterobacter cloacae
cccacagccggacgcagaataatttacttttggcaaagtgttggttttgtcagagtcattaaggattcaggctttttgcccgccttttttaaacctccatgtatcgttcttgccccgtttatgcggggctttttttttgcttctttctatgagttgacatctttaagttttattcagagacataaaaaactttttcgtgtcactgaacctattaggttacagagcgacgttgctatcctggtaaaagttttttctaaaggaccggtaaaatgtcatctcttgattctgaagctaaacccgataatgcaggtcacagcgtactggctttaa

SEQ ID NO: 4912 - DNA, 1824 bp, Enterobacter cloacae
ggctataacctattcccggagcatcatatgcgtaaaactctaattggctgcatggttgcaactgcccttgctactgtatcttcggcacatgctcaggtatttagctactcatttacagataccaataaggctgttcggaatattaagcctgcaacacaaacatatcttaatcccgctggtgttttgactctgaacttgatatcgggtcttgatcggtacgagcgagtgacggtcacacgagacagcgataaaaaggttatgtattcctccgtctcgaccaaaacgagcgttgcagatcgtatcgttgctgccgatggaacagaatactatggaaaggatatggttctaccggcgctcggagaagggacctttactgtagtcaatgaaactctggatattcgccagactgtagtgagcacatctacttatcatttcatcgttgatacaactcctccacgctataagagtatttatccgagtcaaaacgcaggttacgacatggtactttctgggccactttgggagttgggccgaggcggtagtggccagttttctatatttgcagacggtattgaggatgctagtggaattgccaagatccgtcttgtcattaaacgaagtaatggttctgtggtctccgacaataacctgagttatgacacagccaataaacgtgcgttctatccgtggattaaagatatgaacacccaggctggcatgccctcaagtgatcttgatgaagaattcaccttcaatttcatcgttacggacctggcaggaaatacgcttaacattcctccccagcggtttttatatgacgatcaaatgggagaatttacgccatttgcagttcatgactcacgtgtaagcaccagtgttgtacccggcatttcttcgggatacgtcccgtttaaacgaggccttacagtgctggaaaacccctacaagttggttatacgtatcccaagaactaactggaagccatatcgaaatggtggcatgagcattaccaataactatggcggagtacaggtcctttccgaagatgccacctatgtctacgtggaagttaagctgccacagggtgccttagatggaaactactatagacctgtgaatacatatcaatggtctggaggagatcttggtcagtatgccagctggctcaactgggatcctgcctctgtaaagagtccggcttggggaagttcacccatagaacgacaaaaggctgatggaacatggttcaacagcgtaaactggaacctgttcaaggcatctgatatgcctataaaacttactaatatccggttcaatgtacaggctaggccatatgatcaaaaaatcactggcggagcaacatgcagtattccagctggctcaacaacctgtaccgtctctttgccccaggatattataaatggcactaccggctatcttcatagtggctatgaagtaaggtcaaccaccgaagcaaccttctttgcccctatatgggagaatatagcctggcatacactgggtccctccgtcactggatttgattacattgaaaccaccaacattctccaggtttacgtgaatcaacctggagatggttcatatttcgaccatgtttatgtaaatcgagtttggttgtcagataaaaaccgtaacaacgcagaaataagcgtaaccggcaaacaaacaggtagaaatatggcgtctgggaactacacgtatgagttcaacatgaaagaggtaccagaaggcagttataacgtggtaattaatgcccaagatacattcaacaataccggtaacctcccttatcaaactgttgtc

SEQ ID NO: 4913 - DNA, 213 bp, Enterobacter cloacae
gttgatcaagtctggattgctatctgcaagcaatgcattttgtgcaaacatgttcagaaaaacggcaccaccgcctataaagggttctacccaccggcaactatgatcgtgtgggtagtgatggctgatgaaaggcatcagtttcgtttttccaccagcccatttgattatcggcatgtgtctgagatgtcgagtcaaagtgtctatacctga

SEQ ID NO: 4914 - DNA, 309 bp, Enterobacter cloacae
gcacccaaagaaaaatctgttactgttttagatgtcatactttcattaatagtaatcattgcgacaatgaatggtgatgcaattccaagtgttgctaggactatcaccgatatttcagaccggttttctttagcggatcctttacttattgcagacattgctctgaacataacaaatgtactgttgagcatcagaaaacagcataagagcatgtataacattgggtttcctcaacctataagtgatggttaccctgttattttacataaatttgactcaacagatgcttttaaaatctcgcttccttga

SEQ ID NO: 4915 - DNA, 195 bp, Enterobacter cloacae
actcatacgtgtagttcccagacgccatatttctacctgtttgtttgccggttacgcttatttctgcgttgttacggtttttatctgacaaccaaactcgatttacataaacatggtcgaaatatgaaccatctccaggttgattcacgtaaacctggagaatgttggtggtttcaatgtaatcaaatccagtga

SEQ ID NO: 4916 - DNA, 186 bp, Enterobacter cloacae
acccacacgactctgcacgtttccttctccctgggcactaattttagttccgttgtgctctcgatgatcctcagacctgacgttcatccacgtgatctgagcctgtggctgtatataccagttatactcgctgccatggctgcccttgaatttaccagcattgaacgtgtacccagcttcagctga

SEQ ID NO: 4917 - DNA, 381 bp, Enterobacter cloacae
gagttcggctccggtaccttttacggcgcccctggcctcgacaagcgtgaccagtgtttcagcatcatcctgttccagaatgttcttctgcgtatccggtacaggccggacattcaccacctcaccgggaagcgtaacctgtacggtacctttaccactgatatccagaaggccgtcttcactggttacaatactgttgcttgcgacagtatctccgggagtaacggtaccaaaaatcaacttaccaccatcaattcccagtccaccgatatgctgggtaccatctccgactatggttgtgttatcagtctcagaaataagcattgcattcgtgatgctctcagtatttattccgtcgagcacaaagttactttttcctaa

SEQ ID NO: 4918 - DNA, 555 bp, Enterobacter cloacae
atcaagcgatgctccggcgcccagtttgatcgccgcttcaccatcaacggcaataatgtcaccaccagtggtgttattaacctgagaattggccccctttatgtacagcgcaacgccattaacagcgatactgttaccggaattttcgaagcggccatcatccaccaggataccaatattatcggtacccgctgtaaaatcgatatttccgttattaacgagcaaaccctgattacgcgttataaaaccagtcgcattactaagcgcggtggttatatccgcctcgttagtaagaacagaacccgtattttgacctgtgacggaaccatcgaggccgtatgcattaccatcaacctcagccacaatagcgccgtcacctacaaggtttacgctaacaccctgttcaagcgttgcttcagcccccccggtaacgtacaggcccttagcattatcccccagaatctgaaaatcacttccagacccggcaacgactttgcttcctgtacccgtgacccagataccgctgctaccggtgccggaggttttcatctgtaa

SEQ ID NO: 4919 - DNA, 225 bp, Enterobacter cloacae
acaaagtgttactcgcagcaattccggcaatgtatgagcctgcctctggacgataaaccttgtcaccatgctgatccggttcaggagcaggagttggagctggagctggttcaggtgtcggatttggttcaggttctggtgtcgtatcaggcccgggagtcgtatctggttccggggccggtgacagctctgaacgcagataccagtcgccgcctgcgccattga

SEQ ID NO: 4920 - DNA, 333 bp, Enterobacter cloacae
  unsure (8)
  unsure (11)
  unsure (13)
  unsure (19)
  unsure (27)
  unsure (40)
  unsure (50)
  unsure (140)
agatggtntgnanatgatnagggaaanactgacattgtanatttccatanaactaaaatgaatttatttatctatcttctggagcatgccttccagagagaggtgaccagtgatgaattactcattatgttctgggacanatatgggcttaaatcttccaggcgccagctctggtatgttctggggcagctaaagttaagcctttattctttaggtatcccttacgattttatccagacaaaaaaaggaagaggttaccatttggaaaaggtgaagatatatctgataattgattctggaactcaatgcagtcatctagatcatagtcggtaa

SEQ ID NO: 4921 - DNA, 186 bp, Enterobacter cloacae
tcgataaaacagcaggcggtacaattgattcgtctccttataattctcctgtggggactctggctgttctttctgcaaccaatggaggtaccgttacactctcttcttcggggagacttactggtgttttaccagcgtatggctatggtgcaggcgttgtggccagttctggtggtactggtataa

SEQ ID NO: 4922 - DNA, 186 bp, Enterobacter cloacae
agcgcgcttctcggcaatcgcttctttgcgcagggcgtaggagatatccagcccggagtcacgcatgttcaggccctggttcagaccctgagcgccacagccgacaaagaccactttttaacccagaaggaagctcgcgccatcagcaaaatcatcgcgcgccaagaagcggcaaaagcccagtag

SEQ ID NO: 4923 - DNA, 198 bp, Enterobacter cloacae
tttcacgtcatttttcgcattagaaaatctaatcttactatttttatgttacggaaattcggcccatttttccgcatgaaatatcagcatctgctaaatcctgttagatcattgttaattttatgcgggtttaatcgcattttcccagtgaataactctgtaggcttttcagcgatttttggtcataagctaatgtga

SEQ ID NO: 4924 - DNA, 228 bp, Enterobacter cloacae
gtaatcgtgggcatccagcgtcacaaacccggcgtggccgcgatcgctgacgtgaacggtgccgatggccgtcgcgcagtccgctatcgcctgccagatcccaatgcgcgcaagctgctggcaggttccctgggccagcgcgatggcgcgggcatcgaagccgggatgatcggccgcctgcggcgcaaccgcctcaacaagatgcaccggaagctggcctttggttaa

SEQ ID NO: 4925 - DNA, 207 bp, Enterobacter cloacae
atcgcctggtactctgccaggtatcgttgtaattttattacaatgcactgtactgcttttacgcgtttcctgaaaccattagcgcttaacgtcgcgtgcgatacggtgatttttcgtcgcctgggccattacgcccgtctgatgacgcaacaaacgtcgattctttgcgcaacggggtcagagcaaaacccgacgtcgatcaagtaa

SEQ ID NO: 4926 - DNA, 249 bp, Enterobacter cloacae
cgcgcatcaggtgtaaacgttccgctggccggcgataaggcaaacgagggcgagatggatattagcgtggattctaaaactggaagcaagcctgtgatggaaagcaacagccggataattctggctgcagacgctgccctagcggcaatcaacgaacatttcagtgatgaatttgtgaaaggtgaatgggctgattatgcagctttgagaagagcagctctaagaactgccctagcttcgcttatttga

SEQ ID NO: 4927 - DNA, 192 bp, Enterobacter cloacae
atgccagacgcctctgattatttttcctgtaaccatatcttcggttttaccgtgcgaaaagtaggcgatctggacacagtcattgtgtctaatccaataatatccctctttcataattcacctcttaaattgtttcatttagaagtgtatatgacgattcagaacccggtggtcgacaaaacgtttttttga

SEQ ID NO: 4928 - DNA, 273 bp, Enterobacter cloacae
aaaactaatataatcaaaatgatacaatcacagttaacacaagttatattttggctggggctgattgcagcgctcccggccttctatcgctttgtgtacgctggttcctctttgatatggcacaaatatttccctgtaaagaaaattgagatacagttggttaacgaagataaggcattgattgaaaacattgttctagaccttgataagcaggatgccaagagggttatcgagctaattgaatcaagccgtaaaaagggtaaggttcgctga

SEQ ID NO: 4929 - DNA, 900 bp, Enterobacter cloacae
aacaggaaagttatggaaaagactacttccttcaaagttttttatgatgctgatgataaagaactttctaaacatgcaatcgatgcggaaactttaggaaactctattctttccatggctaaccttatatccaaagccgatgacttaattaacgaaggtggaaaatcagtaaaggtcctgttttctgctcctgttgaaaaagggtctgttggtgttgcatacactgttgtacaacttcttccagatgccattgacgttctaaaaactattggcatagtcggtgctgtaggaactgctgtgcacgcttctgcactgtccctaatacgacatcttggtagtaagaaagtaatttctgtgacgcgtcacacaggtaaaaagaaagggatagccaccttagaattagatggcgaagatattgagtgctcagctcctgttgcggctctggtcacagaccctgccattcgcaatgcacttatcgcagttgtgcaaaaacctcttgaaggtaaagactcccctgtcttcaaaattgttgatagtaaaggtaaggaaattgtccgacttgagggcgatgaaactgaagaaataaaacccgtccctaaaggcactttactagaaaaagacgttgaaattaaggaggttaacgtgaaatttacccaagttaacttccacagcgagaaaggctggagaatggagtataaaaacgaagagcactctgtactacttacagactatgaatttttagctaaagtaaggggtgcagagggaaccataacaagtgaagaccttttctcagtatctttagagattaccaaaaccacctcagctagagcttccgcagagaagtatgttatcaagaaagttatccggcatcgagttgctcaaggtaaaaaactaatataa

SEQ ID NO: 4930 - DNA, 198 bp, Enterobacter cloacae
accttcttcctgttctggtacagctggtttatcagcccggttgattttcagtgcagaacgcccctcgccaacctccccacccggtgctttggcaaaatactggtagcacttgccgttatgctggcgggttgcgcgattcagtttgaccagatggcatacaccgcgctgaacagcatgaacgtcgtactgtggcattga

SEQ ID NO: 4931 - DNA, 219 bp, Enterobacter cloacae
tcaaatcctcacactgaggagatagcaatgaaagaaggtttctactggatacagcacaacggcctagtgcaggtagcttactacaccgacggtatcactgaggaccttgaaacgggccagacaataactggtgtctggcatctgacacgaggtgatgatatttgccataacggtgaggctgaagtgattgaaggcccactgtctgcgccactgaaatga

SEQ ID NO: 4932 - DNA, 417 bp, Enterobacter cloacae
gaggattcacagcaatatgagggggggccgatgtccgatccattttccggcacggggctggccggtttagctttgaccggagccagtgtctacggtctattgaccggaactgactacggtgtagtttttggtgcatttgcgggcgccgtattttacatagcgacagcggctgacctgagtgtgttacgtcgcctggcatacttcttcgtgtcgtatatcgtcggcattctttgttcggggctgttgggttcaaaactcacatcctggacggggtacaccgagaagcctctggatgctatcggtgccgtaatcgcttctgcgttagccgttcaaatccttacgttcctgaacaagcaggacatcggctcgctggtggcgctgataacgcgccggggaggttcaggtggtactaaatga

SEQ ID NO: 4933 - DNA, 288 bp, Enterobacter cloacae
cgcgccggggaggttcaggtggtactaaatgacccaacagcaactatcaacgcgctgctctgcgccggagttgtgattactctgatgttttatcgccgtggtgattcgcggcatcggccatggatttcgcgtttagcctggctgattaccgtcacttacagcgctgtaccgctggcgtacctgtgcgggatttacccgcattcatcatgggccaccattgcggccaatatcatattcctttcagtgctggtggccgtcaaaggcaacgttgcatgtctggtcgtcctc

SEQ ID NO: 4934 - DNA, 342 bp, Enterobacter cloacae
cgcatgaacagtttaaaccgattgagaccagcgaagcaattcagatgcgttccactggtagggaaagattccccgttcggctatgtggagagattaaacaaccaggcggatgagaacaactaccagcctgtgaacgcgatggtagaggcatttgcactgatgaacgagaaggggcgtgaggaatggctgaagttgatcggcgattcagagaccacagaggcatcaccgtccacgtcatcagatgggagcccgagacccgacgcgttatataccttcgcgaagggtacgatcatgagtgcttcagccctcttgagcaattccagcgtaaatttacagagttaa

SEQ ID NO: 4935 - DNA, 732 bp, Enterobacter cloacae
cgtacggggaggataacagtgatgaataactcacagcgacagttgcgactgctgaatcttgtcaggaaactgctgaagctgggccgcagcaacagtaatgcccatgaggcaggactggccctgcagcgtgcccagaagctgatggccagatacggtatcagcgagcttgacgccggtcttacatctgtgcgcgaggcgtcttcccgcacggccccttcggatgctgaaaaagttccggaatggatggtaacccttgtccggggcgtctgtcatgcctttggctgccgcgcttattactcatggcgtcagacctctgccgggtatcgccgttcggtaaccttttacggattcagtgaaaaacctgagatagcagcctatgcctttgatgtgctgacgcgccagctgaaagatgccacaaattcttatctcaaaacccagagtaagcggctgaaactggccacacgccgggcgagagcggagcagttccgtgacggctgggtatgtggggtgcgtgaggtgatatcggcaactgacatcagcagcgaggagcagcaggtgatgagccactggctggaaagccgcagtatgaaaacagtcacaacccgtgaactgaaagcctgccgcggtgcggatacagcacgttatcaggggtatgaagccggacaaaatgcccgtcttcatcagggtgtcagcggccggggtccggcagccattggttaccgtcaggattaa

SEQ ID NO: 4936 - DNA, 597 bp, Enterobacter cloacae
gggggaatgatgaacagtttatctcaggctgccaacggattgctgatgcagctggttatggatctgagaagtggctatctgcgccgctgcgaatcgctgggactgaaccgcgaggaaatgcagatgctgcaggggctctcgctcgaagagcttcactacctttccggcagtgaggtgtcgatcatcagtgtgggcatcaatcacggcaatctggtgcgcatgctgcagcaggcccggacggaacagaaacgactccagcgtatcgatcgggcgctggcgctgggcggctccattgaactgatggccaattacttcgggctctccagtacggacgtggcggcccgccgtcgtattgccggtatcgatgtccgcccggggcgcggtaacgcactgggtgatgaggaaaacgccgccctgtggcgacagtggcaaaagtccgacgttgaagatgcggaaagtgctgacgggctggacgtgatgatgctggctgcagaacagatgaacgtctcgctgacgtcggtctggcatgcggtccgtggctggcacaagacccggcagccttctccggcacgaacgccggtaaggaagacggcatga

SEQ ID NO: 4937 - DNA, 378 bp, Enterobacter cloacae
cgggctggacgtgatgatgctggctgcagaacagatgaacgtctcgctgacgtcggtctggcatgcggtccgtggctggcacaagacccggcagccttctccggcacgaacgccggtaaggaagacggcatgaaatacaggatggttgcgccgggcctgcgggctccccatggtacgccgccgcaatgctgtcagaaggcgttacgtcaggttcgccgtttccggcagggggcgcgtaattacacccggctcgatgagaaaggttgcggttactacaaaatcgatctcggcccgttctggcgtctgctgagtcgcaacgaaggtcggacatggcttcttctcagccacgaacgctataacagcgccatacggaaatag

SEQ ID NO: 4938 - DNA, 219 bp, Enterobacter cloacae
caaccgcgtgtcgagcaacagccggcggggaatggaatcatgcacatttccggtaaacagcaggccgttacgtatcctgccatcatcccgccggggactggccgcaaggcgggcattcattttatccagcgtataagcaatcaggctttctgcaggcagactcattatttttccttttcggccgccatcacggccgttctgaactgtcagtatgcttag

SEQ ID NO: 4939 - DNA, 255 bp, Enterobacter cloacae
gagtcgcgccgcgctgtttcagcgccagccccaccacttcgcttagctgcatcaattcatggtcagtcattctcgctccaggccttagaaaaacatgcagcacaagatagcactttctcatcaaatatggggatgcgcgtcgggttttacgagggggcttcagaaaaaagccgatgcgggcgcaccggccagagagacgcttatttcatgctgttagcgagggtgtccacattgtggcgaaacgccttgacgtag

SEQ ID NO: 4940 - DNA, 432 bp, Enterobacter cloacae
aaccttttcgcgtttgtcattgaaatgagcttccagcctgatgactggcttttccgacattgcaaaagctttgtccgttactctgtaccggcattcatctccgaaacattctttaacaacgctggctatgaccgtgtcgtgttctccatcttccggagctggcacaaagatttcaaattgtgccggtgtatccggctcaagcagaacgggatagagacgcggagaattaagcaaagcgcattcagaattaatgagcttaacccaggcgcttttgtcgtccggatccttaagctgctgtccaaggttatcgcaaaagtcaactatctgacgggtatgctcatccgtgactgcacagatcaggttaagaccatgcgtggccatacgcagttcccgggttcgggactgggaattgatcgaccaggggttaagtga

SEQ ID NO: 4941 - DNA, 267 bp, Enterobacter cloacae
atccgcttatttcagagaagctctgatttagtagttagggaaaacgatgcggtgaaaagtaacttttacaccgcaattcagaaaaaagtttcaattagtcacattacgaataacccggcttactttcgcatgtgcgttcccctggatgttaaagtaaagcccctcaggcagactcgtcgcccacttaactcctcgctcagccatacgcttcggtgtttccagccaaccacgaggaatattgcccgtaacgtcaccgataacccgtga

SEQ ID NO: 4942 - DNA, 228 bp, Enterobacter cloacae
tcaggagaacaacccatgaaaatcaaactagccttggttattgcatttgcaggtttcagcgcaggagtttccgctgaaatcgcagaattcagctttaaagataccctgaacgttaaaaagaccgtatcgcctgcatccgtatggattaatccggtaacgagctttgacgttgccggtttatttttccggtctggaccgttatattacgctcagtctgctgaaaagtga

SEQ ID NO: 4943 - DNA, 525 bp, Enterobacter cloacae
ccagtagattcattctgtcatgattactccagaactaaccggaggaatcacattatgaccaaatattatgatcgcagtggaattgaaatctccagcgcaaaaatccgctgtgttgattctgtaaaaggtactgcggaatatacttttcgtattgtttgcgataaatgcaatgggcggggagagcgtaagcatttttatagaagtcgctgtatggcttgtaaagccacgggttacagcctcgaaacgacccgtactgcttacacgctgaatgcgctgtaccgcattaatgcgcaagctgcccgcaaagtgtcagcatccctgcaagacgagcgtttaaggactgaaagcgcccacagttctgcgttcacagcatggtgcaggtctcatcaaaaaatggttgatgcaatcacccaacaatccagtagtaataattttctggaaagccttaagtcttctttaacccaccagcgtcagttaagtgataagcagctggcagttgccgcccgcattttaggtattcattaa

SEQ ID NO: 4944 - DNA, 1206 bp, Enterobacter cloacae
atcgctcatccattaaggttaaaaatgaagctattttcaatttcatcccgggatacaagcatggacgcgatgttttatatccaggccagtactaaacaacaggcaagttacatatttagtaccctttccccgaagcctattgcgaactgccagcttacagatttgcagaatgagacggtcgtcccttccataagccctatttcgctttcacttaacccctggtcgatcaattcccagtcccgaacccgggaactgcgtatggccacgcatggtcttaacctgatctgtgcagtcacggatgagcatacccgtcagatagttgacttttgcgataaccttggacagcagcttaaggatccggacgacaaaagcgcctgggttaagctcattaattctgaatgcgctttgcttaattctccgcgtctctatcccgttctgcttgagccggatacaccggcacaatttgaaatctttgtgccagctccggaagatggagaacacgacacggtcatagccagcgttgttaaagaatgtttcggagatgaatgccggtacagagtaacggacaaagcttttgcaatgtcggaaaagccagtcatcaggctggaagctcatttcaatgacaaacgcgaaaaggttttagaactgaccttttcctgtttcaatctttcactctcagcgtccgtgcatgaaaaccagctacgtcagattttgttactttgcgaagactttggcgtaaggcttcagggtagagcaggggcatcctgccacgttaatatgcgcagtgcttaccgtcgtcttgctcatgttggcaccggctctcgcccaggtgatgacagtgatgtgcgggtctatacctcgttaaaagaagaaaaagatgttaagaggctgcttgataagtcaaccaggggaagtgagcttgtaccggcgaggcacgggcagcagtttaacggggtcttagtgaatgccacacccgcatcggccactactggtttcatttacctttcgcatgattttccggaaggccagtttatgatgacagccgaggtgttgcatgttggaattacaccaggcggtatttactacattgaaacactggacggttaccggtttatcgtgacagcgtttgagaagggattaatgaacggtttgagggagtttatagctgcaaatgaggaatattttaagtattaccgctggtcttag

SEQ ID NO: 4945 - DNA, 282 bp, Enterobacter cloacae
cctcaaactgtgctggaggcacaaatgtctgaaaaacactttatcgttaaaatccagaaccgaaacggcgaccatgagaatagctatgttcggttactcgtcagcgattgtgagaaaaatgcttgccagacggcactcatttcagagtgccatggcgagcttgaacagctgagttttgaagacggtggggtttacgactacaacggcgaaaatcactacagtgtcaggagctgcgtggaggttgctccagaagacgttgcaactttgcaacgcttcctttaa

SEQ ID NO: 4946 - DNA, 441 bp, Enterobacter cloacae
tcattatcctacacttcaaaaatattcattattttttcttctgacctattagccagaattctcgattcggtatcatttacttacggtaaatcttttgaaaacgaggtaaatggcatgcattctcaggatcctatcacgaaattaacccagacgttgcaacgcgacgatggttctcaggttcgtattgtagcgcagcggggatatggaagtgggcttacagcctcgcttgatgtgtacgttctccgtcgtgattcctctgaaagcaactggtcactgtgcggaaaagatcctcacccagagtggagaaagatgtcagtagatgagtatcagaaatttggacgctctgaaatgctgcgttatgccacaccaggtgaaattctcagggtggcatccgctattggccagccaatgagcttcctcgatggcaaccctgcgttttag

SEQ ID NO: 4947 - DNA, 714 bp, Enterobacter cloacae
ataatcaaggagtcaactgtggcagataattatactcaggcgtcgtttattattccctgcactcaggagcaggcaaaaatggcacaagaagcaatcacattcgttaccgaagcagaaattgcagaaggtgagcgtttgcttgataagccactgacagattgttctctgactgagaagctgatcctcagtattatcgagaaccaccctgagtatgacccttctgagccgagctttgggcaaccatcctgcccagactgcaattatgaactgttgttcgcaacagaagttaccagcagtgggctggcagtttttcatggagagaccattgatcttgaccatgcaatttgcctcacaactgccgtgctgtcggtattcgacctctcggaaatggtaacaattactgctgcatttacatgcagtaaaagccggacagatgaatttgggggtatgactattctggtcacaaaggatacccactattaccaggatggctgtcagttttctcgtctcatgaatgaggctcacaaagccggtatccagtatgctctgtgtaaagtgacgcattaccacggtgagagcagctatgtggcaagctatgtcctgagctgcgacgtagcggattcagcccaggaggtcgttaacaaacgactgaaggcatgtgccggaaaagagccagaagagtcttcaccacggggctggaaggaaccgcgctac

SEQ ID NO: 4948 - DNA, 1635 bp, Enterobacter cloacae
cgagctttgacgttgccggtttatttttccggtctggaccgttatattacgctcagtctgctgaaaagtgacgggagcctcatctggagcacgaaaagcagcctggttaccgttgatgaccgtaccacatcttcgacaggctttgattattacggcaagactctgaccgtaccagcgatgggagaagatagcttcaccctcagagaggtgattaccgacttgcaagggaaggaggtctcccggcaggattacccgcttgcaattgaccgaacgcctccggcaacgggtaccataagttatacgagaaatgggtggaactttggcagcgaagcgatcttcacttcagtaccagccggtatgcagtacgccagcgtccaggcactggtctttaatggactgagtgataaaggttccgggcttgctaatgctgaatatttcataaccgatgccgctggagtggagcgtaaaaagccagcggaaattaatacagtggaaggtagcgtaaccgttcaagtcgccgacgcaagcagcaatgccctggcaccggaaaaccgctctgaatataaagtggggatctacctttatgacaaagcgggaaacaggagcgaactaagccgccgaagcgtaattgatcgggttaagcctgacgatatcatccaggtgcaggacgccactaccggatcatgggtctcctatcagtctggcatgaccgtcttccagaaccctatttccgtacgggtattaaggaagaaaagtgactttactgctgttaacggttccaaatatggctgggcggactcgaatttccagacgtccgatagcacttataatatctatactttcaaatacatatatccaaatgtgggggatacttatcatgaatttcagactctggcgggaggagtaagacgaattcatcataactccctcaacttcactccagccccggcgatggaaatagccccgaagatagtggctaaagagatgtaccggagtgataccagtgagtggttaactcaggcctcaatcagcgttaaaaccgccaccattagccgcataaaggtaaccgcagaaccccgaccatacgtgcaaaagttcagaacggtaaaaaatgcagcctggttctgcactattcctgtcggacaaagttcatgcgagatgacggttaacttcaactacaccagtgacaaaggatttgagtatctgcatctttactcgggaaaagatggtgacagcatattcgatgcgcttgctggtaattttacggttatctgggataacaacccaccggtggttaatgtcgctcaggtaaacaaggcctccaagacaatcactatgacggccaccgataatgatcgcgtcaacgcctggaacatcagctactgggataccaaagttttcgaagccacccttaaaaatgcccggggggaaactttcaccctgaagcctgtgactgtcagtgaaagcgattataaaaccaaaaacgccactttctcatacgctggtctaccggacggggattatacggttgttagcgtgtctgccacggatcttggtgggaaactcaggaaccaaaccgcttatggccccgctgaaaattcactcaacgcttccggttattgcgttcacctttaa

SEQ ID NO: 4949 - DNA, 291 bp, Enterobacter cloacae
  unsure (69)
aacgcttcagtgctgcacccagcctttaacgaagggcattggttgttcattgcagagcaggataaccgntacattgaagtggtctgtattctctctttagcttcagaaagcggagagcagcatattgatgtttttattaatatgttcgaagacccgattgatgatgttatttcacgaaacattgaaaccaaaacctttgcgacgctttataaatacattgaacgtataccttttactccgggtgtaaagaaagaattcttgagcagtattgagaacatcaattttagttaa

SEQ ID NO: 4950 - DNA, 333 bp, Enterobacter cloacae
aggtggacagatatgaagtcagatacagaaatggtttctcctatcgagttgcacattggcgatcatgtccagcggcatggtgctttatttgaggttatgcatattgttgaatccgaatgcgatattcccggcggcatccgggtagcagcatgcatttcacgggttatcggtgacgttacgggcaatattcctcgtggttggctggaaacaccgaagcgtatggctgagcgaggagttaagtgggcgacgagtctgcctgaggggctttactttaacatccaggggaacgcacatgcgaaagtaagccgggttattcgtaatgtgactaattga

SEQ ID NO: 4951 - DNA, 801 bp, Enterobacter cloacae
ctgtcagtgaaagcgattataaaaccaaaaacgccactttctcatacgctggtctaccggacggggattatacggttgttagcgtgtctgccacggatcttggtgggaaactcaggaaccaaaccgcttatggccccgctgaaaattcactcaacgcttccggttattgcgttcacctttaatggcgcagacgcagaacgaaaactggttaaagggcttgagaacctacgcataagcgttactgatgcctctggggatgcttccctgatatcgcttcagctcgctggtggacctaactctgaaaaggtcacccttgcattcacgccgctatccaaggatgtctttattcctgaataccccagaatcttccccaatactgacgaatcgggacagatgtatcatctggaggctctggctattgacgaatcaggtaaccggaccactaaaacgcttaattttacctaccagccagctaacctgattatgctggataatctcaagacgctggccacagccgtagcactgaaagcaacggacaacacgccgctggccatcatccgaaccagtgtgttgcgtcgtcaggacggttctatcattaccggacagttaaacggaaccctgactgttcagaaaaacgcccagttcggcgttacggttgccggagttacggtccagcctggtgaaactaaatcgctgtcactggatcttggtaatggtgaagagcgcacatatcccgttactcccgctgtaagtggtcaatctggcacggccacatttactatagaattccctcaaacataa

SEQ ID NO: 4952 - DNA, 453 bp, Enterobacter cloacae
catgaatatgagcggagccgggttatgtctaataatactgaagtcattagctgtgatttattttcaactctatcttcacttaattttagcaccgaggatattacaggtttgactccggccaactttcgaaagggagctttcttacatgcaaaaatttctgctagccaggccacgcgagcgactgatatttccattcaattactcacggatcgtgtttcaggtgaaatgaactacgtaatagtaattggcaggcacgaaggactcctgcaaagcgaagcaattgacccaaacgctgataagcaataccgggaaaaccgttattctcgccattttatctcagtaaccgatgccaataccaaagccctgaaaaaaacctgcaaggtaatgaaaacatatatcaaagagcaggcatttaagcctaacacctgggggcacagtttcattaagggttga

SEQ ID NO: 4953 - DNA, 648 bp, Enterobacter cloacae
gttcagcgtaacaacattactggaattttggttgccttgatgaagagctgcttttctgatttacccgttaaagacggcacgtccggaacctggaaactggacacattcgaaattaccgcagataaggcgatgagcctcgcccttcgtgccgagtatacaggtaatacagacgagtttatcccgcccggtagatatcggcgtttgtccaacggctgggatgtggtgatgtccaataccccgatggagatcagaacctgccaggattttttagagcgagccaccgggcgcgtgctcattaatggtcttggtctggggatggtgcttcacgccattcttcaaaaagaagatgtaacccatgtaacagtaattgaaaaagaacaggacgttattaacctcgttgcggcctcgtttgcaaacgatcctcgcgttgaaattatccatgctgatgcaatgatgtattgcccaccagcaggcgtcacgtacaacgcatgctggcacgacatatggccagacttcgcaacagctaacctctcacagatggataagctggaaattaagtaccgggacatctgtgaatggcagggctcgtggggcagggaggagtgtgagcaaaagcacattgagtttcaaaatcttggggctgattga

SEQ ID NO: 4954 - DNA, 390 bp, Enterobacter cloacae
aattctcagggtggcatccgctattggccagccaatgagcttcctcgatggcaaccctgcgttttagcccgaaccctggcgacgccttttaaaccggcgtcattctttttacgagcaacagacggagaaaaaatgaatctgaacgaacgaagcacgagcgcagcaacgccagatttgagccgactttatctcatttccgggcgcattatgtttgatgatgatgatcaggcctacctggtcgaagccgactcccctggtgatgcagaggaggctttccggcatcatattgctgacagtgccgacgacttagaaaaggtgattatagtttcctctacaagtttcgcttcagctcacagcagtcgcgtaatttgtcggcctgccgtgaagtaa

SEQ ID NO: 4955 - DNA, 240 bp, Enterobacter cloacae
aacatgagattaacctatgaacaccagcctacattttgggatttcaggtctacacggtatacatcattctgtttaataaaccatcagatgattaatgagagaatgaacaccatgtacaccctgtgtatacctgaaaacaaggtatacatggcttattatactgatttatctataaattatttactcgatgtataccatgtatacctttctccatatttatctgaacttcattctttatga

SEQ ID NO: 4956 - DNA, 222 bp, Enterobacter cloacae
tgtgtcatcacacataaacacattacatcgggtgtaattgacgtgtcaacacacaaaaacgagagacgaggcaatcctccattccaatttaggcttgatccagagcttcgagagatgatggaacgagcgcaacagcaagatggtgatgagtctctagccgcatggcttaagagaattattcgcaaggaactccagcagcgtggtatcgagccaaagggctga

SEQ ID NO: 4957 - DNA, 288 bp, Enterobacter cloacae
aatggaaagctttcgtgtcgcggcggttcacagcctggtcagtcaggcatcggaatatctggtgaaagtcagggaggtcaggccatgaccgctatttataatctggtgcgctgtagcgatggcaaaaccgtattcagttttccggccggcggccgctatctggtggacacgtcgaacgggttacagtcgatgcgcccccttatggacaacgagatacttttcacagtggagagtgccgcgcgctttctgaagaaaattggttatcaggtaatcccgccagcgtcgtga

SEQ ID NO: 4958 - DNA, 297 bp, Enterobacter cloacae
cccggcaatcacccgaacttatctccagctggggagcaaggccgcggctatccagacacgcctcgctatggaggtaaacgcatgaaaaagccaactcaaaacgaatccattgccatgctgacgaccagcgcaggccaggcgctggaatacagccgtcaggcgcttgccgttctcgatatgtggatagatacactggcgccggatgatgaaatggaaagctttcgtgtcgcggcggttcacagcctggtcagtcaggcatcggaatatctggtgaaagtcagggaggtcaggccatga

SEQ ID NO: 4959 - DNA, 240 bp, Enterobacter cloacae
atcgcaattaactgctctattgttgcgattaatggaattttaacgattgctattacagggggcatcatgaccaaggttaacgttaagcccgttctgctgaacagggagcagattcaggctctgaaaaccattcaggagagggagcgccagaagtcgggcatggggatcgcgccgtcaatccatgctgttgcgcgcaaggtatttgatgcgggactatcaaaaatggaggctggccagtga

SEQ ID NO: 4960 - DNA, 1434 bp, Enterobacter cloacae
aggaaaatggcgatgaataaaaaggcggaaagacgccgggatttttacccggcagagagcatgcttaatcagccctttggctcgataccacgctgctggagttccttgcgaataattctcttaagccatgcggctagagactcatcaccatcttgctgttgcgctcgttccatcatctctcgaagctctggatcaagcctaaattggaatggaggattgcctcgtctctcgtttttgtgtgttgacacgtcaattacacccgatgtaatgtgtttatgtgtgatgacacattacacacaggaaatgaaaaagacaacgccccgaagtgcgggaacactttcagggcgtctaaccaaaacgttagttgaggtaacattatggcttgcactaagtctacccaaacacgccctgaatttacatggcgttttctcaccttgggtgaattcacaaatcagatcgtcaatgttactgcttccaccgagcgcgaagcccgcgaaaaaacgccagaaggatgtgtctgtattctggcgtgtcgatttcgtgttgaggaggtgcagcatgtttaacctccagaccctgacagcaaaagcacgcgagctgcgcggcaatgtggtaaaagccactaccacgaagggcacccgcaccatgacccccgtttacgaacgggaagagcagcgcaaactgcgcgagcgcatccagcagacccagccggactgggttttactctggtgggatattgcgaccgttaccggctggcgtaccagcgacgtgtgcaatttccgttactcgtgcatcaactgggaaaccggcattgccacaatcatcgtagcgaagcagaccaaagcggcggaagccagagcaacccggaaggggatcgagattgttcgccagcagcgcaaggatgctgcccggcttgctggcgatcacattgggtacatgcactgggatagcgtgagctgcgacgagctggccgccggcatgacggaagaagaacaggcgatcgtgtttgagctggtggcaaaggctgaagtgaagcacgacaccaaacagctgccaccgggcatcatcaaacgactgcgcgaacgtatggagcgcaatcttatcggtgacgacctggtattttcccgcagccagattgaaagtaatcgttgccagtctctggaaggtagcgtgagccgccagacgatctggaagaaacttcacaacgtaatggtgtggtttacccgcgtagtaaacaaacgtctgcgcctgagcgcctactccagccgcaaaattgccgcgtttaatctcatgtccgccggcggcgaacagggtttgctggtcgcctctgaaatgctcgggcacagtaacccggcaatcacccgaacttatctccagctggggagcaaggccgcggctatccagacacgcctcgctatggaggtaaacgcatga

SEQ ID NO: 4961 - DNA, 372 bp, Enterobacter cloacae
acgcaaaacgaaaaaaaagccgcaatcagcaagaagctgagtgcggctttcgtcgatgaattttacttatggcaggcgggaaatctctcttgcgatagcagccgactcctgtgcccatccctgcgcaagtactttcaccatttcgtcatagccatctttctgctgcttgagttcaagatgaaaaggacgcttaatcagctgaccctggtgattcagcagccactccccgctgataacaacggcaccatcatagcggccatggaatcccgtcacgttaacattcagagtgtcctgatcgcttcccagaggctgcgaggcaacgacccaaccggggagctggctgctcagattcgccaccagcgtattgcgtag

SEQ ID NO: 4962 - DNA, 297 bp, Enterobacter cloacae
aatcgaagggacgcagctcgctgcgttcggtactgtacaggtatattaatgagcagacgaaagtttttaatattgtggcatatttatgcgttttcatatctgtgcatatttattgcgttttttgccgtcgtgccagaagtaaagctgttcgattacctgtcaattaaatacggatttattgatattgaacggtgggatatctattactcgatttttgcgatgtcaacaacagtaataataaacttcttgtttattttattaactttccgttttacttctaaaaccaaaaagaaatga

SEQ ID NO: 4963 - DNA, 213 bp, Enterobacter cloacae
agcataaacgagccggaatttatgggggttgccgaccaccatgaatcttcgtttgaaccaccgtctcccgtaaaagaacccgatatacacgttattcttgatggaaaggagcgagctaatgtgactgtgacatcagggttagaagtcgaattactggaaattccggtcgccgtaatatcaatgattgttgagccactcatagttgcccattga

SEQ ID NO: 4964 - DNA, 234 bp, Enterobacter cloacae
cccaccgtaatcgtcaagcgagatattgataaggccctttctcactttttcagtaatatccgtatcgcctaccgatataaaaaaattggggagccacggctgctctcctgtgtttatgcgcgaatcattcactcccataattgcgtagcctcaactattggctcggacgatatttctggcaaaacaatttctttacctgcggggaagactgcgcacatatcgactactccgtaa

SEQ ID NO: 4965 - DNA, 192 bp, Enterobacter cloacae
catcaggatgatcctggtgtcagtgaaaatacgaaatcaacacgttggtatcattaccgccttgccgcaggaaagctatatataaacgtcgaattcgcgcctaaatcaccatgtcagagtgttattatcacttatcgtattaataacgattacaccgttgaacaattcgcggaattacttcaggcggcataa

SEQ ID NO: 4966 - DNA, 495 bp, Enterobacter cloacae
agctggcctgccgactgcacctggcggttcgggcgctatgtacgatattccggggtaaaaatggctgaaagtgaaacagatggcagcagcgatgtgatgatgggcctcggcgaatcattcatcttttgcatatcaacggtcgcgtataactctctgcagcgttctgatgaatggcgatgggttgagcagacaaggttcggaaaaaatgactcgctacagtgcaccggcagaccgaaaccgacgatcacacttgctggcaaaacccatgcgttatttcttgacggtgcaggcgtcgggcagattgagctactgcgccagctggggaacacatacgagccgcagcagctcgtcatgggtacgggtgaagtgatgggctactggacgataacggcgctctctgagaaccagacatcgtttctcgcgaagggagcgccaaaagtgcaggagttttcgttgtcgcttaaatactacggagaaacgctgacagcatcataa

SEQ ID NO: 4967 - DNA, 312 bp, Enterobacter cloacae
ttattattgaggtttaaaatgacagattcattacttgaaacaatcgaaatccctttatctcgtccatatgaaattgacggcgtggcgcatgataaattaactatgttcgagccaaaactgcgcgataaaattctctacagtaaagataaagggacggaggatgaaaaaagcgctcgcatgattgcacgcttattaaacgtaaaggatacggacctaatgaatttgccatcctgtgattttgcgcgcctggaggacgcgtttaatgaaatggtaaaggacccagtcgatcggaacatgaaattgttctcataa

SEQ ID NO: 4968 - DNA, 1068 bp, Enterobacter cloacae
ggctacgcaattatgggagtgaatgattcgcgcataaacacaggagagcagccgtggctccccaatttttttatatcggtaggcgatacggatattactgaaaaagtgagaaagggccttatcaatatctcgcttgacgattacggtgggtcaaacaagcaaacggatcagattaaagtcgcgatagtgtcagaatcgctgcgtataccggccaggggcgtcaaagtgaccctcgggcttgggttcggtactcagatcgttaataagggcgtgtacgtcgttgacggcggctcaagcgggggcgagccgcgcatagtcgaattcactgcgaaagccgccccaatgaacagcgcaaagggcctgagcactgtgcagagcaaaaagacccggagctggaccggtaacaccctcggcgacattcttgcaaaagtagcaaacgacaacgggcttacggcgcgtgtgtctgcgcagttcgcggggaaagtcattgagcaattagatcaggttggcgagtctgatgcgaacctggtttcccgacttgctgaccgcttcgatgctgtcagtaaagtcgccggtggatactggatgtttttgccccgcggcgcaggtgagtctgcgagcgggaagccgcttaaacagtatacgcttgtccggactggaaactcgcagtggaactattcgagaaacggtcgcagcggtgacagcggtgacaatagcgacggcagcaaagatacgtcgacgtttgtgatcaagtatcacgaccaatcaactggcacgataaaagagctgcgttcgggcagtggtgagccggtgatcgaggccccgtttgtcgaaccctcgctcgcagctgcgcaggaactgctgccgggcgcgagcagttcgagcaaaaagaaagagatcacgatgtcgcactcgatgccagccactcaggatctgctctcgctcactgctgaatgcaaaatcacgacaaaagggtttggccccgacgaagaccggagctggacgatcaacacgctgaacatgacgctcggtgagagcggcttttcagtacgactacagctggaataa

SEQ ID NO: 4969 - DNA, 198 bp, Enterobacter cloacae
tgtcacagtcacattagctcgctcctttccatcaagaataacgtgtatatcgggttcttttacgggagacggtggttcaaacgaagattcatggtggtcggcaacccccataaattccggctcgtttatgcttcatacgcgaaacatgaacgggacattttcttttattataaaaggagtctgagtgttttattttag

SEQ ID NO: 4970 - DNA, 282 bp, Enterobacter cloacae
gggttggtcgcggaaggccatagcagttacctcatcatcagaaatataagatgcattttaaatgcatctttaagtggatactataaccctttagaggcaagggtgaaaacgagaaagggatcacaaaaaaagcatgcttttaacttgctgattgaatgcagaaaagggctttcgaaagtttttaaaggtggagaaacagtaaacaacccgccgcgcgtgccgatagatacaggtcagacattacctgtatataaaaaaggcaacgcatgtttaaacgtataa

SEQ ID NO: 4971 - DNA, 207 bp, Enterobacter cloacae
agaaacagcaataaacagacggcgtttcaacggtatatcctcaggtcagtaaaaatcgatgacctttttacgggagttctgatgtcgttacctgccttaattgcaaaaaaatgtgacagaacgcagattttttcggaacaaatctcgcaaatttcttgcctgacggtgctttttgttcggactgctcaccccaatcgtttaccatag

SEQ ID NO: 4972 - DNA, 243 bp, Enterobacter cloacae
cgaagagcttccgcaacccggttcctcagtacgaagacgtcgcgtaagactgcgtcgggtggcggctacgtcttacccgacctaaataccccgcaggcccgcgtaagcgaagcgccatcgggcaaaaaaaaagccggagacatcgcctccggcttttttgtacccgctattcagacaatctcttgcgcatactggaacagcgctttcagcagcgcctgcttctcagcattcccttcatactga

SEQ ID NO: 4973 - DNA, 213 bp, Enterobacter cloacae
tcatggaacaaaaaagtcgggcgcgcggcagagtcagacaccagtaatctcatcctgttaaaagttgacgtctctatggtaaacgattggggtgagcagtccgaacaaaaagcaccgtcaggcaagaaatttgcgagatttgttccgaaaaaatctgcgttctgtcacatttttttgcaattaaggcaggtaacgacatcagaactcccgtaa

SEQ ID NO: 4974 - DNA, 225 bp, Enterobacter cloacae
gcatttataatgcaaaaattcccgttcaaaggcattaatctttgcctgaatgaggggattaatggcacattagcaacaccccgtcgtcgtaaaaatctcgtattaagacagtttgttgaggacagatatgaaaaaactggtgttgtcactttctctggtactggctttttccagcgccaccgcggcattcgcagcaattccgcagaaaattcgtattggaactga

SEQ ID NO: 4975 - DNA, 204 bp, Enterobacter cloacae
gacaatatggagcgcaacgcccatcgcttgacgttgcattcacctgcgggagtaatattgcacctaacatggtcggagtttattgacttcgctcaattaaaatgtcgttttgaagccgactctgcctcagaaaagcgtaaatttacagccatttactacgatgcaaccaccatgcaacacccccaatcaaaaccactaacatga

SEQ ID NO: 4976 - DNA, 339 bp, Enterobacter cloacae
tttaatggattaaccgggaatatgctgatgtctgtgaatactgaaaccgcctccgcgcaggggcagaccaccgtactggaaaaagagggcgtttacgcctccctgtttgaaaaaatcaacctgaccccggcctccagcctgggggatatcaatgcgtttctggatgacgccgcgctttctgacgctccggcgggtgaacgcctgacggcggcgatgcaggtgtttatggactgcatccgcaaatccggttaccagtgttgtcgcagtgggatggcagatgatgcatgcgccagattcggcgcaaatgcagctggccgcgtccctggctcctatacctga

SEQ ID NO: 4977 - DNA, 654 bp, Enterobacter cloacae
cggcggcgatgcaggtgtttatggactgcatccgcaaatccggttaccagtgttgtcgcagtgggatggcagatgatgcatgcgccagattcggcgcaaatgcagctggccgcgtccctggctcctatacctgaaggactctctacagcacagttgcaggcgctgcaacaaacgtcaccgccacctgaaccggggatcagtaagacacagcagatgttagcgcagcttttacatctgaaaccagactgggcagtaagctacggcgaccgtctggtgcagcaggcgctgacgctgtggcctgaagaggccaaatcactggcgcaacagtggcacacgcagattagcgttgccgggcttgcagagtcagatctgaatggctggcatcaggggatgacgcagttacagcagttgacgaacaggctgaacgcgctggatgaacagaaggggaagtacatgacggtgagtgaactgaaatcagccgtgtttgccatgtcgcagtccttcagccataccgttccgcttgaggagcagcttcgtctgctttccattttacctgccgggcaacccctgtcagcagcgcagctaaagcagaccgaacagcatcttcagcagttgattgccagctatgctctgctgaagcaccaaaaagaataa

SEQ ID NO: 4978 - DNA, 324 bp, Enterobacter cloacae
atgcaacgtcaagcgatgggcgttgcgctccatattgtcttacttcctttttttgaattactgcatagcacaattgattcgtacgacgccgacttcatagtcggcttttttttgcctcctgattatctgcgtctaccctttaggggtcagcaccctaatctggaggaaaagatgagtattctacttgccctgcaacgcctgaacacctggcagtccgatccggtgcccaccgatccgacgccgatacccgatcctgtcccacgtccgcagccgatgccggatccgccgcccgatgaagaaccgattaaattgtcgcatcgttag

SEQ ID NO: 4979 - DNA, 534 bp, Enterobacter cloacae
agcaccaaaaagaataatgagactggcgaaaaacacggagttgacatgtcagcaagagagcgtttttttaagaaagtgcaacagagtatcggggacaaaccgatctatgttaatacggctgaggccgaagtcagggcgttttgtgagcggatggaggatcttgcgcagcaaatcattacatggtttgaaggttctggtattgaaatatttttatctaaaaaacatatcaccgatttaagtacggttggctacagccttagtagcggtatatgtcgttatgctattacgacgatcattttgcaaaatggggatcgcagcgtcaccattatgccagaacaggtgatcagggggtcggagaaggggtgtgtgacgatgagtattaatgtccccgatagtctgtcgggggcgaggatattccatttaagcatggcgcctgaaacaggctggtatattcgtcgcgggcatcaaagtgcaaaagagaatattctcatgactgaggactgttttttccaggctatcgactgtctggcctga

SEQ ID NO: 4980 - DNA, 309 bp, Enterobacter cloacae
agtaaatatccgtttaaatcctggaagatttttgacctgaactgtgtaaaaatgagcaagctcacttttcgtagggtgaataaaaggagaaaaattgatgagtaccgatctgaagttttcgctgtttaccaccattgttgttcttgctctgattgttgccggtggtttaaccgctgcactgcactgattcaggcggagggagaaccttctccctctcttgccgctattgttacctctccggcaaaaatcttttgccaaaatgttaacttctcattttttgtgattgatgtcatgcttttgacttcttag

SEQ ID NO: 4981 - DNA, 231 bp, Enterobacter cloacae
catcatgctaaagatccatcactacaggagataaaaatgaaagcgatttcattcgtagaagcgaaagacattattggcggcgcgttaaacccgttcgctggtctggttaaaggtgcacagctgggttacgacactggcgccagcatcatgggcatggttggcggtgtggttggcggagttctgggtggcgcaatgggcttcctgggcgcgctggttggtagctacaactaa

SEQ ID NO: 4982 - DNA, 489 bp, Enterobacter cloacae
aatatgtcaaggactaaaatgagtgtactgttcagtatcgtactggcgctgtctgtcatcgcgttgttatggatctattttaccagaacgcaggatgaggggtttggctgccagtcagataccatttcctggaaaacctattctacgggtgagtcaaccgatatgtcgctaaccacgcttttcctgtttaacaacaaagatgttgtgacggttattcataaaggcgtgctcaagaaagaaggcaaaagctacctgattgaccgaaattacacgctcatcgtggaagaagtcgatggaagcaatatcttttatattaaggataaaaagctgaataaatctgaagatgatgcggcgccggatggcgttgtaaacgaaatgttacttgataatatcaacttcttctatattaccagcgtaaaaaaacatgcgtggttaattaaggggctggtgttgcctgtaatgatgtgtgtggctgtcccgacgtcctga

SEQ ID NO: 4983 - DNA, 219 bp, Enterobacter cloacae
ctacaactaattcacgttaacaggaaaagtatcatgcaagttatcgatttcaaaaaagcacaggccatcatcggtggttgggatccgtttgctgccgctattcagggcgcaagcgcgggctataacgcgggcagccagatgttaggcgcgctgggcggcaccatcggcggcgtattcggcctggtgggcggcttcatcggcggtttcttcagcgcctaa

SEQ ID NO: 4984 - DNA, 234 bp, Enterobacter cloacae
attttaccgcgtaattcttcagcgcgggatttatcaatatccatcacgctgacgcgccagaaggtccccatggttttcccttccagcaccgtcgcggcgggtgcgtcgatttttgcgggctgtgtggaagagtcacacgcggtcaggagtaaaaaagtcgccagaacgctggcgcgtaaaaaagtcatatccattggttattatcctcatgccagggcggcaagagtacactaa

SEQ ID NO: 4985 - DNA, 273 bp, Enterobacter cloacae
cggtcccacggagtggcaatctactcccatgaaaaatatctgtcaacggacccgggggcagaaagcagcattctcagcgcagcgcaacgcattattgtgagctgccgcaaagaaagcagaaaagcagaagaaacgcagaaaggaaagtcatgccccttctctgggggagaaagggcttatgcgggaggaactagcgtgacaggtagcgccgggaaacgcgttttgccagtttctgtaacagcggctccagagcgaccgccagcatcattctga

SEQ ID NO: 4986 - DNA, 249 bp, Enterobacter cloacae
ttcaatcctcatagttctgttatcgggcgatgccctgctgaacagataatacaaatcccatgccaactttttatcttattgattttactcaatgtgattgatatttatccatccagcggctattctcacctggtgaatatcactaaggagtggttaatttcatcatggctgaatataaagataatttgcttggcgaagccaacagcttcctggaagtgcttgaacaggtttcgcgcctcgcgccgctga

SEQ ID NO: 4987 - DNA, 342 bp, Enterobacter cloacae
aaacctttgcgcccttcaacagccacttcgctcatgtatgtcgcgctggtgccgtattcgccacccactgacagcccctggaacagacgtgccagcaacagcaacgccggtgcccatgttccgattgtgtcatatccgggcaagcaggcaatcaccagcgagccgacgcacatcatgcacacagagatgagcatggatgtcttgcgccctttcctgtccgcgatcctgccgaacagccatccgccaatgggacgcatcaggaacccggcggcaaaaacgcctgcggtttgcagaagctgcgttgtggtgttccctgatgggaaaaagatatgcgcaaagtag

SEQ ID NO: 4988 - DNA, 477 bp, Enterobacter cloacae
aacaattttaacaatggtgccgctttgactcgtccctttgattatcaacaagattttgccaatattaattttcgcgaacatcccgaacggtatcaggtgggccggggtgagcagggcgtattgatggtcgagccttataaaagcgaaatccttccacactggcgttataaaaatgctgaagtcgcagcgcgttcggcagaagagatctacgccctctttgaagagtaccgcaggaataacgattttgtaggtatggatatggcgcgtaaattcatacagatgggatacacccgtgcccggcgatacgccaatcataaaggcggaaaaaagtatgatgagaagcgccaggtcaaacccctcgatcacgatccagtaaaagcagaggccgctgcggtattcaaaacgtgctgggataaaattcgtgccgatgaagattatttgcagcgaaaaaaggctcaccagcaagcgtggggataa

SEQ ID NO: 4989 - DNA, 461 bp, Enterobacter cloacae
tatagaaaaaggaaatgctgtatgtctgacaaaaaccatcatacgacatgggaagaattgcttgaggagtacttcttcgcccgaaacctgcgtgctgcaacagaatggagctatacgaaggttgtaaaggggttcctgaaattcatgggtgcaggcaaaactccattaatggttactcatcatgaaatactgagatggcggcgacatgtactcagagaaaagcaacaatcggcgcagacctggaacaataaaattgcacatctcagggccctctataactatgcgatggaaagtggtttattgcctgagggtagaaatcctttcaacaattgcaccgtacagcgggacagaaagaaaaagcgcacgttaacccgctctcagctaacccgcctttatctgataatgcagcaggctgaaattgaatccaacagaagtgctcaccagcggcagagatcagcgtc

SEQ ID NO: 4990 - DNA, 243 bp, Enterobacter cloacae
gagtttttttccccaaaaacccaattttcccccttgggggggggcctgaaattaggtcccaaggggtatggctgttcgccatttaaagtggtacgcgagctgggtttagaacgtcgtgagacagttcgttccatatctgccgtgggcgctggagaattgaggggggttgctcctagtacgagaggaccggagtggacgcatcactggtgttcgggttgtcatgccaatggcactgcccggtag

SEQ ID NO: 4991 - DNA, 198 bp, Enterobacter cloacae
  unsure (133)
ggaataaaagcgatgccattaagcgcacaacagctggcagctcaaaaaaacctgtcctatgtgctggcagagaaactggcgcagctgatcttagcgggtaaatatgctccaggtagcatcctggccccaaagnccgggaaaagatggagctgggagatcagtttggcgttagccgtacagccgttcgcgaagcggtaa

SEQ ID NO: 4992 - DNA, 342 bp, Enterobacter cloacae
aaaaactcaaataatgtaatcgccaacggaggaataatgaatgtacatctgaaatatgatacgataaagcactatcactttgattggctaacgcctgctggcgactatcctaattcagcggttatgctcgtaggtttccgtgatgggcgctggattattgttcaagagttcggaaatgattatagctgcttcgagggcgttctgaagaatggtgatgatcttaatacggagcctaaattctattccgacttagaaagcgtagcggttgctgcttttggcatgatgaagcagatatatccccagtaccaagatagcacgttagaagaattcctcgctggataa

SEQ ID NO: 4993 - DNA, 408 bp, Enterobacter cloacae
gaagacaataccaggtcagacaacaaggtcgttagcatgatcgttggaagcaacggaagcacctttgaaaaaggtcggcagcactataaaatccatcagcaatgcacacaaataaactactggtatcttaaaatgaaagtgaaagagttgatcgccatgctgaacgaaagagaccctgaggcaattgttctgatttccggctatgaaacgatcggcggcacggaagtcgcagaagctgatttgctcattgatatgcagtcaatatgcttagaacaggctgataatctcacaggaaaccgtaaagttgtttcttccggtggtgaagattcagtttggttaggctggaaagatgattaccgtacaaaggtgtttttagaagatgcccaaattcctgatcaagatgaatga

SEQ ID NO: 4994 - DNA, 357 bp, Enterobacter cloacae
gttaaaatcacctataatcaatacctactggagcagctcatggctgacacctacctccccccgggctttaaaaaatgcaaatcatgtcagcaagttaaaccctttgaacagtttggaaaagagctcaagggcaagtttggcctcaagagtaaatgccgagcgtgtattagcgagaaaaacaaaacgtacgcagcaggcccaggggccgaagtaaagacgcaaaataataggacctaccaggcagaaaacaagactgagctcgcggagaaaatgcgcgttaagcgtgcgaaagaaaaatttggtgatcgctataattcctacctcgcttctttagagtccatgaaaaaactcaaataa

SEQ ID NO: 4995 - DNA, 1461 bp, Enterobacter cloacae
aacatgaaggtcactattgatggtgtctcgtacgcacctgtctgtaatgcaggggctcgtattggcattgccataacaacgcataatcgcgctgacgcattgaagcgagctctggcgcagcatcagcagtttttaccgcaaggggcgctggtggtcgtcatagatgatggttcaaaacctccagcggaagttttcgaagacgtgcagctgcttcgccatgaaacatcactcggcattgttgcttcgaagaacgccagtttaaccgcgctgatggacgccgggtgtgagcatctattcctttgggacgatgacgcctggcccatcgctgataactggcacttgccatacatcgaatcacccgaaccgcaccttgcttaccagtttctcgatctggcaggaacgaataagctgaaggatatggcgatcctgtaccgggatgataagcacatcgcttacaccgggcagcgcggcgtgatgctgtattaccaccgcagcgctatcgagaaggttggcggtttcgatcccgtttaccgtcgccgcatgtacgaacacagcgacctcgccctgcgcatccataatgctggcctgacgacatgggcttacggtgatgtggtcggttcagaaaagctgatccattctctcgatgagcatgaagccgtagagcgttcggtaccgcgtcccgaccgacaggcgctggtggaacgtaacgtgaagatccacaacgaacggcgtgatgccgggtttactggttacgctgaataccgccagcagcgcgatgtagttatcacaacgctgctcaccagtcagcctgacccgcagcgcggcacgaaaatggcggcctcgcctgacatgctgagcaaatgggcggcctcgcttcgccagtgtgggcgtatagcgctggtggatgaattactgacggccccggccgatgttgagctgtatctcgtacctgacgtgaagatgaatgtctacttccgtcgctggctgcacatctggcagcacctgcgagatcaccctgaataccggttcgtctggtgtactgatggcaccgatgtcgaaatgctccgcgcaccgtgggaagaaatgcagcccgggactgtttacgtcggttctgaaccgaagacctacgccgacacctgggcgaaacagaatcatcctgagcgtatctatcaggaattcattgaatcgcaccgcggcgatgtgatgcttaacgctggactgctgggcggtacacgcgctgatgtcatggcgtttgctcacggcatcatccgtctttactaccggatcgagagctatcgtttctggaagaaagaacaggctggcgccgcggtgggggacatgctggcgttcggtattgtcgctcattcattcgcaggaaaagtgattaccggacctcaggtgcacaccgtttttaaaactgatgggatcggaaaagataatgcctggtggaaacataaatag

SEQ ID NO: 4996 - DNA, 813 bp, Enterobacter cloacae
gcgtcgatccaactcaatcaattttcctatcaatacgacaacgaattcctttttttaacctcactcgatactccataccgtttgaagagtgtagactctggacgttgtgcattgactaatccattttcaatttctttaaatgtatggagtagagtaatgggaattctcactttcgatatcacttgcccacattgcctgagggaaaatgcagtcctggaaggatgggccgaactgcgaataaacgccggtcctttagttaatgttgcgtttagttgtcgaagctgctttcaagctggtatagctatggtgaaaatgaataatcctgttggtttttcgcccttgtcaaaatccaagcagaataaagatgtaaatgtaatcattcctggaaacctggaatatcagttgattgacgttttcccgaaacctatcacgctaagtgcacctgaccacacaccatcccgtgctgctatggctttcgtagaagcgaaagacaaccttggacgaggacgtttcgacacatctgttatgctttgccgcaaagtgctggacattgcaacaagggaattattaggaaatgactcaaaagatgaaaaattggtcaagcgaatttctatgttgcatggcaaggggctaattacagaccaaatgaaggaatgggcgcatatagttcgaattgattccaatggtgctgttcattccgatgaagaattctcaaaagaagatgctcaggagatgattggttttaccgaagtatttcttctatatgcattcacattgcctgatatggtagacaacaagaaacaaaatcaataa

SEQ ID NO: 4997 - DNA, 204 bp, Enterobacter cloacae
aaaagccgcacaatggcggctactgtctgtatatcagggtgtaacttcgctttaacccgggttaatgtaagcattcagcccgtcagtggtgggacactgacgcactctggcacggaggaatggctgattacctctgataaggaaatgaaatgtcttttttgcacaaaagaatgcatcttaatcaaggtgataccgttgttgtag

SEQ ID NO: 4998 - DNA, 192 bp, Enterobacter cloacae
acaatgcgattttacgcatactactggttccttgataaaacaatgaccaacttgccagaacggcaaaagacacccgaaatcagactaatctggacaggagcgctcacattagcaccgatggagattttcgcaagagccaacctttgcgtttacaaattagttttactttataacccattcacattgtcctga

SEQ ID NO: 4999 - DNA, 204 bp, Enterobacter cloacae
ggcaggcattgtccccggattaaaccgacgcaccagcgtcgacgtttcagggtgcttgaaacggggtttgaagagagtttcggtgagattcgcctgcgtcattgcgttgcctccatggatacgtcatatgaagaccattgtaacgcgtggcagggtaaaaagaacaacgcccggcataaccgggcgtgtaaagttacgtactga

SEQ ID NO: 5000 - DNA, 279 bp, Enterobacter cloacae
tcgcggtcatccgcatgggcggatgcggcgcacagcaatacgccagcgctgagtgcgctggcgcaaagcagaggtctgactgataaccgaagcggcttcatgacccatgtgattgaaaaaatcgcctttcccctcatggggagcgattattccacgatgaacagcggcttgccagtcatctcttcagggatttccatacccatcagcgacaacatggttggcgcgatgtcggaaagcttgccgccttccactgctttcactgatttatcacccacataa

SEQ ID NO: 5001 - DNA, 201 bp, Enterobacter cloacae
aaaaaccaggacaggagtatacctgtgcgctgtggcaaatacagccagcgacataaagctaatctattttctgcggcatgccacgtaaaaaaagcctcaaaatggcctgagaacagccttgcccccgcgctttctttgatcttctgcggctattttatcgattcagctgtagtaaaattacgcaaaatttttgtctcttga

SEQ ID NO: 5002 - DNA, 642 bp, Enterobacter cloacae
gtaatattttacacattgtcgcgttatggaggtgagatggagacgttaaccgtacaggcatatctgaacgaaacatggacggatatcgctctcatcaaatatcctggaagtgaaaaaaatgactggaataccacgcagttagactatcttactgagtatgcgattaattttctcgactatgatgattttcacgcagtctcagtcaatcaccctgtatcactcttttttgatgaccatggccaaccgggctggctgcgatttatcgacgatatcattcccgccggagcaagccgccgttactggattaatgcgctcgacatcagtgagttacccgttggccagcaaaatttcttattgctgaaatttggcacaatgtcccctgtggggaatttgcgcataaaggaatccgtcccagaatggaataaattcgccagcactaaaacgtttacggttgcggacgtcatcgatcgtgcggccgattttctggattatgcccaggaaagaggcgcggcggcgggtggtgcaaccggtgctggcggtgaagcgcctaaacttttgctgcgctgtagtgaaactgatgccatctggatcgatacctggcaaaacgagccggataaccggggaccgctattatttggttaa

SEQ ID NO: 5003 - DNA, 183 bp, Enterobacter cloacae
aggcgcaacttacgcttactgacgttccgttttttagtaacgcgtggcaatccgcatattgttatacattttcatatccggaaatttattccccaagacaatgagttaatttcatgtattcatgctaattatgaattgactgctacacttacttcgacagacatacgcaggagaggcgaatga

SEQ ID NO: 5004 - DNA, 207 bp, Enterobacter cloacae
cctgatagcggcttcaatcagctgctggcgggtcttttgagcctcttctttctttttgcgcgccattacctgctactcgttacttacaagattgatacgttatcaaaggatattgccgtggtcgtgtcagacaaagtattaaccaaaatccgtgttagttttgcacaaaaaaagtcaattcgtttaatttataaacctcgtgaataa

SEQ ID NO: 5005 - DNA, 186 bp, Enterobacter cloacae
gcgaagcgccatccggcaaaaaagcctggccctcaccgcgagggcttttttatctccgccttgctgaaaatagcggcgatcgcagacaaaatcataaccctggattcacatgcatcttacactctcgaactattttcgctatggttagggttaagcgttgctgctggcacagtcacggcaatataa

SEQ ID NO: 5006 - DNA, 222 bp, Enterobacter cloacae
tctgctaccagtcccattagaaagcatggtatcagggttgtaaggctgaaccctaaccaatcgcgccatttaccagcggctttatcggctattacggtgaatagcaaatcaatcaacgctgtgaagattcctattatcattgtgaagatagtgaagagcattgttagcgacatccaactaacagagccgctacagtcccccaaaaagagagacaaaagatga

SEQ ID NO: 5007 - DNA, 537 bp, Enterobacter cloacae
caaaaagccttacggcaacctggttgccgtaagctgcaagaatgcaataaggcttataatatgaaacaacttactttcaacgacctacgcaagcaaagcgcacaagccgcaaattccccccgcttacgtgcccatcataatttccaccctgaattgagcgacccggtgcagcgtctggctattgctatggaaccgggaacttatgttcgccctcatcgccacccgcatacttttgaactgctgacatcccttaccggtcgctttttggtattgaactttgatgacctgggtaacctgacccagcgcgtcgtgttaggtgaggactgtaaagtgctggagatggatgcaggcacctggcataccgtattgtcactggatgaaggcggcgttatttttgaggtaaaacacggtaggtaccagcctgttgctgatcaagatgccgccccatgggcccccgccgaaaacgagccgggaactgcagagctgatgaaatggtacacacaggcgcaagtaggtgatggcggatatccgcggtaa

SEQ ID NO: 5008 - DNA, 393 bp, Enterobacter cloacae
gacgaggcttcaatgacaagtacacttgacccatcacacaagcaaattgaaatgtggcgcagagctaccggttccgaaggtggactcaacgaataccgcaactgggttctggaaaatagtatgagatttacagcatacggtatccataccgttatcgtcgaaggtgaggcgaagcatataacagcgcttgatgatgttaccctctgtaacgagtgggcgaagcttaaaagagaaaacaataggctttacgcagcaaatgaaaaaatttgctctggctggcgtggttttgtgttgcgtttgttaggaataacactgccatgcagaaaaccggtcatcttactgggggtagatgggaagaatcaaaatgatgccgtgaaaggggctgatttgtaa

SEQ ID NO: 5009 - DNA, 366 bp, Enterobacter cloacae
ttttcaggcgagcccaccgttcttagaaagctgttctatgggtatgtaaggaagataatgttctctgaacgctcagtacacttaatcacctcttgtacaaagggcaagaatcatcagggccacgtctggccgacattggacatagatccaaaacaaaccccggacgacgcagcatatgcctggagtaacattgtagacgacgccagaagtaatcaggcggtaccggcattgtccttgtattcaggtaatcactggtctacggcaaaggaaattttaaactcaaccagaaatctggagttgtggataatctctgccgggatggggtttttaaatagtcgagatcgggcccttcttatgaggttttga

SEQ ID NO: 5010 - DNA, 234 bp, Enterobacter cloacae
gtatgtcacgccactaataatggttatttaacatttatttattcaccgactatgctcatagtcaggcatgcaatacgttcattctctttatcccgcgccaccttcaacctcatggaggaatgcatgtacggtttaagcctgattcgccttggtttgtttattgcgctcgccattatcgccagcacagcaatcggtttatttacctatgtggtcgtctcggccctggcagaatag

SEQ ID NO: 5011 - DNA, 972 bp, Enterobacter cloacae
acaacaatgaatgcgacagggctgaatatcatcaagacgctgggctgtatgacggcggttacctttttcaccatctacaacacctgggatcattacgattatgactatcactggatcctcggttttttaaccttcatttcgaccatcgccacgccgttgttttttgtggttgcagggtatctggacgggcaatcccgacacggcacgcgctggcagctggataagatcaaacgcctggtgatcgtctttctgttctgggtaacgatttactacctgtgggaaccctaccagcgcggatatctgatccagccctggttcgtgttcgcgtttatcgtgatttacacgtttcacccggtggtggagcggctcggccagcgacgaatgctcttttgcggggtgattaccgccctgctgcttttctcatacgggtacgatttgctgtcggccctctatcctgatgcccacgtcctttcattgtcgccgcagtatcgcctgtggacgtggctgctgttttatctgacaggccagctcttttgcgatccgcagatcgcggcgtggatcggccgcaaaaacgtggtcagggccgcggtgattgcgataccgttcatctatctcttcacatggttttacgaacggcacttcttttttgcgctatttaaagcagacagaaacgcctttatcctcaccggatcgcaaatttacattctgattattgccctggtgattgcggcaaatggcgtgcggtttcgccgcaatgcggagtttaaagagtccgtgctggccgccattagcaaaacgatgaccggggtctatatcatgcactactcggtgtttcacctgctgaccgcgctcattccggtgacgtccctgagcaccaaacttgctctgattgtgcttacgtttgttacgtcggtcctgttttcgctgctgatcctgtccaacacagtggccaaaaaagtgatcaccctctaa

SEQ ID NO: 5012 - DNA, 225 bp, Enterobacter cloacae
gacacgctacagcggcaatatccgtgcctcggtatcgtctctacggtaaactatgcaagattacggttcaaaactgatggttacgggttttgcacctttagattaatgactgagaggattaaaggtatctcatggctgaatggagcggcgaatatatcagcccatacgctgagcacggtaagaagagtgagcaagtcaagaaaatcacggtgtccattcctctga

SEQ ID NO: 5013 - DNA, 354 bp, Enterobacter cloacae
tcaatggcggccgcaacgggctggataagcgccgcgagctgtttaacctggcgaaatcagttctggtatgaggtgaatgtgggtatcgagacaataatcgggctggccgcactggtcatttccgctatcgccggcgcttttggcctaggccatattcgcggcaccagcaaagcagaagccaaagccgaccagcagcgaaccgaagataacgcagcggcaatggtcgcagcagccgaacgcagggtagaaacaacgaaagaggccagcaatgtacagcagactgttaatcatatgcctggcgacgatgttgatcgcgagctgcgtgacgaatggaagcgtcccggcggtggttga

SEQ ID NO: 5014 - DNA, 507 bp, Enterobacter cloacae
tggacgcgagggcggaagatggggatcagcccgacacttaacattcctcaggcgcgcttcctcgcgatgcagcacaaattcaaagcctatgttgccgggttcggttccggtaagacgtgggtgggttgtggcggcatctgtaaggggatgtgggagcaccctaaaatcaaccagggttatttcgcaccgacgtacccgcagattcgtgacatcttctacccgacgattgaagaggtggcctttgactggggcttgaacgtcaaaatcaacgaggggaacaaagaggttcacttctacgaggggagacgataccgcgggacaaccatctgccgttcgatggaaaaacccggctcgatagtcggcttcaaaatcggtaacgcgatggtggatgagctggatgtcatggcggctgctaaagcgcagcaggcctggcgaaaaatcatcgcccgtatgcgttacaagatcgacgggttgcgtaacggtatccctttaactggacctgggtga

SEQ ID NO: 5015 - DNA, 930 bp, Enterobacter cloacae
acgatgaaagaatgtaaaaaagataggcttcctgagtataaatcgcttagtgttttattatttattatctccatttttattgtaatatttattccggttgcttcactattaatcttggttattcttgttgttactataaagaaacaaaaagcgagaactaaaccacaagaaaatatctatcactttgtaaaggatatgaacgcttttggtagtattcttgagtcacgttgtttaatgtcgttaacaggagggcgatgttatgccacttcaatatttaacccttaccttgggctaagcttgtttgacactgacaatattaaatatgttttagttatgaaggggaaggcaactgatgtcttcaagcctataattagcagctatcgggaagtttttctcccttggaagtggtggaagttttttagaggtgagtatgtcagtaaggctctgaaagatttagagtttaattgcgatgtcaagtctgtgcgtaatgagtacaaagaatacaatagatttgtatgcggcagtcgaaagagagtgctcttttgttacttgtacatagacaatctgacggagttagaaaatgatttgagcatatatagaattcaaaaattccttttttggattggtgatatatttctttcagtcttaggttggattggaattgtatgcggcaatctgatttttctcgggttgtgtggttgcgaatttgtaaactctttaatgaactacataagcaaaaataatgattctttcgctacgcatttttcaatttattgggtgatatacatatcaggtgttttttttgctgtatttttaattgcatgcttatatttcatcctgagaaaaaaatcaattacctcgcgtgttgcaaggcaaaagaaaaaatacaaatctaactataaatttatgctttcaatcagtgagaaatga

SEQ ID NO: 5016 - DNA, 396 bp, Enterobacter cloacae
gggggggcgatgtccgatccattttccggcacggggctggccggtttagctttgaccggagccagtgtctacggtttattgaccgggacagactacggtgttgtttttggtgcatttgcaggcgccgtattttacatcgcgacagcaactgacctgagtatgttgcgccggctggcctatttcgtcgtgtcttatatagtcggcattcttggatatggtctggttggttctaaactcgcgtcctggacggaatatagcgataaaccgctggatgccatcggtgccgtgattgtctctgcgctggccgttcaaatccttacgttcctgaacaagcaggacatcggctcgctggtggcgctgataacgcgccggggaggttcaggtggtactaaatga

SEQ ID NO: 5017 - DNA, 234 bp, Enterobacter cloacae
aaacaacgaaagaggccagcaatgtacagcagactgttaatcatatgcctggcgacgatgttgatcgcgagctgcgtgacgaatggaagcgtcccggcggtggttgataccggttgtgattgggtgaagccaatcttcctgacggatcaagacatcgacgttctggaccgccagacgaagaaagacatcctggcgcataacaaagcatggaaagcaaattgcgggaaaaattga

SEQ ID NO: 5018 - DNA, 456 bp, Enterobacter cloacae
caaccgatgaaaattcactttattacaatcgccttgctggcgacgatttcttcgccatcctacgcagcgtttcaggaaagagaatacaatacttggtatcaaaaagatgctgtactctacgacattacccagacctcagagggattgcctgtcatgataagcatctctcaaccggggagggagtcagctaatatgctcgtatcctatatgtccgatggtggctgtggagatgagaaggtgcggcttaatgctaacgggaaggatgtgcctgcaacttatacttgtgtatcagtcggagcagacaggattgaacactttgcagtgaatgatgcaagcaaggtcaatgagatggttaaccacctcaagtcagatttcactttgttgcttcagaacgatatcaaagtctgggctgctaacataaagacgcctaagtatggtttagcaccaaaattttaa

SEQ ID NO: 5019 - DNA, 1407 bp, Enterobacter cloacae
ctggacctgggtgagcgccaacacattcaccagcaccacctgccaataactcattctgtctcaaaacaaaccccgctccggcggggttttttattgcctggagaaaatatgctttataacactggcaccatcgccattaacggaaatacagccaccggcaccggcacgaactggacggcaccggccagccagattcgggttggccagacgttgtttgttctttctaacccggtacagatgtttcagatcaccgccatcaacagtgcgacgtcactgacggttacgcctgccgcgtctcaggcgttgagcggccagaagtacggcattcttgttactgatagtctctcagtcgacggcctggcgcagagcatgtctcaactcatcaacgagtacgacgagaacatcggcgcctgggagacgttcgccaccacctcagcaaaccagaacatcaccgtcaccatcaacggcgctcgtgtaactattccggcgatcggcaaactggtccagaaagggagcaatggggcggttggagtttctgacggcgggaccggagcaacgaatgccgctgacgctcgcacaaacctcggtttgggaacatccgcgacgaggaacgtcgggggagcccccgggaatgtcatggaagttggagcgtttggtgttgggttaactaattttacggccaatagtgttgcagacgctaacgacataactttcaacggttttagtggtggcggtggtgcatcgtctgtgaatttctttgatcaatatgctgggttgctcgctataacaaggtcaggtggcggtgacggtaacggctttattgcgcaacttcagattagcggatcaggtgctatggccgttcgagggcgagctgggaccacctggtcttcttggatgcaggtttacaacaccggcaataccacaaaggcgagcgatggcaccctgaaagcagcatctccggtcgctcgtatcgttgcgagtgctgatacatgcctgcgatcagatattgctgaggatggattttcatggtgcggctgcggcacggcgaataccgaagctgaaggaatcaaaattctccggctcgatgtgggagtttatgtgttgactggttcgtcagggctggcgtctgaaggatggcagttactgccgccaatggaccctggcggcatgggggaactgggtgtagttgaggcagagcaaaccgctgacggcgagctgactatccgcctgtttaagcgaaaatacatgctgagcgatgaaggggagatcgtcaaaacaaaaggggaaccgatggacgtgccggtgaacagctggatcgatgttcgcctggatatgcctgatgattctgtctttaatcagcggatgagacaggaaccacagcttgagcctcattctccagctctctga

SEQ ID NO: 5020 - DNA, 192 bp, Enterobacter cloacae
ccggtgcgcgtctggcgttcgcgctgctttaccggagcatgtccccttatttaccctcacaacggtctgctatacctgctcgccattacgcgactcggggcagcatcattgctgctgcatggccttatggctgcagtcaacccgcttactgtttcaaggtctttagcccatccaccagtgaaaacaatctga

SEQ ID NO: 5021 - DNA, 237 bp, Enterobacter cloacae
tatcccacgcttacgcttgttgttatctgcctggctgccaggctatacatgactctgatgcggagaatgccaactccggggaacatcaataaaaagagcaacgaaactgagactcctgtagccctcgctgagagggcttttttttcaaaaaaaagccagctcggacagaactggctgggtctagcagtaagtaggtattacttcgcactcatttcgacgtgtaccctattcctttag

SEQ ID NO: 5022 - DNA, 276 bp, Enterobacter cloacae
ggaatgttaagtgtcgggctgatccccatcttccgccctcgcgtccactacattgatattgatctgaactggggtcggttcgtcatcatcaccatcaccggccagctctttgcggagtttttccacctccagcagccggcggtcgatttcgatctgctggagacgctgagcgaactcgctatccgccaggccgagccgcttcattaccgcttcaaacattcgctcacggctgatggctgtgatttcgacaccattcttgccaaccttcacgcctga

SEQ ID NO: 5023 - DNA, 228 bp, Enterobacter cloacae
gtaaaagctaactccatggtaacgaaaaaaatttgcaatcacctctcaatacattatcagcattctacagcatcaaccttatttttggtgagctttttcgaatggcgaactggctgctatgtttcgtccatgatgtctaataacaaagagtcacttattaaacaaataagcgagtatgccaggcttaacgagcaggaagaaatccagttgcgcaagataatcagctga

SEQ ID NO: 5024 - DNA, 270 bp, Enterobacter cloacae
atgccaaacgcctctgattatttttcctgtaaccatatcttcagttttaccgtgcgaaaagtaggcgatctggacacagtcattgtgtctaatccaataatatccctctttcataattcacctcttaaattgtttcatttagaagtgtatatgacgattcagaacctggtggtcgacaaaacgttttttttaaggatgtggcgccgggtgcctcccggtgacttatctctggtcgtcaaagtcgcgtgcatacctgcacatagcagttaa

SEQ ID NO: 5025 - DNA, 186 bp, Enterobacter cloacae
aaaaaaatcttttttgagcatcggtttcaaaatggttttccttttatgcccggtgccgccggggcggtggcgttaaatatacgccatgtaagtaaattaatttatacccatttgattgtcaatacaaacaaaaaaacaaaccatgtttattattttatcaacgatgctattttaaagtccgtctaa

SEQ ID NO: 5026 - DNA, 270 bp, Enterobacter cloacae
acagaaatgacgcatactgccgtttctcaggctaatagtgctttgcagctacccacggtggagcatgtctacgctcttctgaaagcaaattgtaaacctgaccgctttgacgggcgtgacggacccgtgtggggccaggaatactcgtggaatctggcaaaagatcgcttacaggatctggagaaatacggtaaggcatatgtctcccgtcatgaagaccgtatgggggaaggatttagttttggtcctgacctgttaattattcgctaa

SEQ ID NO: 5027 - DNA, 2433 bp, Enterobacter cloacae
aggggaataagaatgaaacatctcgcttttattactgctgtagccggactcggtatgtctgttcaggccccagctcagatatatgaatcggcctttaaagacacgaacggtattgagatccacgccccgtcttctcgtcttatgcttaatccggcatcaccggtaactttgacacttatttcaggtcttgatcgtttcgttaatgtcaaagtcacgaaagacactggaactgtcattcttaatactacgactacacggacgggtgtatcagaccgactaacagctgctgacggtagtgagttctacggcaaaaaagtaactttgcctgctttgggtgaaggcaaatttgtcgttcagataaacgtgttagatctcaatcagaagcctgtagcgacctataactataactggctaattgatgtcacccctccagcggcaaatgctcttaccgctaatactggttctggctctaccgctggtgacgtgtggaagcttggattagaggcaacggggcagtatgacttcacctcttcgggcgtaagtgatgcaaatggtattgataagggcctaatatatatttacaggcaggacggtagcctctacagcactacacagatgcagtatgacgtatccggccaaaagatgtaccacacttactctaagaattcagttaagggaaccggaataccagacagcaacctggatgaagactttactgcaaaagttgttatcttcgataacgcaggtaatagccgaacgctgccaactcaaaaatttcgctacgacaacacgctgggtgagatgacactgtgggccgttcatgatccaaatacgtcttccagcgtcgtacccggggtttctaattatccggcttacaaagccggtatggtcgttaacgaaaaccctattcgattagtctaccggatcccaaaatctaactaccgtgcttattcagaaggtgggcttcagttcatcaatcaatattccgcccccaaagagatagctgtagacagcacttatgcttatgttgaaatgactcttccctatggctcaattaatggggatatggctcgtatggcgaactttggccagtggggagggtattatccgtcatacagcctcgttctaaacccatctgcaaaccaaacgcctgcatttgcgggtacctgggtagatttcctcgatgataaggggaactgggttaagtggaaggattttgagagtgtggcttcatcacgactgccaattaaaatttcccgacttcgttttaacgttgaagcccggccctttgcacaagagatcggcggtaaggcgacctgcaccattccggcaggaaaaacctcgtgtgaagcgcctgagacgtttgatatggccttgggtacccagggctacaataggatcctttacttcgttcgcagcatcagcaatcccattttgcggtctgagcaatggattatgacacgctggaacaataaacaactgccggtaataaactcgatatcatatgacgagactaacaagcagctggatgtactggcgtcacttgaaggcgatggtaactggttcgactcggtctcattgagggaattttatctttccgataagaacaccggtacccggatgtcacccacaggcgtaatcaaatctcgtatctcaggtaactacacgattgcttatgatttatcccgtcagtctgaaggaaaatacaacgttgaggtcaacatcagggacttcttccagaaccagaccaataaaactttcggagaaattgctctggataacactcctccgacagtggccataacattcgacggaaagccggtaaaagacgatacggtagtgtacggcctggagaacctcaggatcgctctggcagataatctgacaaccccgaggataacccgtcttcagctcgtaggtggccccacagctgataacgttgagcttacgtggtcaccggcaggcaaagatacatacatgcctgagtatccgaggctgttcccaaatttcgaaccatctgaaaattattcaattagcgtaacagttgccgatagtcagtcgaataccaaaacctatactcagaagttcagttatctaccgaataaccttgtgcagttacataatctacgcacattatcggtcagttcgcctctcaaaacgacagatggcgtaccccttgcgtacctgtccactaacgttctgcgtaagacaaatggagaaattgctaaaggggtccagaacgcaacgctgactgtgcggaaggatgcagccttcggtattaaatttaacggggcacaggcggctccaggtgagtcagttgaggtgcaaatagatatgggccagggggataatcttctgttacccgtttatccttccgaaaatgggaaagttggcacctcagaattcatgattcagatcgacgagttgaagtaa

SEQ ID NO: 5028 - DNA, 795 bp, Enterobacter cloacae
  unsure (635)
tataaagccaacacagaaaaggaaaacaaaatgtataaattagtatctcctcgtgaactgactgagattattaccggtttactgcttaaacctgaactccttggtgagctggactcaccagaaaagcatcggatgtttatggcagatttaggccgcgtggtggccgaacattgtggaggtctggtaaacagcgtcgtcttgccaggaacagaagttacagtgtcggatgggttaccgcttaatggccagccggtacgttatctcggaatcaaagagaacatccctcacctccttgtagagcctgatgcttccttaccttcgctcgctaaaaacgtctggatgtatgcagatcctgaaggctggaaagaacattttggagctgaggaagactgccttactcctgaaatgatgcagctgttccgtaaaggtatccaggctcttcagaaagagcatgacacccctgaaattagcctcacacttcaggactggcgcctggaggaggaaacactgccagaagaggacagtcaggcctatcaggtcagcgttaccggccaacataacatccactgtgaagttgttaacaaggaaggtaacccctgtttaggtgtcatgttcgaaatcgatcagggtgtgcntgccttacacatcaacaccggcggggatatgttgctccacattcattgcgcccataacggactcgttctgacccctgatgcaagcggtcagcgatttgataaggctcccgttgaccgcttctcttataacagcccatccctgctgttgtctgccgactaa

SEQ ID NO: 5029 - DNA, 612 bp, Enterobacter cloacae
tatggtaagcacaactggaaaaatatgttttcaaagcctatgaccactttcacaccagaacgtattgaacaaattttggaatttgccgagggtagtaacccaagcgaagcaatgagtctcagagctgacgaagttgctgtactggcacgtattggaaaggcagttatgtcgattgcgcctgtttatcagtgcgagttttgccaccatgacgcaaccgggcaacttcagtggcactgggaagatgtgaacaaagctttttatgataaatacgatccagacagacgcggaagacgtcgaatcctctataccgccccgccgatgcctttagtttcggctgacctgcttaacatggcttcatctgctattgaagacttgctcactaacaaagacagaagtggtgcgggaatgtggaatgacattccagaacagctacgacgcgcagcagaactggtaatggataatagccgggccgctgaaacagaagcgatgctgatgcgtctttatgtagaatgtgacacaggtgagcgcaggggcaacggcactcaatctggcgtagcaatgccttcttggcaaaccgttgaagaggcacgtgtgttgctaggggtgaaatga

SEQ ID NO: 5030 - DNA, 198 bp, Enterobacter cloacae
gcttttcctaaaggtcactatgttcgtaaaagtataaaaaacttctccatatggtgctcgaaattacaaatctataatttgcctttcgacaaaccttattgtgcgttcaggacggaaatctttctttttggaattacatctgacatttctgtggtgtccaaactggcaacgattgcaaaacttataacattagcctga

SEQ ID NO: 5031 - DNA, 237 bp, Enterobacter cloacae
gcgacctcgcttagcgagcattgcgatggcatgcatgacatgtttaacgtcagagcgtttaaggaatggtggattcataacgataacatcaaaagtttcatcgggctggtacccaagaaagtcggtatgcaccagctcgactcctgtgctaaggacactatcgttcttcactgcaaggaatcgctcatcgttcaattcgatcccggtaatcaatgcatccggagccgccagttttaa

SEQ ID NO: 5032 - DNA, 567 bp, Enterobacter cloacae
cgccaccgccccggcggcaccgggcataaaaggaaaaccattttgaaaccgatgctcaaaaaagattttttttcagctattgaaaaccttctcaaagctggctttcaacctcgcttttacactgttaacagtggccgaatcggtctcattacattcactgataaaaatggaacaaaacaggtcgaacaggtttattcctgcacttctttagccgccaatacttttggaaagcgcttcaccacttggttagaagaaatttttcaaaagcataatgaagaaaaagtagctgattccgggttcgaggttggtagccgtgtctgggataaattgatgtatacgttgcgcaccatttcagaaattcgtgccgggggggtgctggtgctggataacggtgcacagcgtacactggatgaagtgcaaaaaacggcacctgaaacaaaccaggtggagccaaaggaaatctcttcacttcaggagctgctgaacgcttccaaaaatctggagccgacttcgcctgagctaattgcggctcttaatgaggctctgtcaaccgccataaaacggtga

SEQ ID NO: 5033 - DNA, 216 bp, Enterobacter cloacae
ccatgtacaaagatgatggagaaacaagtggccaaaaataacaacagtctcaaacagcatgtcttcaatatgctgtcggctggcagcgaacttaaagaagtgaagcgttttctcaccagcaagcgagttaaagcccgcctggcagtgtcaatgatccacgagcaggcgattgctgtgcagaacactgaataccagaattatccggcttatagctaa

SEQ ID NO: 5034 - DNA, 726 bp, Enterobacter cloacae
tgtgtaccttactggcattgtcattgtcctccgagtgtgcgttcagctttgggaggacaccggaacttaatgcggcgagtcacggccattgtgaatctcgattggattggcgaatacggcttccggttgggccagatgtcaatggttatgcttcatccagctcattactgtagtcattgccgttcagctgagctgatgctcctctcattctatgtggcgacaacggtagtgagcccagaaagtgactaccgttgtcatggccgtccagtagagcgggtcaacctcttaaatcacagggtgacaacggtattgagcccagaaagtcactaccgttgtcatggacgtctggttaagcggatctacctctcaattcacagggtgacaatggtagtgagcccagcaagtcactaccgttgtcatagtcgtcccgttgagcagatcaacctcttaacttacaggatgacaacggtagtgagcctattaagtcattaccgttgtcattgccatccagaagagcggatgatcctctcaattcatacggcgacaatggcactgagcccagcaagtcacttccgttgtcatagccttccagaagagcagatgagcctcttaattaacagggtgacaacggtagtgagctcattaagtcattactattgtcatggccgtacagctgagctgatcatcctctcaattcacacgccgacaatggtagtgagctattaa

SEQ ID NO: 5035 - DNA, 432 bp, Enterobacter cloacae
atggcgatgaataaaaaagaacaagccgcgtatgatgagctggtggcacaggccagaataaaccgcgctttacgctggtctgactatggcgttgaacgcgatatgcccgtaccagaggtctcgggggaataccaaaacggctggagcttcaacaccgccactggcactgtttatccgacatggagcggaactacggttcacggcacacgggaagagggagaggttgtcgatgcaacctcccgccgcatgcgaggcatgaatggtagccagaacggcataccacaatacagcaccaaagaacgcgccctgaaggcattacgctgttcgcttgaaatcaagtttgccatgcagctggatgccatagataaagctatcgcaaaagaaatagagctgtccaccgctcgccgggagagcgatacatcagatgcctag

SEQ ID NO: 5036 - DNA, 633 bp, Enterobacter cloacae
cttttgctggatctgccgccgtctggtgaagacgtaacagtagatgggctggagaacgtccgtatacagctcaccgatgctctaactaaaccatccttaagccgtatgactcttcgcggtggccctgtttctgatgcggtggaattgtcttgggtgaatctgggaaacaacctgtatgcacctaattatcccaagatctttccgtctcttaatgaaggcgaaacatacactctcacagttcaggccaaagatgagatgaacaacgttaaagaaagctcagtcgaatttaactaccttccaaacaatctcgtcaggctagagaatctgaaaaccttagctgtcaatgcttctctcaaaacatctgacaatactcctctggctgttctgtatgccagccagctgcgtaaaaaggatggttcaatcgctacagggcttcaggacgcagtgcttactgtccgtaaggacgctgcattcggcgtgactgtaaatggtgtttctgcgatgccaggtgaaagcaaagagcttcaactggatttggggctcggggacagccgtagctttcctattttccctgctgtatccggccttacaggcagatctgagttcatgattaacattgaagaattaaaataa

SEQ ID NO: 5037 - DNA, 294 bp, Enterobacter cloacae
agctgtccaccgctcgccgggagagcgatacatcagatgcctagcggtaaaccatcaattcaggcccgtgatcagaggggccttaacgccctgaaagaggcggttccagcgacggcacaactacagatgcgggttacccctgaacgtaaactgcgttacgtcaatcaggcaaaggccgaaggtctgggtctaacagactgggtccaaaagcatatggataacgtgtgtgatctggcaggccagcctgaaataaccatgtacaaagatgatggagaaacaagtggccaaaaataa

SEQ ID NO: 5038 - DNA, 228 bp, Enterobacter cloacae
ccgttacgaactgttacctcattacaatttattaagtggatctatatttataagcccgcaacgctgaagagcatcgtaggtatttttcttttcagctgttctgttgataacaagatcgtggtcaagagacagtattttctcgtcgaaattgcgcaaaacctcgtctatttttcctacgaattccttgtgctgtggcctgtctatatccccagggatcaaagactttag

SEQ ID NO: 5039 - DNA, 327 bp, Enterobacter cloacae
atccacttaataaattgtaatgaggtaacagttcgtaacggtcaaagagaggtgtgggaaatgagaatgttgcctgttttgcctgatgaatccttgttcagccggttttgtcggacaactaccgtgtacggtatgtccccatcttctctgttaacgatcattttcaacaaacctgatatgaacgtccatccaattctcaattcaggattaaaggctatttctcttcatacatccgaaagtgcagatcagctctggcatgaacagactttactccctctttttgcctgggcactaccaatcagtcgtaatgagatcctggacttcaac

SEQ ID NO: 5040 - DNA, 279 bp, Enterobacter cloacae
tcgctgtcatcggggataacgccgcggctgaccaccacggacagcccgctttcgtcatcgcgaatgatgttcatgctgttgtcctgccaggcggcaggaaaaagggtaaaggaaccttcctggagggtgtatttcataagtgaactcgggatgatttattcgaaaaataaaattaaaagcgctaaaatttataccgccaatattaattactgcttagcgactcagagaaatatgatcattagaacgttagcactttctttttttccgcaaaaactttag

SEQ ID NO: 5041 - DNA, 195 bp, Enterobacter cloacae
ctcctggtttattggcttgtggatatgttctcgtccaacctttggatgtcaaaatattatgaacatcagcgggttttttccctgttaatctatccacccatctttgtgttatacgatctttttgagaaaaaccacattttaacccccacggatccacccaccccagcgcattcggcgcatactggtaaaggttaa

SEQ ID NO: 5042 - DNA, 549 bp, Enterobacter cloacae
cttctggcactgagattcgtccatagtggaataaagattatgctcaaccgaattaccgtccagctcccggttgaggggctgcttttctggaaactctccggccgcgaggcgatgtccgagtcgttcgcgctgacgctgaccgtgctcggcacagacgcgcgcatcgaccgcagcaggctgctcggccagccggtcacggtgaccatcccgacgcagaatctgctgacctcccgctatgttaacggcaagattacccgcgtggcggtgagcgccgtggagctgacgggcacccgctatgcggtgtaccagctgacggtggagccggacctgtggccgatgaaacgcgaccgtaacctgcgtatcttccaacgcccaaacggtacgcagattgtcaaaaccctgctgggtgagcatcaagttaaacctccaaaaacaactcaccggcagctaccgggtgtgggactactgcgtgcagtatcaggagtcgagcctggacttcatcagccgcctgatggagctggaggggattgcgtactacttccgccatga

SEQ ID NO: 5043 - DNA, 459 bp, Enterobacter cloacae
atcatcccgagttcacttatgaaatacaccctccaggaaggttcctttaccctttttcctgccgcctggcaggacaacagcatgaacatcattcgcgatgacgaaagcgggctgtccgtggtggtcagccgcggcgttatccccgatgacagcgactacgaacaagagtttcaccgccagtgggacgtgctgcgtcctcagatgggggaaattgcacagagcgaatttcagcacgtaaaagccgggccagacggaaacattagcggactggaagttgagaccacctttgaccgtaacggccagcgcctgtggcaaaaacagctggccgtgcagacgccgggcaaaccggtactgatgatttttaccctctcggccttaaaagcctttacggaagaggacgaggcgcgctggagcgcactgaagcagagtctgacgctaaacgacaaccggaatgtgtaa

SEQ ID NO: 5044 - DNA, 528 bp, Enterobacter cloacae
ccgattcacctgtttatgttgacggagttttacttaatgggggggtataaaatgattgattttaatgctgatattttatcaggaagagcactaggtaacgtttttttgggggataatatcagtaagtacataagcgagttatatgctggctataaggtaacttactttgattatttcttgcctgatgataagaaaaggcttgcatatattgtagatgacacaatgacaatcgctacccttgaagatggaacgatcatttctattggttgtaacgtaaactataaggggaggtataataaaatattacaaacaggccaaacgatgggggaaataatagggttgacttacaaacagcgtatatttaatggctgtattattataaatgacgactttggtttttcattcgagttgccagcgccatatgatgaaattgcagatagcattgcacatgttccactagatcttgttcttaatgaaatccgtgttgctgattactctgattggaacccacaaaaaataaaacgctga

SEQ ID NO: 5045 - DNA, 546 bp, Enterobacter cloacae
attataatgattactatggaggattctatggaaagtaggatgattaaagctacattcctcattgttcttccactattttcaatatttacctatgcagggcataataaaatgaatcaagattcgttgtggcaaatgattaaagaaatgaaatcagtgtggggtaaacaagttgaggatgtcagtaaactgtttaaccaaccgctgattaataatacacaggagaaagaagaccgttatacttcagctccctttacgttaactgatggcacacggatcagtaatgtggatgttcgtttatggggaaatggtgataacagcgtatctttggtttctttcgtagttaatcaaccatgtattactcttgatcaagtcaaatctcattttccggatctaaaattgtctaatatccctcgcggaaacacgccgggacaatcagttggatatcgcacccctaccgatgaacgcgggctggcatgggcatttagctttccagttctgaatcaggaatgcctgggcagggtagttatgtcacgctacgaacaataa

SEQ ID NO: 5046 - DNA, 186 bp, Enterobacter cloacae
aatacccagcgcccgtcgcagcgccgctgggattactactaccgcaataacttggtgcgcgaagagcgggacgataacccgttcaaatggtaccgctggcagtacgacagacagtgccgggcgtctcctggttcaggacggcacgctggccggagaggagcagggggtctgggatgcagccgctaa

SEQ ID NO: 5047 - DNA, 315 bp, Enterobacter cloacae
cggccaaacccgaggaaccgcaaaaaaccgcagacgcaggtcagcttccgctacgatccgctcggtcgccgcatcagtaaaacgcgacgccagaagctgggcggacagccaaccggcaagccatcaccacccggtgtgtctgggaatgactgcctactgggggaagcgcacggggatgtgctgttcacctacgtcgacgaaagtggtcaggacaactacgatttgctggcgcgtgtagatagtgttgatgcttcatatatcttctgggtccattgccaatccaacggcacggcacaacttataactgatatctaa

SEQ ID NO: 5048 - DNA, 246 bp, Enterobacter cloacae
tgtttttccataacaatcatatggaacaagaataaaagtctagggaatataatgagtgataagatcatgcaaacagtagatctgctaatttcacatagtcaaatattgttacgatccagagactatgacgaaaagctgagtcagtggggaaaaggtaatgtttctcaaggcgctgttttacacaaggattatgctgtattcgttcttctaccacaggggacgggcatccgcgcaatgcaatgcgaa

SEQ ID NO: 5049 - DNA, 249 bp, Enterobacter cloacae
ttacccttttgggtaaatagccttggtggaccggtaaaccgggaggaaacggggttgtttcgggaaattttcatgaaggcgcgtgaatcagttattccgtttccaataggaataaaggggttattatttcagtgggaaatgaggcctgtatttgccctgccggataagttagggggcattcagaattcatttattgagctgatgaatgtctacgcggaaaaaactgggtctgaccaataccacctttaa

SEQ ID NO: 5050 - DNA, 189 bp, Enterobacter cloacae
acactgatgggctttttaagacgctggttcaaatctcaggctcagtttttcttctggacctatgtcccgatcatcctcacgttcatttttggctatgtccttgacgtttacttccctgaggttagccagggattcatcctcctgttttacctggtaacactgggactggcttactggatatggcattga

SEQ ID NO: 5051 - DNA, 345 bp, Enterobacter cloacae
ttgatagggtgctggacggggaggcgccgtttaattgattccgtgcgctctggtgccctcatcctaaccctctcccacagggctgagggttccccacaaaataatgcctgcacagacggccccctctcccttgagggagagggctggggtgagggggaacatacggctctggtggtcattccgttcactttatgttccttgctactctgtcacgacatgaccggtgaacgtgccagggtggctcagtcgccaccaccctggcgacccgggcttccggcggaaaatcgccgcttcgcggtgccttcggcttattccttccggcttatcggggacgggcggaggtaa

SEQ ID NO: 5052 - DNA, 756 bp, Enterobacter cloacae
tgctatttcacgttattgaccgaaactatgacacacgccgtcagcccttcagaattatctaagttaccgacaaataagacaaaacgcctttaccgtttgcctgcccgcttttatggttatcagcttttcgtgctgatcgtccttgcgctgctttttacctggctttcgcgcgatgaatcgcttgaccgatggatcaccggcttctggtatgacgcggcgacgcatcatttcccgctacagcaaaatccgctgctggatctgctcaaccatcggctggcgaaatatgtggccattgccctggccgtcatcgcgctggtttacgggacttacagacgcaatgcccggctggtgacagccgcgcttctgatgggtctgggcgcgctcgttgtaggagccctgaaaagcatgagccaccacagctgtccgtgggatctggtggagtatggcggcaaagctgtctcgtatcccctgttcagcgcgattccggcagacagcggaccgggacgctgctttcccggcggccacgcctcaagcgggtttatggtgatggggctgttttttgccttctggcgtgaacgtccacgcctggcctggacctttgtcgcgttgggcgttgttatggggctgctgatgggattcgggcaggtcatgcgcggcgcgcattttttctctcacaacctgtgggccgggtggtgggtctggttttcccaggtgctggtttacgggctggtttccgcctggtttgctaaagagtaa

SEQ ID NO: 5053 - DNA, 726 bp, Enterobacter cloacae
agtgcgaggtcagtaagcatgtaccattctgaagagatcatccgccagcttcagagccaaaagatactggcaatgaagctggaccgggcggtacgtgatgtaggtgaagaggtaaagagccacctgaataatataggtgccggtgcccaacgcctgctgtactacacctcctgctttactgatgaatattacgatgtatgcacccgacaaaacctggaggacgctcgattccgaaagggcatattccatctcatttctcgctggaacatcgtctttgacctaatcaacacgtacgtagaggagctggttaaggattattccccggcagaattatcagcgatacagcatgctctaatgcgcgctaacgtttatatatccaccagcacgctaacctcgtattcattctctgcaggcgtcgcatcgactgtttgcctctatgtgacccttccaccttcagggttaaaggtcgtttcaggattaacgggcgcggctattggagggctggggatatacggggttgtgcaaaaagctgctgacagcgctcatcgcctgcaagtgatgcatcccgcctactatcaagcgttatacctgcaagaactggagatgatgtatttcctggtggagcctgcttttatgcgcgcgggcgtgctaacccagcaatggactgacagtcaaagcccttatgatgctgctgacacgatcctgaagctaatgggtagacactga

SEQ ID NO: 5054 - DNA, 1917 bp, Enterobacter cloacae
agcattactgataaggatcttaccccgatgaaaaaaatgctcactctctcgctgctggctctctgcgtttctcatggcgcggcggcagcaaactacgcgctcagtaacgacaatattgccctttcgtttgatgatgcaaatgcaacggtagtagtaacggacagcaaatctaaccatccgctcacgccccaggagctgttctttctgacgctgccggatgaaacaaaaatccacaccgctgatttcaaaatcaagcacgtcgaaaagcaggacaatgcgatagtcatcgactttacgcatccggattttaacgtaacggtgaaactgaacctggtgaagggaaaatacgccagcatcggctacaccatcgccgccgtcgggcagccgcgggacgtagcgaaaattaccttcttcccgacgaagaagcagtctcaggcaccttacgttgacggggcgattaacagctcgccaatcgtggccgactcgttcttcatcctgccagacaaaccgattgtgaatacttacgcttatgaagccaccacgaacctcaacgtggagctgaaaacgccaattctgcctgagacaccggttagttttaccacctggttcggcactttcccggaaactaatcagctgcgccgcagcgtaaaccagtttatcgatgccgtgcgtccgcggccttataagccttatctgcactacaacagctggatggacatcggtttctttaccccttactccgagcaggatgtcattgggcggatggacgaatggaataaagaatttattgccggacgcggggtggcgctggacgcgttcctgctggacgatggctgggacgatcgcaccggacgctggctttttggcccggcattcagcaacggttttggcaaagtcagggaaaaagccgacagcctgcacagctcggttgggctgtggctttctccgtggggcggatacaacaagccgcgcgatattcgcgtctcgcatgcaaaagagtatggttttgaaaccgtagacggcaagctggcgctgtcggggccgaactattttaaaaactttaacgatcagatcattaagctgatcaaaaacgagcacattacctcgttcaagctcgacggaatgggtaacgccaattcgcatatcaagggcagcccatttgcatcggattttgacgcatccattgccctgctgcacaacatgcgcagcgcaaacccgaacctgtttatcaacctgaccaccggcaccgacgccagcccgtcctggctgttctatgctgattcaatctggcgtcagggcgatgatatcaacctgtacggccccggcacgccagtgcagcagtggatgacctaccgcgatgccgaaacctggcgatccatcgtgcgcaaaggtcctctgttcccgctgaactcactgatgtaccacgggatcgtcagcgcagagaacgcttactatggactcgagaaagtgcaaacagacagcgattttgccgatcaggtctggagctacttcgcaaccggaactcagcttcaggagctgtacatcacgccgtccatgctgaataaggcgaagtgggataccctggcgcaggcggcgaaatggtcgcgtgagaatgccagcgtgctggtggatactcactggattggcggtgacccaacttcgcttcaggtttacggctgggcctcatggagtaaagacaaagcgatttttggcctacgcaacccgtcggataagccgcaacgttactacctggatttaaccaaagattttgagatcccggcaggagagcgttcgcagtttaccctgaaagccgtgtacggcagtaattcgaccgtaccagaggagtataaaaacgctgtggtaattacgctgcaaccgctggaaacgctggtgtttgaggcgatgccggggaaatag

SEQ ID NO: 5055 - DNA, 296 bp, Enterobacter cloacae
cctccacatgcatagcgcggctccttccgccccctgtggtgaaaatatatcctggccgtactggtgctgggggccgcacgcgtctggctgttcccgcatgcggatggcgctatcgacaacacgctgatgtgggtgattgcgatggcggtggccggttgcctgttcgtgatcccaaccgcggcggagatcccgattattcagaccatgatgatggccggtatggggaccgcaccagcgctggcgctgctcatcacgctgccggcggtgagcctgccgtcgcttatcatgctgcgtaa

SEQ ID NO: 5056 - DNA, 372 bp, Enterobacter cloacae
gcttgggcgctcggtttcaaagcgattaatcatgctggcagcaaaatgctgtgcgttggcggcggacgtgccattgccacaacagaggattttgttgccgttgagcagcgactgaaccagtgtcatcgctgcacgcgagatcgcgtccggaagggcttccgccgcggcaatctgcgtttgaatgctttctgtgaagcacactttaattcgttcgagcacggtatccctttaaaatcttatttatgcgtcttcgccaaacgcgtttttaagccagtcgatcgcatttccggtgaaggctaccacatcgaaacggcaatccacagtatcaaaactcccattatggcgggcaagccacaagtgggcagtctgtaa

SEQ ID NO: 5057 - DNA, 405 bp, Enterobacter cloacae
gtggataacgtactgcatcagcatagctggaaacgcgcagcggcattgaccgcgctgtttgcgatcctgctgatcgtcgtggcgccgctgatctccgtctcgctgcaaaaagatcccatgagcgccatgccgggcatgcaccacgacatgagcatgatgtcggtggacgagcatcatggtgatatgccgcattctatgccagttgaccatgctgaagcatgcggctactgcgtgctgttagcgcatgtaccgggcgtgatgctggcgcttatcgttctgctcagcgtggtgttgcagcggctgcgcgtgaagccgcctcgtcaggcggtcagccactggcactttttcccctggctttaccccgatacccgcgcgccgccgcgtcggtctgctttctccctttaa

SEQ ID NO: 5058 - DNA, 279 bp, Enterobacter cloacae
agaggttcgataaattggttgtcgtgccccagtgcaagggactgggcatcggcgagagcaagctggaatttattagtaagacgatccagacgcataactcctcccataacaggtcaaatttgctactggagattaaatgaggtcatccctcaattattcaaggttaataacctgaattatgtgaaaagaaaacggcgcgtaccggatcgtcttgattctttaggttatatcagccaaatgaaacttgccatacggcctgtcgtcttgtcgcggcgatag

SEQ ID NO: 5059 - DNA, 291 bp, Enterobacter cloacae
ctgctgaaatgtaaattcatgagcgcgctcaggatcgagctggaaaagggctttacgaacgaaggggtagtacatgaactctcctggattcccggtgtgcaaaccgggaggggattatgtgcgatcccgcccggaaagggaattgacctgtggcaaaaaaagccacgtaaaacgcaatcgtttacttatcggttcgcttcttatgcatttttctgcattcatcctgaggataaatcatttagtggaataaccacgcaatgtcacactcctgaaaattgttatgaatgttag

SEQ ID NO: 5060 - DNA, 183 bp, Enterobacter cloacae
tcggggttcaataaatcactaaacagggtatactccggagttgtttattgtactaaacgctcccgtgagaggatgctacagcgcacctatgactcaattcgcttctccggttctgcatacgttgctggataccgacgcgtacaagctgcatatgcagcaagccgtgtttcaccactatcatga

SEQ ID NO: 5061 - DNA, 381 bp, Enterobacter cloacae
acaagcctgggaacaggtgggagtactgtaatgcaggtaccggaactgacggatgacgccgtggttgagctggcccgggaaggcggcgtcgcctttattcctaagctgagcggtcagcgcacgatcgccctctccacgctcaacgaggcgcagcgtcagcgcgtggtgaatattctggaacaggctatcccgcgcggacagccaccgggccaggcgtcgtctccgggcagcggcgatcagcgctattttcgcattcagataatctggacccggcacaatcaggcgcagtataccgatattattgtgctggttccggagcaggaagcgccggaatcgctgatcgagctatggcaaaaaggagaaggctgcgtgtgcgattaa

SEQ ID NO: 5062 - DNA, 315 bp, Enterobacter cloacae
cggttcatcaagggaatactccgggtcgatatccacgaccacacccaaatatccgagcaaggtgtggcggacctgctggccgataccgaatttgctggcaatcatagtcacctcccgggaaacattacatacacactatgtgcgggcaatatttctcttttcaagttacatgacgcgacaggcaaaccctttcagatacagcccttccgggtaggtagcgatcaccgggtgatcggcggcctgacggaactgctctataaattgtacatcacgacccgcatctattgcggcatcggcgatgattttttggaataa

SEQ ID NO: 5063 - DNA, 852 bp, Enterobacter cloacae
tttccccttcgtgacagcgatcataaattcagcatcccgatcttttctttggaaccggttccatctagcgtaatactatcgattacgctctggagtcaggaaatgagcaggaaaattatggtggtcaccgccgcgtatggtgcggatcaggtgcgacaggcaggcggtcaacgggcaatgcttcccgttattgccggcgcaggggctgatggcgttgaaatccgccgagagctcttcagccacgacgagttaatggccctgcctgcgctgggcgagtccattgaactgctgggtttactggcgtgctactccgccccggcccccctgtttatgcccgatggaaccctcaacccggatcttccgcgctaccttagcgaagccagcgcactgaacgcgctgtggcttaaagtttcgctgggtcatttcagcgacaaacaaccgcttgaagccctgcgcgcactgctggatgaaagcggcatgacgctggtggtggaaaacgaccagaccgactgcgggcagctcgcgccgatgcagcgcttcaaagccgcatgccgggtaatggcgctgccggtcacactgacgttcgatatgggcaactggctgtgggttggcgactccccggaagaggctgcacgtcagctggctcccgccgtgagctatattcatgtcaaggccgcagtcccgcataaggcgcagttccgcgccgtcgcgccggatcagaccgattctcgctggcgggatctgcttaatcaactgcctgccgacgcgccgcgcggtatcgaatttccgctcgaagggacggatctcaccgccgtcacccgccattacgtcaacctgctgcgcgaggagtaa

SEQ ID NO: 5064 - DNA, 288 bp, Enterobacter cloacae
atgacaagcgttattttcatcaagcataaaaaaaccccgccgaagcgggggtttttcttattccgtagcagcgaccgctgcgctccaggcctggctaaaggcctgatgctgggacgcgagcggaccgatcagcgcgttatactggctcgcctgctgggaggtcgggaactggataccgttagagacaaagctcacctgcgtaccttgttcactaataaagtcacccacctggaccaactgctgagtaaagacctgcgccgccgggatcagcggttgcaaagcgtttga

SEQ ID NO: 5065 - DNA, 747 bp, Enterobacter cloacae
ggtggcacaatgaacgacgcaattatcacggacaatgagcgtattaacattgaaccaaaagatgtaatggtaaaaggttcaaataaaaagcaaggcgtaaacgctcaaacttctactcaacgtagaccagagcaccagggtatggccaaagttattattaaccccggcaccccagactttaaccggtttttaactgccagaaatggagcagtcatcagaggttttgatgatgtgagtatcgctatttcctctctctttaaaacggttgatgcagttaaacatcctgaccttgttcaggctattcaggattggttcaacgagctgcatgaagaaaacaataagatgaaagaaaatcttgttgcttatattaagtcaattgagttcgacaagaatgactcattcatgtcatcaactcagtttgtacctttcagttttgaaccagtacaactcaacttcaataaccacaacaccatgaggttttacaagtacatcttcgagatgaaccagctcatgaacacaatgtatgagtacaactcattgggtttactggctgtaagcgactatccggttatgtctcacaacattataaagagtattaatttatatgttgagaatgtgaaaaagactctgaatgtttctcgccgtaaggatgggccatacagtccagcagagttcatcaccaaagtaatgcaatataaaagtgtgcaggcatacattgcagccgaactgtcaggcaaacgtcgataa

SEQ ID NO: 5066 - DNA, 924 bp, Enterobacter cloacae
ggtatgatgatgaatttcagggcgctgtatttatgtattaaacggattttggggatattctcatctcaggagaatgatgcaacctctgtaatgattgaggatatatcaagcctctctccttttgcgcagattctaggagatcagaagtacactgttcctgatcatccaaatccagaagtcctgaaattcatcgagtatccaactcgtccgacgggcatacagacatttaatgaacagtcaatcctgtctctgtatcgggaaaagctgcactcaatttcaatgatgttagctatcagcgatagcgacatcagggacgatgcatatacatttactaatttagttttaaagcccttggttgaatatgttcgctggatacatcttttgccagcttccgaaaatcatcatcataatggtattggtgggttactttctcacagcctggaagtggccatactctctttaaaaaatgcgcatcactcagaactgagaccaatcggatatcaagatgaagaagtagtccgtagaaaagtatatctctatgctgcgtttatctgtggtttagtccatgatgccggaaaggtttacgatctcgacattgtaagcctgaatttagctagtccgatcatttggacgccaagctcacaaagtcttcttgactgggcacgtgaaaatgacgtggttgaatacgaaatccactggcgaaagcgtattcataatcaacataatatctggtccagcgttttccttgagcgaatcctaaacccggtatgtcttgcatttttggatcgggtaaataaagaacgtgtttattcaaaaatgatcaccgccctaaacgtttatactgatgggaatgactttttgtctaaatgcgtgaggaccgctgatttctattctactggtacagaccttaatgttttacgttga

SEQ ID NO: 5067 - DNA, 624 bp, Enterobacter cloacae
aggcccctcccgaatgggggaaacagcgagtgcattacatctgttcaattccctcatcaaagagcattcaaaaatcttctgttcgtgaaaaaaaacggaaatttcctccggtatagtaatttcacatcaggaggcgtcatgagtaattcaaatcttataagttctatagagctaacacgtaaaaatttacgtgctcagattgaaggtttgcgtgttgaggctgaagatctcattacaaaatactggatcaagtggaaggaacgaaaccaccaagagattaaccttacccgacatagcaaagttccaaagagggagtacctgggttcttacgcaccaaaagttgagctaattggtaatgccagaaaagtaacgatcacttggcatcagttcagcccttataaaacaagagcgcctagccacatgtcaaaacgggtgcaaccaatgaaaagtggaaaatattctaagaactgttttgtaaaccatgccagctgggaatacgaaatgatttctgaaacggaagcattgctggagccttacagagaaatgcttgagctctatcattcagcatatatcgaacttggacgaaaaatccgtcaatactcaaaaactaaggtggcacaatga

SEQ ID NO: 5068 - DNA, 183 bp, Enterobacter cloacae
cttaatataagcaacaagattttctttcatcttattgttttcttcatgcagctcgttgaaccaatcctgaatagcctgaacaaggtcaggatgtttaactgcatcaaccgttttaaagagagaggaaatagcgatactcacatcatcaaaacctctgatgactgctccatttctggcagttaa

SEQ ID NO: 5069 - DNA, 192 bp, Enterobacter cloacae
tcgagcaaaatctcaatcgcattcggcaccctcagtaaggttaaaggcaggagtgttattgatactcgttgtgaagaggtaatgaaaccccctgcaatttttaacaaatctttcttcgattccaaatcaaaaagtaaattattgacttttataacgtcattatctgatttagcattcaagacaaaagaatga

SEQ ID NO: 5070 - DNA, 336 bp, Enterobacter cloacae
ctggagcagtttcaaagagtatcgctgtttgcgttcccctggctgttcccgattactgtttgccgcgtcaataagtcgctctggggggaaatagtgtgtagtgcagatgcctttaatgcagatgatcaatggtacgacgtggtcagaagggccgataatgcagttatctatagcttcccggcggaagggagatatctggtttatcgagtaaatggaatagtttcattacgacccttactcgaagaggaagaaatcttcactcttaacgggtttatgcaatttgcaaaacggcttgggtaccgaattacaccaccgtctgatatcattctttcatag

SEQ ID NO: 5071 - DNA, 621 bp, Enterobacter cloacae
tgcgccacggagagaaccatggcgctagaattacaacttatcaaacaccactcaggaatactgatcccggcaacccccgagaccagcgatatcctgcaatccaaaacccggctcggcgatgttcttgttgccgaattcaggcgggttcgcaagccggcattccatcgacgctttttcgcgcttcttaatctcggatttgaatactgggagccaaccggcggggcgatctcaagtaacgagcgtaagctgattactggctacgccaagttgctggcttcgtatggtggtaatgagggggcgctgatcgatgctgctgagcagtatcttgagcaggttgcataccgccgggtcacaaacggcatcagcctctgtaaatccttcgatgcttaccgctcctgggtgatcgtcgaggcagggcactttgatgccattcagctgccagacggaacactcaagaagcatcctcgtagcatctcgtttgccaacatggacgaattcgagtttcagcaactctataaagctgcgctcgatgtcctctggcgctgggtcctgtcccgttcattccgcagtcgtgatgaggccgagaatgtcgccgcgcagctgcttggcttcgcggggtga

SEQ ID NO: 5072 - DNA, 198 bp, Enterobacter cloacae
gcggaggggcgattcagcaggacatttctccagagtgtccaaccagcgcgcggaaatgaatgctgtgatcatttccaccgggaggcacccggcaccactccctcagttattgccaacttagctatttatgcctgcttttccgagcaggcttttttttcatttattaatcatccatttgacctgctccccgttgattag

SEQ ID NO: 5073 - DNA, 189 bp, Enterobacter cloacae
aagcagatggcagggcatagtgaggaaatggtctgttatgagcgagaagcggactctaccgtggattttatcaacactcagggtttgcttttaaaaattgttatccagttttactgcatgaggtatcccataattgtcctaccgttttactcatttattgtctcttttatctatgacatcaatggttaa

SEQ ID NO: 5074 - DNA, 297 bp, Enterobacter cloacae
atatacatactcgcgatcttatcaagagtggcatgtccgtcgaaaagattgtattgtgcctgttctggcgagaaccttcctattttattctccggatatagagcaagcttgcccttttcatgggcggaagaagttacccgtgttagtgaaacacatgcttccgatgaagcatattccgcagcgctttctgtattcggtgaaaaagatttggttgaacttaccattgttattgccaccatgaatgccattaatcgtatgggtattagttttcgaatgaagccgcttgctaaagcttga

SEQ ID NO: 5075 - DNA, 261 bp, Enterobacter cloacae
gcgagtttgaaatcgccaccactggcggttaagaggcatctcatgaaactacgtatcacaagagcaatcggcctcagcaagttctcgccacgttgggttaaggttatctgtttacggttgactaaaaacgatattgagcgctccctcaacgctcttctggccacaatcgatgaatctgaacttacccctgagcaagtcaaagcattaagggaatgcattgacagaattaacatcgcaagggggaagggtatgcaggcgtga

SEQ ID NO: 5076 - DNA, 822 bp, Enterobacter cloacae
tggcgcaaggacaatcagcacacgtcagaatctgataatttaagtcgtagcttactcggtaaacttttccgcagtgagatttcgcttattagtagttaccgtgcatgtttaatgttattgcttgtgcatggatattctgcatatcaaactgggactcctcttctccagcgtcgcctatttgggaaaggatttagtacagccgctgatttagcttttgaagtggaaacacgtccaggtagttttttggttccgcgtacactcggaaaggaaattacatgggagaggtttttttctgcggtcttggacggtgattccaatgtaattcgtgaatatgatacaaatgatattgactatggtatttacgatgccggtgaaaaagtgacttttctgaatggtacagtggatatctataatcccaagaagattcatgagttgcgttctaaatgtgttgatatacagaatgactactttatgcaggtgttctttatctcaatgctcgcaccagagtttgtaagtattttctttggtttaaaaccaactacagctgatgctattaaagacattggttattcatcgttaaaaacaattaacgatgtcgttcttttcccacgtacaattgctttctcacaagggcatattgaagagagtgtttcacttaaaacgaaagtttttgcctgggcttatgaattgtctgctgacatccggttaggaaaagttagtgatgatttgatggaactattacgttatgacactatgttcaccagtcaccgtcaggatgtgttcaacactttaacaaataaagttatgttaaaggattattga

SEQ ID NO: 5077 - DNA, 453 bp, Enterobacter cloacae
ggcaataaaatgaaaaaattaatgatgttagtcataagtggtaccgtgcttgcaggttgtgtctcgcctgcgcacgccataaacgcccattatcgcgctcaattagagcgttcgggatgcacgcaaattagcgctggcaatggctcttgcgatgtcagcaaaaccaaagcggaaaacacggcacaacacgaaccaacggcatccgttcacgatcccctgcgtgaagcctcgttctcgtcggatacggttaacgccacgctttctaacggcttttttagcgctaccgtgaacggcaaaaaagccagcgttaaacgtctgaatgcgaatttctatgagatccatggtaacggttttgtgatatcgataagcctggatgaaaacggtattacggacgcgtcatggaataaaacgaagggacgcgaacacggcgttttacgcgttagtcagaaataa

SEQ ID NO: 5078 - DNA, 225 bp, Enterobacter cloacae
ggggttgttttagaatggaaagaatcatttcggtacgtattcgataatcaatactataaaaagatatttttactcaatgaaaaacacaacagtcttttcgatattgtttttaattattacgccattatctggctgcgtattttcaccgggtcagcatctggatcttgctggaaaacaggtgatgaccacagaaaatgcaaacgatcgtctggagaagcggattga

SEQ ID NO: 5079 - DNA, 276 bp, Enterobacter cloacae
aaagttaaaaaacagatggggcctgaaaaaaacgccgccaatatagagccttttgtcaccgggctcaatggtttatttgtttactgttttgtgacacagggcacagggcagggaagaacgccgtttgtatggggaagattgcactttatgctaaataaaaacagcagcttacgtatgatttgtcagcattgtaaaatcagacaaaagagtgtgacaaatcgtgcgattggcaggcgaaaaggaggcagagagcctccttacgctgtttatttctga

SEQ ID NO: 5080 - DNA, 291 bp, Enterobacter cloacae
atttatcacttccatttatggactttggttattgcattttataccttctcttttgaatcaattttctgcatcattgataatattaacttttcgcttcagggtgagcttatgtctaacattgatgcaacagccgtggcgcagcgtattgatactgtgctggatattcttgtcgcaggcgattatcactctgctatccgtaatcttgagatcctcaagtctgaactgctggctgagaacggcgctgataacgctccagaatccactcaacctaaagccccgtgggaagtgtaa

SEQ ID NO: 5081 - DNA, 222 bp, Enterobacter cloacae
cagctggtcgccaaacatatgcccataggcatcgttcacttttttaaaattatccagatcgaggtaaactacgccaacctgcgtgtcaccccgagcggtgatggcatcagagatcagctcatggatggcatttcggttaggcaaaccggtaatcgtatccgtattggcgagaacgcgcaggcgctcctgggcccgacgctcctcggttatgtcggtacctga

SEQ ID NO: 5082 - DNA, 336 bp, Enterobacter cloacae
agagaactgattatgtcacaagaattagaattttcgcttcatccacccgtttggcctgccatcgtctattttgttgtatctgttgcaatttttttcttgctttatctcgggaaactaaaagttaacaggctgcataaatacccgctatttatcgcatatctggtgtttgtaatcgctgttgcagccgttcagataaacatctttgctaatggctacgagtttgtccgcagctttttgcatatcgattttgacccctatcgatatgactcggtatattggggatcattgtttttctccataatttacttgctggcgttgccccggaacaagttttag

SEQ ID NO: 5083 - DNA, 192 bp, Enterobacter cloacae
aaagcggcctgctggcccttgccgttcagggaagctattgcgacaggggatggctactacctcgtctggccaaaaaattcactcaaaagagagagcattcagcatcttctggcctggctgcaaaaccataccccggtcgttccggcgctggatatcgattatctggaatacgatgacagtcgggtttattaa

SEQ ID NO: 5084 - DNA, 720 bp, Enterobacter cloacae
aagtgtgtttgtttgatagtaaggttaagtggaaaaagtatccacagcgggatcgcccgccatgcattcaggagagacaagatgaaaattgcactgatgatggaaaacagccaggccgctaaaaatcccatcatccttaatgagctgaaagccgttgctgatgagaaaggtttcccggtctataacgtcggtatgagtgatgagaacgatcatcatctcacctatattcacctgggcatcatggcgagcattctgcttaacgctaaagctgtcgattttgttgtcaccggctgcggtaccgggcagggcgcgttgatgtccctgaacatccatccgggtgtgatttgcggttactgcatcgatcctgcggatgccttcctgtttgcgcaaatcaacaacggtaacgcgctttctctgccttttgcaaagggcttcggctggggggcagaactgaacgtacgctttatctttgagaaagcgtttaccggacgcaatggcgaaggttatccaccagagcgtaaagagccgcaggtgcgtaacgccgggatcctgaaccaggtgaaagcggcggtggtgaaagaaaactatctggataccctgcgagcaatcgatcctgagctggttaaaaccgccgtctcaggccagcgcttccagcagtgcttcttcgagaactgccaggacaaagagatcgaagccttcgtgcgcggtattgttggctga

SEQ ID NO: 5085 - DNA, 501 bp, Enterobacter cloacae
atagtcataatgagaggaaccggggcaaacatgacacttgatgctttatttcagttaatgaaaattatatcgccatctgaaactccatcagatggcaatttagcgaattttatgaccatgcttatctccactaaaaatcattctgacgcccttttaccgttttcgcagcgcgcgtatatgctttcagttgcctatagcgatccccaaaaagcagctgcgttgctttcatcctgtcagcccggagcaggtaacccactcccgctactcaacttctccggctggccggacgtgcgttacgccacgtcgggtgaattacagacgcccgagtctgaggactattttcacaagatttcgtctgccgccacgctattacgcgcggcaatcattgatgctgagcaacagaaaaacacgccagcattttatattctggataaggtactcagcctgaacagcgctttgccagaacgttataaaaagatggcaaacatatcttattcatga

SEQ ID NO: 5086 - DNA, 810 bp, Enterobacter cloacae
gaaacaattgcagttatggaaaatgttaaacagtctgcaccacctcctgattttgttgtcgaggcaatgggtgaatatgttgaaaaatatattacggctatacattttattccacgggatgatgacagggatcctcctggcgaccactggggcactggttggttagttgaagaatgcaatagaccccttcttgcgacttgtgagcatgtagcaagtaagcaattacaaggaatacttggctactcctgtcacggcagtgaatccggaatatcagtaggtggaaaatttactgtttatccttttgaattagattttgctcgtgctgatatatcgaaaacctttaatatggtggaccataaaggtgaatgcacgaacaaagaacattacgccgatagtcactcccctgttgcggatgaatacctctatgtttacggatttcctggcgttgatgcccaggcaggtttcggacaacacgaaatcagggggatgggcgtatttttgcgtgaagttgaatttgacccaagtgcttttaccgaggcaccagtgccagttttaggcgaacatatttcttgtgcctggagtacaaatcttgcttcaccattaatgggaacgaccggaaacttatctcttccagatgggatgagtggctcacccttgtggaataccagatataccgaggtaaccaatgcaggcggtatatggaccccttgtgactctcgcattacaggaatagtatgggggcattcagcaaaaatgactcgactcttcgccacgccagtagaatcatttaaagatttactttttaagtaa

SEQ ID NO: 5087 - DNA, 183 bp, Enterobacter cloacae
tccattcatgtggtttatccccggcaaaaacacagagggagactttacctacagtctccctgtgacagtaagtctaaaggtggccatcaccgtttaacttttatcaaactgactttcggtaaacggatctgcgcgaccgccctgcaatgggatcctggcaagcgctgcatcgatttcgcgtaa

SEQ ID NO: 5088 - DNA, 2016 bp, Enterobacter cloacae
ggaacaaaaatgaggggaagcaaagaaaaatctatgccggatgttctggactctgcccagttggtacgtattgaagccgtacaccggggattcctttatcagcacttgtatgccgttggctgcttgctgctggcacagaaagccagcgtggagacagtaaccgttgagctggatgaggatattgaactcaactccaggcaggagcgcatttacgttcaggttaaaacccgcctgaaacccatcattctcagcgatgtgtctggcgcgctcgcgcggtttgcggagctgcgtaacgagcacactgatgggcgccgccagggaagcgcttctttcgttatcgtcgccaaccaggcgccaggtccacatctgcagaagatgattgaggataagacgcttcctgcggatgtccgttttatctggccccagtcaaccgctgagcgctatcccgtacttccccctgcctgggacaccgtggctgatgcggccgcgtggtgcatcgcgcaagcagagcaactgaatttttcgttattgtcgccagaatccctgatctggaagctggccggtctggtccagctcgccgccaccggaggtgatgccgacggacagcatgcgttttatacccgggatcttcctgccctgttcgaacagctcatcgttcagttacaggacttccctgcaccgccgacactctaccggccacaaagagaggaaccctcttttgtgtctgatgagcggatacgcatcatttgcggcttgtctggtgcaggtaaaacagcatgggcagcacaggccgcccagcacagtacccaggtgtgtgcgtattacgacgctggcgaccttccgggtcctgcacttgccagtacgctggttcgtgagctggcagcccggtttgcgactcaggagcaaggtggcctgcgaagaatactgctccctggtgccagtggcgttgaagcgctgagaacgttcgacaccttcttgcagcaacggaacgacaatctgctgctggttctggataacgcgcatcgtatccctgtggagaacttgcgggatgttctacacgccacaacccgtatccattttgtgctgctgtgccagccccatgacaatgtccgtcaactggaggcgatgactggacttcagcgtgaatcgttacagggatgggatatcgacacagtggctgccgcagtggccgacctcggtgggcacgccagtgcgctgggatatgagcagctacgaagctacaccggagggttgccgctgtatgtcgaaagcgcggcgagagttgccgcagaggaatacaaaggggatatagacacgctgtgtgctgaactgcgacaacaggaaaacagcacggaaaccgcgcaggaagtcattctcagccgtgtctatcaggggtttgagccactggtccagaacgctctggcgttgttcagtctgtccgatgtggggctaagccgtgatgaagtttcagggtaccttgcccgctcattgaatatccctccaaacggggcagccacattaattaaaaaaatgcgggccaccggaaccattgaaaactatggaaaccagacgttaaaggtacacgatgctgtcagggcgctggggctgcaacacctgaccatgatggacgtggatatcgtaaataacgcgttactggcgttaaaagatcttttgattgagagccttcagcaagaacgcgacacttcgcgattttctcttctgacacaaatatacatcaagcttaacgatgtcatgacgctcatcggtctatctggtgaagagctgttttatgagatgggcattactgtcgacattatggaaagcctgaaacaggcgacagcttcggactctctggcgcccttacaaaaattctgggcactcgatggactggttttttccgagcttaaagacggtgtttctgagcaaattgcacaatggctggaagcgatgggagccttgcttacagaacatgagtttggctgcccggacagttatctgtgcaagagcgaagattaa

SEQ ID NO: 5089 - DNA, 324 bp, Enterobacter cloacae
gttcaggagactatgatgcgaattttatgtctggatatccccgcacctggagcatcgctggaaaaatatgctccacaccttaacgctgaagcgctacacgcctggggattgtataaatccggcttcatccgcgacatctacttccgtcaggacagacctggcgtcgctatttttcttgaatgtgactctgtcgatgaagcgatgaacgtaatggccgaattcccgctggcaaaagcaggcttattaagctttgagtgcattccgcttggctcctttattaactgggaaaatctctttgccgctgaatttaaaaataaagagtga

SEQ ID NO: 5090 - DNA, 555 bp, Enterobacter cloacae
aacttgcacagctgggaatggcatgactttgatcaagagagcactgaagtagaggctgatgaattcgaccaatacaattttgatgttgaaaaaaatgatgtagtgaccagagaattttgggcaggctcagttgccactggtcatcgctatgctatcggttttgtaaagtccgaaaaccatagcatgcttaatagctttttagggaatgcccaacacaacggcaagtcgttgaccataccagaaagtggtgcttgggtggtctcgtttgacctggctgatggagaaaatagctatgagcatgttgagcttgaccctagggctctaaggaatttagtggatggtgttgctcgtgcactttatgaccattacaatgtttctaaagcgggtctttatttctggattgcagccagagaagaactagtcagcatctatgataaagctttgggcctggtcccggaaaagacgttaaagttgaagcctttacctttaacagaaaacctcaatcagttaggcgagaacgggaggggttatgccatcatcacgaaatactactga

SEQ ID NO: 5091 - DNA, 606 bp, Enterobacter cloacae
gcgagaacgggaggggttatgccatcatcacgaaatactactgaaaaccctacagccgatcagctgtacgaagaagttacccgtaagcttaagacagcctcttccaatattgctaagcgaaagctcgagtccggtgagtatgtgatgcacaacggcagaataataccggcaagcgttctggaagaggccaatgcagaaaatgcaataagcaagcgaaggagccatggtgctattccattgccatcattcacccggaagtctgaggaagcaaggccactggttcccgtctggatagggggggatgaacaggataatggagaatggaagggcagccggaaaagtattgctgcggcctcagtacaaacatcacttcgtcctcccatgcgtgtaagagctgctgcacattttcgtggaaaaactcagacggtggatgtacatcttgaccattcagggattgctccgaagcacggccagatttttgcgtatgatgcaaaatccggacagtttatcccggtcatttctggtagcggaacgatggctcaggataatcgcagagctaaggacaggaaacacgctggactgctggccgccagaaaatcaaaataa

SEQ ID NO: 5092 - DNA, 270 bp, Enterobacter cloacae
cgtcagggcaggtcagtaatgttaaacagaaatcttgaggttctgacctcatacttcaatgacctgctggagtcagcgccgcagcaccgggataatgtagtcgcaattctcgcgcagatagaaataatgaagtcgcgacctgttttctcactggagccctcaatcctgctggcccgtaaagaaatcgataagtgcacaatatgtaagaagcaggtgctctgtgatgagtggccagaaacgctattttgtggtctcccggtatccgactga

SEQ ID NO: 5093 - DNA, 210 bp, Enterobacter cloacae
gctcgtgcatgtagtttgagcacaggaggagtgtatgggcacaatcatgacttacacctgaatttaaggaagaagctactcactatcacagacacacagaacagaacgaatgacctttttaaccaggtcagacaggaattaagtttatatggcattgaatttgaagatattacggtcactcaacatcttaacgtcagggcaggtcagtaa

SEQ ID NO: 5094 - DNA, 825 bp, Enterobacter cloacae
agtcgcgacctgttttctcactggagccctcaatcctgctggcccgtaaagaaatcgataagtgcacaatatgtaagaagcaggtgctctgtgatgagtggccagaaacgctattttgtggtctcccggtatccgactgattccgagcctaaggggattgggttttcgcctgttggtgatggcaaggtacccgaggagtatctgacgttccgccttgatgtggagcacgttattcagaccattaatgcgctatttgaaaacgacaaggttaagcggcttgaagcctacgaacaggtatttcagtcggcgcaagtccgtttttctggccgggagactgactttgttccggcaagccaggccctcaatgagctgaaaaagaccatccttagttcgtcatgggtctttgtcagaaaccggataatgggtgtatacggcctctatgccttgctactgataattattctgggcatgacgcagtacttttttactgcggagctgaagaacgtacccgcagtactcatcggaacctgtacaggctcctggctctttgtttcaataaaaactaaaaacatcgtatttgatgaaatctacgagaacatgagccagcatcgcagcctgcttatgaggctgatttactgctgtacgctgtcatcggctgttacagcctgccttctggctggattctttgagattaaaattggtgaagtttcaacagcgctgatcccggataacgctatcattgcgctggcggccgggatattttttggtctgggtgagtcttcactggccacaagactgtcaggcaaggttaaaaactctatttaa

SEQ ID NO: 5095 - DNA, 363 bp, Enterobacter cloacae
cgccattcgccaaaaactatcccattaaatacatttcaaaaatggtttgatttactttataacatcatatatatgctacggaaacaaaatgaatttatctgttcagaatgcattaatgaaaaaataggaagcagagttgggtgggtcataggaggactgaatatttatgggattgtacaacgtgctgctgatagcgcagataatctaaaaaatttctgcccaatattttataacgccttatatagagaggggttagaaatgatgtatttcttgatcgaacccatgatcatgaagtcttgctatctaaatattagcacagcatctgatgaagaaattgtcagagcacttaagagaatgatgtga

SEQ ID NO: 5096 - DNA, 507 bp, Enterobacter cloacae
ttcactcctcaaataaaaacaatgaattcttttatggatactttcaaaagtgagataaacatcactttgcttggcaaggacatgttcgatgatcgaatgaacatagcaagggagcacgttatgtattacagcgaagaaattattaagcaacctggaactgacaaagagctagctgtgcggttagataaagcgttaataggcgttaaagaaggtgtacaatattatgtaaatggtcttggcgatgccacaacacgcttactttattatacatcctgtcttacagaaaattatcaagatgtttgtaaaaaacttggttctgaagatgtcagatttatttgcgctctatatgaactagtcaaacatagaaatgttatatttcgaatgttgaatatatatatagaaaccctcttaaaaaataaaagcgatgtagaaaagaaaacaatccttgaaaacttaacgccattcgccaaaaactatcccattaaatacatttcaaaaatggtttga

SEQ ID NO: 5097 - DNA, 183 bp, Enterobacter cloacae
ccgatttcgccgggtgagtgtgacctgatatgcaaatggcagataattattgctgatattcatctaaatgctttttcacccgccagttcgctgcttattccgcagaattataagaaattcttttttggtcatttaaaagctgataacggctgtttactatcttttggacatccatactgctaa

SEQ ID NO: 5098 - DNA, 204 bp, Enterobacter cloacae
gtagagcaccgtaccgacggtaaaggcttccagggcatgggcgttgtaactttctatctggcgaacctggtaggtcagttcggcgaagccaattccgctcgcgagcgaggagagcttcatcaggttaaggtactggccaacgacgggttgccaggcgttagcgagtccctgtggcagaagaatgtagcgaaacagacgccatga

SEQ ID NO: 5099 - DNA, 237 bp, Enterobacter cloacae
gtgacatcaaatgagcgtgcagaagaaagtgtgcctgagtgccagcccaacgaaggagaggagaagttgtacgttgttttttgtattccaagcgctgaaaccattcaccagggatttggcgcgcattatacgctgatttacagtaaaaaggaaaatggaaacagcgtttcaaaaacaatctgtgcagattcacataagtttgttatcaaggcgttaaggcctaatgtcatcttatga

SEQ ID NO: 5100 - DNA, 186 bp, Enterobacter cloacae
gcgagaagggtaatgacgatgaaaaaatggataagcacgttacggcggttttttgcgccccgaccagtgaatgcggagaacagcgcgcaacgtgttcttgagtcaatactgcctgtcgccagcctgtatggcgtggacgtagccaacatcgacccggagtggttccatgataaaacgtcacgctga

SEQ ID NO: 5101 - DNA, 1319 bp, Enterobacter cloacae
tggccgttttgttaccactatctcctttcacagatggagatgataatgaaacggacagtattaacccccgcgctttctgccaccgcacttctgcttaccatgcaggcggcacacgctggtccacaggcacatgttgtatgcagttattcccacaccctcggcgatgatgccattatgatgttcagcatgcccaacgaggctatgctgcacgatttttttggtaacgtgcatacggatgcttactccagccgtgaatcgctgcgtacccaggaaaagaccacctgcgataacaaagcagacagctcggcctactgggctccgtcgctaaaattgccggacggaacggtggtcaaacccgcctatcaaaaaacctattatcaagcatcgaacgttgacgcctggccgctgcacccgttccaggcggggctgtcgctgctggcgggcgatcaccacggcaccgcgccaaatccgcatatcacctttttatgcgccaatggcaagggttacaccaccagaacgggtgaagtctgcggcttacgcaaggcgaaggatgccgtgcagtttaatatcggcattcagttcccgaactgctgggacggggtcaacctgaagcccgcccacggcctggctaacgccacctacgatacgaaaggacagtgtccgtccgccttcccggtgaagatcccgacggtgaacatgaatattgcgtacgtgctcccgacaattagctctctggataccagtaaagtccagctttccctcgaccccatcatgcatggcagtgagcgtgaagagcggtggggtagcctgtatacggcacatgctgacttcatgaacggctggacggaagatgccgcgcgctttatgaccgacctgtgcatgaaccgcggaatggattgcggcaccaccgtgccgtatggttattcaaaagcgaaggccaacgtctggctcagcagcatggaacccgcactttcacagcccgatccccaggtcttactggtgcaggataactggaagaacggtggacgcacgaaaaacagcgaaacattgtcgctggtgaagttccacattccaccgctgcctgccggacaggatcctgcccagtttaaataccgcgtaagaatttttggcgggaaagtggaaaccaacggcgcggatcaaattttcttctatccggcgagtaacgactgggatccggccaccgtaagctggcattcacgaccgtcctgcaactaccgctcggatgcggtgctttacctgaaccactcccgcgaataccggtcttcaccacaggggccgaaggatccgcgcataggtta

SEQ ID NO: 5102 - DNA, 573 bp, Enterobacter cloacae
accgatagtgaatcagccgatacagcttcacttctgagcataggtcttactcacacctaccttacaaatagtcaactcattggcccgccatcaaaagcgggctttttttatttcaggctcaaggaaacatcatcgacacgcctacttgttaaatcgtcccgagggcctgacctaatcaatcagcaccaagcaggtgcgaacatgaagaaaaccactatgcaagacagaccagatacctgggcggtgatgcttgcgtggcttgtaaaccacaaaaacgaagctggctattcggtactggcttttgtcatgtcgatactcgctacctcgcgcggcgcgaaatcaaagtggaaagaccggatcgccggcgcaacgatgtgcgggatcctatgcttcttcgctcagcctacactcacggctatatgggcaatcttcaactggaattttccccctgagctttgctggcccatctcggctggcgtcgggtatgtgggggtggattcgcttttcgcctatgcgcgccgtcgccttggcctgaatgaaccgggagacaaagcaaatgctgaccctcagtaa

SEQ ID NO: 5103 - DNA, 474 bp, Enterobacter cloacae
tggcgggttttctttttccaggagacagctatgtctgcactttatgaaaaatcgcagctgacgaagatccttatttcctccctgccagccaccaaagaaacgatggattccgcaaccttcctcgatctgagttgcaccatcaaagaaattcagttcaccggtggtcagaagcaggatatcgacgtaacaacactttgctctaccgagcaggagaacatcaacggcctgccttctccgtcagaaatctctctgtccggcaacttctacaagaatccggcgcaggacgccttgcgtgaggcctatgacaacgatacgacctacgctttccaggttatcttcccgtccggcaagggctttaagttcctggctgaaatccgccagcacacctggtcttcaggtaccaacggcgtagtggcggcaacgttctccctgcgcctgaaaggtaagcctgaaaacatcgagtctggctcctga

SEQ ID NO: 5104 - DNA, 441 bp, Enterobacter cloacae
gggctaaaaatgacgatctggctgggagcgttaaagaacttgctggcgccgttaacaggcaaaacgttgtcatgtctgaagtcgcagaacaacgggctgagtcggccaagcagaaccgaatgctccagagcgagattaagcgctacctggcggcagataagtgcgctgctgctcctgttcctgatgccgctgttgagcggttgcgcgcagcagcagaagccgcccgtggaataccgggtgataaagcatccagccctgaaccttccggcggagctgacgtcgcgccttgatgtgccggatctgccagacaatccctcatacggtgacagtgtttcgatgaacgcgacactttacgggatcgtcggtcagtgcaacatcgaccgggaagcaattcgcaaaattgagaaagggcgaaatgatgaaaaccaaccagtgcagtga

SEQ ID NO: 5105 - DNA, 702 bp, Enterobacter cloacae
agccaagacagcacgcgaacgcctgaacagaaattaagtaacgaggtgaagatgactgaatcgaaatatggttcagggcttccgcacgcccatgctgcctgcattgtggatggatgcgaattatcggtacgatcccgtaacagccactactgtgaaaagcattacatgcgcgtccggcgtcatggaacgacagagaagctcagcacaagaaaggatggcaagctggagcacactggcggatatctgctggtgtatgcgcccgatcatcctttggcatgtgggagtcctcgtgtttacgagcaccggaaagtctattacgacaaacatggggctggaccgttccgttgtcactggtgtgcaaaaaccgttggctgggacacccttcacatcgaccacctcgatgactgtaagaccaataacgagcctgacaatcttgtgccaagttgccctgtgtgcaatcagaagcgaggcgtagacaagatgagaaagacaatgcgagagaactccgaccgcagatataccgctcacggcaagacgatgtgtcttaacgaatgggcggattacctgggtatttcgagaaactccattgagtatcgactgaaggcaggctgggacatcagtatggtgttcagccctcgcattggtaacagtggtcccccgagccggaaactggcgaaaatcgtgcatgagtcggttaaatga

SEQ ID NO: 5106 - DNA, 465 bp, Enterobacter cloacae
gcaggggatcgaaaaatgattgagacgagcctcgatttttccggcctgaatgacatcgcaaaggatctggaggcgcttagccgcgctgaaaacaataaggttcttcgtgatgccacgcgcgccggtgcggaggtgcttaaggacgaagtgatcgcacgtgcaccggtacgcaccggaaaactgaaaaaaaacgtggtggttgttacccaaaaaagccgccgccgcggggagatttcttccggcgtccatattcgtggcgttaacctgcgcaccggaaacagcgataacacgatgaaggcgaataacccgagaaacgccttttactggcgattcgttgagctgggcaccgcgaacatgcctgcacatccgtttgtgcgacccgcttacgatactcgcgaggaagaggccgccagcgtcgccattgccaggatgaatcaggctattgatgaggtattgagcaagtga

SEQ ID NO: 5107 - DNA, 288 bp, Enterobacter cloacae
aaacatcgagtctggctcctgagaggtcgcatgaagaatattaaaaatctcgccctggctaagatgtcgggatttcgtcataagacggtcgccgttcctgagtgggaaggcgtcaaagtggttctccgtgagccgtctggagaagcctggctgcgctggcaggaggtggtgaaagcgggtgctgatgatgaaaatgtgtcggtatcggaaaaggcacaccgtaatctttgcgctgacgtgtgctcttcattgacattcgaccacggcggctggatagatccacgctcc

SEQ ID NO: 5108 - DNA, 231 bp, Enterobacter cloacae
gttgaaaagggtaattgtcgagaggtatttcagcgcggcatcgctttattccatcaatgcccggaaaatccgtttacgtttcagttaaacgagtttatttacgattgcgtattattgatccgtaataacaatgacaaaggccacctgcgggtggctttatttaatggcgttaaccagcgagagggatccggcacaaacggtgcgacagaaataattagcgttgtaacctga

SEQ ID NO: 5109 - DNA, 183 bp, Enterobacter cloacae
accttcaatggagggatattccgtgcggtaactgacgataaccggatggcgaaggttgagaaagtgatgggcgaggccgatgcgacggcctgcgccagtgatcaatattgggcgttgctgcgtgtgtcccatcgtaatctccttttcagttcaacaatgggacaggcgacgctatcccattaa

SEQ ID NO: 5110 - DNA, 189 bp, Enterobacter cloacae
cttttacaagttaatttaatgttaatgagttgttctattatggcgctatatcatgtttttaccgcttcgcttgcgcgatttatcggtcctgaaggcgaatttaaggtaaatatctctgtcagtaaccccgatcgcttatttttcacagataaagtaatcttcaccacgcggtcgacggtcaacgaacga

SEQ ID NO: 5111 - DNA, 282 bp, Enterobacter cloacae
ggtattcatatccattccattcaaaaagtactgattaaagggaatgatacacgcagagagaaaattcagacagaggcgggggaaagacgcgtgaccgggaacccggtcacgcagaatgattacagcaggtcgccgatcattttttccagtttttcctggtcgatagcaaacttacggataccgtccgccagtttatctacggccattggatcctggttgtgctgccacaggaactcggactcggtgatgcgctcagggcgcgctttcacttcgccagtgtaa

SEQ ID NO: 5112 - DNA, 198 bp, Enterobacter cloacae
cctgtgctatatctgtatgtaatgcagtcacccttcacggatcgaagggatcatgaatcaggaggtcttatgaatgaattcaagaggtgtatgaacgtgtttacccactctccttttaaagtgcgcctgatgctgttgaacatgctgtgcgatatgtttaacgccaaaccccagcaggacgacaactcttcccactaa

SEQ ID NO: 5113 - DNA, 525 bp, Enterobacter cloacae
aatttacaggatgcattgatgaaaaggatatttttatcagtcgctatgttgctggtgggatgtagttctgctgccagtcaagagcagagtgcgaaagatactaccgtatcattttataaatcctatctttgtgcattcggcagtaatgaagccaggccctatcctgccgacgaactgcgtaaatatgtttctgctgatactattgctcgcattggtgctattcaggaaatcccggaacaagaattaatagagtctgactattttacgtatacccaggattacgcccgcgaatggatacctgcgttacgggtggaaaacgcaaggccatttttaaacggggaagtagtccaggtgatggaaggggcaggtggcgggaggagcattcaccttgaagtatttcttcgtcgtgaagatgatgcatggaaaatctaccgcgttcgtgacttaacgaacaatcacgagcatcccatattcaatgccggagcaattgcccaggcaaaaattgcagccgaaagcgggctttaa

SEQ ID NO: 5114 - DNA, 441 bp, Enterobacter cloacae
gcattatttaaccaacatcaggttaatgactggcacaataattccgttcttacttacttaagggaactaagaatgagttggaataaagatgttgctgtttcgtatctccgttcacacgcgctggggcactctcatagtgaatgtgctaagtttacccgtctggcgattctggctggaggtgttaaggtgcctaatacagattatgcaaaagattatggggcggaattattacgtgctggattccgtgagctgccgcccggttcgactttaatagctggcgatgtggctgtgatacagccttatcccggaggaaacggcataggtcacatgactatgtatgacggcacgcagtggatttctgattttgttcaaaaaagcatgtatccggggcctgggtaccgcaaaatgcaaccatcatttaaaatttacaggatgcattga

SEQ ID NO: 5115 - DNA, 192 bp, Enterobacter cloacae
aaacgggggcgagctaccggctggtattacgcgacgcacccggccctgaaaacgggctggatgcgtttcgcgcctgtctgctcagtcgaggctgacgtggtgtttcatcacccgtttgaagaggctcatacgggcacgcatgaagcggttttcaagccgaaaacctgcatgtttattcacaccaatacgtaa

SEQ ID NO: 5116 - DNA, 210 bp, Enterobacter cloacae
ggattgaaattttccggcgatccttcggagcaatacaccagcgtttttgccgcgacggtggaactgaccgtcagtgcagcaagcgccagcgttatcattgtgaatgtgcttttcatcatttattcctgtctttttaattcgacggctaattacttcttttgccatttcataaataacattaaagtgatggcgcaaacacatgaaaaataa

SEQ ID NO: 5117 - DNA, 522 bp, Enterobacter cloacae
ggatgttctcactatgtctgcctttgtctacgcttattttatggtgcgaaattagatttgcataagatgtgccagaaaagcagcatttttacacgacaaaacagcaatatagcgagtaaagagggttttatggaatggaaggttgttgagactattgcgagcccggaaagcggaactatcttttgcaaagttgaaacacagtatggcctgaattatatcctgtggttaaagggagattattacgttcgtacaggtgaaatcatcaccacctcaaaccaggggatcctgataaacgatcgacgccgtagagtatggatagcgcaggcaatgccctttacatccataggctggatggggttcaaacagaaaaacgcgtgtccaggcaaccggcaagagatggatcgtccgtgcacggctgaaaccccgtgccagttcaaactgtgcccgttcggcttaaaacggtatattccggaaagttattccacgacgaaaattaacaaccatcctgacggcaggctttaa

SEQ ID NO: 5118 - DNA, 183 bp, Enterobacter cloacae
atagttgagcaaataactcaggtattcagtacgacattgctcacattgcttccagtatttcttgcccactttttagtgggcttttttttttgcctcaacccaccaaaatctggcgttttttctgtggaggtgaaacgctattctctgttgcttctgaataaccaaaaagcgttgataacatga

SEQ ID NO: 5119 - DNA, 843 bp, Enterobacter cloacae
cgaggtggctttctgatggctaactcattcaagcaaatgacccgtgacgggaccatcaagcgcaccgataccgggatgttcatcagccttgaccaaatccatgtgcgggaaggtttcaacaaacgcgaagatgatgagcgtacccgccaggcagatgatgacctcttcaactacctgatgaacggtggttctgttcctccactggaagttatcgcccgcgatgaaggtggagtgtgggttgttgaaggccaccgtcggcgtcgctgctatgcgcgctgtgcagaagcaggtaagccagtagaccgtatccacatcatgccgttcaacggtaacgatgttcagcgcctggcgcgcatcatgaccagtaacaaccagctcccgctatccgatatggaacaggctgctgttattcaggagcttcataatgccttcaaccagaccaccagcgagatagcaaagctggttaataagtctgtccctactgtcgaaaagcttctgcttcttagcacagccaatcacgacgttcagaaagaagttaagtccgggaccgtgtctgtagatgtggccgttgaccgagtaaaagagtttggcgaaaaggccggtgaggttcttcagaaggataaagcttctgctgctgccaaaggtaagaagaaagtcacccgcagcgttatagcgccagaaattagcgttaagaaagcgcgtcgccttgtagagctgatcagcctggcgggtataagcgacacaggtgttatctatctcgaaggattggtccatgcagaagtcgtggagattatcgacgagcacaaagctatcgccgttcagcgtcatggagaagcatcatga

SEQ ID NO: 5120 - DNA, 282 bp, Enterobacter cloacae
tcagcccgaagtccactggtcaaccttccacttgaagaagcgtcagacattattcgtgaaagtcttcgcactgaggttcgccacgagctggaatatgaatacgatgaccgtatttcttctgctgaagaagaggcatctgattgggaatcacgggcagacagttacgaatgcgatgcgattagttttgccagagcgatagagaaagccttgcttgcaccaaccttggatgaagcaaaaattattctcgaacgcgttcgttctgataatcgcgaatatttttaa

SEQ ID NO: 5121 - DNA, 462 bp, Enterobacter cloacae
tacttaatgaatatttacgaatttggcagcattcaagtgccgggattcgtgcaaccaaaattcagcgctgtgcagagcgctcataacacggagaaactatccatgacgaacacacagaacgtcaccgagttacaaccacgtatgacccgggagcagctgatcgacgcagcgcgtaaggcagcccctctccttccgccagcttatcgcggcattatgaccgaactggctaaccgcctggactataccagcgtcgcgctttgtgaggcgatggctcagcgtaaggaactggctgttcagaacgctactctgcgtgaagatgtcgcaagctgggccaaagagtgtgaccgcattgttgaacgccacacgaagagcagaaccaatatgcatttactggaagcccagcgagaattgcgtgagctatcacccatcgtcatttcccaaaataacgaggtggctttctga

SEQ ID NO: 5122 - DNA, 339 bp, Enterobacter cloacae
ccagtttctggcagtacgtttgcgagaagaagtatgtttcagttaaaaccgggcagcatggcgatgatcgtgggtgcgcgtacggcggcaggccgtcgaaatatcggtaaatccgtggagctgtttggcctttgtcagccgggccagcgttttgtaaacccggttaacggcgtcatgacgcaattacctgatacatcagcacgtgcgctgtggctggtcaccggtgatgtttacgcctttgataaccagcacggttttgcgtttgttcgcccggaacatttgatgccgctaactcccgacgagatgccacacaacgtggatgagctggcgatcggttaa

SEQ ID NO: 5123 - DNA, 219 bp, Enterobacter cloacae
gttttctcaccatatgccatacccggtcatggatatgagctggcagatagcgaacatcaccgccgtgataactacaactttgactggaggcattattcgtcctcctctcgaccaaggtatgaaagagagctgatcgcctttggcttaaaatcatcgccagaaatcaactccttcaacttgtctaaatcagcctgcgattttatgcggaaagtaagttga

SEQ ID NO: 5124 - DNA, 198 bp, Enterobacter cloacae
attcttctgaaagcggatgagggagaggctaaaaaaagccccgatgttgagatcggggcaaaacatcttgattacggaatgatgttctctggtcagtgtgagaacaggtatcactataagagggaatcgtgcaggtttaatggagaaatcatggagaaaacggcgatgacccgttactctgacgtttttacaccctga

SEQ ID NO: 5125 - DNA, 282 bp, Enterobacter cloacae
aataattactggcatcggcacgcggatgaccagcctgcggagttcggctatttcgtcggcctgctccatgactctggcgtacaggtccgaggcttcacctttccaccaggcaacgtcggctttaaggcggcgcaggcgccgctgtttaagttttctcaccatatgccatacccggtcatggatatgagctggcagatagcgaacatcaccgccgtgataactacaactttgactggaggcattattcgtcctcctctcgaccaaggtatgaaagagagctga

SEQ ID NO: 5126 - DNA, 186 bp, Enterobacter cloacae
tgggtcgtcgtcccggtcacgtcatcagacataacgatttcacctgtgatttgccaatacgtagcttgctacattagcacgggacggagagggctgaaagaaaacagccagcgggagcgctggctgttgggtcatgcgttgctggtggatgactgtttctggagcaattcgctaaaatttaactga

SEQ ID NO: 5127 - DNA, 210 bp, Enterobacter cloacae
ccttcatcttccaggttaagacgcaggagtgccgcgatatcgtggtcatcttctaccagcaggatctgcttcatgggtaagccttcaatcatttgttatgtcgtaagcttacctgatttcgagcgggggaagagttcacattttgttgaacattgtgtggggtttatgccggggggcggcttcgccttacccggcctacgctttggttaa

SEQ ID NO: 5128 - DNA, 399 bp, Enterobacter cloacae
gcctgtatcatgtcatcaaaaaatcaatcccagtatttttcaattgctgtatacatccctgaggagttgaagcagacttttgtagaagaatgcagtattgtcggcattgacgccaaaagagtacaatgtttctcctccaatccaggcatacgtgaatatctgagcattttagttgaacgtgggcagaagtttgcgccataccttcttaaggtactgaacttgttgcagtcaaaatccaaaataagaattgaagtcgcagccgatagaaaaatcatagacttacaaggtgtaagtgttgatgatgctctaaagttgattcaagctgctgatgccattcgggtaattgaccagcaagaaccggaagatatgaacagtgattccgcaaaacacacaatctga

SEQ ID NO: 5129 - DNA, 315 bp, Enterobacter cloacae
aacgataataaaaaccgaggtaatgtaatgaatgataaaaaaatacaaatagttgagctactgatttcacatagtcaaatgttgttacgatccagagactatgacgaaaagctgaattactggggaaaaggcaatgtttctcaaggtgctgttcttcacaaagattatgttatattcgacccattaccagaggacgcatttggagccaacgtcaatatcaaaatagataattcttttatattagatgaaactgctcaacgctgcattgtagtgccattttttattacaaataaaaataagcttcaggtcgcatga

SEQ ID NO: 5130 - DNA, 687 bp, Enterobacter cloacae
actttacagaaggaatcatccatgaaccaatttacagaggacctacataatgtagtagctcaaatcttagccggcgcagaaatctctgatagtgaaattttcaaagaattaactattgaacctgatttttacaaggtgcaggaccagtattacggtggaaatggtatctatttcaactctgaatcagaaacccgcttttcactgcgtagcaaatccaaaggtgtattgtatctggccaccacggcatttacagggctgaaagagttttatcaggatgctccgcttgttgaaactgaggatcttgagaaaaactgtatggcggtaattcaggcagcacgcacaatcaagattattgatttagctgccctggcgccccatctgaaaactccgttaggttatttgatgggctctaaagctgtctatgaggatactcagtggctggcagaagtgctttctcattatgctgatggtattgaatatttgtctcgacacaccggcaaaacctgtatcgcgttgtggtctgacaccgttgatggaaacggaatgctgaagaacatctcagtcactccgttaatccagttcagtctcaacggacaaagtacgcaggcgatcttaaaatcaaagctgggtattcttactgtcttcaccacaggggggcgggcgaaccgcgctaagcaaggcggggaa

SEQ ID NO: 5131 - DNA, 186 bp, Enterobacter cloacae
actccaattgaagcaattaagggtaccgaaatatatcctggcggtttatatgcgctggtgttcagagcccagggcttttacatggatgattttccgtccctgtcgggccggaattcagccccgggctttatgcccgttaaccgggacctggtttccaggtgctcatattttccttcatttgaatga

SEQ ID NO: 5132 - DNA, 306 bp, Enterobacter cloacae
ggaccaaaaatgaaaaggacgctttgtacagtgctgacggcactcacgctggcgactgccttgcctgctataggcgctaccaccgaagcaggtagcaccagcgcagcaacaaccggaacaacaaccggagcaacggtgggaactaccgctggcactacggggggactggcggcaggggcgattgggacaaccgctgttgtcaccaccgctgcgattgccggcgtagcgacgttagccgttgtcgcggcaagcgacagtggcgatgactcaagcaatggtacttccacgacgacagttacccgctaa

SEQ ID NO: 5133 - DNA, 186 bp, Enterobacter cloacae
tgtagcgcaaagaaaatagcgccgcacttcagcctattaccaggccagaccgaaacgtctatactcgcttcaattagccgccacgacggcgaaaggatgcaaaactattatggctcactcacatttattagcagaaagaatttcccgcctcagcagtgcgctggaaaaaggcctttacgagcgtag

SEQ ID NO: 5134 - DNA, 255 bp, Enterobacter cloacae
tggaacctatgtaaagcctgtgaaggtagcgcagacttcgcgataccacgtgccattaagaccgtaggacgaggtcatggttgcaggctttaccgttctttacgacgttgcctggccattgctgacttgggtgggcggcataatgtagcaccgttatacattatgagctatcactcgtttttgtttaaaaaagcggcaattgcggagtggtttgattttgctattgttaaatctgcgttcccgcatgcctcctga

SEQ ID NO: 5135 - DNA, 339 bp, Enterobacter cloacae
aaagcaaaattcaaggctgacaaagccagtaatagcaacaaagaggaaagagaaacttttttcaggtttttttacagtccggccttaaaggccgcatcggattttctaaatacagttttacataaggaaaatcgtatgactgtatttctaatcctcaccgccatcgcatatggcatcttcaaagccggctgcttcatcctattagtggtcaaggggtatcagggctggacattgttctggaaaaactatgaccgtctccctcatatcatccgttcccgctgccgatatcagagacgattcattttcagacgcatctggaagcgaatcttcagccactga

SEQ ID NO: 5136 - DNA, 324 bp, Enterobacter cloacae
ctgtttctggacattatcaatcttgttatggatcgccagattcagcgtgagcatatagaacaacagattgatatgagcctcggtgacggcattaaagctgcgttcagacgctcgatcatgactacctccaacgcacatttctgccgtaagacgggttccctgatgttccagcaccgcataaagatctataccacgtcgtttcacctcaccaagtacatccacggaaggcgtttcgaaacacgcatcatactggtctataaactgctgataggctatgccggcattttcaaatcgctcatccctgatggcgtccagtatctgtga

SEQ ID NO: 5137 - DNA, 282 bp, Enterobacter cloacae
gtgtcatttcgtgtctttaaccataacccttcgagcacggccaggaaactggccagaccaatggttattgctgggaaaataatgtggaaggaaacagtaaatgcaaactgtaccctggccaaatggaaggcatctaatccgaacatagttcaccttaaccccgataatacactgataattaattatttcttatcaaatcagagccttgatgagaaatttcgactattgaaaacaatcatttttttgtatgagataaaaactcacttgcaagtacattgttaa

SEQ ID NO: 5138 - DNA, 570 bp, Enterobacter cloacae
gcaatgacacaggcgcgacgcccgtcaccgctgcagcggcgggtgctgattgtgctggccgccctggattcgaaacgtccggggccggtggccacgcgggatattgagcgggtgctggaacagggcggggacgccccggtgtacgggccgaacctgcgcgcctcctgccggcgcatggaagcagcgggctggctgcgcaccctgcgcgcgcctaaccagcagctggccgtggagctgaccggggccggacgcgatgtggcggaaccgctttatcaggcagcccgtgatgacgaaatctcccgccagcgccagttgaaggtgcacagtctgcccttgcgcgagtcgacaaccggtgaggcggtggaggtttttctcggtgacagccttcaccgtatctgtcaggcagcctacgtgatccggctcgacggctccacctgtctgcaagtgacgaatgcaggtggaatacgtcagataatggaaggcgatcccctgcaggtggctgacttgtatcagacctgttatgacgcgggtcttccggtacatatccagattaacgagagccaggattag

SEQ ID NO: 5139 - DNA, 306 bp, Enterobacter cloacae
tgcgcttgcaaaggcgatttcatccctgacctcggtctgctgaccaacaatcacaaactgttccggcgtcagacggtgaacaagaacccgatattgtacaccggtgatggtggcgttctgaaaaccttccctcacgggcgcgggcaaatgaaaggtgatgcctgtgtcatcgttttgcgtacccgagacggtgagatattccaccagtattttgccatcgctgtcctcgtcggccctcttttgcccctttatttcgggcagcgcgttatgtccgggggacttcgtgacgtaagctatctgttttaa

SEQ ID NO: 5140 - DNA, 297 bp, Enterobacter cloacae
ctaaaccggacattatcagacggagcgtgcaggatggatgagaaagaagtgaatttttcactcagctatgagcagctgacccggatagcggaagaacgtatccgtgaatgcgagctggacagtcagggcgctaaatacatcagcgaatcgagtatggccagcacccttctgcaattctggtatgaactggcgattactggtgcgccaatgaaaaattacgaacaaaccaaagcgctcattgacgtcgatcatcagcgtctcagaaaactcatctggccggagacggataagcaatga

SEQ ID NO: 5141 - DNA, 417 bp, Enterobacter cloacae
gttcccatgaaaaaaaccaaatacagatttgagagtgatgacgatccctttgtatctaaagatgttttgactctgatcgacaacggacttgtgtttctggataaggcgcgtgaagaattgcaggactccatgcccaaattttcgattgtcagtttctggacagcggtcgagatcctgctgaaggtacctttgttacatgagcactggagtctggtgtgctccggcaggaaaatagagcgagcaaggtaccttgcaggtgatttccagtcggtgacatacgatgaaacatgtcagcgattagctgatgttctggaacaccctcttcctaaagaaaccatcgacgtattcaaaaaagtcaaagaccatcgcaaccgggtggttcatttttatcattccgattggcactgttgcaaatag

SEQ ID NO: 5142 - DNA, 582 bp, Enterobacter cloacae
aatgtaaggcctttgaataagacaaaaggctgcctcatcgctaactttgcaacagtgccggacatagatccaaaacaaaccccggacgacgcagcatatgcctggagtaacattgtagacgacgccagaagtaatcaggcggtaccggcattgtccttgtattcaggtaatcactggtctacggcaaaggaaattttaaactcaaccagaaatctggagttgtggataatctctgccgggatgggttttttaaattgtagagatcgggtgccctcttacgaggcgacatttcatcaagtaccattcaggcatgatctctggtggaaagccatcacaaaatcactaggaaagcataaccgttgcgcaactataagccagttaatgcagtccagtccgaatgatgaatatttgattgcggcttcgcctgtttatattgctgctgtccagaatgacatcctgaagggcattgagagtttgactcatcctcttacgcaactaacgatcgtgacatcaggggcatatgctggcccacttgaagaatacttaattaagagttcttcggtaatgactccaacttattga

SEQ ID NO: 5143 - DNA, 213 bp, Enterobacter cloacae
gttaacgccgctatgctgtccttaacaaacaaggaggacaatcacatgaacataaagacgttaaaaaatgatacggtggaaaccgtgtcatttctggtgaaggctctgtttttcgttgtaagaaagatatatctgaagccggcagtcgcggtatgtccgctgccgcagacactggcggagtgccggatatacgcagcacggagtatctgctaa

SEQ ID NO: 5144 - DNA, 1068 bp, Enterobacter cloacae
tatagcaagcccacacagagggaaagaggaatgagccagcaactgcgcaagcggtctgacattgagaaaaaggttgcggccggagaggctgttaaggaacagccgcgtcagctaatcagggacactatcaccgggaaaatcatttctaacgagcgggtgcctgaaacgctcccggcctgcctgatagcgatgcagtcgaatacgcttgtctacaacgatgtagatgtggaggcctttcagcgggaagtccgtcagcaggtatcacagatactggacgccatcagggatgagcgatttgaaaatgccggcatagcctatcagcagtttatagaccagtatgatgcgtgtttcgaaacgccttccgtggatgtacttggtgaggtgaaacgacgtggtatagatctttatgcggtgctggaacatcagggaacccgtcttacggcagaaatgtgcgttggaggtagtcatgatcgagcgtctgaacgcagctttaatgccgtcaccgaggctcatatcaatctgttgttctatatgctcacgctgaatctggcgatccataacaagattgataatgtccagaaacagctacgtactaaactcggttttctggaagagcggctcagaacgttgcttaacgagtacatctatgcaaatcaacttggccggatcgttctggacgggttacatgcaagcgagaccctttatggctggattttgcttgaaaaaaatgacctggatgctgcccggttgatttataagaatgatttaaagctgaataacgaaatgaagtttgccgagcttcatgcagaggtgatgagcatctaccaaaagagatacacatctgaaacgcctgaagatcttcggaatagagctttctcaaggtgtgggttatccgaagacagagcacaattcgcttttaagctgtgttattaccttcaccagacaggacagattaggaagtatatcgatgagctgacgctgggtgctgataacaacgacacgagtgacgctaccgtggatgtccggtccctcctggttccctctgcatccgggctcgcaactcaatga

SEQ ID NO: 5145 - DNA, 186 bp, Enterobacter cloacae
aataattgtctcgtcagaaaaacgcctcaagggtccggatattccggcataaccagcatggggtcatttgcctgtagggcctggaactcatcaatgcagctgatcctgaacacctcccgcggtctgtcgacggtagtcagctccttgtcgattatttattcctttgtttgtgacatctacttctga

SEQ ID NO: 5146 - DNA, 375 bp, Enterobacter cloacae
cacaccatgaaacgcacaattttttttgccctttctacatttttactggcaatgactgccagctctgtatacgccagtaccgaacacaccggtatgtctgacttacgggttcagaaaaccgctaatgccagctactgtaatccaggttcacatcgttgcgaggccccttttactattggccgggataatattgcaaaaccagacgggtcagataaaaactactgtaatccgggatcacatcgttgcgaggcccctttttctactggccgggataatattgccaagccagacggaacagacaaaaactactgtaaccctaactccagaaaatgtaatgcacctttcaccaccggacatgataatattaatcagtaa

SEQ ID NO: 5147 - DNA, 183 bp, Enterobacter cloacae
gctcgccagggatgttctatgaatacgaaattacaggcatcgttagtcaaggtgcctcagattacccttacgttctggatagtcaaaatagcagtaaccactttgggtgagaccggtggggatgctgtttcaatgtccatggggataggctacgccggcagggtaatgactccaacttattga

SEQ ID NO: 5148 - DNA, 237 bp, Enterobacter cloacae
tcacctaaatttttcagtaagttacacataaccccccccactattaagaattactctcaacactatttgtatcgtgcagtatcaggaatgatcgtggttgctgacacaataacgaaaatcctgcatttttgtaatcgacctcatctatcactacattattgcaacttattggacacatttaatcatgtgcttaacaatgtacttgcaagtgagtttttatctcatacaaaaaaatga

SEQ ID NO: 5149 - DNA, 837 bp, Enterobacter cloacae
tctgcggtggaagcagactcacccgatgaatacggcaacagtcatcccaggcaggaaacaatgcgaccacaacaaaatacgtccccggctttcccgatgaataaagttcctgaagtcacactctttttctggctgataaaaatgatgtccactaccgtgggtgaaacagcggcagacttcctgaatatggatctcaactgggggctgactaatacctctctgcttaccggcatattgtttgccgtggtactgacctttcagttacgtgcgaatcgctatattccggctctttactggtcaactgtactattaatcagcgtgttcggaacgctgatcactgacaacatgaccgaccactttggagtgccgctcgcgctgtcaacatcggtatttggcggattgctggttctgacattcggactctggtacgcgaaggaaaaaaccttatctattcacagcatcaacagcctgaagcgggaaacgtattactggatcgccattttgttcaccttctcgctgggaactgccgcaggagactgggcagcggaaagtctggggcttggttatctgaatgcagccattgtgtttggtgcgctgattgcgctgaccgcggtcagtcgctatctgttcaaagcgaacagcgtactgtgtttctggattgcgtatattttaacccggcctctgggagcctcttgtggtgatttgttatctcaaccccttaccagcggtggtctggggcttggcacaacaggaaccagcattttgttcctgctgaccatcaccagtcttatcggttacctcacctataaaatgaaactcgaagaaatcaacagataa

SEQ ID NO: 5150 - DNA, 219 bp, Enterobacter cloacae
aaaagaaaccatcactttgcaggttgtaataaacggggggcgagtgttttcgtatttgctttcagtaaaaaccagactccctgtatacaaaatcattcatatcattttttaaaaaacgattttactatctttatatcgaaagcaggtcactccctttcattctatggccagcacacacctgacgagccggcttacccgattgtaaatatctggcactga

SEQ ID NO: 5151 - DNA, 324 bp, Enterobacter cloacae
ccgccagggaccgacgttgatccccggccgcaggtttgcatactggctgtcgctgcgggtgcctgccccgcttcttgcccggctgtttgccccgctcaggctgtagttgagcatggccgcggtaatgccttcatcccacatatccggcggaacgtaacctctcgctggcaggtctatggccgcctgtgggatgctgatcgccaggcgctgggcgccaaactggaaatccgcgctggcctgtggaatcgccctgagatcggcgcattctccttccccggcgtcgagctgcgggaaaagcgccgttttcacgccccacgcttttaa

SEQ ID NO: 5152 - DNA, 486 bp, Enterobacter cloacae
agccagcatatgcaatttacaggcatgactgacatgaaaaaaaaaattctggcgatcctgcttctgcccactctcgcatccgctgcacagaagttcccccctgaggtatccgctgcccttcagtttaataagtggtacatctcgcaaattattatcgggaaagagcccctgaaaaactatgaagcgctgaggccatatgtaacccgcgaaactatcagcaaactcaaagccatggataagctggatccagatgaatatgacgtgcctgacgtcgatatgttcatcaaggctcagggatatgaagatgactgggacatcgtcagtgcgcgggcgctggattacgatgccgcctgtatgcaggtttatatctcattcggcaaaaagcgggatcacaccgtgattgactgcatggtcaaggaagatggcgtgtggaaagttgaatccgtggccagtatgaatatttcagacaacctgatgatggaataa

SEQ ID NO: 5153 - DNA, 246 bp, Enterobacter cloacae
aaagcattatttatcaatgcattgaacaaatctaaccatcccatccgcatcccgtcacagggtctatgcttaatgaaagtagccaaaaagggcggtttagcccaaagtccctgctcgcagggggttgaagtgataatcgttatcactaacatggtgttatgccctggtggcttatcagatgaggtggacctatggaactgcattcagaaaccttcaatccggccgattttgcctggcgtggcttaa

SEQ ID NO: 5154 - DNA, 480 bp, Enterobacter cloacae
actatgttaaatattctgattcaggaaacggatctgttttttcaggctgggctacagagctttttcgaagatttttttaagcataactttcatcgctccatcacttttcacctggcgctgaccaatgaaaacgtcagccaggccgatattattgttctttcattatgtcagggggaaacgctgacctgttttccggaattactggcccggcaaaaaggaattgtgataggtctcgtcgacgatgagctgcgcttttcggcgctgccttcctgctttcaggacattatttttcttcctcgccgggcatcgcttgatcgtattagcggcgttctgtttattgcgtggttcacgacgcaattaccgggttacacctggaataaaaagacctgtttcgactgccagcataaagggttatcccggcaacaaattcgtattctggtcaatttttaccgagggctgtcggtagtgcagaccgcttag

SEQ ID NO: 5155 - DNA, 231 bp, Enterobacter cloacae
aaaagcatcgcccggctggctacggtggcgttcacggcgacagtggaactgctgcgtaccggaaagggttattccgaccagatagctatcatgccagtggggatcaaaggcatgtccttcgaaatgcgccttaattgtctcaatacctgtttctgcatgctgacgcagctcaagccagtcgtttgccatactgccctcctcttaccgtcagcattgtcacatcttgcctga

SEQ ID NO: 5156 - DNA, 438 bp, Enterobacter cloacae
tcattcaacataaacgaggcacacatgagaaattttgatatgcacggaaaaggtcacgggcgtggtttgggccgccatcgtatgggtaagggcatcgtgattggcgcagtcctgttcgtggtgcttggcctgctggtcatgtccctgtggaacgcgttgctcccggccatcctgggggttaaagccattggcttctggcaggcgctggggatcctgctgctgagccgcattcttttcggtgggctgggtttccgtcccggtatgttcggtgcgcaccgccgtatgcacgaacaatggatgaatatgagccccgaacaacgtgaggccttcattcagcagcgtcgggcgggatttggtcgccatggtcattgccgatggcacgatggccgggatgaaaaacgagatgataacggtgcgaaagcgccggaagccgagtga

SEQ ID NO: 5157 - DNA, 303 bp, Enterobacter cloacae
gactaccggacgcctatgacagcacatgtttccaacgatcctttgcatggcgtaacgctcgaaatgcaggttaacgcgctggttgcgcgatatggctggaatgaactgggcaaccgaatcaaaatcaactgttttcgcaaggacccgagtgttaaatcgagtctgaagttcctgcgccgcaccccatgggcgcgggcggaagttgaagccctctacctcgactcccttcacgatgacggtaacggggagcaggacgaaccggcgtttaatccctggacggatagccggacacccaggagctaa

SEQ ID NO: 5158 - DNA, 231 bp, Enterobacter cloacae
ttcaatcagggattgataacggtcaggattgatctccgcagggacatccgcgggataacggttaagccaaacctttttcaatgcatcacctctgaaatgagtgttcgtcgtcatcacagccccgataataaacagtttgttaacattatattaactcagcgtaccagtttattaattgttcagattgcaggttgcgaagcgcgtcactcttttttttcgttttatccgtaa

SEQ ID NO: 5159 - DNA, 201 bp, Enterobacter cloacae
gctattcacttcttcctgagcttgtctgagttcagcatcccggattaccttatggtcgggttcaaatacaaaactggacagaaaatccttaaccaggaagcgatgctctcgcatttctttgccacgttccctacggttgccgctgctgtcttcagtgacaatagctacagtctgaccgtaaacgcggggatgggcgcgtag

SEQ ID NO: 5160 - DNA, 615 bp, Enterobacter cloacae
aggatgattaggcagggctttatactcacaaccgcaatgcttttgagtggatgcggatatcatttcgcaaaccaggtagatgcgtacgatctaatgcctcgtcctgttacaaataaaaggtttcagatagtccctccggacgaaagtattcagtccagaatgttttcaggccgttttgctgatggattagcaaaaaaaggagtcattatttccactcaccagccagattatgtgctcaggttccgaatcagcagctcacaggagaacatgcagtatagcgagcagcttcttactggggtgacaggctacgttgtagataaaaagacaacgagaactgacaagcatggcgaattgcatactgactatgactacaagccagtcgatggggtaataggcactgagacgatgtcgcagatgcactatatgcgacagctggatgtcgaggtatacccgtcagcgaaaggagcaaagcaggttctgaaagtgagtatgcaaagcaatgcacctgtgccgtcagacagcattgcttattcagcaatgatcgacgcctttactgataaatttgatgcgccgctgcgttccggaaattatgttgcagtgatcccctggaactga

SEQ ID NO: 5161 - DNA, 195 bp, Enterobacter cloacae
actacatgcgccgagacagagctgaatatttacctctccgtggaacaattcaacaatactgtacgccctaacttccttaaatcactttcagaccacccagatgccctggctacgtttgaacctaacgatttgatgaaactttgcaacaggcaaggtcccctctgggtggcaggttcaccacaagatccctcttga

SEQ ID NO: 5162 - DNA, 570 bp, Enterobacter cloacae
aacactatcaataagttggagtcattacccagcgaggtaaatcactattatgagcattgcactgtccccgtgattgactggttttttaaacaagcaaccgaggcgctgcatcatggtctatggttaccggcctgtacgagctttctgaatgggatcgaaacatcactcagggttacgctgaagttgaaatcaactgttaacgttcagcagtcagttcctgtactggtggacttagatggtacgtcagtaatgagtaacgctttaatgcgaaaggctaagcaggaagggatgccgatagaattactgtcatttccagccgagaagaatatgttggcaaagatagacgctggtaaaaaacctgaagcagatatcgtcaggcttagaaatagtctatgccatggcaacattctggagttcattatgagtgttaaagtcggttctccagatcccatacgaatttttactcctggtaactgctgtggtttagcgcttttactttcggccttatcgaagaaatggacggtaggcttgcatcaatactggatcgacaacaatctgacgtcctgctga

SEQ ID NO: 5163 - DNA, 357 bp, Enterobacter cloacae
actatgaaattaaaaaatattctgctgtgtgcgatgatgtcagtcgcttttggctcctctgctaatactacacataaagttgaaaacgaacctatcccaaacattattcttgatggtaaggttgatgatatttgtaaagatgcaagcatccgaactgaacttaatcatgataaagcaaaggaactggtaaccaccaacctgaagcaggcattaccattaaatacggtaccggataagttggatgaagttgcagaagcctttgtaaaccgcgacaaaggcgcttcagaaacagcagaccattgccttgttaatgtacgtaataaatactgggaaatgtatccctctgaagataagtag

SEQ ID NO: 5164 - DNA, 402 bp, Enterobacter cloacae
gaggtgtgtatgaaatctactttactgagtacgttaatgctggttgctgtaggtgtacagcccgttttcgctgcacaatgtcagtacggagcctgtggaacggaaaacgatcccggaatcggatttctgatgtcatcggtacaaatggataaaggtgaacatctaaaggaactctctggtgttgcgaccacaggtgacaccatctctaaaaagatggaaagctacctgggaaataaaaagctcaaggtaaacaccgacagtacccgcaaggggccgggtaataccaccatcaggcctacagatgagctcgccccaacgaggcaactaaaagttatccggcccgaactggtaaaaaatcccgattcgcagctcgtggtagctttcaatgagcgcctggcctga

SEQ ID NO: 5165 - DNA, 444 bp, Enterobacter cloacae
gagcgtccagaaggaaaaaagatgtcgatactcagtagcttcgtcatcagagcaacggggatacctgacaaaaagtatctccgggatcccgtaataaaacgttgttataaacgtctgagtcgtagggtgcctgctctaatgacggggtggcttctgtgcattctgggttcagggtatgtcagtatggcactggaacagcctgatagcactgtattactcagtctgctgctgttgtatgttatgtcaggcattttactgatgcagttccagtatatgtattcagagcgaagcataggctacaagttctacctggaagtgcttatgaatgcagctgccagtactcaacataaagaacagttacagtatctgttcattaataagcccaattccatcacgatgggcgatctttaccgactttatgattttaatgggggagggcgatag

SEQ ID NO: 5166 - DNA, 1122 bp, Enterobacter cloacae
aaacgaccatgctatacgagctctaaccttttttttgtatgccatcataaccgcatcagaaaaggagaacggtctatgactcgtattgcattagcgccttcaaagatggttttgcttatgtctttggtaattactggtgcccacgccagccctgagcaacccctaataaaagatacgccctttgtatctggccaggcttataagaagggtttcttctggtatgacgatcctgctaaaaaaagcgaagctgaagaagaagaggttttgccaccaaccggtgctgctagctcgccttcaaaagaggaaatggtagatttaaattcaaaatggctaaaagagaatatgcctcgactgttaacgcaggcaatggataaccctaccgcagaaaatctatcacgttattacacggcgcaaaggttaatgctggatatcagtacgcgtttttctgacaaatcaaaagattattttcttaaaaacccgatgatgtctgaaaaacgcaggcaaccagtggaaaaggtggcactggatgctcaccgcactgttgttgaaaaaaatcagcaaacggtaatgaaagatatctttactaagtcaggtttatttttctttttccagagtacttgccagttttgccacgaagaaagccaaatacttcaatttatgcagaactattattcggtagatattcttccaatcagtatggatggaaggccattgcataatggcctttttcaggattttaacatccccaacgcacaaattattgatcaatttaaaattcgagaggtacctacaattttcctggtttcaaaggatgggacatcagctcagcgcattagtgaaggcatgatctccgctgatgaattaaagaacactattatacttgccgcgaagggcatgaatctgatcgatgacgcttcgttccagtcaactctagatattaaaaggcaatataccatcggcgatgatggcgttattaccgttaataaatccgaaatggaatcagacccattcctacttcaaaaaataatggaccaaaaactcgaaggctatgacatgcctacggccgatccggtcaattatctcaatgctggcggcagttttggaggcacttatgcgcagtaa

SEQ ID NO: 5167 - DNA, 192 bp, Enterobacter cloacae
acaaacgcagcgaaaatcaggcaaacgagcaggcaaaccaggtgtgcagatttcatcgaaacctcctttgaaagtcacatgcttcccctgaaatatatcgttacattcatcaacgcgattcaagccaaaagtatgaatttacgcattctgcgtgcggtatccgatcgccagtgcaatgccatagcttactaa

SEQ ID NO: 5168 - DNA, 315 bp, Enterobacter cloacae
ctttcaaaggaggtttcgatgaaatctgcacacctggtttgcctgctcgtttgcctgattttcgctgcgtttgttcacgcgcaggagaagagcgctccggagaaagaggcccagataaaacagcaggtcctgaaagatgtaaagaaaacctgtaccccgcagaaaaagcagagcgataaggcctggcaggcgatgattttgtcgtctgaggccaatcagctgctgatcaaaaacgccatcaccgccgtgaagcgtgacaacctggacgcctactgggatgcagtcagtcaggtggattgtatggaagattactga

SEQ ID NO: 5169 - DNA, 468 bp, Enterobacter cloacae
ttttctctttctaccgtattcgcgtggcgcagctggtgcgggaatacagttccgaaaccggagggcacgcggatgtatgacgttcacgtgattttccgcgacgggcccggcgagctggcgcgctttggacagctgttggggcgcaacggcgtggggcttgagggtggcggcgtattcggtaccgatgcccatttcctggtggaggacggggaaaaagcccgccgtgtgctgctcgacgccgggtttaccgtgcaggcgctgcgaaagccggtgatcagaaagcttaagcaggagcgtcctggcgagctgggcgagatagcggcggcgctggcggcacgcggcgtgtctatcctgactcagtacagtgaccatgcgaatcaccttattctgctgacggatgatgataagctggccgctgagatcaccacaccctgggcgacgaatgttaaagacgagcttaccctctga

SEQ ID NO: 5170 - DNA, 1089 bp, Enterobacter cloacae
gcctgcttcactatgtctattagcaccctggcacgggtatttaccccgcacggcaacatcgtctatacggcaaacgactttcgccagaccctgcgtatcgtctttgccgggatgattgcgctcagtatttcgagtttctacaacaccagctacggcgtgttttttgtggtctacccgatcatgcttctctcgctggtaccggtgtttaatcgccacgtggcgaagcagtttatcttcagcgcctcgctgaactgcgtcgaaatggtgttgattatcggctatctgtcgcagtggccggtcatcatgacgctggtggtgtttgccctgtacgtgatgcgttttcgctttatgagtaaggggccgctgttcctgttcggctcgatgggcgtggtttgccagagcgtgatgctcaactttatgagctaccccaccaccaactggcacacgcttttattctctaacatcgaagcgagcgtgatggcggtgtgcctgagcgcgctgatgaactacctgctgccggacgtggagccgcgtaagccgccgccgctgattgagaaagacgatgcccgcgtgcgccacgagtcgctgctatccggcaccgtggcgacgctgattttcgtcgtgttccagattagcgacttaagtgattcgctttcggcgctgatggcggggattttgatcctgttcccgatgcactatcgcggctcggttatcagctccatctggcgcgtggttggcgtggtgctggggtgcctctatatccttgtcgtccagcttatcctctacgatcacagcagccatatgctgctgatgatgccgctgattggccttggtctggcgtttggcgcgcgtctgcacgtaatggagaaggtcggcgccggggtaggcttcgccagtatcaccaccatcggcattatgttcgggcagaacatgcacccggacagcgacctggtgttcagcgatctataccgcatcacctccgttaccttcgcgctggtggtcacgctgacgatggtctttctggtgcacctgatcctgaatcgcttcgaggcgacgcgctacgttatcgcgccgccaaaagcggattaa

SEQ ID NO: 5171 - DNA, 249 bp, Enterobacter cloacae
ttcatcaagggtccacaacacggaaggcgcggggctgggattatcaattacaaggtcgatcattcatgctcatggcggcgagctgtcagcagaacagcaggggcgggaaattgtgttcagtgtgcgcctgttaatggattaatcccgttcttcaggagaaacctggaaggtgacaaaattgtcatcattcagtcacgcgataaacagaggcggttttttataatcatacataaatcaggagcagagtga

SEQ ID NO: 5172 - DNA, 269 bp, Enterobacter cloacae
cggtccgggtttatttacccacagcatcgactaattcaagaggttacatatgatagtttcagaagcaattttttattcttctattatttcctgggttctttattgccggtttatcccgcccccattactaaaaaggtagggatgcttgttgttccactcacgcttaccttcggatgttacatttatgcaattcatttggatgattccgcacagcaaaccaatttactagtcgtcaccacaggggacaaaagcacccgcgctaagcgaat

SEQ ID NO: 5173 - DNA, 186 bp, Enterobacter cloacae
attgaagcggtgctcgttctcatcgcaataccagttcgcccggtaagtacggctggaataagtattccattcgctcgtgaaaagacatttaccaccgatggcatcaaatccgcttcgcagtccacctatccctgcaaacagatcgataaagctaaagtgcctgtcctcataatcagcaggtcgtga

SEQ ID NO: 5174 - DNA, 1011 bp, Enterobacter cloacae
atccgcagcacaaaaggaggcaaaagggttatgggcagacaccaaccctgtcccaccatggcagtggagacaggcaaacgaaaagcccagaaaggtgaaagggaagaaataaccatgatgaaagagcctcatccgttacttcagttggtactaaacgattccggtcgtctaaccatgcctgtttattatagagatcaacagtattgcccgacttgccttacaaaggtgttgaagagtgaggatggaagtttggcgcacctcggggaaataaatcaaaatacatgtagaccttctatttcagtagttgtgacaaaagcaattattgaaatgttatgtgacggggaaaaaatatttgtaaatccaatacgataccgaggccgggtgctggcaccctcagtaattttttctcccgacactcacactttcaaaccgtttataaatacagactatcagcctgtgggagcaaactggaaaagtgaaaagggatataaactcggtctgttttatctcaaagatcgagccaactctatcaataaagaggaatttgatttcattgccgttatagaccctaaggcaatgcagaaagaatttatttcggcctggtctgaggttgatgaaaaaaatccattggaaacgctgaagcagatcttacgatctaaaaacaactcttctttatgggtaaaatggcctggcaaaattgagcatgcgcaaaaaggaaattgcaacgaaaattactggttcgattatcaatctgataatcaggaagtgaactgtacggtctctgttgtaggtatcgaaggtaacagttccggtgagacaatttatagattgcaaactttgctaaagcgtaagctcaatgaatatcaactggttcggtctttagggactattatgcttcttgataataccgggaatatgattccatcaaaccatccttattttgaagtcatctcaaaagcatgtataaatggagtgcgtgactttgttcgtcaaaacccgtgggtagtctga

SEQ ID NO: 5175 - DNA, 360 bp, Enterobacter cloacae
ctggttagcccagctcgatacggcatcctgtttatgtttggccgactgcaataccgccctggcaccatggataagcaaggtcctcaaataggtatcacctcgcttgcttatcccgagcaggacttgtttacccccactggagtgctgacgtggaaccaatccgagccaggcagccagttgtcggccattctcgaaattgttggctttaccaatggtcgcaatcagcgcgctggcggtaacagggccaataccagggatcttgccgatacgctggcagagagcattttgccgatagcactgctcaatctgcttgtcgagtgtagcgatgacatcgaacaggtacgccatgtggtgctgtag

SEQ ID NO: 5176 - DNA, 1329 bp, Enterobacter cloacae
gagactactatgagccaaaaattcgcagtgatgattgcttacgacgacgatccaaacgtcaaaaggtactcacctgactttcaaacgcaggatgagtttgctaaagggtggcagtcggctcttaaaaaggcacaccacacctcaggtcaaaaatcagtcatcacctgcggatgtcgtggaaaaggagaaaagcgactttatgttcgtgctttaccgaacggtgatgcctttattctcgtcaaagccgctaacacgggcattgagcatgatccttcctgtgtattcttctcccttgatgcccggcataccggcctgaaaggatatgcgagtggtgtggtccggattacaaccgaaggtgatatggctgtaaggctcggtatcggtatgacagagaaagatcctcctgaaaaatcagaagtgcctcccctgccccatgttcagcgaccagaaggaggtcaggcctcaatgaccctcctgggcttgcttagtcttttgtggacagagtctggtctgaatgtctggtacccgaaaatggcagggaaacgtaacgattcactggtacggtatcgtctgcttgaaaccgctaaacaaattcgtaccggcagagcctgcataggtgaccatttattcattggtgtacctgacccgaaacaacctgtcgctcagtcgcaaattcagcgtctttcatcacaggcgatgagtgataaacgtctcatgctcctgtcagttttacctcgctacgatgctgaaaagcatgagaagccacttaaatttttacccctgcggaattttggggggctaccgctgatttttttcaattcagaaggccattgggatagcgtaaagaaacgattttcatcggagtacgcagcatggaaatccggggcgaaaatagttgtctttgcgttgacgtcaccagctgcggtaaccggcagaggcccttctgtaagagctcatcaaattgtgctgatgcacgttagcgagaactggatacctctggactcctcctatgaggcggttgttgcagaaaagctggatgcagagcaccggcagtacgttaagcccatgcgttatgatgcgagtattagtgaggtgttccctgacttctacctgctcgacacaaaaagcgataagccgttcccgatggaagtatttggtatggccactcctgcttatctggcccgaaagcaactcaaaaaagattattacaaccgtgaatatgggccttatggatggtggcactgggatgcgaccacagcatctgaaactatggtgctgcctcattttccagaatcacgtaaacctctttcaactggcacacctgcttaa

SEQ ID NO: 5177 - DNA, 216 bp, Enterobacter cloacae
aatggagaaaaaatgtcatacatgctttcactaagcgaacagacaaaactgaacgctttcctgtcagggatccttgatgattacaagactggggttatcactcagatacaagctgttggtaaaatcggtaacgtgttttctgcactggaaagtggagactcaaaaaaggtagtgcatttgttgactgaaggacgaaaactcctgcggacgggctga

SEQ ID NO: 5178 - DNA, 249 bp, Enterobacter cloacae
gcatccaacgcagttatggtgtcaccgtcaacaatcttaaccacctttgcctcaaaagttgttgagttcccccaggacgccactgggaatacaacaatcatgatgggcaaaagtaactttgtaaaaaaaaacatcatttcacctgaatttgttgagtacagacatgtatccacaagcctatttacaggcagtattttaacaagtcattatttcatgggcgggcttaaaaccaatctttttgcaacttaa

SEQ ID NO: 5179 - DNA, 183 bp, Enterobacter cloacae
tgtcagaggtcaaccatgacgtatttcgaatcagctgaaggtgagacggtatctaaagaacgagcattacaagaactgtccaggcattgcgttcccgaaacagatttcgaagaattctttagcgacatgggcgtaaaggaacagtatgacgctcaggaagtgttgctttggttgggatattaa

SEQ ID NO: 5180 - DNA, 369 bp, Enterobacter cloacae
tttaaagcaaccatgaacatgaaaaagcccaaagctgcattacagaatgccatgaaagaagatgtgccagctgtgacacagattcagatgcgatctacggtttccagaaaggttcgctatgtaaaacaggcaaatcgagagggtctgaaattatctgagtggatgtcgcggcatctcgacgctgtctgtgataccgcagatgagattcataaaggcaaacgctcaactccggttgcgcctgggaagattccccctgaggtataccaggtgatatacgatcagtgcggcgggttcgtggagtgtgatgctaatgcccaggtaatctgggaagcctgccgtgatgccattcttaacggagacaaagggtaa

SEQ ID NO: 5181 - DNA, 330 bp, Enterobacter cloacae
ggaaatcgaatgtgtgatttttgcagggctgacgaaaattactttcatatggcagaatgcgtgtatgaccaactggttaaagagtatcccgtaatgtggctgcgggattcaacccggatcggggcctgctacctctgtcgagaactgctgtcgccggaggggatggtcctggcgatgcagagcgctttccctgcgaagggatggcggctgcgtatttggtacaatgaaaccattgacgaagagatagaaccgcagcgtggagactgtattgagctgtcctccagggcggacgctctgctgtccttcatgtcgttccaggaaaaggtttag
